United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 181

SEQ ID NO: 7548687 - DNA, 22 bp, Homo sapiens
cacagccctgcgccccagtttg

SEQ ID NO: 7548688 - DNA, 22 bp, Homo sapiens
ggagcagccacgtctcagggca

SEQ ID NO: 7548689 - DNA, 22 bp, Homo sapiens
ggagcagccacgtctcagggca

SEQ ID NO: 7548690 - DNA, 22 bp, Homo sapiens
ggagcagccacgtctcagggca

SEQ ID NO: 7548691 - DNA, 22 bp, Homo sapiens
cacagccctgcgccccagtttg

SEQ ID NO: 7548692 - DNA, 22 bp, Homo sapiens
cacagccctgcgccccagtttg

SEQ ID NO: 7548693 - DNA, 22 bp, Homo sapiens
cacagccctgcgccccagtttg

SEQ ID NO: 7548694 - DNA, 22 bp, Homo sapiens
cacagccctgcgccccagtttg

SEQ ID NO: 7548695 - DNA, 22 bp, Homo sapiens
cacagcccccttgacactctgg

SEQ ID NO: 7548696 - DNA, 22 bp, Homo sapiens
cacagcccccttgacactctgg

SEQ ID NO: 7548697 - DNA, 22 bp, Homo sapiens
cacagcccccttgacactctgg

SEQ ID NO: 7548698 - DNA, 22 bp, Homo sapiens
cacagcccccttgacactctgg

SEQ ID NO: 7548699 - DNA, 22 bp, Homo sapiens
cacagcccccttgacactctgg

SEQ ID NO: 7548700 - DNA, 22 bp, Homo sapiens
cacagcattgccttccaaaagg

SEQ ID NO: 7548701 - DNA, 19 bp, Homo sapiens
cacagccacagccaacctc

SEQ ID NO: 7548702 - DNA, 22 bp, Homo sapiens
cacagccatgtcctcattcttc

SEQ ID NO: 7548703 - DNA, 22 bp, Homo sapiens
cacagccatgtcctcattcttc

SEQ ID NO: 7548704 - DNA, 22 bp, Homo sapiens
cacagccatgtcctcattcttc

SEQ ID NO: 7548705 - DNA, 19 bp, Homo sapiens
cacagccacagccaacctc

SEQ ID NO: 7548706 - DNA, 19 bp, Homo sapiens
cacagccacagccaacctc

SEQ ID NO: 7548707 - DNA, 22 bp, Homo sapiens
cacagcattgccttccaaaagg

SEQ ID NO: 7548708 - DNA, 22 bp, Homo sapiens
cacagcattgccttccaaaagg

SEQ ID NO: 7548709 - DNA, 22 bp, Homo sapiens
cacagcattcacagaaagacat

SEQ ID NO: 7548710 - DNA, 22 bp, Homo sapiens
cacagcagggcatggctgttgt

SEQ ID NO: 7548711 - DNA, 22 bp, Homo sapiens
cacagcagggcatggctgttgt

SEQ ID NO: 7548712 - DNA, 21 bp, Homo sapiens
cacagcagggttcctgggctc

SEQ ID NO: 7548713 - DNA, 21 bp, Homo sapiens
cacagcagggttcctgggctc

SEQ ID NO: 7548714 - DNA, 21 bp, Homo sapiens
cacagcagggttcctgggctc

SEQ ID NO: 7548715 - DNA, 21 bp, Homo sapiens
cacagcagggttcctgggctc

SEQ ID NO: 7548716 - DNA, 22 bp, Homo sapiens
cacagcagggcatggctgttgt

SEQ ID NO: 7548717 - DNA, 22 bp, Homo sapiens
cacagcagggatgaatggagtg

SEQ ID NO: 7548718 - DNA, 22 bp, Homo sapiens
cacagcagggatgaatggagtg

SEQ ID NO: 7548719 - DNA, 22 bp, Homo sapiens
cacagcagggatgaatggagtg

SEQ ID NO: 7548720 - DNA, 22 bp, Homo sapiens
cacagcagggatgaatggagtg

SEQ ID NO: 7548721 - DNA, 22 bp, Homo sapiens
cacagcaggcagaacgtgggca

SEQ ID NO: 7548722 - DNA, 22 bp, Homo sapiens
cacagcaggcagaacgtgggca

SEQ ID NO: 7548723 - DNA, 22 bp, Homo sapiens
cacagcaggcagaacgtgggca

SEQ ID NO: 7548724 - DNA, 22 bp, Homo sapiens
cacagcaggcactatacagggc

SEQ ID NO: 7548725 - DNA, 22 bp, Homo sapiens
cacagcataatgaaatatactt

SEQ ID NO: 7548726 - DNA, 22 bp, Homo sapiens
cacagcataatgaaatatactt

SEQ ID NO: 7548727 - DNA, 22 bp, Homo sapiens
cacagcataatgaaatatactt

SEQ ID NO: 7548728 - DNA, 22 bp, Homo sapiens
cacagcattaactgggacagct

SEQ ID NO: 7548729 - DNA, 21 bp, Homo sapiens
cacagcagggttcctgggctc

SEQ ID NO: 7548730 - DNA, 22 bp, Homo sapiens
cacagcaggtgcttaatgatta

SEQ ID NO: 7548731 - DNA, 22 bp, Homo sapiens
cacagcaggtgcttaatgatta

SEQ ID NO: 7548732 - DNA, 22 bp, Homo sapiens
cacagcagtctttcactaaata

SEQ ID NO: 7548733 - DNA, 22 bp, Homo sapiens
cacagcagtctttcactaaata

SEQ ID NO: 7548734 - DNA, 22 bp, Homo sapiens
cacagcagtctttcactaaata

SEQ ID NO: 7548735 - DNA, 22 bp, Homo sapiens
cacagcagtctttcactaaata

SEQ ID NO: 7548736 - DNA, 22 bp, Homo sapiens
ggaggagagaggttgcaaacac

SEQ ID NO: 7548737 - DNA, 22 bp, Homo sapiens
ggaggagattcccctctcactt

SEQ ID NO: 7548738 - DNA, 22 bp, Homo sapiens
ggaggagacggagtgattagtg

SEQ ID NO: 7548739 - DNA, 22 bp, Homo sapiens
ggaggagacggagtgattagtg

SEQ ID NO: 7548740 - DNA, 22 bp, Homo sapiens
ggaggagagaggttgcaaacac

SEQ ID NO: 7548741 - DNA, 22 bp, Homo sapiens
ggaggagacggagtgattagtg

SEQ ID NO: 7548742 - DNA, 22 bp, Homo sapiens
ggaggagacggagtgattagtg

SEQ ID NO: 7548743 - DNA, 22 bp, Homo sapiens
ggaggagacggagtgattagtg

SEQ ID NO: 7548744 - DNA, 22 bp, Homo sapiens
ggaggagacggagtgattagtg

SEQ ID NO: 7548745 - DNA, 22 bp, Homo sapiens
ggaggagacggagtgattagtg

SEQ ID NO: 7548746 - DNA, 22 bp, Homo sapiens
ggaggagaccctgtgtcagttt

SEQ ID NO: 7548747 - DNA, 22 bp, Homo sapiens
ggaggagaccctgtgtcagttt

SEQ ID NO: 7548748 - DNA, 22 bp, Homo sapiens
ggaggagacagtaaaaagcacg

SEQ ID NO: 7548749 - DNA, 22 bp, Homo sapiens
ggaggagaccctgtgtcagttt

SEQ ID NO: 7548750 - DNA, 22 bp, Homo sapiens
ggaggagaccctgtgtcagttt

SEQ ID NO: 7548751 - DNA, 22 bp, Homo sapiens
ggaggagacagtaaaaagcacg

SEQ ID NO: 7548752 - DNA, 22 bp, Homo sapiens
ggaggagacagtaaaaagcacg

SEQ ID NO: 7548753 - DNA, 22 bp, Homo sapiens
ggaggagcacttctgagctcag

SEQ ID NO: 7548754 - DNA, 22 bp, Homo sapiens
ggaggagcacttctgagctcag

SEQ ID NO: 7548755 - DNA, 22 bp, Homo sapiens
ggaggagcacttctgagctcag

SEQ ID NO: 7548756 - DNA, 22 bp, Homo sapiens
ggaggagcacttctgagctcag

SEQ ID NO: 7548757 - DNA, 22 bp, Homo sapiens
ggaggagcacttctgagctcag

SEQ ID NO: 7548758 - DNA, 22 bp, Homo sapiens
ggaggagattcccctctcactt

SEQ ID NO: 7548759 - DNA, 22 bp, Homo sapiens
ggaggagattcccctctcactt

SEQ ID NO: 7548760 - DNA, 22 bp, Homo sapiens
ggaggagcacttctgagctcag

SEQ ID NO: 7548761 - DNA, 22 bp, Homo sapiens
ggaggagattcccctctcactt

SEQ ID NO: 7548762 - DNA, 22 bp, Homo sapiens
ggaggagcacttctgagctcag

SEQ ID NO: 7548763 - DNA, 22 bp, Homo sapiens
ggaggagcacttctgagctcag

SEQ ID NO: 7548764 - DNA, 22 bp, Homo sapiens
ggaggagcacttgacggggtct

SEQ ID NO: 7548765 - DNA, 22 bp, Homo sapiens
ggaggagcatgagagggtagtg

SEQ ID NO: 7548766 - DNA, 22 bp, Homo sapiens
ggaggagcacttgacggggtct

SEQ ID NO: 7548767 - DNA, 22 bp, Homo sapiens
ggaggagcacttgacggggtct

SEQ ID NO: 7548768 - DNA, 22 bp, Homo sapiens
ggaggagcacttgacggggtct

SEQ ID NO: 7548769 - DNA, 22 bp, Homo sapiens
ggaggagcacttgacggggtct

SEQ ID NO: 7548770 - DNA, 22 bp, Homo sapiens
ggaggagcacttgacggggtct

SEQ ID NO: 7548771 - DNA, 22 bp, Homo sapiens
ggagcagcctgtgtagacgggg

SEQ ID NO: 7548772 - DNA, 22 bp, Homo sapiens
ggagcagccgcgtctcagggca

SEQ ID NO: 7548773 - DNA, 22 bp, Homo sapiens
ggagcagcctgtgtagacgggg

SEQ ID NO: 7548774 - DNA, 22 bp, Homo sapiens
ggagcagcttgcatgctcaggg

SEQ ID NO: 7548775 - DNA, 22 bp, Homo sapiens
ggagcagcctgtgtagacgggg

SEQ ID NO: 7548776 - DNA, 22 bp, Homo sapiens
ggagcagcctgtgtagacgggg

SEQ ID NO: 7548777 - DNA, 22 bp, Homo sapiens
ggagcagcttgcatgctcaggg

SEQ ID NO: 7548778 - DNA, 22 bp, Homo sapiens
ggagcagcttgcatgctcaggg

SEQ ID NO: 7548779 - DNA, 22 bp, Homo sapiens
ggagcagcttgcatgctcaggg

SEQ ID NO: 7548780 - DNA, 22 bp, Homo sapiens
ggagcagcttgcatgctcaggg

SEQ ID NO: 7548781 - DNA, 22 bp, Homo sapiens
ggagcaggagtctcttgaattt

SEQ ID NO: 7548782 - DNA, 22 bp, Homo sapiens
ggagcaggagtctcttgaattt

SEQ ID NO: 7548783 - DNA, 22 bp, Homo sapiens
ggagcaggagtctcttgaattt

SEQ ID NO: 7548784 - DNA, 22 bp, Homo sapiens
ggagcagcttgcatgctcaggg

SEQ ID NO: 7548785 - DNA, 22 bp, Homo sapiens
ggagcagcttgcatgctcaggg

SEQ ID NO: 7548786 - DNA, 22 bp, Homo sapiens
ggagcagcttgcatgctcaggg

SEQ ID NO: 7548787 - DNA, 22 bp, Homo sapiens
ggagcagcttgcatgctcaggg

SEQ ID NO: 7548788 - DNA, 22 bp, Homo sapiens
ggagcagcttgcatgctcaggg

SEQ ID NO: 7548789 - DNA, 22 bp, Homo sapiens
ggagcagcttgcatgctcaggg

SEQ ID NO: 7548790 - DNA, 22 bp, Homo sapiens
ggagcagcttgcatgctcaggg

SEQ ID NO: 7548791 - DNA, 22 bp, Homo sapiens
ggagcagcttgcatgctcaggg

SEQ ID NO: 7548792 - DNA, 22 bp, Homo sapiens
ggagcagcttgcatgctcaggg

SEQ ID NO: 7548793 - DNA, 22 bp, Homo sapiens
ggagcagcttgcatgctcaggg

SEQ ID NO: 7548794 - DNA, 22 bp, Homo sapiens
ggagcaggagtctcttgaattt

SEQ ID NO: 7548795 - DNA, 22 bp, Homo sapiens
ggagcaggcagggccgtgtctg

SEQ ID NO: 7548796 - DNA, 22 bp, Homo sapiens
ggagcaggagtctcttgaattt

SEQ ID NO: 7548797 - DNA, 22 bp, Homo sapiens
ggagctggccctctgagtttgt

SEQ ID NO: 7548798 - DNA, 22 bp, Homo sapiens
ggagctggccctctgagtttgt

SEQ ID NO: 7548799 - DNA, 20 bp, Homo sapiens
ggagctggcatccagcctct

SEQ ID NO: 7548800 - DNA, 22 bp, Homo sapiens
ggagctggccgcctatgtgcag

SEQ ID NO: 7548801 - DNA, 22 bp, Homo sapiens
ggagctggccgcctatgtgcag

SEQ ID NO: 7548802 - DNA, 22 bp, Homo sapiens
ggagctggccctctgagtttgt

SEQ ID NO: 7548803 - DNA, 22 bp, Homo sapiens
ggagctggccctctgagtttgt

SEQ ID NO: 7548804 - DNA, 22 bp, Homo sapiens
ggaggagacagtaaaaagcacg

SEQ ID NO: 7548805 - DNA, 22 bp, Homo sapiens
ggaggagacagtaaaaagcacg

SEQ ID NO: 7548806 - DNA, 22 bp, Homo sapiens
ggaggagacagtaaaaagcacg

SEQ ID NO: 7548807 - DNA, 22 bp, Homo sapiens
ggaggactgagacactcctggc

SEQ ID NO: 7548808 - DNA, 22 bp, Homo sapiens
ggagctggccgcctatgtgcag

SEQ ID NO: 7548809 - DNA, 22 bp, Homo sapiens
cacagcctcctctggctcacgg

SEQ ID NO: 7548810 - DNA, 22 bp, Homo sapiens
ggaggagcacttgacggggtct

SEQ ID NO: 7548811 - DNA, 22 bp, Homo sapiens
cacagcctccttcagagagcat

SEQ ID NO: 7548812 - DNA, 22 bp, Homo sapiens
cacagcctcctctggctcacgg

SEQ ID NO: 7548813 - DNA, 22 bp, Homo sapiens
cacagcctcctctggctcacgg

SEQ ID NO: 7548814 - DNA, 22 bp, Homo sapiens
cacagcctccttcagagagcat

SEQ ID NO: 7548815 - DNA, 22 bp, Homo sapiens
cacagcctccttcagagagcat

SEQ ID NO: 7548816 - DNA, 22 bp, Homo sapiens
cacagcctccttcagagagcat

SEQ ID NO: 7548817 - DNA, 22 bp, Homo sapiens
cacagcctccttcagagagcat

SEQ ID NO: 7548818 - DNA, 22 bp, Homo sapiens
cacagccttgagcgaggacaag

SEQ ID NO: 7548819 - DNA, 22 bp, Homo sapiens
cacagccttgagcgaggacaag

SEQ ID NO: 7548820 - DNA, 22 bp, Homo sapiens
cacagccttgagcgaggacaag

SEQ ID NO: 7548821 - DNA, 22 bp, Homo sapiens
cacagccttactgagatccact

SEQ ID NO: 7548822 - DNA, 22 bp, Homo sapiens
cacagccttactgagatccact

SEQ ID NO: 7548823 - DNA, 22 bp, Homo sapiens
cacagcctgctgcactcaagaa

SEQ ID NO: 7548824 - DNA, 22 bp, Homo sapiens
cacagcctgctgcactcaagaa

SEQ ID NO: 7548825 - DNA, 22 bp, Homo sapiens
cacagcctgctgcactcaagaa

SEQ ID NO: 7548826 - DNA, 22 bp, Homo sapiens
cacagccttactgagatccact

SEQ ID NO: 7548827 - DNA, 22 bp, Homo sapiens
cacagccttactgagatccact

SEQ ID NO: 7548828 - DNA, 22 bp, Homo sapiens
cacagccttactgagatccact

SEQ ID NO: 7548829 - DNA, 22 bp, Homo sapiens
cacagccttgagcgaggacaag

SEQ ID NO: 7548830 - DNA, 22 bp, Homo sapiens
cacagcctttagggtacacaca

SEQ ID NO: 7548831 - DNA, 22 bp, Homo sapiens
cacagcctttagggtacacaca

SEQ ID NO: 7548832 - DNA, 22 bp, Homo sapiens
cacagcggcctccgatgctgat

SEQ ID NO: 7548833 - DNA, 22 bp, Homo sapiens
cacagcggcctccgatgctgat

SEQ ID NO: 7548834 - DNA, 22 bp, Homo sapiens
cacagcgccttccccgggagcg

SEQ ID NO: 7548835 - DNA, 22 bp, Homo sapiens
cacagcgccttccccgggagcg

SEQ ID NO: 7548836 - DNA, 22 bp, Homo sapiens
cacagcctttagggtacacaca

SEQ ID NO: 7548837 - DNA, 22 bp, Homo sapiens
cacagcctttagggtacacaca

SEQ ID NO: 7548838 - DNA, 22 bp, Homo sapiens
cacagctacctgcatgcctgct

SEQ ID NO: 7548839 - DNA, 22 bp, Homo sapiens
cacagctaatggaagtggaatc

SEQ ID NO: 7548840 - DNA, 22 bp, Homo sapiens
cacagctaatggaagtggaatc

SEQ ID NO: 7548841 - DNA, 22 bp, Homo sapiens
cacagctaactttcactgagca

SEQ ID NO: 7548842 - DNA, 22 bp, Homo sapiens
cacagctaactttcactgagca

SEQ ID NO: 7548843 - DNA, 22 bp, Homo sapiens
cacagcgtgatgaatgtagcgt

SEQ ID NO: 7548844 - DNA, 22 bp, Homo sapiens
cacagctagatggatagataga

SEQ ID NO: 7548845 - DNA, 22 bp, Homo sapiens
cacagctagactaattgctggg

SEQ ID NO: 7548846 - DNA, 22 bp, Homo sapiens
cacagctacctgcatgcctgct

SEQ ID NO: 7548847 - DNA, 22 bp, Homo sapiens
cacagctacctgcatgcctgct

SEQ ID NO: 7548848 - DNA, 22 bp, Homo sapiens
cacagctacctgcatgcctgct

SEQ ID NO: 7548849 - DNA, 22 bp, Homo sapiens
cacagctacctgcatgcctgct

SEQ ID NO: 7548850 - DNA, 22 bp, Homo sapiens
ggagggagtttcattcctgccc

SEQ ID NO: 7548851 - DNA, 22 bp, Homo sapiens
cacagctgaagtagccatgtgg

SEQ ID NO: 7548852 - DNA, 22 bp, Homo sapiens
cacagctgaagtagccatgtgg

SEQ ID NO: 7548853 - DNA, 22 bp, Homo sapiens
cacagctgaagtagccatgtgg

SEQ ID NO: 7548854 - DNA, 22 bp, Homo sapiens
ggagggcaacttttcagtaggt

SEQ ID NO: 7548855 - DNA, 22 bp, Homo sapiens
ggagggcaacttttcagtaggt

SEQ ID NO: 7548856 - DNA, 22 bp, Homo sapiens
ggagggcacaggaccagaaatc

SEQ ID NO: 7548857 - DNA, 22 bp, Homo sapiens
ggagggcaacttttcagtaggt

SEQ ID NO: 7548858 - DNA, 22 bp, Homo sapiens
ggagggcaacttttcagtaggt

SEQ ID NO: 7548859 - DNA, 22 bp, Homo sapiens
cacagctgaagtagccatgtgg

SEQ ID NO: 7548860 - DNA, 22 bp, Homo sapiens
cacagctgaagtagccatgtgg

SEQ ID NO: 7548861 - DNA, 22 bp, Homo sapiens
cacagctatggggctgtagcct

SEQ ID NO: 7548862 - DNA, 19 bp, Homo sapiens
cacagctctgctcagggaa

SEQ ID NO: 7548863 - DNA, 22 bp, Homo sapiens
cacagctaggaggaaagcagag

SEQ ID NO: 7548864 - DNA, 22 bp, Homo sapiens
cacagctagatggatagataga

SEQ ID NO: 7548865 - DNA, 22 bp, Homo sapiens
cacagctaggaggaaagcagag

SEQ ID NO: 7548866 - DNA, 22 bp, Homo sapiens
cacagctatgagcagcctagct

SEQ ID NO: 7548867 - DNA, 22 bp, Homo sapiens
cacagctatggggctgtagcct

SEQ ID NO: 7548868 - DNA, 22 bp, Homo sapiens
ggagggcacaggaccagaaatc

SEQ ID NO: 7548869 - DNA, 22 bp, Homo sapiens
ggaggggatggtttgaccctgg

SEQ ID NO: 7548870 - DNA, 22 bp, Homo sapiens
ggaggggatggtttgaccctgg

SEQ ID NO: 7548871 - DNA, 22 bp, Homo sapiens
ggaggggatggtttgaccctgg

SEQ ID NO: 7548872 - DNA, 22 bp, Homo sapiens
ggaggggatggtttgaccctgg

SEQ ID NO: 7548873 - DNA, 22 bp, Homo sapiens
ggaggggatggtttgaccctgg

SEQ ID NO: 7548874 - DNA, 22 bp, Homo sapiens
ggaggggatggtttgaccctgg

SEQ ID NO: 7548875 - DNA, 22 bp, Homo sapiens
ggaggggatggtttgaccctgg

SEQ ID NO: 7548876 - DNA, 22 bp, Homo sapiens
ggaggggatggtttgaccctgg

SEQ ID NO: 7548877 - DNA, 22 bp, Homo sapiens
ggaggggatggtttgaccctgg

SEQ ID NO: 7548878 - DNA, 22 bp, Homo sapiens
ggaggggatggtttgaccctgg

SEQ ID NO: 7548879 - DNA, 22 bp, Homo sapiens
ggaggggatggtttgaccctgg

SEQ ID NO: 7548880 - DNA, 22 bp, Homo sapiens
ggaggggatttagtagatgcta

SEQ ID NO: 7548881 - DNA, 22 bp, Homo sapiens
ggaggggatttagtagatgcta

SEQ ID NO: 7548882 - DNA, 22 bp, Homo sapiens
ggaggggatttagtagatgcta

SEQ ID NO: 7548883 - DNA, 22 bp, Homo sapiens
ggaggggatttagtagatgcta

SEQ ID NO: 7548884 - DNA, 22 bp, Homo sapiens
ggaggggatttagtagatgcta

SEQ ID NO: 7548885 - DNA, 22 bp, Homo sapiens
ggaggggatttagtagatgcta

SEQ ID NO: 7548886 - DNA, 22 bp, Homo sapiens
ggaggggcatagttcaccatca

SEQ ID NO: 7548887 - DNA, 22 bp, Homo sapiens
ggaggggcaggtcccaagttgt

SEQ ID NO: 7548888 - DNA, 22 bp, Homo sapiens
ggaggggcagccatggaactcc

SEQ ID NO: 7548889 - DNA, 22 bp, Homo sapiens
ggaggggcagccatggaactcc

SEQ ID NO: 7548890 - DNA, 22 bp, Homo sapiens
ggaggggcagccatggaactcc

SEQ ID NO: 7548891 - DNA, 22 bp, Homo sapiens
ggaggggcaggtcccaagttgt

SEQ ID NO: 7548892 - DNA, 22 bp, Homo sapiens
ggaggggcaggtcccaagttgt

SEQ ID NO: 7548893 - DNA, 22 bp, Homo sapiens
ggaggggcagccatggaactcc

SEQ ID NO: 7548894 - DNA, 22 bp, Homo sapiens
ggaggggcagccatggaactcc

SEQ ID NO: 7548895 - DNA, 22 bp, Homo sapiens
ggaggggcagccatggaactcc

SEQ ID NO: 7548896 - DNA, 22 bp, Homo sapiens
ggaggggcagccatggaactcc

SEQ ID NO: 7548897 - DNA, 22 bp, Homo sapiens
ggaggggcagccatggaactcc

SEQ ID NO: 7548898 - DNA, 22 bp, Homo sapiens
ggaggggcagccatggaactcc

SEQ ID NO: 7548899 - DNA, 22 bp, Homo sapiens
ggaggggcagccatggaactcc

SEQ ID NO: 7548900 - DNA, 22 bp, Homo sapiens
ggaggggatttagtagatgcta

SEQ ID NO: 7548901 - DNA, 22 bp, Homo sapiens
ggaggggatttagtagatgcta

SEQ ID NO: 7548902 - DNA, 22 bp, Homo sapiens
ggaggggatttagtagatgcta

SEQ ID NO: 7548903 - DNA, 22 bp, Homo sapiens
ggaggggatttagtagatgcta

SEQ ID NO: 7548904 - DNA, 22 bp, Homo sapiens
ggaggggatttagtagatgcta

SEQ ID NO: 7548905 - DNA, 22 bp, Homo sapiens
cacaggagaaaggggaagctcg

SEQ ID NO: 7548906 - DNA, 22 bp, Homo sapiens
cacaggagaaaggggaagctcg

SEQ ID NO: 7548907 - DNA, 22 bp, Homo sapiens
ggaggggccggctgcctgccac

SEQ ID NO: 7548908 - DNA, 22 bp, Homo sapiens
ggaggggccggctgcctgccac

SEQ ID NO: 7548909 - DNA, 22 bp, Homo sapiens
ggaggggccggctgcctgccac

SEQ ID NO: 7548910 - DNA, 22 bp, Homo sapiens
ggaggggccggctgcctgccac

SEQ ID NO: 7548911 - DNA, 22 bp, Homo sapiens
ggaggggccggctgcctgccac

SEQ ID NO: 7548912 - DNA, 22 bp, Homo sapiens
ggaggggcatagttcaccatca

SEQ ID NO: 7548913 - DNA, 22 bp, Homo sapiens
ggaggggcatagttcaccatca

SEQ ID NO: 7548914 - DNA, 22 bp, Homo sapiens
ggaggggcatagttcaccatca

SEQ ID NO: 7548915 - DNA, 22 bp, Homo sapiens
ggaggggcatagttcaccatca

SEQ ID NO: 7548916 - DNA, 22 bp, Homo sapiens
ggaggggcatagttcaccatca

SEQ ID NO: 7548917 - DNA, 22 bp, Homo sapiens
ggaggggccggctgcctgccac

SEQ ID NO: 7548918 - DNA, 22 bp, Homo sapiens
ggaggggccggctgcctgccac

SEQ ID NO: 7548919 - DNA, 22 bp, Homo sapiens
ggaggggccggctgcctgccac

SEQ ID NO: 7548920 - DNA, 22 bp, Homo sapiens
ggaggggccggctgcctgccac

SEQ ID NO: 7548921 - DNA, 22 bp, Homo sapiens
cacaggagattgatctattggt

SEQ ID NO: 7548922 - DNA, 22 bp, Homo sapiens
cacaggagattgatctattggt

SEQ ID NO: 7548923 - DNA, 22 bp, Homo sapiens
cacaggagattgatctattggt

SEQ ID NO: 7548924 - DNA, 22 bp, Homo sapiens
cacaggagattgatctattggt

SEQ ID NO: 7548925 - DNA, 18 bp, Homo sapiens
cacaggagatgacctgac

SEQ ID NO: 7548926 - DNA, 18 bp, Homo sapiens
cacaggagatgacctgac

SEQ ID NO: 7548927 - DNA, 18 bp, Homo sapiens
cacaggagatgacctgac

SEQ ID NO: 7548928 - DNA, 18 bp, Homo sapiens
cacaggagatgacctgac

SEQ ID NO: 7548929 - DNA, 22 bp, Homo sapiens
cacaggagagctgggaggtgcc

SEQ ID NO: 7548930 - DNA, 22 bp, Homo sapiens
cacaggagaggttaatgggggc

SEQ ID NO: 7548931 - DNA, 22 bp, Homo sapiens
cacaggagaggttaatgggggc

SEQ ID NO: 7548932 - DNA, 22 bp, Homo sapiens
cacaggagaggttaatgggggc

SEQ ID NO: 7548933 - DNA, 22 bp, Homo sapiens
cacaggagaggttaatgggggc

SEQ ID NO: 7548934 - DNA, 18 bp, Homo sapiens
cacaggagatgacctgac

SEQ ID NO: 7548935 - DNA, 18 bp, Homo sapiens
cacaggagatgacctgac

SEQ ID NO: 7548936 - DNA, 22 bp, Homo sapiens
cacaggagaacccacagattct

SEQ ID NO: 7548937 - DNA, 22 bp, Homo sapiens
cacaggagaacccacagattct

SEQ ID NO: 7548938 - DNA, 22 bp, Homo sapiens
cacaggagaacccacagattct

SEQ ID NO: 7548939 - DNA, 22 bp, Homo sapiens
cacaggagaacccacagattct

SEQ ID NO: 7548940 - DNA, 22 bp, Homo sapiens
cacaggagaaaggggaagctcg

SEQ ID NO: 7548941 - DNA, 22 bp, Homo sapiens
cacaggagaaaggggaagctcg

SEQ ID NO: 7548942 - DNA, 22 bp, Homo sapiens
cacaggagaaaggggaagctcg

SEQ ID NO: 7548943 - DNA, 22 bp, Homo sapiens
cacaggagagctgggaggtgcc

SEQ ID NO: 7548944 - DNA, 22 bp, Homo sapiens
cacaggagagctgggaggtgcc

SEQ ID NO: 7548945 - DNA, 22 bp, Homo sapiens
cacaggagagctgggaggtgcc

SEQ ID NO: 7548946 - DNA, 22 bp, Homo sapiens
cacaggagagctgggaggtgcc

SEQ ID NO: 7548947 - DNA, 22 bp, Homo sapiens
cacaggagagctgggaggtgcc

SEQ ID NO: 7548948 - DNA, 22 bp, Homo sapiens
cacaggagagctgggaggtgcc

SEQ ID NO: 7548949 - DNA, 22 bp, Homo sapiens
cacaggagagctgggaggtgcc

SEQ ID NO: 7548950 - DNA, 22 bp, Homo sapiens
cacaggagagctgggaggtgcc

SEQ ID NO: 7548951 - DNA, 22 bp, Homo sapiens
ggacagcttgcctggtaatgca

SEQ ID NO: 7548952 - DNA, 22 bp, Homo sapiens
ggacagctgctttcaggccaca

SEQ ID NO: 7548953 - DNA, 22 bp, Homo sapiens
ggacagctgctttcaggccaca

SEQ ID NO: 7548954 - DNA, 22 bp, Homo sapiens
ggagagctgacatcatgatgtt

SEQ ID NO: 7548955 - DNA, 22 bp, Homo sapiens
ggagaggtgtattcagtgggtc

SEQ ID NO: 7548956 - DNA, 22 bp, Homo sapiens
ggagagctgacatcatgatgtt

SEQ ID NO: 7548957 - DNA, 22 bp, Homo sapiens
ggagaggttatccgtgttatgt

SEQ ID NO: 7548958 - DNA, 22 bp, Homo sapiens
ggagagctgacatcatgatgtt

SEQ ID NO: 7548959 - DNA, 22 bp, Homo sapiens
ggagagctgacatcatgatgtt

SEQ ID NO: 7548960 - DNA, 22 bp, Homo sapiens
ggagagtccggatatgtaatat

SEQ ID NO: 7548961 - DNA, 22 bp, Homo sapiens
ggagagtctgccgagccagccc

SEQ ID NO: 7548962 - DNA, 22 bp, Homo sapiens
ggagagtctgagcctgctggag

SEQ ID NO: 7548963 - DNA, 22 bp, Homo sapiens
ggagagtctgctggccacagtg

SEQ ID NO: 7548964 - DNA, 22 bp, Homo sapiens
ggagagtctgctggccacagtg

SEQ ID NO: 7548965 - DNA, 22 bp, Homo sapiens
ggagagtctgccgagccagccc

SEQ ID NO: 7548966 - DNA, 18 bp, Homo sapiens
ggagagtgacagagtcgt

SEQ ID NO: 7548967 - DNA, 18 bp, Homo sapiens
ggagagtgacagagtcgt

SEQ ID NO: 7548968 - DNA, 18 bp, Homo sapiens
ggagagtgacagagtcgt

SEQ ID NO: 7548969 - DNA, 18 bp, Homo sapiens
ggagagtgacagagtcgt

SEQ ID NO: 7548970 - DNA, 18 bp, Homo sapiens
ggagagtgacagagtcgt

SEQ ID NO: 7548971 - DNA, 18 bp, Homo sapiens
ggagagtgacagagtcgt

SEQ ID NO: 7548972 - DNA, 22 bp, Homo sapiens
ggagagtggattccagctgtat

SEQ ID NO: 7548973 - DNA, 22 bp, Homo sapiens
ggagagtggattccagctgtat

SEQ ID NO: 7548974 - DNA, 22 bp, Homo sapiens
ggagagtggattccagctgtat

SEQ ID NO: 7548975 - DNA, 16 bp, Homo sapiens
ggagagtgtctgcaaa

SEQ ID NO: 7548976 - DNA, 22 bp, Homo sapiens
ggagagttcatgtggagtgggg

SEQ ID NO: 7548977 - DNA, 17 bp, Homo sapiens
ggagagtgggaatggcc

SEQ ID NO: 7548978 - DNA, 22 bp, Homo sapiens
ggagagttgtttttgcctagat

SEQ ID NO: 7548979 - DNA, 17 bp, Homo sapiens
ggagagtgggaatggcc

SEQ ID NO: 7548980 - DNA, 17 bp, Homo sapiens
ggagagtgggaatggcc

SEQ ID NO: 7548981 - DNA, 17 bp, Homo sapiens
ggagagtgggaatggcc

SEQ ID NO: 7548982 - DNA, 17 bp, Homo sapiens
ggagagtgggaatggcc

SEQ ID NO: 7548983 - DNA, 21 bp, Homo sapiens
ggacagctgcgcgcagggctc

SEQ ID NO: 7548984 - DNA, 21 bp, Homo sapiens
ggacagctgcgcgcagggctc

SEQ ID NO: 7548985 - DNA, 22 bp, Homo sapiens
ggacagctgctttcaggccaca

SEQ ID NO: 7548986 - DNA, 22 bp, Homo sapiens
ggacagccgagtggccttctcc

SEQ ID NO: 7548987 - DNA, 22 bp, Homo sapiens
ggacagctgctttcaggccaca

SEQ ID NO: 7548988 - DNA, 22 bp, Homo sapiens
ggacagctgctttcaggccaca

SEQ ID NO: 7548989 - DNA, 22 bp, Homo sapiens
ggacagctctgccaggagctca

SEQ ID NO: 7548990 - DNA, 22 bp, Homo sapiens
ggacagctctgccaggagctca

SEQ ID NO: 7548991 - DNA, 22 bp, Homo sapiens
ggacagctctgccaggagctca

SEQ ID NO: 7548992 - DNA, 21 bp, Homo sapiens
ggacagctgcgcgcagggctc

SEQ ID NO: 7548993 - DNA, 21 bp, Homo sapiens
ggacagctgcgcgcagggctc

SEQ ID NO: 7548994 - DNA, 21 bp, Homo sapiens
ggacagctgcgcgcagggctc

SEQ ID NO: 7548995 - DNA, 22 bp, Homo sapiens
ggacagctcctgcacttgagta

SEQ ID NO: 7548996 - DNA, 22 bp, Homo sapiens
ggacagcgtggctggtggaggg

SEQ ID NO: 7548997 - DNA, 22 bp, Homo sapiens
ggacagctcctgcacttgagta

SEQ ID NO: 7548998 - DNA, 22 bp, Homo sapiens
ggacagccgagtggccttctcc

SEQ ID NO: 7548999 - DNA, 22 bp, Homo sapiens
ggacagcgtggctggtggaggg

SEQ ID NO: 7549000 - DNA, 22 bp, Homo sapiens
ggacagcgtggctggtggaggg

SEQ ID NO: 7549001 - DNA, 22 bp, Homo sapiens
ggacagcattctactgtaggca

SEQ ID NO: 7549002 - DNA, 22 bp, Homo sapiens
ggacagcccatacacatgtctg

SEQ ID NO: 7549003 - DNA, 22 bp, Homo sapiens
ggacagcccatacacatgtctg

SEQ ID NO: 7549004 - DNA, 22 bp, Homo sapiens
ggacagcccatacacatgtctg

SEQ ID NO: 7549005 - DNA, 22 bp, Homo sapiens
ggacagcccatacacatgtctg

SEQ ID NO: 7549006 - DNA, 22 bp, Homo sapiens
ggacagcattcctagttccaaa

SEQ ID NO: 7549007 - DNA, 22 bp, Homo sapiens
ggacagcattcctagttccaaa

SEQ ID NO: 7549008 - DNA, 22 bp, Homo sapiens
ggacagcatatcagcagggcag

SEQ ID NO: 7549009 - DNA, 22 bp, Homo sapiens
ggacagcatatcagcagggcag

SEQ ID NO: 7549010 - DNA, 22 bp, Homo sapiens
ggacagcattctactgtaggca

SEQ ID NO: 7549011 - DNA, 22 bp, Homo sapiens
ggacagcattctactgtaggca

SEQ ID NO: 7549012 - DNA, 22 bp, Homo sapiens
ggacagcattctactgtaggca

SEQ ID NO: 7549013 - DNA, 22 bp, Homo sapiens
ggacagcattctactgtaggca

SEQ ID NO: 7549014 - DNA, 22 bp, Homo sapiens
ggacagcatatcagcagggcag

SEQ ID NO: 7549015 - DNA, 22 bp, Homo sapiens
ggacagcagcctcttacatgaa

SEQ ID NO: 7549016 - DNA, 22 bp, Homo sapiens
ggacagcagcctcttacatgaa

SEQ ID NO: 7549017 - DNA, 22 bp, Homo sapiens
ggacagcagcctcttacatgaa

SEQ ID NO: 7549018 - DNA, 22 bp, Homo sapiens
ggacagcacagctcttgacaac

SEQ ID NO: 7549019 - DNA, 22 bp, Homo sapiens
ggacagcacagctcttgacaac

SEQ ID NO: 7549020 - DNA, 22 bp, Homo sapiens
ggacagcatatcagcagggcag

SEQ ID NO: 7549021 - DNA, 22 bp, Homo sapiens
ggacagcatatcagcagggcag

SEQ ID NO: 7549022 - DNA, 22 bp, Homo sapiens
ggacagcatatcagcagggcag

SEQ ID NO: 7549023 - DNA, 22 bp, Homo sapiens
ggacagcatatcagcagggcag

SEQ ID NO: 7549024 - DNA, 22 bp, Homo sapiens
ggacagcatatcagcagggcag

SEQ ID NO: 7549025 - DNA, 22 bp, Homo sapiens
cacagagaatgatgagtcactg

SEQ ID NO: 7549026 - DNA, 22 bp, Homo sapiens
cacagagaatactgctcttgct

SEQ ID NO: 7549027 - DNA, 22 bp, Homo sapiens
cacagagaatgatgagtcactg

SEQ ID NO: 7549028 - DNA, 22 bp, Homo sapiens
cacagagaatgatgagtcactg

SEQ ID NO: 7549029 - DNA, 22 bp, Homo sapiens
cacagagaactgtgggagtgtg

SEQ ID NO: 7549030 - DNA, 22 bp, Homo sapiens
cacagagaatactgctcttgct

SEQ ID NO: 7549031 - DNA, 22 bp, Homo sapiens
cacagagaatactgctcttgct

SEQ ID NO: 7549032 - DNA, 22 bp, Homo sapiens
cacagagaactgtgggagtgtg

SEQ ID NO: 7549033 - DNA, 22 bp, Homo sapiens
cacagagaatactgctcttgct

SEQ ID NO: 7549034 - DNA, 22 bp, Homo sapiens
cacagagaatactgctcttgct

SEQ ID NO: 7549035 - DNA, 22 bp, Homo sapiens
cacagagaatactgctcttgct

SEQ ID NO: 7549036 - DNA, 22 bp, Homo sapiens
cacagagaatactgctcttgct

SEQ ID NO: 7549037 - DNA, 22 bp, Homo sapiens
cacagagaactgtgggagtgtg

SEQ ID NO: 7549038 - DNA, 22 bp, Homo sapiens
ggagatctgagagctggaagtg

SEQ ID NO: 7549039 - DNA, 22 bp, Homo sapiens
cacagagaactgtgggagtgtg

SEQ ID NO: 7549040 - DNA, 22 bp, Homo sapiens
cacagagaactgtgggagtgtg

SEQ ID NO: 7549041 - DNA, 22 bp, Homo sapiens
cacagagaactgtgggagtgtg

SEQ ID NO: 7549042 - DNA, 22 bp, Homo sapiens
cacagagaactgtgggagtgtg

SEQ ID NO: 7549043 - DNA, 22 bp, Homo sapiens
cacagagaactgtgggagtgtg

SEQ ID NO: 7549044 - DNA, 22 bp, Homo sapiens
cacagagaactgtgggagtgtg

SEQ ID NO: 7549045 - DNA, 22 bp, Homo sapiens
cacagagaactgtgggagtgtg

SEQ ID NO: 7549046 - DNA, 22 bp, Homo sapiens
ggagatagacttggtgagccac

SEQ ID NO: 7549047 - DNA, 22 bp, Homo sapiens
ggagatagtccaggtgaaggga

SEQ ID NO: 7549048 - DNA, 22 bp, Homo sapiens
ggagatagtccaggtgaaggga

SEQ ID NO: 7549049 - DNA, 22 bp, Homo sapiens
ggagatatggtctagtatagag

SEQ ID NO: 7549050 - DNA, 22 bp, Homo sapiens
ggagatattgcctgatgaagaa

SEQ ID NO: 7549051 - DNA, 22 bp, Homo sapiens
ggagatccaggctgagtctttc

SEQ ID NO: 7549052 - DNA, 22 bp, Homo sapiens
ggagatccaggcaaggccgcag

SEQ ID NO: 7549053 - DNA, 19 bp, Homo sapiens
ggagatcccgctgcagatg

SEQ ID NO: 7549054 - DNA, 22 bp, Homo sapiens
ggagatccaggctgagtctttc

SEQ ID NO: 7549055 - DNA, 22 bp, Homo sapiens
ggagatccaggcaaggccgcag

SEQ ID NO: 7549056 - DNA, 22 bp, Homo sapiens
ggagatatttgcaggtcttatg

SEQ ID NO: 7549057 - DNA, 23 bp, Homo sapiens
ggagatcagagactagggcagtt

SEQ ID NO: 7549058 - DNA, 23 bp, Homo sapiens
ggagatcagagactagggcagtt

SEQ ID NO: 7549059 - DNA, 22 bp, Homo sapiens
cacagcaggcactatacagggc

SEQ ID NO: 7549060 - DNA, 22 bp, Homo sapiens
cacagcaggcactatacagggc

SEQ ID NO: 7549061 - DNA, 22 bp, Homo sapiens
cacagcaggcactatacagggc

SEQ ID NO: 7549062 - DNA, 22 bp, Homo sapiens
cacagcaggcactatacagggc

SEQ ID NO: 7549063 - DNA, 22 bp, Homo sapiens
cacagcaaaggcttcggctgat

SEQ ID NO: 7549064 - DNA, 22 bp, Homo sapiens
cacagcaaaggcttcggctgat

SEQ ID NO: 7549065 - DNA, 22 bp, Homo sapiens
cacagcaaaggcttcggctgat

SEQ ID NO: 7549066 - DNA, 22 bp, Homo sapiens
cacagcaaaggcttcggctgat

SEQ ID NO: 7549067 - DNA, 22 bp, Homo sapiens
cacagcaaagacactctcaact

SEQ ID NO: 7549068 - DNA, 22 bp, Homo sapiens
cacagcaaagacactctcaact

SEQ ID NO: 7549069 - DNA, 22 bp, Homo sapiens
cacagcaaagacactctcaact

SEQ ID NO: 7549070 - DNA, 22 bp, Homo sapiens
cacagcaaagacactctcaact

SEQ ID NO: 7549071 - DNA, 22 bp, Homo sapiens
cacagcaaagacactctcaact

SEQ ID NO: 7549072 - DNA, 22 bp, Homo sapiens
cacagagacagatctattttgc

SEQ ID NO: 7549073 - DNA, 22 bp, Homo sapiens
cacagagacagatctattttgc

SEQ ID NO: 7549074 - DNA, 22 bp, Homo sapiens
cacagagacatgatgtcattgc

SEQ ID NO: 7549075 - DNA, 22 bp, Homo sapiens
cacagagacatgatgtcattgc

SEQ ID NO: 7549076 - DNA, 22 bp, Homo sapiens
cacagagacatgatgtcattgc

SEQ ID NO: 7549077 - DNA, 22 bp, Homo sapiens
cacagagacatgatgtcattgc

SEQ ID NO: 7549078 - DNA, 22 bp, Homo sapiens
cacagagacatgatgtcattgc

SEQ ID NO: 7549079 - DNA, 22 bp, Homo sapiens
cacagagaccccttctggggcc

SEQ ID NO: 7549080 - DNA, 22 bp, Homo sapiens
cacagagaccccttctggggcc

SEQ ID NO: 7549081 - DNA, 22 bp, Homo sapiens
cacagagaccccttctggggcc

SEQ ID NO: 7549082 - DNA, 22 bp, Homo sapiens
cacagcaaagacactctcaact

SEQ ID NO: 7549083 - DNA, 22 bp, Homo sapiens
cacagcaaagacactctcaact

SEQ ID NO: 7549084 - DNA, 22 bp, Homo sapiens
cacagagaattcccatatgtga

SEQ ID NO: 7549085 - DNA, 22 bp, Homo sapiens
cacagagaattcccatatgtga

SEQ ID NO: 7549086 - DNA, 22 bp, Homo sapiens
cacagagaatgatgagtcactg

SEQ ID NO: 7549087 - DNA, 22 bp, Homo sapiens
cacagagaatgatgagtcactg

SEQ ID NO: 7549088 - DNA, 22 bp, Homo sapiens
cacagagaatgatgagtcactg

SEQ ID NO: 7549089 - DNA, 22 bp, Homo sapiens
cacagagaattcccatatgtga

SEQ ID NO: 7549090 - DNA, 22 bp, Homo sapiens
cacagagaattcccatatgtga

SEQ ID NO: 7549091 - DNA, 22 bp, Homo sapiens
cacagagaattcccatatgtga

SEQ ID NO: 7549092 - DNA, 22 bp, Homo sapiens
cacagagaattcccatatgtga

SEQ ID NO: 7549093 - DNA, 22 bp, Homo sapiens
cacagagaattcccatatgtga

SEQ ID NO: 7549094 - DNA, 22 bp, Homo sapiens
cacagagacagatctattttgc

SEQ ID NO: 7549095 - DNA, 22 bp, Homo sapiens
cacagagacagatctattttgc

SEQ ID NO: 7549096 - DNA, 22 bp, Homo sapiens
cacagagacagatctattttgc

SEQ ID NO: 7549097 - DNA, 22 bp, Homo sapiens
cacagagacagatctattttgc

SEQ ID NO: 7549098 - DNA, 22 bp, Homo sapiens
cacagagacagaagcacttatg

SEQ ID NO: 7549099 - DNA, 22 bp, Homo sapiens
cacagagacagaagcacttatg

SEQ ID NO: 7549100 - DNA, 22 bp, Homo sapiens
cacagagacagaagcacttatg

SEQ ID NO: 7549101 - DNA, 22 bp, Homo sapiens
cacagagacagaagcacttatg

SEQ ID NO: 7549102 - DNA, 22 bp, Homo sapiens
ggaagagagatcccatagatgt

SEQ ID NO: 7549103 - DNA, 22 bp, Homo sapiens
ggaagagagatcccatagatgt

SEQ ID NO: 7549104 - DNA, 22 bp, Homo sapiens
ggaagagagatcccatagatgt

SEQ ID NO: 7549105 - DNA, 22 bp, Homo sapiens
ggaagagagatcccatagatgt

SEQ ID NO: 7549106 - DNA, 22 bp, Homo sapiens
ggaagagagatcccatagatgt

SEQ ID NO: 7549107 - DNA, 19 bp, Homo sapiens
ggaagagaggaaaggtgga

SEQ ID NO: 7549108 - DNA, 19 bp, Homo sapiens
ggaagagaggaaaggtgga

SEQ ID NO: 7549109 - DNA, 22 bp, Homo sapiens
ggaagagagatcccatagatgt

SEQ ID NO: 7549110 - DNA, 19 bp, Homo sapiens
ggaagagaggaaaggtgga

SEQ ID NO: 7549111 - DNA, 19 bp, Homo sapiens
ggaagagaggaaaggtgga

SEQ ID NO: 7549112 - DNA, 19 bp, Homo sapiens
ggaagagaggaaaggtgga

SEQ ID NO: 7549113 - DNA, 19 bp, Homo sapiens
ggaagagaggaaaggtgga

SEQ ID NO: 7549114 - DNA, 19 bp, Homo sapiens
ggaagagaggaaaggtgga

SEQ ID NO: 7549115 - DNA, 22 bp, Homo sapiens
ggaagagaatttctctcttttt

SEQ ID NO: 7549116 - DNA, 22 bp, Homo sapiens
ggaagagagatcccatagatgt

SEQ ID NO: 7549117 - DNA, 22 bp, Homo sapiens
ggaagagagatcccatagatgt

SEQ ID NO: 7549118 - DNA, 22 bp, Homo sapiens
ggaagagagatcccatagatgt

SEQ ID NO: 7549119 - DNA, 22 bp, Homo sapiens
ggaagagaatgatggctatggg

SEQ ID NO: 7549120 - DNA, 22 bp, Homo sapiens
ggaagagaatgatggctatggg

SEQ ID NO: 7549121 - DNA, 22 bp, Homo sapiens
ggaagagaatttctctcttttt

SEQ ID NO: 7549122 - DNA, 22 bp, Homo sapiens
ggaagagaatgatggctatggg

SEQ ID NO: 7549123 - DNA, 22 bp, Homo sapiens
ggaagagaatgatggctatggg

SEQ ID NO: 7549124 - DNA, 22 bp, Homo sapiens
ggaagagaggttcagccctaag

SEQ ID NO: 7549125 - DNA, 22 bp, Homo sapiens
ggaagagaggttcagccctaag

SEQ ID NO: 7549126 - DNA, 22 bp, Homo sapiens
ggaagagaggttcagccctaag

SEQ ID NO: 7549127 - DNA, 22 bp, Homo sapiens
ggaagagaggttcagccctaag

SEQ ID NO: 7549128 - DNA, 22 bp, Homo sapiens
ggaagagaggttcagccctaag

SEQ ID NO: 7549129 - DNA, 22 bp, Homo sapiens
ggaagagattctttacattcat

SEQ ID NO: 7549130 - DNA, 22 bp, Homo sapiens
ggaagagcctggggtgtcaggc

SEQ ID NO: 7549131 - DNA, 22 bp, Homo sapiens
ggaagagattctttacattcat

SEQ ID NO: 7549132 - DNA, 22 bp, Homo sapiens
ggaagagaggttcagccctaag

SEQ ID NO: 7549133 - DNA, 22 bp, Homo sapiens
ggaagagattctttacattcat

SEQ ID NO: 7549134 - DNA, 19 bp, Homo sapiens
ggaagagaggaaaggtgga

SEQ ID NO: 7549135 - DNA, 19 bp, Homo sapiens
ggaagagaggaaaggtgga

SEQ ID NO: 7549136 - DNA, 19 bp, Homo sapiens
ggaagagaggaaaggtgga

SEQ ID NO: 7549137 - DNA, 19 bp, Homo sapiens
ggaagagaggaaaggtgga

SEQ ID NO: 7549138 - DNA, 19 bp, Homo sapiens
ggaagagaggaaaggtgga

SEQ ID NO: 7549139 - DNA, 22 bp, Homo sapiens
ggaagagagggctgggcctcaa

SEQ ID NO: 7549140 - DNA, 22 bp, Homo sapiens
ggaagagagggctgggcctcaa

SEQ ID NO: 7549141 - DNA, 19 bp, Homo sapiens
ggaagagaggaaaggtgga

SEQ ID NO: 7549142 - DNA, 22 bp, Homo sapiens
ggaagagagggctgggcctcaa

SEQ ID NO: 7549143 - DNA, 22 bp, Homo sapiens
ggaagagagggctgggcctcaa

SEQ ID NO: 7549144 - DNA, 22 bp, Homo sapiens
ggaacagggatttggcctggtt

SEQ ID NO: 7549145 - DNA, 22 bp, Homo sapiens
ggaacagggatttggcctggtt

SEQ ID NO: 7549146 - DNA, 22 bp, Homo sapiens
ggaacaggaaaggagggatgct

SEQ ID NO: 7549147 - DNA, 22 bp, Homo sapiens
ggaacaggaaaggagggatgct

SEQ ID NO: 7549148 - DNA, 22 bp, Homo sapiens
ggaacaggaaaggagggatgct

SEQ ID NO: 7549149 - DNA, 22 bp, Homo sapiens
ggaacaggaaaggagggatgct

SEQ ID NO: 7549150 - DNA, 22 bp, Homo sapiens
ggaacaggaaaggagggatgct

SEQ ID NO: 7549151 - DNA, 18 bp, Homo sapiens
ggaacagctcagggcagc

SEQ ID NO: 7549152 - DNA, 18 bp, Homo sapiens
ggaacagctcagggcagc

SEQ ID NO: 7549153 - DNA, 22 bp, Homo sapiens
ggaacaggaaaggagggatgct

SEQ ID NO: 7549154 - DNA, 22 bp, Homo sapiens
ggaacaggaaaggagggatgct

SEQ ID NO: 7549155 - DNA, 22 bp, Homo sapiens
ggaacaggaaaggagggatgct

SEQ ID NO: 7549156 - DNA, 22 bp, Homo sapiens
ggaacaggaaaggagggatgct

SEQ ID NO: 7549157 - DNA, 22 bp, Homo sapiens
ggaacaggaaaggagggatgct

SEQ ID NO: 7549158 - DNA, 20 bp, Homo sapiens
ggaacactgttcattctgta

SEQ ID NO: 7549159 - DNA, 22 bp, Homo sapiens
ggaacactgtggttccatagca

SEQ ID NO: 7549160 - DNA, 22 bp, Homo sapiens
ggaacactgtggttccatagca

SEQ ID NO: 7549161 - DNA, 22 bp, Homo sapiens
ggaacagactgacttcttgaat

SEQ ID NO: 7549162 - DNA, 22 bp, Homo sapiens
ggaacagccagctcagtttcag

SEQ ID NO: 7549163 - DNA, 22 bp, Homo sapiens
ggaacactggctcaattatatc

SEQ ID NO: 7549164 - DNA, 22 bp, Homo sapiens
ggaagagaatgatggctatggg

SEQ ID NO: 7549165 - DNA, 22 bp, Homo sapiens
ggaagagaatgatggctatggg

SEQ ID NO: 7549166 - DNA, 22 bp, Homo sapiens
ggaagagaatgatggctatggg

SEQ ID NO: 7549167 - DNA, 22 bp, Homo sapiens
ggaagagaaatgagtcaagact

SEQ ID NO: 7549168 - DNA, 22 bp, Homo sapiens
ggaagagaaatgagtcaagact

SEQ ID NO: 7549169 - DNA, 22 bp, Homo sapiens
ggaagagaaatgagtcaagact

SEQ ID NO: 7549170 - DNA, 22 bp, Homo sapiens
ggaagagaaatgagtcaagact

SEQ ID NO: 7549171 - DNA, 22 bp, Homo sapiens
ggaagagaaatgagtcaagact

SEQ ID NO: 7549172 - DNA, 22 bp, Homo sapiens
ggaagacatctgcttgcaccag

SEQ ID NO: 7549173 - DNA, 22 bp, Homo sapiens
ggaagagaaatgagtcaagact

SEQ ID NO: 7549174 - DNA, 22 bp, Homo sapiens
ggaagagaaatgagtcaagact

SEQ ID NO: 7549175 - DNA, 22 bp, Homo sapiens
ggaagagaaatgagtcaagact

SEQ ID NO: 7549176 - DNA, 22 bp, Homo sapiens
ggaagagaaatgagtcaagact

SEQ ID NO: 7549177 - DNA, 22 bp, Homo sapiens
ggaagactgcatggcatagtga

SEQ ID NO: 7549178 - DNA, 22 bp, Homo sapiens
ggaagactgcatggcatagtga

SEQ ID NO: 7549179 - DNA, 22 bp, Homo sapiens
ggaagactgcatggcatagtga

SEQ ID NO: 7549180 - DNA, 22 bp, Homo sapiens
ggaagacatctgcttgcaccag

SEQ ID NO: 7549181 - DNA, 22 bp, Homo sapiens
ggaagactagtgttttaagtta

SEQ ID NO: 7549182 - DNA, 22 bp, Homo sapiens
ggaacagggatttggcctggtt

SEQ ID NO: 7549183 - DNA, 22 bp, Homo sapiens
ggaacagggatttggcctggtt

SEQ ID NO: 7549184 - DNA, 22 bp, Homo sapiens
ggaacagggatttggcctggtt

SEQ ID NO: 7549185 - DNA, 22 bp, Homo sapiens
ggaagacagaagcctacagctt

SEQ ID NO: 7549186 - DNA, 22 bp, Homo sapiens
ggacaagtggcccggtgtgtta

SEQ ID NO: 7549187 - DNA, 22 bp, Homo sapiens
ggacaagcctgtgagtgggttt

SEQ ID NO: 7549188 - DNA, 22 bp, Homo sapiens
ggacaagcctgtgagtgggttt

SEQ ID NO: 7549189 - DNA, 22 bp, Homo sapiens
ggacaagcctgtgagtgggttt

SEQ ID NO: 7549190 - DNA, 22 bp, Homo sapiens
ggacaagcctgtgagtgggttt

SEQ ID NO: 7549191 - DNA, 22 bp, Homo sapiens
ggacaacatgttttaattaagg

SEQ ID NO: 7549192 - DNA, 22 bp, Homo sapiens
ggacaagcctgtgagtgggttt

SEQ ID NO: 7549193 - DNA, 22 bp, Homo sapiens
ggacaagcctgtgagtgggttt

SEQ ID NO: 7549194 - DNA, 22 bp, Homo sapiens
ggacaagcctgtgagtgggttt

SEQ ID NO: 7549195 - DNA, 22 bp, Homo sapiens
ggacaaattccctatttgcatg

SEQ ID NO: 7549196 - DNA, 22 bp, Homo sapiens
ggacaaatctcattatttctga

SEQ ID NO: 7549197 - DNA, 22 bp, Homo sapiens
ggacaaatctcattatttctga

SEQ ID NO: 7549198 - DNA, 22 bp, Homo sapiens
ggacaacacttcattccagcta

SEQ ID NO: 7549199 - DNA, 22 bp, Homo sapiens
ggacaaattccctatttgcatg

SEQ ID NO: 7549200 - DNA, 22 bp, Homo sapiens
ggacaaattccctatttgcatg

SEQ ID NO: 7549201 - DNA, 22 bp, Homo sapiens
ggacaagcctcagacaaaactc

SEQ ID NO: 7549202 - DNA, 22 bp, Homo sapiens
ggacaacacttcattccagcta

SEQ ID NO: 7549203 - DNA, 22 bp, Homo sapiens
ggacaaatttttgtgatgtgct

SEQ ID NO: 7549204 - DNA, 22 bp, Homo sapiens
ggacaacatgttttaattaagg

SEQ ID NO: 7549205 - DNA, 22 bp, Homo sapiens
ggacaaaggtagacagtctctg

SEQ ID NO: 7549206 - DNA, 22 bp, Homo sapiens
ggacaaagggtggagcctctga

SEQ ID NO: 7549207 - DNA, 22 bp, Homo sapiens
ggacaaagggctagccacaact

SEQ ID NO: 7549208 - DNA, 22 bp, Homo sapiens
ggacaaaggggagcctgccccg

SEQ ID NO: 7549209 - DNA, 22 bp, Homo sapiens
ggacaaaggggagcctgccccg

SEQ ID NO: 7549210 - DNA, 22 bp, Homo sapiens
ggacaaagggtggagcctctga

SEQ ID NO: 7549211 - DNA, 22 bp, Homo sapiens
ggaaggggccttgagcaaactg

SEQ ID NO: 7549212 - DNA, 22 bp, Homo sapiens
ggaaggggtcacctcctgatga

SEQ ID NO: 7549213 - DNA, 22 bp, Homo sapiens
ggaaggggtcacctcctgatga

SEQ ID NO: 7549214 - DNA, 22 bp, Homo sapiens
ggaaggggtcacctcctgatga

SEQ ID NO: 7549215 - DNA, 22 bp, Homo sapiens
ggaaggggtcacctcctgatga

SEQ ID NO: 7549216 - DNA, 22 bp, Homo sapiens
ggacaaagctctgctgcctccc

SEQ ID NO: 7549217 - DNA, 22 bp, Homo sapiens
ggaaggggtcacctcctgatga

SEQ ID NO: 7549218 - DNA, 19 bp, Homo sapiens
ggacacagaaagctgcatt

SEQ ID NO: 7549219 - DNA, 19 bp, Homo sapiens
ggacacagaaagctgcatt

SEQ ID NO: 7549220 - DNA, 19 bp, Homo sapiens
ggacacagaaagctgcatt

SEQ ID NO: 7549221 - DNA, 19 bp, Homo sapiens
ggacacagaaagctgcatt

SEQ ID NO: 7549222 - DNA, 19 bp, Homo sapiens
ggacacagaaagctgcatt

SEQ ID NO: 7549223 - DNA, 22 bp, Homo sapiens
ggacacaaaagtgaataaaata

SEQ ID NO: 7549224 - DNA, 22 bp, Homo sapiens
ggacacaaaagtgaataaaata

SEQ ID NO: 7549225 - DNA, 22 bp, Homo sapiens
ggacacaaaagtgaataaaata

SEQ ID NO: 7549226 - DNA, 23 bp, Homo sapiens
ggacaatcaagtttcacttatgc

SEQ ID NO: 7549227 - DNA, 22 bp, Homo sapiens
ggacaattcagtgatttgggga

SEQ ID NO: 7549228 - DNA, 21 bp, Homo sapiens
ggacaattgttcattttcttt

SEQ ID NO: 7549229 - DNA, 19 bp, Homo sapiens
ggacacagaaagctgcatt

SEQ ID NO: 7549230 - DNA, 19 bp, Homo sapiens
ggacacagaaagctgcatt

SEQ ID NO: 7549231 - DNA, 19 bp, Homo sapiens
ggacacagaaagctgcatt

SEQ ID NO: 7549232 - DNA, 19 bp, Homo sapiens
ggacacagaaagctgcatt

SEQ ID NO: 7549233 - DNA, 22 bp, Homo sapiens
ggacacagacctttctgttcta

SEQ ID NO: 7549234 - DNA, 23 bp, Homo sapiens
ggacacagagataagtgagacaa

SEQ ID NO: 7549235 - DNA, 23 bp, Homo sapiens
ggacacagagataagtgagacaa

SEQ ID NO: 7549236 - DNA, 22 bp, Homo sapiens
ggacacagacctttctgttcta

SEQ ID NO: 7549237 - DNA, 22 bp, Homo sapiens
ggacacagacctttctgttcta

SEQ ID NO: 7549238 - DNA, 19 bp, Homo sapiens
ggacacagaaagctgcatt

SEQ ID NO: 7549239 - DNA, 22 bp, Homo sapiens
ggacagagggttgacagagtat

SEQ ID NO: 7549240 - DNA, 22 bp, Homo sapiens
ggacagagggttgacagagtat

SEQ ID NO: 7549241 - DNA, 22 bp, Homo sapiens
ggacacagataatcacacagat

SEQ ID NO: 7549242 - DNA, 22 bp, Homo sapiens
ggacagagggttgacagagtat

SEQ ID NO: 7549243 - DNA, 22 bp, Homo sapiens
ggacagagggttgacagagtat

SEQ ID NO: 7549244 - DNA, 22 bp, Homo sapiens
ggacagattgagctaggcgttt

SEQ ID NO: 7549245 - DNA, 22 bp, Homo sapiens
ggacagcacagctcttgacaac

SEQ ID NO: 7549246 - DNA, 22 bp, Homo sapiens
ggacagcacagctcttgacaac

SEQ ID NO: 7549247 - DNA, 22 bp, Homo sapiens
ggacagcacagctcttgacaac

SEQ ID NO: 7549248 - DNA, 23 bp, Homo sapiens
ggacacagagataagtgagacaa

SEQ ID NO: 7549249 - DNA, 23 bp, Homo sapiens
ggacacagagataagtgagacaa

SEQ ID NO: 7549250 - DNA, 22 bp, Homo sapiens
ggacacagataatcacacagat

SEQ ID NO: 7549251 - DNA, 22 bp, Homo sapiens
ggacacagataatcacacagat

SEQ ID NO: 7549252 - DNA, 22 bp, Homo sapiens
ggacacagataatcacacagat

SEQ ID NO: 7549253 - DNA, 22 bp, Homo sapiens
ggacacagataatcacacagat

SEQ ID NO: 7549254 - DNA, 22 bp, Homo sapiens
ggacacagataatcacacagat

SEQ ID NO: 7549255 - DNA, 22 bp, Homo sapiens
ggacagagggttgacagagtat

SEQ ID NO: 7549256 - DNA, 22 bp, Homo sapiens
ggccccagcctcagtcccctga

SEQ ID NO: 7549257 - DNA, 21 bp, Homo sapiens
ggccccagcccatgggttctc

SEQ ID NO: 7549258 - DNA, 22 bp, Homo sapiens
ggccccagcctcagtcccctga

SEQ ID NO: 7549259 - DNA, 22 bp, Homo sapiens
ggccccagcctcagtcccctga

SEQ ID NO: 7549260 - DNA, 21 bp, Homo sapiens
ggccccagcccatgggttctc

SEQ ID NO: 7549261 - DNA, 21 bp, Homo sapiens
ggccccagcccatgggttctc

SEQ ID NO: 7549262 - DNA, 19 bp, Homo sapiens
ggccccagccagggtatca

SEQ ID NO: 7549263 - DNA, 19 bp, Homo sapiens
ggccccagccagggtatca

SEQ ID NO: 7549264 - DNA, 22 bp, Homo sapiens
ggccccagcagaccctcctctg

SEQ ID NO: 7549265 - DNA, 22 bp, Homo sapiens
ggccccagcagaccctcctctg

SEQ ID NO: 7549266 - DNA, 22 bp, Homo sapiens
ggccccagcagtgcttgtttat

SEQ ID NO: 7549267 - DNA, 22 bp, Homo sapiens
ggccccagcagtgcttgtttat

SEQ ID NO: 7549268 - DNA, 22 bp, Homo sapiens
ggcccagcatcttgtgaagttt

SEQ ID NO: 7549269 - DNA, 22 bp, Homo sapiens
ggcccagcatcttgtgaagttt

SEQ ID NO: 7549270 - DNA, 22 bp, Homo sapiens
ggcccagcccgagtcagccttc

SEQ ID NO: 7549271 - DNA, 22 bp, Homo sapiens
ggcccagcatcttgtgaagttt

SEQ ID NO: 7549272 - DNA, 22 bp, Homo sapiens
ggcccagcatcttgtgaagttt

SEQ ID NO: 7549273 - DNA, 22 bp, Homo sapiens
ggcccagcatcttgtgaagttt

SEQ ID NO: 7549274 - DNA, 22 bp, Homo sapiens
ggcccagcacagtgcttggggg

SEQ ID NO: 7549275 - DNA, 22 bp, Homo sapiens
ggcccagcacagtgcttggggg

SEQ ID NO: 7549276 - DNA, 22 bp, Homo sapiens
ggcccagcccgagtcagccttc

SEQ ID NO: 7549277 - DNA, 22 bp, Homo sapiens
ggcccagcccgagtcagccttc

SEQ ID NO: 7549278 - DNA, 22 bp, Homo sapiens
ggcccagcccgagtcagccttc

SEQ ID NO: 7549279 - DNA, 22 bp, Homo sapiens
ggcccagcccgagtcagccttc

SEQ ID NO: 7549280 - DNA, 22 bp, Homo sapiens
ggcccagcccgagtcagccttc

SEQ ID NO: 7549281 - DNA, 22 bp, Homo sapiens
ggcccagcccgagtcagccttc

SEQ ID NO: 7549282 - DNA, 22 bp, Homo sapiens
ggccccagcagaccctcctctg

SEQ ID NO: 7549283 - DNA, 22 bp, Homo sapiens
ggccccagcagaccctcctctg

SEQ ID NO: 7549284 - DNA, 22 bp, Homo sapiens
ggcccagagctccctggcacct

SEQ ID NO: 7549285 - DNA, 22 bp, Homo sapiens
ggcccagagctccctggcacct

SEQ ID NO: 7549286 - DNA, 22 bp, Homo sapiens
ggcccagagctccctggcacct

SEQ ID NO: 7549287 - DNA, 22 bp, Homo sapiens
ggcccagagctctgggggagct

SEQ ID NO: 7549288 - DNA, 22 bp, Homo sapiens
ggcccagagctccctggcacct

SEQ ID NO: 7549289 - DNA, 22 bp, Homo sapiens
ggcccagagctctgggggagct

SEQ ID NO: 7549290 - DNA, 22 bp, Homo sapiens
ggcccagagctccctggcacct

SEQ ID NO: 7549291 - DNA, 22 bp, Homo sapiens
ggcccagacccaagagtggtgg

SEQ ID NO: 7549292 - DNA, 22 bp, Homo sapiens
ggcccagacccaagagtggtgg

SEQ ID NO: 7549293 - DNA, 22 bp, Homo sapiens
ggcccagagctccctggcacct

SEQ ID NO: 7549294 - DNA, 22 bp, Homo sapiens
ggcccagagacgtgcaatgtac

SEQ ID NO: 7549295 - DNA, 22 bp, Homo sapiens
ggcccagagacgtgcaatgtac

SEQ ID NO: 7549296 - DNA, 22 bp, Homo sapiens
ggcccagacccaagagtggtgg

SEQ ID NO: 7549297 - DNA, 22 bp, Homo sapiens
ggcccagacccaagagtggtgg

SEQ ID NO: 7549298 - DNA, 22 bp, Homo sapiens
ggcccagacccaagagtggtgg

SEQ ID NO: 7549299 - DNA, 22 bp, Homo sapiens
ggcccagaatactttgtaaaat

SEQ ID NO: 7549300 - DNA, 22 bp, Homo sapiens
ggcccagaatacatgaagtata

SEQ ID NO: 7549301 - DNA, 22 bp, Homo sapiens
ggcccagaatactttgtaaaat

SEQ ID NO: 7549302 - DNA, 22 bp, Homo sapiens
ggcccagaagccagaagcctcc

SEQ ID NO: 7549303 - DNA, 22 bp, Homo sapiens
ggcccagaagccagaagcctcc

SEQ ID NO: 7549304 - DNA, 22 bp, Homo sapiens
ggcccagaagccagaagcctcc

SEQ ID NO: 7549305 - DNA, 22 bp, Homo sapiens
ggcccagaagccagaagcctcc

SEQ ID NO: 7549306 - DNA, 22 bp, Homo sapiens
ggccagggcctggggactgtcc

SEQ ID NO: 7549307 - DNA, 22 bp, Homo sapiens
ggcccagaagccagaagcctcc

SEQ ID NO: 7549308 - DNA, 22 bp, Homo sapiens
ggcccagaatacatgaagtata

SEQ ID NO: 7549309 - DNA, 22 bp, Homo sapiens
ggcccagaatacatgaagtata

SEQ ID NO: 7549310 - DNA, 22 bp, Homo sapiens
ggcccagcacagtgcttggggg

SEQ ID NO: 7549311 - DNA, 22 bp, Homo sapiens
ggcccagcacagtgcttggggg

SEQ ID NO: 7549312 - DNA, 22 bp, Homo sapiens
ggcccagcacagtgcttggggg

SEQ ID NO: 7549313 - DNA, 22 bp, Homo sapiens
ggcccagcacagtgcttggggg

SEQ ID NO: 7549314 - DNA, 22 bp, Homo sapiens
ggcccagattagaagctgaatg

SEQ ID NO: 7549315 - DNA, 22 bp, Homo sapiens
ggcccagcacagtgcttggggg

SEQ ID NO: 7549316 - DNA, 22 bp, Homo sapiens
ggcccagattagaagctgaatg

SEQ ID NO: 7549317 - DNA, 22 bp, Homo sapiens
ggcccagattagaagctgaatg

SEQ ID NO: 7549318 - DNA, 22 bp, Homo sapiens
ggcccagaggggttgagcatct

SEQ ID NO: 7549319 - DNA, 22 bp, Homo sapiens
ggcccagagctctgggggagct

SEQ ID NO: 7549320 - DNA, 22 bp, Homo sapiens
ggcccagaggggttgagcatct

SEQ ID NO: 7549321 - DNA, 22 bp, Homo sapiens
ggcccagaggggttgagcatct

SEQ ID NO: 7549322 - DNA, 22 bp, Homo sapiens
ggcccagagggtcaggagctga

SEQ ID NO: 7549323 - DNA, 22 bp, Homo sapiens
ggcccagagggtcaggagctga

SEQ ID NO: 7549324 - DNA, 22 bp, Homo sapiens
ggcccagaggggttgagcatct

SEQ ID NO: 7549325 - DNA, 22 bp, Homo sapiens
ggcccagagggtcaggagctga

SEQ ID NO: 7549326 - DNA, 22 bp, Homo sapiens
ggcccagagggtcaggagctga

SEQ ID NO: 7549327 - DNA, 22 bp, Homo sapiens
ggcccagagtctgcaatggagt

SEQ ID NO: 7549328 - DNA, 22 bp, Homo sapiens
ggcccagagtctgcaatggagt

SEQ ID NO: 7549329 - DNA, 22 bp, Homo sapiens
ggcccagagtctgcaatggagt

SEQ ID NO: 7549330 - DNA, 22 bp, Homo sapiens
ggcccagagggtcaggagctga

SEQ ID NO: 7549331 - DNA, 22 bp, Homo sapiens
ggcccagaggggttgagcatct

SEQ ID NO: 7549332 - DNA, 22 bp, Homo sapiens
ggcccagagggtcaggagctga

SEQ ID NO: 7549333 - DNA, 22 bp, Homo sapiens
ggcccagagtctgcaatggagt

SEQ ID NO: 7549334 - DNA, 22 bp, Homo sapiens
ggcccagagtctgcaatggagt

SEQ ID NO: 7549335 - DNA, 22 bp, Homo sapiens
ggcgccagcggtaagtaagaca

SEQ ID NO: 7549336 - DNA, 22 bp, Homo sapiens
ggcgccagcggtaagtaagaca

SEQ ID NO: 7549337 - DNA, 22 bp, Homo sapiens
ggcgccagcactgcagcgcctc

SEQ ID NO: 7549338 - DNA, 22 bp, Homo sapiens
ggcgccagcccaggccgtcgtg

SEQ ID NO: 7549339 - DNA, 22 bp, Homo sapiens
ggcgccagcccaggccgtcgtg

SEQ ID NO: 7549340 - DNA, 22 bp, Homo sapiens
ggcgccagcactgcagcgcctc

SEQ ID NO: 7549341 - DNA, 22 bp, Homo sapiens
ggcgccagcactgcagcgcctc

SEQ ID NO: 7549342 - DNA, 22 bp, Homo sapiens
ggcgcagtgtgcagaggagtga

SEQ ID NO: 7549343 - DNA, 22 bp, Homo sapiens
ggcgcagttgagcgtgctgttc

SEQ ID NO: 7549344 - DNA, 22 bp, Homo sapiens
ggcgcccccttcaaacagagca

SEQ ID NO: 7549345 - DNA, 22 bp, Homo sapiens
ggcgcccatcggtgcagagggc

SEQ ID NO: 7549346 - DNA, 22 bp, Homo sapiens
ggcgcccatcggtgcagagggc

SEQ ID NO: 7549347 - DNA, 22 bp, Homo sapiens
ggcgcccatcggtgcagagggc

SEQ ID NO: 7549348 - DNA, 22 bp, Homo sapiens
ggcgccccatatagttcttaat

SEQ ID NO: 7549349 - DNA, 22 bp, Homo sapiens
ggcgccccatgatgagggctag

SEQ ID NO: 7549350 - DNA, 22 bp, Homo sapiens
ggcgaggtgtctgccatcaagc

SEQ ID NO: 7549351 - DNA, 22 bp, Homo sapiens
ggcgatttatactggtatttgg

SEQ ID NO: 7549352 - DNA, 22 bp, Homo sapiens
ggcgagggagcagtgcggtggg

SEQ ID NO: 7549353 - DNA, 22 bp, Homo sapiens
ggcgagggagcagtgcggtggg

SEQ ID NO: 7549354 - DNA, 22 bp, Homo sapiens
ggcgagggagcagtgcggtggg

SEQ ID NO: 7549355 - DNA, 22 bp, Homo sapiens
ggcgcaggccttggatcctggt

SEQ ID NO: 7549356 - DNA, 22 bp, Homo sapiens
ggcgcaggccttggatcctggt

SEQ ID NO: 7549357 - DNA, 22 bp, Homo sapiens
ggcgcaggccttggatcctggt

SEQ ID NO: 7549358 - DNA, 22 bp, Homo sapiens
ggcgagggaagtttactgtgag

SEQ ID NO: 7549359 - DNA, 22 bp, Homo sapiens
ggcgaggccgggacaggctgga

SEQ ID NO: 7549360 - DNA, 22 bp, Homo sapiens
ggcgagggaagtttactgtgag

SEQ ID NO: 7549361 - DNA, 23 bp, Homo sapiens
ggcctgtgttttgtctgaagtac

SEQ ID NO: 7549362 - DNA, 17 bp, Homo sapiens
ggcctgtgtggctgcag

SEQ ID NO: 7549363 - DNA, 22 bp, Homo sapiens
ggcgagggagcagtgcggtggg

SEQ ID NO: 7549364 - DNA, 22 bp, Homo sapiens
ggcgagggagcagtgcggtggg

SEQ ID NO: 7549365 - DNA, 22 bp, Homo sapiens
ggcgagggagcagtgcggtggg

SEQ ID NO: 7549366 - DNA, 22 bp, Homo sapiens
ggcgagggagcagtgcggtggg

SEQ ID NO: 7549367 - DNA, 22 bp, Homo sapiens
ggccccagggattaggccaacc

SEQ ID NO: 7549368 - DNA, 22 bp, Homo sapiens
ggccccagggattaggccaacc

SEQ ID NO: 7549369 - DNA, 22 bp, Homo sapiens
ggccccagggaagaaggtggtc

SEQ ID NO: 7549370 - DNA, 22 bp, Homo sapiens
ggccccagggattaggccaacc

SEQ ID NO: 7549371 - DNA, 22 bp, Homo sapiens
ggccccagggattaggccaacc

SEQ ID NO: 7549372 - DNA, 17 bp, Homo sapiens
ggcctgtgtggctgcag

SEQ ID NO: 7549373 - DNA, 22 bp, Homo sapiens
ggccccagggaagaaggtggtc

SEQ ID NO: 7549374 - DNA, 22 bp, Homo sapiens
ggccccaggcctttggtctggc

SEQ ID NO: 7549375 - DNA, 22 bp, Homo sapiens
ggccccaggcctttggtctggc

SEQ ID NO: 7549376 - DNA, 22 bp, Homo sapiens
ggccccagggaagaaggtggtc

SEQ ID NO: 7549377 - DNA, 22 bp, Homo sapiens
ggccccagggaagaaggtggtc

SEQ ID NO: 7549378 - DNA, 22 bp, Homo sapiens
ggccccagggaagaaggtggtc

SEQ ID NO: 7549379 - DNA, 22 bp, Homo sapiens
ggccccagggaagaaggtggtc

SEQ ID NO: 7549380 - DNA, 22 bp, Homo sapiens
ggccccaggcctttggtctggc

SEQ ID NO: 7549381 - DNA, 22 bp, Homo sapiens
ggccccaggcctttggtctggc

SEQ ID NO: 7549382 - DNA, 22 bp, Homo sapiens
ggccccaggcctttggtctggc

SEQ ID NO: 7549383 - DNA, 22 bp, Homo sapiens
ggccccaggcctttggtctggc

SEQ ID NO: 7549384 - DNA, 22 bp, Homo sapiens
ggccccaggacctccacggtcc

SEQ ID NO: 7549385 - DNA, 22 bp, Homo sapiens
ggccccaggacctccacggtcc

SEQ ID NO: 7549386 - DNA, 22 bp, Homo sapiens
ggccccaggacctccacggtcc

SEQ ID NO: 7549387 - DNA, 22 bp, Homo sapiens
ggccccaggacctccacggtcc

SEQ ID NO: 7549388 - DNA, 22 bp, Homo sapiens
ggccccagcttcaaccccgtgg

SEQ ID NO: 7549389 - DNA, 22 bp, Homo sapiens
ggccccagcttcaaccccgtgg

SEQ ID NO: 7549390 - DNA, 22 bp, Homo sapiens
ggccccagcctcagtcccctga

SEQ ID NO: 7549391 - DNA, 22 bp, Homo sapiens
ggccccagcctcagtcccctga

SEQ ID NO: 7549392 - DNA, 22 bp, Homo sapiens
ggccccagctgtggtgaataga

SEQ ID NO: 7549393 - DNA, 22 bp, Homo sapiens
ggccccagctgtggtgaataga

SEQ ID NO: 7549394 - DNA, 22 bp, Homo sapiens
ggccccagcctcagtcccctga

SEQ ID NO: 7549395 - DNA, 19 bp, Homo sapiens
cacattttgagtctgagat

SEQ ID NO: 7549396 - DNA, 22 bp, Homo sapiens
cacatttttactgccaacttaa

SEQ ID NO: 7549397 - DNA, 22 bp, Homo sapiens
cacatttttactgccaacttaa

SEQ ID NO: 7549398 - DNA, 22 bp, Homo sapiens
cacatttttactgccaacttaa

SEQ ID NO: 7549399 - DNA, 22 bp, Homo sapiens
cacatttttactgccaacttaa

SEQ ID NO: 7549400 - DNA, 22 bp, Homo sapiens
cacatttttactgccaacttaa

SEQ ID NO: 7549401 - DNA, 19 bp, Homo sapiens
cacattttgagtctgagat

SEQ ID NO: 7549402 - DNA, 22 bp, Homo sapiens
cacatttgaaggaattagcatt

SEQ ID NO: 7549403 - DNA, 19 bp, Homo sapiens
cacattttgagtctgagat

SEQ ID NO: 7549404 - DNA, 19 bp, Homo sapiens
cacattttgagtctgagat

SEQ ID NO: 7549405 - DNA, 19 bp, Homo sapiens
cacattttgagtctgagat

SEQ ID NO: 7549406 - DNA, 19 bp, Homo sapiens
cacattttgagtctgagat

SEQ ID NO: 7549407 - DNA, 21 bp, Homo sapiens
cacatttgaacctcacagcaa

SEQ ID NO: 7549408 - DNA, 21 bp, Homo sapiens
cacatttgaacctcacagcaa

SEQ ID NO: 7549409 - DNA, 21 bp, Homo sapiens
cacatttgaacctcacagcaa

SEQ ID NO: 7549410 - DNA, 22 bp, Homo sapiens
cacatttgaaggaattagcatt

SEQ ID NO: 7549411 - DNA, 22 bp, Homo sapiens
cacatttgaaggaattagcatt

SEQ ID NO: 7549412 - DNA, 22 bp, Homo sapiens
cacatttgaaggaattagcatt

SEQ ID NO: 7549413 - DNA, 22 bp, Homo sapiens
cacatttgaaggaattagcatt

SEQ ID NO: 7549414 - DNA, 19 bp, Homo sapiens
cacattttgagtctgagat

SEQ ID NO: 7549415 - DNA, 19 bp, Homo sapiens
cacattttgagtctgagat

SEQ ID NO: 7549416 - DNA, 19 bp, Homo sapiens
cacattttgagtctgagat

SEQ ID NO: 7549417 - DNA, 22 bp, Homo sapiens
caccaataattttatatcacat

SEQ ID NO: 7549418 - DNA, 20 bp, Homo sapiens
caccaagctaaggttacttt

SEQ ID NO: 7549419 - DNA, 19 bp, Homo sapiens
caccaagatggctctagtc

SEQ ID NO: 7549420 - DNA, 17 bp, Homo sapiens
caccaattaagaccctc

SEQ ID NO: 7549421 - DNA, 20 bp, Homo sapiens
caccacagaattggggacag

SEQ ID NO: 7549422 - DNA, 22 bp, Homo sapiens
caccaagaatcttcacttttta

SEQ ID NO: 7549423 - DNA, 19 bp, Homo sapiens
caccaagatggctctagtc

SEQ ID NO: 7549424 - DNA, 21 bp, Homo sapiens
caccaacacctgggataggtc

SEQ ID NO: 7549425 - DNA, 22 bp, Homo sapiens
caccaagactgtataccaggca

SEQ ID NO: 7549426 - DNA, 22 bp, Homo sapiens
cacatttttactgccaacttaa

SEQ ID NO: 7549427 - DNA, 22 bp, Homo sapiens
caccaaagtcgcttctgtcgtc

SEQ ID NO: 7549428 - DNA, 21 bp, Homo sapiens
caccaacacctgggataggtc

SEQ ID NO: 7549429 - DNA, 22 bp, Homo sapiens
caccacagcatccactagaagg

SEQ ID NO: 7549430 - DNA, 22 bp, Homo sapiens
caccacagcatccactagaagg

SEQ ID NO: 7549431 - DNA, 22 bp, Homo sapiens
caccacagcatccactagaagg

SEQ ID NO: 7549432 - DNA, 22 bp, Homo sapiens
caccacagcatccactagaagg

SEQ ID NO: 7549433 - DNA, 22 bp, Homo sapiens
caccacagcatccactagaagg

SEQ ID NO: 7549434 - DNA, 22 bp, Homo sapiens
caccacagcatccactagaagg

SEQ ID NO: 7549435 - DNA, 22 bp, Homo sapiens
caccaccaggcaggacaccgaa

SEQ ID NO: 7549436 - DNA, 22 bp, Homo sapiens
caccactgaattgttcactttc

SEQ ID NO: 7549437 - DNA, 22 bp, Homo sapiens
caccactgaattgttcactttc

SEQ ID NO: 7549438 - DNA, 22 bp, Homo sapiens
ggccagcctggggctcccagac

SEQ ID NO: 7549439 - DNA, 22 bp, Homo sapiens
ggccagcctggggctcccagac

SEQ ID NO: 7549440 - DNA, 22 bp, Homo sapiens
ggccagcctggggctcccagac

SEQ ID NO: 7549441 - DNA, 22 bp, Homo sapiens
ggccagcctggggctcccagac

SEQ ID NO: 7549442 - DNA, 22 bp, Homo sapiens
ggccagctacccatctgcgtca

SEQ ID NO: 7549443 - DNA, 22 bp, Homo sapiens
ggccagctacccatctgcgtca

SEQ ID NO: 7549444 - DNA, 22 bp, Homo sapiens
ggccagcggcacagcctggccc

SEQ ID NO: 7549445 - DNA, 22 bp, Homo sapiens
ggccagcggcacagcctggccc

SEQ ID NO: 7549446 - DNA, 22 bp, Homo sapiens
ggccagcctggggctcccagac

SEQ ID NO: 7549447 - DNA, 22 bp, Homo sapiens
ggccagcctggggctcccagac

SEQ ID NO: 7549448 - DNA, 22 bp, Homo sapiens
ggccagcctggggctcccagac

SEQ ID NO: 7549449 - DNA, 22 bp, Homo sapiens
ggccagcctggggctcccagac

SEQ ID NO: 7549450 - DNA, 22 bp, Homo sapiens
ggccagcctggggctcccagac

SEQ ID NO: 7549451 - DNA, 22 bp, Homo sapiens
ggccagccctcctccctgggtt

SEQ ID NO: 7549452 - DNA, 22 bp, Homo sapiens
ggccagcctggggctcccagac

SEQ ID NO: 7549453 - DNA, 22 bp, Homo sapiens
ggccagcctggggctcccagac

SEQ ID NO: 7549454 - DNA, 22 bp, Homo sapiens
ggccagccctcctccctgggtt

SEQ ID NO: 7549455 - DNA, 22 bp, Homo sapiens
ggccagccctcctccctgggtt

SEQ ID NO: 7549456 - DNA, 22 bp, Homo sapiens
ggccagccctcctccctgggtt

SEQ ID NO: 7549457 - DNA, 22 bp, Homo sapiens
ggccagccctcctccctgggtt

SEQ ID NO: 7549458 - DNA, 22 bp, Homo sapiens
ggccagcccagtggtcctctct

SEQ ID NO: 7549459 - DNA, 22 bp, Homo sapiens
ggccagcccagtggtcctctct

SEQ ID NO: 7549460 - DNA, 22 bp, Homo sapiens
ggccactgtttcctgggcagtt

SEQ ID NO: 7549461 - DNA, 22 bp, Homo sapiens
ggccactgtttcctgggcagtt

SEQ ID NO: 7549462 - DNA, 22 bp, Homo sapiens
ggccactttcatagcaagtgtg

SEQ ID NO: 7549463 - DNA, 22 bp, Homo sapiens
ggccactttcatagcaagtgtg

SEQ ID NO: 7549464 - DNA, 23 bp, Homo sapiens
ggccactttgtgtcagtatgtgc

SEQ ID NO: 7549465 - DNA, 23 bp, Homo sapiens
ggccactttgtgtcagtatgtgc

SEQ ID NO: 7549466 - DNA, 22 bp, Homo sapiens
ggccagccctcctccctgggtt

SEQ ID NO: 7549467 - DNA, 18 bp, Homo sapiens
ggccagccccaggccagc

SEQ ID NO: 7549468 - DNA, 18 bp, Homo sapiens
ggccagccccaggccagc

SEQ ID NO: 7549469 - DNA, 18 bp, Homo sapiens
ggccagccccaggccagc

SEQ ID NO: 7549470 - DNA, 18 bp, Homo sapiens
ggccagccccaggccagc

SEQ ID NO: 7549471 - DNA, 18 bp, Homo sapiens
ggccagccccaggccagc

SEQ ID NO: 7549472 - DNA, 18 bp, Homo sapiens
ggccagccccaggccagc

SEQ ID NO: 7549473 - DNA, 18 bp, Homo sapiens
ggccagccccaggccagc

SEQ ID NO: 7549474 - DNA, 18 bp, Homo sapiens
ggccagccccaggccagc

SEQ ID NO: 7549475 - DNA, 22 bp, Homo sapiens
cacccaggctagagtgcagtgg

SEQ ID NO: 7549476 - DNA, 22 bp, Homo sapiens
cacccaggctagagtgcagtgg

SEQ ID NO: 7549477 - DNA, 22 bp, Homo sapiens
cacccaggcatgggttgagatg

SEQ ID NO: 7549478 - DNA, 22 bp, Homo sapiens
cacccaggcaggtggctgagaa

SEQ ID NO: 7549479 - DNA, 22 bp, Homo sapiens
cacccaggcatgggttgagatg

SEQ ID NO: 7549480 - DNA, 22 bp, Homo sapiens
cacccaggcatgggttgagatg

SEQ ID NO: 7549481 - DNA, 22 bp, Homo sapiens
cacccaggcaggtggctgagaa

SEQ ID NO: 7549482 - DNA, 22 bp, Homo sapiens
cacccaggcaggtggctgagaa

SEQ ID NO: 7549483 - DNA, 22 bp, Homo sapiens
cacccaggcaggtggctgagaa

SEQ ID NO: 7549484 - DNA, 22 bp, Homo sapiens
cacccaggcaggtggctgagaa

SEQ ID NO: 7549485 - DNA, 22 bp, Homo sapiens
ggccagggcctggggactgtcc

SEQ ID NO: 7549486 - DNA, 22 bp, Homo sapiens
ggccagggcctggggactgtcc

SEQ ID NO: 7549487 - DNA, 22 bp, Homo sapiens
ggccagggcctggggactgtcc

SEQ ID NO: 7549488 - DNA, 22 bp, Homo sapiens
ggccagggcctggggactgtcc

SEQ ID NO: 7549489 - DNA, 22 bp, Homo sapiens
ggccagggcctggggactgtcc

SEQ ID NO: 7549490 - DNA, 22 bp, Homo sapiens
ggccagggccaaggctttccca

SEQ ID NO: 7549491 - DNA, 22 bp, Homo sapiens
cacccaggcatgggttgagatg

SEQ ID NO: 7549492 - DNA, 22 bp, Homo sapiens
cacccaggctagagtgcagtgg

SEQ ID NO: 7549493 - DNA, 22 bp, Homo sapiens
cacccaggctagagtgcagtgg

SEQ ID NO: 7549494 - DNA, 22 bp, Homo sapiens
cacccaggctagagtgcagtgg

SEQ ID NO: 7549495 - DNA, 22 bp, Homo sapiens
cacccaggctagagtgcagtgg

SEQ ID NO: 7549496 - DNA, 22 bp, Homo sapiens
cacccaggaggttgggaagggc

SEQ ID NO: 7549497 - DNA, 22 bp, Homo sapiens
cacccaggaggttgggaagggc

SEQ ID NO: 7549498 - DNA, 22 bp, Homo sapiens
cacccaggacaggccagatgtg

SEQ ID NO: 7549499 - DNA, 22 bp, Homo sapiens
cacccaggacaggccagatgtg

SEQ ID NO: 7549500 - DNA, 22 bp, Homo sapiens
cacccaggacaggccagatgtg

SEQ ID NO: 7549501 - DNA, 22 bp, Homo sapiens
cacccaggacaggccagatgtg

SEQ ID NO: 7549502 - DNA, 22 bp, Homo sapiens
cacccaggacaggccagatgtg

SEQ ID NO: 7549503 - DNA, 22 bp, Homo sapiens
cacccaggacaggccagatgtg

SEQ ID NO: 7549504 - DNA, 22 bp, Homo sapiens
cacccaggacaggccagatgtg

SEQ ID NO: 7549505 - DNA, 22 bp, Homo sapiens
cacccaggcaggtggctgagaa

SEQ ID NO: 7549506 - DNA, 22 bp, Homo sapiens
cacccaggcaggtggctgagaa

SEQ ID NO: 7549507 - DNA, 22 bp, Homo sapiens
cacccaggcaggtggctgagaa

SEQ ID NO: 7549508 - DNA, 22 bp, Homo sapiens
cacccaggcaggtggctgagaa

SEQ ID NO: 7549509 - DNA, 22 bp, Homo sapiens
cacccaggcaggtggctgagaa

SEQ ID NO: 7549510 - DNA, 22 bp, Homo sapiens
cacccaggcaaggattctgcaa

SEQ ID NO: 7549511 - DNA, 22 bp, Homo sapiens
cacccaggcaggtggctgagaa

SEQ ID NO: 7549512 - DNA, 22 bp, Homo sapiens
cacccagccttcacacaggagt

SEQ ID NO: 7549513 - DNA, 22 bp, Homo sapiens
cacccagccttcacacaggagt

SEQ ID NO: 7549514 - DNA, 22 bp, Homo sapiens
cacccagccttcacacaggagt

SEQ ID NO: 7549515 - DNA, 22 bp, Homo sapiens
cacccagcattggctaagagag

SEQ ID NO: 7549516 - DNA, 22 bp, Homo sapiens
cacccagcattggctaagagag

SEQ ID NO: 7549517 - DNA, 21 bp, Homo sapiens
ggccagctcggaaggtcccat

SEQ ID NO: 7549518 - DNA, 21 bp, Homo sapiens
ggccagctcggaaggtcccat

SEQ ID NO: 7549519 - DNA, 22 bp, Homo sapiens
cacccagcttttgcatcctccg

SEQ ID NO: 7549520 - DNA, 22 bp, Homo sapiens
cacccagcttttgcatcctccg

SEQ ID NO: 7549521 - DNA, 22 bp, Homo sapiens
cacccagccttcacacaggagt

SEQ ID NO: 7549522 - DNA, 22 bp, Homo sapiens
cacccagccttcacacaggagt

SEQ ID NO: 7549523 - DNA, 22 bp, Homo sapiens
cacccagccttcacacaggagt

SEQ ID NO: 7549524 - DNA, 22 bp, Homo sapiens
cacccagcttttgcatcctccg

SEQ ID NO: 7549525 - DNA, 22 bp, Homo sapiens
cacccaggacaaaatatggaat

SEQ ID NO: 7549526 - DNA, 22 bp, Homo sapiens
cacccagcttttgcatcctccg

SEQ ID NO: 7549527 - DNA, 22 bp, Homo sapiens
cacccaggacaaaatatggaat

SEQ ID NO: 7549528 - DNA, 22 bp, Homo sapiens
cacccaggacaaaatatggaat

SEQ ID NO: 7549529 - DNA, 22 bp, Homo sapiens
ggccagctcagggtccttgggc

SEQ ID NO: 7549530 - DNA, 22 bp, Homo sapiens
ggccagctcagggtccttgggc

SEQ ID NO: 7549531 - DNA, 22 bp, Homo sapiens
ggccagctcagtctccatcagg

SEQ ID NO: 7549532 - DNA, 22 bp, Homo sapiens
ggccagctcagtctccatcagg

SEQ ID NO: 7549533 - DNA, 22 bp, Homo sapiens
ggccagctcagggtccttgggc

SEQ ID NO: 7549534 - DNA, 22 bp, Homo sapiens
ggccagctcagggtccttgggc

SEQ ID NO: 7549535 - DNA, 22 bp, Homo sapiens
ggccagctcagactccacttgc

SEQ ID NO: 7549536 - DNA, 22 bp, Homo sapiens
ggccagctacccatctgcgtca

SEQ ID NO: 7549537 - DNA, 22 bp, Homo sapiens
ggccagctacccatctgcgtca

SEQ ID NO: 7549538 - DNA, 18 bp, Homo sapiens
ggccagctcctgaggcag

SEQ ID NO: 7549539 - DNA, 18 bp, Homo sapiens
ggccagctcctgaggcag

SEQ ID NO: 7549540 - DNA, 22 bp, Homo sapiens
ggccagctccttggcagtgcct

SEQ ID NO: 7549541 - DNA, 22 bp, Homo sapiens
ggccagctccttggcagtgcct

SEQ ID NO: 7549542 - DNA, 22 bp, Homo sapiens
ggccagctccttggcagtgcct

SEQ ID NO: 7549543 - DNA, 22 bp, Homo sapiens
ggccagctccttggcagtgcct

SEQ ID NO: 7549544 - DNA, 22 bp, Homo sapiens
ggccagctccttggcagtgcct

SEQ ID NO: 7549545 - DNA, 20 bp, Homo sapiens
ggatcagatggagcctctgc

SEQ ID NO: 7549546 - DNA, 22 bp, Homo sapiens
ggatcagaggatcagggacagt

SEQ ID NO: 7549547 - DNA, 22 bp, Homo sapiens
ggatcagaggatcagggacagt

SEQ ID NO: 7549548 - DNA, 22 bp, Homo sapiens
ggatcagaacgtgatggctgtg

SEQ ID NO: 7549549 - DNA, 22 bp, Homo sapiens
ggatcacacatgcactgtttga

SEQ ID NO: 7549550 - DNA, 22 bp, Homo sapiens
ggatcaagaaagtcagatgaag

SEQ ID NO: 7549551 - DNA, 22 bp, Homo sapiens
ggatcaagaaagtcagatgaag

SEQ ID NO: 7549552 - DNA, 22 bp, Homo sapiens
ggatcagaatctctgagagttt

SEQ ID NO: 7549553 - DNA, 22 bp, Homo sapiens
ggatcagaacgtgatggctgtg

SEQ ID NO: 7549554 - DNA, 22 bp, Homo sapiens
ggatcagaatctctgagagttt

SEQ ID NO: 7549555 - DNA, 22 bp, Homo sapiens
ggatcagaatctctgagagttt

SEQ ID NO: 7549556 - DNA, 22 bp, Homo sapiens
ggatcaggcgccatgggaagtg

SEQ ID NO: 7549557 - DNA, 22 bp, Homo sapiens
ggatcaggcgccatgggaagtg

SEQ ID NO: 7549558 - DNA, 22 bp, Homo sapiens
ggatcaggcgccatgggaagtg

SEQ ID NO: 7549559 - DNA, 22 bp, Homo sapiens
ggatcaggctgaagctaggact

SEQ ID NO: 7549560 - DNA, 22 bp, Homo sapiens
ggatcaggctgaagctaggact

SEQ ID NO: 7549561 - DNA, 22 bp, Homo sapiens
ggatcaggctgaagctaggact

SEQ ID NO: 7549562 - DNA, 22 bp, Homo sapiens
ggatcaggctgaagctaggact

SEQ ID NO: 7549563 - DNA, 22 bp, Homo sapiens
ggatcaggctgaagctaggact

SEQ ID NO: 7549564 - DNA, 22 bp, Homo sapiens
ggatcagggctggggatattct

SEQ ID NO: 7549565 - DNA, 22 bp, Homo sapiens
ggatccagaggtgaagatggga

SEQ ID NO: 7549566 - DNA, 22 bp, Homo sapiens
ggatccagaggtgaagatggga

SEQ ID NO: 7549567 - DNA, 19 bp, Homo sapiens
ggatccagaggatctgcca

SEQ ID NO: 7549568 - DNA, 19 bp, Homo sapiens
ggataaggttggagtgatc

SEQ ID NO: 7549569 - DNA, 22 bp, Homo sapiens
ggataatgaaatggtagtggtt

SEQ ID NO: 7549570 - DNA, 22 bp, Homo sapiens
ggataatgaaatggtagtggtt

SEQ ID NO: 7549571 - DNA, 22 bp, Homo sapiens
ggatacaactagaagatggcag

SEQ ID NO: 7549572 - DNA, 23 bp, Homo sapiens
ggatacaaagattaatagtagag

SEQ ID NO: 7549573 - DNA, 22 bp, Homo sapiens
ggatagccgggtgttgtgggct

SEQ ID NO: 7549574 - DNA, 22 bp, Homo sapiens
ggatacaactagaagatggcag

SEQ ID NO: 7549575 - DNA, 22 bp, Homo sapiens
ggataagcaactatgatggaga

SEQ ID NO: 7549576 - DNA, 22 bp, Homo sapiens
ggataagaaaattgtaataact

SEQ ID NO: 7549577 - DNA, 22 bp, Homo sapiens
ggataagaaaattgtaataact

SEQ ID NO: 7549578 - DNA, 22 bp, Homo sapiens
ggataaagtctttaggtggaca

SEQ ID NO: 7549579 - DNA, 23 bp, Homo sapiens
ggataaatctcagcttcttccat

SEQ ID NO: 7549580 - DNA, 22 bp, Homo sapiens
ggataggaattgagatgctatt

SEQ ID NO: 7549581 - DNA, 22 bp, Homo sapiens
ggataggaattgagatgctatt

SEQ ID NO: 7549582 - DNA, 22 bp, Homo sapiens
ggatagttctggatattttaag

SEQ ID NO: 7549583 - DNA, 22 bp, Homo sapiens
ggatagtgggagaatgctatgt

SEQ ID NO: 7549584 - DNA, 22 bp, Homo sapiens
ggatattctttatagatacagt

SEQ ID NO: 7549585 - DNA, 22 bp, Homo sapiens
ggatcaaagggaacctgttagg

SEQ ID NO: 7549586 - DNA, 22 bp, Homo sapiens
ggatcaaagggaacctgttagg

SEQ ID NO: 7549587 - DNA, 22 bp, Homo sapiens
ggatatgacgagtttggtgatt

SEQ ID NO: 7549588 - DNA, 22 bp, Homo sapiens
ggatatctgccccatgagtcac

SEQ ID NO: 7549589 - DNA, 22 bp, Homo sapiens
ggatatcaaattattaggtaga

SEQ ID NO: 7549590 - DNA, 22 bp, Homo sapiens
ggatatatgcatgttatcattt

SEQ ID NO: 7549591 - DNA, 22 bp, Homo sapiens
ggcaggaaatgggataagggct

SEQ ID NO: 7549592 - DNA, 22 bp, Homo sapiens
ggcaggaaatgggataagggct

SEQ ID NO: 7549593 - DNA, 22 bp, Homo sapiens
ggcaggaaaacaatgagccagg

SEQ ID NO: 7549594 - DNA, 22 bp, Homo sapiens
ggcaggaaaacaatgagccagg

SEQ ID NO: 7549595 - DNA, 22 bp, Homo sapiens
ggcaggaaaacaatgagccagg

SEQ ID NO: 7549596 - DNA, 22 bp, Homo sapiens
ggcaggaaaacaatgagccagg

SEQ ID NO: 7549597 - DNA, 22 bp, Homo sapiens
ggcagcttttccaggctctcca

SEQ ID NO: 7549598 - DNA, 22 bp, Homo sapiens
ggcagcttttccaggctctcca

SEQ ID NO: 7549599 - DNA, 22 bp, Homo sapiens
ggcaggaaaacaatgagccagg

SEQ ID NO: 7549600 - DNA, 22 bp, Homo sapiens
ggcaggaaaacaatgagccagg

SEQ ID NO: 7549601 - DNA, 22 bp, Homo sapiens
ggcaggaaaacaatgagccagg

SEQ ID NO: 7549602 - DNA, 22 bp, Homo sapiens
ggcagctgcaaatctgctctgt

SEQ ID NO: 7549603 - DNA, 22 bp, Homo sapiens
ggcagctgcaaatctgctctgt

SEQ ID NO: 7549604 - DNA, 22 bp, Homo sapiens
ggcagcttttatccctgacaga

SEQ ID NO: 7549605 - DNA, 22 bp, Homo sapiens
ggcagctgcaaatctgctctgt

SEQ ID NO: 7549606 - DNA, 22 bp, Homo sapiens
ggcagctgcaaatctgctctgt

SEQ ID NO: 7549607 - DNA, 22 bp, Homo sapiens
ggcagctgcaaatctgctctgt

SEQ ID NO: 7549608 - DNA, 22 bp, Homo sapiens
ggcagctgcaaatctgctctgt

SEQ ID NO: 7549609 - DNA, 22 bp, Homo sapiens
ggatcctgatatgtgtttctca

SEQ ID NO: 7549610 - DNA, 22 bp, Homo sapiens
ggcagctgcaaatctgctctgt

SEQ ID NO: 7549611 - DNA, 22 bp, Homo sapiens
ggatccagaggtgaagatggga

SEQ ID NO: 7549612 - DNA, 22 bp, Homo sapiens
ggatccagtccagggctgtgtg

SEQ ID NO: 7549613 - DNA, 22 bp, Homo sapiens
ggatccagtccagggctgtgtg

SEQ ID NO: 7549614 - DNA, 22 bp, Homo sapiens
ggatccagtccagggctgtgtg

SEQ ID NO: 7549615 - DNA, 22 bp, Homo sapiens
ggcaggaacacagatggtgccg

SEQ ID NO: 7549616 - DNA, 22 bp, Homo sapiens
ggcaggaagaggagggtgaact

SEQ ID NO: 7549617 - DNA, 22 bp, Homo sapiens
ggcaggaagaggagggtgaact

SEQ ID NO: 7549618 - DNA, 22 bp, Homo sapiens
ggcaggaagaggagggtgaact

SEQ ID NO: 7549619 - DNA, 22 bp, Homo sapiens
ggcaggaagaggagggtgaact

SEQ ID NO: 7549620 - DNA, 22 bp, Homo sapiens
ggcaggaacacagatggtgccg

SEQ ID NO: 7549621 - DNA, 22 bp, Homo sapiens
ggcaggaacacagatggtgccg

SEQ ID NO: 7549622 - DNA, 22 bp, Homo sapiens
ggcaggaagcattaaaacgatt

SEQ ID NO: 7549623 - DNA, 22 bp, Homo sapiens
ggcaggaagctcatgtggactg

SEQ ID NO: 7549624 - DNA, 22 bp, Homo sapiens
ggcaggaagaggagggtgaact

SEQ ID NO: 7549625 - DNA, 22 bp, Homo sapiens
ggcaggaagcattaaaacgatt

SEQ ID NO: 7549626 - DNA, 22 bp, Homo sapiens
ggcaggaagcattaaaacgatt

SEQ ID NO: 7549627 - DNA, 22 bp, Homo sapiens
ggcaggaagtagcagtctgagc

SEQ ID NO: 7549628 - DNA, 22 bp, Homo sapiens
ggcaggaagctcatgtggactg

SEQ ID NO: 7549629 - DNA, 22 bp, Homo sapiens
ggcaggaagctcatgtggactg

SEQ ID NO: 7549630 - DNA, 22 bp, Homo sapiens
ggcaggaagctcatgtggactg

SEQ ID NO: 7549631 - DNA, 22 bp, Homo sapiens
ggcaggaagctcatgtggactg

SEQ ID NO: 7549632 - DNA, 22 bp, Homo sapiens
ggcaggaagtagcagtctgagc

SEQ ID NO: 7549633 - DNA, 22 bp, Homo sapiens
ggcaggaagtagcagtctgagc

SEQ ID NO: 7549634 - DNA, 22 bp, Homo sapiens
ggcaggaataaattatggactt

SEQ ID NO: 7549635 - DNA, 22 bp, Homo sapiens
ggcaggaagtagcagtctgagc

SEQ ID NO: 7549636 - DNA, 22 bp, Homo sapiens
ggcaggaagtagcagtctgagc

SEQ ID NO: 7549637 - DNA, 23 bp, Homo sapiens
ggataaatctcagcttcttccat

SEQ ID NO: 7549638 - DNA, 23 bp, Homo sapiens
ggataaatctcagcttcttccat

SEQ ID NO: 7549639 - DNA, 21 bp, Homo sapiens
ggagtttttctggaagggact

SEQ ID NO: 7549640 - DNA, 22 bp, Homo sapiens
ggataaagtctttaggtggaca

SEQ ID NO: 7549641 - DNA, 21 bp, Homo sapiens
ggagtttttctggaagggact

SEQ ID NO: 7549642 - DNA, 22 bp, Homo sapiens
ggagtttgcctattgcttttgg

SEQ ID NO: 7549643 - DNA, 22 bp, Homo sapiens
ggagtttcttgagcccttaagg

SEQ ID NO: 7549644 - DNA, 22 bp, Homo sapiens
ggagtgagcaaatagagatttg

SEQ ID NO: 7549645 - DNA, 22 bp, Homo sapiens
ggagtgactctcggggccacta

SEQ ID NO: 7549646 - DNA, 22 bp, Homo sapiens
ggagtgactctcggggccacta

SEQ ID NO: 7549647 - DNA, 22 bp, Homo sapiens
ggagtgactctcggggccacta

SEQ ID NO: 7549648 - DNA, 22 bp, Homo sapiens
ggagtgactctcggggccacta

SEQ ID NO: 7549649 - DNA, 22 bp, Homo sapiens
ggagtgactcacagctgggaca

SEQ ID NO: 7549650 - DNA, 22 bp, Homo sapiens
ggagtgactctcggggccacta

SEQ ID NO: 7549651 - DNA, 22 bp, Homo sapiens
ggagtgaagcaaataatgctgg

SEQ ID NO: 7549652 - DNA, 22 bp, Homo sapiens
ggagtgaagcaaataatgctgg

SEQ ID NO: 7549653 - DNA, 22 bp, Homo sapiens
ggagtgaagtggcgcgatctcg

SEQ ID NO: 7549654 - DNA, 22 bp, Homo sapiens
ggagtgaagtggcgcgatctcg

SEQ ID NO: 7549655 - DNA, 22 bp, Homo sapiens
ggagtgaataagtagggggaaa

SEQ ID NO: 7549656 - DNA, 22 bp, Homo sapiens
ggagtgaatcactagatgcaga

SEQ ID NO: 7549657 - DNA, 22 bp, Homo sapiens
ggagtgaatcactagatgcaga

SEQ ID NO: 7549658 - DNA, 22 bp, Homo sapiens
ggagtgaatcactagatgcaga

SEQ ID NO: 7549659 - DNA, 22 bp, Homo sapiens
ggagtgaatcactagatgcaga

SEQ ID NO: 7549660 - DNA, 22 bp, Homo sapiens
ggagtgaatcactagatgcaga

SEQ ID NO: 7549661 - DNA, 22 bp, Homo sapiens
ggagtgactcacagctgggaca

SEQ ID NO: 7549662 - DNA, 22 bp, Homo sapiens
ggagtgactcacagctgggaca

SEQ ID NO: 7549663 - DNA, 22 bp, Homo sapiens
ggagtgactcacagctgggaca

SEQ ID NO: 7549664 - DNA, 22 bp, Homo sapiens
ggagtgactcacagctgggaca

SEQ ID NO: 7549665 - DNA, 22 bp, Homo sapiens
ggagtgactcacagctgggaca

SEQ ID NO: 7549666 - DNA, 22 bp, Homo sapiens
ggagtgactcacagctgggaca

SEQ ID NO: 7549667 - DNA, 22 bp, Homo sapiens
ggagtgactcacagctgggaca

SEQ ID NO: 7549668 - DNA, 22 bp, Homo sapiens
ggagtgactcacagctgggaca

SEQ ID NO: 7549669 - DNA, 22 bp, Homo sapiens
ggagtgactcacagctgggaca

SEQ ID NO: 7549670 - DNA, 22 bp, Homo sapiens
ggagtctgtgtcttgaagcagt

SEQ ID NO: 7549671 - DNA, 22 bp, Homo sapiens
ggagtctgtgtcttgaagcagt

SEQ ID NO: 7549672 - DNA, 22 bp, Homo sapiens
ggagtctgtgtcttgaagcagt

SEQ ID NO: 7549673 - DNA, 21 bp, Homo sapiens
ggagtctgtggatgctgtttc

SEQ ID NO: 7549674 - DNA, 22 bp, Homo sapiens
ggagtctgggaattggagagaa

SEQ ID NO: 7549675 - DNA, 22 bp, Homo sapiens
ggagtctgggaattggagagaa

SEQ ID NO: 7549676 - DNA, 22 bp, Homo sapiens
ggagtctgggaattggagagaa

SEQ ID NO: 7549677 - DNA, 22 bp, Homo sapiens
ggagtctgggaattggagagaa

SEQ ID NO: 7549678 - DNA, 22 bp, Homo sapiens
ggagtctgttttacatgcagga

SEQ ID NO: 7549679 - DNA, 22 bp, Homo sapiens
ggagtctgttttacatgcagga

SEQ ID NO: 7549680 - DNA, 22 bp, Homo sapiens
ggagtctgttttacatgcagga

SEQ ID NO: 7549681 - DNA, 22 bp, Homo sapiens
ggagtcttggcctgctgagaaa

SEQ ID NO: 7549682 - DNA, 22 bp, Homo sapiens
ggagtctgttttacatgcagga

SEQ ID NO: 7549683 - DNA, 22 bp, Homo sapiens
ggagtcttggcctgctgagaaa

SEQ ID NO: 7549684 - DNA, 22 bp, Homo sapiens
ggagtctgggaattggagagaa

SEQ ID NO: 7549685 - DNA, 22 bp, Homo sapiens
ggagtctgggaattggagagaa

SEQ ID NO: 7549686 - DNA, 22 bp, Homo sapiens
ggagtctgggaattggagagaa

SEQ ID NO: 7549687 - DNA, 22 bp, Homo sapiens
ggagtctggagtggggcccaag

SEQ ID NO: 7549688 - DNA, 22 bp, Homo sapiens
ggagtctggagtggggcccaag

SEQ ID NO: 7549689 - DNA, 22 bp, Homo sapiens
ggagtctgcggcagacactgta

SEQ ID NO: 7549690 - DNA, 22 bp, Homo sapiens
ggagtctgctcccagacatgat

SEQ ID NO: 7549691 - DNA, 22 bp, Homo sapiens
ggagtctgctcccagacatgat

SEQ ID NO: 7549692 - DNA, 22 bp, Homo sapiens
ggagtctgctcccagacatgat

SEQ ID NO: 7549693 - DNA, 22 bp, Homo sapiens
ggaggtggaggttgcagtgagc

SEQ ID NO: 7549694 - DNA, 22 bp, Homo sapiens
ggagtctgattttttatgggtg

SEQ ID NO: 7549695 - DNA, 22 bp, Homo sapiens
ggaggtggaggttgcagtgagc

SEQ ID NO: 7549696 - DNA, 22 bp, Homo sapiens
ggagtctgcggcagacactgta

SEQ ID NO: 7549697 - DNA, 22 bp, Homo sapiens
cacaggagattgatctattggt

SEQ ID NO: 7549698 - DNA, 22 bp, Homo sapiens
ggaggtggaggttgcagtgagc

SEQ ID NO: 7549699 - DNA, 22 bp, Homo sapiens
ggaggtggaggttgcagtgagc

SEQ ID NO: 7549700 - DNA, 22 bp, Homo sapiens
ggaggtggaggttgcagtgagc

SEQ ID NO: 7549701 - DNA, 22 bp, Homo sapiens
ggaggtggaggttgcagtgagc

SEQ ID NO: 7549702 - DNA, 22 bp, Homo sapiens
ggcaggagaaaggtctcttctt

SEQ ID NO: 7549703 - DNA, 22 bp, Homo sapiens
ggcaggagaaaggtctcttctt

SEQ ID NO: 7549704 - DNA, 22 bp, Homo sapiens
ggcaggagaaaggtctcttctt

SEQ ID NO: 7549705 - DNA, 22 bp, Homo sapiens
ggcaggagaaaggtctcttctt

SEQ ID NO: 7549706 - DNA, 22 bp, Homo sapiens
ggcaggagaaaggtctcttctt

SEQ ID NO: 7549707 - DNA, 22 bp, Homo sapiens
ggcaggactcttctgtgggccg

SEQ ID NO: 7549708 - DNA, 22 bp, Homo sapiens
ggcaggactcttctgtgggccg

SEQ ID NO: 7549709 - DNA, 22 bp, Homo sapiens
ggcaggactgatcagtgggatg

SEQ ID NO: 7549710 - DNA, 22 bp, Homo sapiens
ggcaggactcttctgtgggccg

SEQ ID NO: 7549711 - DNA, 22 bp, Homo sapiens
ggcaggactgatcagtgggatg

SEQ ID NO: 7549712 - DNA, 22 bp, Homo sapiens
ggcaggactgatcagtgggatg

SEQ ID NO: 7549713 - DNA, 22 bp, Homo sapiens
cacatgcaggagccaatgtaca

SEQ ID NO: 7549714 - DNA, 23 bp, Homo sapiens
cacatgcaggcagtggccttcaa

SEQ ID NO: 7549715 - DNA, 23 bp, Homo sapiens
cacatgcaggcagtggccttcaa

SEQ ID NO: 7549716 - DNA, 23 bp, Homo sapiens
cacatgcaggcagtggccttcaa

SEQ ID NO: 7549717 - DNA, 22 bp, Homo sapiens
ggcaggagaaaggtctcttctt

SEQ ID NO: 7549718 - DNA, 22 bp, Homo sapiens
cacatgcaggagccaatgtaca

SEQ ID NO: 7549719 - DNA, 22 bp, Homo sapiens
cacatgcagtttacgtcactga

SEQ ID NO: 7549720 - DNA, 22 bp, Homo sapiens
cacatgcagtttacgtcactga

SEQ ID NO: 7549721 - DNA, 22 bp, Homo sapiens
cacatgcagtttacgtcactga

SEQ ID NO: 7549722 - DNA, 22 bp, Homo sapiens
cacatgcagtttacgtcactga

SEQ ID NO: 7549723 - DNA, 23 bp, Homo sapiens
cacatgcaggcagtggccttcaa

SEQ ID NO: 7549724 - DNA, 23 bp, Homo sapiens
cacatgcaggcagtggccttcaa

SEQ ID NO: 7549725 - DNA, 20 bp, Homo sapiens
ggcaggaccccagtggcatc

SEQ ID NO: 7549726 - DNA, 20 bp, Homo sapiens
ggcaggaccccagtggcatc

SEQ ID NO: 7549727 - DNA, 20 bp, Homo sapiens
ggcaggaccccagtggcatc

SEQ ID NO: 7549728 - DNA, 20 bp, Homo sapiens
ggcaggaccccagtggcatc

SEQ ID NO: 7549729 - DNA, 20 bp, Homo sapiens
ggcaggaccccagtggcatc

SEQ ID NO: 7549730 - DNA, 22 bp, Homo sapiens
ggcaggacagtcccagttcaaa

SEQ ID NO: 7549731 - DNA, 22 bp, Homo sapiens
ggcaggacagccccggaaatct

SEQ ID NO: 7549732 - DNA, 22 bp, Homo sapiens
ggcaggacagtcccagttcaaa

SEQ ID NO: 7549733 - DNA, 22 bp, Homo sapiens
ggcaggacaggggaatgtttgg

SEQ ID NO: 7549734 - DNA, 22 bp, Homo sapiens
ggcaggacaggggaatgtttgg

SEQ ID NO: 7549735 - DNA, 22 bp, Homo sapiens
ggcaggacaggggaatgtttgg

SEQ ID NO: 7549736 - DNA, 22 bp, Homo sapiens
ggcaggacagccccggaaatct

SEQ ID NO: 7549737 - DNA, 22 bp, Homo sapiens
ggcaggaataaattatggactt

SEQ ID NO: 7549738 - DNA, 22 bp, Homo sapiens
ggcaggaataaattatggactt

SEQ ID NO: 7549739 - DNA, 22 bp, Homo sapiens
ggcaggactcttctgtgggccg

SEQ ID NO: 7549740 - DNA, 22 bp, Homo sapiens
ggcaggactcttctgtgggccg

SEQ ID NO: 7549741 - DNA, 22 bp, Homo sapiens
ggcaggactcttctgtgggccg

SEQ ID NO: 7549742 - DNA, 22 bp, Homo sapiens
ggcaggactctcaggaccaagc

SEQ ID NO: 7549743 - DNA, 22 bp, Homo sapiens
ggcaggactctcaggaccaagc

SEQ ID NO: 7549744 - DNA, 20 bp, Homo sapiens
ggcaggacccggtagggagc

SEQ ID NO: 7549745 - DNA, 20 bp, Homo sapiens
ggcaggacccggtagggagc

SEQ ID NO: 7549746 - DNA, 20 bp, Homo sapiens
ggcaggacccggtagggagc

SEQ ID NO: 7549747 - DNA, 20 bp, Homo sapiens
ggcaggacccggtagggagc

SEQ ID NO: 7549748 - DNA, 20 bp, Homo sapiens
ggcaggaccccagtggcatc

SEQ ID NO: 7549749 - DNA, 20 bp, Homo sapiens
ggcaggaccccagtggcatc

SEQ ID NO: 7549750 - DNA, 20 bp, Homo sapiens
ggcaggaccccagtggcatc

SEQ ID NO: 7549751 - DNA, 22 bp, Homo sapiens
cacatgcagttttccagcagtc

SEQ ID NO: 7549752 - DNA, 22 bp, Homo sapiens
cacatgcataaggataattact

SEQ ID NO: 7549753 - DNA, 22 bp, Homo sapiens
cacatgcataaggataattact

SEQ ID NO: 7549754 - DNA, 22 bp, Homo sapiens
cacatgcataaggataattact

SEQ ID NO: 7549755 - DNA, 22 bp, Homo sapiens
cacatgcagttttccagcagtc

SEQ ID NO: 7549756 - DNA, 22 bp, Homo sapiens
cacatgcagttttccagcagtc

SEQ ID NO: 7549757 - DNA, 22 bp, Homo sapiens
cacatgcagttttccagcagtc

SEQ ID NO: 7549758 - DNA, 22 bp, Homo sapiens
cacatgcagttttccagcagtc

SEQ ID NO: 7549759 - DNA, 22 bp, Homo sapiens
cacatgcagttttccagcagtc

SEQ ID NO: 7549760 - DNA, 22 bp, Homo sapiens
cacatgcagtttacgtcactga

SEQ ID NO: 7549761 - DNA, 22 bp, Homo sapiens
cacatgcagtttacgtcactga

SEQ ID NO: 7549762 - DNA, 22 bp, Homo sapiens
cacatgcagtttacgtcactga

SEQ ID NO: 7549763 - DNA, 22 bp, Homo sapiens
cacatgcatcacgacttccttt

SEQ ID NO: 7549764 - DNA, 22 bp, Homo sapiens
cacatgcatcacgacttccttt

SEQ ID NO: 7549765 - DNA, 22 bp, Homo sapiens
cacatgcatacctatgtgtata

SEQ ID NO: 7549766 - DNA, 22 bp, Homo sapiens
cacatgcatacctatgtgtata

SEQ ID NO: 7549767 - DNA, 22 bp, Homo sapiens
cacatgcatacctatgtgtata

SEQ ID NO: 7549768 - DNA, 22 bp, Homo sapiens
cacatgcatacctatgtgtata

SEQ ID NO: 7549769 - DNA, 22 bp, Homo sapiens
cacatgcatacctatgtgtata

SEQ ID NO: 7549770 - DNA, 22 bp, Homo sapiens
cacatgcataaggataattact

SEQ ID NO: 7549771 - DNA, 22 bp, Homo sapiens
cacatgcatctgtcatgtttgg

SEQ ID NO: 7549772 - DNA, 22 bp, Homo sapiens
cacatgcatctgtcatgtttgg

SEQ ID NO: 7549773 - DNA, 22 bp, Homo sapiens
cacatgcatcacgacttccttt

SEQ ID NO: 7549774 - DNA, 22 bp, Homo sapiens
cacatgcatcacgacttccttt

SEQ ID NO: 7549775 - DNA, 22 bp, Homo sapiens
cacatgcatcacgacttccttt

SEQ ID NO: 7549776 - DNA, 22 bp, Homo sapiens
cacatgcatcacgacttccttt

SEQ ID NO: 7549777 - DNA, 22 bp, Homo sapiens
cacatgcatcacgacttccttt

SEQ ID NO: 7549778 - DNA, 21 bp, Homo sapiens
cacatgcatgcacaggttgta

SEQ ID NO: 7549779 - DNA, 21 bp, Homo sapiens
cacatgcatgcacaggttgta

SEQ ID NO: 7549780 - DNA, 21 bp, Homo sapiens
cacatgcatgcacaggttgta

SEQ ID NO: 7549781 - DNA, 21 bp, Homo sapiens
cacatgcatgcacaggttgta

SEQ ID NO: 7549782 - DNA, 22 bp, Homo sapiens
cacatgcatctgtcatgtttgg

SEQ ID NO: 7549783 - DNA, 22 bp, Homo sapiens
cacatgcattggcaaaagtgta

SEQ ID NO: 7549784 - DNA, 22 bp, Homo sapiens
cacatgcatgccaggctcacag

SEQ ID NO: 7549785 - DNA, 22 bp, Homo sapiens
cacatgcatgccaggctcacag

SEQ ID NO: 7549786 - DNA, 22 bp, Homo sapiens
cacatgcatgccaggctcacag

SEQ ID NO: 7549787 - DNA, 22 bp, Homo sapiens
cacatgcatgccaggctcacag

SEQ ID NO: 7549788 - DNA, 22 bp, Homo sapiens
cacatgcatgccaggctcacag

SEQ ID NO: 7549789 - DNA, 22 bp, Homo sapiens
cacatgcccagaacttctcatt

SEQ ID NO: 7549790 - DNA, 22 bp, Homo sapiens
cacatgcattggcaaaagtgta

SEQ ID NO: 7549791 - DNA, 22 bp, Homo sapiens
cacatgcattggcaaaagtgta

SEQ ID NO: 7549792 - DNA, 22 bp, Homo sapiens
cacatgcattggcaaaagtgta

SEQ ID NO: 7549793 - DNA, 22 bp, Homo sapiens
cacatgcattggcaaaagtgta

SEQ ID NO: 7549794 - DNA, 22 bp, Homo sapiens
cacatgcattggcaaaagtgta

SEQ ID NO: 7549795 - DNA, 22 bp, Homo sapiens
cacatttctgtacttaggtaga

SEQ ID NO: 7549796 - DNA, 22 bp, Homo sapiens
cacatttctggaattgacttgg

SEQ ID NO: 7549797 - DNA, 22 bp, Homo sapiens
cacatttctggaattgacttgg

SEQ ID NO: 7549798 - DNA, 22 bp, Homo sapiens
cacatttctggaattgacttgg

SEQ ID NO: 7549799 - DNA, 22 bp, Homo sapiens
cacatttctgtgagtcaatatt

SEQ ID NO: 7549800 - DNA, 22 bp, Homo sapiens
cacatttctgtgagtcaatatt

SEQ ID NO: 7549801 - DNA, 22 bp, Homo sapiens
cacatttctgtgagtcaatatt

SEQ ID NO: 7549802 - DNA, 22 bp, Homo sapiens
cacatttctgtgagtcaatatt

SEQ ID NO: 7549803 - DNA, 22 bp, Homo sapiens
cacatttcttatggatgttggc

SEQ ID NO: 7549804 - DNA, 22 bp, Homo sapiens
cacatttcttatggatgttggc

SEQ ID NO: 7549805 - DNA, 21 bp, Homo sapiens
cacatttgaacctcacagcaa

SEQ ID NO: 7549806 - DNA, 21 bp, Homo sapiens
cacatttgaacctcacagcaa

SEQ ID NO: 7549807 - DNA, 19 bp, Homo sapiens
ggcagtcacggtcaggagc

SEQ ID NO: 7549808 - DNA, 22 bp, Homo sapiens
ggcagtcacttttgcttgtgcc

SEQ ID NO: 7549809 - DNA, 22 bp, Homo sapiens
cacatttctaggaaattaaatg

SEQ ID NO: 7549810 - DNA, 22 bp, Homo sapiens
ggcagtcacttttgcttgtgcc

SEQ ID NO: 7549811 - DNA, 22 bp, Homo sapiens
cacatttctctacctcacacaa

SEQ ID NO: 7549812 - DNA, 22 bp, Homo sapiens
cacatttctaggaaattaaatg

SEQ ID NO: 7549813 - DNA, 22 bp, Homo sapiens
cacatttctctacctcacacaa

SEQ ID NO: 7549814 - DNA, 22 bp, Homo sapiens
ggcagtcacaggggagactggg

SEQ ID NO: 7549815 - DNA, 22 bp, Homo sapiens
ggcagtcacaggggagactggg

SEQ ID NO: 7549816 - DNA, 22 bp, Homo sapiens
ggcaggttggatgctgtagtga

SEQ ID NO: 7549817 - DNA, 22 bp, Homo sapiens
ggcagtagccagggactggcag

SEQ ID NO: 7549818 - DNA, 22 bp, Homo sapiens
ggcagtatgagttcaaataatt

SEQ ID NO: 7549819 - DNA, 22 bp, Homo sapiens
ggcagtcaagagggagtctgaa

SEQ ID NO: 7549820 - DNA, 22 bp, Homo sapiens
ggcagtcaagagggagtctgaa

SEQ ID NO: 7549821 - DNA, 22 bp, Homo sapiens
ggcaggtgtggtgaccagagat

SEQ ID NO: 7549822 - DNA, 22 bp, Homo sapiens
ggcaggtgtggtgaccagagat

SEQ ID NO: 7549823 - DNA, 22 bp, Homo sapiens
ggcaggtgtggtgaccagagat

SEQ ID NO: 7549824 - DNA, 22 bp, Homo sapiens
ggcaggtgtttttatattaaag

SEQ ID NO: 7549825 - DNA, 22 bp, Homo sapiens
ggcaggtgtggtgaccagagat

SEQ ID NO: 7549826 - DNA, 22 bp, Homo sapiens
cacatgcccagaacttctcatt

SEQ ID NO: 7549827 - DNA, 22 bp, Homo sapiens
cacatgcccagaacttctcatt

SEQ ID NO: 7549828 - DNA, 22 bp, Homo sapiens
cacatgctagaataaatctcca

SEQ ID NO: 7549829 - DNA, 22 bp, Homo sapiens
cacatgcctattaaccaaacga

SEQ ID NO: 7549830 - DNA, 22 bp, Homo sapiens
cacatgccttcctcaggcctct

SEQ ID NO: 7549831 - DNA, 22 bp, Homo sapiens
cacatgccttcctcaggcctct

SEQ ID NO: 7549832 - DNA, 22 bp, Homo sapiens
cacatgccttcctcaggcctct

SEQ ID NO: 7549833 - DNA, 22 bp, Homo sapiens
cacatgctcattggcactgttc

SEQ ID NO: 7549834 - DNA, 22 bp, Homo sapiens
cacatgctcattggcactgttc

SEQ ID NO: 7549835 - DNA, 22 bp, Homo sapiens
cacatgctcattggcactgttc

SEQ ID NO: 7549836 - DNA, 22 bp, Homo sapiens
cacatgctcattggcactgttc

SEQ ID NO: 7549837 - DNA, 22 bp, Homo sapiens
cacatgctccatacagaatggg

SEQ ID NO: 7549838 - DNA, 22 bp, Homo sapiens
ggcaggtgccttctgtgctagc

SEQ ID NO: 7549839 - DNA, 22 bp, Homo sapiens
ggcaggtgccttctgtgctagc

SEQ ID NO: 7549840 - DNA, 22 bp, Homo sapiens
ggcaggtgtgagatcgaggcca

SEQ ID NO: 7549841 - DNA, 22 bp, Homo sapiens
ggcaggtgtggagtgttatttt

SEQ ID NO: 7549842 - DNA, 22 bp, Homo sapiens
ggcaggtgtggtgaccagagat

SEQ ID NO: 7549843 - DNA, 22 bp, Homo sapiens
ggcaggtgtggtgaccagagat

SEQ ID NO: 7549844 - DNA, 22 bp, Homo sapiens
ggcaggtgtggagtgttatttt

SEQ ID NO: 7549845 - DNA, 22 bp, Homo sapiens
ggcaggtgtgagatcgaggcca

SEQ ID NO: 7549846 - DNA, 22 bp, Homo sapiens
ggcaggtgtgagatcgaggcca

SEQ ID NO: 7549847 - DNA, 22 bp, Homo sapiens
ggcaggtgtgagatcgaggcca

SEQ ID NO: 7549848 - DNA, 22 bp, Homo sapiens
ggcaggtgtgagctgtaaagga

SEQ ID NO: 7549849 - DNA, 22 bp, Homo sapiens
ggcaggtgtgagctgtaaagga

SEQ ID NO: 7549850 - DNA, 22 bp, Homo sapiens
cagaaatgtactgacatgcagt

SEQ ID NO: 7549851 - DNA, 22 bp, Homo sapiens
cagaaatgtactgacatgcagt

SEQ ID NO: 7549852 - DNA, 22 bp, Homo sapiens
cagaaatgtactgacatgcagt

SEQ ID NO: 7549853 - DNA, 22 bp, Homo sapiens
cagaaatgtactgacatgcagt

SEQ ID NO: 7549854 - DNA, 22 bp, Homo sapiens
cagaaatgtactgacatgcagt

SEQ ID NO: 7549855 - DNA, 22 bp, Homo sapiens
cagaaatggtctgttcagctta

SEQ ID NO: 7549856 - DNA, 22 bp, Homo sapiens
cagaaatggtctgttcagctta

SEQ ID NO: 7549857 - DNA, 22 bp, Homo sapiens
cagaaatggtctgttcagctta

SEQ ID NO: 7549858 - DNA, 22 bp, Homo sapiens
cagaaatggagcccaggaatct

SEQ ID NO: 7549859 - DNA, 22 bp, Homo sapiens
cagaaatggagcccaggaatct

SEQ ID NO: 7549860 - DNA, 22 bp, Homo sapiens
cagaaatggagcccaggaatct

SEQ ID NO: 7549861 - DNA, 22 bp, Homo sapiens
cagaaatggagcccaggaatct

SEQ ID NO: 7549862 - DNA, 22 bp, Homo sapiens
cagaaatggaattttccatcac

SEQ ID NO: 7549863 - DNA, 22 bp, Homo sapiens
cagaaatggaattttccatcac

SEQ ID NO: 7549864 - DNA, 22 bp, Homo sapiens
cagaaatggaattttccatcac

SEQ ID NO: 7549865 - DNA, 19 bp, Homo sapiens
cagaaatagcgaagtgtaa

SEQ ID NO: 7549866 - DNA, 19 bp, Homo sapiens
cagaaatagcgaagtgtaa

SEQ ID NO: 7549867 - DNA, 19 bp, Homo sapiens
cagaaatagcgaagtgtaa

SEQ ID NO: 7549868 - DNA, 19 bp, Homo sapiens
cagaaatagcgaagtgtaa

SEQ ID NO: 7549869 - DNA, 22 bp, Homo sapiens
cagaaatgcctgcttctctctc

SEQ ID NO: 7549870 - DNA, 22 bp, Homo sapiens
cagaaatggaagttctggttta

SEQ ID NO: 7549871 - DNA, 22 bp, Homo sapiens
cagaaatggaagttctggttta

SEQ ID NO: 7549872 - DNA, 22 bp, Homo sapiens
cagaaatggaagttctggttta

SEQ ID NO: 7549873 - DNA, 22 bp, Homo sapiens
cagaaatgcctgcttctctctc

SEQ ID NO: 7549874 - DNA, 22 bp, Homo sapiens
cagaaatgcctgcttctctctc

SEQ ID NO: 7549875 - DNA, 22 bp, Homo sapiens
cagaaatgcctgcttctctctc

SEQ ID NO: 7549876 - DNA, 22 bp, Homo sapiens
cagaaatgcctgcttctctctc

SEQ ID NO: 7549877 - DNA, 22 bp, Homo sapiens
cagaaatagacaatggcagtgg

SEQ ID NO: 7549878 - DNA, 22 bp, Homo sapiens
cagaaatagacaatggcagtgg

SEQ ID NO: 7549879 - DNA, 21 bp, Homo sapiens
ggctgctgtcaccgctgtcac

SEQ ID NO: 7549880 - DNA, 22 bp, Homo sapiens
ggctgctgtgacctcaggtgat

SEQ ID NO: 7549881 - DNA, 22 bp, Homo sapiens
ggctgctgtgacctcaggtgat

SEQ ID NO: 7549882 - DNA, 22 bp, Homo sapiens
ggctgctgtgacctcaggtgat

SEQ ID NO: 7549883 - DNA, 20 bp, Homo sapiens
ggctgctggtttggctctgt

SEQ ID NO: 7549884 - DNA, 19 bp, Homo sapiens
ggctgctggttacagaggc

SEQ ID NO: 7549885 - DNA, 20 bp, Homo sapiens
ggctgctggtttggctctgt

SEQ ID NO: 7549886 - DNA, 20 bp, Homo sapiens
ggctgctggtttggctctgt

SEQ ID NO: 7549887 - DNA, 20 bp, Homo sapiens
ggctgctggtttggctctgt

SEQ ID NO: 7549888 - DNA, 20 bp, Homo sapiens
ggctgctggtttggctctgt

SEQ ID NO: 7549889 - DNA, 22 bp, Homo sapiens
ggctgctgtactgatgtcagtt

SEQ ID NO: 7549890 - DNA, 20 bp, Homo sapiens
ggctgctggtttggctctgt

SEQ ID NO: 7549891 - DNA, 22 bp, Homo sapiens
ggctgctgtactgatgtcagtt

SEQ ID NO: 7549892 - DNA, 20 bp, Homo sapiens
ggctgctggtttggctctgt

SEQ ID NO: 7549893 - DNA, 22 bp, Homo sapiens
ggctgctgtactgatgtcagtt

SEQ ID NO: 7549894 - DNA, 22 bp, Homo sapiens
ggctgctgtactgatgtcagtt

SEQ ID NO: 7549895 - DNA, 22 bp, Homo sapiens
ggctgctgtactgatgtcagtt

SEQ ID NO: 7549896 - DNA, 22 bp, Homo sapiens
ggctgctgtactgatgtcagtt

SEQ ID NO: 7549897 - DNA, 22 bp, Homo sapiens
ggctgctgtactgatgtcagtt

SEQ ID NO: 7549898 - DNA, 22 bp, Homo sapiens
ggctgctgtactgatgtcagtt

SEQ ID NO: 7549899 - DNA, 21 bp, Homo sapiens
ggctgctgtcaccgctgtcac

SEQ ID NO: 7549900 - DNA, 21 bp, Homo sapiens
ggctgctgtcaccgctgtcac

SEQ ID NO: 7549901 - DNA, 21 bp, Homo sapiens
ggctgctgtcaccgctgtcac

SEQ ID NO: 7549902 - DNA, 21 bp, Homo sapiens
ggctgctgtcaccgctgtcac

SEQ ID NO: 7549903 - DNA, 22 bp, Homo sapiens
ggctgctggtaggggtaggaag

SEQ ID NO: 7549904 - DNA, 22 bp, Homo sapiens
ggctgctggtaggggtaggaag

SEQ ID NO: 7549905 - DNA, 22 bp, Homo sapiens
ggctgctgggtcatgatgcaga

SEQ ID NO: 7549906 - DNA, 22 bp, Homo sapiens
ggctgctgggtcatgatgcaga

SEQ ID NO: 7549907 - DNA, 22 bp, Homo sapiens
ggctgctgggtcatgatgcaga

SEQ ID NO: 7549908 - DNA, 22 bp, Homo sapiens
ggctgctgggtcatgatgcaga

SEQ ID NO: 7549909 - DNA, 22 bp, Homo sapiens
ggctgctggtaggggtaggaag

SEQ ID NO: 7549910 - DNA, 22 bp, Homo sapiens
ggctgctggtaggggtaggaag

SEQ ID NO: 7549911 - DNA, 22 bp, Homo sapiens
ggctgctggtaggggtaggaag

SEQ ID NO: 7549912 - DNA, 22 bp, Homo sapiens
ggctgctggtaggggtaggaag

SEQ ID NO: 7549913 - DNA, 22 bp, Homo sapiens
ggctgctggtggaatggtaggc

SEQ ID NO: 7549914 - DNA, 22 bp, Homo sapiens
ggctgctggtggaatggtaggc

SEQ ID NO: 7549915 - DNA, 22 bp, Homo sapiens
ggctgctggtggaatggtaggc

SEQ ID NO: 7549916 - DNA, 19 bp, Homo sapiens
ggctgctggttacagaggc

SEQ ID NO: 7549917 - DNA, 19 bp, Homo sapiens
ggctgctggttacagaggc

SEQ ID NO: 7549918 - DNA, 19 bp, Homo sapiens
ggctgctggttacagaggc

SEQ ID NO: 7549919 - DNA, 19 bp, Homo sapiens
ggctgctggttacagaggc

SEQ ID NO: 7549920 - DNA, 19 bp, Homo sapiens
ggctgctggttacagaggc

SEQ ID NO: 7549921 - DNA, 20 bp, Homo sapiens
cagaaatttgtaaaagggat

SEQ ID NO: 7549922 - DNA, 22 bp, Homo sapiens
cagaacacattttcagagtcaa

SEQ ID NO: 7549923 - DNA, 22 bp, Homo sapiens
cagaacacaggctaaactgaga

SEQ ID NO: 7549924 - DNA, 22 bp, Homo sapiens
cagaacacattttcagagtcaa

SEQ ID NO: 7549925 - DNA, 22 bp, Homo sapiens
cagaaattggaatagagaaata

SEQ ID NO: 7549926 - DNA, 22 bp, Homo sapiens
cagaaattggaatagagaaata

SEQ ID NO: 7549927 - DNA, 20 bp, Homo sapiens
cagaaatttgtaaaagggat

SEQ ID NO: 7549928 - DNA, 22 bp, Homo sapiens
cagaaattcccatttcagattc

SEQ ID NO: 7549929 - DNA, 22 bp, Homo sapiens
cagaaattcccatttcagattc

SEQ ID NO: 7549930 - DNA, 22 bp, Homo sapiens
cagaacagaaacgttgttccat

SEQ ID NO: 7549931 - DNA, 22 bp, Homo sapiens
cagaacacattttcagagtcaa

SEQ ID NO: 7549932 - DNA, 22 bp, Homo sapiens
cagaacagaaacgttgttccat

SEQ ID NO: 7549933 - DNA, 22 bp, Homo sapiens
cagaacagaagtaaaatttacc

SEQ ID NO: 7549934 - DNA, 22 bp, Homo sapiens
cagaacagaagtaaaatttacc

SEQ ID NO: 7549935 - DNA, 22 bp, Homo sapiens
cagaacagaatcgtgtggtgag

SEQ ID NO: 7549936 - DNA, 22 bp, Homo sapiens
cagaacagaatcgtgtggtgag

SEQ ID NO: 7549937 - DNA, 22 bp, Homo sapiens
cagaacagaagtaaaatttacc

SEQ ID NO: 7549938 - DNA, 22 bp, Homo sapiens
cagaacagaagtaaaatttacc

SEQ ID NO: 7549939 - DNA, 22 bp, Homo sapiens
cagaacagaagtaaaatttacc

SEQ ID NO: 7549940 - DNA, 22 bp, Homo sapiens
cagaaattcccatttcagattc

SEQ ID NO: 7549941 - DNA, 22 bp, Homo sapiens
cagaaattcccatttcagattc

SEQ ID NO: 7549942 - DNA, 22 bp, Homo sapiens
cagaaattcccatttcagattc

SEQ ID NO: 7549943 - DNA, 22 bp, Homo sapiens
cagaaatgtttgttaatattgt

SEQ ID NO: 7549944 - DNA, 22 bp, Homo sapiens
cagaaatgtttgttaatattgt

SEQ ID NO: 7549945 - DNA, 22 bp, Homo sapiens
cagaaatgtttgttaatattgt

SEQ ID NO: 7549946 - DNA, 22 bp, Homo sapiens
cagaaatgtttgttaatattgt

SEQ ID NO: 7549947 - DNA, 22 bp, Homo sapiens
cagaaatgtttgttaatattgt

SEQ ID NO: 7549948 - DNA, 22 bp, Homo sapiens
cagaaatgtttatgcttttgaa

SEQ ID NO: 7549949 - DNA, 22 bp, Homo sapiens
cagaaatgtttatgcttttgaa

SEQ ID NO: 7549950 - DNA, 22 bp, Homo sapiens
cagaaatgtttatatgtggtgt

SEQ ID NO: 7549951 - DNA, 22 bp, Homo sapiens
cagaaatgtttatatgtggtgt

SEQ ID NO: 7549952 - DNA, 22 bp, Homo sapiens
cagaaatgttctaatgattcag

SEQ ID NO: 7549953 - DNA, 22 bp, Homo sapiens
cagaaatgttctaatgattcag

SEQ ID NO: 7549954 - DNA, 22 bp, Homo sapiens
cagaaatgttctaatgattcag

SEQ ID NO: 7549955 - DNA, 22 bp, Homo sapiens
cagaaatgttctaatgattcag

SEQ ID NO: 7549956 - DNA, 22 bp, Homo sapiens
cagaaatgtttatatgtggtgt

SEQ ID NO: 7549957 - DNA, 22 bp, Homo sapiens
cagaaatgtttatatgtggtgt

SEQ ID NO: 7549958 - DNA, 22 bp, Homo sapiens
cagaaatgtttatatgtggtgt

SEQ ID NO: 7549959 - DNA, 22 bp, Homo sapiens
cagaaatgtgatgtacacacac

SEQ ID NO: 7549960 - DNA, 22 bp, Homo sapiens
cagaaatgtgatgtacacacac

SEQ ID NO: 7549961 - DNA, 22 bp, Homo sapiens
cagaaatgtgatgtacacacac

SEQ ID NO: 7549962 - DNA, 22 bp, Homo sapiens
cagaaatgtgatgtacacacac

SEQ ID NO: 7549963 - DNA, 22 bp, Homo sapiens
ggctgggagctggacaggccgg

SEQ ID NO: 7549964 - DNA, 23 bp, Homo sapiens
ggctgggagctccgggtgcacgt

SEQ ID NO: 7549965 - DNA, 23 bp, Homo sapiens
ggctgggagctccgggtgcacgt

SEQ ID NO: 7549966 - DNA, 23 bp, Homo sapiens
ggctgggagctccgggtgcacgt

SEQ ID NO: 7549967 - DNA, 23 bp, Homo sapiens
ggctgggagctccgggtgcacgt

SEQ ID NO: 7549968 - DNA, 23 bp, Homo sapiens
ggctgggagctccgggtgcacgt

SEQ ID NO: 7549969 - DNA, 22 bp, Homo sapiens
ggctgggagccccacagagtca

SEQ ID NO: 7549970 - DNA, 22 bp, Homo sapiens
ggctgggagccccacagagtca

SEQ ID NO: 7549971 - DNA, 23 bp, Homo sapiens
ggctgggagctccgggtgcacgt

SEQ ID NO: 7549972 - DNA, 23 bp, Homo sapiens
ggctgggagctccgggtgcacgt

SEQ ID NO: 7549973 - DNA, 22 bp, Homo sapiens
ggctgggagccccacagagtca

SEQ ID NO: 7549974 - DNA, 23 bp, Homo sapiens
ggctgggagctccgggtgcacgt

SEQ ID NO: 7549975 - DNA, 23 bp, Homo sapiens
ggctgggagctccgggtgcacgt

SEQ ID NO: 7549976 - DNA, 23 bp, Homo sapiens
ggctgggagctccgggtgcacgt

SEQ ID NO: 7549977 - DNA, 23 bp, Homo sapiens
ggctgggagctccgggtgcacgt

SEQ ID NO: 7549978 - DNA, 23 bp, Homo sapiens
ggctgggagctccgggtgcacgt

SEQ ID NO: 7549979 - DNA, 22 bp, Homo sapiens
ggctggctttctctccgcacct

SEQ ID NO: 7549980 - DNA, 22 bp, Homo sapiens
ggctggctttctctccgcacct

SEQ ID NO: 7549981 - DNA, 22 bp, Homo sapiens
ggctggctttctctccgcacct

SEQ ID NO: 7549982 - DNA, 22 bp, Homo sapiens
ggctgggacgatgaggattagt

SEQ ID NO: 7549983 - DNA, 22 bp, Homo sapiens
ggctgggacgatgaggattagt

SEQ ID NO: 7549984 - DNA, 22 bp, Homo sapiens
ggctggctttctctccgcacct

SEQ ID NO: 7549985 - DNA, 22 bp, Homo sapiens
ggctgggagccccacagagtca

SEQ ID NO: 7549986 - DNA, 22 bp, Homo sapiens
ggctgggagccccacagagtca

SEQ ID NO: 7549987 - DNA, 22 bp, Homo sapiens
ggctgggagccccacagagtca

SEQ ID NO: 7549988 - DNA, 22 bp, Homo sapiens
ggctgggagccccacagagtca

SEQ ID NO: 7549989 - DNA, 22 bp, Homo sapiens
ggctgggagccccacagagtca

SEQ ID NO: 7549990 - DNA, 22 bp, Homo sapiens
ggctgggacgatgaggattagt

SEQ ID NO: 7549991 - DNA, 22 bp, Homo sapiens
ggctgggagccccacagagtca

SEQ ID NO: 7549992 - DNA, 22 bp, Homo sapiens
ggctgggagccccacagagtca

SEQ ID NO: 7549993 - DNA, 22 bp, Homo sapiens
ggctgggacgatgaggattagt

SEQ ID NO: 7549994 - DNA, 22 bp, Homo sapiens
ggctgggacgatgaggattagt

SEQ ID NO: 7549995 - DNA, 22 bp, Homo sapiens
ggctgggacgatgaggattagt

SEQ ID NO: 7549996 - DNA, 22 bp, Homo sapiens
ggctgggacgatgaggattagt

SEQ ID NO: 7549997 - DNA, 22 bp, Homo sapiens
ggctgggacgatgaggattagt

SEQ ID NO: 7549998 - DNA, 22 bp, Homo sapiens
ggctgggagccccacagagtca

SEQ ID NO: 7549999 - DNA, 22 bp, Homo sapiens
cagaacagagtcaaaagtatgt

SEQ ID NO: 7550000 - DNA, 22 bp, Homo sapiens
cagaacagagtcaaaagtatgt

SEQ ID NO: 7550001 - DNA, 19 bp, Homo sapiens
cagaacagctgggaagaga

SEQ ID NO: 7550002 - DNA, 19 bp, Homo sapiens
cagaacagctgggaagaga

SEQ ID NO: 7550003 - DNA, 19 bp, Homo sapiens
cagaacagctgggaagaga

SEQ ID NO: 7550004 - DNA, 19 bp, Homo sapiens
cagaacaggaccaggggcc

SEQ ID NO: 7550005 - DNA, 19 bp, Homo sapiens
cagaacaggaccaggggcc

SEQ ID NO: 7550006 - DNA, 19 bp, Homo sapiens
cagaacagctgggaagaga

SEQ ID NO: 7550007 - DNA, 19 bp, Homo sapiens
cagaacagaggtcatggcc

SEQ ID NO: 7550008 - DNA, 19 bp, Homo sapiens
cagaacagaggtcatggcc

SEQ ID NO: 7550009 - DNA, 19 bp, Homo sapiens
cagaacagaggtcatggcc

SEQ ID NO: 7550010 - DNA, 19 bp, Homo sapiens
cagaacagaggtcatggcc

SEQ ID NO: 7550011 - DNA, 22 bp, Homo sapiens
cagaacagagcctgaatctctc

SEQ ID NO: 7550012 - DNA, 22 bp, Homo sapiens
cagaacagagtcaaaagtatgt

SEQ ID NO: 7550013 - DNA, 22 bp, Homo sapiens
cagaacagagtcaaaagtatgt

SEQ ID NO: 7550014 - DNA, 22 bp, Homo sapiens
cagaacagagtcaaaagtatgt

SEQ ID NO: 7550015 - DNA, 22 bp, Homo sapiens
cagaacagtcgcctgcatggat

SEQ ID NO: 7550016 - DNA, 22 bp, Homo sapiens
cagaacagtacctagcacatag

SEQ ID NO: 7550017 - DNA, 22 bp, Homo sapiens
cagaacagtacctagcacatag

SEQ ID NO: 7550018 - DNA, 22 bp, Homo sapiens
cagaacagtacctagcacatag

SEQ ID NO: 7550019 - DNA, 22 bp, Homo sapiens
cagaacagtacctagcacatag

SEQ ID NO: 7550020 - DNA, 22 bp, Homo sapiens
cagaacagtacctagcacatag

SEQ ID NO: 7550021 - DNA, 22 bp, Homo sapiens
cagaacagtacctagcacatag

SEQ ID NO: 7550022 - DNA, 22 bp, Homo sapiens
cagaacagtacctagcacatag

SEQ ID NO: 7550023 - DNA, 23 bp, Homo sapiens
cagaacagtaaaagatgccatgg

SEQ ID NO: 7550024 - DNA, 23 bp, Homo sapiens
cagaacagtaaaagatgccatgg

SEQ ID NO: 7550025 - DNA, 23 bp, Homo sapiens
cagaacagtaaaagatgccatgg

SEQ ID NO: 7550026 - DNA, 23 bp, Homo sapiens
cagaacagtaaaagatgccatgg

SEQ ID NO: 7550027 - DNA, 23 bp, Homo sapiens
cagaacagtaaaagatgccatgg

SEQ ID NO: 7550028 - DNA, 22 bp, Homo sapiens
cagaacaggtcatgcttgctgt

SEQ ID NO: 7550029 - DNA, 22 bp, Homo sapiens
cagaacaggtcatgcttgctgt

SEQ ID NO: 7550030 - DNA, 22 bp, Homo sapiens
cagaacagggcccaaggggtcg

SEQ ID NO: 7550031 - DNA, 19 bp, Homo sapiens
cagaacaggaccaggggcc

SEQ ID NO: 7550032 - DNA, 22 bp, Homo sapiens
cagaagaggactgggtagctca

SEQ ID NO: 7550033 - DNA, 22 bp, Homo sapiens
cagaagaggactgggtagctca

SEQ ID NO: 7550034 - DNA, 22 bp, Homo sapiens
cagaagagtagctgaacaagtt

SEQ ID NO: 7550035 - DNA, 22 bp, Homo sapiens
cagaagagtagctgaacaagtt

SEQ ID NO: 7550036 - DNA, 22 bp, Homo sapiens
cagaagagtagctgaacaagtt

SEQ ID NO: 7550037 - DNA, 22 bp, Homo sapiens
cagaagaggactgggtagctca

SEQ ID NO: 7550038 - DNA, 22 bp, Homo sapiens
cagaagagtagctgaacaagtt

SEQ ID NO: 7550039 - DNA, 22 bp, Homo sapiens
cagaagaggactgggtagctca

SEQ ID NO: 7550040 - DNA, 22 bp, Homo sapiens
cagaagaggactgggtagctca

SEQ ID NO: 7550041 - DNA, 22 bp, Homo sapiens
cagaagaggactgggtagctca

SEQ ID NO: 7550042 - DNA, 22 bp, Homo sapiens
cagaacattcactcatatgtgg

SEQ ID NO: 7550043 - DNA, 22 bp, Homo sapiens
cagaacattcttgccagtacat

SEQ ID NO: 7550044 - DNA, 22 bp, Homo sapiens
cagaacattgttttctcatctg

SEQ ID NO: 7550045 - DNA, 22 bp, Homo sapiens
cagaacattccatgtgccctgc

SEQ ID NO: 7550046 - DNA, 22 bp, Homo sapiens
cagaacattcactcatatgtgg

SEQ ID NO: 7550047 - DNA, 20 bp, Homo sapiens
cagaacatgagcatcgagcc

SEQ ID NO: 7550048 - DNA, 22 bp, Homo sapiens
cagaacatccccactgctacct

SEQ ID NO: 7550049 - DNA, 20 bp, Homo sapiens
cagaacagtctgagaggcca

SEQ ID NO: 7550050 - DNA, 20 bp, Homo sapiens
cagaacatgagcatcgagcc

SEQ ID NO: 7550051 - DNA, 22 bp, Homo sapiens
cagaacatgatataaacagaag

SEQ ID NO: 7550052 - DNA, 22 bp, Homo sapiens
cagaacatgatataaacagaag

SEQ ID NO: 7550053 - DNA, 22 bp, Homo sapiens
cagaacattcactcatatgtgg

SEQ ID NO: 7550054 - DNA, 22 bp, Homo sapiens
cagaacattcactcatatgtgg

SEQ ID NO: 7550055 - DNA, 22 bp, Homo sapiens
cagaacagtcgcctgcatggat

SEQ ID NO: 7550056 - DNA, 22 bp, Homo sapiens
cagaacagtcgcctgcatggat

SEQ ID NO: 7550057 - DNA, 22 bp, Homo sapiens
cagaacagtcgcctgcatggat

SEQ ID NO: 7550058 - DNA, 22 bp, Homo sapiens
cagaacagtcgcctgcatggat

SEQ ID NO: 7550059 - DNA, 20 bp, Homo sapiens
cagaacagtctgagaggcca

SEQ ID NO: 7550060 - DNA, 20 bp, Homo sapiens
cagaacagtctgagaggcca

SEQ ID NO: 7550061 - DNA, 20 bp, Homo sapiens
cagaacagtctgagaggcca

SEQ ID NO: 7550062 - DNA, 20 bp, Homo sapiens
cagaacagtctgagaggcca

SEQ ID NO: 7550063 - DNA, 20 bp, Homo sapiens
cagaacagtctgagaggcca

SEQ ID NO: 7550064 - DNA, 22 bp, Homo sapiens
ggcttcaggggcccagtcagca

SEQ ID NO: 7550065 - DNA, 22 bp, Homo sapiens
ggcttcaggggcccagtcagca

SEQ ID NO: 7550066 - DNA, 20 bp, Homo sapiens
ggcttcttcaggtgtctatt

SEQ ID NO: 7550067 - DNA, 22 bp, Homo sapiens
ggcttcaggggcccagtcagca

SEQ ID NO: 7550068 - DNA, 19 bp, Homo sapiens
ggcttcagggagttagcat

SEQ ID NO: 7550069 - DNA, 17 bp, Homo sapiens
ggcttcagggagctggg

SEQ ID NO: 7550070 - DNA, 22 bp, Homo sapiens
ggcttcttcctggctcctatta

SEQ ID NO: 7550071 - DNA, 22 bp, Homo sapiens
ggcttcttcctggctcctatta

SEQ ID NO: 7550072 - DNA, 22 bp, Homo sapiens
ggcttcttcctggctcctatta

SEQ ID NO: 7550073 - DNA, 22 bp, Homo sapiens
ggcttcttcctgtgaacatgtt

SEQ ID NO: 7550074 - DNA, 22 bp, Homo sapiens
ggcttcttcctgtgaacatgtt

SEQ ID NO: 7550075 - DNA, 22 bp, Homo sapiens
ggcttcttcctgtgaacatgtt

SEQ ID NO: 7550076 - DNA, 22 bp, Homo sapiens
ggctgggaggatgacttgctac

SEQ ID NO: 7550077 - DNA, 17 bp, Homo sapiens
ggcttcagggagctggg

SEQ ID NO: 7550078 - DNA, 22 bp, Homo sapiens
ggctgggagctggacaggccgg

SEQ ID NO: 7550079 - DNA, 22 bp, Homo sapiens
ggctgggagctggacaggccgg

SEQ ID NO: 7550080 - DNA, 22 bp, Homo sapiens
ggctgggagctggacaggccgg

SEQ ID NO: 7550081 - DNA, 22 bp, Homo sapiens
ggctgggagctggacaggccgg

SEQ ID NO: 7550082 - DNA, 22 bp, Homo sapiens
ggctgggagctggacaggccgg

SEQ ID NO: 7550083 - DNA, 22 bp, Homo sapiens
ggcttcttgtgtgtcaggctct

SEQ ID NO: 7550084 - DNA, 22 bp, Homo sapiens
ggcttcttgctattttccaatg

SEQ ID NO: 7550085 - DNA, 22 bp, Homo sapiens
ggcttcttctctgtgtccagca

SEQ ID NO: 7550086 - DNA, 22 bp, Homo sapiens
ggcttcttctttctcaaacccc

SEQ ID NO: 7550087 - DNA, 23 bp, Homo sapiens
ggcttcttgcctgtcttggtgct

SEQ ID NO: 7550088 - DNA, 22 bp, Homo sapiens
ggcttcttgctattttccaatg

SEQ ID NO: 7550089 - DNA, 22 bp, Homo sapiens
ggcttcttgctattttccaatg

SEQ ID NO: 7550090 - DNA, 22 bp, Homo sapiens
ggcttctttcagagtgaataga

SEQ ID NO: 7550091 - DNA, 22 bp, Homo sapiens
ggcttctttgtaacgtgccagc

SEQ ID NO: 7550092 - DNA, 20 bp, Homo sapiens
ggcttctttacatctgtgtt

SEQ ID NO: 7550093 - DNA, 22 bp, Homo sapiens
ggcttctttcactaagtagaga

SEQ ID NO: 7550094 - DNA, 22 bp, Homo sapiens
ggcttctttcactaagtagaga

SEQ ID NO: 7550095 - DNA, 22 bp, Homo sapiens
ggcttgaaagaataggaatgca

SEQ ID NO: 7550096 - DNA, 22 bp, Homo sapiens
ggcttgaagactatgacatttc

SEQ ID NO: 7550097 - DNA, 22 bp, Homo sapiens
ggcttctttttagtaaatgtca

SEQ ID NO: 7550098 - DNA, 22 bp, Homo sapiens
ggcttctttttagtaaatgtca

SEQ ID NO: 7550099 - DNA, 22 bp, Homo sapiens
ggcttctttttagtaaatgtca

SEQ ID NO: 7550100 - DNA, 22 bp, Homo sapiens
ggcttggaaactagagtgtgca

SEQ ID NO: 7550101 - DNA, 22 bp, Homo sapiens
ggcttggaaactagagtgtgca

SEQ ID NO: 7550102 - DNA, 22 bp, Homo sapiens
ggcttggaaatggtaatgagct

SEQ ID NO: 7550103 - DNA, 22 bp, Homo sapiens
ggcttggaaattgcaggacaca

SEQ ID NO: 7550104 - DNA, 22 bp, Homo sapiens
ggcttgcacacagcctcagttt

SEQ ID NO: 7550105 - DNA, 22 bp, Homo sapiens
ggcttgctctctaaaagggctg

SEQ ID NO: 7550106 - DNA, 20 bp, Homo sapiens
ggcttgagtcagatcttgga

SEQ ID NO: 7550107 - DNA, 20 bp, Homo sapiens
ggcttgagtcagatcttgga

SEQ ID NO: 7550108 - DNA, 23 bp, Homo sapiens
ggcttgagctggaacagcttggt

SEQ ID NO: 7550109 - DNA, 23 bp, Homo sapiens
ggcttgagctggaacagcttggt

SEQ ID NO: 7550110 - DNA, 23 bp, Homo sapiens
ggcttgagctggaacagcttggt

SEQ ID NO: 7550111 - DNA, 23 bp, Homo sapiens
ggcttgagctggaacagcttggt

SEQ ID NO: 7550112 - DNA, 22 bp, Homo sapiens
ggcttgagacccgggagccaga

SEQ ID NO: 7550113 - DNA, 22 bp, Homo sapiens
ggcttgagacccgggagccaga

SEQ ID NO: 7550114 - DNA, 22 bp, Homo sapiens
ggcttgagacccgggagccaga

SEQ ID NO: 7550115 - DNA, 22 bp, Homo sapiens
ggcttgaagggaggaaagcagg

SEQ ID NO: 7550116 - DNA, 22 bp, Homo sapiens
ggcttgagacccgggagccaga

SEQ ID NO: 7550117 - DNA, 22 bp, Homo sapiens
ggcttgagacccgggagccaga

SEQ ID NO: 7550118 - DNA, 22 bp, Homo sapiens
ggcttgaagggaggaaagcagg

SEQ ID NO: 7550119 - DNA, 22 bp, Homo sapiens
ggcttgaatggatataatctgt

SEQ ID NO: 7550120 - DNA, 22 bp, Homo sapiens
cagaacagacttaacagggctg

SEQ ID NO: 7550121 - DNA, 23 bp, Homo sapiens
ggcttggccctcaagggccctgc

SEQ ID NO: 7550122 - DNA, 23 bp, Homo sapiens
ggcttggccctcaagggccctgc

SEQ ID NO: 7550123 - DNA, 22 bp, Homo sapiens
ggcttggcctgataaatgcatg

SEQ ID NO: 7550124 - DNA, 22 bp, Homo sapiens
cagaacagacttaacagggctg

SEQ ID NO: 7550125 - DNA, 22 bp, Homo sapiens
cagaacagacttaacagggctg

SEQ ID NO: 7550126 - DNA, 22 bp, Homo sapiens
cagaacagacttaacagggctg

SEQ ID NO: 7550127 - DNA, 22 bp, Homo sapiens
cagaacagacttaacagggctg

SEQ ID NO: 7550128 - DNA, 22 bp, Homo sapiens
cagaacagacttaacagggctg

SEQ ID NO: 7550129 - DNA, 22 bp, Homo sapiens
cagaacagacttaacagggctg

SEQ ID NO: 7550130 - DNA, 22 bp, Homo sapiens
ggcttggaccagtcacagtggt

SEQ ID NO: 7550131 - DNA, 22 bp, Homo sapiens
cagaacagacttaacagggctg

SEQ ID NO: 7550132 - DNA, 22 bp, Homo sapiens
cagaacagacttaacagggctg

SEQ ID NO: 7550133 - DNA, 22 bp, Homo sapiens
ggcttggcaggtgccctgcgca

SEQ ID NO: 7550134 - DNA, 22 bp, Homo sapiens
ggcttggcaggtgccctgcgca

SEQ ID NO: 7550135 - DNA, 22 bp, Homo sapiens
ggcttggcccaggcctcactcc

SEQ ID NO: 7550136 - DNA, 22 bp, Homo sapiens
ggcttggcccaggcctcactcc

SEQ ID NO: 7550137 - DNA, 22 bp, Homo sapiens
ggcttggcagaggtgggtgctt

SEQ ID NO: 7550138 - DNA, 22 bp, Homo sapiens
ggcttggcagaggtgggtgctt

SEQ ID NO: 7550139 - DNA, 22 bp, Homo sapiens
ggcttggaccagtcacagtggt

SEQ ID NO: 7550140 - DNA, 22 bp, Homo sapiens
ggcttggagtcatactgagaat

SEQ ID NO: 7550141 - DNA, 22 bp, Homo sapiens
ggcttggagtcatactgagaat

SEQ ID NO: 7550142 - DNA, 22 bp, Homo sapiens
ggcttggaaattgcaggacaca

SEQ ID NO: 7550143 - DNA, 22 bp, Homo sapiens
ggcttggaattggtaggatgta

SEQ ID NO: 7550144 - DNA, 22 bp, Homo sapiens
ggcttggaaattgcaggacaca

SEQ ID NO: 7550145 - DNA, 18 bp, Homo sapiens
ggctcctgtgatcacatt

SEQ ID NO: 7550146 - DNA, 18 bp, Homo sapiens
ggctcctgtgatcacatt

SEQ ID NO: 7550147 - DNA, 22 bp, Homo sapiens
ggctcctgtcctcctggagctc

SEQ ID NO: 7550148 - DNA, 22 bp, Homo sapiens
ggctcctgtcctcctggagctc

SEQ ID NO: 7550149 - DNA, 22 bp, Homo sapiens
ggctcctgtcctcctggagctc

SEQ ID NO: 7550150 - DNA, 22 bp, Homo sapiens
ggctcctgtcctcctggagctc

SEQ ID NO: 7550151 - DNA, 22 bp, Homo sapiens
ggctcctgtcctcctggagctc

SEQ ID NO: 7550152 - DNA, 22 bp, Homo sapiens
ggctcctgtcctcctggagctc

SEQ ID NO: 7550153 - DNA, 19 bp, Homo sapiens
ggctcctgtggctgcagcc

SEQ ID NO: 7550154 - DNA, 19 bp, Homo sapiens
ggctcctgtggctgcagcc

SEQ ID NO: 7550155 - DNA, 22 bp, Homo sapiens
ggctcctgtggcaagacagctt

SEQ ID NO: 7550156 - DNA, 22 bp, Homo sapiens
ggctcctgtggcaagacagctt

SEQ ID NO: 7550157 - DNA, 18 bp, Homo sapiens
ggctcctgtgatcacatt

SEQ ID NO: 7550158 - DNA, 18 bp, Homo sapiens
ggctcctgtgatcacatt

SEQ ID NO: 7550159 - DNA, 22 bp, Homo sapiens
ggctcctgtggcaagacagctt

SEQ ID NO: 7550160 - DNA, 22 bp, Homo sapiens
ggctcctgtggcaagacagctt

SEQ ID NO: 7550161 - DNA, 22 bp, Homo sapiens
ggctcctgtggcaagacagctt

SEQ ID NO: 7550162 - DNA, 22 bp, Homo sapiens
ggctcctgtggcaagacagctt

SEQ ID NO: 7550163 - DNA, 22 bp, Homo sapiens
ggctcctgtcccctcagctgct

SEQ ID NO: 7550164 - DNA, 22 bp, Homo sapiens
ggctcctgtcccctcagctgct

SEQ ID NO: 7550165 - DNA, 22 bp, Homo sapiens
ggctcctgtagatctctaaagc

SEQ ID NO: 7550166 - DNA, 22 bp, Homo sapiens
ggctcctgtcccctcagctgct

SEQ ID NO: 7550167 - DNA, 22 bp, Homo sapiens
ggctcctgtcccctcagctgct

SEQ ID NO: 7550168 - DNA, 22 bp, Homo sapiens
ggctcctgggggtgctcctgcc

SEQ ID NO: 7550169 - DNA, 22 bp, Homo sapiens
ggctcctgggggtgctcctgcc

SEQ ID NO: 7550170 - DNA, 22 bp, Homo sapiens
ggctcctgtagatctctaaagc

SEQ ID NO: 7550171 - DNA, 22 bp, Homo sapiens
ggctcctgggggtgctcctgcc

SEQ ID NO: 7550172 - DNA, 22 bp, Homo sapiens
cactgcccaggcacccatcttg

SEQ ID NO: 7550173 - DNA, 22 bp, Homo sapiens
cactgcccaggcacccatcttg

SEQ ID NO: 7550174 - DNA, 22 bp, Homo sapiens
cactgcccaggcacccatcttg

SEQ ID NO: 7550175 - DNA, 22 bp, Homo sapiens
cactgcccaggcacccatcttg

SEQ ID NO: 7550176 - DNA, 22 bp, Homo sapiens
cactgcccaggacctgccaccc

SEQ ID NO: 7550177 - DNA, 22 bp, Homo sapiens
cactgcccaggacctgccaccc

SEQ ID NO: 7550178 - DNA, 22 bp, Homo sapiens
cactgcccaggacctgccaccc

SEQ ID NO: 7550179 - DNA, 22 bp, Homo sapiens
cactgcccaggacctgccaccc

SEQ ID NO: 7550180 - DNA, 22 bp, Homo sapiens
cactgcccaggacctgccaccc

SEQ ID NO: 7550181 - DNA, 22 bp, Homo sapiens
cactgcccaggacctgccaccc

SEQ ID NO: 7550182 - DNA, 22 bp, Homo sapiens
cactgcccagcgtcttaggcac

SEQ ID NO: 7550183 - DNA, 22 bp, Homo sapiens
cactgcccagcgtcttaggcac

SEQ ID NO: 7550184 - DNA, 22 bp, Homo sapiens
cactgcccagcgtcttaggcac

SEQ ID NO: 7550185 - DNA, 19 bp, Homo sapiens
ggctcctgtggctgcagcc

SEQ ID NO: 7550186 - DNA, 19 bp, Homo sapiens
ggctcctgtggctgcagcc

SEQ ID NO: 7550187 - DNA, 19 bp, Homo sapiens
ggctcctgtggctgcagcc

SEQ ID NO: 7550188 - DNA, 19 bp, Homo sapiens
ggctcctgtggctgcagcc

SEQ ID NO: 7550189 - DNA, 19 bp, Homo sapiens
ggctcctgtggctgcagcc

SEQ ID NO: 7550190 - DNA, 19 bp, Homo sapiens
ggctcctgtggctgcagcc

SEQ ID NO: 7550191 - DNA, 19 bp, Homo sapiens
ggctcctgtggctgcagcc

SEQ ID NO: 7550192 - DNA, 20 bp, Homo sapiens
cactgccctccagcctgagc

SEQ ID NO: 7550193 - DNA, 22 bp, Homo sapiens
cactgccctgggggttgccatc

SEQ ID NO: 7550194 - DNA, 22 bp, Homo sapiens
cactgccctgggggttgccatc

SEQ ID NO: 7550195 - DNA, 22 bp, Homo sapiens
cactgccctgggggttgccatc

SEQ ID NO: 7550196 - DNA, 22 bp, Homo sapiens
cactgcccttacatgccctgca

SEQ ID NO: 7550197 - DNA, 22 bp, Homo sapiens
cactgcccttacatgccctgca

SEQ ID NO: 7550198 - DNA, 22 bp, Homo sapiens
cactgcccttacatgccctgca

SEQ ID NO: 7550199 - DNA, 22 bp, Homo sapiens
cactgcctccccaggctccaca

SEQ ID NO: 7550200 - DNA, 22 bp, Homo sapiens
cactgcctataaatttggccaa

SEQ ID NO: 7550201 - DNA, 22 bp, Homo sapiens
cactgcctccccaggctccaca

SEQ ID NO: 7550202 - DNA, 22 bp, Homo sapiens
cactgcccttacatgccctgca

SEQ ID NO: 7550203 - DNA, 22 bp, Homo sapiens
cactgcccttacatgccctgca

SEQ ID NO: 7550204 - DNA, 22 bp, Homo sapiens
cactgcccttacatgccctgca

SEQ ID NO: 7550205 - DNA, 22 bp, Homo sapiens
cactgcccaggcacccatcttg

SEQ ID NO: 7550206 - DNA, 22 bp, Homo sapiens
cactgcccaggcacccatcttg

SEQ ID NO: 7550207 - DNA, 22 bp, Homo sapiens
cactgcccaggacctgccaccc

SEQ ID NO: 7550208 - DNA, 22 bp, Homo sapiens
cactgccctcactgtggttctc

SEQ ID NO: 7550209 - DNA, 20 bp, Homo sapiens
cactgccctccagcctgagc

SEQ ID NO: 7550210 - DNA, 20 bp, Homo sapiens
cactgccctccagcctgagc

SEQ ID NO: 7550211 - DNA, 20 bp, Homo sapiens
cactgccctccagcctgagc

SEQ ID NO: 7550212 - DNA, 20 bp, Homo sapiens
cactgccctccagcctgagc

SEQ ID NO: 7550213 - DNA, 20 bp, Homo sapiens
cactgccctccagcctgagc

SEQ ID NO: 7550214 - DNA, 22 bp, Homo sapiens
ggctcctgggggtgctcctgcc

SEQ ID NO: 7550215 - DNA, 22 bp, Homo sapiens
ggctcctgggggtgctcctgcc

SEQ ID NO: 7550216 - DNA, 22 bp, Homo sapiens
ggctcctgggggtgctcctgcc

SEQ ID NO: 7550217 - DNA, 19 bp, Homo sapiens
ggctcctggggctcagccc

SEQ ID NO: 7550218 - DNA, 22 bp, Homo sapiens
ggctccagtttgtgccttcagc

SEQ ID NO: 7550219 - DNA, 19 bp, Homo sapiens
ggctcctggggctcagccc

SEQ ID NO: 7550220 - DNA, 22 bp, Homo sapiens
ggctccagtttgtgccttcagc

SEQ ID NO: 7550221 - DNA, 22 bp, Homo sapiens
ggctccagtttgtgccttcagc

SEQ ID NO: 7550222 - DNA, 19 bp, Homo sapiens
ggctcctggggctcagccc

SEQ ID NO: 7550223 - DNA, 22 bp, Homo sapiens
ggctccagtttgtgccttcagc

SEQ ID NO: 7550224 - DNA, 22 bp, Homo sapiens
ggctccagtttgtgccttcagc

SEQ ID NO: 7550225 - DNA, 22 bp, Homo sapiens
ggctccagtttccccttggggc

SEQ ID NO: 7550226 - DNA, 22 bp, Homo sapiens
ggctccagtttccccttggggc

SEQ ID NO: 7550227 - DNA, 22 bp, Homo sapiens
ggctccagtttccccttggggc

SEQ ID NO: 7550228 - DNA, 22 bp, Homo sapiens
cactgcaacctccacctcctgg

SEQ ID NO: 7550229 - DNA, 22 bp, Homo sapiens
cactgcaacctccacctcctgg

SEQ ID NO: 7550230 - DNA, 22 bp, Homo sapiens
cactgcaacctccacctcctgg

SEQ ID NO: 7550231 - DNA, 22 bp, Homo sapiens
cactgcaacctccacctcctgg

SEQ ID NO: 7550232 - DNA, 22 bp, Homo sapiens
cactgcaacctccacctcctgg

SEQ ID NO: 7550233 - DNA, 22 bp, Homo sapiens
cactgcaacctccacctcctgg

SEQ ID NO: 7550234 - DNA, 22 bp, Homo sapiens
cactgattaagtctgctagagg

SEQ ID NO: 7550235 - DNA, 22 bp, Homo sapiens
cactgcaacctccacctcctgg

SEQ ID NO: 7550236 - DNA, 22 bp, Homo sapiens
cactgcaacaacctctacctcc

SEQ ID NO: 7550237 - DNA, 22 bp, Homo sapiens
cactgcaacctcagactcctgg

SEQ ID NO: 7550238 - DNA, 22 bp, Homo sapiens
cactgatttagtttgtgttacc

SEQ ID NO: 7550239 - DNA, 22 bp, Homo sapiens
cactgcaaaggggaaagaagca

SEQ ID NO: 7550240 - DNA, 22 bp, Homo sapiens
cactgcaaaggggaaagaagca

SEQ ID NO: 7550241 - DNA, 22 bp, Homo sapiens
cactgcaaaggggaaagaagca

SEQ ID NO: 7550242 - DNA, 22 bp, Homo sapiens
cactgcaaaggggaaagaagca

SEQ ID NO: 7550243 - DNA, 20 bp, Homo sapiens
cactgaggtgcagctcatgc

SEQ ID NO: 7550244 - DNA, 20 bp, Homo sapiens
cactgaggtgcagctcatgc

SEQ ID NO: 7550245 - DNA, 22 bp, Homo sapiens
cactgaggtttgttaactgagt

SEQ ID NO: 7550246 - DNA, 21 bp, Homo sapiens
cactgaggtcaggggtagggt

SEQ ID NO: 7550247 - DNA, 21 bp, Homo sapiens
cactgaggtcaggggtagggt

SEQ ID NO: 7550248 - DNA, 20 bp, Homo sapiens
cactgaggtgcagctcatgc

SEQ ID NO: 7550249 - DNA, 20 bp, Homo sapiens
cactgaggtgcagctcatgc

SEQ ID NO: 7550250 - DNA, 20 bp, Homo sapiens
cactgaggtgcagctcatgc

SEQ ID NO: 7550251 - DNA, 21 bp, Homo sapiens
cactgaggtcaggggtagggt

SEQ ID NO: 7550252 - DNA, 20 bp, Homo sapiens
ggcgcctggcctcatggctg

SEQ ID NO: 7550253 - DNA, 20 bp, Homo sapiens
ggcgcctggcctcatggctg

SEQ ID NO: 7550254 - DNA, 20 bp, Homo sapiens
ggcgcctggcctcatggctg

SEQ ID NO: 7550255 - DNA, 22 bp, Homo sapiens
ggcgcggagctggcttttggcc

SEQ ID NO: 7550256 - DNA, 22 bp, Homo sapiens
ggcgcggagctggcttttggcc

SEQ ID NO: 7550257 - DNA, 22 bp, Homo sapiens
ggcgcggcctctgggtcggttt

SEQ ID NO: 7550258 - DNA, 22 bp, Homo sapiens
ggcgccgcactcggtgcagccg

SEQ ID NO: 7550259 - DNA, 22 bp, Homo sapiens
ggcgccgcactcggtgcagccg

SEQ ID NO: 7550260 - DNA, 22 bp, Homo sapiens
ggcgccgcactcggtgcagccg

SEQ ID NO: 7550261 - DNA, 22 bp, Homo sapiens
ggcgccgcactcggtgcagccg

SEQ ID NO: 7550262 - DNA, 20 bp, Homo sapiens
ggcgcctggcctcatggctg

SEQ ID NO: 7550263 - DNA, 22 bp, Homo sapiens
ggcgccgcactcggtgcagccg

SEQ ID NO: 7550264 - DNA, 22 bp, Homo sapiens
ggcgctcagtgttgccccagag

SEQ ID NO: 7550265 - DNA, 22 bp, Homo sapiens
ggcgctcagtgttgccccagag

SEQ ID NO: 7550266 - DNA, 22 bp, Homo sapiens
ggcgctcagtgttgccccagag

SEQ ID NO: 7550267 - DNA, 22 bp, Homo sapiens
ggcgctcagtgttgccccagag

SEQ ID NO: 7550268 - DNA, 22 bp, Homo sapiens
ggcgctcagtgttgccccagag

SEQ ID NO: 7550269 - DNA, 22 bp, Homo sapiens
ggcgctcagtgttgccccagag

SEQ ID NO: 7550270 - DNA, 22 bp, Homo sapiens
ggcgctggccacggtggctctg

SEQ ID NO: 7550271 - DNA, 22 bp, Homo sapiens
ggcgctggccacggtggctctg

SEQ ID NO: 7550272 - DNA, 22 bp, Homo sapiens
ggcgctcagtgttgccccagag

SEQ ID NO: 7550273 - DNA, 22 bp, Homo sapiens
cactgaggcttccttaggcaat

SEQ ID NO: 7550274 - DNA, 22 bp, Homo sapiens
cactgaggcttccttaggcaat

SEQ ID NO: 7550275 - DNA, 22 bp, Homo sapiens
cactgaggctgggggagaaggt

SEQ ID NO: 7550276 - DNA, 22 bp, Homo sapiens
cactgagggcggagcccaggga

SEQ ID NO: 7550277 - DNA, 22 bp, Homo sapiens
cactgagggcggagcccaggga

SEQ ID NO: 7550278 - DNA, 22 bp, Homo sapiens
cactgagggcggagcccaggga

SEQ ID NO: 7550279 - DNA, 22 bp, Homo sapiens
cactgagggagggtttcttctg

SEQ ID NO: 7550280 - DNA, 22 bp, Homo sapiens
cactgagggggtggtttcagga

SEQ ID NO: 7550281 - DNA, 22 bp, Homo sapiens
cactgagggcggagcccaggga

SEQ ID NO: 7550282 - DNA, 22 bp, Homo sapiens
cactgagggcggagcccaggga

SEQ ID NO: 7550283 - DNA, 22 bp, Homo sapiens
cactgaggtatctgtctctcct

SEQ ID NO: 7550284 - DNA, 22 bp, Homo sapiens
cactgaggtatctgtctctcct

SEQ ID NO: 7550285 - DNA, 22 bp, Homo sapiens
cactgaggtatctgtctctcct

SEQ ID NO: 7550286 - DNA, 22 bp, Homo sapiens
cactgaggtatctgtctctcct

SEQ ID NO: 7550287 - DNA, 22 bp, Homo sapiens
cactgaggtatctgtctctcct

SEQ ID NO: 7550288 - DNA, 22 bp, Homo sapiens
cactgagggggtggtttcagga

SEQ ID NO: 7550289 - DNA, 22 bp, Homo sapiens
cactgcctctgcctcctgggtt

SEQ ID NO: 7550290 - DNA, 22 bp, Homo sapiens
cactgcctgctggctgtcactt

SEQ ID NO: 7550291 - DNA, 22 bp, Homo sapiens
cactgcctccccaggctccaca

SEQ ID NO: 7550292 - DNA, 22 bp, Homo sapiens
cactgcctctgcctcctgggtt

SEQ ID NO: 7550293 - DNA, 22 bp, Homo sapiens
cactgcctctgcctcctgggtt

SEQ ID NO: 7550294 - DNA, 22 bp, Homo sapiens
cactgcctctgcctcctgggtt

SEQ ID NO: 7550295 - DNA, 22 bp, Homo sapiens
cactgcctccccaggctccaca

SEQ ID NO: 7550296 - DNA, 22 bp, Homo sapiens
cactgcctccccaggctccaca

SEQ ID NO: 7550297 - DNA, 22 bp, Homo sapiens
cactgcctccccaggctccaca

SEQ ID NO: 7550298 - DNA, 22 bp, Homo sapiens
ggctgcagaggcgatctgaggt

SEQ ID NO: 7550299 - DNA, 22 bp, Homo sapiens
ggctgaggctcatgccatcttg

SEQ ID NO: 7550300 - DNA, 22 bp, Homo sapiens
ggctgaggctcatgccatcttg

SEQ ID NO: 7550301 - DNA, 22 bp, Homo sapiens
ggctgaggctcatgccatcttg

SEQ ID NO: 7550302 - DNA, 22 bp, Homo sapiens
ggctgaggctcatgccatcttg

SEQ ID NO: 7550303 - DNA, 22 bp, Homo sapiens
ggctgaggctcatgccatcttg

SEQ ID NO: 7550304 - DNA, 22 bp, Homo sapiens
ggctgaggctcatgccatcttg

SEQ ID NO: 7550305 - DNA, 22 bp, Homo sapiens
ggctgcagatagccagccacca

SEQ ID NO: 7550306 - DNA, 22 bp, Homo sapiens
ggctgcagatagccagccacca

SEQ ID NO: 7550307 - DNA, 22 bp, Homo sapiens
ggctgcagattgtagtctgtta

SEQ ID NO: 7550308 - DNA, 22 bp, Homo sapiens
ggctgcagattgtagtctgtta

SEQ ID NO: 7550309 - DNA, 22 bp, Homo sapiens
ggctgcagattgtagtctgtta

SEQ ID NO: 7550310 - DNA, 22 bp, Homo sapiens
ggctgcagattgtagtctgtta

SEQ ID NO: 7550311 - DNA, 22 bp, Homo sapiens
ggctgcagattgtagtctgtta

SEQ ID NO: 7550312 - DNA, 22 bp, Homo sapiens
ggctgcagatagccagccacca

SEQ ID NO: 7550313 - DNA, 22 bp, Homo sapiens
ggctgcagatagccagccacca

SEQ ID NO: 7550314 - DNA, 22 bp, Homo sapiens
ggctgcagatagccagccacca

SEQ ID NO: 7550315 - DNA, 22 bp, Homo sapiens
ggctgcagatagccagccacca

SEQ ID NO: 7550316 - DNA, 22 bp, Homo sapiens
ggctgcagatagccagccacca

SEQ ID NO: 7550317 - DNA, 22 bp, Homo sapiens
ggctgcagaggcgatctgaggt

SEQ ID NO: 7550318 - DNA, 22 bp, Homo sapiens
ggctgcagaggtcactttatag

SEQ ID NO: 7550319 - DNA, 22 bp, Homo sapiens
ggctgcagaggtcactttatag

SEQ ID NO: 7550320 - DNA, 22 bp, Homo sapiens
ggctgcagccctcgcctagcca

SEQ ID NO: 7550321 - DNA, 22 bp, Homo sapiens
ggctgcagcagagggactcacg

SEQ ID NO: 7550322 - DNA, 22 bp, Homo sapiens
ggctgcagccctcgcctagcca

SEQ ID NO: 7550323 - DNA, 22 bp, Homo sapiens
ggctgcagccctcgcctagcca

SEQ ID NO: 7550324 - DNA, 22 bp, Homo sapiens
ggctgcagccctcgcctagcca

SEQ ID NO: 7550325 - DNA, 22 bp, Homo sapiens
ggctgcagccctcgcctagcca

SEQ ID NO: 7550326 - DNA, 22 bp, Homo sapiens
ggctgcagccctcgcctagcca

SEQ ID NO: 7550327 - DNA, 22 bp, Homo sapiens
ggctgcagccctcgcctagcca

SEQ ID NO: 7550328 - DNA, 22 bp, Homo sapiens
ggctgcagccctcgcctagcca

SEQ ID NO: 7550329 - DNA, 22 bp, Homo sapiens
ggctgcagccctcgcctagcca

SEQ ID NO: 7550330 - DNA, 22 bp, Homo sapiens
ggctgcagattgtagtctgtta

SEQ ID NO: 7550331 - DNA, 22 bp, Homo sapiens
ggctgcagattgtagtctgtta

SEQ ID NO: 7550332 - DNA, 22 bp, Homo sapiens
ggctgcagcagagggactcacg

SEQ ID NO: 7550333 - DNA, 22 bp, Homo sapiens
ggctgcagcagagggactcacg

SEQ ID NO: 7550334 - DNA, 22 bp, Homo sapiens
ggctgcagcagagggactcacg

SEQ ID NO: 7550335 - DNA, 22 bp, Homo sapiens
ggctgcagcagagggactcacg

SEQ ID NO: 7550336 - DNA, 22 bp, Homo sapiens
ggctgcagcagagggactcacg

SEQ ID NO: 7550337 - DNA, 22 bp, Homo sapiens
ggctgcagccctcgcctagcca

SEQ ID NO: 7550338 - DNA, 22 bp, Homo sapiens
ggctgcagcagagggactcacg

SEQ ID NO: 7550339 - DNA, 22 bp, Homo sapiens
ggctgcagcggattggggattg

SEQ ID NO: 7550340 - DNA, 22 bp, Homo sapiens
ggctgcagcggattggggattg

SEQ ID NO: 7550341 - DNA, 22 bp, Homo sapiens
ggctgcagccctcgcctagcca

SEQ ID NO: 7550342 - DNA, 22 bp, Homo sapiens
ggctgcagcggattggggattg

SEQ ID NO: 7550343 - DNA, 22 bp, Homo sapiens
ggctgcagcggattggggattg

SEQ ID NO: 7550344 - DNA, 22 bp, Homo sapiens
cactgtctattaatataactta

SEQ ID NO: 7550345 - DNA, 22 bp, Homo sapiens
cactgtctattaatataactta

SEQ ID NO: 7550346 - DNA, 19 bp, Homo sapiens
cactgtcctagtcgaggcc

SEQ ID NO: 7550347 - DNA, 19 bp, Homo sapiens
cactgtcctagtcgaggcc

SEQ ID NO: 7550348 - DNA, 22 bp, Homo sapiens
cactgtccctgtttcctggaaa

SEQ ID NO: 7550349 - DNA, 22 bp, Homo sapiens
cactgtccctgtttcctggaaa

SEQ ID NO: 7550350 - DNA, 22 bp, Homo sapiens
ggctgcctttagaacggatgct

SEQ ID NO: 7550351 - DNA, 22 bp, Homo sapiens
ggctgcctttagaacggatgct

SEQ ID NO: 7550352 - DNA, 22 bp, Homo sapiens
ggctgcctttagaacggatgct

SEQ ID NO: 7550353 - DNA, 22 bp, Homo sapiens
ggctgcctttagaacggatgct

SEQ ID NO: 7550354 - DNA, 22 bp, Homo sapiens
ggctgccttgggggttgtcatt

SEQ ID NO: 7550355 - DNA, 22 bp, Homo sapiens
ggctgccttgggggttgtcatt

SEQ ID NO: 7550356 - DNA, 19 bp, Homo sapiens
ggctgcctttccttaccag

SEQ ID NO: 7550357 - DNA, 19 bp, Homo sapiens
ggctgcctttccttaccag

SEQ ID NO: 7550358 - DNA, 19 bp, Homo sapiens
ggctgcctttccttaccag

SEQ ID NO: 7550359 - DNA, 22 bp, Homo sapiens
ggctgcggatctaaggctggga

SEQ ID NO: 7550360 - DNA, 22 bp, Homo sapiens
ggctgcggatctaaggctggga

SEQ ID NO: 7550361 - DNA, 22 bp, Homo sapiens
ggctgcggatctaaggctggga

SEQ ID NO: 7550362 - DNA, 19 bp, Homo sapiens
ggctgcctttccttaccag

SEQ ID NO: 7550363 - DNA, 22 bp, Homo sapiens
ggctgctagcaatgctcaggcg

SEQ ID NO: 7550364 - DNA, 22 bp, Homo sapiens
ggctgctcaaggactctgatcg

SEQ ID NO: 7550365 - DNA, 22 bp, Homo sapiens
ggctgctcaaggactctgatcg

SEQ ID NO: 7550366 - DNA, 22 bp, Homo sapiens
ggctgcggccgcgggtctgtgc

SEQ ID NO: 7550367 - DNA, 22 bp, Homo sapiens
ggctgctcggagcctcctgtga

SEQ ID NO: 7550368 - DNA, 22 bp, Homo sapiens
ggctgctcggagcctcctgtga

SEQ ID NO: 7550369 - DNA, 22 bp, Homo sapiens
ggctgctgggtcatgatgcaga

SEQ ID NO: 7550370 - DNA, 18 bp, Homo sapiens
ggctgctcgctctccccg

SEQ ID NO: 7550371 - DNA, 18 bp, Homo sapiens
ggctgctcgctctccccg

SEQ ID NO: 7550372 - DNA, 22 bp, Homo sapiens
ggctgctcctttaccctggcag

SEQ ID NO: 7550373 - DNA, 22 bp, Homo sapiens
ggctgctcctttaccctggcag

SEQ ID NO: 7550374 - DNA, 22 bp, Homo sapiens
ggctgctcctttaccctggcag

SEQ ID NO: 7550375 - DNA, 22 bp, Homo sapiens
ggctgctcacgcagccctccct

SEQ ID NO: 7550376 - DNA, 22 bp, Homo sapiens
ggctgctcacgcagccctccct

SEQ ID NO: 7550377 - DNA, 18 bp, Homo sapiens
ggctgctcctctccctac

SEQ ID NO: 7550378 - DNA, 18 bp, Homo sapiens
ggctgctcctctccctac

SEQ ID NO: 7550379 - DNA, 18 bp, Homo sapiens
ggctgctcctctccctac

SEQ ID NO: 7550380 - DNA, 21 bp, Homo sapiens
ggctgctcacctaggtcccaa

SEQ ID NO: 7550381 - DNA, 21 bp, Homo sapiens
ggctgctcacctaggtcccaa

SEQ ID NO: 7550382 - DNA, 21 bp, Homo sapiens
ggctgctcacctaggtcccaa

SEQ ID NO: 7550383 - DNA, 22 bp, Homo sapiens
ggctgcctcaaagctcaagctc

SEQ ID NO: 7550384 - DNA, 22 bp, Homo sapiens
cactgtgaaaaatggagtggtc

SEQ ID NO: 7550385 - DNA, 22 bp, Homo sapiens
cactgtcttttgtgaagacaat

SEQ ID NO: 7550386 - DNA, 22 bp, Homo sapiens
cactgtgaaaaatggagtggtc

SEQ ID NO: 7550387 - DNA, 22 bp, Homo sapiens
cactgtcttttgtgaagacaat

SEQ ID NO: 7550388 - DNA, 22 bp, Homo sapiens
ggctgccttgaccctggctccg

SEQ ID NO: 7550389 - DNA, 22 bp, Homo sapiens
ggctgcctcagatttgctgact

SEQ ID NO: 7550390 - DNA, 22 bp, Homo sapiens
ggctgcctcaattaatcttaca

SEQ ID NO: 7550391 - DNA, 22 bp, Homo sapiens
ggctgcctcaattaatcttaca

SEQ ID NO: 7550392 - DNA, 22 bp, Homo sapiens
ggctgccttgaccctggctccg

SEQ ID NO: 7550393 - DNA, 22 bp, Homo sapiens
ggctgccttgaccctggctccg

SEQ ID NO: 7550394 - DNA, 22 bp, Homo sapiens
ggctgccttgggggttgtcatt

SEQ ID NO: 7550395 - DNA, 22 bp, Homo sapiens
ggctgccttgggggttgtcatt

SEQ ID NO: 7550396 - DNA, 22 bp, Homo sapiens
ggctgccttgaccctggctccg

SEQ ID NO: 7550397 - DNA, 22 bp, Homo sapiens
cactgtcttcagtttcactgca

SEQ ID NO: 7550398 - DNA, 22 bp, Homo sapiens
cactgtcctagtcttcctggag

SEQ ID NO: 7550399 - DNA, 22 bp, Homo sapiens
cactgtcctagtcttcctggag

SEQ ID NO: 7550400 - DNA, 22 bp, Homo sapiens
cactgtctgtgtgtccttgggg

SEQ ID NO: 7550401 - DNA, 22 bp, Homo sapiens
cactgtcttcagtttcactgca

SEQ ID NO: 7550402 - DNA, 22 bp, Homo sapiens
cactgtcttcagtttcactgca

SEQ ID NO: 7550403 - DNA, 22 bp, Homo sapiens
cactgtcttcagtttcactgca

SEQ ID NO: 7550404 - DNA, 22 bp, Homo sapiens
cactgtcttgattactatgggt

SEQ ID NO: 7550405 - DNA, 22 bp, Homo sapiens
cactgtcttgattactatgggt

SEQ ID NO: 7550406 - DNA, 22 bp, Homo sapiens
cactgtcttttgtgaagacaat

SEQ ID NO: 7550407 - DNA, 22 bp, Homo sapiens
cactgtcttttgtgaagacaat

SEQ ID NO: 7550408 - DNA, 22 bp, Homo sapiens
cactgtctgtgtgtccttgggg

SEQ ID NO: 7550409 - DNA, 22 bp, Homo sapiens
cactgtctgggacatgtggtct

SEQ ID NO: 7550410 - DNA, 22 bp, Homo sapiens
cactgtctgcttcgactcttca

SEQ ID NO: 7550411 - DNA, 22 bp, Homo sapiens
cactgtctgagctggtgattag

SEQ ID NO: 7550412 - DNA, 22 bp, Homo sapiens
cactgtctcctagggggacttc

SEQ ID NO: 7550413 - DNA, 22 bp, Homo sapiens
cactgtctgagctggtgattag

SEQ ID NO: 7550414 - DNA, 22 bp, Homo sapiens
cactgtctgcttcgactcttca

SEQ ID NO: 7550415 - DNA, 22 bp, Homo sapiens
gaacatcatgaagaaaacatat

SEQ ID NO: 7550416 - DNA, 22 bp, Homo sapiens
gaacatcatgaagaaaacatat

SEQ ID NO: 7550417 - DNA, 22 bp, Homo sapiens
gaacatcaaggtctgtgtctag

SEQ ID NO: 7550418 - DNA, 22 bp, Homo sapiens
gaacatacaagaattaagtaca

SEQ ID NO: 7550419 - DNA, 22 bp, Homo sapiens
gaacatcaaggtctgtgtctag

SEQ ID NO: 7550420 - DNA, 22 bp, Homo sapiens
gaacataattaaatgtcctggg

SEQ ID NO: 7550421 - DNA, 22 bp, Homo sapiens
gaacatatgcatgtttgttttg

SEQ ID NO: 7550422 - DNA, 22 bp, Homo sapiens
gaacatatgcatgtttgttttg

SEQ ID NO: 7550423 - DNA, 22 bp, Homo sapiens
gaacaatgagtcattcaggtga

SEQ ID NO: 7550424 - DNA, 22 bp, Homo sapiens
gaacaatgagtcattcaggtga

SEQ ID NO: 7550425 - DNA, 19 bp, Homo sapiens
gaacaatttgttagctctc

SEQ ID NO: 7550426 - DNA, 19 bp, Homo sapiens
gaacaatttgttagctctc

SEQ ID NO: 7550427 - DNA, 22 bp, Homo sapiens
gaacaatgagtcattcaggtga

SEQ ID NO: 7550428 - DNA, 19 bp, Homo sapiens
gaacaatttgttagctctc

SEQ ID NO: 7550429 - DNA, 22 bp, Homo sapiens
gaacataactattgtgaatagt

SEQ ID NO: 7550430 - DNA, 19 bp, Homo sapiens
gaacaatttgttagctctc

SEQ ID NO: 7550431 - DNA, 22 bp, Homo sapiens
atgaggcatctgcagtcactag

SEQ ID NO: 7550432 - DNA, 22 bp, Homo sapiens
gaacataactattgtgaatagt

SEQ ID NO: 7550433 - DNA, 22 bp, Homo sapiens
gaacataattaaatgtcctggg

SEQ ID NO: 7550434 - DNA, 23 bp, Homo sapiens
atgaggcattaaacaggcttttt

SEQ ID NO: 7550435 - DNA, 23 bp, Homo sapiens
atgaggcattaaacaggcttttt

SEQ ID NO: 7550436 - DNA, 22 bp, Homo sapiens
atgaggcattcacagaaggcac

SEQ ID NO: 7550437 - DNA, 22 bp, Homo sapiens
atgaggcattcacagaaggcac

SEQ ID NO: 7550438 - DNA, 22 bp, Homo sapiens
atgaggcattcacagaaggcac

SEQ ID NO: 7550439 - DNA, 23 bp, Homo sapiens
atgaggcattaaacaggcttttt

SEQ ID NO: 7550440 - DNA, 22 bp, Homo sapiens
atgaggcatgtgaggagaaggg

SEQ ID NO: 7550441 - DNA, 22 bp, Homo sapiens
atgaggcatgtgaggagaaggg

SEQ ID NO: 7550442 - DNA, 22 bp, Homo sapiens
atgaggcatgtgaggagaaggg

SEQ ID NO: 7550443 - DNA, 22 bp, Homo sapiens
atgaggcattcacagaaggcac

SEQ ID NO: 7550444 - DNA, 22 bp, Homo sapiens
atgaggcattccactcaaactc

SEQ ID NO: 7550445 - DNA, 22 bp, Homo sapiens
atgaggcattccactcaaactc

SEQ ID NO: 7550446 - DNA, 15 bp, Homo sapiens
atgaggcatttgggg

SEQ ID NO: 7550447 - DNA, 22 bp, Homo sapiens
gaacaatgaaagacataaactc

SEQ ID NO: 7550448 - DNA, 22 bp, Homo sapiens
gaacaatgagtcattcaggtga

SEQ ID NO: 7550449 - DNA, 22 bp, Homo sapiens
atgaggcattccactcaaactc

SEQ ID NO: 7550450 - DNA, 22 bp, Homo sapiens
gaacaatgaaagacataaactc

SEQ ID NO: 7550451 - DNA, 22 bp, Homo sapiens
atgaggcatctgcagtcactag

SEQ ID NO: 7550452 - DNA, 22 bp, Homo sapiens
atgaggcatctgcagtcactag

SEQ ID NO: 7550453 - DNA, 22 bp, Homo sapiens
atgaggcatctaacattgcaaa

SEQ ID NO: 7550454 - DNA, 22 bp, Homo sapiens
atgaggcatctaacattgcaaa

SEQ ID NO: 7550455 - DNA, 22 bp, Homo sapiens
atgaggcatctaacattgcaaa

SEQ ID NO: 7550456 - DNA, 22 bp, Homo sapiens
atgaggcatatcctcctatggt

SEQ ID NO: 7550457 - DNA, 22 bp, Homo sapiens
atgaggcatatcctcctatggt

SEQ ID NO: 7550458 - DNA, 16 bp, Homo sapiens
atgaggcataggctgc

SEQ ID NO: 7550459 - DNA, 22 bp, Homo sapiens
atgaggcatatcctcctatggt

SEQ ID NO: 7550460 - DNA, 22 bp, Homo sapiens
atgaggcatctaacattgcaaa

SEQ ID NO: 7550461 - DNA, 22 bp, Homo sapiens
atgaggcatgtgaggagaaggg

SEQ ID NO: 7550462 - DNA, 22 bp, Homo sapiens
atgaggcatgtgaggagaaggg

SEQ ID NO: 7550463 - DNA, 22 bp, Homo sapiens
atgaggcatgtgaggagaaggg

SEQ ID NO: 7550464 - DNA, 22 bp, Homo sapiens
atgaggcatgggatcaaaatga

SEQ ID NO: 7550465 - DNA, 21 bp, Homo sapiens
atgaggcatgagagggtttct

SEQ ID NO: 7550466 - DNA, 22 bp, Homo sapiens
atgaggcatgggatcaaaatga

SEQ ID NO: 7550467 - DNA, 22 bp, Homo sapiens
atgaggcatgggatcaaaatga

SEQ ID NO: 7550468 - DNA, 21 bp, Homo sapiens
atgaggcatgagagggtttct

SEQ ID NO: 7550469 - DNA, 22 bp, Homo sapiens
atgaggcatgggatcaaaatga

SEQ ID NO: 7550470 - DNA, 22 bp, Homo sapiens
atgaggcatctgcagtcactag

SEQ ID NO: 7550471 - DNA, 22 bp, Homo sapiens
atgaggcatagcagggatcgga

SEQ ID NO: 7550472 - DNA, 22 bp, Homo sapiens
atgaggcatagcagggatcgga

SEQ ID NO: 7550473 - DNA, 22 bp, Homo sapiens
atgaggcagtctggcctgaggg

SEQ ID NO: 7550474 - DNA, 22 bp, Homo sapiens
atgaggcatagcagggatcgga

SEQ ID NO: 7550475 - DNA, 16 bp, Homo sapiens
atgaggcataggctgc

SEQ ID NO: 7550476 - DNA, 16 bp, Homo sapiens
atgaggcataggctgc

SEQ ID NO: 7550477 - DNA, 22 bp, Homo sapiens
atgaggcatagcagggatcgga

SEQ ID NO: 7550478 - DNA, 22 bp, Homo sapiens
atgaggcatagcagggatcgga

SEQ ID NO: 7550479 - DNA, 22 bp, Homo sapiens
atgaggcagtctggcctgaggg

SEQ ID NO: 7550480 - DNA, 22 bp, Homo sapiens
atgaggcagtctggcctgaggg

SEQ ID NO: 7550481 - DNA, 22 bp, Homo sapiens
gaaatgattttagtttatcatg

SEQ ID NO: 7550482 - DNA, 22 bp, Homo sapiens
gaaatgattttagtttatcatg

SEQ ID NO: 7550483 - DNA, 22 bp, Homo sapiens
gaaatgacaaggacattcctgt

SEQ ID NO: 7550484 - DNA, 22 bp, Homo sapiens
gaaatgatgtctgtgctgccac

SEQ ID NO: 7550485 - DNA, 22 bp, Homo sapiens
gaaatgacaaggacattcctgt

SEQ ID NO: 7550486 - DNA, 22 bp, Homo sapiens
gaaatgattttagtttatcatg

SEQ ID NO: 7550487 - DNA, 22 bp, Homo sapiens
gaaatgattttagtttatcatg

SEQ ID NO: 7550488 - DNA, 22 bp, Homo sapiens
gaaatgatgtctgtgctgccac

SEQ ID NO: 7550489 - DNA, 22 bp, Homo sapiens
gaaatgatgtctgtgctgccac

SEQ ID NO: 7550490 - DNA, 19 bp, Homo sapiens
gaaatctctttcttgtctt

SEQ ID NO: 7550491 - DNA, 22 bp, Homo sapiens
gaaatctcgccaagcacctggg

SEQ ID NO: 7550492 - DNA, 22 bp, Homo sapiens
gaaatctccaatcttttcttta

SEQ ID NO: 7550493 - DNA, 22 bp, Homo sapiens
gaaatctccaatcttttcttta

SEQ ID NO: 7550494 - DNA, 18 bp, Homo sapiens
gaaatctcaagagacaga

SEQ ID NO: 7550495 - DNA, 22 bp, Homo sapiens
gaaatctactttgggttagaca

SEQ ID NO: 7550496 - DNA, 22 bp, Homo sapiens
gaaatctactttgggttagaca

SEQ ID NO: 7550497 - DNA, 23 bp, Homo sapiens
gaaatctagtcatttttagtctg

SEQ ID NO: 7550498 - DNA, 23 bp, Homo sapiens
gaaatctagtcatttttagtctg

SEQ ID NO: 7550499 - DNA, 18 bp, Homo sapiens
gaaatctcaagagacaga

SEQ ID NO: 7550500 - DNA, 22 bp, Homo sapiens
gaaatatacatgaagtcggctg

SEQ ID NO: 7550501 - DNA, 22 bp, Homo sapiens
gaaatatacatgaagtcggctg

SEQ ID NO: 7550502 - DNA, 22 bp, Homo sapiens
gaaatatacatgaagtcggctg

SEQ ID NO: 7550503 - DNA, 22 bp, Homo sapiens
gaaatatacatgaagtcggctg

SEQ ID NO: 7550504 - DNA, 22 bp, Homo sapiens
gaaatctacttagtgtctggat

SEQ ID NO: 7550505 - DNA, 22 bp, Homo sapiens
gaaatatacattgcaggaagag

SEQ ID NO: 7550506 - DNA, 22 bp, Homo sapiens
gaaatctacttagtgtctggat

SEQ ID NO: 7550507 - DNA, 22 bp, Homo sapiens
gaaatatacattgcaggaagag

SEQ ID NO: 7550508 - DNA, 22 bp, Homo sapiens
gaaatatacattgcaggaagag

SEQ ID NO: 7550509 - DNA, 22 bp, Homo sapiens
gaaatatacattgcaggaagag

SEQ ID NO: 7550510 - DNA, 22 bp, Homo sapiens
gaaatctacgattagtgaaaat

SEQ ID NO: 7550511 - DNA, 22 bp, Homo sapiens
gaaatctacgattagtgaaaat

SEQ ID NO: 7550512 - DNA, 22 bp, Homo sapiens
gaaatatacatgaagtcggctg

SEQ ID NO: 7550513 - DNA, 22 bp, Homo sapiens
gaaatatacatgaagtcggctg

SEQ ID NO: 7550514 - DNA, 22 bp, Homo sapiens
gaaatatacatgaagtcggctg

SEQ ID NO: 7550515 - DNA, 22 bp, Homo sapiens
gaaaatgtgtcatccctactgt

SEQ ID NO: 7550516 - DNA, 22 bp, Homo sapiens
gaaaatgtgtcatccctactgt

SEQ ID NO: 7550517 - DNA, 22 bp, Homo sapiens
gaaaatgtgcctttgggtattg

SEQ ID NO: 7550518 - DNA, 22 bp, Homo sapiens
gaaaatgtgcctttgggtattg

SEQ ID NO: 7550519 - DNA, 22 bp, Homo sapiens
gaaaatgtgcctttgggtattg

SEQ ID NO: 7550520 - DNA, 22 bp, Homo sapiens
gaaaatgtgcctttgggtattg

SEQ ID NO: 7550521 - DNA, 22 bp, Homo sapiens
gaaaatgagcctcagctacatt

SEQ ID NO: 7550522 - DNA, 22 bp, Homo sapiens
gaaaatgagcctcagctacatt

SEQ ID NO: 7550523 - DNA, 22 bp, Homo sapiens
gaaaatgagcctcagctacatt

SEQ ID NO: 7550524 - DNA, 22 bp, Homo sapiens
gaaaatgagcctcagctacatt

SEQ ID NO: 7550525 - DNA, 22 bp, Homo sapiens
gaaaatgcctctggcattaaac

SEQ ID NO: 7550526 - DNA, 22 bp, Homo sapiens
gaaaatgcctctggcattaaac

SEQ ID NO: 7550527 - DNA, 22 bp, Homo sapiens
gaaaatgcctctggcattaaac

SEQ ID NO: 7550528 - DNA, 22 bp, Homo sapiens
gaaaatgtgcctttgggtattg

SEQ ID NO: 7550529 - DNA, 22 bp, Homo sapiens
gaaaatgtgcctttgggtattg

SEQ ID NO: 7550530 - DNA, 22 bp, Homo sapiens
gaaaatgcctctggcattaaac

SEQ ID NO: 7550531 - DNA, 22 bp, Homo sapiens
gaaatcttccaatggtcacatc

SEQ ID NO: 7550532 - DNA, 22 bp, Homo sapiens
gaaatcttccttcagtgaagaa

SEQ ID NO: 7550533 - DNA, 22 bp, Homo sapiens
gaaatcttgctcattgtgacaa

SEQ ID NO: 7550534 - DNA, 22 bp, Homo sapiens
gaaatcttccttcagtgaagaa

SEQ ID NO: 7550535 - DNA, 22 bp, Homo sapiens
gaaatcttttcatctcatttga

SEQ ID NO: 7550536 - DNA, 22 bp, Homo sapiens
gaaatcttttaaccattcattt

SEQ ID NO: 7550537 - DNA, 22 bp, Homo sapiens
gaaatctttgccttagctgtgt

SEQ ID NO: 7550538 - DNA, 22 bp, Homo sapiens
gaaatctttgccttagctgtgt

SEQ ID NO: 7550539 - DNA, 22 bp, Homo sapiens
gaaatcttttaaccattcattt

SEQ ID NO: 7550540 - DNA, 22 bp, Homo sapiens
gaaatgaactgattatcattgc

SEQ ID NO: 7550541 - DNA, 22 bp, Homo sapiens
gaaatgaactgattatcattgc

SEQ ID NO: 7550542 - DNA, 22 bp, Homo sapiens
gaaatgaactgattatcattgc

SEQ ID NO: 7550543 - DNA, 22 bp, Homo sapiens
gaaatgaactgattatcattgc

SEQ ID NO: 7550544 - DNA, 22 bp, Homo sapiens
gaaatgaactgattatcattgc

SEQ ID NO: 7550545 - DNA, 22 bp, Homo sapiens
gaaatgaactgattatcattgc

SEQ ID NO: 7550546 - DNA, 22 bp, Homo sapiens
gaaatgaaatagcaccaaggtt

SEQ ID NO: 7550547 - DNA, 22 bp, Homo sapiens
gaaatgaaatagcaccaaggtt

SEQ ID NO: 7550548 - DNA, 22 bp, Homo sapiens
gaaatgaactgattatcattgc

SEQ ID NO: 7550549 - DNA, 22 bp, Homo sapiens
gaaatgaactgattatcattgc

SEQ ID NO: 7550550 - DNA, 22 bp, Homo sapiens
gaaatgaactgattatcattgc

SEQ ID NO: 7550551 - DNA, 22 bp, Homo sapiens
gaaatgaactgattatcattgc

SEQ ID NO: 7550552 - DNA, 22 bp, Homo sapiens
gaaatgaactgattatcattgc

SEQ ID NO: 7550553 - DNA, 22 bp, Homo sapiens
gaaatgaaacaggcttttaagg

SEQ ID NO: 7550554 - DNA, 22 bp, Homo sapiens
gaaatgaaacaggcttttaagg

SEQ ID NO: 7550555 - DNA, 22 bp, Homo sapiens
gaaatgaaacaggcttttaagg

SEQ ID NO: 7550556 - DNA, 22 bp, Homo sapiens
gaaatgaaacaggcttttaagg

SEQ ID NO: 7550557 - DNA, 22 bp, Homo sapiens
gaaatgaaacaggcttttaagg

SEQ ID NO: 7550558 - DNA, 22 bp, Homo sapiens
gaaatgaaacaggcttttaagg

SEQ ID NO: 7550559 - DNA, 22 bp, Homo sapiens
gaaatcttttccaattgtttag

SEQ ID NO: 7550560 - DNA, 22 bp, Homo sapiens
gaaatgaaatagcaccaaggtt

SEQ ID NO: 7550561 - DNA, 22 bp, Homo sapiens
gaaatgaaatagcaccaaggtt

SEQ ID NO: 7550562 - DNA, 22 bp, Homo sapiens
gaaatgaaatagcaccaaggtt

SEQ ID NO: 7550563 - DNA, 22 bp, Homo sapiens
gaaatgaaatagcaccaaggtt

SEQ ID NO: 7550564 - DNA, 22 bp, Homo sapiens
gaaatgaaacaggcttttaagg

SEQ ID NO: 7550565 - DNA, 22 bp, Homo sapiens
gaaatgaaacaggcttttaagg

SEQ ID NO: 7550566 - DNA, 22 bp, Homo sapiens
gaaatgaaacaggcttttaagg

SEQ ID NO: 7550567 - DNA, 22 bp, Homo sapiens
atgcaatgtgacacactacctt

SEQ ID NO: 7550568 - DNA, 22 bp, Homo sapiens
atgcaatttactgtacataaat

SEQ ID NO: 7550569 - DNA, 22 bp, Homo sapiens
atgcaatttactgtacataaat

SEQ ID NO: 7550570 - DNA, 22 bp, Homo sapiens
atgcaatttactgtacataaat

SEQ ID NO: 7550571 - DNA, 22 bp, Homo sapiens
atgcaatatgtgtttctgttta

SEQ ID NO: 7550572 - DNA, 22 bp, Homo sapiens
atgcaatcatatggcatacagc

SEQ ID NO: 7550573 - DNA, 22 bp, Homo sapiens
atgcaatatgtgtttctgttta

SEQ ID NO: 7550574 - DNA, 22 bp, Homo sapiens
atgcaatggtatatggtcacct

SEQ ID NO: 7550575 - DNA, 22 bp, Homo sapiens
atgcaatggtatatggtcacct

SEQ ID NO: 7550576 - DNA, 22 bp, Homo sapiens
atgcaatgttacagaatgtact

SEQ ID NO: 7550577 - DNA, 22 bp, Homo sapiens
atgcaatgttacagaatgtact

SEQ ID NO: 7550578 - DNA, 22 bp, Homo sapiens
atgcacaagaggctagaaaaga

SEQ ID NO: 7550579 - DNA, 22 bp, Homo sapiens
atgcacaacagacgaatggaag

SEQ ID NO: 7550580 - DNA, 22 bp, Homo sapiens
atgcacaacagacgaatggaag

SEQ ID NO: 7550581 - DNA, 21 bp, Homo sapiens
atgcacaaaaagactctttct

SEQ ID NO: 7550582 - DNA, 22 bp, Homo sapiens
atgcacaaacccacaattagtc

SEQ ID NO: 7550583 - DNA, 22 bp, Homo sapiens
atgcacaaacccacaattagtc

SEQ ID NO: 7550584 - DNA, 22 bp, Homo sapiens
atgcaataccttctgaaaataa

SEQ ID NO: 7550585 - DNA, 22 bp, Homo sapiens
atgcaataccttctgaaaataa

SEQ ID NO: 7550586 - DNA, 22 bp, Homo sapiens
atgcaataccttctgaaaataa

SEQ ID NO: 7550587 - DNA, 22 bp, Homo sapiens
atgcaatagtaattctagtctg

SEQ ID NO: 7550588 - DNA, 22 bp, Homo sapiens
atgcaatagtaattctagtctg

SEQ ID NO: 7550589 - DNA, 22 bp, Homo sapiens
atgcaatatagggaagatagat

SEQ ID NO: 7550590 - DNA, 22 bp, Homo sapiens
atgcaatatagggaagatagat

SEQ ID NO: 7550591 - DNA, 22 bp, Homo sapiens
atgcaatatagggaagatagat

SEQ ID NO: 7550592 - DNA, 22 bp, Homo sapiens
atgcaatatagggaagatagat

SEQ ID NO: 7550593 - DNA, 22 bp, Homo sapiens
atgcaataaatactttccagct

SEQ ID NO: 7550594 - DNA, 22 bp, Homo sapiens
atgcaagtcttaatagtttagg

SEQ ID NO: 7550595 - DNA, 22 bp, Homo sapiens
atgcaataccttctgaaaataa

SEQ ID NO: 7550596 - DNA, 22 bp, Homo sapiens
atgcaataccttctgaaaataa

SEQ ID NO: 7550597 - DNA, 22 bp, Homo sapiens
atgcaataaatactttccagct

SEQ ID NO: 7550598 - DNA, 18 bp, Homo sapiens
atgcaagctatggatttg

SEQ ID NO: 7550599 - DNA, 22 bp, Homo sapiens
atgcaagggttgcctttccagc

SEQ ID NO: 7550600 - DNA, 22 bp, Homo sapiens
atgcaagggttgcctttccagc

SEQ ID NO: 7550601 - DNA, 22 bp, Homo sapiens
gaagaaagattggcatgcttca

SEQ ID NO: 7550602 - DNA, 22 bp, Homo sapiens
gaagaaagattggcatgcttca

SEQ ID NO: 7550603 - DNA, 22 bp, Homo sapiens
atgcaaatgaacatgttgctag

SEQ ID NO: 7550604 - DNA, 22 bp, Homo sapiens
gaagaaagggaattaacttgag

SEQ ID NO: 7550605 - DNA, 22 bp, Homo sapiens
gaagaaagattggcatgcttca

SEQ ID NO: 7550606 - DNA, 22 bp, Homo sapiens
gaagaaagattggcatgcttca

SEQ ID NO: 7550607 - DNA, 22 bp, Homo sapiens
gaagaaagattggcatgcttca

SEQ ID NO: 7550608 - DNA, 22 bp, Homo sapiens
gaagaaagattggcatgcttca

SEQ ID NO: 7550609 - DNA, 22 bp, Homo sapiens
gaagaaagattggcatgcttca

SEQ ID NO: 7550610 - DNA, 22 bp, Homo sapiens
gaagaaagattggcatgcttca

SEQ ID NO: 7550611 - DNA, 22 bp, Homo sapiens
gaagaaagatcaaatagtttcc

SEQ ID NO: 7550612 - DNA, 22 bp, Homo sapiens
gaagaaagatcaaatagtttcc

SEQ ID NO: 7550613 - DNA, 22 bp, Homo sapiens
gaagaaactgaaaggggttggt

SEQ ID NO: 7550614 - DNA, 22 bp, Homo sapiens
gaagaaagatcaaatagtttcc

SEQ ID NO: 7550615 - DNA, 22 bp, Homo sapiens
gaagaaagatcaaatagtttcc

SEQ ID NO: 7550616 - DNA, 22 bp, Homo sapiens
gaagaaagatcaaatagtttcc

SEQ ID NO: 7550617 - DNA, 22 bp, Homo sapiens
gaagaaactgaaaggggttggt

SEQ ID NO: 7550618 - DNA, 22 bp, Homo sapiens
atgcaagagcaatatggtatgc

SEQ ID NO: 7550619 - DNA, 23 bp, Homo sapiens
atgcaagagtttctcaaactgga

SEQ ID NO: 7550620 - DNA, 23 bp, Homo sapiens
atgcaagagtttctcaaactgga

SEQ ID NO: 7550621 - DNA, 22 bp, Homo sapiens
atgcaagatgtatagaagactt

SEQ ID NO: 7550622 - DNA, 22 bp, Homo sapiens
atgcaagagatggacttgtgtt

SEQ ID NO: 7550623 - DNA, 22 bp, Homo sapiens
atgcaagagatggacttgtgtt

SEQ ID NO: 7550624 - DNA, 22 bp, Homo sapiens
atgcaagacccagaaatcatta

SEQ ID NO: 7550625 - DNA, 22 bp, Homo sapiens
atgcaagacccagaaatcatta

SEQ ID NO: 7550626 - DNA, 22 bp, Homo sapiens
atgcaaatgctagagaatgttg

SEQ ID NO: 7550627 - DNA, 22 bp, Homo sapiens
atgcaaatgctagagaatgttg

SEQ ID NO: 7550628 - DNA, 22 bp, Homo sapiens
atgcaaatgctagagaatgttg

SEQ ID NO: 7550629 - DNA, 22 bp, Homo sapiens
atgcaaatgcagccattgcaga

SEQ ID NO: 7550630 - DNA, 22 bp, Homo sapiens
atgcaaatgcagccattgcaga

SEQ ID NO: 7550631 - DNA, 22 bp, Homo sapiens
atgcaaatgcagccattgcaga

SEQ ID NO: 7550632 - DNA, 22 bp, Homo sapiens
atgcaaatgcagccattgcaga

SEQ ID NO: 7550633 - DNA, 22 bp, Homo sapiens
atgcaaatgcagccattgcaga

SEQ ID NO: 7550634 - DNA, 23 bp, Homo sapiens
gaacattcattggttgctttaga

SEQ ID NO: 7550635 - DNA, 22 bp, Homo sapiens
gaacattcacagactcaccatt

SEQ ID NO: 7550636 - DNA, 22 bp, Homo sapiens
gaacattattgtacaaatgtct

SEQ ID NO: 7550637 - DNA, 22 bp, Homo sapiens
gaacattattgtacaaatgtct

SEQ ID NO: 7550638 - DNA, 22 bp, Homo sapiens
gaacattattgtacaaatgtct

SEQ ID NO: 7550639 - DNA, 20 bp, Homo sapiens
gaacatggcaggtggagggg

SEQ ID NO: 7550640 - DNA, 20 bp, Homo sapiens
gaacatggcaggtggagggg

SEQ ID NO: 7550641 - DNA, 20 bp, Homo sapiens
gaacatggcaggtggagggg

SEQ ID NO: 7550642 - DNA, 22 bp, Homo sapiens
gaacattattgtacaaatgtct

SEQ ID NO: 7550643 - DNA, 22 bp, Homo sapiens
gaacattattgtacaaatgtct

SEQ ID NO: 7550644 - DNA, 22 bp, Homo sapiens
gaacattattgtacaaatgtct

SEQ ID NO: 7550645 - DNA, 22 bp, Homo sapiens
gaacattactgcttgggagagg

SEQ ID NO: 7550646 - DNA, 22 bp, Homo sapiens
gaacatctgttaaataaaggta

SEQ ID NO: 7550647 - DNA, 22 bp, Homo sapiens
gaacatctgtgatctctttggg

SEQ ID NO: 7550648 - DNA, 22 bp, Homo sapiens
gaacatctgttaaataaaggta

SEQ ID NO: 7550649 - DNA, 22 bp, Homo sapiens
gaacatctgttaaataaaggta

SEQ ID NO: 7550650 - DNA, 22 bp, Homo sapiens
gaacatctgggatcattgctgt

SEQ ID NO: 7550651 - DNA, 22 bp, Homo sapiens
gaacatctgccttgtggctgcc

SEQ ID NO: 7550652 - DNA, 22 bp, Homo sapiens
gaacatctgggatcattgctgt

SEQ ID NO: 7550653 - DNA, 22 bp, Homo sapiens
gaacatcatgaagaaaacatat

SEQ ID NO: 7550654 - DNA, 22 bp, Homo sapiens
gaacatctttaggggaccatca

SEQ ID NO: 7550655 - DNA, 22 bp, Homo sapiens
gaacatcttatccatttcctct

SEQ ID NO: 7550656 - DNA, 22 bp, Homo sapiens
gaacatttgatgatgacattgg

SEQ ID NO: 7550657 - DNA, 22 bp, Homo sapiens
gaacatttgatgatgacattgg

SEQ ID NO: 7550658 - DNA, 22 bp, Homo sapiens
gaacatttccagaaaggaacta

SEQ ID NO: 7550659 - DNA, 22 bp, Homo sapiens
gaacatttccagaaaggaacta

SEQ ID NO: 7550660 - DNA, 22 bp, Homo sapiens
gaacatttatgatgcaatacct

SEQ ID NO: 7550661 - DNA, 22 bp, Homo sapiens
gaacatttatgatgcaatacct

SEQ ID NO: 7550662 - DNA, 22 bp, Homo sapiens
gaacatttatgatgcaatacct

SEQ ID NO: 7550663 - DNA, 22 bp, Homo sapiens
gaacatttatgatgcaatacct

SEQ ID NO: 7550664 - DNA, 22 bp, Homo sapiens
gaacatttatgatgcaatacct

SEQ ID NO: 7550665 - DNA, 22 bp, Homo sapiens
gaacatttatattagatagcta

SEQ ID NO: 7550666 - DNA, 22 bp, Homo sapiens
gaacatttatattagatagcta

SEQ ID NO: 7550667 - DNA, 22 bp, Homo sapiens
gaacatttatattagatagcta

SEQ ID NO: 7550668 - DNA, 22 bp, Homo sapiens
gaacattcttgggcaagttact

SEQ ID NO: 7550669 - DNA, 22 bp, Homo sapiens
gaacattcttggaggaaataac

SEQ ID NO: 7550670 - DNA, 23 bp, Homo sapiens
gaacattcattggttgctttaga

SEQ ID NO: 7550671 - DNA, 22 bp, Homo sapiens
gaacattcctggaagagtgctt

SEQ ID NO: 7550672 - DNA, 22 bp, Homo sapiens
gaacattcttggaggaaataac

SEQ ID NO: 7550673 - DNA, 22 bp, Homo sapiens
gaacattcttggaggaaataac

SEQ ID NO: 7550674 - DNA, 22 bp, Homo sapiens
gaactttataactgtaaatgtc

SEQ ID NO: 7550675 - DNA, 22 bp, Homo sapiens
gaactttaggattttcacaggt

SEQ ID NO: 7550676 - DNA, 22 bp, Homo sapiens
gaactttaggattttcacaggt

SEQ ID NO: 7550677 - DNA, 22 bp, Homo sapiens
gaactttaccatttaggtaact

SEQ ID NO: 7550678 - DNA, 22 bp, Homo sapiens
gaactttaggattttcacaggt

SEQ ID NO: 7550679 - DNA, 22 bp, Homo sapiens
gaactttaggattttcacaggt

SEQ ID NO: 7550680 - DNA, 22 bp, Homo sapiens
gaactttaattagcttttgtct

SEQ ID NO: 7550681 - DNA, 22 bp, Homo sapiens
gaactttaccatttaggtaact

SEQ ID NO: 7550682 - DNA, 22 bp, Homo sapiens
gaactttaccatttaggtaact

SEQ ID NO: 7550683 - DNA, 22 bp, Homo sapiens
gaacatttgatgatgacattgg

SEQ ID NO: 7550684 - DNA, 22 bp, Homo sapiens
gaacatttgatgatgacattgg

SEQ ID NO: 7550685 - DNA, 22 bp, Homo sapiens
gaacatttgatgatgacattgg

SEQ ID NO: 7550686 - DNA, 22 bp, Homo sapiens
gaacatttgatgatgacattgg

SEQ ID NO: 7550687 - DNA, 22 bp, Homo sapiens
gaacatttgatgatgacattgg

SEQ ID NO: 7550688 - DNA, 22 bp, Homo sapiens
gaactttaaaacaaagtacagt

SEQ ID NO: 7550689 - DNA, 22 bp, Homo sapiens
gaactttaatcccttgggctta

SEQ ID NO: 7550690 - DNA, 22 bp, Homo sapiens
gaactttaaaacaaagtacagt

SEQ ID NO: 7550691 - DNA, 22 bp, Homo sapiens
gaactttatcaaaagttgttta

SEQ ID NO: 7550692 - DNA, 22 bp, Homo sapiens
gaactttatcaaaagttgttta

SEQ ID NO: 7550693 - DNA, 22 bp, Homo sapiens
gaactttgcgcagttcccgggg

SEQ ID NO: 7550694 - DNA, 22 bp, Homo sapiens
gaactttattccagaagaaagc

SEQ ID NO: 7550695 - DNA, 22 bp, Homo sapiens
gaactttcctagacctgagatg

SEQ ID NO: 7550696 - DNA, 22 bp, Homo sapiens
gaactttgcaaatgtcagaagc

SEQ ID NO: 7550697 - DNA, 22 bp, Homo sapiens
gaactttcctagacctgagatg

SEQ ID NO: 7550698 - DNA, 22 bp, Homo sapiens
gaactttggatcatgttcttgg

SEQ ID NO: 7550699 - DNA, 22 bp, Homo sapiens
gaactttgtggggctgagagga

SEQ ID NO: 7550700 - DNA, 17 bp, Homo sapiens
gaacttttattaaattc

SEQ ID NO: 7550701 - DNA, 17 bp, Homo sapiens
gaacttttattaaattc

SEQ ID NO: 7550702 - DNA, 17 bp, Homo sapiens
gaacttttattaaattc

SEQ ID NO: 7550703 - DNA, 17 bp, Homo sapiens
gaacttttattaaattc

SEQ ID NO: 7550704 - DNA, 17 bp, Homo sapiens
gaacttttattaaattc

SEQ ID NO: 7550705 - DNA, 18 bp, Homo sapiens
gaacttttggctttgtgt

SEQ ID NO: 7550706 - DNA, 18 bp, Homo sapiens
gaacttttggctttgtgt

SEQ ID NO: 7550707 - DNA, 22 bp, Homo sapiens
gaacttttgggaagccgtgtga

SEQ ID NO: 7550708 - DNA, 22 bp, Homo sapiens
gaagaaacaggggcttggggag

SEQ ID NO: 7550709 - DNA, 22 bp, Homo sapiens
gaaaagagaacatctgaggatc

SEQ ID NO: 7550710 - DNA, 22 bp, Homo sapiens
gaaaagaactgcatgggattaa

SEQ ID NO: 7550711 - DNA, 22 bp, Homo sapiens
gaaaagaactgcatgggattaa

SEQ ID NO: 7550712 - DNA, 22 bp, Homo sapiens
gaaaagaactgcatgggattaa

SEQ ID NO: 7550713 - DNA, 22 bp, Homo sapiens
gaaaagaactgcatgggattaa

SEQ ID NO: 7550714 - DNA, 22 bp, Homo sapiens
gaaaagaactgcatgggattaa

SEQ ID NO: 7550715 - DNA, 22 bp, Homo sapiens
gaaaagaactgcatgggattaa

SEQ ID NO: 7550716 - DNA, 22 bp, Homo sapiens
gaaaagaactgcatgggattaa

SEQ ID NO: 7550717 - DNA, 22 bp, Homo sapiens
gaaaagaactgcatgggattaa

SEQ ID NO: 7550718 - DNA, 22 bp, Homo sapiens
gaaaagaactgcatgggattaa

SEQ ID NO: 7550719 - DNA, 22 bp, Homo sapiens
gaaaagaactgcatgggattaa

SEQ ID NO: 7550720 - DNA, 22 bp, Homo sapiens
gaaaacttggatctctagaatg

SEQ ID NO: 7550721 - DNA, 22 bp, Homo sapiens
gaaaacttggatctctagaatg

SEQ ID NO: 7550722 - DNA, 22 bp, Homo sapiens
gaaaacttggatctctagaatg

SEQ ID NO: 7550723 - DNA, 22 bp, Homo sapiens
gaaaactaacggaaaagttagg

SEQ ID NO: 7550724 - DNA, 22 bp, Homo sapiens
gaaaactaacggaaaagttagg

SEQ ID NO: 7550725 - DNA, 22 bp, Homo sapiens
gaaaactaacggaaaagttagg

SEQ ID NO: 7550726 - DNA, 22 bp, Homo sapiens
gaaaactaacggaaaagttagg

SEQ ID NO: 7550727 - DNA, 22 bp, Homo sapiens
gaaaactaacggaaaagttagg

SEQ ID NO: 7550728 - DNA, 22 bp, Homo sapiens
gaaaactaacggaaaagttagg

SEQ ID NO: 7550729 - DNA, 22 bp, Homo sapiens
gaaaactaacggaaaagttagg

SEQ ID NO: 7550730 - DNA, 22 bp, Homo sapiens
gaaaactattggcctagaacaa

SEQ ID NO: 7550731 - DNA, 22 bp, Homo sapiens
gaaaacttggatctctagaatg

SEQ ID NO: 7550732 - DNA, 22 bp, Homo sapiens
gaaaacttggatctctagaatg

SEQ ID NO: 7550733 - DNA, 22 bp, Homo sapiens
gaaaactgtgattagaatgcct

SEQ ID NO: 7550734 - DNA, 22 bp, Homo sapiens
gaaaactgtgattagaatgcct

SEQ ID NO: 7550735 - DNA, 22 bp, Homo sapiens
gaaaactgtgattagaatgcct

SEQ ID NO: 7550736 - DNA, 22 bp, Homo sapiens
gaaaactgtgattagaatgcct

SEQ ID NO: 7550737 - DNA, 22 bp, Homo sapiens
gaaaactgtgattagaatgcct

SEQ ID NO: 7550738 - DNA, 22 bp, Homo sapiens
gaaaactgtgattagaatgcct

SEQ ID NO: 7550739 - DNA, 22 bp, Homo sapiens
gaaaactgtgattagaatgcct

SEQ ID NO: 7550740 - DNA, 22 bp, Homo sapiens
gaaaactattggcctagaacaa

SEQ ID NO: 7550741 - DNA, 22 bp, Homo sapiens
gaaaactattggcctagaacaa

SEQ ID NO: 7550742 - DNA, 22 bp, Homo sapiens
gaaaactattggcctagaacaa

SEQ ID NO: 7550743 - DNA, 20 bp, Homo sapiens
gaaaataggccagccaggta

SEQ ID NO: 7550744 - DNA, 20 bp, Homo sapiens
gaaaataggccagccaggta

SEQ ID NO: 7550745 - DNA, 22 bp, Homo sapiens
gaaaataggctgcatctccttc

SEQ ID NO: 7550746 - DNA, 20 bp, Homo sapiens
gaaaataggccagccaggta

SEQ ID NO: 7550747 - DNA, 20 bp, Homo sapiens
gaaaataggccagccaggta

SEQ ID NO: 7550748 - DNA, 22 bp, Homo sapiens
gaaaataggcagatgcattgta

SEQ ID NO: 7550749 - DNA, 22 bp, Homo sapiens
gaaaataggcagatgcattgta

SEQ ID NO: 7550750 - DNA, 20 bp, Homo sapiens
gaaaataggccagccaggta

SEQ ID NO: 7550751 - DNA, 20 bp, Homo sapiens
gaaaataggccagccaggta

SEQ ID NO: 7550752 - DNA, 22 bp, Homo sapiens
gaaaatagcagatagaccaatg

SEQ ID NO: 7550753 - DNA, 22 bp, Homo sapiens
gaaaatagcagatagaccaatg

SEQ ID NO: 7550754 - DNA, 22 bp, Homo sapiens
gaaaatagcagatagaccaatg

SEQ ID NO: 7550755 - DNA, 22 bp, Homo sapiens
gaaaatagcagatagaccaatg

SEQ ID NO: 7550756 - DNA, 22 bp, Homo sapiens
gaaaagagaacatctgaggatc

SEQ ID NO: 7550757 - DNA, 22 bp, Homo sapiens
gaaaataggcagatgcattgta

SEQ ID NO: 7550758 - DNA, 22 bp, Homo sapiens
gaaaataggcagatgcattgta

SEQ ID NO: 7550759 - DNA, 22 bp, Homo sapiens
gaaaataggcagatgcattgta

SEQ ID NO: 7550760 - DNA, 22 bp, Homo sapiens
gaaaataggctgcatctccttc

SEQ ID NO: 7550761 - DNA, 22 bp, Homo sapiens
gaaaataggctgcatctccttc

SEQ ID NO: 7550762 - DNA, 22 bp, Homo sapiens
gaaaatagttcatcacaatgat

SEQ ID NO: 7550763 - DNA, 22 bp, Homo sapiens
gaaaatagttcatcacaatgat

SEQ ID NO: 7550764 - DNA, 22 bp, Homo sapiens
gaaaataggctgcatctccttc

SEQ ID NO: 7550765 - DNA, 22 bp, Homo sapiens
gaaaataggctgcatctccttc

SEQ ID NO: 7550766 - DNA, 22 bp, Homo sapiens
gaaaatagttcatcacaatgat

SEQ ID NO: 7550767 - DNA, 22 bp, Homo sapiens
gaaaatagttcatcacaatgat

SEQ ID NO: 7550768 - DNA, 22 bp, Homo sapiens
gaaaatagttcatcacaatgat

SEQ ID NO: 7550769 - DNA, 22 bp, Homo sapiens
gaaaatagttcatcacaatgat

SEQ ID NO: 7550770 - DNA, 22 bp, Homo sapiens
gaaaatagttcatcacaatgat

SEQ ID NO: 7550771 - DNA, 22 bp, Homo sapiens
gaaaatagttcatcacaatgat

SEQ ID NO: 7550772 - DNA, 22 bp, Homo sapiens
gaaaatagttcatcacaatgat

SEQ ID NO: 7550773 - DNA, 22 bp, Homo sapiens
gaaaatgagcctcagctacatt

SEQ ID NO: 7550774 - DNA, 22 bp, Homo sapiens
gaaaatgagcctcagctacatt

SEQ ID NO: 7550775 - DNA, 22 bp, Homo sapiens
gaaaatgagcctcagctacatt

SEQ ID NO: 7550776 - DNA, 22 bp, Homo sapiens
gaaaatgagcctcagctacatt

SEQ ID NO: 7550777 - DNA, 22 bp, Homo sapiens
gaaaatgagcctcagctacatt

SEQ ID NO: 7550778 - DNA, 22 bp, Homo sapiens
gaaaatgagcctcagctacatt

SEQ ID NO: 7550779 - DNA, 22 bp, Homo sapiens
gaaaatagttcatcacaatgat

SEQ ID NO: 7550780 - DNA, 22 bp, Homo sapiens
gaaaatctgcttatattatttt

SEQ ID NO: 7550781 - DNA, 22 bp, Homo sapiens
gaaaatctgcttatattatttt

SEQ ID NO: 7550782 - DNA, 22 bp, Homo sapiens
gaaaatctgcttatattatttt

SEQ ID NO: 7550783 - DNA, 22 bp, Homo sapiens
gaaaatctgcttatattatttt

SEQ ID NO: 7550784 - DNA, 22 bp, Homo sapiens
atgaattaaggataactggtct

SEQ ID NO: 7550785 - DNA, 22 bp, Homo sapiens
atgaattgaggaaaacagtcgt

SEQ ID NO: 7550786 - DNA, 22 bp, Homo sapiens
atgaattgaggaaaacagtcgt

SEQ ID NO: 7550787 - DNA, 22 bp, Homo sapiens
atgaattgaggaaaacagtcgt

SEQ ID NO: 7550788 - DNA, 22 bp, Homo sapiens
atgaattgaggaaaacagtcgt

SEQ ID NO: 7550789 - DNA, 22 bp, Homo sapiens
atgaattgaggaaaacagtcgt

SEQ ID NO: 7550790 - DNA, 22 bp, Homo sapiens
ctttttccagcttcagggtggg

SEQ ID NO: 7550791 - DNA, 19 bp, Homo sapiens
atgaattgagcacttacta

SEQ ID NO: 7550792 - DNA, 22 bp, Homo sapiens
atgaattgaggaaaacagtcgt

SEQ ID NO: 7550793 - DNA, 22 bp, Homo sapiens
atgaatgtgatgattctgttac

SEQ ID NO: 7550794 - DNA, 22 bp, Homo sapiens
atgaatgtgatgattctgttac

SEQ ID NO: 7550795 - DNA, 19 bp, Homo sapiens
atgaatgtgttcttacctc

SEQ ID NO: 7550796 - DNA, 19 bp, Homo sapiens
atgaatgtgttcttacctc

SEQ ID NO: 7550797 - DNA, 22 bp, Homo sapiens
atgaatgtacctgaaatagcct

SEQ ID NO: 7550798 - DNA, 22 bp, Homo sapiens
atgaatgtacctgaaatagcct

SEQ ID NO: 7550799 - DNA, 22 bp, Homo sapiens
atgaatgtacctgaaatagcct

SEQ ID NO: 7550800 - DNA, 22 bp, Homo sapiens
atgaatgtttggtgatcagata

SEQ ID NO: 7550801 - DNA, 22 bp, Homo sapiens
atgaatggtgaagtctgataag

SEQ ID NO: 7550802 - DNA, 22 bp, Homo sapiens
atgaatggtgaagtctgataag

SEQ ID NO: 7550803 - DNA, 22 bp, Homo sapiens
atgaatgtaagtggatttcttt

SEQ ID NO: 7550804 - DNA, 22 bp, Homo sapiens
atgaatgtaagtggatttcttt

SEQ ID NO: 7550805 - DNA, 22 bp, Homo sapiens
atgaatgggtcattatttgatc

SEQ ID NO: 7550806 - DNA, 22 bp, Homo sapiens
atgaatggatggggtcaagata

SEQ ID NO: 7550807 - DNA, 19 bp, Homo sapiens
gaaaacatgggtgagggtc

SEQ ID NO: 7550808 - DNA, 19 bp, Homo sapiens
gaaaacatgggtgagggtc

SEQ ID NO: 7550809 - DNA, 19 bp, Homo sapiens
gaaaacatgggtgagggtc

SEQ ID NO: 7550810 - DNA, 19 bp, Homo sapiens
gaaaacatgggtgagggtc

SEQ ID NO: 7550811 - DNA, 22 bp, Homo sapiens
gaaaacatccagagatagacct

SEQ ID NO: 7550812 - DNA, 22 bp, Homo sapiens
gaaaacatccagagatagacct

SEQ ID NO: 7550813 - DNA, 22 bp, Homo sapiens
ctttttcccaggtggagagagg

SEQ ID NO: 7550814 - DNA, 22 bp, Homo sapiens
ctttttccagcttcagggtggg

SEQ ID NO: 7550815 - DNA, 22 bp, Homo sapiens
gaaaacatccagagatagacct

SEQ ID NO: 7550816 - DNA, 22 bp, Homo sapiens
ctttttccagcttcagggtggg

SEQ ID NO: 7550817 - DNA, 22 bp, Homo sapiens
gaaaaccacctcccatcaagca

SEQ ID NO: 7550818 - DNA, 22 bp, Homo sapiens
gaaaaccacctcccatcaagca

SEQ ID NO: 7550819 - DNA, 19 bp, Homo sapiens
gaaaacatgggtgagggtc

SEQ ID NO: 7550820 - DNA, 19 bp, Homo sapiens
gaaaacatgggtgagggtc

SEQ ID NO: 7550821 - DNA, 19 bp, Homo sapiens
gaaaacatgggtgagggtc

SEQ ID NO: 7550822 - DNA, 19 bp, Homo sapiens
gaaaacatgggtgagggtc

SEQ ID NO: 7550823 - DNA, 22 bp, Homo sapiens
gaaaaccacctcccatcaagca

SEQ ID NO: 7550824 - DNA, 22 bp, Homo sapiens
gaaaaccacctcccatcaagca

SEQ ID NO: 7550825 - DNA, 21 bp, Homo sapiens
gaaaaccatttgcatcatgag

SEQ ID NO: 7550826 - DNA, 22 bp, Homo sapiens
gaaaactaacggaaaagttagg

SEQ ID NO: 7550827 - DNA, 21 bp, Homo sapiens
gaaaaccatttgcatcatgag

SEQ ID NO: 7550828 - DNA, 21 bp, Homo sapiens
gaaaaccatttgcatcatgag

SEQ ID NO: 7550829 - DNA, 22 bp, Homo sapiens
atgaatgctgaattatgaactg

SEQ ID NO: 7550830 - DNA, 22 bp, Homo sapiens
atgaatgctgggacaaatatat

SEQ ID NO: 7550831 - DNA, 22 bp, Homo sapiens
atgaatgctgggacaaatatat

SEQ ID NO: 7550832 - DNA, 22 bp, Homo sapiens
atgaatgctgggacaaatatat

SEQ ID NO: 7550833 - DNA, 22 bp, Homo sapiens
atgaatgcttattaaattgaaa

SEQ ID NO: 7550834 - DNA, 22 bp, Homo sapiens
atgaatgcttattaaattgaaa

SEQ ID NO: 7550835 - DNA, 22 bp, Homo sapiens
atgaatgccacgatttcatcct

SEQ ID NO: 7550836 - DNA, 22 bp, Homo sapiens
atgaatgctatgctctaccagc

SEQ ID NO: 7550837 - DNA, 22 bp, Homo sapiens
atgaatgctatgctctaccagc

SEQ ID NO: 7550838 - DNA, 22 bp, Homo sapiens
atgaatgcatacatttgtcaag

SEQ ID NO: 7550839 - DNA, 22 bp, Homo sapiens
atgaatgcatgcttattttgca

SEQ ID NO: 7550840 - DNA, 22 bp, Homo sapiens
atgaatgcatgcttattttgca

SEQ ID NO: 7550841 - DNA, 22 bp, Homo sapiens
atgaatgattttatgtaaatga

SEQ ID NO: 7550842 - DNA, 22 bp, Homo sapiens
atgaatgcaatattttatgaca

SEQ ID NO: 7550843 - DNA, 22 bp, Homo sapiens
atgaatgcagcactgtttttct

SEQ ID NO: 7550844 - DNA, 22 bp, Homo sapiens
atgaatgcagcactgtttttct

SEQ ID NO: 7550845 - DNA, 22 bp, Homo sapiens
atgaatgatttgtcagtcacag

SEQ ID NO: 7550846 - DNA, 22 bp, Homo sapiens
atgaatgatttgtcagtcacag

SEQ ID NO: 7550847 - DNA, 22 bp, Homo sapiens
atgaatgattttatgtaaatga

SEQ ID NO: 7550848 - DNA, 22 bp, Homo sapiens
atgaatgattttatgtaaatga

SEQ ID NO: 7550849 - DNA, 22 bp, Homo sapiens
atgaatgattttatgtaaatga

SEQ ID NO: 7550850 - DNA, 22 bp, Homo sapiens
atgaatgagaaagctgaaatct

SEQ ID NO: 7550851 - DNA, 22 bp, Homo sapiens
atgaatgagaaagctgaaatct

SEQ ID NO: 7550852 - DNA, 22 bp, Homo sapiens
atgaatgagaaagctgaaatct

SEQ ID NO: 7550853 - DNA, 22 bp, Homo sapiens
atgaatgagaaacaggtgagat

SEQ ID NO: 7550854 - DNA, 22 bp, Homo sapiens
atgaatgagaaagctgaaatct

SEQ ID NO: 7550855 - DNA, 22 bp, Homo sapiens
atgaatgagattaccaatgtga

SEQ ID NO: 7550856 - DNA, 22 bp, Homo sapiens
atgaatgaaatacagagtactt

SEQ ID NO: 7550857 - DNA, 22 bp, Homo sapiens
atgaatgagagaatagtggagc

SEQ ID NO: 7550858 - DNA, 19 bp, Homo sapiens
atgaatgagctgtgaggtt

SEQ ID NO: 7550859 - DNA, 22 bp, Homo sapiens
atgaatgatgccagttgaaatg

SEQ ID NO: 7550860 - DNA, 19 bp, Homo sapiens
atgaatgatccggtttctc

SEQ ID NO: 7550861 - DNA, 22 bp, Homo sapiens
atgaatgatgcaaaagacactg

SEQ ID NO: 7550862 - DNA, 22 bp, Homo sapiens
atgaatgatgcaaaagacactg

SEQ ID NO: 7550863 - DNA, 22 bp, Homo sapiens
atgaatgagcttagaggctgac

SEQ ID NO: 7550864 - DNA, 19 bp, Homo sapiens
atgaatgagctgtgaggtt

SEQ ID NO: 7550865 - DNA, 22 bp, Homo sapiens
atgaatgagtgctaggtttgtc

SEQ ID NO: 7550866 - DNA, 22 bp, Homo sapiens
atgaatgattaaagagtacagt

SEQ ID NO: 7550867 - DNA, 22 bp, Homo sapiens
atgaatgattaaagagtacagt

SEQ ID NO: 7550868 - DNA, 22 bp, Homo sapiens
atgaatgatgccagttgaaatg

SEQ ID NO: 7550869 - DNA, 21 bp, Homo sapiens
atgaatgatttctactcttaa

SEQ ID NO: 7550870 - DNA, 22 bp, Homo sapiens
atgaagcagttaaggtgcatga

SEQ ID NO: 7550871 - DNA, 22 bp, Homo sapiens
atgaagcaggcacagcttcagg

SEQ ID NO: 7550872 - DNA, 22 bp, Homo sapiens
atgaagcaggcacagcttcagg

SEQ ID NO: 7550873 - DNA, 22 bp, Homo sapiens
atgaagcagcgttgtagagtga

SEQ ID NO: 7550874 - DNA, 22 bp, Homo sapiens
atgaagcaggcacagcttcagg

SEQ ID NO: 7550875 - DNA, 22 bp, Homo sapiens
cttgaggttttgactcagcttt

SEQ ID NO: 7550876 - DNA, 22 bp, Homo sapiens
cttgaggttttgactcagcttt

SEQ ID NO: 7550877 - DNA, 22 bp, Homo sapiens
cttgaggttttgactcagcttt

SEQ ID NO: 7550878 - DNA, 22 bp, Homo sapiens
atgaagcagcgttgtagagtga

SEQ ID NO: 7550879 - DNA, 22 bp, Homo sapiens
cttgagtacagatcatattatt

SEQ ID NO: 7550880 - DNA, 22 bp, Homo sapiens
atgaataaaacattttaatcag

SEQ ID NO: 7550881 - DNA, 22 bp, Homo sapiens
atgaataaaacattttaatcag

SEQ ID NO: 7550882 - DNA, 22 bp, Homo sapiens
atgaataaaacattttaatcag

SEQ ID NO: 7550883 - DNA, 22 bp, Homo sapiens
atgaataaaacattttaatcag

SEQ ID NO: 7550884 - DNA, 22 bp, Homo sapiens
atgaagttctcaataatcatgt

SEQ ID NO: 7550885 - DNA, 22 bp, Homo sapiens
atgaagcaggcacagcttcagg

SEQ ID NO: 7550886 - DNA, 22 bp, Homo sapiens
atgaagttctcaataatcatgt

SEQ ID NO: 7550887 - DNA, 22 bp, Homo sapiens
atgaataaacaggtgcctcttc

SEQ ID NO: 7550888 - DNA, 22 bp, Homo sapiens
atgaataaacaggtgcctcttc

SEQ ID NO: 7550889 - DNA, 22 bp, Homo sapiens
atgaataaacaggtgcctcttc

SEQ ID NO: 7550890 - DNA, 22 bp, Homo sapiens
atgaataaaacattttaatcag

SEQ ID NO: 7550891 - DNA, 22 bp, Homo sapiens
atgaataaaacattttaatcag

SEQ ID NO: 7550892 - DNA, 22 bp, Homo sapiens
cttgagagccactcctggggcc

SEQ ID NO: 7550893 - DNA, 22 bp, Homo sapiens
cttgagcacagcggcttcagga

SEQ ID NO: 7550894 - DNA, 22 bp, Homo sapiens
cttgagcacagcggcttcagga

SEQ ID NO: 7550895 - DNA, 22 bp, Homo sapiens
cttgagctaggaaggctgaggc

SEQ ID NO: 7550896 - DNA, 23 bp, Homo sapiens
cttgagctcaggaagagctgagt

SEQ ID NO: 7550897 - DNA, 23 bp, Homo sapiens
cttgagctcaggaagagctgagt

SEQ ID NO: 7550898 - DNA, 22 bp, Homo sapiens
cttgagcatcggatggaatttc

SEQ ID NO: 7550899 - DNA, 18 bp, Homo sapiens
cttgagctaagggacccc

SEQ ID NO: 7550900 - DNA, 18 bp, Homo sapiens
cttgagctaagggacccc

SEQ ID NO: 7550901 - DNA, 22 bp, Homo sapiens
cttgaggtatgaaacctgcatt

SEQ ID NO: 7550902 - DNA, 22 bp, Homo sapiens
cttgaggttttgactcagcttt

SEQ ID NO: 7550903 - DNA, 22 bp, Homo sapiens
cttgagggactctatgacttag

SEQ ID NO: 7550904 - DNA, 22 bp, Homo sapiens
cttgaggctgcactccagggcc

SEQ ID NO: 7550905 - DNA, 23 bp, Homo sapiens
cttgagctcaggaagagctgagt

SEQ ID NO: 7550906 - DNA, 22 bp, Homo sapiens
cttgagctctcagccactagct

SEQ ID NO: 7550907 - DNA, 22 bp, Homo sapiens
cttgagctgaagccagttgaaa

SEQ ID NO: 7550908 - DNA, 22 bp, Homo sapiens
cttgaggctgcactccagggcc

SEQ ID NO: 7550909 - DNA, 22 bp, Homo sapiens
cttgaggagtttaatagggatc

SEQ ID NO: 7550910 - DNA, 22 bp, Homo sapiens
cttgagctgaagccagttgaaa

SEQ ID NO: 7550911 - DNA, 22 bp, Homo sapiens
atgaatacgcggtcatacacat

SEQ ID NO: 7550912 - DNA, 22 bp, Homo sapiens
atgaatacgcggtcatacacat

SEQ ID NO: 7550913 - DNA, 22 bp, Homo sapiens
atgaatatgagactgagagcct

SEQ ID NO: 7550914 - DNA, 22 bp, Homo sapiens
atgaataagtaaactcctttgg

SEQ ID NO: 7550915 - DNA, 22 bp, Homo sapiens
atgaataagtaaactcctttgg

SEQ ID NO: 7550916 - DNA, 22 bp, Homo sapiens
atgaatatgagactgagagcct

SEQ ID NO: 7550917 - DNA, 22 bp, Homo sapiens
atgaatatgagactgagagcct

SEQ ID NO: 7550918 - DNA, 22 bp, Homo sapiens
atgaatatgagactgagagcct

SEQ ID NO: 7550919 - DNA, 22 bp, Homo sapiens
atgaatatgtacacatctgtca

SEQ ID NO: 7550920 - DNA, 22 bp, Homo sapiens
atgaatatgtacacatctgtca

SEQ ID NO: 7550921 - DNA, 22 bp, Homo sapiens
atgaatcaaactgtacactgag

SEQ ID NO: 7550922 - DNA, 22 bp, Homo sapiens
atgaatatgtacacatctgtca

SEQ ID NO: 7550923 - DNA, 22 bp, Homo sapiens
atgaatcaaactgtacactgag

SEQ ID NO: 7550924 - DNA, 22 bp, Homo sapiens
atgaatcaaagttcatttgatc

SEQ ID NO: 7550925 - DNA, 22 bp, Homo sapiens
atgaatcaaagttcatttgatc

SEQ ID NO: 7550926 - DNA, 22 bp, Homo sapiens
atgaatcaaagttcatttgatc

SEQ ID NO: 7550927 - DNA, 22 bp, Homo sapiens
atgaatcaaactgtacactgag

SEQ ID NO: 7550928 - DNA, 22 bp, Homo sapiens
atgaatattgaatgtcttatga

SEQ ID NO: 7550929 - DNA, 22 bp, Homo sapiens
atgaatattgaatgtcttatga

SEQ ID NO: 7550930 - DNA, 22 bp, Homo sapiens
atgaatattgaatgtcttatga

SEQ ID NO: 7550931 - DNA, 22 bp, Homo sapiens
atgaatattgaatgtcttatga

SEQ ID NO: 7550932 - DNA, 22 bp, Homo sapiens
atgaatgactgtctactttggg

SEQ ID NO: 7550933 - DNA, 22 bp, Homo sapiens
atgaatgactgtctactttggg

SEQ ID NO: 7550934 - DNA, 22 bp, Homo sapiens
atgaatgacatctgattccata

SEQ ID NO: 7550935 - DNA, 22 bp, Homo sapiens
atgaatgaatgagagtaggtca

SEQ ID NO: 7550936 - DNA, 22 bp, Homo sapiens
atgaatgaatgagagtaggtca

SEQ ID NO: 7550937 - DNA, 23 bp, Homo sapiens
atgaatgaataaggcaggaaagc

SEQ ID NO: 7550938 - DNA, 22 bp, Homo sapiens
atgaatgaataccatgcaacta

SEQ ID NO: 7550939 - DNA, 22 bp, Homo sapiens
atgaatgaagaacatctgtgcc

SEQ ID NO: 7550940 - DNA, 23 bp, Homo sapiens
atgaatgaataaggcaggaaagc

SEQ ID NO: 7550941 - DNA, 22 bp, Homo sapiens
atgaatcagaatctgcatttta

SEQ ID NO: 7550942 - DNA, 22 bp, Homo sapiens
atgaatcagaatctgcatttta

SEQ ID NO: 7550943 - DNA, 22 bp, Homo sapiens
atgaatcaaagttcatttgatc

SEQ ID NO: 7550944 - DNA, 22 bp, Homo sapiens
atgaatcaagtgagaacagcat

SEQ ID NO: 7550945 - DNA, 22 bp, Homo sapiens
atgaatccaaagtttactatta

SEQ ID NO: 7550946 - DNA, 22 bp, Homo sapiens
atgaatccaaagtttactatta

SEQ ID NO: 7550947 - DNA, 22 bp, Homo sapiens
atcttcccaggctggggagagg

SEQ ID NO: 7550948 - DNA, 22 bp, Homo sapiens
atcttcccaggctggggagagg

SEQ ID NO: 7550949 - DNA, 22 bp, Homo sapiens
atcttcccaggctggggagagg

SEQ ID NO: 7550950 - DNA, 22 bp, Homo sapiens
atcttcccaggctggggagagg

SEQ ID NO: 7550951 - DNA, 22 bp, Homo sapiens
atcttcccaggctggggagagg

SEQ ID NO: 7550952 - DNA, 22 bp, Homo sapiens
atcttcccaggctggggagagg

SEQ ID NO: 7550953 - DNA, 22 bp, Homo sapiens
atcttcccaggctggggagagg

SEQ ID NO: 7550954 - DNA, 22 bp, Homo sapiens
cttgagaacagggttaggtaac

SEQ ID NO: 7550955 - DNA, 22 bp, Homo sapiens
cttgagaaaggaacaggaagct

SEQ ID NO: 7550956 - DNA, 22 bp, Homo sapiens
cttgagaaaggaacaggaagct

SEQ ID NO: 7550957 - DNA, 22 bp, Homo sapiens
cttgagaaaggaacaggaagct

SEQ ID NO: 7550958 - DNA, 22 bp, Homo sapiens
cttgagaaaggaacaggaagct

SEQ ID NO: 7550959 - DNA, 22 bp, Homo sapiens
cttgagaaaggaacaggaagct

SEQ ID NO: 7550960 - DNA, 22 bp, Homo sapiens
atcttcccaggctggggagagg

SEQ ID NO: 7550961 - DNA, 22 bp, Homo sapiens
cttgagaatgtgagccacagat

SEQ ID NO: 7550962 - DNA, 22 bp, Homo sapiens
cttgagaatcttgatgtctacc

SEQ ID NO: 7550963 - DNA, 22 bp, Homo sapiens
cttgagaatcttgatgtctacc

SEQ ID NO: 7550964 - DNA, 22 bp, Homo sapiens
cttgagaatgtgagccacagat

SEQ ID NO: 7550965 - DNA, 22 bp, Homo sapiens
cttgagaaggaggaagggcttt

SEQ ID NO: 7550966 - DNA, 22 bp, Homo sapiens
cttgagaaggaggaagggcttt

SEQ ID NO: 7550967 - DNA, 22 bp, Homo sapiens
cttgagaatcttctctgaagag

SEQ ID NO: 7550968 - DNA, 22 bp, Homo sapiens
cttgagaagagatttatatttg

SEQ ID NO: 7550969 - DNA, 22 bp, Homo sapiens
cttgagaagcattaagaggtag

SEQ ID NO: 7550970 - DNA, 22 bp, Homo sapiens
cttgagaagcattaagaggtag

SEQ ID NO: 7550971 - DNA, 22 bp, Homo sapiens
cttgagaacatctccagctcac

SEQ ID NO: 7550972 - DNA, 22 bp, Homo sapiens
cttgagaacatctccagctcac

SEQ ID NO: 7550973 - DNA, 22 bp, Homo sapiens
cttgagaacagggttaggtaac

SEQ ID NO: 7550974 - DNA, 22 bp, Homo sapiens
atcttcaacaacaaattgcctc

SEQ ID NO: 7550975 - DNA, 22 bp, Homo sapiens
atcttcaaagggatgtccatgg

SEQ ID NO: 7550976 - DNA, 22 bp, Homo sapiens
atcttcaaagggatgtccatgg

SEQ ID NO: 7550977 - DNA, 22 bp, Homo sapiens
atcttcaactcagagagtgctg

SEQ ID NO: 7550978 - DNA, 22 bp, Homo sapiens
atcttcaacaacaaattgcctc

SEQ ID NO: 7550979 - DNA, 22 bp, Homo sapiens
atcttcaactcagagagtgctg

SEQ ID NO: 7550980 - DNA, 22 bp, Homo sapiens
atcttcaaagcacatcgtttgt

SEQ ID NO: 7550981 - DNA, 22 bp, Homo sapiens
atcttcaaagcacatcgtttgt

SEQ ID NO: 7550982 - DNA, 19 bp, Homo sapiens
atcttcaaagccagcagca

SEQ ID NO: 7550983 - DNA, 21 bp, Homo sapiens
atcttcaactgattggaggag

SEQ ID NO: 7550984 - DNA, 22 bp, Homo sapiens
atcttcaacttgatcatttgaa

SEQ ID NO: 7550985 - DNA, 22 bp, Homo sapiens
atcttcaacttgatcatttgaa

SEQ ID NO: 7550986 - DNA, 22 bp, Homo sapiens
atcttcaaggaaaaaatacagt

SEQ ID NO: 7550987 - DNA, 22 bp, Homo sapiens
atcttcaaggaaaaaatacagt

SEQ ID NO: 7550988 - DNA, 22 bp, Homo sapiens
atcttcaaggaaaaaatacagt

SEQ ID NO: 7550989 - DNA, 22 bp, Homo sapiens
atcttcaactttggggctgcct

SEQ ID NO: 7550990 - DNA, 22 bp, Homo sapiens
atcttcaactttggggctgcct

SEQ ID NO: 7550991 - DNA, 22 bp, Homo sapiens
atcttcaaggaaaaaatacagt

SEQ ID NO: 7550992 - DNA, 22 bp, Homo sapiens
atcttcagttttcagtgagcca

SEQ ID NO: 7550993 - DNA, 22 bp, Homo sapiens
atcttcagttttcagtgagcca

SEQ ID NO: 7550994 - DNA, 22 bp, Homo sapiens
atcttccaggtgccgggggtca

SEQ ID NO: 7550995 - DNA, 22 bp, Homo sapiens
atcttccaggtgccgggggtca

SEQ ID NO: 7550996 - DNA, 16 bp, Homo sapiens
atcttccaaagttatt

SEQ ID NO: 7550997 - DNA, 16 bp, Homo sapiens
atcttccaaagttatt

SEQ ID NO: 7550998 - DNA, 22 bp, Homo sapiens
atcttccaagctccctggtgta

SEQ ID NO: 7550999 - DNA, 22 bp, Homo sapiens
atcttccaagctccctggtgta

SEQ ID NO: 7551000 - DNA, 22 bp, Homo sapiens
atcttcaattgaaaactagcct

SEQ ID NO: 7551001 - DNA, 22 bp, Homo sapiens
atcttcaatatttttgtgtaga

SEQ ID NO: 7551002 - DNA, 22 bp, Homo sapiens
atcttcaattgaaaactagcct

SEQ ID NO: 7551003 - DNA, 22 bp, Homo sapiens
atcttcaagggaagaaagagta

SEQ ID NO: 7551004 - DNA, 22 bp, Homo sapiens
atcttcaatatttttgtgtaga

SEQ ID NO: 7551005 - DNA, 22 bp, Homo sapiens
atcttcaatatttttgtgtaga

SEQ ID NO: 7551006 - DNA, 22 bp, Homo sapiens
atcttcaaggaaaaaatacagt

SEQ ID NO: 7551007 - DNA, 22 bp, Homo sapiens
atcttcaagggaagaaagagta

SEQ ID NO: 7551008 - DNA, 22 bp, Homo sapiens
atgctttacccacaccaggatg

SEQ ID NO: 7551009 - DNA, 22 bp, Homo sapiens
atgctttacagttttccaaaca

SEQ ID NO: 7551010 - DNA, 22 bp, Homo sapiens
atgctttacagttttccaaaca

SEQ ID NO: 7551011 - DNA, 22 bp, Homo sapiens
atgctttacccacaccaggatg

SEQ ID NO: 7551012 - DNA, 22 bp, Homo sapiens
atgctttacccacaccaggatg

SEQ ID NO: 7551013 - DNA, 22 bp, Homo sapiens
atgctttacgacaaaaaactca

SEQ ID NO: 7551014 - DNA, 22 bp, Homo sapiens
atgctttacgacaaaaaactca

SEQ ID NO: 7551015 - DNA, 22 bp, Homo sapiens
atgctttacgacaaaaaactca

SEQ ID NO: 7551016 - DNA, 22 bp, Homo sapiens
atgctttacagttttccaaaca

SEQ ID NO: 7551017 - DNA, 22 bp, Homo sapiens
atgctttacagttttccaaaca

SEQ ID NO: 7551018 - DNA, 22 bp, Homo sapiens
atgctttacagttttccaaaca

SEQ ID NO: 7551019 - DNA, 22 bp, Homo sapiens
atgctttaaatgtcttttgctt

SEQ ID NO: 7551020 - DNA, 22 bp, Homo sapiens
atgctttaaactataaatccac

SEQ ID NO: 7551021 - DNA, 22 bp, Homo sapiens
atgctttaaactataaatccac

SEQ ID NO: 7551022 - DNA, 22 bp, Homo sapiens
atgctttaaactataaatccac

SEQ ID NO: 7551023 - DNA, 22 bp, Homo sapiens
atgctttaaaacgtatgtgtaa

SEQ ID NO: 7551024 - DNA, 22 bp, Homo sapiens
atgctttaaaacgtatgtgtaa

SEQ ID NO: 7551025 - DNA, 22 bp, Homo sapiens
atgctttatacaaaacacttaa

SEQ ID NO: 7551026 - DNA, 22 bp, Homo sapiens
atgctttatacaaaacacttaa

SEQ ID NO: 7551027 - DNA, 22 bp, Homo sapiens
atgctttatacaaaacacttaa

SEQ ID NO: 7551028 - DNA, 19 bp, Homo sapiens
atgctttatgttatttctt

SEQ ID NO: 7551029 - DNA, 19 bp, Homo sapiens
atgctttatgttatttctt

SEQ ID NO: 7551030 - DNA, 19 bp, Homo sapiens
atgctttatgttatttctt

SEQ ID NO: 7551031 - DNA, 19 bp, Homo sapiens
atgctttatgttatttctt

SEQ ID NO: 7551032 - DNA, 22 bp, Homo sapiens
atgctttacgacaaaaaactca

SEQ ID NO: 7551033 - DNA, 22 bp, Homo sapiens
atgctttagttcaaaggactta

SEQ ID NO: 7551034 - DNA, 22 bp, Homo sapiens
atgctttagttcaaaggactta

SEQ ID NO: 7551035 - DNA, 22 bp, Homo sapiens
atgctttagttcaaaggactta

SEQ ID NO: 7551036 - DNA, 22 bp, Homo sapiens
atgctttagtgtcaagtttggg

SEQ ID NO: 7551037 - DNA, 22 bp, Homo sapiens
atgctttagtgtcaagtttggg

SEQ ID NO: 7551038 - DNA, 22 bp, Homo sapiens
atgcttaagctcagttatatat

SEQ ID NO: 7551039 - DNA, 22 bp, Homo sapiens
gacataaagttcttgcttgaat

SEQ ID NO: 7551040 - DNA, 20 bp, Homo sapiens
atgcttaagtgttcattatt

SEQ ID NO: 7551041 - DNA, 20 bp, Homo sapiens
atgcttaagtgttcattatt

SEQ ID NO: 7551042 - DNA, 22 bp, Homo sapiens
atgcttaagctcagttatatat

SEQ ID NO: 7551043 - DNA, 22 bp, Homo sapiens
atgcttaatacactgttaaagg

SEQ ID NO: 7551044 - DNA, 20 bp, Homo sapiens
atgcttaagtgttcattatt

SEQ ID NO: 7551045 - DNA, 22 bp, Homo sapiens
atgcttggcccctttatagcct

SEQ ID NO: 7551046 - DNA, 22 bp, Homo sapiens
atgcttggcgtttcacttcctg

SEQ ID NO: 7551047 - DNA, 22 bp, Homo sapiens
atgcttgggactccctgtagca

SEQ ID NO: 7551048 - DNA, 22 bp, Homo sapiens
atgcttgtagtgtaatcactgt

SEQ ID NO: 7551049 - DNA, 22 bp, Homo sapiens
atgcttgtagtgtaatcactgt

SEQ ID NO: 7551050 - DNA, 22 bp, Homo sapiens
atgcttgtagtgtaatcactgt

SEQ ID NO: 7551051 - DNA, 22 bp, Homo sapiens
atgcttgtactaaaaaaatatt

SEQ ID NO: 7551052 - DNA, 22 bp, Homo sapiens
atgcttgtactaaaaaaatatt

SEQ ID NO: 7551053 - DNA, 22 bp, Homo sapiens
atgcttgtactaaaaaaatatt

SEQ ID NO: 7551054 - DNA, 22 bp, Homo sapiens
gacataaaatggaattctgttg

SEQ ID NO: 7551055 - DNA, 22 bp, Homo sapiens
gacataaaatggaattctgttg

SEQ ID NO: 7551056 - DNA, 22 bp, Homo sapiens
gacagttttgctgaaattgagc

SEQ ID NO: 7551057 - DNA, 22 bp, Homo sapiens
gacataaaattcaataatttgt

SEQ ID NO: 7551058 - DNA, 22 bp, Homo sapiens
gacataaaccttgagatattaa

SEQ ID NO: 7551059 - DNA, 22 bp, Homo sapiens
gacataaaccttgagatattaa

SEQ ID NO: 7551060 - DNA, 22 bp, Homo sapiens
gacataaaattcaataatttgt

SEQ ID NO: 7551061 - DNA, 22 bp, Homo sapiens
gacataaaattcaataatttgt

SEQ ID NO: 7551062 - DNA, 22 bp, Homo sapiens
gacataaaattcaataatttgt

SEQ ID NO: 7551063 - DNA, 22 bp, Homo sapiens
gacagtggagccacgttgggag

SEQ ID NO: 7551064 - DNA, 22 bp, Homo sapiens
gacagtggtgttttccattgca

SEQ ID NO: 7551065 - DNA, 22 bp, Homo sapiens
gacagtggattcatctagtcaa

SEQ ID NO: 7551066 - DNA, 22 bp, Homo sapiens
gacagtggagggctgatgttaa

SEQ ID NO: 7551067 - DNA, 22 bp, Homo sapiens
gacagtgctatggtaggacatt

SEQ ID NO: 7551068 - DNA, 23 bp, Homo sapiens
gacagggctgacttggcagctgc

SEQ ID NO: 7551069 - DNA, 23 bp, Homo sapiens
gacagggctgacttggcagctgc

SEQ ID NO: 7551070 - DNA, 22 bp, Homo sapiens
gacagtgctatggtaggacatt

SEQ ID NO: 7551071 - DNA, 22 bp, Homo sapiens
gacagtgctatggtaggacatt

SEQ ID NO: 7551072 - DNA, 23 bp, Homo sapiens
gacagggctgacttggcagctgc

SEQ ID NO: 7551073 - DNA, 23 bp, Homo sapiens
gacagggctgacttggcagctgc

SEQ ID NO: 7551074 - DNA, 22 bp, Homo sapiens
gacagtgtccctctggggtgga

SEQ ID NO: 7551075 - DNA, 22 bp, Homo sapiens
gacagtggttccaaggcagctt

SEQ ID NO: 7551076 - DNA, 22 bp, Homo sapiens
gacagtggttccaaggcagctt

SEQ ID NO: 7551077 - DNA, 22 bp, Homo sapiens
gacagtgtgaacatctaatagt

SEQ ID NO: 7551078 - DNA, 22 bp, Homo sapiens
gacagtgtgaacatctaatagt

SEQ ID NO: 7551079 - DNA, 22 bp, Homo sapiens
gacagtgtgaacatctaatagt

SEQ ID NO: 7551080 - DNA, 22 bp, Homo sapiens
gacagtggttccaaggcagctt

SEQ ID NO: 7551081 - DNA, 22 bp, Homo sapiens
gacagtggttccaaggcagctt

SEQ ID NO: 7551082 - DNA, 22 bp, Homo sapiens
gacagtggttccaaggcagctt

SEQ ID NO: 7551083 - DNA, 22 bp, Homo sapiens
gacagtggttccaaggcagctt

SEQ ID NO: 7551084 - DNA, 22 bp, Homo sapiens
gacagtggttccaaggcagctt

SEQ ID NO: 7551085 - DNA, 22 bp, Homo sapiens
gacagtgttacaatttaatgga

SEQ ID NO: 7551086 - DNA, 22 bp, Homo sapiens
gacagtgttacaatttaatgga

SEQ ID NO: 7551087 - DNA, 22 bp, Homo sapiens
gacagtgtttgtataattcctg

SEQ ID NO: 7551088 - DNA, 22 bp, Homo sapiens
gacagtttaagcacctaatatt

SEQ ID NO: 7551089 - DNA, 22 bp, Homo sapiens
gacagttaggacaactgacttc

SEQ ID NO: 7551090 - DNA, 22 bp, Homo sapiens
gacagtttctgaatgcgtactt

SEQ ID NO: 7551091 - DNA, 22 bp, Homo sapiens
gacagttttgctaaaaggttga

SEQ ID NO: 7551092 - DNA, 22 bp, Homo sapiens
gacagttttgctgaaattgagc

SEQ ID NO: 7551093 - DNA, 22 bp, Homo sapiens
gacagtttaggttcaaatctca

SEQ ID NO: 7551094 - DNA, 22 bp, Homo sapiens
gacagtttaggttcaaatctca

SEQ ID NO: 7551095 - DNA, 22 bp, Homo sapiens
gacagtttaggttcaaatctca

SEQ ID NO: 7551096 - DNA, 22 bp, Homo sapiens
gacagtttaggttcaaatctca

SEQ ID NO: 7551097 - DNA, 22 bp, Homo sapiens
gacagggccaaaccggctgatc

SEQ ID NO: 7551098 - DNA, 22 bp, Homo sapiens
gacagggccgcagatggagact

SEQ ID NO: 7551099 - DNA, 22 bp, Homo sapiens
gacagggccgcagatggagact

SEQ ID NO: 7551100 - DNA, 22 bp, Homo sapiens
gacagggccgcagatggagact

SEQ ID NO: 7551101 - DNA, 22 bp, Homo sapiens
gacagggccgcagatggagact

SEQ ID NO: 7551102 - DNA, 22 bp, Homo sapiens
gacagggccaaaccggctgatc

SEQ ID NO: 7551103 - DNA, 22 bp, Homo sapiens
gacagggcatggtgcagagttc

SEQ ID NO: 7551104 - DNA, 22 bp, Homo sapiens
gacagggcatggtgcagagttc

SEQ ID NO: 7551105 - DNA, 22 bp, Homo sapiens
gacagggcgagactcagtctca

SEQ ID NO: 7551106 - DNA, 22 bp, Homo sapiens
gacagggcgagactcagtctca

SEQ ID NO: 7551107 - DNA, 22 bp, Homo sapiens
gacagggcgagactcagtctca

SEQ ID NO: 7551108 - DNA, 22 bp, Homo sapiens
gacagggcgcccagcctgtttc

SEQ ID NO: 7551109 - DNA, 23 bp, Homo sapiens
gacagggctgacttggcagctgc

SEQ ID NO: 7551110 - DNA, 22 bp, Homo sapiens
gacagggcgcccagcctgtttc

SEQ ID NO: 7551111 - DNA, 23 bp, Homo sapiens
gacagggctgacttggcagctgc

SEQ ID NO: 7551112 - DNA, 23 bp, Homo sapiens
gacagggctgacttggcagctgc

SEQ ID NO: 7551113 - DNA, 22 bp, Homo sapiens
gacagggcaagactctgtctaa

SEQ ID NO: 7551114 - DNA, 22 bp, Homo sapiens
gacagggcatggtgcagagttc

SEQ ID NO: 7551115 - DNA, 22 bp, Homo sapiens
gacagggcatggtgcagagttc

SEQ ID NO: 7551116 - DNA, 22 bp, Homo sapiens
gacagggaggagcagagcttct

SEQ ID NO: 7551117 - DNA, 22 bp, Homo sapiens
gacagggaggagcagagcttct

SEQ ID NO: 7551118 - DNA, 22 bp, Homo sapiens
gacagggaggagcagagcttct

SEQ ID NO: 7551119 - DNA, 22 bp, Homo sapiens
gacagggaggagcagagcttct

SEQ ID NO: 7551120 - DNA, 22 bp, Homo sapiens
gacagggaggagcagagcttct

SEQ ID NO: 7551121 - DNA, 22 bp, Homo sapiens
gacagggaggagcagagcttct

SEQ ID NO: 7551122 - DNA, 22 bp, Homo sapiens
gacagggaggagcagagcttct

SEQ ID NO: 7551123 - DNA, 22 bp, Homo sapiens
gacagggaggaaagagactgct

SEQ ID NO: 7551124 - DNA, 22 bp, Homo sapiens
gacagggaggaaagagactgct

SEQ ID NO: 7551125 - DNA, 22 bp, Homo sapiens
gacagggaggaaagagactgct

SEQ ID NO: 7551126 - DNA, 22 bp, Homo sapiens
gacagggaggaaagagactgct

SEQ ID NO: 7551127 - DNA, 22 bp, Homo sapiens
gacagggaggaaagagactgct

SEQ ID NO: 7551128 - DNA, 22 bp, Homo sapiens
gacagggaggaaagagactgct

SEQ ID NO: 7551129 - DNA, 22 bp, Homo sapiens
gacagggaggaaagagactgct

SEQ ID NO: 7551130 - DNA, 22 bp, Homo sapiens
gacagggaggaaagagactgct

SEQ ID NO: 7551131 - DNA, 22 bp, Homo sapiens
gacagggaggaaagagactgct

SEQ ID NO: 7551132 - DNA, 22 bp, Homo sapiens
gactttctgctatactttctgt

SEQ ID NO: 7551133 - DNA, 22 bp, Homo sapiens
gactttctgatgtaaacattta

SEQ ID NO: 7551134 - DNA, 22 bp, Homo sapiens
gactttctgctatactttctgt

SEQ ID NO: 7551135 - DNA, 22 bp, Homo sapiens
gactttctgctatactttctgt

SEQ ID NO: 7551136 - DNA, 22 bp, Homo sapiens
gactttctgtccagtgatttct

SEQ ID NO: 7551137 - DNA, 21 bp, Homo sapiens
gactttcttaccagatttttg

SEQ ID NO: 7551138 - DNA, 22 bp, Homo sapiens
gactttctgtccagtgatttct

SEQ ID NO: 7551139 - DNA, 21 bp, Homo sapiens
gactttcttaccagatttttg

SEQ ID NO: 7551140 - DNA, 21 bp, Homo sapiens
gactttcttaccagatttttg

SEQ ID NO: 7551141 - DNA, 21 bp, Homo sapiens
gactttcttaccagatttttg

SEQ ID NO: 7551142 - DNA, 22 bp, Homo sapiens
gactttcttgtagtgtctgatg

SEQ ID NO: 7551143 - DNA, 22 bp, Homo sapiens
gactttcttgcagaaatattcc

SEQ ID NO: 7551144 - DNA, 22 bp, Homo sapiens
gactttcttgcagaaatattcc

SEQ ID NO: 7551145 - DNA, 22 bp, Homo sapiens
gactttcttgcagaaatattcc

SEQ ID NO: 7551146 - DNA, 22 bp, Homo sapiens
gactttcttgtagtgtctgatg

SEQ ID NO: 7551147 - DNA, 22 bp, Homo sapiens
gactttcttgtagtgtctgatg

SEQ ID NO: 7551148 - DNA, 22 bp, Homo sapiens
gactttcttgtagtgtctgatg

SEQ ID NO: 7551149 - DNA, 21 bp, Homo sapiens
gactttcttaccagatttttg

SEQ ID NO: 7551150 - DNA, 21 bp, Homo sapiens
gactttcttaccagatttttg

SEQ ID NO: 7551151 - DNA, 22 bp, Homo sapiens
gactttcttaggccccctaata

SEQ ID NO: 7551152 - DNA, 22 bp, Homo sapiens
gactttcttaggccccctaata

SEQ ID NO: 7551153 - DNA, 22 bp, Homo sapiens
gactttcttaggccccctaata

SEQ ID NO: 7551154 - DNA, 22 bp, Homo sapiens
gactttcttgcagaaatattcc

SEQ ID NO: 7551155 - DNA, 22 bp, Homo sapiens
gactttgattaaatcaagcaaa

SEQ ID NO: 7551156 - DNA, 22 bp, Homo sapiens
gactttgaacagtgtatcagta

SEQ ID NO: 7551157 - DNA, 22 bp, Homo sapiens
gactttgaacagtgtatcagta

SEQ ID NO: 7551158 - DNA, 19 bp, Homo sapiens
gactttggaaatgctgttt

SEQ ID NO: 7551159 - DNA, 19 bp, Homo sapiens
gactttggaaatgctgttt

SEQ ID NO: 7551160 - DNA, 19 bp, Homo sapiens
gactttggaaatgctgttt

SEQ ID NO: 7551161 - DNA, 22 bp, Homo sapiens
gactttggattcattatctgga

SEQ ID NO: 7551162 - DNA, 17 bp, Homo sapiens
gactttggagtttcata

SEQ ID NO: 7551163 - DNA, 22 bp, Homo sapiens
gactttggcatctagacattgt

SEQ ID NO: 7551164 - DNA, 22 bp, Homo sapiens
gactttggcatctagacattgt

SEQ ID NO: 7551165 - DNA, 22 bp, Homo sapiens
gactttggtataccttgcttta

SEQ ID NO: 7551166 - DNA, 22 bp, Homo sapiens
gactttggcttttattctaggt

SEQ ID NO: 7551167 - DNA, 22 bp, Homo sapiens
gactttggcatctagacattgt

SEQ ID NO: 7551168 - DNA, 17 bp, Homo sapiens
gactttggagtttcata

SEQ ID NO: 7551169 - DNA, 17 bp, Homo sapiens
gactttggagtttcata

SEQ ID NO: 7551170 - DNA, 22 bp, Homo sapiens
gactttggagcagaaagaaatt

SEQ ID NO: 7551171 - DNA, 22 bp, Homo sapiens
gactttggagcagaaagaaatt

SEQ ID NO: 7551172 - DNA, 22 bp, Homo sapiens
gactttggagcagaaagaaatt

SEQ ID NO: 7551173 - DNA, 22 bp, Homo sapiens
gactttggagcagctacttcct

SEQ ID NO: 7551174 - DNA, 22 bp, Homo sapiens
atgcttttccaggagaaatata

SEQ ID NO: 7551175 - DNA, 22 bp, Homo sapiens
atgcttttccaggagaaatata

SEQ ID NO: 7551176 - DNA, 22 bp, Homo sapiens
atgcttttccaggagaaatata

SEQ ID NO: 7551177 - DNA, 22 bp, Homo sapiens
atgcttttccaggagaaatata

SEQ ID NO: 7551178 - DNA, 22 bp, Homo sapiens
atgcttttccaggagaaatata

SEQ ID NO: 7551179 - DNA, 22 bp, Homo sapiens
atgcttttccaggagaaatata

SEQ ID NO: 7551180 - DNA, 22 bp, Homo sapiens
atgcttttccaggagaaatata

SEQ ID NO: 7551181 - DNA, 22 bp, Homo sapiens
atgcttttccaggagaaatata

SEQ ID NO: 7551182 - DNA, 22 bp, Homo sapiens
atgcttttaactcctttatccc

SEQ ID NO: 7551183 - DNA, 22 bp, Homo sapiens
atgcttttaactcctttatccc

SEQ ID NO: 7551184 - DNA, 22 bp, Homo sapiens
atgctttgtttaaagattttca

SEQ ID NO: 7551185 - DNA, 22 bp, Homo sapiens
atgctttgtttaaagattttca

SEQ ID NO: 7551186 - DNA, 22 bp, Homo sapiens
atgctttgtggagtattactgt

SEQ ID NO: 7551187 - DNA, 22 bp, Homo sapiens
atgctttgtggagtattactgt

SEQ ID NO: 7551188 - DNA, 22 bp, Homo sapiens
atgcttttaactcctttatccc

SEQ ID NO: 7551189 - DNA, 22 bp, Homo sapiens
atgcttttatgtcacatggtca

SEQ ID NO: 7551190 - DNA, 22 bp, Homo sapiens
atgctttattgttaggtcatgt

SEQ ID NO: 7551191 - DNA, 22 bp, Homo sapiens
atgctttattgttaggtcatgt

SEQ ID NO: 7551192 - DNA, 22 bp, Homo sapiens
atgctttattgttaggtcatgt

SEQ ID NO: 7551193 - DNA, 22 bp, Homo sapiens
atgctttctcttagttcattga

SEQ ID NO: 7551194 - DNA, 22 bp, Homo sapiens
atgctttctaggtgatctgagg

SEQ ID NO: 7551195 - DNA, 18 bp, Homo sapiens
atgctttgcttacgttat

SEQ ID NO: 7551196 - DNA, 22 bp, Homo sapiens
atgctttggccaatgagaagtg

SEQ ID NO: 7551197 - DNA, 22 bp, Homo sapiens
atgctttggccaatgagaagtg

SEQ ID NO: 7551198 - DNA, 22 bp, Homo sapiens
atgctttgatttggtttctcta

SEQ ID NO: 7551199 - DNA, 22 bp, Homo sapiens
atgctttgatagtttattacat

SEQ ID NO: 7551200 - DNA, 22 bp, Homo sapiens
atgctttgatttggtttctcta

SEQ ID NO: 7551201 - DNA, 22 bp, Homo sapiens
atgctttgatttggtttctcta

SEQ ID NO: 7551202 - DNA, 22 bp, Homo sapiens
atgctttgatttggtttctcta

SEQ ID NO: 7551203 - DNA, 22 bp, Homo sapiens
atgctttgatttggtttctcta

SEQ ID NO: 7551204 - DNA, 22 bp, Homo sapiens
atgctttgatagtttattacat

SEQ ID NO: 7551205 - DNA, 22 bp, Homo sapiens
atgctttgaagtttttcctcat

SEQ ID NO: 7551206 - DNA, 22 bp, Homo sapiens
atgctttgaagtttttcctcat

SEQ ID NO: 7551207 - DNA, 22 bp, Homo sapiens
atgctttgaagtttttcctcat

SEQ ID NO: 7551208 - DNA, 22 bp, Homo sapiens
atgctttgaagtttttcctcat

SEQ ID NO: 7551209 - DNA, 22 bp, Homo sapiens
gaccctccactcactgctgtgt

SEQ ID NO: 7551210 - DNA, 22 bp, Homo sapiens
gaccctcctactaccctggaaa

SEQ ID NO: 7551211 - DNA, 22 bp, Homo sapiens
gaccctcctactaccctggaaa

SEQ ID NO: 7551212 - DNA, 22 bp, Homo sapiens
gaccctcctactaccctggaaa

SEQ ID NO: 7551213 - DNA, 22 bp, Homo sapiens
gaccctcctgtcttctaaccaa

SEQ ID NO: 7551214 - DNA, 22 bp, Homo sapiens
gaccctccactcactgctgtgt

SEQ ID NO: 7551215 - DNA, 22 bp, Homo sapiens
gaccctccactcactgctgtgt

SEQ ID NO: 7551216 - DNA, 22 bp, Homo sapiens
gaccctcattgtcaccgtgagc

SEQ ID NO: 7551217 - DNA, 22 bp, Homo sapiens
gacccgtggcaggctgcctgct

SEQ ID NO: 7551218 - DNA, 22 bp, Homo sapiens
gaccctcaaacaattacactgc

SEQ ID NO: 7551219 - DNA, 22 bp, Homo sapiens
gaccctccactcactgctgtgt

SEQ ID NO: 7551220 - DNA, 22 bp, Homo sapiens
gaccctccactcactgctgtgt

SEQ ID NO: 7551221 - DNA, 22 bp, Homo sapiens
gacccctagagataggaggaac

SEQ ID NO: 7551222 - DNA, 22 bp, Homo sapiens
gacccggctccaggcccagcag

SEQ ID NO: 7551223 - DNA, 22 bp, Homo sapiens
gacccgtggcaggctgcctgct

SEQ ID NO: 7551224 - DNA, 22 bp, Homo sapiens
gaccccaggcagatcagggggt

SEQ ID NO: 7551225 - DNA, 18 bp, Homo sapiens
gaccccgggatctgtcga

SEQ ID NO: 7551226 - DNA, 22 bp, Homo sapiens
gaccccaggcagatcagggggt

SEQ ID NO: 7551227 - DNA, 22 bp, Homo sapiens
gaccccatctggctgccccagg

SEQ ID NO: 7551228 - DNA, 19 bp, Homo sapiens
atgctttatgttatttctt

SEQ ID NO: 7551229 - DNA, 19 bp, Homo sapiens
atgctttatgttatttctt

SEQ ID NO: 7551230 - DNA, 22 bp, Homo sapiens
atgctttatgttctggcatttt

SEQ ID NO: 7551231 - DNA, 22 bp, Homo sapiens
atgctttatgttctggcatttt

SEQ ID NO: 7551232 - DNA, 22 bp, Homo sapiens
atgctttatgttctggcatttt

SEQ ID NO: 7551233 - DNA, 22 bp, Homo sapiens
atgctttatgttctggcatttt

SEQ ID NO: 7551234 - DNA, 22 bp, Homo sapiens
atgctttattgcttctgggcac

SEQ ID NO: 7551235 - DNA, 22 bp, Homo sapiens
atgctttattgcttctgggcac

SEQ ID NO: 7551236 - DNA, 22 bp, Homo sapiens
atgctttattattttgcaggga

SEQ ID NO: 7551237 - DNA, 22 bp, Homo sapiens
atgctttattattttgcaggga

SEQ ID NO: 7551238 - DNA, 22 bp, Homo sapiens
gaccccagaggaaggggcgccg

SEQ ID NO: 7551239 - DNA, 21 bp, Homo sapiens
gaccccagaccagcagacaca

SEQ ID NO: 7551240 - DNA, 21 bp, Homo sapiens
gaccccagaccagcagacaca

SEQ ID NO: 7551241 - DNA, 21 bp, Homo sapiens
gaccccagaccagcagacaca

SEQ ID NO: 7551242 - DNA, 22 bp, Homo sapiens
gaccccaggcagatcagggggt

SEQ ID NO: 7551243 - DNA, 22 bp, Homo sapiens
gaccccagaggaaggggcgccg

SEQ ID NO: 7551244 - DNA, 21 bp, Homo sapiens
gaccccagaccagcagacaca

SEQ ID NO: 7551245 - DNA, 22 bp, Homo sapiens
atgctttattggagacagtcat

SEQ ID NO: 7551246 - DNA, 22 bp, Homo sapiens
atgctttattggagacagtcat

SEQ ID NO: 7551247 - DNA, 22 bp, Homo sapiens
gaccccaaccctagagtctgac

SEQ ID NO: 7551248 - DNA, 22 bp, Homo sapiens
gaccctgaggatgcaccagcag

SEQ ID NO: 7551249 - DNA, 22 bp, Homo sapiens
gaccctgactctaatgcttggc

SEQ ID NO: 7551250 - DNA, 22 bp, Homo sapiens
gaccctgagcaaaagcagttct

SEQ ID NO: 7551251 - DNA, 22 bp, Homo sapiens
gaccctctagatggaagcactg

SEQ ID NO: 7551252 - DNA, 22 bp, Homo sapiens
gaccctctagatggaagcactg

SEQ ID NO: 7551253 - DNA, 22 bp, Homo sapiens
gaccctctagatggaagcactg

SEQ ID NO: 7551254 - DNA, 22 bp, Homo sapiens
gaccctctagatggaagcactg

SEQ ID NO: 7551255 - DNA, 22 bp, Homo sapiens
gaccctgccatgagtgacaggg

SEQ ID NO: 7551256 - DNA, 22 bp, Homo sapiens
gaccctgccatgagtgacaggg

SEQ ID NO: 7551257 - DNA, 22 bp, Homo sapiens
gaccctgaggattccctgctga

SEQ ID NO: 7551258 - DNA, 22 bp, Homo sapiens
gaccctggaactttcagcagag

SEQ ID NO: 7551259 - DNA, 22 bp, Homo sapiens
gaccctggaactttcagcagag

SEQ ID NO: 7551260 - DNA, 22 bp, Homo sapiens
gaccctggaactttcagcagag

SEQ ID NO: 7551261 - DNA, 22 bp, Homo sapiens
gaccctggaactttcagcagag

SEQ ID NO: 7551262 - DNA, 22 bp, Homo sapiens
gaccctgaggatgcaccagcag

SEQ ID NO: 7551263 - DNA, 22 bp, Homo sapiens
gaccctggaactttcagcagag

SEQ ID NO: 7551264 - DNA, 22 bp, Homo sapiens
gaccctggagccgtctgaggca

SEQ ID NO: 7551265 - DNA, 22 bp, Homo sapiens
gactggggtaaggtgaggaggt

SEQ ID NO: 7551266 - DNA, 22 bp, Homo sapiens
gactttctaatgctctgtagat

SEQ ID NO: 7551267 - DNA, 22 bp, Homo sapiens
gactttctaatgctctgtagat

SEQ ID NO: 7551268 - DNA, 22 bp, Homo sapiens
gactttccaggtcctgggctat

SEQ ID NO: 7551269 - DNA, 22 bp, Homo sapiens
gactgggggcagccgcaccagt

SEQ ID NO: 7551270 - DNA, 22 bp, Homo sapiens
gactgggggcagccgcaccagt

SEQ ID NO: 7551271 - DNA, 22 bp, Homo sapiens
gactggggctctagccaggcct

SEQ ID NO: 7551272 - DNA, 22 bp, Homo sapiens
gactgggggcagccgcaccagt

SEQ ID NO: 7551273 - DNA, 22 bp, Homo sapiens
gactggggtaaggtgaggaggt

SEQ ID NO: 7551274 - DNA, 22 bp, Homo sapiens
gactggggtaaggtgaggaggt

SEQ ID NO: 7551275 - DNA, 22 bp, Homo sapiens
gactttctaatgctctgtagat

SEQ ID NO: 7551276 - DNA, 22 bp, Homo sapiens
gactttctctcctcccaggtgt

SEQ ID NO: 7551277 - DNA, 22 bp, Homo sapiens
gactttctgaaggtctcgcagt

SEQ ID NO: 7551278 - DNA, 22 bp, Homo sapiens
gactttctaatgctctgtagat

SEQ ID NO: 7551279 - DNA, 22 bp, Homo sapiens
gactttctgagtcaaagaaagg

SEQ ID NO: 7551280 - DNA, 22 bp, Homo sapiens
gactttctgagtcaaagaaagg

SEQ ID NO: 7551281 - DNA, 22 bp, Homo sapiens
gactttctgagtcaaagaaagg

SEQ ID NO: 7551282 - DNA, 22 bp, Homo sapiens
gactttctgatgtaaacattta

SEQ ID NO: 7551283 - DNA, 20 bp, Homo sapiens
atgccctgtcctcttctgtt

SEQ ID NO: 7551284 - DNA, 22 bp, Homo sapiens
atgccctgtgactctcctggac

SEQ ID NO: 7551285 - DNA, 22 bp, Homo sapiens
atgccctgtggcagtacatatt

SEQ ID NO: 7551286 - DNA, 23 bp, Homo sapiens
atgccctgtgcagaaatgtggaa

SEQ ID NO: 7551287 - DNA, 22 bp, Homo sapiens
atgccctgtgactctcctggac

SEQ ID NO: 7551288 - DNA, 22 bp, Homo sapiens
atgccctgtgactctcctggac

SEQ ID NO: 7551289 - DNA, 23 bp, Homo sapiens
atgccctgtgcagaaatgtggaa

SEQ ID NO: 7551290 - DNA, 22 bp, Homo sapiens
atgccctgggagtgctgtacca

SEQ ID NO: 7551291 - DNA, 22 bp, Homo sapiens
atgccctgggagtgctgtacca

SEQ ID NO: 7551292 - DNA, 22 bp, Homo sapiens
atgccctggacttctagtattc

SEQ ID NO: 7551293 - DNA, 22 bp, Homo sapiens
atgccctggacttctagtattc

SEQ ID NO: 7551294 - DNA, 22 bp, Homo sapiens
atgccctgctgccatctggccg

SEQ ID NO: 7551295 - DNA, 23 bp, Homo sapiens
atgccctgtagaggctgctgacc

SEQ ID NO: 7551296 - DNA, 23 bp, Homo sapiens
atgccctgtagaggctgctgacc

SEQ ID NO: 7551297 - DNA, 22 bp, Homo sapiens
atgccctggggctacctctgag

SEQ ID NO: 7551298 - DNA, 22 bp, Homo sapiens
atgccctggggctacctctgag

SEQ ID NO: 7551299 - DNA, 22 bp, Homo sapiens
atgcctcctcaaatctgccaca

SEQ ID NO: 7551300 - DNA, 22 bp, Homo sapiens
atgcctccgcatgtgcctttga

SEQ ID NO: 7551301 - DNA, 22 bp, Homo sapiens
atgcctccgcatgtgcctttga

SEQ ID NO: 7551302 - DNA, 22 bp, Homo sapiens
atgcctcccctgtgtcttttat

SEQ ID NO: 7551303 - DNA, 22 bp, Homo sapiens
atgcctccaagattcttacgtt

SEQ ID NO: 7551304 - DNA, 22 bp, Homo sapiens
atgcctccaagattcttacgtt

SEQ ID NO: 7551305 - DNA, 22 bp, Homo sapiens
atgcctcccctgtgtcttttat

SEQ ID NO: 7551306 - DNA, 22 bp, Homo sapiens
atgcctccctgtccttcagttc

SEQ ID NO: 7551307 - DNA, 22 bp, Homo sapiens
atgccctgtggttcatgtgaga

SEQ ID NO: 7551308 - DNA, 22 bp, Homo sapiens
atgccctgtggttcatgtgaga

SEQ ID NO: 7551309 - DNA, 18 bp, Homo sapiens
atgccctgttgacttcag

SEQ ID NO: 7551310 - DNA, 22 bp, Homo sapiens
atgcccttcatttatcatgaaa

SEQ ID NO: 7551311 - DNA, 22 bp, Homo sapiens
atgccctttaatttcactgtta

SEQ ID NO: 7551312 - DNA, 22 bp, Homo sapiens
atgccctttaatttcactgtta

SEQ ID NO: 7551313 - DNA, 22 bp, Homo sapiens
atgcccttatgccagaggcaat

SEQ ID NO: 7551314 - DNA, 22 bp, Homo sapiens
atgcccttcaacgtgaggattt

SEQ ID NO: 7551315 - DNA, 21 bp, Homo sapiens
atgcccttcactcaaggccag

SEQ ID NO: 7551316 - DNA, 22 bp, Homo sapiens
gacagggactccctggttagaa

SEQ ID NO: 7551317 - DNA, 22 bp, Homo sapiens
gacagggaggaaagagactgct

SEQ ID NO: 7551318 - DNA, 22 bp, Homo sapiens
gacagggactccctggttagaa

SEQ ID NO: 7551319 - DNA, 22 bp, Homo sapiens
gacagggactccctggttagaa

SEQ ID NO: 7551320 - DNA, 22 bp, Homo sapiens
gacagggactccctggttagaa

SEQ ID NO: 7551321 - DNA, 22 bp, Homo sapiens
gacagggactccctggttagaa

SEQ ID NO: 7551322 - DNA, 22 bp, Homo sapiens
gacagggactccctggttagaa

SEQ ID NO: 7551323 - DNA, 22 bp, Homo sapiens
gacagggacgaggcttcaggca

SEQ ID NO: 7551324 - DNA, 22 bp, Homo sapiens
gacaggaaatatgggggttgtt

SEQ ID NO: 7551325 - DNA, 22 bp, Homo sapiens
gacagggacgaggcttcaggca

SEQ ID NO: 7551326 - DNA, 22 bp, Homo sapiens
gacagggacgaggcttcaggca

SEQ ID NO: 7551327 - DNA, 22 bp, Homo sapiens
gacaggaaatatgggggttgtt

SEQ ID NO: 7551328 - DNA, 22 bp, Homo sapiens
gacaggaaatatgggggttgtt

SEQ ID NO: 7551329 - DNA, 22 bp, Homo sapiens
atgcctggactgacatgcactg

SEQ ID NO: 7551330 - DNA, 22 bp, Homo sapiens
atgcctggactgacatgcactg

SEQ ID NO: 7551331 - DNA, 22 bp, Homo sapiens
gacaggaaatatgggggttgtt

SEQ ID NO: 7551332 - DNA, 22 bp, Homo sapiens
gacaggaaatatgggggttgtt

SEQ ID NO: 7551333 - DNA, 22 bp, Homo sapiens
atgcctcctcaaatctgccaca

SEQ ID NO: 7551334 - DNA, 22 bp, Homo sapiens
atgcctcctgtgccactgtgat

SEQ ID NO: 7551335 - DNA, 22 bp, Homo sapiens
atgcctcctgtgccactgtgat

SEQ ID NO: 7551336 - DNA, 22 bp, Homo sapiens
atgcctcctcaaatctgccaca

SEQ ID NO: 7551337 - DNA, 22 bp, Homo sapiens
atgcctcctcaaatctgccaca

SEQ ID NO: 7551338 - DNA, 22 bp, Homo sapiens
atgcctccttctgaaacagggc

SEQ ID NO: 7551339 - DNA, 20 bp, Homo sapiens
atgcctctaattttgcaaac

SEQ ID NO: 7551340 - DNA, 20 bp, Homo sapiens
atgcctctaattttgcaaac

SEQ ID NO: 7551341 - DNA, 22 bp, Homo sapiens
atgcctctgctcttggtcctca

SEQ ID NO: 7551342 - DNA, 22 bp, Homo sapiens
atgcctctgctcttggtcctca

SEQ ID NO: 7551343 - DNA, 22 bp, Homo sapiens
atgcctctgctcttggtcctca

SEQ ID NO: 7551344 - DNA, 22 bp, Homo sapiens
atgcctctgctcttggtcctca

SEQ ID NO: 7551345 - DNA, 22 bp, Homo sapiens
atgcctggactgacatgcactg

SEQ ID NO: 7551346 - DNA, 22 bp, Homo sapiens
atgcctggactgacatgcactg

SEQ ID NO: 7551347 - DNA, 22 bp, Homo sapiens
atgcctggactgacatgcactg

SEQ ID NO: 7551348 - DNA, 22 bp, Homo sapiens
atgcctggactgacatgcactg

SEQ ID NO: 7551349 - DNA, 22 bp, Homo sapiens
atgcctggactgacatgcactg

SEQ ID NO: 7551350 - DNA, 22 bp, Homo sapiens
atgcccttcatttatcatgaaa

SEQ ID NO: 7551351 - DNA, 22 bp, Homo sapiens
atgccctgaggaatgtcacgct

SEQ ID NO: 7551352 - DNA, 22 bp, Homo sapiens
atgccctgcatcaagtgacact

SEQ ID NO: 7551353 - DNA, 22 bp, Homo sapiens
atgccctgcatcaagtgacact

SEQ ID NO: 7551354 - DNA, 22 bp, Homo sapiens
atgccctgcatcaagtgacact

SEQ ID NO: 7551355 - DNA, 22 bp, Homo sapiens
atgccctgctctcgggaaggga

SEQ ID NO: 7551356 - DNA, 22 bp, Homo sapiens
atgccctgccaagcaggctaaa

SEQ ID NO: 7551357 - DNA, 22 bp, Homo sapiens
atgccctgccaagcaggctaaa

SEQ ID NO: 7551358 - DNA, 22 bp, Homo sapiens
atgccctgccaagcaggctaaa

SEQ ID NO: 7551359 - DNA, 22 bp, Homo sapiens
atgccctgccaagcaggctaaa

SEQ ID NO: 7551360 - DNA, 22 bp, Homo sapiens
atgccctgcatcaagtgacact

SEQ ID NO: 7551361 - DNA, 22 bp, Homo sapiens
atgccctgctgccatctggccg

SEQ ID NO: 7551362 - DNA, 22 bp, Homo sapiens
atgccctgctctcgggaaggga

SEQ ID NO: 7551363 - DNA, 22 bp, Homo sapiens
atgccctgctctcgggaaggga

SEQ ID NO: 7551364 - DNA, 22 bp, Homo sapiens
atgccctgctctcgggaaggga

SEQ ID NO: 7551365 - DNA, 22 bp, Homo sapiens
atgccctggactagctatactt

SEQ ID NO: 7551366 - DNA, 22 bp, Homo sapiens
atgccctggactagctatactt

SEQ ID NO: 7551367 - DNA, 22 bp, Homo sapiens
atgccctgctgctggggcagtg

SEQ ID NO: 7551368 - DNA, 22 bp, Homo sapiens
atgccctgctgctggggcagtg

SEQ ID NO: 7551369 - DNA, 22 bp, Homo sapiens
atgccctgctgctggggcagtg

SEQ ID NO: 7551370 - DNA, 22 bp, Homo sapiens
atgccctgctgccatctggccg

SEQ ID NO: 7551371 - DNA, 22 bp, Homo sapiens
atgccccaggaggtgccatcca

SEQ ID NO: 7551372 - DNA, 22 bp, Homo sapiens
atgcccagggctggtgaggtcc

SEQ ID NO: 7551373 - DNA, 22 bp, Homo sapiens
atgcccaggcccatacctagat

SEQ ID NO: 7551374 - DNA, 22 bp, Homo sapiens
atgcccaggcccatacctagat

SEQ ID NO: 7551375 - DNA, 22 bp, Homo sapiens
atgcccagggctggtgaggtcc

SEQ ID NO: 7551376 - DNA, 22 bp, Homo sapiens
atgcccagggctggtgaggtcc

SEQ ID NO: 7551377 - DNA, 22 bp, Homo sapiens
atgcccaggcccatacctagat

SEQ ID NO: 7551378 - DNA, 22 bp, Homo sapiens
atgcccaggcccatacctagat

SEQ ID NO: 7551379 - DNA, 22 bp, Homo sapiens
atgcccaggcccatacctagat

SEQ ID NO: 7551380 - DNA, 22 bp, Homo sapiens
atgcccagaaccccctggatgg

SEQ ID NO: 7551381 - DNA, 22 bp, Homo sapiens
atgcccagaaccccctggatgg

SEQ ID NO: 7551382 - DNA, 22 bp, Homo sapiens
atgcccactcccattacaggac

SEQ ID NO: 7551383 - DNA, 22 bp, Homo sapiens
atgcccagaaccccctggatgg

SEQ ID NO: 7551384 - DNA, 22 bp, Homo sapiens
atgcccagaaccccctggatgg

SEQ ID NO: 7551385 - DNA, 22 bp, Homo sapiens
atgcccagaaccccctggatgg

SEQ ID NO: 7551386 - DNA, 22 bp, Homo sapiens
atgccctgaaagattcaaaggc

SEQ ID NO: 7551387 - DNA, 22 bp, Homo sapiens
atgccctgagcaggccttcaag

SEQ ID NO: 7551388 - DNA, 22 bp, Homo sapiens
atgccctgagcaggccttcaag

SEQ ID NO: 7551389 - DNA, 22 bp, Homo sapiens
atgccctgagcaggccttcaag

SEQ ID NO: 7551390 - DNA, 22 bp, Homo sapiens
atgccctgaggaatgtcacgct

SEQ ID NO: 7551391 - DNA, 22 bp, Homo sapiens
atgccctgagcaggccttcaag

SEQ ID NO: 7551392 - DNA, 22 bp, Homo sapiens
atgccccagtgtgtgcttcctt

SEQ ID NO: 7551393 - DNA, 22 bp, Homo sapiens
atgcccccatctctgttggctc

SEQ ID NO: 7551394 - DNA, 22 bp, Homo sapiens
atgcccctccttgtggtcgccc

SEQ ID NO: 7551395 - DNA, 22 bp, Homo sapiens
atgcccctggccactcatattg

SEQ ID NO: 7551396 - DNA, 22 bp, Homo sapiens
atgccctctgtttcccaaggcc

SEQ ID NO: 7551397 - DNA, 22 bp, Homo sapiens
atgccctctgtttcccaaggcc

SEQ ID NO: 7551398 - DNA, 22 bp, Homo sapiens
atgcatatgcatctgtgtacat

SEQ ID NO: 7551399 - DNA, 22 bp, Homo sapiens
atgccacttcattccagcctcg

SEQ ID NO: 7551400 - DNA, 22 bp, Homo sapiens
atgcccaatgtcacaatttttg

SEQ ID NO: 7551401 - DNA, 22 bp, Homo sapiens
atgcccaatgtcacaatttttg

SEQ ID NO: 7551402 - DNA, 22 bp, Homo sapiens
atgccacttcattccagcctcg

SEQ ID NO: 7551403 - DNA, 22 bp, Homo sapiens
atgccacttcattccagcctcg

SEQ ID NO: 7551404 - DNA, 22 bp, Homo sapiens
atgcccacaacactgcactttt

SEQ ID NO: 7551405 - DNA, 22 bp, Homo sapiens
atgcccaccctcagcccaggct

SEQ ID NO: 7551406 - DNA, 22 bp, Homo sapiens
atgcccacagagagggaaattt

SEQ ID NO: 7551407 - DNA, 22 bp, Homo sapiens
atgcccaccctcagcccaggct

SEQ ID NO: 7551408 - DNA, 22 bp, Homo sapiens
atgcccactcccattacaggac

SEQ ID NO: 7551409 - DNA, 22 bp, Homo sapiens
atgcccacaacactgcactttt

SEQ ID NO: 7551410 - DNA, 22 bp, Homo sapiens
atgcccacaacactgcactttt

SEQ ID NO: 7551411 - DNA, 22 bp, Homo sapiens
atgcccacaacactgcactttt

SEQ ID NO: 7551412 - DNA, 22 bp, Homo sapiens
atgcccaatgtcacaatttttg

SEQ ID NO: 7551413 - DNA, 22 bp, Homo sapiens
atgcccaatgtcacaatttttg

SEQ ID NO: 7551414 - DNA, 22 bp, Homo sapiens
atgcatatgcatctgtgtacat

SEQ ID NO: 7551415 - DNA, 22 bp, Homo sapiens
atgcatatgcaatgcacaattt

SEQ ID NO: 7551416 - DNA, 22 bp, Homo sapiens
atgcatatgcaatgcacaattt

SEQ ID NO: 7551417 - DNA, 22 bp, Homo sapiens
atgcatatgcaatgcacaattt

SEQ ID NO: 7551418 - DNA, 22 bp, Homo sapiens
atgcatatctcctatctcctca

SEQ ID NO: 7551419 - DNA, 22 bp, Homo sapiens
atgcatatgcaatgcacaattt

SEQ ID NO: 7551420 - DNA, 22 bp, Homo sapiens
atgcatatctcctatctcctca

SEQ ID NO: 7551421 - DNA, 22 bp, Homo sapiens
atgcatatctcctatctcctca

SEQ ID NO: 7551422 - DNA, 22 bp, Homo sapiens
atgcatatctcctatctcctca

SEQ ID NO: 7551423 - DNA, 22 bp, Homo sapiens
atgcatatcagtgattgtttgc

SEQ ID NO: 7551424 - DNA, 22 bp, Homo sapiens
atgcatatcagtgattgtttgc

SEQ ID NO: 7551425 - DNA, 22 bp, Homo sapiens
atgcatatcacagtctccatgt

SEQ ID NO: 7551426 - DNA, 22 bp, Homo sapiens
atgcatatcagtgattgtttgc

SEQ ID NO: 7551427 - DNA, 22 bp, Homo sapiens
atgcatatcagtgattgtttgc

SEQ ID NO: 7551428 - DNA, 22 bp, Homo sapiens
atgcatatcacagtctccatgt

SEQ ID NO: 7551429 - DNA, 22 bp, Homo sapiens
atgcatatcacagtctccatgt

SEQ ID NO: 7551430 - DNA, 20 bp, Homo sapiens
atgcatatatgtggtgtctg

SEQ ID NO: 7551431 - DNA, 20 bp, Homo sapiens
atgcatatatgtggtgtctg

SEQ ID NO: 7551432 - DNA, 22 bp, Homo sapiens
gaagcagagcctaaggcagaca

SEQ ID NO: 7551433 - DNA, 22 bp, Homo sapiens
gaagcagagcctaaggcagaca

SEQ ID NO: 7551434 - DNA, 22 bp, Homo sapiens
gaagcagagcctaaggcagaca

SEQ ID NO: 7551435 - DNA, 22 bp, Homo sapiens
gaagcagacttttgcttatttg

SEQ ID NO: 7551436 - DNA, 22 bp, Homo sapiens
gaagcagagcctaaggcagaca

SEQ ID NO: 7551437 - DNA, 22 bp, Homo sapiens
gaagcagagcctaaggcagaca

SEQ ID NO: 7551438 - DNA, 22 bp, Homo sapiens
gaagcagagcctaaggcagaca

SEQ ID NO: 7551439 - DNA, 22 bp, Homo sapiens
gaagcagacttttgcttatttg

SEQ ID NO: 7551440 - DNA, 22 bp, Homo sapiens
gaagcagacttttgcttatttg

SEQ ID NO: 7551441 - DNA, 22 bp, Homo sapiens
gaagcagacttttgcttatttg

SEQ ID NO: 7551442 - DNA, 22 bp, Homo sapiens
gaagcagaagtacgatttacta

SEQ ID NO: 7551443 - DNA, 22 bp, Homo sapiens
gaagcagaagtacgatttacta

SEQ ID NO: 7551444 - DNA, 22 bp, Homo sapiens
gaagcagaagtacgatttacta

SEQ ID NO: 7551445 - DNA, 22 bp, Homo sapiens
gaagcagaagtacgatttacta

SEQ ID NO: 7551446 - DNA, 22 bp, Homo sapiens
gaagcagaaggtttggacgtgc

SEQ ID NO: 7551447 - DNA, 22 bp, Homo sapiens
gaagcagaaggtttggacgtgc

SEQ ID NO: 7551448 - DNA, 22 bp, Homo sapiens
gaagcagaacccactccccaac

SEQ ID NO: 7551449 - DNA, 22 bp, Homo sapiens
gaagcactgtgctgctaagttg

SEQ ID NO: 7551450 - DNA, 22 bp, Homo sapiens
gaagcactgtgctgctaagttg

SEQ ID NO: 7551451 - DNA, 22 bp, Homo sapiens
gaagcactgccataattcagac

SEQ ID NO: 7551452 - DNA, 22 bp, Homo sapiens
gaagcactgccataattcagac

SEQ ID NO: 7551453 - DNA, 22 bp, Homo sapiens
gaagcactgcatttcaagatca

SEQ ID NO: 7551454 - DNA, 22 bp, Homo sapiens
gaagcactgcatttcaagatca

SEQ ID NO: 7551455 - DNA, 22 bp, Homo sapiens
gaagcacattagatgtgtcttc

SEQ ID NO: 7551456 - DNA, 22 bp, Homo sapiens
gaagcacattagatgtgtcttc

SEQ ID NO: 7551457 - DNA, 22 bp, Homo sapiens
gaatgtaatagtcagtagaaca

SEQ ID NO: 7551458 - DNA, 22 bp, Homo sapiens
gaatgtaataggaaacgtgtgg

SEQ ID NO: 7551459 - DNA, 22 bp, Homo sapiens
gaatgtaatagtcagtagaaca

SEQ ID NO: 7551460 - DNA, 22 bp, Homo sapiens
gaatgtaatagtcagtagaaca

SEQ ID NO: 7551461 - DNA, 22 bp, Homo sapiens
gaatgtaatagtcagtagaaca

SEQ ID NO: 7551462 - DNA, 22 bp, Homo sapiens
gaagcagagcctaaggcagaca

SEQ ID NO: 7551463 - DNA, 22 bp, Homo sapiens
gaagcagagcctaaggcagaca

SEQ ID NO: 7551464 - DNA, 22 bp, Homo sapiens
gaagcagagcctaaggcagaca

SEQ ID NO: 7551465 - DNA, 22 bp, Homo sapiens
gaagcagagcctaaggcagaca

SEQ ID NO: 7551466 - DNA, 23 bp, Homo sapiens
gaagcagatgtctgagtaggcag

SEQ ID NO: 7551467 - DNA, 23 bp, Homo sapiens
gaagcagatgtctgagtaggcag

SEQ ID NO: 7551468 - DNA, 23 bp, Homo sapiens
gaagcagatgtctgagtaggcag

SEQ ID NO: 7551469 - DNA, 16 bp, Homo sapiens
gaagcagagggtgttg

SEQ ID NO: 7551470 - DNA, 23 bp, Homo sapiens
gaagcagatgtctgagtaggcag

SEQ ID NO: 7551471 - DNA, 22 bp, Homo sapiens
gaatcaggattcaagatcagct

SEQ ID NO: 7551472 - DNA, 23 bp, Homo sapiens
gaatcagtggctaacaaggaaac

SEQ ID NO: 7551473 - DNA, 22 bp, Homo sapiens
atgcacaaggtagattattatt

SEQ ID NO: 7551474 - DNA, 23 bp, Homo sapiens
atgcacaagccagcaggggacag

SEQ ID NO: 7551475 - DNA, 22 bp, Homo sapiens
atgcacaagcaagagataatgg

SEQ ID NO: 7551476 - DNA, 22 bp, Homo sapiens
atgcacaagcaagagataatgg

SEQ ID NO: 7551477 - DNA, 22 bp, Homo sapiens
atgcacaagcaagagataatgg

SEQ ID NO: 7551478 - DNA, 22 bp, Homo sapiens
atgcacaagcaagagataatgg

SEQ ID NO: 7551479 - DNA, 22 bp, Homo sapiens
atgcacaagcaagagataatgg

SEQ ID NO: 7551480 - DNA, 22 bp, Homo sapiens
atgcacaacagacgaatggaag

SEQ ID NO: 7551481 - DNA, 22 bp, Homo sapiens
atgcacaagaggctagaaaaga

SEQ ID NO: 7551482 - DNA, 22 bp, Homo sapiens
atgcacaagaggctagaaaaga

SEQ ID NO: 7551483 - DNA, 22 bp, Homo sapiens
atgcacaagaggctagaaaaga

SEQ ID NO: 7551484 - DNA, 22 bp, Homo sapiens
atgcacaagaggctagaaaaga

SEQ ID NO: 7551485 - DNA, 22 bp, Homo sapiens
atgcacaagcaagagataatgg

SEQ ID NO: 7551486 - DNA, 22 bp, Homo sapiens
atgcacaagcaagagataatgg

SEQ ID NO: 7551487 - DNA, 22 bp, Homo sapiens
atgcacaagaggctagaaaaga

SEQ ID NO: 7551488 - DNA, 22 bp, Homo sapiens
atgcacaagaggctagaaaaga

SEQ ID NO: 7551489 - DNA, 22 bp, Homo sapiens
gaagcaatctggctcccagcca

SEQ ID NO: 7551490 - DNA, 22 bp, Homo sapiens
gaagcaatgtgttttcaacatt

SEQ ID NO: 7551491 - DNA, 22 bp, Homo sapiens
gaagcaatctggctcccagcca

SEQ ID NO: 7551492 - DNA, 22 bp, Homo sapiens
gaagcaatgtgttttcaacatt

SEQ ID NO: 7551493 - DNA, 22 bp, Homo sapiens
gaagcaatgtgttttcaacatt

SEQ ID NO: 7551494 - DNA, 22 bp, Homo sapiens
gaagcaatgtgttttcaacatt

SEQ ID NO: 7551495 - DNA, 22 bp, Homo sapiens
gaagcaatgtgttttcaacatt

SEQ ID NO: 7551496 - DNA, 22 bp, Homo sapiens
gaagcaatgtgttttcaacatt

SEQ ID NO: 7551497 - DNA, 22 bp, Homo sapiens
atgcacaaggtagattattatt

SEQ ID NO: 7551498 - DNA, 22 bp, Homo sapiens
gaagcaattaagtttgtgatct

SEQ ID NO: 7551499 - DNA, 22 bp, Homo sapiens
gaagcaattaagtttgtgatct

SEQ ID NO: 7551500 - DNA, 22 bp, Homo sapiens
gaagcaatttagaatcagaagc

SEQ ID NO: 7551501 - DNA, 22 bp, Homo sapiens
gaagcaattaagtttgtgatct

SEQ ID NO: 7551502 - DNA, 22 bp, Homo sapiens
gaagcacatggctgtgagcaac

SEQ ID NO: 7551503 - DNA, 22 bp, Homo sapiens
gaagcacatggctatagctatt

SEQ ID NO: 7551504 - DNA, 22 bp, Homo sapiens
gaagcacatggctatagctatt

SEQ ID NO: 7551505 - DNA, 22 bp, Homo sapiens
gaagcacatggctgtgagcaac

SEQ ID NO: 7551506 - DNA, 22 bp, Homo sapiens
gaagcacatggctgtgagcaac

SEQ ID NO: 7551507 - DNA, 22 bp, Homo sapiens
gaagcacatggctgtgagcaac

SEQ ID NO: 7551508 - DNA, 22 bp, Homo sapiens
gaagcacatggctgtgagcaac

SEQ ID NO: 7551509 - DNA, 22 bp, Homo sapiens
gaagcacatggctgtgagcaac

SEQ ID NO: 7551510 - DNA, 22 bp, Homo sapiens
gaagcacatggctgtgagcaac

SEQ ID NO: 7551511 - DNA, 22 bp, Homo sapiens
gaagcacagataattcaagtat

SEQ ID NO: 7551512 - DNA, 22 bp, Homo sapiens
gaagcacagataattcaagtat

SEQ ID NO: 7551513 - DNA, 22 bp, Homo sapiens
gaagcacagataattcaagtat

SEQ ID NO: 7551514 - DNA, 22 bp, Homo sapiens
gaagcacactgattttatttct

SEQ ID NO: 7551515 - DNA, 22 bp, Homo sapiens
gaagcacagaatggttaacatg

SEQ ID NO: 7551516 - DNA, 22 bp, Homo sapiens
gaagcacagaatggttaacatg

SEQ ID NO: 7551517 - DNA, 22 bp, Homo sapiens
gaagcacaaagtgtagttccga

SEQ ID NO: 7551518 - DNA, 22 bp, Homo sapiens
gaagcacaaagtgtagttccga

SEQ ID NO: 7551519 - DNA, 22 bp, Homo sapiens
gaagcacaaagtgtagttccga

SEQ ID NO: 7551520 - DNA, 22 bp, Homo sapiens
gaagcaatttagaatcagaagc

SEQ ID NO: 7551521 - DNA, 22 bp, Homo sapiens
gaagcaatttagaatcagaagc

SEQ ID NO: 7551522 - DNA, 22 bp, Homo sapiens
gaagcaatttagaatcagaagc

SEQ ID NO: 7551523 - DNA, 22 bp, Homo sapiens
atgcatatagaacatttgacat

SEQ ID NO: 7551524 - DNA, 22 bp, Homo sapiens
atgcatatagaacatttgacat

SEQ ID NO: 7551525 - DNA, 22 bp, Homo sapiens
atgcatatagaacatttgacat

SEQ ID NO: 7551526 - DNA, 22 bp, Homo sapiens
atgcatatagaacatttgacat

SEQ ID NO: 7551527 - DNA, 22 bp, Homo sapiens
atgcatataatggccagaacaa

SEQ ID NO: 7551528 - DNA, 22 bp, Homo sapiens
atgcatatatacatacacagtc

SEQ ID NO: 7551529 - DNA, 22 bp, Homo sapiens
atgcatatatacatacacagtc

SEQ ID NO: 7551530 - DNA, 22 bp, Homo sapiens
atgcatatagaacatttgacat

SEQ ID NO: 7551531 - DNA, 22 bp, Homo sapiens
atgcatatatacatacacagtc

SEQ ID NO: 7551532 - DNA, 22 bp, Homo sapiens
atgcatataaggcacatgtatt

SEQ ID NO: 7551533 - DNA, 22 bp, Homo sapiens
atgcatataatggccagaacaa

SEQ ID NO: 7551534 - DNA, 22 bp, Homo sapiens
atgcatataatggccagaacaa

SEQ ID NO: 7551535 - DNA, 22 bp, Homo sapiens
atgcatataaggcacatgtatt

SEQ ID NO: 7551536 - DNA, 22 bp, Homo sapiens
atgcatataaggcacatgtatt

SEQ ID NO: 7551537 - DNA, 22 bp, Homo sapiens
atgcatataaggcacatgtatt

SEQ ID NO: 7551538 - DNA, 19 bp, Homo sapiens
atgcatacttgcatagttt

SEQ ID NO: 7551539 - DNA, 22 bp, Homo sapiens
atgcatacagatttaaaatttt

SEQ ID NO: 7551540 - DNA, 22 bp, Homo sapiens
atgcatactgtatgtgtattta

SEQ ID NO: 7551541 - DNA, 22 bp, Homo sapiens
atgcatactgtatgtgtattta

SEQ ID NO: 7551542 - DNA, 22 bp, Homo sapiens
gaatgtttgactaaaggtagct

SEQ ID NO: 7551543 - DNA, 22 bp, Homo sapiens
gaatgtttgactaaaggtagct

SEQ ID NO: 7551544 - DNA, 22 bp, Homo sapiens
atgcataagtgcagcagatttg

SEQ ID NO: 7551545 - DNA, 22 bp, Homo sapiens
atgcataatgtatgtattgact

SEQ ID NO: 7551546 - DNA, 22 bp, Homo sapiens
atgcataatgtatgtattgact

SEQ ID NO: 7551547 - DNA, 22 bp, Homo sapiens
atgcataatgtatgtattgact

SEQ ID NO: 7551548 - DNA, 22 bp, Homo sapiens
atgcatacagatttaaaatttt

SEQ ID NO: 7551549 - DNA, 22 bp, Homo sapiens
gaatgtttaaaaggtgcagttt

SEQ ID NO: 7551550 - DNA, 22 bp, Homo sapiens
gaatgtttaaggaaggcgtggc

SEQ ID NO: 7551551 - DNA, 22 bp, Homo sapiens
gaatgtttaaggaaggcgtggc

SEQ ID NO: 7551552 - DNA, 22 bp, Homo sapiens
gaatgtttcatgtgtatgttag

SEQ ID NO: 7551553 - DNA, 22 bp, Homo sapiens
gaatgttaatgcacttctagct

SEQ ID NO: 7551554 - DNA, 22 bp, Homo sapiens
gaatgttaatgcacttctagct

SEQ ID NO: 7551555 - DNA, 22 bp, Homo sapiens
gaatgttactttgattttgtcc

SEQ ID NO: 7551556 - DNA, 22 bp, Homo sapiens
gaatgtgtgactctattgagca

SEQ ID NO: 7551557 - DNA, 22 bp, Homo sapiens
gaatgtgtgactctattgagca

SEQ ID NO: 7551558 - DNA, 22 bp, Homo sapiens
gaatgtgtcaccctgtcccatg

SEQ ID NO: 7551559 - DNA, 22 bp, Homo sapiens
gaatgtgggctgtgaagaggag

SEQ ID NO: 7551560 - DNA, 22 bp, Homo sapiens
gaatgtgggctgtgaagaggag

SEQ ID NO: 7551561 - DNA, 22 bp, Homo sapiens
gaatgtgtactgagtgcccctt

SEQ ID NO: 7551562 - DNA, 22 bp, Homo sapiens
gaatgtgggctgtgaagaggag

SEQ ID NO: 7551563 - DNA, 22 bp, Homo sapiens
gaatgtgggctgtgaagaggag

SEQ ID NO: 7551564 - DNA, 22 bp, Homo sapiens
gaatgtgggctgtgaagaggag

SEQ ID NO: 7551565 - DNA, 22 bp, Homo sapiens
gaatgttatgtatccagtcaca

SEQ ID NO: 7551566 - DNA, 22 bp, Homo sapiens
gaatgttagagattcttaggtt

SEQ ID NO: 7551567 - DNA, 22 bp, Homo sapiens
gaatgttactttgattttgtcc

SEQ ID NO: 7551568 - DNA, 22 bp, Homo sapiens
gaatgttattgaactacgagct

SEQ ID NO: 7551569 - DNA, 22 bp, Homo sapiens
gaatgttattgaactacgagct

SEQ ID NO: 7551570 - DNA, 22 bp, Homo sapiens
gaatgttatgtatccagtcaca

SEQ ID NO: 7551571 - DNA, 22 bp, Homo sapiens
gaatgttattggacagcagtgg

SEQ ID NO: 7551572 - DNA, 22 bp, Homo sapiens
gaatgttctgaggaatcagaga

SEQ ID NO: 7551573 - DNA, 22 bp, Homo sapiens
gaatgtctaaacatagctttta

SEQ ID NO: 7551574 - DNA, 22 bp, Homo sapiens
gaatgtctccaacttggggaaa

SEQ ID NO: 7551575 - DNA, 22 bp, Homo sapiens
gaatgtctatgtaaccgagggg

SEQ ID NO: 7551576 - DNA, 22 bp, Homo sapiens
gaatgtcagttgcgggcatttc

SEQ ID NO: 7551577 - DNA, 22 bp, Homo sapiens
gaatgtccctgcagttgctgcc

SEQ ID NO: 7551578 - DNA, 22 bp, Homo sapiens
gaatgtcagggccagaagaggc

SEQ ID NO: 7551579 - DNA, 22 bp, Homo sapiens
gaatgtaatagtcagtagaaca

SEQ ID NO: 7551580 - DNA, 22 bp, Homo sapiens
gaatgtcttctgttcccagctg

SEQ ID NO: 7551581 - DNA, 22 bp, Homo sapiens
gaatgtcttctgttcccagctg

SEQ ID NO: 7551582 - DNA, 22 bp, Homo sapiens
gaatgtctttttggtacttata

SEQ ID NO: 7551583 - DNA, 22 bp, Homo sapiens
gaatgtgaggttgtatgtgaaa

SEQ ID NO: 7551584 - DNA, 22 bp, Homo sapiens
gaatgtgaggttgtatgtgaaa

SEQ ID NO: 7551585 - DNA, 22 bp, Homo sapiens
gaatgtgaggttgtatgtgaaa

SEQ ID NO: 7551586 - DNA, 22 bp, Homo sapiens
gaatgtcttcaaaactagactg

SEQ ID NO: 7551587 - DNA, 22 bp, Homo sapiens
gaatgtcttattgctcgttgta

SEQ ID NO: 7551588 - DNA, 22 bp, Homo sapiens
gaatgtctgtttcaacaagcac

SEQ ID NO: 7551589 - DNA, 19 bp, Homo sapiens
gaatgtctcctacttctga

SEQ ID NO: 7551590 - DNA, 21 bp, Homo sapiens
gaatgtctgccttcacaatga

SEQ ID NO: 7551591 - DNA, 22 bp, Homo sapiens
gaatgtctatgtaaccgagggg

SEQ ID NO: 7551592 - DNA, 22 bp, Homo sapiens
atgtaatttatgttatccataa

SEQ ID NO: 7551593 - DNA, 22 bp, Homo sapiens
atgtaatttgccctcaagttaa

SEQ ID NO: 7551594 - DNA, 22 bp, Homo sapiens
atgtacaaaatgccactgaatt

SEQ ID NO: 7551595 - DNA, 22 bp, Homo sapiens
atgtacaaaatgccactgaatt

SEQ ID NO: 7551596 - DNA, 22 bp, Homo sapiens
atgtaattgtagcaaaatgatg

SEQ ID NO: 7551597 - DNA, 22 bp, Homo sapiens
atgtaatttagaaatgaacaca

SEQ ID NO: 7551598 - DNA, 22 bp, Homo sapiens
atgtaatttagaaatgaacaca

SEQ ID NO: 7551599 - DNA, 22 bp, Homo sapiens
atgtaatttatgttatccataa

SEQ ID NO: 7551600 - DNA, 22 bp, Homo sapiens
atgtaatttatgttatccataa

SEQ ID NO: 7551601 - DNA, 22 bp, Homo sapiens
atgtaatttatgttatccataa

SEQ ID NO: 7551602 - DNA, 22 bp, Homo sapiens
atgtaatttatgttatccataa

SEQ ID NO: 7551603 - DNA, 22 bp, Homo sapiens
atgtaatttagaaatgaacaca

SEQ ID NO: 7551604 - DNA, 22 bp, Homo sapiens
atgtaatttagaaatgaacaca

SEQ ID NO: 7551605 - DNA, 22 bp, Homo sapiens
atgtaattgtggtttttgccat

SEQ ID NO: 7551606 - DNA, 22 bp, Homo sapiens
atgtaattgtagcaaaatgatg

SEQ ID NO: 7551607 - DNA, 22 bp, Homo sapiens
atgtaatgattgcaatgctgct

SEQ ID NO: 7551608 - DNA, 22 bp, Homo sapiens
atgtaattctaagactgaagaa

SEQ ID NO: 7551609 - DNA, 22 bp, Homo sapiens
atgtaattctaagactgaagaa

SEQ ID NO: 7551610 - DNA, 22 bp, Homo sapiens
atgtaattgtagcaaaatgatg

SEQ ID NO: 7551611 - DNA, 22 bp, Homo sapiens
atgtaattgtagcaaaatgatg

SEQ ID NO: 7551612 - DNA, 22 bp, Homo sapiens
atgtaatagggtaacataacat

SEQ ID NO: 7551613 - DNA, 22 bp, Homo sapiens
atgtaatagggtaacataacat

SEQ ID NO: 7551614 - DNA, 22 bp, Homo sapiens
atgtaatagggtaacataacat

SEQ ID NO: 7551615 - DNA, 22 bp, Homo sapiens
atgtaatgattgcaatgctgct

SEQ ID NO: 7551616 - DNA, 22 bp, Homo sapiens
atgtaatgtagctgtgttagga

SEQ ID NO: 7551617 - DNA, 22 bp, Homo sapiens
atgtaattattaacacctgtgc

SEQ ID NO: 7551618 - DNA, 22 bp, Homo sapiens
atgtaattattaacacctgtgc

SEQ ID NO: 7551619 - DNA, 22 bp, Homo sapiens
atgtaaggagccacagtggggg

SEQ ID NO: 7551620 - DNA, 23 bp, Homo sapiens
atgtaagagttccagttactttg

SEQ ID NO: 7551621 - DNA, 23 bp, Homo sapiens
atgtaagagttccagttactttg

SEQ ID NO: 7551622 - DNA, 22 bp, Homo sapiens
atgtaagtattcaaaatatttc

SEQ ID NO: 7551623 - DNA, 22 bp, Homo sapiens
atgtaagtattcaaaatatttc

SEQ ID NO: 7551624 - DNA, 22 bp, Homo sapiens
atgtaagtttaagcacaacaag

SEQ ID NO: 7551625 - DNA, 22 bp, Homo sapiens
atgtaagtattcaaaatatttc

SEQ ID NO: 7551626 - DNA, 22 bp, Homo sapiens
atgtaagactttaagaacctaa

SEQ ID NO: 7551627 - DNA, 22 bp, Homo sapiens
atgtaagagtctaagattgtag

SEQ ID NO: 7551628 - DNA, 22 bp, Homo sapiens
atgtaagagctttgcagggaaa

SEQ ID NO: 7551629 - DNA, 22 bp, Homo sapiens
atgtaactgaaggaaatgcatg

SEQ ID NO: 7551630 - DNA, 22 bp, Homo sapiens
atgtaactgttatattttgttg

SEQ ID NO: 7551631 - DNA, 22 bp, Homo sapiens
atgtaactgttatattttgttg

SEQ ID NO: 7551632 - DNA, 17 bp, Homo sapiens
atgtaagaagaaagcag

SEQ ID NO: 7551633 - DNA, 22 bp, Homo sapiens
atgtaacttctgtgaatctgac

SEQ ID NO: 7551634 - DNA, 22 bp, Homo sapiens
atgtaaattgtactgacacacg

SEQ ID NO: 7551635 - DNA, 22 bp, Homo sapiens
atgtaaattgtactgacacacg

SEQ ID NO: 7551636 - DNA, 22 bp, Homo sapiens
atgtaacaaatggtatacatgt

SEQ ID NO: 7551637 - DNA, 22 bp, Homo sapiens
atgtaacaaatggtatacatgt

SEQ ID NO: 7551638 - DNA, 22 bp, Homo sapiens
atgtaacaaatggtatacatgt

SEQ ID NO: 7551639 - DNA, 22 bp, Homo sapiens
atgtaaattgtactgacacacg

SEQ ID NO: 7551640 - DNA, 22 bp, Homo sapiens
atggtttaagggagaatattga

SEQ ID NO: 7551641 - DNA, 22 bp, Homo sapiens
atgtaacattgaattatatagt

SEQ ID NO: 7551642 - DNA, 22 bp, Homo sapiens
atgtaacatatgtgatcgcatt

SEQ ID NO: 7551643 - DNA, 22 bp, Homo sapiens
atgtaacattgaattatatagt

SEQ ID NO: 7551644 - DNA, 22 bp, Homo sapiens
atgtaacattgaattatatagt

SEQ ID NO: 7551645 - DNA, 22 bp, Homo sapiens
atgtaaccaccacacaaagcaa

SEQ ID NO: 7551646 - DNA, 22 bp, Homo sapiens
atgtaactgaaggaaatgcatg

SEQ ID NO: 7551647 - DNA, 22 bp, Homo sapiens
atgtaactgaaggaaatgcatg

SEQ ID NO: 7551648 - DNA, 22 bp, Homo sapiens
atgtaacaaatggtatacatgt

SEQ ID NO: 7551649 - DNA, 22 bp, Homo sapiens
atgtaacaaatggtatacatgt

SEQ ID NO: 7551650 - DNA, 22 bp, Homo sapiens
atgtaacacccacttttatagc

SEQ ID NO: 7551651 - DNA, 22 bp, Homo sapiens
atgtaacacccacttttatagc

SEQ ID NO: 7551652 - DNA, 22 bp, Homo sapiens
atgtaacacccacttttatagc

SEQ ID NO: 7551653 - DNA, 22 bp, Homo sapiens
atgtaacaggtgaagctctgag

SEQ ID NO: 7551654 - DNA, 22 bp, Homo sapiens
atgtaacaggtgaagctctgag

SEQ ID NO: 7551655 - DNA, 22 bp, Homo sapiens
atgtaacacccacttttatagc

SEQ ID NO: 7551656 - DNA, 22 bp, Homo sapiens
atgtaacaggcacgggtggata

SEQ ID NO: 7551657 - DNA, 22 bp, Homo sapiens
atgtaacaggcacgggtggata

SEQ ID NO: 7551658 - DNA, 22 bp, Homo sapiens
atgtaacacccacttttatagc

SEQ ID NO: 7551659 - DNA, 22 bp, Homo sapiens
atgtaacacccacttttatagc

SEQ ID NO: 7551660 - DNA, 22 bp, Homo sapiens
atgtcacaaaagtcccattatg

SEQ ID NO: 7551661 - DNA, 18 bp, Homo sapiens
atgtcacagagggctgaa

SEQ ID NO: 7551662 - DNA, 18 bp, Homo sapiens
atgtcacagagggctgaa

SEQ ID NO: 7551663 - DNA, 22 bp, Homo sapiens
atgtcacagcaggagtattctt

SEQ ID NO: 7551664 - DNA, 22 bp, Homo sapiens
atgtcacagcaggagtattctt

SEQ ID NO: 7551665 - DNA, 22 bp, Homo sapiens
atgtcacagcaggagtattctt

SEQ ID NO: 7551666 - DNA, 22 bp, Homo sapiens
atgtcaagactatactttgcct

SEQ ID NO: 7551667 - DNA, 22 bp, Homo sapiens
atgtcaatttgttctctcgaag

SEQ ID NO: 7551668 - DNA, 21 bp, Homo sapiens
atgtcaaatgctttattttat

SEQ ID NO: 7551669 - DNA, 21 bp, Homo sapiens
atgtcaaatgctttattttat

SEQ ID NO: 7551670 - DNA, 22 bp, Homo sapiens
atgtatttgaaatttgagacat

SEQ ID NO: 7551671 - DNA, 22 bp, Homo sapiens
atgtatttgaaatttgagacat

SEQ ID NO: 7551672 - DNA, 22 bp, Homo sapiens
atgtatttgaaatttgagacat

SEQ ID NO: 7551673 - DNA, 22 bp, Homo sapiens
atgtatttgaaatttgagacat

SEQ ID NO: 7551674 - DNA, 22 bp, Homo sapiens
atgtatttgaaatttgagacat

SEQ ID NO: 7551675 - DNA, 22 bp, Homo sapiens
atgtatttctatgtagtgaaga

SEQ ID NO: 7551676 - DNA, 22 bp, Homo sapiens
atgtatttctatgtagtgaaga

SEQ ID NO: 7551677 - DNA, 22 bp, Homo sapiens
atgtatttctatgtagtgaaga

SEQ ID NO: 7551678 - DNA, 22 bp, Homo sapiens
atgtacaatctatcacaagaag

SEQ ID NO: 7551679 - DNA, 22 bp, Homo sapiens
atgtcacagctcccattcctcc

SEQ ID NO: 7551680 - DNA, 22 bp, Homo sapiens
atgtcacagctcccattcctcc

SEQ ID NO: 7551681 - DNA, 22 bp, Homo sapiens
atgtcacagctcccattcctcc

SEQ ID NO: 7551682 - DNA, 22 bp, Homo sapiens
atgtcacagctcccattcctcc

SEQ ID NO: 7551683 - DNA, 22 bp, Homo sapiens
atgtcacaggcaacaagattgc

SEQ ID NO: 7551684 - DNA, 22 bp, Homo sapiens
atgtcacagcaggagtattctt

SEQ ID NO: 7551685 - DNA, 22 bp, Homo sapiens
atgtcacagcaggagtattctt

SEQ ID NO: 7551686 - DNA, 22 bp, Homo sapiens
atgtcacagtctgactcagtga

SEQ ID NO: 7551687 - DNA, 22 bp, Homo sapiens
atgtcacagtctgactcagtga

SEQ ID NO: 7551688 - DNA, 22 bp, Homo sapiens
atgtcacagtctgactcagtga

SEQ ID NO: 7551689 - DNA, 22 bp, Homo sapiens
atgtcacagtctgactcagtga

SEQ ID NO: 7551690 - DNA, 22 bp, Homo sapiens
atgtcacagtctgactcagtga

SEQ ID NO: 7551691 - DNA, 22 bp, Homo sapiens
atgtcacagttgcaacatgaat

SEQ ID NO: 7551692 - DNA, 22 bp, Homo sapiens
atgtcacagtctgactcagtga

SEQ ID NO: 7551693 - DNA, 22 bp, Homo sapiens
atgtcacagtgttgctggaagt

SEQ ID NO: 7551694 - DNA, 22 bp, Homo sapiens
atgtcacagtgttgctggaagt

SEQ ID NO: 7551695 - DNA, 22 bp, Homo sapiens
atgtacaaaatgttttgaaatg

SEQ ID NO: 7551696 - DNA, 22 bp, Homo sapiens
atgtacaaaatgttttgaaatg

SEQ ID NO: 7551697 - DNA, 22 bp, Homo sapiens
atgtacaacctgcatgacagtc

SEQ ID NO: 7551698 - DNA, 22 bp, Homo sapiens
atgtacaacctgcatgacagtc

SEQ ID NO: 7551699 - DNA, 22 bp, Homo sapiens
atgtacaacctgcatgacagtc

SEQ ID NO: 7551700 - DNA, 22 bp, Homo sapiens
atgtacaacctgcatgacagtc

SEQ ID NO: 7551701 - DNA, 22 bp, Homo sapiens
atgtacaacctgcatgacagtc

SEQ ID NO: 7551702 - DNA, 22 bp, Homo sapiens
atgtacaacctgcatgacagtc

SEQ ID NO: 7551703 - DNA, 22 bp, Homo sapiens
atgtacaacctgcatgacagtc

SEQ ID NO: 7551704 - DNA, 22 bp, Homo sapiens
atgtacaacctgcatgacagtc

SEQ ID NO: 7551705 - DNA, 22 bp, Homo sapiens
atgtacaacctgcatgacagtc

SEQ ID NO: 7551706 - DNA, 22 bp, Homo sapiens
atgtacaaaatgttttgaaatg

SEQ ID NO: 7551707 - DNA, 22 bp, Homo sapiens
atgtacaaaatgttttgaaatg

SEQ ID NO: 7551708 - DNA, 22 bp, Homo sapiens
atgtacaaaatgttttgaaatg

SEQ ID NO: 7551709 - DNA, 22 bp, Homo sapiens
atgtacaaaatgccactgaatt

SEQ ID NO: 7551710 - DNA, 22 bp, Homo sapiens
atgtacaaaatgccactgaatt

SEQ ID NO: 7551711 - DNA, 22 bp, Homo sapiens
atgtacaaaatgccactgaatt

SEQ ID NO: 7551712 - DNA, 22 bp, Homo sapiens
atgtacaatctatcacaagaag

SEQ ID NO: 7551713 - DNA, 22 bp, Homo sapiens
atgtacaatctatcacaagaag

SEQ ID NO: 7551714 - DNA, 22 bp, Homo sapiens
atgtacaatctatcacaagaag

SEQ ID NO: 7551715 - DNA, 22 bp, Homo sapiens
atgtacaatctatcacaagaag

SEQ ID NO: 7551716 - DNA, 22 bp, Homo sapiens
atgtacaatctatcacaagaag

SEQ ID NO: 7551717 - DNA, 22 bp, Homo sapiens
atgtacaatctagggtttgcat

SEQ ID NO: 7551718 - DNA, 22 bp, Homo sapiens
atgtacaatctatcacaagaag

SEQ ID NO: 7551719 - DNA, 22 bp, Homo sapiens
atgtacaatctagggtttgcat

SEQ ID NO: 7551720 - DNA, 22 bp, Homo sapiens
atgtacaagctgttttactgca

SEQ ID NO: 7551721 - DNA, 22 bp, Homo sapiens
atgtacaagctgttttactgca

SEQ ID NO: 7551722 - DNA, 22 bp, Homo sapiens
atgtacaagctgttttactgca

SEQ ID NO: 7551723 - DNA, 22 bp, Homo sapiens
atgtacaagctgttttactgca

SEQ ID NO: 7551724 - DNA, 22 bp, Homo sapiens
atgtacaagctgttttactgca

SEQ ID NO: 7551725 - DNA, 22 bp, Homo sapiens
atgtacaacctgcatgacagtc

SEQ ID NO: 7551726 - DNA, 22 bp, Homo sapiens
gaggaagctgcgtggcatttca

SEQ ID NO: 7551727 - DNA, 22 bp, Homo sapiens
gaggaagctgcgtggcatttca

SEQ ID NO: 7551728 - DNA, 22 bp, Homo sapiens
gaggaagctgcgtggcatttca

SEQ ID NO: 7551729 - DNA, 22 bp, Homo sapiens
gaggaagccccattgaagccag

SEQ ID NO: 7551730 - DNA, 22 bp, Homo sapiens
gaggaagccccattgaagccag

SEQ ID NO: 7551731 - DNA, 22 bp, Homo sapiens
gaggaagccccattgaagccag

SEQ ID NO: 7551732 - DNA, 22 bp, Homo sapiens
gaggaagccccattgaagccag

SEQ ID NO: 7551733 - DNA, 22 bp, Homo sapiens
gaggaagccccattgaagccag

SEQ ID NO: 7551734 - DNA, 22 bp, Homo sapiens
gaggaagcattgacataatctc

SEQ ID NO: 7551735 - DNA, 22 bp, Homo sapiens
gaggaagatggttgagtggtcc

SEQ ID NO: 7551736 - DNA, 22 bp, Homo sapiens
gaggaagcagggcttggctgag

SEQ ID NO: 7551737 - DNA, 22 bp, Homo sapiens
gaggaagcagggcttggctgag

SEQ ID NO: 7551738 - DNA, 22 bp, Homo sapiens
gaggaagcagggcttggctgag

SEQ ID NO: 7551739 - DNA, 22 bp, Homo sapiens
gaggaagcagggcttggctgag

SEQ ID NO: 7551740 - DNA, 22 bp, Homo sapiens
gaggaagcagggcttggctgag

SEQ ID NO: 7551741 - DNA, 22 bp, Homo sapiens
gaggaagatggttgagtggtcc

SEQ ID NO: 7551742 - DNA, 22 bp, Homo sapiens
gaggaagatggttgagtggtcc

SEQ ID NO: 7551743 - DNA, 22 bp, Homo sapiens
gagcttttactgctgtattgaa

SEQ ID NO: 7551744 - DNA, 22 bp, Homo sapiens
gagctttgtctcctggagaccc

SEQ ID NO: 7551745 - DNA, 22 bp, Homo sapiens
gagctttgtgctggtaggtggt

SEQ ID NO: 7551746 - DNA, 22 bp, Homo sapiens
gagctttgtgctggtaggtggt

SEQ ID NO: 7551747 - DNA, 22 bp, Homo sapiens
gagctttgctggaagcctgggg

SEQ ID NO: 7551748 - DNA, 22 bp, Homo sapiens
gagctttggggaagaatacaga

SEQ ID NO: 7551749 - DNA, 22 bp, Homo sapiens
gagctttggggaagaatacaga

SEQ ID NO: 7551750 - DNA, 22 bp, Homo sapiens
gagctttgcctaaaactagaat

SEQ ID NO: 7551751 - DNA, 22 bp, Homo sapiens
gaggaaggagggaaagcgcgcg

SEQ ID NO: 7551752 - DNA, 22 bp, Homo sapiens
gaggaaggagggaaagcgcgcg

SEQ ID NO: 7551753 - DNA, 22 bp, Homo sapiens
gaggaaggagggaaagcgcgcg

SEQ ID NO: 7551754 - DNA, 22 bp, Homo sapiens
gaggaaggagggaaagcgcgcg

SEQ ID NO: 7551755 - DNA, 22 bp, Homo sapiens
gaggaaggagggaaagcgcgcg

SEQ ID NO: 7551756 - DNA, 22 bp, Homo sapiens
gaggaaggagggaaagcgcgcg

SEQ ID NO: 7551757 - DNA, 22 bp, Homo sapiens
gaggaaggaatgcagtgtatgc

SEQ ID NO: 7551758 - DNA, 22 bp, Homo sapiens
gaggaaggagggaaagcgcgcg

SEQ ID NO: 7551759 - DNA, 22 bp, Homo sapiens
gaggaaggagggaaagcgcgcg

SEQ ID NO: 7551760 - DNA, 22 bp, Homo sapiens
gaggaagcttttgatcgcccag

SEQ ID NO: 7551761 - DNA, 22 bp, Homo sapiens
gaggaaggaatgcagtgtatgc

SEQ ID NO: 7551762 - DNA, 22 bp, Homo sapiens
gaggaaggaatgcagtgtatgc

SEQ ID NO: 7551763 - DNA, 22 bp, Homo sapiens
gaggaaggaatgcagtgtatgc

SEQ ID NO: 7551764 - DNA, 22 bp, Homo sapiens
gaggaaggaatgcagtgtatgc

SEQ ID NO: 7551765 - DNA, 22 bp, Homo sapiens
gaggaaggaatgcagtgtatgc

SEQ ID NO: 7551766 - DNA, 22 bp, Homo sapiens
gaggaaggaatgcagtgtatgc

SEQ ID NO: 7551767 - DNA, 22 bp, Homo sapiens
gaggaaggctaaggggcttaga

SEQ ID NO: 7551768 - DNA, 22 bp, Homo sapiens
gaggaaggctaaggggcttaga

SEQ ID NO: 7551769 - DNA, 22 bp, Homo sapiens
gaggaaggatttagtttgaggg

SEQ ID NO: 7551770 - DNA, 22 bp, Homo sapiens
gaggaaggatttagtttgaggg

SEQ ID NO: 7551771 - DNA, 22 bp, Homo sapiens
gaggaaggatttagtttgaggg

SEQ ID NO: 7551772 - DNA, 22 bp, Homo sapiens
gaggaaggatttagtttgaggg

SEQ ID NO: 7551773 - DNA, 22 bp, Homo sapiens
gaggaaggatttagtttgaggg

SEQ ID NO: 7551774 - DNA, 22 bp, Homo sapiens
gaggaaggatttagtttgaggg

SEQ ID NO: 7551775 - DNA, 22 bp, Homo sapiens
gaggaaggatttagtttgaggg

SEQ ID NO: 7551776 - DNA, 22 bp, Homo sapiens
atggtttaagggagaatattga

SEQ ID NO: 7551777 - DNA, 22 bp, Homo sapiens
gaggaaggctaaggggcttaga

SEQ ID NO: 7551778 - DNA, 22 bp, Homo sapiens
gaggaaggctaaggggcttaga

SEQ ID NO: 7551779 - DNA, 22 bp, Homo sapiens
gaggaaggctaaggggcttaga

SEQ ID NO: 7551780 - DNA, 22 bp, Homo sapiens
gaggaaggctaaggggcttaga

SEQ ID NO: 7551781 - DNA, 20 bp, Homo sapiens
atggttcaggccagctgtct

SEQ ID NO: 7551782 - DNA, 22 bp, Homo sapiens
atggttattgacctgttgtgct

SEQ ID NO: 7551783 - DNA, 22 bp, Homo sapiens
gagctttaagggataaaatgat

SEQ ID NO: 7551784 - DNA, 22 bp, Homo sapiens
gagctttaccttaggttctgtt

SEQ ID NO: 7551785 - DNA, 22 bp, Homo sapiens
gagcttggtgttatttctgtgg

SEQ ID NO: 7551786 - DNA, 22 bp, Homo sapiens
gagcttggtgttatttctgtgg

SEQ ID NO: 7551787 - DNA, 22 bp, Homo sapiens
gagcttggtgctgcctgttgtc

SEQ ID NO: 7551788 - DNA, 22 bp, Homo sapiens
gagcttggtgctgcctgttgtc

SEQ ID NO: 7551789 - DNA, 22 bp, Homo sapiens
gagcttggtgctgcctgttgtc

SEQ ID NO: 7551790 - DNA, 22 bp, Homo sapiens
gagcttggtgcacagtggttaa

SEQ ID NO: 7551791 - DNA, 22 bp, Homo sapiens
gagcttggtgctgcctgttgtc

SEQ ID NO: 7551792 - DNA, 22 bp, Homo sapiens
gagcttggtgctgcctgttgtc

SEQ ID NO: 7551793 - DNA, 22 bp, Homo sapiens
gagctttgatcgctaagcctca

SEQ ID NO: 7551794 - DNA, 22 bp, Homo sapiens
gagctttaccttaggttctgtt

SEQ ID NO: 7551795 - DNA, 22 bp, Homo sapiens
gagcttggctggacctcacgga

SEQ ID NO: 7551796 - DNA, 22 bp, Homo sapiens
gagctggggcggatactcagct

SEQ ID NO: 7551797 - DNA, 22 bp, Homo sapiens
gagcttggggcatatggtgcta

SEQ ID NO: 7551798 - DNA, 22 bp, Homo sapiens
gagcttggctggacctcacgga

SEQ ID NO: 7551799 - DNA, 22 bp, Homo sapiens
gagctggggcggatactcagct

SEQ ID NO: 7551800 - DNA, 22 bp, Homo sapiens
gagctggggcggatactcagct

SEQ ID NO: 7551801 - DNA, 22 bp, Homo sapiens
gagctggggcggatactcagct

SEQ ID NO: 7551802 - DNA, 22 bp, Homo sapiens
gagctggggcggatactcagct

SEQ ID NO: 7551803 - DNA, 22 bp, Homo sapiens
gagctggggcggatactcagct

SEQ ID NO: 7551804 - DNA, 22 bp, Homo sapiens
gagctggggcggatactcagct

SEQ ID NO: 7551805 - DNA, 22 bp, Homo sapiens
gagcttggtgcacagtggttaa

SEQ ID NO: 7551806 - DNA, 22 bp, Homo sapiens
gagcttggtgatgcctcctggt

SEQ ID NO: 7551807 - DNA, 22 bp, Homo sapiens
gagcttgggtgccatgctgagc

SEQ ID NO: 7551808 - DNA, 22 bp, Homo sapiens
gagcttggtgatgcctcctggt

SEQ ID NO: 7551809 - DNA, 22 bp, Homo sapiens
gagcttggtgatgcctcctggt

SEQ ID NO: 7551810 - DNA, 22 bp, Homo sapiens
gagcttgggtgccatgctgagc

SEQ ID NO: 7551811 - DNA, 22 bp, Homo sapiens
gagcttgggtgccatgctgagc

SEQ ID NO: 7551812 - DNA, 22 bp, Homo sapiens
gagcttgggtgccatgctgagc

SEQ ID NO: 7551813 - DNA, 22 bp, Homo sapiens
gagcttggggcatatggtgcta

SEQ ID NO: 7551814 - DNA, 22 bp, Homo sapiens
gagcttggggcatatggtgcta

SEQ ID NO: 7551815 - DNA, 22 bp, Homo sapiens
gagcttggggcatatggtgcta

SEQ ID NO: 7551816 - DNA, 22 bp, Homo sapiens
gagctctgctactcaaagtatg

SEQ ID NO: 7551817 - DNA, 22 bp, Homo sapiens
gagctctgctactcaaagtatg

SEQ ID NO: 7551818 - DNA, 22 bp, Homo sapiens
gagctctgcggaaaacgtgccg

SEQ ID NO: 7551819 - DNA, 22 bp, Homo sapiens
gagctctggacgaggggagtgg

SEQ ID NO: 7551820 - DNA, 22 bp, Homo sapiens
gagctctgcttgggttcttagg

SEQ ID NO: 7551821 - DNA, 22 bp, Homo sapiens
gagctctgcttgggttcttagg

SEQ ID NO: 7551822 - DNA, 22 bp, Homo sapiens
gagctctgcttgggttcttagg

SEQ ID NO: 7551823 - DNA, 22 bp, Homo sapiens
gagctctgcttgggttcttagg

SEQ ID NO: 7551824 - DNA, 22 bp, Homo sapiens
gagctctgcttgggttcttagg

SEQ ID NO: 7551825 - DNA, 22 bp, Homo sapiens
gagctctgggaaacaaagtgta

SEQ ID NO: 7551826 - DNA, 22 bp, Homo sapiens
gagctctgggaaacaaagtgta

SEQ ID NO: 7551827 - DNA, 22 bp, Homo sapiens
gagctctgggaaacaaagtgta

SEQ ID NO: 7551828 - DNA, 22 bp, Homo sapiens
gagctctggcagggcaggtctg

SEQ ID NO: 7551829 - DNA, 22 bp, Homo sapiens
gagctctggcagggcaggtctg

SEQ ID NO: 7551830 - DNA, 22 bp, Homo sapiens
gagctctggcagggcaggtctg

SEQ ID NO: 7551831 - DNA, 22 bp, Homo sapiens
gagctctggcagggcaggtctg

SEQ ID NO: 7551832 - DNA, 22 bp, Homo sapiens
gagctctggacgaggggagtgg

SEQ ID NO: 7551833 - DNA, 22 bp, Homo sapiens
gagctctggcagggcaggtctg

SEQ ID NO: 7551834 - DNA, 22 bp, Homo sapiens
gagctctggcagggcaggtctg

SEQ ID NO: 7551835 - DNA, 22 bp, Homo sapiens
gagctctgggtgtgttgtcagt

SEQ ID NO: 7551836 - DNA, 22 bp, Homo sapiens
gagctctgggtgtgttgtcagt

SEQ ID NO: 7551837 - DNA, 22 bp, Homo sapiens
gagctctggttcatgatctatt

SEQ ID NO: 7551838 - DNA, 22 bp, Homo sapiens
gagctctggcagggcaggtctg

SEQ ID NO: 7551839 - DNA, 22 bp, Homo sapiens
gagctctgggaaacaaagtgta

SEQ ID NO: 7551840 - DNA, 22 bp, Homo sapiens
gagctctgggtggcaggtgtct

SEQ ID NO: 7551841 - DNA, 22 bp, Homo sapiens
gagctctgggtggcaggtgtct

SEQ ID NO: 7551842 - DNA, 22 bp, Homo sapiens
gagctctgggtggcaggtgtct

SEQ ID NO: 7551843 - DNA, 22 bp, Homo sapiens
gagctctgggtggcaggtgtct

SEQ ID NO: 7551844 - DNA, 22 bp, Homo sapiens
gagctctgtacacagagggtgt

SEQ ID NO: 7551845 - DNA, 22 bp, Homo sapiens
gagctctgtccacacttggaga

SEQ ID NO: 7551846 - DNA, 22 bp, Homo sapiens
gagctctgtacacagagggtgt

SEQ ID NO: 7551847 - DNA, 22 bp, Homo sapiens
gagctctgtacacagagggtgt

SEQ ID NO: 7551848 - DNA, 22 bp, Homo sapiens
gagctctgtgaatgtggggagg

SEQ ID NO: 7551849 - DNA, 22 bp, Homo sapiens
gagctggggcggatactcagct

SEQ ID NO: 7551850 - DNA, 22 bp, Homo sapiens
gagctctgtccacacttggaga

SEQ ID NO: 7551851 - DNA, 22 bp, Homo sapiens
gagctctgtccacacttggaga

SEQ ID NO: 7551852 - DNA, 22 bp, Homo sapiens
gagcagctagataaagcccttc

SEQ ID NO: 7551853 - DNA, 22 bp, Homo sapiens
gagcagctaaaattctcatgca

SEQ ID NO: 7551854 - DNA, 22 bp, Homo sapiens
gagcagctagataaagcccttc

SEQ ID NO: 7551855 - DNA, 22 bp, Homo sapiens
gagcagctagataaagcccttc

SEQ ID NO: 7551856 - DNA, 22 bp, Homo sapiens
gagcagctcagaggactagtgt

SEQ ID NO: 7551857 - DNA, 22 bp, Homo sapiens
gagcagctagataaagcccttc

SEQ ID NO: 7551858 - DNA, 22 bp, Homo sapiens
gagcagctaaaattctcatgca

SEQ ID NO: 7551859 - DNA, 22 bp, Homo sapiens
gagcagctaaaattctcatgca

SEQ ID NO: 7551860 - DNA, 22 bp, Homo sapiens
gagcagctaaaattctcatgca

SEQ ID NO: 7551861 - DNA, 22 bp, Homo sapiens
gagcagctaaaattctcatgca

SEQ ID NO: 7551862 - DNA, 22 bp, Homo sapiens
gagcagctaaaattctcatgca

SEQ ID NO: 7551863 - DNA, 22 bp, Homo sapiens
gagcagctaaaattctcatgca

SEQ ID NO: 7551864 - DNA, 16 bp, Homo sapiens
gagcagcctgggcctt

SEQ ID NO: 7551865 - DNA, 22 bp, Homo sapiens
gagcacagtaaagcagtgtcac

SEQ ID NO: 7551866 - DNA, 22 bp, Homo sapiens
gagcacagtaaagcagtgtcac

SEQ ID NO: 7551867 - DNA, 22 bp, Homo sapiens
gagcacagtaaagcagtgtcac

SEQ ID NO: 7551868 - DNA, 22 bp, Homo sapiens
gagcacagtaaagcagtgtcac

SEQ ID NO: 7551869 - DNA, 22 bp, Homo sapiens
gagcacagtaaagcagtgtcac

SEQ ID NO: 7551870 - DNA, 22 bp, Homo sapiens
gagcacagtaaagcagtgtcac

SEQ ID NO: 7551871 - DNA, 22 bp, Homo sapiens
gagcacagggaatagacagata

SEQ ID NO: 7551872 - DNA, 22 bp, Homo sapiens
gagcacagggaatagacagata

SEQ ID NO: 7551873 - DNA, 22 bp, Homo sapiens
gagcagctccagccgcatgact

SEQ ID NO: 7551874 - DNA, 22 bp, Homo sapiens
gagcagctccagccgcatgact

SEQ ID NO: 7551875 - DNA, 22 bp, Homo sapiens
gagcagctccagccgcatgact

SEQ ID NO: 7551876 - DNA, 22 bp, Homo sapiens
gagcagctccagccgcatgact

SEQ ID NO: 7551877 - DNA, 22 bp, Homo sapiens
gagcagctcaggcacttagcca

SEQ ID NO: 7551878 - DNA, 22 bp, Homo sapiens
gagcagctccagccgcatgact

SEQ ID NO: 7551879 - DNA, 22 bp, Homo sapiens
gagcagctccagccgcatgact

SEQ ID NO: 7551880 - DNA, 22 bp, Homo sapiens
gagcagctcagaggactagtgt

SEQ ID NO: 7551881 - DNA, 22 bp, Homo sapiens
gagcagctcagaggactagtgt

SEQ ID NO: 7551882 - DNA, 22 bp, Homo sapiens
gagcagctcagaggactagtgt

SEQ ID NO: 7551883 - DNA, 22 bp, Homo sapiens
gagcagctcaggcacttagcca

SEQ ID NO: 7551884 - DNA, 22 bp, Homo sapiens
gagcagctcagaggactagtgt

SEQ ID NO: 7551885 - DNA, 22 bp, Homo sapiens
gagcagctcaggcacttagcca

SEQ ID NO: 7551886 - DNA, 22 bp, Homo sapiens
gagcagctccagccgcatgact

SEQ ID NO: 7551887 - DNA, 22 bp, Homo sapiens
gagcagctcgagaaggaagcag

SEQ ID NO: 7551888 - DNA, 22 bp, Homo sapiens
gagcagctcgagaaggaagcag

SEQ ID NO: 7551889 - DNA, 22 bp, Homo sapiens
gagcagctcgagaaggaagcag

SEQ ID NO: 7551890 - DNA, 22 bp, Homo sapiens
gagcagctcgagaaggaagcag

SEQ ID NO: 7551891 - DNA, 22 bp, Homo sapiens
gagcagctcgagaaggaagcag

SEQ ID NO: 7551892 - DNA, 22 bp, Homo sapiens
gagcagctcgagaaggaagcag

SEQ ID NO: 7551893 - DNA, 22 bp, Homo sapiens
gagcagctcgagaaggaagcag

SEQ ID NO: 7551894 - DNA, 22 bp, Homo sapiens
gagcagctcgagaaggaagcag

SEQ ID NO: 7551895 - DNA, 22 bp, Homo sapiens
gagcagctcgagaaggaagcag

SEQ ID NO: 7551896 - DNA, 22 bp, Homo sapiens
gagcagctcgagaaggaagcag

SEQ ID NO: 7551897 - DNA, 22 bp, Homo sapiens
gagcagctcgagaaggaagcag

SEQ ID NO: 7551898 - DNA, 22 bp, Homo sapiens
gagaggtggaggttgcagtgag

SEQ ID NO: 7551899 - DNA, 22 bp, Homo sapiens
gagaggtggaggttgcagtgag

SEQ ID NO: 7551900 - DNA, 22 bp, Homo sapiens
gagaggtggaggttgcagtgag

SEQ ID NO: 7551901 - DNA, 22 bp, Homo sapiens
gagaggtggaggttgcagtgag

SEQ ID NO: 7551902 - DNA, 22 bp, Homo sapiens
gagaggtggaggttgcagtgag

SEQ ID NO: 7551903 - DNA, 22 bp, Homo sapiens
gagaggtgtgtttcagataaga

SEQ ID NO: 7551904 - DNA, 22 bp, Homo sapiens
gagaggtgtgtttcagataaga

SEQ ID NO: 7551905 - DNA, 22 bp, Homo sapiens
gagaggtgtgtttcagataaga

SEQ ID NO: 7551906 - DNA, 22 bp, Homo sapiens
gagaggtgtgtttcagataaga

SEQ ID NO: 7551907 - DNA, 22 bp, Homo sapiens
gagaggtggtgaggacttgtct

SEQ ID NO: 7551908 - DNA, 22 bp, Homo sapiens
gagaggtggtgaggacttgtct

SEQ ID NO: 7551909 - DNA, 22 bp, Homo sapiens
gagaggtggaggttgcagtgag

SEQ ID NO: 7551910 - DNA, 22 bp, Homo sapiens
gagaggtggaggttgcagtgag

SEQ ID NO: 7551911 - DNA, 22 bp, Homo sapiens
gagaggtgaatgtggatgccac

SEQ ID NO: 7551912 - DNA, 22 bp, Homo sapiens
gagaggtgaatgtggatgccac

SEQ ID NO: 7551913 - DNA, 22 bp, Homo sapiens
gagaggtgaatgtggatgccac

SEQ ID NO: 7551914 - DNA, 22 bp, Homo sapiens
gagaggtgaatgtggatgccac

SEQ ID NO: 7551915 - DNA, 22 bp, Homo sapiens
gagaggtgaatgtggatgccac

SEQ ID NO: 7551916 - DNA, 22 bp, Homo sapiens
gagaggtgaatgtggatgccac

SEQ ID NO: 7551917 - DNA, 22 bp, Homo sapiens
gagaggtgaatgtggatgccac

SEQ ID NO: 7551918 - DNA, 22 bp, Homo sapiens
gagaggtgaaggctgccctggg

SEQ ID NO: 7551919 - DNA, 22 bp, Homo sapiens
gagaggtgaaggctgccctggg

SEQ ID NO: 7551920 - DNA, 22 bp, Homo sapiens
gagaggtgaaggctgccctggg

SEQ ID NO: 7551921 - DNA, 22 bp, Homo sapiens
gagaggtgaaggctgccctggg

SEQ ID NO: 7551922 - DNA, 22 bp, Homo sapiens
gagaggtgaaatagttgtccgg

SEQ ID NO: 7551923 - DNA, 22 bp, Homo sapiens
gagaggtgaaggctgccctggg

SEQ ID NO: 7551924 - DNA, 22 bp, Homo sapiens
gagaggtgaaggctgccctggg

SEQ ID NO: 7551925 - DNA, 22 bp, Homo sapiens
gagaggtgaaggctgccctggg

SEQ ID NO: 7551926 - DNA, 22 bp, Homo sapiens
gagaggtgaaggctgccctggg

SEQ ID NO: 7551927 - DNA, 22 bp, Homo sapiens
gagaggtgaaatagttgtccgg

SEQ ID NO: 7551928 - DNA, 22 bp, Homo sapiens
gagaggtgaaaggatagtttga

SEQ ID NO: 7551929 - DNA, 22 bp, Homo sapiens
gagaggtgaaatagttgtccgg

SEQ ID NO: 7551930 - DNA, 22 bp, Homo sapiens
gagaggtgaaatagttgtccgg

SEQ ID NO: 7551931 - DNA, 22 bp, Homo sapiens
gagaggtcggggacactgcaaa

SEQ ID NO: 7551932 - DNA, 22 bp, Homo sapiens
gagaggtgaaaggatagtttga

SEQ ID NO: 7551933 - DNA, 22 bp, Homo sapiens
atgctttttaaacttaattgga

SEQ ID NO: 7551934 - DNA, 22 bp, Homo sapiens
atgcttttggtctttggtccgg

SEQ ID NO: 7551935 - DNA, 22 bp, Homo sapiens
atgcttttggtctttggtccgg

SEQ ID NO: 7551936 - DNA, 22 bp, Homo sapiens
atgctttttaaacttaattgga

SEQ ID NO: 7551937 - DNA, 22 bp, Homo sapiens
atgctttttaaacttaattgga

SEQ ID NO: 7551938 - DNA, 22 bp, Homo sapiens
atgcttttcctaaaatgatgcc

SEQ ID NO: 7551939 - DNA, 22 bp, Homo sapiens
atgcttttcctaaaatgatgcc

SEQ ID NO: 7551940 - DNA, 22 bp, Homo sapiens
atgcttttcctaaaatgatgcc

SEQ ID NO: 7551941 - DNA, 22 bp, Homo sapiens
atgcttttcctaaaatgatgcc

SEQ ID NO: 7551942 - DNA, 22 bp, Homo sapiens
atgcttttcctaaaatgatgcc

SEQ ID NO: 7551943 - DNA, 21 bp, Homo sapiens
atggaaaaacaggtagagcat

SEQ ID NO: 7551944 - DNA, 21 bp, Homo sapiens
atggaaaaacaggtagagcat

SEQ ID NO: 7551945 - DNA, 21 bp, Homo sapiens
atggaaaaacaggtagagcat

SEQ ID NO: 7551946 - DNA, 21 bp, Homo sapiens
atggaaaaacaggtagagcat

SEQ ID NO: 7551947 - DNA, 21 bp, Homo sapiens
atggaaaaacaggtagagcat

SEQ ID NO: 7551948 - DNA, 22 bp, Homo sapiens
gagaggaagccttctgtacttg

SEQ ID NO: 7551949 - DNA, 22 bp, Homo sapiens
gagaggaagccttctgtacttg

SEQ ID NO: 7551950 - DNA, 22 bp, Homo sapiens
gagaggaatatcattatattag

SEQ ID NO: 7551951 - DNA, 22 bp, Homo sapiens
gagaggaatatcattatattag

SEQ ID NO: 7551952 - DNA, 22 bp, Homo sapiens
gagaggaatatcattatattag

SEQ ID NO: 7551953 - DNA, 22 bp, Homo sapiens
gagaggctccatgaccccggca

SEQ ID NO: 7551954 - DNA, 22 bp, Homo sapiens
gagaggaatgaggttaaggact

SEQ ID NO: 7551955 - DNA, 22 bp, Homo sapiens
gagaggaatgaggttaaggact

SEQ ID NO: 7551956 - DNA, 22 bp, Homo sapiens
gagaggaatgaggttaaggact

SEQ ID NO: 7551957 - DNA, 22 bp, Homo sapiens
gagaggaatgaggttaaggact

SEQ ID NO: 7551958 - DNA, 22 bp, Homo sapiens
gagaggctccgccactgctcag

SEQ ID NO: 7551959 - DNA, 22 bp, Homo sapiens
gagaggctccgccactgctcag

SEQ ID NO: 7551960 - DNA, 22 bp, Homo sapiens
gagaggctccgccactgctcag

SEQ ID NO: 7551961 - DNA, 22 bp, Homo sapiens
gagaggctccgccactgctcag

SEQ ID NO: 7551962 - DNA, 22 bp, Homo sapiens
gagaggctccgccactgctcag

SEQ ID NO: 7551963 - DNA, 22 bp, Homo sapiens
gagaggctctgaggactggggt

SEQ ID NO: 7551964 - DNA, 22 bp, Homo sapiens
gagaggctctgaggactggggt

SEQ ID NO: 7551965 - DNA, 22 bp, Homo sapiens
gagaggctctgaggactggggt

SEQ ID NO: 7551966 - DNA, 22 bp, Homo sapiens
gagaggctctgaggactggggt

SEQ ID NO: 7551967 - DNA, 22 bp, Homo sapiens
gagaggctctgaggactggggt

SEQ ID NO: 7551968 - DNA, 22 bp, Homo sapiens
gagaggctctgaggactggggt

SEQ ID NO: 7551969 - DNA, 22 bp, Homo sapiens
gagaggctctgaggactggggt

SEQ ID NO: 7551970 - DNA, 22 bp, Homo sapiens
gagaggctctgaggactggggt

SEQ ID NO: 7551971 - DNA, 22 bp, Homo sapiens
gagaggctccgccactgctcag

SEQ ID NO: 7551972 - DNA, 22 bp, Homo sapiens
gagaggctctgaggactggggt

SEQ ID NO: 7551973 - DNA, 22 bp, Homo sapiens
gagaggctctgaggactggggt

SEQ ID NO: 7551974 - DNA, 22 bp, Homo sapiens
gagaggctgatcctgcagagaa

SEQ ID NO: 7551975 - DNA, 22 bp, Homo sapiens
gagaggctgatcctgcagagaa

SEQ ID NO: 7551976 - DNA, 22 bp, Homo sapiens
gagaggctgactggctgtcctg

SEQ ID NO: 7551977 - DNA, 22 bp, Homo sapiens
gagaggctgactggctgtcctg

SEQ ID NO: 7551978 - DNA, 22 bp, Homo sapiens
gagaggctgatcctgcagagaa

SEQ ID NO: 7551979 - DNA, 22 bp, Homo sapiens
gagaggctgatcctgcagagaa

SEQ ID NO: 7551980 - DNA, 22 bp, Homo sapiens
gagaggctgatcctgcagagaa

SEQ ID NO: 7551981 - DNA, 22 bp, Homo sapiens
gagaggctgactggctgtcctg

SEQ ID NO: 7551982 - DNA, 22 bp, Homo sapiens
gagaggctgatcctgcagagaa

SEQ ID NO: 7551983 - DNA, 22 bp, Homo sapiens
gagaggctgatcctgcagagaa

SEQ ID NO: 7551984 - DNA, 22 bp, Homo sapiens
gagaggctgatcctgcagagaa

SEQ ID NO: 7551985 - DNA, 22 bp, Homo sapiens
gagaggctgatcctgcagagaa

SEQ ID NO: 7551986 - DNA, 22 bp, Homo sapiens
gagaggctgatcctgcagagaa

SEQ ID NO: 7551987 - DNA, 22 bp, Homo sapiens
gagaggctgaaatcacaggagc

SEQ ID NO: 7551988 - DNA, 22 bp, Homo sapiens
gagaggctgaaatcacaggagc

SEQ ID NO: 7551989 - DNA, 22 bp, Homo sapiens
gagaggctgaaatcacaggagc

SEQ ID NO: 7551990 - DNA, 22 bp, Homo sapiens
gagaggctgaaatcacaggagc

SEQ ID NO: 7551991 - DNA, 22 bp, Homo sapiens
gagaggctgaaatcacaggagc

SEQ ID NO: 7551992 - DNA, 22 bp, Homo sapiens
gagaggctgactggctgtcctg

SEQ ID NO: 7551993 - DNA, 22 bp, Homo sapiens
gagaggctgactggctgtcctg

SEQ ID NO: 7551994 - DNA, 22 bp, Homo sapiens
gagaggctgaaatcacaggagc

SEQ ID NO: 7551995 - DNA, 22 bp, Homo sapiens
gagaggctgactggctgtcctg

SEQ ID NO: 7551996 - DNA, 22 bp, Homo sapiens
gagaggtcatctcccatcagca

SEQ ID NO: 7551997 - DNA, 22 bp, Homo sapiens
gagaggtcatctcccatcagca

SEQ ID NO: 7551998 - DNA, 22 bp, Homo sapiens
gagaggtcggggacactgcaaa

SEQ ID NO: 7551999 - DNA, 22 bp, Homo sapiens
gagaggtccattcccctgtcag

SEQ ID NO: 7552000 - DNA, 22 bp, Homo sapiens
gagaggtccattcccctgtcag

SEQ ID NO: 7552001 - DNA, 22 bp, Homo sapiens
gagaggctgggttggagatcga

SEQ ID NO: 7552002 - DNA, 22 bp, Homo sapiens
gagaggtagcagtaagaacagg

SEQ ID NO: 7552003 - DNA, 22 bp, Homo sapiens
gagaggtagcagtaagaacagg

SEQ ID NO: 7552004 - DNA, 22 bp, Homo sapiens
gagaggctggcagtgccaggtt

SEQ ID NO: 7552005 - DNA, 22 bp, Homo sapiens
gagaggctggcagtgccaggtt

SEQ ID NO: 7552006 - DNA, 22 bp, Homo sapiens
gagaggctggcagtgccaggtt

SEQ ID NO: 7552007 - DNA, 22 bp, Homo sapiens
gagaggctggcagtgccaggtt

SEQ ID NO: 7552008 - DNA, 22 bp, Homo sapiens
gagaggctggcagtgccaggtt

SEQ ID NO: 7552009 - DNA, 22 bp, Homo sapiens
gagaggctggcagtgccaggtt

SEQ ID NO: 7552010 - DNA, 22 bp, Homo sapiens
gagaggctgcatatgcacactg

SEQ ID NO: 7552011 - DNA, 22 bp, Homo sapiens
gagaggctgcatatgcacactg

SEQ ID NO: 7552012 - DNA, 22 bp, Homo sapiens
gagaggctgcatatgcacactg

SEQ ID NO: 7552013 - DNA, 22 bp, Homo sapiens
gagaggctgcatatgcacactg

SEQ ID NO: 7552014 - DNA, 22 bp, Homo sapiens
gagaggctggcagtgccaggtt

SEQ ID NO: 7552015 - DNA, 22 bp, Homo sapiens
gagcctggcctcctgcctcagc

SEQ ID NO: 7552016 - DNA, 22 bp, Homo sapiens
gagcctggcctcctgcctcagc

SEQ ID NO: 7552017 - DNA, 22 bp, Homo sapiens
gagcctggcctcctgcctcagc

SEQ ID NO: 7552018 - DNA, 22 bp, Homo sapiens
gagcctggcctcctgcctcagc

SEQ ID NO: 7552019 - DNA, 22 bp, Homo sapiens
gagcctggcctcctgcctcagc

SEQ ID NO: 7552020 - DNA, 22 bp, Homo sapiens
gagcctggcctcctgcctcagc

SEQ ID NO: 7552021 - DNA, 22 bp, Homo sapiens
gagcctggcctcctgcctcagc

SEQ ID NO: 7552022 - DNA, 22 bp, Homo sapiens
gagcctggcctcctgcctcagc

SEQ ID NO: 7552023 - DNA, 20 bp, Homo sapiens
gagcctgggaagtctaaggt

SEQ ID NO: 7552024 - DNA, 20 bp, Homo sapiens
gagcctgggaagtctaaggt

SEQ ID NO: 7552025 - DNA, 22 bp, Homo sapiens
gagcctgggactgggggtcatg

SEQ ID NO: 7552026 - DNA, 22 bp, Homo sapiens
gagcctgggactgggggtcatg

SEQ ID NO: 7552027 - DNA, 20 bp, Homo sapiens
gagcctgggaagtctaaggt

SEQ ID NO: 7552028 - DNA, 22 bp, Homo sapiens
gagcctgggactgggggtcatg

SEQ ID NO: 7552029 - DNA, 22 bp, Homo sapiens
gagcctgggactgggggtcatg

SEQ ID NO: 7552030 - DNA, 22 bp, Homo sapiens
gagcctgggactgggggtcatg

SEQ ID NO: 7552031 - DNA, 22 bp, Homo sapiens
gagcctgggtccttccctggga

SEQ ID NO: 7552032 - DNA, 22 bp, Homo sapiens
gagcctgggtccttccctggga

SEQ ID NO: 7552033 - DNA, 22 bp, Homo sapiens
gagcctgggtccttccctggga

SEQ ID NO: 7552034 - DNA, 22 bp, Homo sapiens
gagcctgggtccttccctggga

SEQ ID NO: 7552035 - DNA, 22 bp, Homo sapiens
gagcctggggaccctcctgagt

SEQ ID NO: 7552036 - DNA, 22 bp, Homo sapiens
gagcctgggtccttccctggga

SEQ ID NO: 7552037 - DNA, 22 bp, Homo sapiens
gagcctgggtccttccctggga

SEQ ID NO: 7552038 - DNA, 22 bp, Homo sapiens
gagcctggggaccctcctgagt

SEQ ID NO: 7552039 - DNA, 22 bp, Homo sapiens
gagcctggggaccctcctgagt

SEQ ID NO: 7552040 - DNA, 22 bp, Homo sapiens
gagcctgggactgggggtcatg

SEQ ID NO: 7552041 - DNA, 22 bp, Homo sapiens
gagcctgggactgggggtcatg

SEQ ID NO: 7552042 - DNA, 22 bp, Homo sapiens
gagcctgggactgggggtcatg

SEQ ID NO: 7552043 - DNA, 22 bp, Homo sapiens
gagcctgggactgggggtcatg

SEQ ID NO: 7552044 - DNA, 22 bp, Homo sapiens
gagcctgtgtttcctgtagcca

SEQ ID NO: 7552045 - DNA, 22 bp, Homo sapiens
gagccttcatcgcagccttgtt

SEQ ID NO: 7552046 - DNA, 22 bp, Homo sapiens
gagcctgtgagccccaactcca

SEQ ID NO: 7552047 - DNA, 21 bp, Homo sapiens
gagccttccctctgccctttc

SEQ ID NO: 7552048 - DNA, 22 bp, Homo sapiens
gagcctttgaagccctcagaga

SEQ ID NO: 7552049 - DNA, 19 bp, Homo sapiens
gagcgcagagggcagggga

SEQ ID NO: 7552050 - DNA, 22 bp, Homo sapiens
gagcgcgggtcgagggaacggc

SEQ ID NO: 7552051 - DNA, 22 bp, Homo sapiens
gagcgcggtccccacggaggat

SEQ ID NO: 7552052 - DNA, 22 bp, Homo sapiens
gagcggaggcttggaggccagc

SEQ ID NO: 7552053 - DNA, 22 bp, Homo sapiens
gagcggaggcttggaggccagc

SEQ ID NO: 7552054 - DNA, 22 bp, Homo sapiens
gagcctttgcacttgctgtgtt

SEQ ID NO: 7552055 - DNA, 22 bp, Homo sapiens
gagcgattgcgggggtcagagg

SEQ ID NO: 7552056 - DNA, 19 bp, Homo sapiens
gagcgcagagggcagggga

SEQ ID NO: 7552057 - DNA, 23 bp, Homo sapiens
gagctctgcactaggccctggga

SEQ ID NO: 7552058 - DNA, 23 bp, Homo sapiens
gagctctgcactaggccctggga

SEQ ID NO: 7552059 - DNA, 22 bp, Homo sapiens
gagctctgcagattgttttagg

SEQ ID NO: 7552060 - DNA, 22 bp, Homo sapiens
gagctctgcagattgttttagg

SEQ ID NO: 7552061 - DNA, 22 bp, Homo sapiens
gagctctgcagattgttttagg

SEQ ID NO: 7552062 - DNA, 23 bp, Homo sapiens
gagctctgcactaggccctggga

SEQ ID NO: 7552063 - DNA, 23 bp, Homo sapiens
gagctctgcactaggccctggga

SEQ ID NO: 7552064 - DNA, 23 bp, Homo sapiens
gagctctgcactaggccctggga

SEQ ID NO: 7552065 - DNA, 22 bp, Homo sapiens
gagcggaggcttggaggccagc

SEQ ID NO: 7552066 - DNA, 18 bp, Homo sapiens
gagctctgcctcccagtc

SEQ ID NO: 7552067 - DNA, 22 bp, Homo sapiens
gagctctgccatggctcccacc

SEQ ID NO: 7552068 - DNA, 22 bp, Homo sapiens
gagctctgccatggctcccacc

SEQ ID NO: 7552069 - DNA, 22 bp, Homo sapiens
gagctctgccatggctcccacc

SEQ ID NO: 7552070 - DNA, 22 bp, Homo sapiens
gagctctgccatggctcccacc

SEQ ID NO: 7552071 - DNA, 18 bp, Homo sapiens
gagctctgcctcccagtc

SEQ ID NO: 7552072 - DNA, 18 bp, Homo sapiens
gagctctgcctcccagtc

SEQ ID NO: 7552073 - DNA, 18 bp, Homo sapiens
gagctctgcctcccagtc

SEQ ID NO: 7552074 - DNA, 18 bp, Homo sapiens
gagctctgcctcccagtc

SEQ ID NO: 7552075 - DNA, 22 bp, Homo sapiens
gagcagtagagtacatggctcc

SEQ ID NO: 7552076 - DNA, 22 bp, Homo sapiens
gagcaggtgcctgtagctctct

SEQ ID NO: 7552077 - DNA, 22 bp, Homo sapiens
gagcagtagagtacatggctcc

SEQ ID NO: 7552078 - DNA, 22 bp, Homo sapiens
gagcaggtttcaatgctgatgc

SEQ ID NO: 7552079 - DNA, 22 bp, Homo sapiens
gagcagtaggagaaccctgagc

SEQ ID NO: 7552080 - DNA, 22 bp, Homo sapiens
gagcagtgaagacagaagtaca

SEQ ID NO: 7552081 - DNA, 22 bp, Homo sapiens
gagccctcttccctagtgatcg

SEQ ID NO: 7552082 - DNA, 22 bp, Homo sapiens
gagccctcttgtctatatggta

SEQ ID NO: 7552083 - DNA, 22 bp, Homo sapiens
gagccctcttccctagtgatcg

SEQ ID NO: 7552084 - DNA, 22 bp, Homo sapiens
gagcagtgactggagcatgaga

SEQ ID NO: 7552085 - DNA, 22 bp, Homo sapiens
gagccctcttccctagtgatcg

SEQ ID NO: 7552086 - DNA, 22 bp, Homo sapiens
gagcctggattgtcaccgactt

SEQ ID NO: 7552087 - DNA, 22 bp, Homo sapiens
gagccctgaacaacagcaggaa

SEQ ID NO: 7552088 - DNA, 22 bp, Homo sapiens
gagccctcttgtctatatggta

SEQ ID NO: 7552089 - DNA, 22 bp, Homo sapiens
gagcagggccacttctgtacct

SEQ ID NO: 7552090 - DNA, 22 bp, Homo sapiens
gagcagggccacttctgtacct

SEQ ID NO: 7552091 - DNA, 22 bp, Homo sapiens
gagcagggcttgtcctcctcat

SEQ ID NO: 7552092 - DNA, 22 bp, Homo sapiens
gagcagggccacttctgtacct

SEQ ID NO: 7552093 - DNA, 17 bp, Homo sapiens
gagcagggatgcggttc

SEQ ID NO: 7552094 - DNA, 17 bp, Homo sapiens
gagcagggatgcggttc

SEQ ID NO: 7552095 - DNA, 22 bp, Homo sapiens
gagcagggcttgtcctcctcat

SEQ ID NO: 7552096 - DNA, 22 bp, Homo sapiens
gagcagggcttgtcctcctcat

SEQ ID NO: 7552097 - DNA, 22 bp, Homo sapiens
gagcaggtctttcatggtgcat

SEQ ID NO: 7552098 - DNA, 22 bp, Homo sapiens
gagcaggtctttcatggtgcat

SEQ ID NO: 7552099 - DNA, 22 bp, Homo sapiens
gagcaggtctttcatggtgcat

SEQ ID NO: 7552100 - DNA, 22 bp, Homo sapiens
gagcaggtctttcatggtgcat

SEQ ID NO: 7552101 - DNA, 22 bp, Homo sapiens
gagcagggcttgtcctcctcat

SEQ ID NO: 7552102 - DNA, 22 bp, Homo sapiens
gagcagctctgtgcctggagac

SEQ ID NO: 7552103 - DNA, 22 bp, Homo sapiens
gagcagctctgggtgacccagt

SEQ ID NO: 7552104 - DNA, 22 bp, Homo sapiens
gagcagctctgtgcctggagac

SEQ ID NO: 7552105 - DNA, 22 bp, Homo sapiens
gagcagctctgtgcctggagac

SEQ ID NO: 7552106 - DNA, 22 bp, Homo sapiens
gagcagctctgtgcctggagac

SEQ ID NO: 7552107 - DNA, 22 bp, Homo sapiens
gagcagctctgtgcctggagac

SEQ ID NO: 7552108 - DNA, 22 bp, Homo sapiens
gagcagctctgggtgacccagt

SEQ ID NO: 7552109 - DNA, 22 bp, Homo sapiens
gagcagctctgggtgacccagt

SEQ ID NO: 7552110 - DNA, 22 bp, Homo sapiens
gagcagctctgggtgacccagt

SEQ ID NO: 7552111 - DNA, 22 bp, Homo sapiens
gagcagctctgggtgacccagt

SEQ ID NO: 7552112 - DNA, 22 bp, Homo sapiens
gagcagctgagctggaatgaga

SEQ ID NO: 7552113 - DNA, 22 bp, Homo sapiens
gagcagctgagctggaatgaga

SEQ ID NO: 7552114 - DNA, 22 bp, Homo sapiens
gagcagctgagctggaatgaga

SEQ ID NO: 7552115 - DNA, 22 bp, Homo sapiens
gagcagctgagctggaatgaga

SEQ ID NO: 7552116 - DNA, 22 bp, Homo sapiens
gagcagctgagctggaatgaga

SEQ ID NO: 7552117 - DNA, 22 bp, Homo sapiens
gagcagctctgtgcctggagac

SEQ ID NO: 7552118 - DNA, 22 bp, Homo sapiens
gagcagctctgtgcctggagac

SEQ ID NO: 7552119 - DNA, 22 bp, Homo sapiens
gagcagctgagctggaatgaga

SEQ ID NO: 7552120 - DNA, 22 bp, Homo sapiens
gagcagctgagctggaatgaga

SEQ ID NO: 7552121 - DNA, 22 bp, Homo sapiens
gagcagctgagctggaatgaga

SEQ ID NO: 7552122 - DNA, 22 bp, Homo sapiens
gagcagggagacaactctggtg

SEQ ID NO: 7552123 - DNA, 22 bp, Homo sapiens
gagcagggagacaactctggtg

SEQ ID NO: 7552124 - DNA, 22 bp, Homo sapiens
gagcagggagacaactctggtg

SEQ ID NO: 7552125 - DNA, 19 bp, Homo sapiens
gagcagctgcacccattga

SEQ ID NO: 7552126 - DNA, 19 bp, Homo sapiens
gagcagctgcacccattga

SEQ ID NO: 7552127 - DNA, 19 bp, Homo sapiens
gagcagctgcacccattga

SEQ ID NO: 7552128 - DNA, 22 bp, Homo sapiens
gagcagctgagctggaatgaga

SEQ ID NO: 7552129 - DNA, 22 bp, Homo sapiens
gagcagctgagctggaatgaga

SEQ ID NO: 7552130 - DNA, 22 bp, Homo sapiens
gagcagctgagctggaatgaga

SEQ ID NO: 7552131 - DNA, 19 bp, Homo sapiens
gagcagctgcacccattga

SEQ ID NO: 7552132 - DNA, 17 bp, Homo sapiens
gagcagggatgcggttc

SEQ ID NO: 7552133 - DNA, 17 bp, Homo sapiens
gagcagggatgcggttc

SEQ ID NO: 7552134 - DNA, 17 bp, Homo sapiens
gagcagggatgcggttc

SEQ ID NO: 7552135 - DNA, 17 bp, Homo sapiens
gagcagggatgcggttc

SEQ ID NO: 7552136 - DNA, 17 bp, Homo sapiens
gagcagggatgcggttc

SEQ ID NO: 7552137 - DNA, 17 bp, Homo sapiens
gagcagggatgcggttc

SEQ ID NO: 7552138 - DNA, 22 bp, Homo sapiens
gagcagggagacaactctggtg

SEQ ID NO: 7552139 - DNA, 22 bp, Homo sapiens
gagcagggagacaactctggtg

SEQ ID NO: 7552140 - DNA, 22 bp, Homo sapiens
gagcagggagacaactctggtg

SEQ ID NO: 7552141 - DNA, 22 bp, Homo sapiens
gaggtactttctggttcaggtg

SEQ ID NO: 7552142 - DNA, 22 bp, Homo sapiens
gaggtacatgaggatacacagg

SEQ ID NO: 7552143 - DNA, 22 bp, Homo sapiens
gaggtacatgaggatacacagg

SEQ ID NO: 7552144 - DNA, 22 bp, Homo sapiens
gaggtacatgaggatacacagg

SEQ ID NO: 7552145 - DNA, 23 bp, Homo sapiens
gaggtacagcaccagtgaatagg

SEQ ID NO: 7552146 - DNA, 23 bp, Homo sapiens
gaggtacagcaccagtgaatagg

SEQ ID NO: 7552147 - DNA, 22 bp, Homo sapiens
gaggtagcatgctggaagggac

SEQ ID NO: 7552148 - DNA, 18 bp, Homo sapiens
gaggtagataagattttc

SEQ ID NO: 7552149 - DNA, 18 bp, Homo sapiens
gaggtagataagattttc

SEQ ID NO: 7552150 - DNA, 18 bp, Homo sapiens
gaggtagataagattttc

SEQ ID NO: 7552151 - DNA, 22 bp, Homo sapiens
gaggtagacttcttggaagtag

SEQ ID NO: 7552152 - DNA, 22 bp, Homo sapiens
gaggtagacttcttggaagtag

SEQ ID NO: 7552153 - DNA, 22 bp, Homo sapiens
gaggtagacttcttggaagtag

SEQ ID NO: 7552154 - DNA, 22 bp, Homo sapiens
gaggtagacttcttggaagtag

SEQ ID NO: 7552155 - DNA, 22 bp, Homo sapiens
gaggggtcacatgggctggctt

SEQ ID NO: 7552156 - DNA, 22 bp, Homo sapiens
gaggggtcacatgggctggctt

SEQ ID NO: 7552157 - DNA, 22 bp, Homo sapiens
gaggggtcacatgggctggctt

SEQ ID NO: 7552158 - DNA, 22 bp, Homo sapiens
gaggtacagagtgttccaatgt

SEQ ID NO: 7552159 - DNA, 22 bp, Homo sapiens
gaggtaagggcaggagagtgaa

SEQ ID NO: 7552160 - DNA, 22 bp, Homo sapiens
gaggtaagggcaggagagtgaa

SEQ ID NO: 7552161 - DNA, 22 bp, Homo sapiens
gaggtaattactatgttcagat

SEQ ID NO: 7552162 - DNA, 22 bp, Homo sapiens
gaggtaattactatgttcagat

SEQ ID NO: 7552163 - DNA, 22 bp, Homo sapiens
gaggtacagagtgttccaatgt

SEQ ID NO: 7552164 - DNA, 23 bp, Homo sapiens
gaggtacagcaccagtgaatagg

SEQ ID NO: 7552165 - DNA, 17 bp, Homo sapiens
gaggtaggaagtgagtc

SEQ ID NO: 7552166 - DNA, 17 bp, Homo sapiens
gaggtaggaagtgagtc

SEQ ID NO: 7552167 - DNA, 22 bp, Homo sapiens
gaggtaggaggtaggtattgtg

SEQ ID NO: 7552168 - DNA, 22 bp, Homo sapiens
gaggtaggaggtaggtattgtg

SEQ ID NO: 7552169 - DNA, 22 bp, Homo sapiens
gaggtaggcagggtgacttggc

SEQ ID NO: 7552170 - DNA, 22 bp, Homo sapiens
gaggtaggctgtgaaagggggt

SEQ ID NO: 7552171 - DNA, 22 bp, Homo sapiens
gaggtaggctgtgaaagggggt

SEQ ID NO: 7552172 - DNA, 22 bp, Homo sapiens
gaggtaggaggtaggtattgtg

SEQ ID NO: 7552173 - DNA, 22 bp, Homo sapiens
gaggtaggaggtaggtattgtg

SEQ ID NO: 7552174 - DNA, 22 bp, Homo sapiens
gaggtaggaggtaggtattgtg

SEQ ID NO: 7552175 - DNA, 22 bp, Homo sapiens
gaggtagcgagtggacagtgca

SEQ ID NO: 7552176 - DNA, 22 bp, Homo sapiens
gaggtagccacagatagagact

SEQ ID NO: 7552177 - DNA, 22 bp, Homo sapiens
gaggtagcatgctggaagggac

SEQ ID NO: 7552178 - DNA, 22 bp, Homo sapiens
gaggtagcatgctggaagggac

SEQ ID NO: 7552179 - DNA, 22 bp, Homo sapiens
gaggtagccacagatagagact

SEQ ID NO: 7552180 - DNA, 22 bp, Homo sapiens
gaggtagcgagtggacagtgca

SEQ ID NO: 7552181 - DNA, 22 bp, Homo sapiens
gaggtagcgagtggacagtgca

SEQ ID NO: 7552182 - DNA, 17 bp, Homo sapiens
gaggtaggaagtgagtc

SEQ ID NO: 7552183 - DNA, 17 bp, Homo sapiens
gaggtaggaagtgagtc

SEQ ID NO: 7552184 - DNA, 17 bp, Homo sapiens
gaggtaggaagtgagtc

SEQ ID NO: 7552185 - DNA, 17 bp, Homo sapiens
gaggtaggaagtgagtc

SEQ ID NO: 7552186 - DNA, 22 bp, Homo sapiens
gagtccaggctgttgctcatct

SEQ ID NO: 7552187 - DNA, 22 bp, Homo sapiens
gagtccaggctggtcaaatagc

SEQ ID NO: 7552188 - DNA, 18 bp, Homo sapiens
gagtccaggctcttcacc

SEQ ID NO: 7552189 - DNA, 18 bp, Homo sapiens
gagtccaggctcttcacc

SEQ ID NO: 7552190 - DNA, 22 bp, Homo sapiens
gagtccaggatttgagctctgt

SEQ ID NO: 7552191 - DNA, 22 bp, Homo sapiens
gagtccaggcatccctcccata

SEQ ID NO: 7552192 - DNA, 22 bp, Homo sapiens
gagtccaggctcagaaacccgt

SEQ ID NO: 7552193 - DNA, 22 bp, Homo sapiens
gagtccaggcatccctcccata

SEQ ID NO: 7552194 - DNA, 22 bp, Homo sapiens
gagtccaggctcagaaacccgt

SEQ ID NO: 7552195 - DNA, 22 bp, Homo sapiens
gagtccaggctcagaaacccgt

SEQ ID NO: 7552196 - DNA, 22 bp, Homo sapiens
gagtccaggatttgagctctgt

SEQ ID NO: 7552197 - DNA, 22 bp, Homo sapiens
gagtccaggatttgagctctgt

SEQ ID NO: 7552198 - DNA, 22 bp, Homo sapiens
gagtccagctctgcctcttact

SEQ ID NO: 7552199 - DNA, 22 bp, Homo sapiens
gagtccagctctgcctcttact

SEQ ID NO: 7552200 - DNA, 22 bp, Homo sapiens
gagtccaggatttgagctctgt

SEQ ID NO: 7552201 - DNA, 22 bp, Homo sapiens
gagtccaggatttgagctctgt

SEQ ID NO: 7552202 - DNA, 22 bp, Homo sapiens
gagtccaggatttgagctctgt

SEQ ID NO: 7552203 - DNA, 22 bp, Homo sapiens
gagtccaggatttgagctctgt

SEQ ID NO: 7552204 - DNA, 22 bp, Homo sapiens
gagtccaggatttgagctctgt

SEQ ID NO: 7552205 - DNA, 22 bp, Homo sapiens
gagtccaggatttgagctctgt

SEQ ID NO: 7552206 - DNA, 22 bp, Homo sapiens
gagtccaggatttgagctctgt

SEQ ID NO: 7552207 - DNA, 22 bp, Homo sapiens
gaggttggggctgcagtgagct

SEQ ID NO: 7552208 - DNA, 22 bp, Homo sapiens
gaggtagggaagacaaatatgc

SEQ ID NO: 7552209 - DNA, 22 bp, Homo sapiens
gaggtaggcagggtgacttggc

SEQ ID NO: 7552210 - DNA, 22 bp, Homo sapiens
gaggttgggatgagggatacag

SEQ ID NO: 7552211 - DNA, 22 bp, Homo sapiens
gaggttggggctgcagtgagct

SEQ ID NO: 7552212 - DNA, 22 bp, Homo sapiens
gaggttggggctgcagtgagct

SEQ ID NO: 7552213 - DNA, 22 bp, Homo sapiens
gaggtagggcagaggctgaatg

SEQ ID NO: 7552214 - DNA, 22 bp, Homo sapiens
gagtccagcagaatgagccaag

SEQ ID NO: 7552215 - DNA, 22 bp, Homo sapiens
gagtccagcagaatgagccaag

SEQ ID NO: 7552216 - DNA, 22 bp, Homo sapiens
gagtccagcagaatgagccaag

SEQ ID NO: 7552217 - DNA, 22 bp, Homo sapiens
gagtccagcagaatgagccaag

SEQ ID NO: 7552218 - DNA, 22 bp, Homo sapiens
gagtccagcagaatgagccaag

SEQ ID NO: 7552219 - DNA, 22 bp, Homo sapiens
gaggttggtgaggggacacggt

SEQ ID NO: 7552220 - DNA, 22 bp, Homo sapiens
gaggttggtgaggggacacggt

SEQ ID NO: 7552221 - DNA, 22 bp, Homo sapiens
gaggttggggctgcagtgagct

SEQ ID NO: 7552222 - DNA, 22 bp, Homo sapiens
gagtccagctcattgtctggga

SEQ ID NO: 7552223 - DNA, 22 bp, Homo sapiens
gagtccagctcattgtctggga

SEQ ID NO: 7552224 - DNA, 22 bp, Homo sapiens
gagtccagctcattgtctggga

SEQ ID NO: 7552225 - DNA, 22 bp, Homo sapiens
gagtccagccctgttctagtaa

SEQ ID NO: 7552226 - DNA, 22 bp, Homo sapiens
gagtccagctcattgtctggga

SEQ ID NO: 7552227 - DNA, 22 bp, Homo sapiens
gagtccagctcattgtctggga

SEQ ID NO: 7552228 - DNA, 22 bp, Homo sapiens
gagggcacgaaacaaccacttc

SEQ ID NO: 7552229 - DNA, 22 bp, Homo sapiens
gagggcactcgagactacggca

SEQ ID NO: 7552230 - DNA, 22 bp, Homo sapiens
gagggcacgaaacaaccacttc

SEQ ID NO: 7552231 - DNA, 22 bp, Homo sapiens
gagggcacgaaacaaccacttc

SEQ ID NO: 7552232 - DNA, 22 bp, Homo sapiens
gagggcaccttcagtaatagct

SEQ ID NO: 7552233 - DNA, 22 bp, Homo sapiens
gagggcaccttcagtaatagct

SEQ ID NO: 7552234 - DNA, 22 bp, Homo sapiens
gagggcacaaaggcaacattca

SEQ ID NO: 7552235 - DNA, 22 bp, Homo sapiens
gagggcaccagaagagccagat

SEQ ID NO: 7552236 - DNA, 20 bp, Homo sapiens
gagggcacattgttccgtgc

SEQ ID NO: 7552237 - DNA, 20 bp, Homo sapiens
gagggcacattgttccgtgc

SEQ ID NO: 7552238 - DNA, 22 bp, Homo sapiens
gagggcaccagaagagccagat

SEQ ID NO: 7552239 - DNA, 22 bp, Homo sapiens
gagggcaccagaagagccagat

SEQ ID NO: 7552240 - DNA, 22 bp, Homo sapiens
gagggcaccagaagagccagat

SEQ ID NO: 7552241 - DNA, 22 bp, Homo sapiens
gagggcaccagaagagccagat

SEQ ID NO: 7552242 - DNA, 22 bp, Homo sapiens
gagggcagaaaattatgcggtg

SEQ ID NO: 7552243 - DNA, 22 bp, Homo sapiens
gagggcagaaaattatgcggtg

SEQ ID NO: 7552244 - DNA, 22 bp, Homo sapiens
gagggcagaaaattatgcggtg

SEQ ID NO: 7552245 - DNA, 22 bp, Homo sapiens
gagggcagaaaattatgcggtg

SEQ ID NO: 7552246 - DNA, 22 bp, Homo sapiens
gagggcagaaaattatgcggtg

SEQ ID NO: 7552247 - DNA, 22 bp, Homo sapiens
gagggcactcgagactacggca

SEQ ID NO: 7552248 - DNA, 22 bp, Homo sapiens
gagggcactcgagactacggca

SEQ ID NO: 7552249 - DNA, 22 bp, Homo sapiens
gagggcactgggtttcaatgtc

SEQ ID NO: 7552250 - DNA, 22 bp, Homo sapiens
gagggcactgggtttcaatgtc

SEQ ID NO: 7552251 - DNA, 22 bp, Homo sapiens
gagggcagaaaattatgcggtg

SEQ ID NO: 7552252 - DNA, 22 bp, Homo sapiens
gagggcactgggtttcaatgtc

SEQ ID NO: 7552253 - DNA, 22 bp, Homo sapiens
gagggcagaaaattatgcggtg

SEQ ID NO: 7552254 - DNA, 19 bp, Homo sapiens
gaggggaggaattgacaag

SEQ ID NO: 7552255 - DNA, 19 bp, Homo sapiens
gaggggaggaattgacaag

SEQ ID NO: 7552256 - DNA, 19 bp, Homo sapiens
gaggggaggaattgacaag

SEQ ID NO: 7552257 - DNA, 19 bp, Homo sapiens
gaggggaggaattgacaag

SEQ ID NO: 7552258 - DNA, 19 bp, Homo sapiens
gaggggaggaattgacaag

SEQ ID NO: 7552259 - DNA, 19 bp, Homo sapiens
gaggggaggaattgacaag

SEQ ID NO: 7552260 - DNA, 19 bp, Homo sapiens
gaggggaggaattgacaag

SEQ ID NO: 7552261 - DNA, 22 bp, Homo sapiens
gagggggcgtgcaaggctccgc

SEQ ID NO: 7552262 - DNA, 22 bp, Homo sapiens
gagggggcgtgcaaggctccgc

SEQ ID NO: 7552263 - DNA, 22 bp, Homo sapiens
gagggggcgtgcaaggctccgc

SEQ ID NO: 7552264 - DNA, 22 bp, Homo sapiens
gagggggcgtgcaaggctccgc

SEQ ID NO: 7552265 - DNA, 22 bp, Homo sapiens
gagggggcgaacagaagcaagg

SEQ ID NO: 7552266 - DNA, 22 bp, Homo sapiens
gagggggcgaacagaagcaagg

SEQ ID NO: 7552267 - DNA, 22 bp, Homo sapiens
gagggggcgtgcaaggctccgc

SEQ ID NO: 7552268 - DNA, 22 bp, Homo sapiens
gagggggcgtgcaaggctccgc

SEQ ID NO: 7552269 - DNA, 22 bp, Homo sapiens
gagggggcgtgcaaggctccgc

SEQ ID NO: 7552270 - DNA, 22 bp, Homo sapiens
gagggggcgtgcaaggctccgc

SEQ ID NO: 7552271 - DNA, 22 bp, Homo sapiens
gagggggctctgccaacctgtc

SEQ ID NO: 7552272 - DNA, 22 bp, Homo sapiens
gagggggctctgccaacctgtc

SEQ ID NO: 7552273 - DNA, 22 bp, Homo sapiens
gagggggctctgccaacctgtc

SEQ ID NO: 7552274 - DNA, 22 bp, Homo sapiens
gagggggctctgccaacctgtc

SEQ ID NO: 7552275 - DNA, 22 bp, Homo sapiens
gagggggctctgccaacctgtc

SEQ ID NO: 7552276 - DNA, 22 bp, Homo sapiens
gagggggctctgccaacctgtc

SEQ ID NO: 7552277 - DNA, 22 bp, Homo sapiens
gaggggggcgccctgcagtgca

SEQ ID NO: 7552278 - DNA, 22 bp, Homo sapiens
gaggggggcgccctgcagtgca

SEQ ID NO: 7552279 - DNA, 22 bp, Homo sapiens
gaggggggcgccctgcagtgca

SEQ ID NO: 7552280 - DNA, 22 bp, Homo sapiens
gagggggtctatgaggtagagc

SEQ ID NO: 7552281 - DNA, 22 bp, Homo sapiens
gagggggtctatgaggtagagc

SEQ ID NO: 7552282 - DNA, 22 bp, Homo sapiens
gagggggtctatgaggtagagc

SEQ ID NO: 7552283 - DNA, 22 bp, Homo sapiens
gagggggtctatgaggtagagc

SEQ ID NO: 7552284 - DNA, 22 bp, Homo sapiens
gagggggtctatgaggtagagc

SEQ ID NO: 7552285 - DNA, 22 bp, Homo sapiens
gagggggtctatgaggtagagc

SEQ ID NO: 7552286 - DNA, 22 bp, Homo sapiens
gaggggggcgccctgcagtgca

SEQ ID NO: 7552287 - DNA, 22 bp, Homo sapiens
gaggggggcgccctgcagtgca

SEQ ID NO: 7552288 - DNA, 22 bp, Homo sapiens
gaggggggcgccctgcagtgca

SEQ ID NO: 7552289 - DNA, 22 bp, Homo sapiens
gaggggggcgccctgcagtgca

SEQ ID NO: 7552290 - DNA, 22 bp, Homo sapiens
gagggggctagcgcagtgccca

SEQ ID NO: 7552291 - DNA, 22 bp, Homo sapiens
gagggggctagcgcagtgccca

SEQ ID NO: 7552292 - DNA, 22 bp, Homo sapiens
gagggggctagcgcagtgccca

SEQ ID NO: 7552293 - DNA, 22 bp, Homo sapiens
gagggggctagcgcagtgccca

SEQ ID NO: 7552294 - DNA, 22 bp, Homo sapiens
gagggggcgtgcaaggctccgc

SEQ ID NO: 7552295 - DNA, 22 bp, Homo sapiens
gagggggctagcgcagtgccca

SEQ ID NO: 7552296 - DNA, 22 bp, Homo sapiens
gagggggctagcgcagtgccca

SEQ ID NO: 7552297 - DNA, 22 bp, Homo sapiens
gagggggctagcgcagtgccca

SEQ ID NO: 7552298 - DNA, 22 bp, Homo sapiens
gagggggctagcgcagtgccca

SEQ ID NO: 7552299 - DNA, 22 bp, Homo sapiens
gagggggctccctgaagccagt

SEQ ID NO: 7552300 - DNA, 22 bp, Homo sapiens
gagggggctccctgaagccagt

SEQ ID NO: 7552301 - DNA, 22 bp, Homo sapiens
gagggggctccctgaagccagt

SEQ ID NO: 7552302 - DNA, 22 bp, Homo sapiens
gagggggctccctgaagccagt

SEQ ID NO: 7552303 - DNA, 22 bp, Homo sapiens
gagggggctccctgaagccagt

SEQ ID NO: 7552304 - DNA, 22 bp, Homo sapiens
gagggggctccctgaagccagt

SEQ ID NO: 7552305 - DNA, 22 bp, Homo sapiens
gagggggctccctgaagccagt

SEQ ID NO: 7552306 - DNA, 22 bp, Homo sapiens
gagggggctccctgaagccagt

SEQ ID NO: 7552307 - DNA, 22 bp, Homo sapiens
gagggatggtgtgagaggctca

SEQ ID NO: 7552308 - DNA, 22 bp, Homo sapiens
gagggatggtagttgacactga

SEQ ID NO: 7552309 - DNA, 22 bp, Homo sapiens
gagggaagaaagaattgatgcg

SEQ ID NO: 7552310 - DNA, 22 bp, Homo sapiens
gagggatggtgtgagaggctca

SEQ ID NO: 7552311 - DNA, 22 bp, Homo sapiens
gagggatggtgtgagaggctca

SEQ ID NO: 7552312 - DNA, 22 bp, Homo sapiens
gagggatggtgtgagaggctca

SEQ ID NO: 7552313 - DNA, 22 bp, Homo sapiens
gagggatggtgtgagaggctca

SEQ ID NO: 7552314 - DNA, 22 bp, Homo sapiens
gagggatggtgtgagaggctca

SEQ ID NO: 7552315 - DNA, 22 bp, Homo sapiens
gagggatggtgtgagaggctca

SEQ ID NO: 7552316 - DNA, 22 bp, Homo sapiens
gagggaaacagatgggttgtgg

SEQ ID NO: 7552317 - DNA, 22 bp, Homo sapiens
gagggaaacagatgggttgtgg

SEQ ID NO: 7552318 - DNA, 22 bp, Homo sapiens
gagggaaacagatgggttgtgg

SEQ ID NO: 7552319 - DNA, 22 bp, Homo sapiens
gagggaaacagatgggttgtgg

SEQ ID NO: 7552320 - DNA, 22 bp, Homo sapiens
gagggaaaggttaatacatgat

SEQ ID NO: 7552321 - DNA, 22 bp, Homo sapiens
gagggaaaggttaatacatgat

SEQ ID NO: 7552322 - DNA, 22 bp, Homo sapiens
gagggaaaataaaattgcagta

SEQ ID NO: 7552323 - DNA, 22 bp, Homo sapiens
gagggaaaggttaatacatgat

SEQ ID NO: 7552324 - DNA, 22 bp, Homo sapiens
gagggaagaaagaattgatgcg

SEQ ID NO: 7552325 - DNA, 22 bp, Homo sapiens
gagggaagaaagaattgatgcg

SEQ ID NO: 7552326 - DNA, 22 bp, Homo sapiens
gagggaagaaagaattgatgcg

SEQ ID NO: 7552327 - DNA, 22 bp, Homo sapiens
gagggaagaaagaattgatgcg

SEQ ID NO: 7552328 - DNA, 22 bp, Homo sapiens
gagggaagaaagaattgatgcg

SEQ ID NO: 7552329 - DNA, 22 bp, Homo sapiens
gagggatgtgcctgaaggcagg

SEQ ID NO: 7552330 - DNA, 22 bp, Homo sapiens
gagggatgtgcctgaaggcagg

SEQ ID NO: 7552331 - DNA, 22 bp, Homo sapiens
gagggatgtgcctgaaggcagg

SEQ ID NO: 7552332 - DNA, 22 bp, Homo sapiens
gagggatgtgcctgaaggcagg

SEQ ID NO: 7552333 - DNA, 22 bp, Homo sapiens
gagggatgtgcctgaaggcagg

SEQ ID NO: 7552334 - DNA, 22 bp, Homo sapiens
gagggcacaaaggcaacattca

SEQ ID NO: 7552335 - DNA, 22 bp, Homo sapiens
gagggcacaaaggcaacattca

SEQ ID NO: 7552336 - DNA, 22 bp, Homo sapiens
gagggcaagagttggaaacggt

SEQ ID NO: 7552337 - DNA, 22 bp, Homo sapiens
gagggcaaaacagagaagatgt

SEQ ID NO: 7552338 - DNA, 22 bp, Homo sapiens
gagggatgtgcctgaaggcagg

SEQ ID NO: 7552339 - DNA, 22 bp, Homo sapiens
gagggatggtgtgagaggctca

SEQ ID NO: 7552340 - DNA, 22 bp, Homo sapiens
gagggatggtgtgagaggctca

SEQ ID NO: 7552341 - DNA, 22 bp, Homo sapiens
gagggatggtgtgagaggctca

SEQ ID NO: 7552342 - DNA, 22 bp, Homo sapiens
gagggatggtgtgagaggctca

SEQ ID NO: 7552343 - DNA, 22 bp, Homo sapiens
gagggatgtcaggggaccttgg

SEQ ID NO: 7552344 - DNA, 22 bp, Homo sapiens
gagggatgtcaggggaccttgg

SEQ ID NO: 7552345 - DNA, 22 bp, Homo sapiens
gagggatgtgcctgaaggcagg

SEQ ID NO: 7552346 - DNA, 22 bp, Homo sapiens
gagggatgtcaggggaccttgg

SEQ ID NO: 7552347 - DNA, 22 bp, Homo sapiens
gaggctgttcagtgtccagctt

SEQ ID NO: 7552348 - DNA, 22 bp, Homo sapiens
gaggctgttcagtgtccagctt

SEQ ID NO: 7552349 - DNA, 22 bp, Homo sapiens
gaggctgttagggcctgaggta

SEQ ID NO: 7552350 - DNA, 22 bp, Homo sapiens
gaggctgtttgtggcagtgatg

SEQ ID NO: 7552351 - DNA, 22 bp, Homo sapiens
gaggcttcccgcccatgctgga

SEQ ID NO: 7552352 - DNA, 22 bp, Homo sapiens
gaggcttcccgcccatgctgga

SEQ ID NO: 7552353 - DNA, 22 bp, Homo sapiens
gaggcttgcaccatgagcacca

SEQ ID NO: 7552354 - DNA, 22 bp, Homo sapiens
gaggcttgcaccatgagcacca

SEQ ID NO: 7552355 - DNA, 22 bp, Homo sapiens
gaggcttgcaccatgagcacca

SEQ ID NO: 7552356 - DNA, 22 bp, Homo sapiens
gaggcttgggacattagttgca

SEQ ID NO: 7552357 - DNA, 23 bp, Homo sapiens
gaggcttgatcagcttcctccac

SEQ ID NO: 7552358 - DNA, 23 bp, Homo sapiens
gaggcttgatcagcttcctccac

SEQ ID NO: 7552359 - DNA, 22 bp, Homo sapiens
gaggcttctgttcactcacgct

SEQ ID NO: 7552360 - DNA, 22 bp, Homo sapiens
gaggcttctggaaagcctggca

SEQ ID NO: 7552361 - DNA, 22 bp, Homo sapiens
gagggaaaataaaattgcagta

SEQ ID NO: 7552362 - DNA, 22 bp, Homo sapiens
gagggaaaataaaattgcagta

SEQ ID NO: 7552363 - DNA, 22 bp, Homo sapiens
gaggcttttcttcaggtatcaa

SEQ ID NO: 7552364 - DNA, 22 bp, Homo sapiens
gaggcttttggctaataactgt

SEQ ID NO: 7552365 - DNA, 22 bp, Homo sapiens
gaggcttttctctaaatagtgg

SEQ ID NO: 7552366 - DNA, 22 bp, Homo sapiens
gaggcttttcttcaggtatcaa

SEQ ID NO: 7552367 - DNA, 22 bp, Homo sapiens
gagggaaaataaaattgcagta

SEQ ID NO: 7552368 - DNA, 22 bp, Homo sapiens
gagggaaaataaaattgcagta

SEQ ID NO: 7552369 - DNA, 22 bp, Homo sapiens
gagggaaacagatgggttgtgg

SEQ ID NO: 7552370 - DNA, 22 bp, Homo sapiens
gagggaaaataaaattgcagta

SEQ ID NO: 7552371 - DNA, 22 bp, Homo sapiens
gaggctttataactatttgttc

SEQ ID NO: 7552372 - DNA, 22 bp, Homo sapiens
gaggctttcacaaggttagttc

SEQ ID NO: 7552373 - DNA, 22 bp, Homo sapiens
gaggcttggggctggcttgcct

SEQ ID NO: 7552374 - DNA, 22 bp, Homo sapiens
gaggcttggggctggcttgcct

SEQ ID NO: 7552375 - DNA, 22 bp, Homo sapiens
gaggctttacctagtaaagtgg

SEQ ID NO: 7552376 - DNA, 22 bp, Homo sapiens
gaggctttacctagtaaagtgg

SEQ ID NO: 7552377 - DNA, 22 bp, Homo sapiens
gaggctttataactatttgttc

SEQ ID NO: 7552378 - DNA, 22 bp, Homo sapiens
gaggcttttagtatggggactg

SEQ ID NO: 7552379 - DNA, 22 bp, Homo sapiens
gaggcttttagtatggggactg

SEQ ID NO: 7552380 - DNA, 22 bp, Homo sapiens
gaggcttttagtatggggactg

SEQ ID NO: 7552381 - DNA, 22 bp, Homo sapiens
gaggctttggttataaaagatc

SEQ ID NO: 7552382 - DNA, 22 bp, Homo sapiens
gaggctttgaatgcacggttca

SEQ ID NO: 7552383 - DNA, 22 bp, Homo sapiens
atgtcacatctgggatggccct

SEQ ID NO: 7552384 - DNA, 22 bp, Homo sapiens
atgtcacagttgcaacatgaat

SEQ ID NO: 7552385 - DNA, 22 bp, Homo sapiens
atgtcacagttgcaacatgaat

SEQ ID NO: 7552386 - DNA, 22 bp, Homo sapiens
atgtcacatgagagcgcagcac

SEQ ID NO: 7552387 - DNA, 22 bp, Homo sapiens
atgtcacatctgggatggccct

SEQ ID NO: 7552388 - DNA, 22 bp, Homo sapiens
atgtcacatggtcacctctagc

SEQ ID NO: 7552389 - DNA, 22 bp, Homo sapiens
atgtcacatggtcacctctagc

SEQ ID NO: 7552390 - DNA, 22 bp, Homo sapiens
atgtcacatggcctgtactttg

SEQ ID NO: 7552391 - DNA, 22 bp, Homo sapiens
atgtcacatgagagcgcagcac

SEQ ID NO: 7552392 - DNA, 22 bp, Homo sapiens
gaggcattaaagggaatcttct

SEQ ID NO: 7552393 - DNA, 22 bp, Homo sapiens
atgtcaccttcggtggcacggt

SEQ ID NO: 7552394 - DNA, 22 bp, Homo sapiens
atgtcacatggttctggggcct

SEQ ID NO: 7552395 - DNA, 22 bp, Homo sapiens
atgtcacatggttctggggcct

SEQ ID NO: 7552396 - DNA, 22 bp, Homo sapiens
atgtcacattggagctgctgga

SEQ ID NO: 7552397 - DNA, 22 bp, Homo sapiens
atgtcacattggagctgctgga

SEQ ID NO: 7552398 - DNA, 22 bp, Homo sapiens
gaggccaaggtgggcagatcac

SEQ ID NO: 7552399 - DNA, 22 bp, Homo sapiens
gaggccaaggtgggcagatcac

SEQ ID NO: 7552400 - DNA, 17 bp, Homo sapiens
gaggccaaggcaggcgg

SEQ ID NO: 7552401 - DNA, 22 bp, Homo sapiens
gaggccaactttggagaacagg

SEQ ID NO: 7552402 - DNA, 22 bp, Homo sapiens
gaggccaactttggagaacagg

SEQ ID NO: 7552403 - DNA, 22 bp, Homo sapiens
gaggccaagttggagaccaggt

SEQ ID NO: 7552404 - DNA, 22 bp, Homo sapiens
gaggccaagttggagaccaggt

SEQ ID NO: 7552405 - DNA, 22 bp, Homo sapiens
gaggccaagttggagaccaggt

SEQ ID NO: 7552406 - DNA, 22 bp, Homo sapiens
gaggccaaggtgggcagatcac

SEQ ID NO: 7552407 - DNA, 22 bp, Homo sapiens
gaggccaatcaatagggcaata

SEQ ID NO: 7552408 - DNA, 22 bp, Homo sapiens
gaggccacagctatcagggaca

SEQ ID NO: 7552409 - DNA, 22 bp, Homo sapiens
gaggccacagctatcagggaca

SEQ ID NO: 7552410 - DNA, 22 bp, Homo sapiens
gaggccacattacttggtgggt

SEQ ID NO: 7552411 - DNA, 22 bp, Homo sapiens
gaggccacagtgtctgggggcc

SEQ ID NO: 7552412 - DNA, 22 bp, Homo sapiens
gaggccacagtgtctgggggcc

SEQ ID NO: 7552413 - DNA, 22 bp, Homo sapiens
gaggccacagtgtctgggggcc

SEQ ID NO: 7552414 - DNA, 23 bp, Homo sapiens
gaggccacattcccctgcttgag

SEQ ID NO: 7552415 - DNA, 22 bp, Homo sapiens
gaggccacattacttggtgggt

SEQ ID NO: 7552416 - DNA, 22 bp, Homo sapiens
gaggccacagtcctgaggcatc

SEQ ID NO: 7552417 - DNA, 22 bp, Homo sapiens
gaggccacagtcctgaggcatc

SEQ ID NO: 7552418 - DNA, 22 bp, Homo sapiens
gaggccacagtgtctgggggcc

SEQ ID NO: 7552419 - DNA, 22 bp, Homo sapiens
gaggccacagtcctgaggcatc

SEQ ID NO: 7552420 - DNA, 22 bp, Homo sapiens
gaggccacagctatcagggaca

SEQ ID NO: 7552421 - DNA, 22 bp, Homo sapiens
gaggccacagtcagtgttcatc

SEQ ID NO: 7552422 - DNA, 22 bp, Homo sapiens
gaggccacagtcagtgttcatc

SEQ ID NO: 7552423 - DNA, 22 bp, Homo sapiens
gaggccacagtcagtgttcatc

SEQ ID NO: 7552424 - DNA, 22 bp, Homo sapiens
gaggccacagtcctgaggcatc

SEQ ID NO: 7552425 - DNA, 22 bp, Homo sapiens
gaggccacagtcctgaggcatc

SEQ ID NO: 7552426 - DNA, 22 bp, Homo sapiens
gaggccacagtcctgaggcatc

SEQ ID NO: 7552427 - DNA, 22 bp, Homo sapiens
gaggccacagtcctgaggcatc

SEQ ID NO: 7552428 - DNA, 23 bp, Homo sapiens
gaggccacattcccctgcttgag

SEQ ID NO: 7552429 - DNA, 22 bp, Homo sapiens
gaggctgctttgatgacaggag

SEQ ID NO: 7552430 - DNA, 23 bp, Homo sapiens
gaggccacattcccctgcttgag

SEQ ID NO: 7552431 - DNA, 23 bp, Homo sapiens
gaggccacattcccctgcttgag

SEQ ID NO: 7552432 - DNA, 22 bp, Homo sapiens
gaggccacattacttggtgggt

SEQ ID NO: 7552433 - DNA, 23 bp, Homo sapiens
gaggccacattcccctgcttgag

SEQ ID NO: 7552434 - DNA, 22 bp, Homo sapiens
gaggctggaatattagaaatgt

SEQ ID NO: 7552435 - DNA, 22 bp, Homo sapiens
gaggctgtgtcttggggtggaa

SEQ ID NO: 7552436 - DNA, 22 bp, Homo sapiens
gaggctggaatattagaaatgt

SEQ ID NO: 7552437 - DNA, 22 bp, Homo sapiens
gaggctggaatattagaaatgt

SEQ ID NO: 7552438 - DNA, 22 bp, Homo sapiens
gaggctgttaggagggactctg

SEQ ID NO: 7552439 - DNA, 22 bp, Homo sapiens
gaggctgtgtttcagtgaggcc

SEQ ID NO: 7552440 - DNA, 22 bp, Homo sapiens
gaggctgtgtttcagtgaggcc

SEQ ID NO: 7552441 - DNA, 22 bp, Homo sapiens
gaggctggaatattagaaatgt

SEQ ID NO: 7552442 - DNA, 22 bp, Homo sapiens
gaggctggaatattagaaatgt

SEQ ID NO: 7552443 - DNA, 22 bp, Homo sapiens
gagttaattcgaatattctagc

SEQ ID NO: 7552444 - DNA, 22 bp, Homo sapiens
gagttaattcgaatattctagc

SEQ ID NO: 7552445 - DNA, 22 bp, Homo sapiens
gagttaatagggttctttgtga

SEQ ID NO: 7552446 - DNA, 22 bp, Homo sapiens
gagttaatactgagtttattaa

SEQ ID NO: 7552447 - DNA, 22 bp, Homo sapiens
gagttacacaaaatttctattt

SEQ ID NO: 7552448 - DNA, 22 bp, Homo sapiens
gagttactgggtggaaggcact

SEQ ID NO: 7552449 - DNA, 22 bp, Homo sapiens
gagttagaagacagaatgtaaa

SEQ ID NO: 7552450 - DNA, 22 bp, Homo sapiens
gagttagagccatagagcacgg

SEQ ID NO: 7552451 - DNA, 22 bp, Homo sapiens
gagttacatttggtgacacttc

SEQ ID NO: 7552452 - DNA, 22 bp, Homo sapiens
gagttacatttggtgacacttc

SEQ ID NO: 7552453 - DNA, 22 bp, Homo sapiens
gagttacagagaggattatggt

SEQ ID NO: 7552454 - DNA, 22 bp, Homo sapiens
gagttacatggacattctctcc

SEQ ID NO: 7552455 - DNA, 22 bp, Homo sapiens
gagttattaatggctgagtttg

SEQ ID NO: 7552456 - DNA, 22 bp, Homo sapiens
gagttattaatggctgagtttg

SEQ ID NO: 7552457 - DNA, 22 bp, Homo sapiens
gagttatatttgcgatattgga

SEQ ID NO: 7552458 - DNA, 22 bp, Homo sapiens
gagttatatcctgagtcatatt

SEQ ID NO: 7552459 - DNA, 22 bp, Homo sapiens
gagttatatttgcgatattgga

SEQ ID NO: 7552460 - DNA, 22 bp, Homo sapiens
gagttattgagtatagaatgta

SEQ ID NO: 7552461 - DNA, 19 bp, Homo sapiens
gagttattgccagggcatg

SEQ ID NO: 7552462 - DNA, 19 bp, Homo sapiens
gagttattgccagggcatg

SEQ ID NO: 7552463 - DNA, 22 bp, Homo sapiens
gagttattctaggtcctttgta

SEQ ID NO: 7552464 - DNA, 22 bp, Homo sapiens
gagttattctaggtcctttgta

SEQ ID NO: 7552465 - DNA, 22 bp, Homo sapiens
gagttattaatggctgagtttg

SEQ ID NO: 7552466 - DNA, 22 bp, Homo sapiens
gagttattagtcaaatagggaa

SEQ ID NO: 7552467 - DNA, 22 bp, Homo sapiens
gagttattctaggtcctttgta

SEQ ID NO: 7552468 - DNA, 22 bp, Homo sapiens
gagttataacctagtttaactg

SEQ ID NO: 7552469 - DNA, 22 bp, Homo sapiens
gagttatatcctgagtcatatt

SEQ ID NO: 7552470 - DNA, 22 bp, Homo sapiens
gagttatagatggactattatt

SEQ ID NO: 7552471 - DNA, 22 bp, Homo sapiens
gagttatatcctgagtcatatt

SEQ ID NO: 7552472 - DNA, 22 bp, Homo sapiens
gagttatagatggactattatt

SEQ ID NO: 7552473 - DNA, 22 bp, Homo sapiens
gagttatagatggactattatt

SEQ ID NO: 7552474 - DNA, 22 bp, Homo sapiens
gagttatttgtagggattatat

SEQ ID NO: 7552475 - DNA, 22 bp, Homo sapiens
gagttatttcagaaggaaagat

SEQ ID NO: 7552476 - DNA, 22 bp, Homo sapiens
gagttatttcagaaggaaagat

SEQ ID NO: 7552477 - DNA, 22 bp, Homo sapiens
gagttatttgtagggattatat

SEQ ID NO: 7552478 - DNA, 22 bp, Homo sapiens
gagttatttcagaaggaaagat

SEQ ID NO: 7552479 - DNA, 22 bp, Homo sapiens
gagttatttggtttgcatgcag

SEQ ID NO: 7552480 - DNA, 22 bp, Homo sapiens
gagttattgggtggaaaggtag

SEQ ID NO: 7552481 - DNA, 22 bp, Homo sapiens
gagttattgggtggaaaggtag

SEQ ID NO: 7552482 - DNA, 22 bp, Homo sapiens
gatatttacaaatttgccaata

SEQ ID NO: 7552483 - DNA, 22 bp, Homo sapiens
gatatttacaaatttgccaata

SEQ ID NO: 7552484 - DNA, 22 bp, Homo sapiens
gatatttaactctcacaggtcc

SEQ ID NO: 7552485 - DNA, 22 bp, Homo sapiens
gatatttaactctcacaggtcc

SEQ ID NO: 7552486 - DNA, 22 bp, Homo sapiens
gagttatttgtagggattatat

SEQ ID NO: 7552487 - DNA, 22 bp, Homo sapiens
gatatttaactctcacaggtcc

SEQ ID NO: 7552488 - DNA, 22 bp, Homo sapiens
gatatttacaaatttgccaata

SEQ ID NO: 7552489 - DNA, 22 bp, Homo sapiens
gatatttacaaatttgccaata

SEQ ID NO: 7552490 - DNA, 22 bp, Homo sapiens
gatatttacattaagcacattg

SEQ ID NO: 7552491 - DNA, 22 bp, Homo sapiens
gatatttacaaatttgccaata

SEQ ID NO: 7552492 - DNA, 22 bp, Homo sapiens
gatcctgggactgaatgggtgc

SEQ ID NO: 7552493 - DNA, 22 bp, Homo sapiens
gatcctgggactgaatgggtgc

SEQ ID NO: 7552494 - DNA, 22 bp, Homo sapiens
gatcctggagctccatcactat

SEQ ID NO: 7552495 - DNA, 22 bp, Homo sapiens
gatcctggagctccatcactat

SEQ ID NO: 7552496 - DNA, 22 bp, Homo sapiens
gatcctggcacaggttggtccc

SEQ ID NO: 7552497 - DNA, 22 bp, Homo sapiens
gatccttgcaactctgtgaggt

SEQ ID NO: 7552498 - DNA, 22 bp, Homo sapiens
gatccttgcacttgacttggca

SEQ ID NO: 7552499 - DNA, 22 bp, Homo sapiens
gatcctttggtttctgatttag

SEQ ID NO: 7552500 - DNA, 22 bp, Homo sapiens
gatcctttggtttctgatttag

SEQ ID NO: 7552501 - DNA, 18 bp, Homo sapiens
gatcgggggcgccccaag

SEQ ID NO: 7552502 - DNA, 22 bp, Homo sapiens
gatctagaaggcaaatatagtg

SEQ ID NO: 7552503 - DNA, 22 bp, Homo sapiens
gatctagaccagaagctgttgt

SEQ ID NO: 7552504 - DNA, 22 bp, Homo sapiens
gatctagaaggcaaatatagtg

SEQ ID NO: 7552505 - DNA, 18 bp, Homo sapiens
gatcgggggcgccccaag

SEQ ID NO: 7552506 - DNA, 18 bp, Homo sapiens
gatcgggggcgccccaag

SEQ ID NO: 7552507 - DNA, 18 bp, Homo sapiens
gatcgggggcgccccaag

SEQ ID NO: 7552508 - DNA, 22 bp, Homo sapiens
gatcgggtgggttctgccatca

SEQ ID NO: 7552509 - DNA, 22 bp, Homo sapiens
gatcctgttagatcccattaga

SEQ ID NO: 7552510 - DNA, 22 bp, Homo sapiens
gatccttatccttaaagatgct

SEQ ID NO: 7552511 - DNA, 22 bp, Homo sapiens
gatccttatttggtcaagcttc

SEQ ID NO: 7552512 - DNA, 22 bp, Homo sapiens
gatccttcagttcgatggggat

SEQ ID NO: 7552513 - DNA, 22 bp, Homo sapiens
gatccttctcctttttcatgct

SEQ ID NO: 7552514 - DNA, 22 bp, Homo sapiens
gatccttctcctttttcatgct

SEQ ID NO: 7552515 - DNA, 22 bp, Homo sapiens
gatcctgtgcatggggtgatgg

SEQ ID NO: 7552516 - DNA, 22 bp, Homo sapiens
gatcctgtggttttcctgtgca

SEQ ID NO: 7552517 - DNA, 22 bp, Homo sapiens
gatcctgggcccttctgggtca

SEQ ID NO: 7552518 - DNA, 22 bp, Homo sapiens
atgtttccatagaagtcacagt

SEQ ID NO: 7552519 - DNA, 22 bp, Homo sapiens
atgtttccaggttcttcctatg

SEQ ID NO: 7552520 - DNA, 22 bp, Homo sapiens
atgtttccatagaagtcacagt

SEQ ID NO: 7552521 - DNA, 22 bp, Homo sapiens
atgtttccaggttcttcctatg

SEQ ID NO: 7552522 - DNA, 22 bp, Homo sapiens
atgtttccatagaagtcacagt

SEQ ID NO: 7552523 - DNA, 22 bp, Homo sapiens
atgtttccatagaagtcacagt

SEQ ID NO: 7552524 - DNA, 22 bp, Homo sapiens
atgtttccatcaaatttgatga

SEQ ID NO: 7552525 - DNA, 22 bp, Homo sapiens
atgtttccatcaaatttgatga

SEQ ID NO: 7552526 - DNA, 22 bp, Homo sapiens
atgtttcatttagatatcaggc

SEQ ID NO: 7552527 - DNA, 22 bp, Homo sapiens
atgtttccagctcagctgcagg

SEQ ID NO: 7552528 - DNA, 22 bp, Homo sapiens
atgtttccagctcagctgcagg

SEQ ID NO: 7552529 - DNA, 22 bp, Homo sapiens
atgtttccaggttcttcctatg

SEQ ID NO: 7552530 - DNA, 22 bp, Homo sapiens
atgtttccaggttcttcctatg

SEQ ID NO: 7552531 - DNA, 22 bp, Homo sapiens
gatctgggagcctcatggagac

SEQ ID NO: 7552532 - DNA, 22 bp, Homo sapiens
gatctggaatctgaaggctgag

SEQ ID NO: 7552533 - DNA, 22 bp, Homo sapiens
gatctgggagcctcatggagac

SEQ ID NO: 7552534 - DNA, 22 bp, Homo sapiens
gatctggaatctgaaggctgag

SEQ ID NO: 7552535 - DNA, 22 bp, Homo sapiens
gatctggaatctgaaggctgag

SEQ ID NO: 7552536 - DNA, 22 bp, Homo sapiens
atgtttcatttagatatcaggc

SEQ ID NO: 7552537 - DNA, 22 bp, Homo sapiens
gatctgggagcctcatggagac

SEQ ID NO: 7552538 - DNA, 22 bp, Homo sapiens
atgtttcatttagatatcaggc

SEQ ID NO: 7552539 - DNA, 22 bp, Homo sapiens
atgtttcatttagatatcaggc

SEQ ID NO: 7552540 - DNA, 22 bp, Homo sapiens
atgtttccagatatgtcaccct

SEQ ID NO: 7552541 - DNA, 22 bp, Homo sapiens
atgtttccagatatgtcaccct

SEQ ID NO: 7552542 - DNA, 22 bp, Homo sapiens
atgtttccagatatgtcaccct

SEQ ID NO: 7552543 - DNA, 22 bp, Homo sapiens
atgtttcccagagcaaatctgg

SEQ ID NO: 7552544 - DNA, 22 bp, Homo sapiens
atgtttccattttcttgtatca

SEQ ID NO: 7552545 - DNA, 22 bp, Homo sapiens
atgtttccattttcttgtatca

SEQ ID NO: 7552546 - DNA, 22 bp, Homo sapiens
atgtttccattttcttgtatca

SEQ ID NO: 7552547 - DNA, 22 bp, Homo sapiens
atgtttcccagagcaaatctgg

SEQ ID NO: 7552548 - DNA, 22 bp, Homo sapiens
atgtttcccagagcaaatctgg

SEQ ID NO: 7552549 - DNA, 22 bp, Homo sapiens
atgtttcccagagcaaatctgg

SEQ ID NO: 7552550 - DNA, 22 bp, Homo sapiens
atgtttcccataagattttctg

SEQ ID NO: 7552551 - DNA, 22 bp, Homo sapiens
atgtttcccataagattttctg

SEQ ID NO: 7552552 - DNA, 22 bp, Homo sapiens
atgtttccatgttcaatttact

SEQ ID NO: 7552553 - DNA, 22 bp, Homo sapiens
atgtttccatgttcaatttact

SEQ ID NO: 7552554 - DNA, 22 bp, Homo sapiens
atgtttccatgttcaatttact

SEQ ID NO: 7552555 - DNA, 22 bp, Homo sapiens
atgtttccattttcttgtatca

SEQ ID NO: 7552556 - DNA, 22 bp, Homo sapiens
atgtttccattttcttgtatca

SEQ ID NO: 7552557 - DNA, 22 bp, Homo sapiens
atgtttctaaaacttgcatggc

SEQ ID NO: 7552558 - DNA, 22 bp, Homo sapiens
atgtttccttatagataaaagc

SEQ ID NO: 7552559 - DNA, 22 bp, Homo sapiens
atgtttccttatagataaaagc

SEQ ID NO: 7552560 - DNA, 22 bp, Homo sapiens
atgtttccgtgagcatccttga

SEQ ID NO: 7552561 - DNA, 22 bp, Homo sapiens
atgtttcctgttggattggccc

SEQ ID NO: 7552562 - DNA, 22 bp, Homo sapiens
atgtttcctgttggattggccc

SEQ ID NO: 7552563 - DNA, 22 bp, Homo sapiens
atgtttccgtgagcatccttga

SEQ ID NO: 7552564 - DNA, 22 bp, Homo sapiens
atgtttccgtgagcatccttga

SEQ ID NO: 7552565 - DNA, 22 bp, Homo sapiens
atgtttcccataagattttctg

SEQ ID NO: 7552566 - DNA, 22 bp, Homo sapiens
atgtttcccataagattttctg

SEQ ID NO: 7552567 - DNA, 22 bp, Homo sapiens
atgtttcccataagattttctg

SEQ ID NO: 7552568 - DNA, 22 bp, Homo sapiens
atgtttcccttctgatttggga

SEQ ID NO: 7552569 - DNA, 22 bp, Homo sapiens
atgtttcccttctgatttggga

SEQ ID NO: 7552570 - DNA, 22 bp, Homo sapiens
gatctatttactcttttcctag

SEQ ID NO: 7552571 - DNA, 21 bp, Homo sapiens
gatctagacttgggcccagta

SEQ ID NO: 7552572 - DNA, 21 bp, Homo sapiens
gatctagacttgggcccagta

SEQ ID NO: 7552573 - DNA, 22 bp, Homo sapiens
gatctagaccagaagctgttgt

SEQ ID NO: 7552574 - DNA, 22 bp, Homo sapiens
gatctcagagtaactgaggggc

SEQ ID NO: 7552575 - DNA, 22 bp, Homo sapiens
gatctctgaatctgaagccttc

SEQ ID NO: 7552576 - DNA, 21 bp, Homo sapiens
gatctctggaaggagaaagct

SEQ ID NO: 7552577 - DNA, 18 bp, Homo sapiens
gatctctgcagtgcctac

SEQ ID NO: 7552578 - DNA, 22 bp, Homo sapiens
gatctctgctggaagggacacc

SEQ ID NO: 7552579 - DNA, 21 bp, Homo sapiens
gatctctggaaggagaaagct

SEQ ID NO: 7552580 - DNA, 22 bp, Homo sapiens
gatctctgtggactcttagcac

SEQ ID NO: 7552581 - DNA, 22 bp, Homo sapiens
gatctgaagagttattttctga

SEQ ID NO: 7552582 - DNA, 22 bp, Homo sapiens
gatctgaagagcaatgaaatat

SEQ ID NO: 7552583 - DNA, 22 bp, Homo sapiens
gatctgaagagcaatgaaatat

SEQ ID NO: 7552584 - DNA, 22 bp, Homo sapiens
gatctgaaaatgctcttcttct

SEQ ID NO: 7552585 - DNA, 22 bp, Homo sapiens
gatctgaaatagctactgcaga

SEQ ID NO: 7552586 - DNA, 22 bp, Homo sapiens
gatctgaatcaatagaataact

SEQ ID NO: 7552587 - DNA, 22 bp, Homo sapiens
gatctgaatagacttgctaagg

SEQ ID NO: 7552588 - DNA, 22 bp, Homo sapiens
gatctgaagatatgaaatattt

SEQ ID NO: 7552589 - DNA, 22 bp, Homo sapiens
gatctgaagatatgaaatattt

SEQ ID NO: 7552590 - DNA, 22 bp, Homo sapiens
gatctgcactctgagaggcttg

SEQ ID NO: 7552591 - DNA, 22 bp, Homo sapiens
gatctggaatctgaaggctgag

SEQ ID NO: 7552592 - DNA, 22 bp, Homo sapiens
gatctggaatctgaaggctgag

SEQ ID NO: 7552593 - DNA, 22 bp, Homo sapiens
gatctggaatctgaaggctgag

SEQ ID NO: 7552594 - DNA, 22 bp, Homo sapiens
gatctggaatctgaaggctgag

SEQ ID NO: 7552595 - DNA, 22 bp, Homo sapiens
gatctggaatctgaaggctgag

SEQ ID NO: 7552596 - DNA, 22 bp, Homo sapiens
gatctgcactctgagaggcttg

SEQ ID NO: 7552597 - DNA, 22 bp, Homo sapiens
gatctgcactctgagaggcttg

SEQ ID NO: 7552598 - DNA, 22 bp, Homo sapiens
gatctgagatctaaaccagagg

SEQ ID NO: 7552599 - DNA, 22 bp, Homo sapiens
gatctgaatcaatagaataact

SEQ ID NO: 7552600 - DNA, 22 bp, Homo sapiens
gagtccaggctggtcaaatagc

SEQ ID NO: 7552601 - DNA, 22 bp, Homo sapiens
gagtccaggctgttgctcatct

SEQ ID NO: 7552602 - DNA, 22 bp, Homo sapiens
gagtccaggctgttgctcatct

SEQ ID NO: 7552603 - DNA, 22 bp, Homo sapiens
gagtccaggctgttgctcatct

SEQ ID NO: 7552604 - DNA, 20 bp, Homo sapiens
gagtccaggggcctgtagca

SEQ ID NO: 7552605 - DNA, 22 bp, Homo sapiens
gagtccaggctgttgctcatct

SEQ ID NO: 7552606 - DNA, 20 bp, Homo sapiens
gagtccaggggcctgtagca

SEQ ID NO: 7552607 - DNA, 20 bp, Homo sapiens
gagtccaggggcctgtagca

SEQ ID NO: 7552608 - DNA, 22 bp, Homo sapiens
gagtccagtgatgttcctggtc

SEQ ID NO: 7552609 - DNA, 22 bp, Homo sapiens
gagtccagtagttaggacagag

SEQ ID NO: 7552610 - DNA, 22 bp, Homo sapiens
gagtccagtgatgttcctggtc

SEQ ID NO: 7552611 - DNA, 22 bp, Homo sapiens
gagtccagtagttaggacagag

SEQ ID NO: 7552612 - DNA, 22 bp, Homo sapiens
gagtccagtagttaggacagag

SEQ ID NO: 7552613 - DNA, 22 bp, Homo sapiens
gagtccagtgatgttcctggtc

SEQ ID NO: 7552614 - DNA, 22 bp, Homo sapiens
gagtccagtagttaggacagag

SEQ ID NO: 7552615 - DNA, 22 bp, Homo sapiens
gagtccagtagttaggacagag

SEQ ID NO: 7552616 - DNA, 22 bp, Homo sapiens
gagtccagtagttaggacagag

SEQ ID NO: 7552617 - DNA, 22 bp, Homo sapiens
gagtccagtagttaggacagag

SEQ ID NO: 7552618 - DNA, 22 bp, Homo sapiens
gagtccagtagttaggacagag

SEQ ID NO: 7552619 - DNA, 22 bp, Homo sapiens
gagtccagtgtttaccaggggt

SEQ ID NO: 7552620 - DNA, 22 bp, Homo sapiens
gagtccagtgtttaccaggggt

SEQ ID NO: 7552621 - DNA, 22 bp, Homo sapiens
gagtccagttagtgaggctggg

SEQ ID NO: 7552622 - DNA, 22 bp, Homo sapiens
gagtccagttagtgaggctggg

SEQ ID NO: 7552623 - DNA, 22 bp, Homo sapiens
gagtccagttagtgaggctggg

SEQ ID NO: 7552624 - DNA, 22 bp, Homo sapiens
gagtccagttagtgaggctggg

SEQ ID NO: 7552625 - DNA, 22 bp, Homo sapiens
gagtccagttagtgaggctggg

SEQ ID NO: 7552626 - DNA, 22 bp, Homo sapiens
gagtccagttagtgaggctggg

SEQ ID NO: 7552627 - DNA, 22 bp, Homo sapiens
gagtccagttagtgaggctggg

SEQ ID NO: 7552628 - DNA, 22 bp, Homo sapiens
gagtccagttagtgaggctggg

SEQ ID NO: 7552629 - DNA, 22 bp, Homo sapiens
gagtccagttagtgaggctggg

SEQ ID NO: 7552630 - DNA, 22 bp, Homo sapiens
gagtccagttctttccagcagt

SEQ ID NO: 7552631 - DNA, 22 bp, Homo sapiens
gagtccagttctttccagcagt

SEQ ID NO: 7552632 - DNA, 22 bp, Homo sapiens
gagtccagttctttccagcagt

SEQ ID NO: 7552633 - DNA, 22 bp, Homo sapiens
gagtccagttagtgaggctggg

SEQ ID NO: 7552634 - DNA, 22 bp, Homo sapiens
gagtccagttagtgaggctggg

SEQ ID NO: 7552635 - DNA, 23 bp, Homo sapiens
gagtgcagaatagacatgcagtg

SEQ ID NO: 7552636 - DNA, 23 bp, Homo sapiens
gagtgcagaatagacatgcagtg

SEQ ID NO: 7552637 - DNA, 22 bp, Homo sapiens
gagtccagttctttccagcagt

SEQ ID NO: 7552638 - DNA, 22 bp, Homo sapiens
gagtccagttctttccagcagt

SEQ ID NO: 7552639 - DNA, 21 bp, Homo sapiens
gagtgcaggtctgatgccatc

SEQ ID NO: 7552640 - DNA, 21 bp, Homo sapiens
gagtgcaggtctgatgccatc

SEQ ID NO: 7552641 - DNA, 22 bp, Homo sapiens
gagtgcaggcctgagcaccatc

SEQ ID NO: 7552642 - DNA, 22 bp, Homo sapiens
gagtgcaggcctgagcaccatc

SEQ ID NO: 7552643 - DNA, 22 bp, Homo sapiens
gagtgcaggcctgagcaccatc

SEQ ID NO: 7552644 - DNA, 22 bp, Homo sapiens
gagtgcaggcctgagcaccatc

SEQ ID NO: 7552645 - DNA, 22 bp, Homo sapiens
gagtgcaggcctgagcaccatc

SEQ ID NO: 7552646 - DNA, 22 bp, Homo sapiens
gagtgcagatgccagccccagt

SEQ ID NO: 7552647 - DNA, 22 bp, Homo sapiens
gagtgcagatgccagccccagt

SEQ ID NO: 7552648 - DNA, 22 bp, Homo sapiens
gagtgcagatgccagccccagt

SEQ ID NO: 7552649 - DNA, 22 bp, Homo sapiens
gagtgcagatgccagccccagt

SEQ ID NO: 7552650 - DNA, 21 bp, Homo sapiens
gagtgcagcaaggtagagtct

SEQ ID NO: 7552651 - DNA, 22 bp, Homo sapiens
gagtgcagatgccagccccagt

SEQ ID NO: 7552652 - DNA, 21 bp, Homo sapiens
gagtgcagcaaggtagagtct

SEQ ID NO: 7552653 - DNA, 21 bp, Homo sapiens
gagtgcagcaaggtagagtct

SEQ ID NO: 7552654 - DNA, 21 bp, Homo sapiens
gagtgcagcaaggtagagtct

SEQ ID NO: 7552655 - DNA, 21 bp, Homo sapiens
gagtgcagcaaggtagagtct

SEQ ID NO: 7552656 - DNA, 22 bp, Homo sapiens
gagtgcagatgaacagaagatt

SEQ ID NO: 7552657 - DNA, 22 bp, Homo sapiens
gagtgcagatgaacagaagatt

SEQ ID NO: 7552658 - DNA, 17 bp, Homo sapiens
gagtgcagacacaagca

SEQ ID NO: 7552659 - DNA, 17 bp, Homo sapiens
gagtgcagacacaagca

SEQ ID NO: 7552660 - DNA, 22 bp, Homo sapiens
gagtgcagatgaacagaagatt

SEQ ID NO: 7552661 - DNA, 23 bp, Homo sapiens
gagtgcagaatagacatgcagtg

SEQ ID NO: 7552662 - DNA, 17 bp, Homo sapiens
gagtgcagacacaagca

SEQ ID NO: 7552663 - DNA, 23 bp, Homo sapiens
gagtgcagaatagacatgcagtg

SEQ ID NO: 7552664 - DNA, 23 bp, Homo sapiens
gagtgcagaatagacatgcagtg

SEQ ID NO: 7552665 - DNA, 23 bp, Homo sapiens
gagtgcagaatagacatgcagtg

SEQ ID NO: 7552666 - DNA, 23 bp, Homo sapiens
gagtgcagaatagacatgcagtg

SEQ ID NO: 7552667 - DNA, 23 bp, Homo sapiens
gagtgcagaatagacatgcagtg

SEQ ID NO: 7552668 - DNA, 23 bp, Homo sapiens
gagtgcagaatagacatgcagtg

SEQ ID NO: 7552669 - DNA, 22 bp, Homo sapiens
atgtttcatttagatatcaggc

SEQ ID NO: 7552670 - DNA, 22 bp, Homo sapiens
atgtttcatgactgagcaaaat

SEQ ID NO: 7552671 - DNA, 22 bp, Homo sapiens
atgtttcatgactgagcaaaat

SEQ ID NO: 7552672 - DNA, 22 bp, Homo sapiens
atgtttcatgactgagcaaaat

SEQ ID NO: 7552673 - DNA, 22 bp, Homo sapiens
atgtttcatcagtaaggttttg

SEQ ID NO: 7552674 - DNA, 22 bp, Homo sapiens
atgtttcatccactggcctttc

SEQ ID NO: 7552675 - DNA, 22 bp, Homo sapiens
atgtttcatcagtaaggttttg

SEQ ID NO: 7552676 - DNA, 22 bp, Homo sapiens
atgtttcagttctaaagttaga

SEQ ID NO: 7552677 - DNA, 22 bp, Homo sapiens
gagttaaatattttctgaagtt

SEQ ID NO: 7552678 - DNA, 22 bp, Homo sapiens
gagttaaatagcttaggattca

SEQ ID NO: 7552679 - DNA, 22 bp, Homo sapiens
gagttaaatgacttggttaagg

SEQ ID NO: 7552680 - DNA, 22 bp, Homo sapiens
gagttaaatgacttggttaagg

SEQ ID NO: 7552681 - DNA, 22 bp, Homo sapiens
gagttaagggaaagttgtggta

SEQ ID NO: 7552682 - DNA, 22 bp, Homo sapiens
gagttaatactgagtttattaa

SEQ ID NO: 7552683 - DNA, 22 bp, Homo sapiens
atgtttcatgactgagcaaaat

SEQ ID NO: 7552684 - DNA, 22 bp, Homo sapiens
atgtttcatttagatatcaggc

SEQ ID NO: 7552685 - DNA, 22 bp, Homo sapiens
gagttaaagtacctttgtatgt

SEQ ID NO: 7552686 - DNA, 22 bp, Homo sapiens
gagttaaatagcttaggattca

SEQ ID NO: 7552687 - DNA, 22 bp, Homo sapiens
atgtttcaggaaatcagctaga

SEQ ID NO: 7552688 - DNA, 22 bp, Homo sapiens
atgtttcaggaaatcagctaga

SEQ ID NO: 7552689 - DNA, 22 bp, Homo sapiens
atgtttcaggaaatcagctaga

SEQ ID NO: 7552690 - DNA, 22 bp, Homo sapiens
atgtttcaggaaatcagctaga

SEQ ID NO: 7552691 - DNA, 22 bp, Homo sapiens
atgtttcaggaaatcagctaga

SEQ ID NO: 7552692 - DNA, 22 bp, Homo sapiens
atgtttcaggaaatcagctaga

SEQ ID NO: 7552693 - DNA, 22 bp, Homo sapiens
atgtttcagatacagatcaaat

SEQ ID NO: 7552694 - DNA, 22 bp, Homo sapiens
atgtttcagatacagatcaaat

SEQ ID NO: 7552695 - DNA, 22 bp, Homo sapiens
atgtttcagatacagatcaaat

SEQ ID NO: 7552696 - DNA, 22 bp, Homo sapiens
atgtttcaccagttttataaga

SEQ ID NO: 7552697 - DNA, 22 bp, Homo sapiens
atgtttcagttctaaagttaga

SEQ ID NO: 7552698 - DNA, 22 bp, Homo sapiens
atgtttcagttctaaagttaga

SEQ ID NO: 7552699 - DNA, 22 bp, Homo sapiens
atgtttcagggtgatagaaggt

SEQ ID NO: 7552700 - DNA, 22 bp, Homo sapiens
atgtttcagggtgatagaaggt

SEQ ID NO: 7552701 - DNA, 22 bp, Homo sapiens
atgtttcagggtgatagaaggt

SEQ ID NO: 7552702 - DNA, 22 bp, Homo sapiens
atgtttcaggcgaactaacatg

SEQ ID NO: 7552703 - DNA, 22 bp, Homo sapiens
atgtttcaggcgaactaacatg

SEQ ID NO: 7552704 - DNA, 22 bp, Homo sapiens
atgtttcaggcgaactaacatg

SEQ ID NO: 7552705 - DNA, 22 bp, Homo sapiens
atgtttcaggcgaactaacatg

SEQ ID NO: 7552706 - DNA, 22 bp, Homo sapiens
atgtttcaggcgaactaacatg

SEQ ID NO: 7552707 - DNA, 20 bp, Homo sapiens
atgtttaatgttgtccaccc

SEQ ID NO: 7552708 - DNA, 22 bp, Homo sapiens
atgtttaattatctgggttttg

SEQ ID NO: 7552709 - DNA, 22 bp, Homo sapiens
atgtttaattatctgggttttg

SEQ ID NO: 7552710 - DNA, 22 bp, Homo sapiens
atgtttaattatctgggttttg

SEQ ID NO: 7552711 - DNA, 21 bp, Homo sapiens
gagtgcaggtctgatgccatc

SEQ ID NO: 7552712 - DNA, 21 bp, Homo sapiens
gagtgcaggtctgatgccatc

SEQ ID NO: 7552713 - DNA, 21 bp, Homo sapiens
gagtgcaggtctgatgccatc

SEQ ID NO: 7552714 - DNA, 21 bp, Homo sapiens
gagtgcaggtctgatgccatc

SEQ ID NO: 7552715 - DNA, 22 bp, Homo sapiens
atgtttattttgcagagtaggg

SEQ ID NO: 7552716 - DNA, 22 bp, Homo sapiens
atgtttattttgcagagtaggg

SEQ ID NO: 7552717 - DNA, 22 bp, Homo sapiens
atgtttacaaaaaggaggcttg

SEQ ID NO: 7552718 - DNA, 22 bp, Homo sapiens
atgtttaattatctgggttttg

SEQ ID NO: 7552719 - DNA, 22 bp, Homo sapiens
atgtttattgttttaagctgct

SEQ ID NO: 7552720 - DNA, 22 bp, Homo sapiens
atgtttattgttttaagctgct

SEQ ID NO: 7552721 - DNA, 22 bp, Homo sapiens
atgtttcaccagcaaattacct

SEQ ID NO: 7552722 - DNA, 22 bp, Homo sapiens
atgtttcaccagcaaattacct

SEQ ID NO: 7552723 - DNA, 22 bp, Homo sapiens
atgtttcaccagcaaattacct

SEQ ID NO: 7552724 - DNA, 22 bp, Homo sapiens
atgtttcaccagcaaattacct

SEQ ID NO: 7552725 - DNA, 22 bp, Homo sapiens
atgtttcaccagttttataaga

SEQ ID NO: 7552726 - DNA, 22 bp, Homo sapiens
atgtttcaccagttttataaga

SEQ ID NO: 7552727 - DNA, 22 bp, Homo sapiens
atgtttcaccagttttataaga

SEQ ID NO: 7552728 - DNA, 22 bp, Homo sapiens
atgtttcaccagttttataaga

SEQ ID NO: 7552729 - DNA, 22 bp, Homo sapiens
atgtttcaccagttttataaga

SEQ ID NO: 7552730 - DNA, 22 bp, Homo sapiens
atgtttcaccagttttataaga

SEQ ID NO: 7552731 - DNA, 22 bp, Homo sapiens
atgtttcaaatatatagagttg

SEQ ID NO: 7552732 - DNA, 22 bp, Homo sapiens
atgtttcaaatatatagagttg

SEQ ID NO: 7552733 - DNA, 22 bp, Homo sapiens
atgtttcaaatatatagagttg

SEQ ID NO: 7552734 - DNA, 22 bp, Homo sapiens
atgtttcaaatatatagagttg

SEQ ID NO: 7552735 - DNA, 22 bp, Homo sapiens
atgtttcaagagaaaaagagac

SEQ ID NO: 7552736 - DNA, 22 bp, Homo sapiens
atgtttcaagagaaaaagagac

SEQ ID NO: 7552737 - DNA, 22 bp, Homo sapiens
atgtttcaaatatatagagttg

SEQ ID NO: 7552738 - DNA, 22 bp, Homo sapiens
atgtttcaagagaaaaagagac

SEQ ID NO: 7552739 - DNA, 22 bp, Homo sapiens
atgtttcaagagaaaaagagac

SEQ ID NO: 7552740 - DNA, 22 bp, Homo sapiens
atgtttcaatgcactttagcct

SEQ ID NO: 7552741 - DNA, 22 bp, Homo sapiens
caaatgaatatttccatgggtt

SEQ ID NO: 7552742 - DNA, 22 bp, Homo sapiens
caaatgaatatttccatgggtt

SEQ ID NO: 7552743 - DNA, 22 bp, Homo sapiens
caaatgaatttccctgcaaatg

SEQ ID NO: 7552744 - DNA, 22 bp, Homo sapiens
caaatgaatttccctgcaaatg

SEQ ID NO: 7552745 - DNA, 22 bp, Homo sapiens
caaatgaatatttccatgggtt

SEQ ID NO: 7552746 - DNA, 22 bp, Homo sapiens
caaatgaatatttccatgggtt

SEQ ID NO: 7552747 - DNA, 22 bp, Homo sapiens
caaatgaatatttccatgggtt

SEQ ID NO: 7552748 - DNA, 22 bp, Homo sapiens
caaatgaatatttccatgggtt

SEQ ID NO: 7552749 - DNA, 22 bp, Homo sapiens
caaatgaatagggagtgtgatg

SEQ ID NO: 7552750 - DNA, 22 bp, Homo sapiens
caaatgaatagggagtgtgatg

SEQ ID NO: 7552751 - DNA, 22 bp, Homo sapiens
caaatgtgtagagcttttgggg

SEQ ID NO: 7552752 - DNA, 22 bp, Homo sapiens
caaatgtgttttttcttctaca

SEQ ID NO: 7552753 - DNA, 22 bp, Homo sapiens
caaatgtgttttttcttctaca

SEQ ID NO: 7552754 - DNA, 22 bp, Homo sapiens
caaatgaatttccctgcaaatg

SEQ ID NO: 7552755 - DNA, 22 bp, Homo sapiens
caaatgaatttccctgcaaatg

SEQ ID NO: 7552756 - DNA, 22 bp, Homo sapiens
caaatgaatttccctgcaaatg

SEQ ID NO: 7552757 - DNA, 22 bp, Homo sapiens
caaatgaatttccctgcaaatg

SEQ ID NO: 7552758 - DNA, 22 bp, Homo sapiens
caaatgaatttccctgcaaatg

SEQ ID NO: 7552759 - DNA, 22 bp, Homo sapiens
caaatgaatttccctgcaaatg

SEQ ID NO: 7552760 - DNA, 22 bp, Homo sapiens
caaatgaatttccctgcaaatg

SEQ ID NO: 7552761 - DNA, 22 bp, Homo sapiens
caaattcaaatttcatcagtgt

SEQ ID NO: 7552762 - DNA, 22 bp, Homo sapiens
caaattcaaatttcatcagtgt

SEQ ID NO: 7552763 - DNA, 22 bp, Homo sapiens
caaattcaaatttcatcagtgt

SEQ ID NO: 7552764 - DNA, 22 bp, Homo sapiens
caaattaccctcaacatctaga

SEQ ID NO: 7552765 - DNA, 22 bp, Homo sapiens
caaattaccctcaacatctaga

SEQ ID NO: 7552766 - DNA, 22 bp, Homo sapiens
caaattaccctcaacatctaga

SEQ ID NO: 7552767 - DNA, 22 bp, Homo sapiens
caaattaccctcaacatctaga

SEQ ID NO: 7552768 - DNA, 22 bp, Homo sapiens
caaatgtgttttttcttctaca

SEQ ID NO: 7552769 - DNA, 22 bp, Homo sapiens
caaattaccctcaacatctaga

SEQ ID NO: 7552770 - DNA, 22 bp, Homo sapiens
caaattaccctcaacatctaga

SEQ ID NO: 7552771 - DNA, 22 bp, Homo sapiens
caaattcaaatttcatcagtgt

SEQ ID NO: 7552772 - DNA, 22 bp, Homo sapiens
caaattcaatgaacatgtttaa

SEQ ID NO: 7552773 - DNA, 22 bp, Homo sapiens
caaattcaatgaacatgtttaa

SEQ ID NO: 7552774 - DNA, 22 bp, Homo sapiens
caaattcaatgaacatgtttaa

SEQ ID NO: 7552775 - DNA, 22 bp, Homo sapiens
caaattcaatgaacatgtttaa

SEQ ID NO: 7552776 - DNA, 22 bp, Homo sapiens
caaattcacatgattgcttctg

SEQ ID NO: 7552777 - DNA, 22 bp, Homo sapiens
caaattcaatgaacatgtttaa

SEQ ID NO: 7552778 - DNA, 22 bp, Homo sapiens
caaattcacatgattgcttctg

SEQ ID NO: 7552779 - DNA, 22 bp, Homo sapiens
caaattcagaaaattggtagag

SEQ ID NO: 7552780 - DNA, 22 bp, Homo sapiens
caaatgaagagggcaacttctg

SEQ ID NO: 7552781 - DNA, 22 bp, Homo sapiens
caaatgaagagggcaacttctg

SEQ ID NO: 7552782 - DNA, 22 bp, Homo sapiens
caaatgaagagggcaacttctg

SEQ ID NO: 7552783 - DNA, 22 bp, Homo sapiens
caaatgaagagggcaacttctg

SEQ ID NO: 7552784 - DNA, 22 bp, Homo sapiens
caaatgaagagggcaacttctg

SEQ ID NO: 7552785 - DNA, 22 bp, Homo sapiens
gctgaggaggtgtggttaggtg

SEQ ID NO: 7552786 - DNA, 22 bp, Homo sapiens
caaatgaagaaccttctcacct

SEQ ID NO: 7552787 - DNA, 22 bp, Homo sapiens
caaatgaagaaccttctcacct

SEQ ID NO: 7552788 - DNA, 22 bp, Homo sapiens
gctgaggagcgagaactctgct

SEQ ID NO: 7552789 - DNA, 22 bp, Homo sapiens
gctgaggagcgagaactctgct

SEQ ID NO: 7552790 - DNA, 22 bp, Homo sapiens
gctgaggaggtgtggttaggtg

SEQ ID NO: 7552791 - DNA, 22 bp, Homo sapiens
gctgaggaggtgtggttaggtg

SEQ ID NO: 7552792 - DNA, 22 bp, Homo sapiens
gctgaggaggtgtggttaggtg

SEQ ID NO: 7552793 - DNA, 22 bp, Homo sapiens
gctgaggaggtgtggttaggtg

SEQ ID NO: 7552794 - DNA, 22 bp, Homo sapiens
caaatgaagggagctgaagtct

SEQ ID NO: 7552795 - DNA, 20 bp, Homo sapiens
caaatgaagctgttggcctc

SEQ ID NO: 7552796 - DNA, 20 bp, Homo sapiens
caaatgaagctgttggcctc

SEQ ID NO: 7552797 - DNA, 20 bp, Homo sapiens
caaatgaagctgttggcctc

SEQ ID NO: 7552798 - DNA, 22 bp, Homo sapiens
caaatgaagggagctgaagtct

SEQ ID NO: 7552799 - DNA, 22 bp, Homo sapiens
caaatgaagggagctgaagtct

SEQ ID NO: 7552800 - DNA, 22 bp, Homo sapiens
caaatgaagggagctgaagtct

SEQ ID NO: 7552801 - DNA, 22 bp, Homo sapiens
caaatgaagggagctgaagtct

SEQ ID NO: 7552802 - DNA, 22 bp, Homo sapiens
caaatgaagggagctgaagtct

SEQ ID NO: 7552803 - DNA, 22 bp, Homo sapiens
caaatgaagagggcaacttctg

SEQ ID NO: 7552804 - DNA, 22 bp, Homo sapiens
caaatgaagagggcaacttctg

SEQ ID NO: 7552805 - DNA, 22 bp, Homo sapiens
caaatgaagagggcaacttctg

SEQ ID NO: 7552806 - DNA, 20 bp, Homo sapiens
caaatgaagctgttggcctc

SEQ ID NO: 7552807 - DNA, 22 bp, Homo sapiens
caaatgaagagggcaacttctg

SEQ ID NO: 7552808 - DNA, 20 bp, Homo sapiens
caaatgaagctgttggcctc

SEQ ID NO: 7552809 - DNA, 22 bp, Homo sapiens
caaatgaatagggagtgtgatg

SEQ ID NO: 7552810 - DNA, 22 bp, Homo sapiens
caaatgaatagggagtgtgatg

SEQ ID NO: 7552811 - DNA, 22 bp, Homo sapiens
caaatgaagtccaaagggctta

SEQ ID NO: 7552812 - DNA, 22 bp, Homo sapiens
caaatgaatagggagtgtgatg

SEQ ID NO: 7552813 - DNA, 22 bp, Homo sapiens
caaatgaatagggagtgtgatg

SEQ ID NO: 7552814 - DNA, 22 bp, Homo sapiens
caaatgaatagggagtgtgatg

SEQ ID NO: 7552815 - DNA, 22 bp, Homo sapiens
caaatgaatagggagtgtgatg

SEQ ID NO: 7552816 - DNA, 22 bp, Homo sapiens
caaatgaatagggagtgtgatg

SEQ ID NO: 7552817 - DNA, 22 bp, Homo sapiens
caaatgaagtccaaagggctta

SEQ ID NO: 7552818 - DNA, 22 bp, Homo sapiens
caaatgaagtccaaagggctta

SEQ ID NO: 7552819 - DNA, 22 bp, Homo sapiens
caaatgaagtccaaagggctta

SEQ ID NO: 7552820 - DNA, 22 bp, Homo sapiens
caaatgaagtccaaagggctta

SEQ ID NO: 7552821 - DNA, 22 bp, Homo sapiens
caaatgaagtccaaagggctta

SEQ ID NO: 7552822 - DNA, 22 bp, Homo sapiens
caaatgaaggtggtgggtcatt

SEQ ID NO: 7552823 - DNA, 22 bp, Homo sapiens
caaatgaaggtggtgggtcatt

SEQ ID NO: 7552824 - DNA, 22 bp, Homo sapiens
caaatgaaggtggtgggtcatt

SEQ ID NO: 7552825 - DNA, 22 bp, Homo sapiens
caaatgaaggtggtgggtcatt

SEQ ID NO: 7552826 - DNA, 22 bp, Homo sapiens
caaatgaaggtggtgggtcatt

SEQ ID NO: 7552827 - DNA, 22 bp, Homo sapiens
caaatgaaggtggtgggtcatt

SEQ ID NO: 7552828 - DNA, 22 bp, Homo sapiens
caaatgaagggagctgaagtct

SEQ ID NO: 7552829 - DNA, 22 bp, Homo sapiens
caaatgaagggagctgaagtct

SEQ ID NO: 7552830 - DNA, 22 bp, Homo sapiens
caaatgaagggagctgaagtct

SEQ ID NO: 7552831 - DNA, 22 bp, Homo sapiens
caaatgaagggagctgaagtct

SEQ ID NO: 7552832 - DNA, 22 bp, Homo sapiens
gctgagaacagagctctgagct

SEQ ID NO: 7552833 - DNA, 22 bp, Homo sapiens
gctgagaacagagctctgagct

SEQ ID NO: 7552834 - DNA, 22 bp, Homo sapiens
gctgagaaatgcagacatgctg

SEQ ID NO: 7552835 - DNA, 22 bp, Homo sapiens
gctgactttgcctgtctttagc

SEQ ID NO: 7552836 - DNA, 22 bp, Homo sapiens
gctgagaacagagctctgagct

SEQ ID NO: 7552837 - DNA, 22 bp, Homo sapiens
gctgagaaatgcagacatgctg

SEQ ID NO: 7552838 - DNA, 22 bp, Homo sapiens
gctgagctgaggcagggctggg

SEQ ID NO: 7552839 - DNA, 22 bp, Homo sapiens
gctgagctgctgttcatcctgc

SEQ ID NO: 7552840 - DNA, 22 bp, Homo sapiens
gctgagctgaggcagggctggg

SEQ ID NO: 7552841 - DNA, 22 bp, Homo sapiens
gctgagctgaggcagggctggg

SEQ ID NO: 7552842 - DNA, 22 bp, Homo sapiens
gctgagctgggacagtcctggg

SEQ ID NO: 7552843 - DNA, 22 bp, Homo sapiens
gctgagctgggacagtcctggg

SEQ ID NO: 7552844 - DNA, 22 bp, Homo sapiens
gctgagctgggacagtcctggg

SEQ ID NO: 7552845 - DNA, 22 bp, Homo sapiens
gctgagctgggacagtcctggg

SEQ ID NO: 7552846 - DNA, 22 bp, Homo sapiens
gctgactttgcctgtctttagc

SEQ ID NO: 7552847 - DNA, 22 bp, Homo sapiens
gctgagaaatgcagacatgctg

SEQ ID NO: 7552848 - DNA, 20 bp, Homo sapiens
gctgactgtttgggtggcgg

SEQ ID NO: 7552849 - DNA, 22 bp, Homo sapiens
gctctggtgagtgtagttcagg

SEQ ID NO: 7552850 - DNA, 22 bp, Homo sapiens
gctctggtggtgatcagacgct

SEQ ID NO: 7552851 - DNA, 22 bp, Homo sapiens
gctctgggttctgatttatgag

SEQ ID NO: 7552852 - DNA, 22 bp, Homo sapiens
gctctgggttctgatttatgag

SEQ ID NO: 7552853 - DNA, 22 bp, Homo sapiens
gctctggtaccagctactccta

SEQ ID NO: 7552854 - DNA, 22 bp, Homo sapiens
gctctggtagatcctcaggctc

SEQ ID NO: 7552855 - DNA, 22 bp, Homo sapiens
gctctggtagatcctcaggctc

SEQ ID NO: 7552856 - DNA, 22 bp, Homo sapiens
gctctggtagatcctcaggctc

SEQ ID NO: 7552857 - DNA, 22 bp, Homo sapiens
gctgaggaagtcaggtggccca

SEQ ID NO: 7552858 - DNA, 22 bp, Homo sapiens
gctgaggaagtcaggtggccca

SEQ ID NO: 7552859 - DNA, 22 bp, Homo sapiens
gctgaggacatacacattgtgc

SEQ ID NO: 7552860 - DNA, 22 bp, Homo sapiens
gctgaggacatcatggaaggaa

SEQ ID NO: 7552861 - DNA, 22 bp, Homo sapiens
gctgaggacatacacattgtgc

SEQ ID NO: 7552862 - DNA, 22 bp, Homo sapiens
gctgaggacatacacattgtgc

SEQ ID NO: 7552863 - DNA, 22 bp, Homo sapiens
gctgaggacatacacattgtgc

SEQ ID NO: 7552864 - DNA, 22 bp, Homo sapiens
gctgaggacatcatggaaggaa

SEQ ID NO: 7552865 - DNA, 22 bp, Homo sapiens
gctgaggacatcatggaaggaa

SEQ ID NO: 7552866 - DNA, 22 bp, Homo sapiens
gctgaggacatcatggaaggaa

SEQ ID NO: 7552867 - DNA, 22 bp, Homo sapiens
gctgaggacatcatggaaggaa

SEQ ID NO: 7552868 - DNA, 22 bp, Homo sapiens
gctgaggacatcatggaaggaa

SEQ ID NO: 7552869 - DNA, 20 bp, Homo sapiens
gctgaggagcagtgtggttg

SEQ ID NO: 7552870 - DNA, 20 bp, Homo sapiens
gctgaggagcagtgtggttg

SEQ ID NO: 7552871 - DNA, 20 bp, Homo sapiens
gctgaggagcagtgtggttg

SEQ ID NO: 7552872 - DNA, 20 bp, Homo sapiens
gctgaggagcagtgtggttg

SEQ ID NO: 7552873 - DNA, 22 bp, Homo sapiens
gctgaggaaaccaatgctcaga

SEQ ID NO: 7552874 - DNA, 22 bp, Homo sapiens
gctgaggaaaccaatgctcaga

SEQ ID NO: 7552875 - DNA, 22 bp, Homo sapiens
gctgaggaaaccaatgctcaga

SEQ ID NO: 7552876 - DNA, 22 bp, Homo sapiens
gctgaggaaaccaatgctcaga

SEQ ID NO: 7552877 - DNA, 22 bp, Homo sapiens
gctgagctgggacagtcctggg

SEQ ID NO: 7552878 - DNA, 22 bp, Homo sapiens
gctgaggaaaccaatgctcaga

SEQ ID NO: 7552879 - DNA, 22 bp, Homo sapiens
gctgaggaaaccaatgctcaga

SEQ ID NO: 7552880 - DNA, 22 bp, Homo sapiens
gctgaggaaaccaatgctcaga

SEQ ID NO: 7552881 - DNA, 22 bp, Homo sapiens
gctgaggaaaccaatgctcaga

SEQ ID NO: 7552882 - DNA, 22 bp, Homo sapiens
gctgaggaaaggctggaaggga

SEQ ID NO: 7552883 - DNA, 22 bp, Homo sapiens
gctgaggaaaccaatgctcaga

SEQ ID NO: 7552884 - DNA, 22 bp, Homo sapiens
gctgaggaaaggctggaaggga

SEQ ID NO: 7552885 - DNA, 22 bp, Homo sapiens
gctgaggaaaggctggaaggga

SEQ ID NO: 7552886 - DNA, 22 bp, Homo sapiens
gctgaggaaaggctggaaggga

SEQ ID NO: 7552887 - DNA, 22 bp, Homo sapiens
gctgaggaaaggctggaaggga

SEQ ID NO: 7552888 - DNA, 22 bp, Homo sapiens
gctgaggaagtcaggtggccca

SEQ ID NO: 7552889 - DNA, 22 bp, Homo sapiens
gctgaggaagtcaggtggccca

SEQ ID NO: 7552890 - DNA, 22 bp, Homo sapiens
gctgaggaaggtttcttatcaa

SEQ ID NO: 7552891 - DNA, 22 bp, Homo sapiens
gctgaggaagtcaggtggccca

SEQ ID NO: 7552892 - DNA, 22 bp, Homo sapiens
gctgaggaagtcaggtggccca

SEQ ID NO: 7552893 - DNA, 22 bp, Homo sapiens
gctgaggaaaggctggaaggga

SEQ ID NO: 7552894 - DNA, 22 bp, Homo sapiens
caaatcatggaataactagaga

SEQ ID NO: 7552895 - DNA, 22 bp, Homo sapiens
caaatcatggaataactagaga

SEQ ID NO: 7552896 - DNA, 22 bp, Homo sapiens
caaatcatggaataactagaga

SEQ ID NO: 7552897 - DNA, 22 bp, Homo sapiens
caaatcatggaataactagaga

SEQ ID NO: 7552898 - DNA, 22 bp, Homo sapiens
caaatcatggaataactagaga

SEQ ID NO: 7552899 - DNA, 22 bp, Homo sapiens
caaatcatggaataactagaga

SEQ ID NO: 7552900 - DNA, 22 bp, Homo sapiens
caaatcatggctctagcttaca

SEQ ID NO: 7552901 - DNA, 22 bp, Homo sapiens
caaatcatggctctagcttaca

SEQ ID NO: 7552902 - DNA, 22 bp, Homo sapiens
caaatcatggctctagcttaca

SEQ ID NO: 7552903 - DNA, 22 bp, Homo sapiens
caaatcatggaataactagaga

SEQ ID NO: 7552904 - DNA, 22 bp, Homo sapiens
caaatcatggaataactagaga

SEQ ID NO: 7552905 - DNA, 22 bp, Homo sapiens
caaatcatggaataactagaga

SEQ ID NO: 7552906 - DNA, 22 bp, Homo sapiens
caaatccagatcccagtcgtag

SEQ ID NO: 7552907 - DNA, 22 bp, Homo sapiens
caaatccagatcccagtcgtag

SEQ ID NO: 7552908 - DNA, 22 bp, Homo sapiens
caaatccagatcccagtcgtag

SEQ ID NO: 7552909 - DNA, 20 bp, Homo sapiens
caaatccctgctctgtgctg

SEQ ID NO: 7552910 - DNA, 20 bp, Homo sapiens
caaatccctgctctgtgctg

SEQ ID NO: 7552911 - DNA, 20 bp, Homo sapiens
caaatccctgctctgtgctg

SEQ ID NO: 7552912 - DNA, 22 bp, Homo sapiens
caaatcatggctctagcttaca

SEQ ID NO: 7552913 - DNA, 22 bp, Homo sapiens
caaatctaggatgcatgtagtg

SEQ ID NO: 7552914 - DNA, 22 bp, Homo sapiens
caaatctaggatgcatgtagtg

SEQ ID NO: 7552915 - DNA, 22 bp, Homo sapiens
caaatctaggatgcatgtagtg

SEQ ID NO: 7552916 - DNA, 22 bp, Homo sapiens
caaatcctggagccatggtaac

SEQ ID NO: 7552917 - DNA, 22 bp, Homo sapiens
caaatctacatgaacccaaaga

SEQ ID NO: 7552918 - DNA, 22 bp, Homo sapiens
caaatcctggagccatggtaac

SEQ ID NO: 7552919 - DNA, 22 bp, Homo sapiens
caaatcctcacctcatcatgaa

SEQ ID NO: 7552920 - DNA, 20 bp, Homo sapiens
caaatccctgctctgtgctg

SEQ ID NO: 7552921 - DNA, 17 bp, Homo sapiens
caaatcctaggatgtct

SEQ ID NO: 7552922 - DNA, 22 bp, Homo sapiens
caaatctccttaaaggtaaaat

SEQ ID NO: 7552923 - DNA, 22 bp, Homo sapiens
caaatctccttaaaggtaaaat

SEQ ID NO: 7552924 - DNA, 22 bp, Homo sapiens
caaatctatatgttgatattct

SEQ ID NO: 7552925 - DNA, 22 bp, Homo sapiens
caaatctctgctactagctatg

SEQ ID NO: 7552926 - DNA, 22 bp, Homo sapiens
caaatctatatgttgatattct

SEQ ID NO: 7552927 - DNA, 22 bp, Homo sapiens
caaatctatatgttgatattct

SEQ ID NO: 7552928 - DNA, 22 bp, Homo sapiens
caaatctaggatgcatgtagtg

SEQ ID NO: 7552929 - DNA, 22 bp, Homo sapiens
gctctgggttctgatttatgag

SEQ ID NO: 7552930 - DNA, 22 bp, Homo sapiens
gctctgggttctgatttatgag

SEQ ID NO: 7552931 - DNA, 22 bp, Homo sapiens
gctctgggttctgatttatgag

SEQ ID NO: 7552932 - DNA, 20 bp, Homo sapiens
gctctgggtggtaaatgact

SEQ ID NO: 7552933 - DNA, 20 bp, Homo sapiens
gctctgggtggtaaatgact

SEQ ID NO: 7552934 - DNA, 22 bp, Homo sapiens
gctctgggtgaatggcagattg

SEQ ID NO: 7552935 - DNA, 22 bp, Homo sapiens
gctctgggtgaatggcagattg

SEQ ID NO: 7552936 - DNA, 22 bp, Homo sapiens
gctctgggtgaatggcagattg

SEQ ID NO: 7552937 - DNA, 22 bp, Homo sapiens
gctctgggtgaagggtaccatt

SEQ ID NO: 7552938 - DNA, 22 bp, Homo sapiens
gctctgggtgaagggtaccatt

SEQ ID NO: 7552939 - DNA, 22 bp, Homo sapiens
gctctgggtgaagggtaccatt

SEQ ID NO: 7552940 - DNA, 22 bp, Homo sapiens
gctctgggtgaagggtaccatt

SEQ ID NO: 7552941 - DNA, 22 bp, Homo sapiens
gctctgggtgaagggtaccatt

SEQ ID NO: 7552942 - DNA, 22 bp, Homo sapiens
gctctgggtgaatggcagattg

SEQ ID NO: 7552943 - DNA, 22 bp, Homo sapiens
gctctgggtgaatggcagattg

SEQ ID NO: 7552944 - DNA, 22 bp, Homo sapiens
gctctgggtgaatggcagattg

SEQ ID NO: 7552945 - DNA, 22 bp, Homo sapiens
gctctgggtgaatggcagattg

SEQ ID NO: 7552946 - DNA, 22 bp, Homo sapiens
gctctgggtgaatggcagattg

SEQ ID NO: 7552947 - DNA, 22 bp, Homo sapiens
gctctgggtgaatggcagattg

SEQ ID NO: 7552948 - DNA, 22 bp, Homo sapiens
gctctgggtgaagggtaccatt

SEQ ID NO: 7552949 - DNA, 22 bp, Homo sapiens
gctctgggtgaacttggagcaa

SEQ ID NO: 7552950 - DNA, 22 bp, Homo sapiens
gctctgggtgaacttggagcaa

SEQ ID NO: 7552951 - DNA, 22 bp, Homo sapiens
gctctgggtgaacttggagcaa

SEQ ID NO: 7552952 - DNA, 22 bp, Homo sapiens
gctctgggtgaacttggagcaa

SEQ ID NO: 7552953 - DNA, 22 bp, Homo sapiens
gctctgggtgaacttggagcaa

SEQ ID NO: 7552954 - DNA, 22 bp, Homo sapiens
gctctgggtgaacttggagcaa

SEQ ID NO: 7552955 - DNA, 15 bp, Homo sapiens
gctctgggtatttga

SEQ ID NO: 7552956 - DNA, 15 bp, Homo sapiens
gctctgggtatttga

SEQ ID NO: 7552957 - DNA, 22 bp, Homo sapiens
gctctgggtgaacttggagcaa

SEQ ID NO: 7552958 - DNA, 22 bp, Homo sapiens
caaatgaaaatggcgtcttgga

SEQ ID NO: 7552959 - DNA, 22 bp, Homo sapiens
caaatctttaattgaggaatca

SEQ ID NO: 7552960 - DNA, 22 bp, Homo sapiens
caaatgaaaatggcgtcttgga

SEQ ID NO: 7552961 - DNA, 22 bp, Homo sapiens
caaatgaaaatggcgtcttgga

SEQ ID NO: 7552962 - DNA, 22 bp, Homo sapiens
caaatgaaaatggcgtcttgga

SEQ ID NO: 7552963 - DNA, 22 bp, Homo sapiens
caaatgaaaatggcgtcttgga

SEQ ID NO: 7552964 - DNA, 22 bp, Homo sapiens
caaatgaaaatggcgtcttgga

SEQ ID NO: 7552965 - DNA, 22 bp, Homo sapiens
caaatgaagaaccttctcacct

SEQ ID NO: 7552966 - DNA, 22 bp, Homo sapiens
caaatgaagaaccttctcacct

SEQ ID NO: 7552967 - DNA, 22 bp, Homo sapiens
caaatgaagaaccttctcacct

SEQ ID NO: 7552968 - DNA, 22 bp, Homo sapiens
caaatgaagaaccttctcacct

SEQ ID NO: 7552969 - DNA, 22 bp, Homo sapiens
caaatgaagaaccttctcacct

SEQ ID NO: 7552970 - DNA, 22 bp, Homo sapiens
caaatgaagaaccttctcacct

SEQ ID NO: 7552971 - DNA, 22 bp, Homo sapiens
caaatgaagaaccttctcacct

SEQ ID NO: 7552972 - DNA, 20 bp, Homo sapiens
caaatcacaggtaattgcaa

SEQ ID NO: 7552973 - DNA, 22 bp, Homo sapiens
caaatattccaggtacatccct

SEQ ID NO: 7552974 - DNA, 22 bp, Homo sapiens
caaatattccaggtacatccct

SEQ ID NO: 7552975 - DNA, 22 bp, Homo sapiens
caaatattccaggtacatccct

SEQ ID NO: 7552976 - DNA, 22 bp, Homo sapiens
caaatattccaggtacatccct

SEQ ID NO: 7552977 - DNA, 22 bp, Homo sapiens
caaatagacttaagcatctgta

SEQ ID NO: 7552978 - DNA, 22 bp, Homo sapiens
caaatagacttaagcatctgta

SEQ ID NO: 7552979 - DNA, 22 bp, Homo sapiens
caaatagacttcaatctcttga

SEQ ID NO: 7552980 - DNA, 22 bp, Homo sapiens
caaatagacttaagcatctgta

SEQ ID NO: 7552981 - DNA, 22 bp, Homo sapiens
caaatagacttaagcatctgta

SEQ ID NO: 7552982 - DNA, 22 bp, Homo sapiens
caaatattccaggtacatccct

SEQ ID NO: 7552983 - DNA, 22 bp, Homo sapiens
caaatagacttcaatctcttga

SEQ ID NO: 7552984 - DNA, 22 bp, Homo sapiens
caaatagacttcaatctcttga

SEQ ID NO: 7552985 - DNA, 22 bp, Homo sapiens
caaatagacttcaatctcttga

SEQ ID NO: 7552986 - DNA, 22 bp, Homo sapiens
gctctgagaggtgcagcagtaa

SEQ ID NO: 7552987 - DNA, 22 bp, Homo sapiens
gctctgagaggtgcagcagtaa

SEQ ID NO: 7552988 - DNA, 19 bp, Homo sapiens
gctctgagaggggcatggg

SEQ ID NO: 7552989 - DNA, 22 bp, Homo sapiens
gctctgagaggtgcagcagtaa

SEQ ID NO: 7552990 - DNA, 22 bp, Homo sapiens
gctctgagaggtgcagcagtaa

SEQ ID NO: 7552991 - DNA, 22 bp, Homo sapiens
gctctgagaggtgcagcagtaa

SEQ ID NO: 7552992 - DNA, 22 bp, Homo sapiens
gctctgagaggtgcagcagtaa

SEQ ID NO: 7552993 - DNA, 22 bp, Homo sapiens
gctctgagagtgcatgatagca

SEQ ID NO: 7552994 - DNA, 22 bp, Homo sapiens
gctctgagagtgcatgatagca

SEQ ID NO: 7552995 - DNA, 22 bp, Homo sapiens
caaatagactctagaatttatt

SEQ ID NO: 7552996 - DNA, 19 bp, Homo sapiens
gctctgagaggggcatggg

SEQ ID NO: 7552997 - DNA, 19 bp, Homo sapiens
gctctgagaggggcatggg

SEQ ID NO: 7552998 - DNA, 19 bp, Homo sapiens
gctctgagaggggcatggg

SEQ ID NO: 7552999 - DNA, 19 bp, Homo sapiens
gctctgagaggggcatggg

SEQ ID NO: 7553000 - DNA, 19 bp, Homo sapiens
gctctgagaggggcatggg

SEQ ID NO: 7553001 - DNA, 19 bp, Homo sapiens
gctctgagaggggcatggg

SEQ ID NO: 7553002 - DNA, 19 bp, Homo sapiens
gctctgagaggggcatggg

SEQ ID NO: 7553003 - DNA, 19 bp, Homo sapiens
gctctgagaggggcatggg

SEQ ID NO: 7553004 - DNA, 22 bp, Homo sapiens
gctctgagaggatgctgagcag

SEQ ID NO: 7553005 - DNA, 22 bp, Homo sapiens
gctctgagaggatgctgagcag

SEQ ID NO: 7553006 - DNA, 22 bp, Homo sapiens
gctctgaagggtgagctgttcg

SEQ ID NO: 7553007 - DNA, 22 bp, Homo sapiens
gctctgaagggtgagctgttcg

SEQ ID NO: 7553008 - DNA, 20 bp, Homo sapiens
gctctgaaccaagagctgtc

SEQ ID NO: 7553009 - DNA, 20 bp, Homo sapiens
gctctgaaccaagagctgtc

SEQ ID NO: 7553010 - DNA, 22 bp, Homo sapiens
gctctgaacttccaccttttca

SEQ ID NO: 7553011 - DNA, 22 bp, Homo sapiens
gctctgaatcaatcagataagg

SEQ ID NO: 7553012 - DNA, 22 bp, Homo sapiens
gctctgaatcaatcagataagg

SEQ ID NO: 7553013 - DNA, 22 bp, Homo sapiens
gctctgacaaaggccacttaca

SEQ ID NO: 7553014 - DNA, 20 bp, Homo sapiens
gctctgaccatatcaagaca

SEQ ID NO: 7553015 - DNA, 20 bp, Homo sapiens
gctctgaccatatcaagaca

SEQ ID NO: 7553016 - DNA, 22 bp, Homo sapiens
gctctgacacatttgttctacc

SEQ ID NO: 7553017 - DNA, 22 bp, Homo sapiens
gctctgacaaaggccacttaca

SEQ ID NO: 7553018 - DNA, 22 bp, Homo sapiens
gctctgagaagtattatttctt

SEQ ID NO: 7553019 - DNA, 22 bp, Homo sapiens
gctctgagaaccaggaacacag

SEQ ID NO: 7553020 - DNA, 22 bp, Homo sapiens
gctctgagaaccaggaacacag

SEQ ID NO: 7553021 - DNA, 22 bp, Homo sapiens
gctctgacttcctgcgctccag

SEQ ID NO: 7553022 - DNA, 22 bp, Homo sapiens
gctctgacttcctgcgctccag

SEQ ID NO: 7553023 - DNA, 22 bp, Homo sapiens
gctctgagaaccaggaacacag

SEQ ID NO: 7553024 - DNA, 22 bp, Homo sapiens
gctctgactggtgggccacagt

SEQ ID NO: 7553025 - DNA, 22 bp, Homo sapiens
gctctgacctggccgccctgct

SEQ ID NO: 7553026 - DNA, 22 bp, Homo sapiens
gctctgactggtgggccacagt

SEQ ID NO: 7553027 - DNA, 22 bp, Homo sapiens
gctctgactgagcttcctgcct

SEQ ID NO: 7553028 - DNA, 22 bp, Homo sapiens
gctctgactgagcttcctgcct

SEQ ID NO: 7553029 - DNA, 22 bp, Homo sapiens
gctctgacctggccgccctgct

SEQ ID NO: 7553030 - DNA, 22 bp, Homo sapiens
gctctgagaggatgctgagcag

SEQ ID NO: 7553031 - DNA, 22 bp, Homo sapiens
gctctgagaggatgctgagcag

SEQ ID NO: 7553032 - DNA, 22 bp, Homo sapiens
gctctgagaggatgctgagcag

SEQ ID NO: 7553033 - DNA, 22 bp, Homo sapiens
gctctgagaggatgctgagcag

SEQ ID NO: 7553034 - DNA, 22 bp, Homo sapiens
gctctgagaggatgctgagcag

SEQ ID NO: 7553035 - DNA, 22 bp, Homo sapiens
gctctgagagctacacagggta

SEQ ID NO: 7553036 - DNA, 22 bp, Homo sapiens
gctctgagagctacacagggta

SEQ ID NO: 7553037 - DNA, 22 bp, Homo sapiens
gctctgagagctacacagggta

SEQ ID NO: 7553038 - DNA, 22 bp, Homo sapiens
gctctgagaggatgctgagcag

SEQ ID NO: 7553039 - DNA, 22 bp, Homo sapiens
gctctgagagctacacagggta

SEQ ID NO: 7553040 - DNA, 22 bp, Homo sapiens
gctctgagagagcaaagtcacc

SEQ ID NO: 7553041 - DNA, 22 bp, Homo sapiens
gctctgagacagtagagatggc

SEQ ID NO: 7553042 - DNA, 22 bp, Homo sapiens
gctctgagacagtagagatggc

SEQ ID NO: 7553043 - DNA, 22 bp, Homo sapiens
gctctgagacagtagagatggc

SEQ ID NO: 7553044 - DNA, 22 bp, Homo sapiens
gctctgagacagtagagatggc

SEQ ID NO: 7553045 - DNA, 22 bp, Homo sapiens
gctctgagacagtagagatggc

SEQ ID NO: 7553046 - DNA, 22 bp, Homo sapiens
gctctgagacagtagagatggc

SEQ ID NO: 7553047 - DNA, 22 bp, Homo sapiens
gctctgagaagtattatttctt

SEQ ID NO: 7553048 - DNA, 22 bp, Homo sapiens
gctctgagacacaaagggtgca

SEQ ID NO: 7553049 - DNA, 22 bp, Homo sapiens
gctctgagacacaaagggtgca

SEQ ID NO: 7553050 - DNA, 22 bp, Homo sapiens
gctctgagacacaaagggtgca

SEQ ID NO: 7553051 - DNA, 22 bp, Homo sapiens
gctctgagacacaaagggtgca

SEQ ID NO: 7553052 - DNA, 22 bp, Homo sapiens
gctcaaagaccagacagaggag

SEQ ID NO: 7553053 - DNA, 22 bp, Homo sapiens
gctcaaagaccagacagaggag

SEQ ID NO: 7553054 - DNA, 22 bp, Homo sapiens
gctatttttgagccatttataa

SEQ ID NO: 7553055 - DNA, 22 bp, Homo sapiens
gctatttttgagccatttataa

SEQ ID NO: 7553056 - DNA, 22 bp, Homo sapiens
gctatttttgagccatttataa

SEQ ID NO: 7553057 - DNA, 22 bp, Homo sapiens
gctatttttgagccatttataa

SEQ ID NO: 7553058 - DNA, 22 bp, Homo sapiens
gctatttccaaagctgctgttc

SEQ ID NO: 7553059 - DNA, 22 bp, Homo sapiens
gctatttattaaaatggtgaag

SEQ ID NO: 7553060 - DNA, 22 bp, Homo sapiens
gctatttattaaaatggtgaag

SEQ ID NO: 7553061 - DNA, 22 bp, Homo sapiens
gctatttattaaaatggtgaag

SEQ ID NO: 7553062 - DNA, 22 bp, Homo sapiens
gctatttattaaaatggtgaag

SEQ ID NO: 7553063 - DNA, 22 bp, Homo sapiens
gctatttttgagccatttataa

SEQ ID NO: 7553064 - DNA, 22 bp, Homo sapiens
gctatttttgagccatttataa

SEQ ID NO: 7553065 - DNA, 22 bp, Homo sapiens
gctatttttgagccatttataa

SEQ ID NO: 7553066 - DNA, 22 bp, Homo sapiens
gctatttctttaaattgatctc

SEQ ID NO: 7553067 - DNA, 22 bp, Homo sapiens
gctcaaagaggcctccaaatcc

SEQ ID NO: 7553068 - DNA, 22 bp, Homo sapiens
gctcaaagaggcctccaaatcc

SEQ ID NO: 7553069 - DNA, 22 bp, Homo sapiens
gctcaaagcataagacatctaa

SEQ ID NO: 7553070 - DNA, 22 bp, Homo sapiens
gctcaaaggccaggtagcagca

SEQ ID NO: 7553071 - DNA, 22 bp, Homo sapiens
gctcaaaggttgatagctgtgc

SEQ ID NO: 7553072 - DNA, 21 bp, Homo sapiens
gctcaaagggcttgccatgct

SEQ ID NO: 7553073 - DNA, 22 bp, Homo sapiens
gctcaaaggctatcaatagtgt

SEQ ID NO: 7553074 - DNA, 23 bp, Homo sapiens
gctcaggcatcattcttcctggc

SEQ ID NO: 7553075 - DNA, 23 bp, Homo sapiens
gctcaggcatcattcttcctggc

SEQ ID NO: 7553076 - DNA, 23 bp, Homo sapiens
gctcaggcatcattcttcctggc

SEQ ID NO: 7553077 - DNA, 23 bp, Homo sapiens
gctcaggcatcattcttcctggc

SEQ ID NO: 7553078 - DNA, 22 bp, Homo sapiens
gctcaaatcccagcgggctcct

SEQ ID NO: 7553079 - DNA, 23 bp, Homo sapiens
gctcaggcatcattcttcctggc

SEQ ID NO: 7553080 - DNA, 22 bp, Homo sapiens
gctcagggctaaggctgagggg

SEQ ID NO: 7553081 - DNA, 22 bp, Homo sapiens
gctcagggctaaggctgagggg

SEQ ID NO: 7553082 - DNA, 23 bp, Homo sapiens
gctcaggcatcattcttcctggc

SEQ ID NO: 7553083 - DNA, 22 bp, Homo sapiens
gctcagggctaaggctgagggg

SEQ ID NO: 7553084 - DNA, 22 bp, Homo sapiens
gctcagggctaaggctgagggg

SEQ ID NO: 7553085 - DNA, 22 bp, Homo sapiens
gctcagggctaaggctgagggg

SEQ ID NO: 7553086 - DNA, 22 bp, Homo sapiens
gctaatcaatgttaaggctgtg

SEQ ID NO: 7553087 - DNA, 22 bp, Homo sapiens
gctaatcaatgttaaggctgtg

SEQ ID NO: 7553088 - DNA, 22 bp, Homo sapiens
gctaatcaatgttaaggctgtg

SEQ ID NO: 7553089 - DNA, 22 bp, Homo sapiens
gctaagggataggctgcctcct

SEQ ID NO: 7553090 - DNA, 22 bp, Homo sapiens
gctaataattcctttgtgaact

SEQ ID NO: 7553091 - DNA, 22 bp, Homo sapiens
gctaataattcctttgtgaact

SEQ ID NO: 7553092 - DNA, 22 bp, Homo sapiens
gctaatgactgagtttttagca

SEQ ID NO: 7553093 - DNA, 22 bp, Homo sapiens
gctaatgactgagtttttagca

SEQ ID NO: 7553094 - DNA, 22 bp, Homo sapiens
gctaatgaggtaatgaatacgt

SEQ ID NO: 7553095 - DNA, 22 bp, Homo sapiens
gctaatgatagcaagataaaca

SEQ ID NO: 7553096 - DNA, 22 bp, Homo sapiens
gctaatcaatgttaaggctgtg

SEQ ID NO: 7553097 - DNA, 22 bp, Homo sapiens
gctaatcttcctaaaccttggt

SEQ ID NO: 7553098 - DNA, 22 bp, Homo sapiens
gctaatgaaaaatagattatag

SEQ ID NO: 7553099 - DNA, 22 bp, Homo sapiens
gctaatgaaaaatagattatag

SEQ ID NO: 7553100 - DNA, 22 bp, Homo sapiens
gctaatgaaaaatagattatag

SEQ ID NO: 7553101 - DNA, 22 bp, Homo sapiens
gctacacaaaaggagagtgagt

SEQ ID NO: 7553102 - DNA, 22 bp, Homo sapiens
gctacacaatagcgttcactta

SEQ ID NO: 7553103 - DNA, 22 bp, Homo sapiens
gctacacaatagcgttcactta

SEQ ID NO: 7553104 - DNA, 22 bp, Homo sapiens
gctacagactgagcatggctct

SEQ ID NO: 7553105 - DNA, 22 bp, Homo sapiens
gctaattcttgataacataaca

SEQ ID NO: 7553106 - DNA, 22 bp, Homo sapiens
gctacaaagagagcccactcta

SEQ ID NO: 7553107 - DNA, 22 bp, Homo sapiens
gctacaagtcttgtcattcatt

SEQ ID NO: 7553108 - DNA, 22 bp, Homo sapiens
gctatggctcaccatgtcctgg

SEQ ID NO: 7553109 - DNA, 22 bp, Homo sapiens
gctatgtaatttgcaagaccca

SEQ ID NO: 7553110 - DNA, 22 bp, Homo sapiens
gctatgtaggcaagttgttaca

SEQ ID NO: 7553111 - DNA, 22 bp, Homo sapiens
gctatgtataaccaaagtacaa

SEQ ID NO: 7553112 - DNA, 22 bp, Homo sapiens
gctatgtattccttagccgctt

SEQ ID NO: 7553113 - DNA, 19 bp, Homo sapiens
gctatgtatttagctgaga

SEQ ID NO: 7553114 - DNA, 22 bp, Homo sapiens
gctatgttagacattctcattt

SEQ ID NO: 7553115 - DNA, 22 bp, Homo sapiens
gctatgttcccttttgctataa

SEQ ID NO: 7553116 - DNA, 22 bp, Homo sapiens
gctattcatggagcatgtactg

SEQ ID NO: 7553117 - DNA, 22 bp, Homo sapiens
gctattgtttattttgaatcta

SEQ ID NO: 7553118 - DNA, 22 bp, Homo sapiens
gctattgtgacagcttttcgcc

SEQ ID NO: 7553119 - DNA, 22 bp, Homo sapiens
gctatttagtgagtcacatcct

SEQ ID NO: 7553120 - DNA, 22 bp, Homo sapiens
gctatttagtgagtcacatcct

SEQ ID NO: 7553121 - DNA, 22 bp, Homo sapiens
gctatttattaaaatagtgaag

SEQ ID NO: 7553122 - DNA, 22 bp, Homo sapiens
gctatttattaaaatagtgaag

SEQ ID NO: 7553123 - DNA, 22 bp, Homo sapiens
gcgtgtcaatctatctgttcca

SEQ ID NO: 7553124 - DNA, 22 bp, Homo sapiens
gcgtggtgctgccctgcacaca

SEQ ID NO: 7553125 - DNA, 22 bp, Homo sapiens
gcgtgtatgcaggtctgtgcag

SEQ ID NO: 7553126 - DNA, 22 bp, Homo sapiens
gcgtggggtaggtagacatgga

SEQ ID NO: 7553127 - DNA, 22 bp, Homo sapiens
gcgtggggtaggtagacatgga

SEQ ID NO: 7553128 - DNA, 22 bp, Homo sapiens
gcgtggggtaggtagacatgga

SEQ ID NO: 7553129 - DNA, 22 bp, Homo sapiens
gcgtggggtaggtagacatgga

SEQ ID NO: 7553130 - DNA, 22 bp, Homo sapiens
gctaaaaggagcactagagatt

SEQ ID NO: 7553131 - DNA, 22 bp, Homo sapiens
gcgtttgtaggggtgttttgcc

SEQ ID NO: 7553132 - DNA, 22 bp, Homo sapiens
gcgttggggaccccgaagctgg

SEQ ID NO: 7553133 - DNA, 22 bp, Homo sapiens
gcgttggggaccccgaagctgg

SEQ ID NO: 7553134 - DNA, 20 bp, Homo sapiens
gcgttcagactcaactgtgg

SEQ ID NO: 7553135 - DNA, 22 bp, Homo sapiens
gcgttggggaccccgaagctgg

SEQ ID NO: 7553136 - DNA, 17 bp, Homo sapiens
gcgtgtccccgcgtctc

SEQ ID NO: 7553137 - DNA, 22 bp, Homo sapiens
gcgtgtgtgatatgcctctgca

SEQ ID NO: 7553138 - DNA, 22 bp, Homo sapiens
gcgtgtttgcccagtgagtggc

SEQ ID NO: 7553139 - DNA, 22 bp, Homo sapiens
gctaaggaaatgcgcggcacag

SEQ ID NO: 7553140 - DNA, 22 bp, Homo sapiens
gctaaggaggaatagtgaggca

SEQ ID NO: 7553141 - DNA, 22 bp, Homo sapiens
gctaagaattctgagcagctga

SEQ ID NO: 7553142 - DNA, 22 bp, Homo sapiens
gctaagaattctgagcagctga

SEQ ID NO: 7553143 - DNA, 22 bp, Homo sapiens
gctaagaggctatatctttctc

SEQ ID NO: 7553144 - DNA, 22 bp, Homo sapiens
gctaagaggagcctccttctga

SEQ ID NO: 7553145 - DNA, 22 bp, Homo sapiens
gctaaggccttaactcatggag

SEQ ID NO: 7553146 - DNA, 22 bp, Homo sapiens
gctaagggaggcatgccgtggt

SEQ ID NO: 7553147 - DNA, 22 bp, Homo sapiens
gctaacagcaggttccgggctc

SEQ ID NO: 7553148 - DNA, 22 bp, Homo sapiens
gctaaatttaagcctttctcct

SEQ ID NO: 7553149 - DNA, 22 bp, Homo sapiens
gctaacattgattcagtgcctg

SEQ ID NO: 7553150 - DNA, 22 bp, Homo sapiens
gctaaataatcttcttctgaca

SEQ ID NO: 7553151 - DNA, 22 bp, Homo sapiens
gctaaaataactgagtttttgc

SEQ ID NO: 7553152 - DNA, 22 bp, Homo sapiens
gctaaataatcttcttctgaca

SEQ ID NO: 7553153 - DNA, 22 bp, Homo sapiens
gctaaaataactgagtttttgc

SEQ ID NO: 7553154 - DNA, 22 bp, Homo sapiens
gctaaatagtttttggaacctc

SEQ ID NO: 7553155 - DNA, 22 bp, Homo sapiens
gctaaatctcctacaatgcaca

SEQ ID NO: 7553156 - DNA, 23 bp, Homo sapiens
gctaaattgaagtctcaggggaa

SEQ ID NO: 7553157 - DNA, 22 bp, Homo sapiens
gcgcaggcccgggtcagggccg

SEQ ID NO: 7553158 - DNA, 22 bp, Homo sapiens
gcgcaggagccgcggagggccg

SEQ ID NO: 7553159 - DNA, 22 bp, Homo sapiens
gcgcaggagccgcggagggccg

SEQ ID NO: 7553160 - DNA, 22 bp, Homo sapiens
gcgcaggagccgcggagggccg

SEQ ID NO: 7553161 - DNA, 22 bp, Homo sapiens
gcgccccatctacagtactttt

SEQ ID NO: 7553162 - DNA, 22 bp, Homo sapiens
gcgccccatctacagtactttt

SEQ ID NO: 7553163 - DNA, 22 bp, Homo sapiens
gcgcaggcccgggtcagggccg

SEQ ID NO: 7553164 - DNA, 22 bp, Homo sapiens
gcctggctctgagggagctcct

SEQ ID NO: 7553165 - DNA, 21 bp, Homo sapiens
gcctggctctcactggcctgg

SEQ ID NO: 7553166 - DNA, 22 bp, Homo sapiens
gcctggctctgagggagctcct

SEQ ID NO: 7553167 - DNA, 21 bp, Homo sapiens
gcctggctctcactggcctgg

SEQ ID NO: 7553168 - DNA, 21 bp, Homo sapiens
gcctggctctcactggcctgg

SEQ ID NO: 7553169 - DNA, 21 bp, Homo sapiens
gcctggctctcactggcctgg

SEQ ID NO: 7553170 - DNA, 22 bp, Homo sapiens
gcctggctctgagtttctctcc

SEQ ID NO: 7553171 - DNA, 22 bp, Homo sapiens
gcctggctctgagtttctctcc

SEQ ID NO: 7553172 - DNA, 22 bp, Homo sapiens
gcctggctctgagggagctcct

SEQ ID NO: 7553173 - DNA, 22 bp, Homo sapiens
gcctggctctgagggagctcct

SEQ ID NO: 7553174 - DNA, 22 bp, Homo sapiens
gcctggctctgagggagctcct

SEQ ID NO: 7553175 - DNA, 22 bp, Homo sapiens
gcctggctcctaaggactggct

SEQ ID NO: 7553176 - DNA, 22 bp, Homo sapiens
gcctggctcctaaggactggct

SEQ ID NO: 7553177 - DNA, 22 bp, Homo sapiens
gcctggctcctaaggactggct

SEQ ID NO: 7553178 - DNA, 22 bp, Homo sapiens
gcctggctcctaaggactggct

SEQ ID NO: 7553179 - DNA, 22 bp, Homo sapiens
gcctggctcctaaggactggct

SEQ ID NO: 7553180 - DNA, 22 bp, Homo sapiens
gcctggctcctaagagcacaac

SEQ ID NO: 7553181 - DNA, 22 bp, Homo sapiens
gcctggctcctaagagcacaac

SEQ ID NO: 7553182 - DNA, 22 bp, Homo sapiens
gcctggctcctaagagcacaac

SEQ ID NO: 7553183 - DNA, 21 bp, Homo sapiens
gcctggctctcactggcctgg

SEQ ID NO: 7553184 - DNA, 22 bp, Homo sapiens
gcctggctcgggcactcgccag

SEQ ID NO: 7553185 - DNA, 21 bp, Homo sapiens
gcctggctctcactggcctgg

SEQ ID NO: 7553186 - DNA, 22 bp, Homo sapiens
gcctggctcctaaggactggct

SEQ ID NO: 7553187 - DNA, 22 bp, Homo sapiens
gcctggctcgggcactcgccag

SEQ ID NO: 7553188 - DNA, 22 bp, Homo sapiens
gcctggctcctaaggactggct

SEQ ID NO: 7553189 - DNA, 22 bp, Homo sapiens
gcctggctcctaaggactggct

SEQ ID NO: 7553190 - DNA, 22 bp, Homo sapiens
gcctggctcctaaggactggct

SEQ ID NO: 7553191 - DNA, 22 bp, Homo sapiens
gctcgcctggctggatctgggt

SEQ ID NO: 7553192 - DNA, 22 bp, Homo sapiens
gctcgaccgccagaaacttcct

SEQ ID NO: 7553193 - DNA, 22 bp, Homo sapiens
gctccttctggctcccttttgg

SEQ ID NO: 7553194 - DNA, 22 bp, Homo sapiens
gctcgaccgccagaaacttcct

SEQ ID NO: 7553195 - DNA, 17 bp, Homo sapiens
gctccttctaacttcca

SEQ ID NO: 7553196 - DNA, 22 bp, Homo sapiens
gctcctggatgttcaagtcggc

SEQ ID NO: 7553197 - DNA, 22 bp, Homo sapiens
gctcctggatgttcaagtcggc

SEQ ID NO: 7553198 - DNA, 22 bp, Homo sapiens
gctcgcttagattttcctctga

SEQ ID NO: 7553199 - DNA, 22 bp, Homo sapiens
gctcggagtcccacctgggaaa

SEQ ID NO: 7553200 - DNA, 22 bp, Homo sapiens
gctcggccccgacggccggcgg

SEQ ID NO: 7553201 - DNA, 22 bp, Homo sapiens
gctcggtggccagcctgaggcc

SEQ ID NO: 7553202 - DNA, 22 bp, Homo sapiens
gctcggtggccagcctgaggcc

SEQ ID NO: 7553203 - DNA, 22 bp, Homo sapiens
gctcggtggccagcctgaggcc

SEQ ID NO: 7553204 - DNA, 22 bp, Homo sapiens
gctcggtggccagcctgaggcc

SEQ ID NO: 7553205 - DNA, 22 bp, Homo sapiens
gctcggtggccagcctgaggcc

SEQ ID NO: 7553206 - DNA, 22 bp, Homo sapiens
gctcggtggccagcctgaggcc

SEQ ID NO: 7553207 - DNA, 22 bp, Homo sapiens
gctcggtggccagcctgaggcc

SEQ ID NO: 7553208 - DNA, 17 bp, Homo sapiens
gctccaggcgtgagtga

SEQ ID NO: 7553209 - DNA, 22 bp, Homo sapiens
gctccaggctgctctgtcccat

SEQ ID NO: 7553210 - DNA, 22 bp, Homo sapiens
gctccaggctgctctgtcccat

SEQ ID NO: 7553211 - DNA, 22 bp, Homo sapiens
gctccaggctgctctgtcccat

SEQ ID NO: 7553212 - DNA, 22 bp, Homo sapiens
gctccaggctgctctgtcccat

SEQ ID NO: 7553213 - DNA, 22 bp, Homo sapiens
gctccagggaacagaatgtact

SEQ ID NO: 7553214 - DNA, 22 bp, Homo sapiens
gctccagggaacagaatgtact

SEQ ID NO: 7553215 - DNA, 22 bp, Homo sapiens
gctccagggaacagaatgtact

SEQ ID NO: 7553216 - DNA, 19 bp, Homo sapiens
gctcctggatgacctgtgg

SEQ ID NO: 7553217 - DNA, 22 bp, Homo sapiens
gctcctggatgttcaagtcggc

SEQ ID NO: 7553218 - DNA, 22 bp, Homo sapiens
gctcctggatgttcaagtcggc

SEQ ID NO: 7553219 - DNA, 22 bp, Homo sapiens
gctcctggatgttcaagtcggc

SEQ ID NO: 7553220 - DNA, 22 bp, Homo sapiens
gctcctggatgttcaagtcggc

SEQ ID NO: 7553221 - DNA, 22 bp, Homo sapiens
gctctaggagaggggcagtcca

SEQ ID NO: 7553222 - DNA, 22 bp, Homo sapiens
gctctaggaggtgtgcttagaa

SEQ ID NO: 7553223 - DNA, 22 bp, Homo sapiens
gctctaggaggtgtgcttagaa

SEQ ID NO: 7553224 - DNA, 22 bp, Homo sapiens
gctctagaaagaaggatgtggg

SEQ ID NO: 7553225 - DNA, 22 bp, Homo sapiens
gctctagcaaggctggcctggg

SEQ ID NO: 7553226 - DNA, 22 bp, Homo sapiens
gctctaggttcctagccaagtc

SEQ ID NO: 7553227 - DNA, 22 bp, Homo sapiens
gctctaggttcctagccaagtc

SEQ ID NO: 7553228 - DNA, 22 bp, Homo sapiens
gctctaggttcctagccaagtc

SEQ ID NO: 7553229 - DNA, 22 bp, Homo sapiens
gctctagtaggaatgtccctct

SEQ ID NO: 7553230 - DNA, 22 bp, Homo sapiens
gctctagtaggaatgtccctct

SEQ ID NO: 7553231 - DNA, 20 bp, Homo sapiens
gctctgaaccaagagctgtc

SEQ ID NO: 7553232 - DNA, 21 bp, Homo sapiens
gctctatcaggccaaaatgtc

SEQ ID NO: 7553233 - DNA, 22 bp, Homo sapiens
gctctagtaggaatgtccctct

SEQ ID NO: 7553234 - DNA, 23 bp, Homo sapiens
gctctatcaggaacaagccaggt

SEQ ID NO: 7553235 - DNA, 22 bp, Homo sapiens
gctctaaagagaatctatgcgg

SEQ ID NO: 7553236 - DNA, 22 bp, Homo sapiens
gctctaaagaacccagaggagt

SEQ ID NO: 7553237 - DNA, 20 bp, Homo sapiens
gctctaaagccacagattga

SEQ ID NO: 7553238 - DNA, 20 bp, Homo sapiens
gctctaaagccacagattga

SEQ ID NO: 7553239 - DNA, 22 bp, Homo sapiens
gctctaaagaacccagaggagt

SEQ ID NO: 7553240 - DNA, 20 bp, Homo sapiens
gctctaaaccacaaagccca

SEQ ID NO: 7553241 - DNA, 19 bp, Homo sapiens
gctctaaaagattttgaag

SEQ ID NO: 7553242 - DNA, 19 bp, Homo sapiens
gctctaaaagattttgaag

SEQ ID NO: 7553243 - DNA, 22 bp, Homo sapiens
gctcgttgaacctgtccccgag

SEQ ID NO: 7553244 - DNA, 21 bp, Homo sapiens
gctctaagctttgggaagaat

SEQ ID NO: 7553245 - DNA, 20 bp, Homo sapiens
gctctaaagccacagattga

SEQ ID NO: 7553246 - DNA, 22 bp, Homo sapiens
gctctagaaagaaggatgtggg

SEQ ID NO: 7553247 - DNA, 22 bp, Homo sapiens
gctctagaaagaaggatgtggg

SEQ ID NO: 7553248 - DNA, 22 bp, Homo sapiens
gctctagacagaaagaccagtg

SEQ ID NO: 7553249 - DNA, 22 bp, Homo sapiens
gctctaagtgagaaggtgccat

SEQ ID NO: 7553250 - DNA, 18 bp, Homo sapiens
gctctaattttagaaagg

SEQ ID NO: 7553251 - DNA, 18 bp, Homo sapiens
gctctaattttagaaagg

SEQ ID NO: 7553252 - DNA, 22 bp, Homo sapiens
gctcaggggaatgggctgccgt

SEQ ID NO: 7553253 - DNA, 22 bp, Homo sapiens
gctcaggggaatgggctgccgt

SEQ ID NO: 7553254 - DNA, 22 bp, Homo sapiens
gctcaggggaatgggctgccgt

SEQ ID NO: 7553255 - DNA, 22 bp, Homo sapiens
gctcaggggaatgggctgccgt

SEQ ID NO: 7553256 - DNA, 22 bp, Homo sapiens
gctcagggctaaggctgagggg

SEQ ID NO: 7553257 - DNA, 22 bp, Homo sapiens
gctcagggctaaggctgagggg

SEQ ID NO: 7553258 - DNA, 22 bp, Homo sapiens
gctcagggctaaggctgagggg

SEQ ID NO: 7553259 - DNA, 22 bp, Homo sapiens
gctcagggtcccttggtgctgg

SEQ ID NO: 7553260 - DNA, 22 bp, Homo sapiens
gctcagggtcccttggtgctgg

SEQ ID NO: 7553261 - DNA, 22 bp, Homo sapiens
gctcaggggaatgggctgccgt

SEQ ID NO: 7553262 - DNA, 22 bp, Homo sapiens
gctcaggggaatgggctgccgt

SEQ ID NO: 7553263 - DNA, 22 bp, Homo sapiens
gctcagggtcccttggtgctgg

SEQ ID NO: 7553264 - DNA, 22 bp, Homo sapiens
gctcagggtcccttggtgctgg

SEQ ID NO: 7553265 - DNA, 22 bp, Homo sapiens
gctcagggtcccttggtgctgg

SEQ ID NO: 7553266 - DNA, 22 bp, Homo sapiens
gctcagggtcccttggtgctgg

SEQ ID NO: 7553267 - DNA, 22 bp, Homo sapiens
gctcagggtcccttggtgctgg

SEQ ID NO: 7553268 - DNA, 22 bp, Homo sapiens
gctcagggtgcagtgtccatga

SEQ ID NO: 7553269 - DNA, 22 bp, Homo sapiens
gctcagggtgcagtgtccatga

SEQ ID NO: 7553270 - DNA, 22 bp, Homo sapiens
gctcagggtgcagtgtccatga

SEQ ID NO: 7553271 - DNA, 22 bp, Homo sapiens
gctcaggtcttacccatgcctg

SEQ ID NO: 7553272 - DNA, 23 bp, Homo sapiens
gctcaggtggctcagggactgat

SEQ ID NO: 7553273 - DNA, 22 bp, Homo sapiens
gctcaggtgttacctcctctag

SEQ ID NO: 7553274 - DNA, 20 bp, Homo sapiens
gctcaggtttgggctttgtg

SEQ ID NO: 7553275 - DNA, 20 bp, Homo sapiens
gctcaggtttgggctttgtg

SEQ ID NO: 7553276 - DNA, 20 bp, Homo sapiens
gctcaggtgacagtcaggag

SEQ ID NO: 7553277 - DNA, 23 bp, Homo sapiens
gctcaggtggctcagggactgat

SEQ ID NO: 7553278 - DNA, 20 bp, Homo sapiens
gctcaggtgacagtcaggag

SEQ ID NO: 7553279 - DNA, 23 bp, Homo sapiens
gctcaggtggctcagggactgat

SEQ ID NO: 7553280 - DNA, 23 bp, Homo sapiens
gctcaggtggctcagggactgat

SEQ ID NO: 7553281 - DNA, 22 bp, Homo sapiens
gctccaggcgagctggaccaga

SEQ ID NO: 7553282 - DNA, 22 bp, Homo sapiens
gctccaggcgagctggaccaga

SEQ ID NO: 7553283 - DNA, 22 bp, Homo sapiens
gctccaggcgagctggaccaga

SEQ ID NO: 7553284 - DNA, 22 bp, Homo sapiens
gctccaggcgagctggaccaga

SEQ ID NO: 7553285 - DNA, 22 bp, Homo sapiens
gctccaggcgagctggaccaga

SEQ ID NO: 7553286 - DNA, 17 bp, Homo sapiens
gctccaggcgtgagtga

SEQ ID NO: 7553287 - DNA, 17 bp, Homo sapiens
gctccaggcgtgagtga

SEQ ID NO: 7553288 - DNA, 17 bp, Homo sapiens
gctccaggcgtgagtga

SEQ ID NO: 7553289 - DNA, 17 bp, Homo sapiens
gctccaggcgtgagtga

SEQ ID NO: 7553290 - DNA, 22 bp, Homo sapiens
gctcagtctaaagacatgctcc

SEQ ID NO: 7553291 - DNA, 19 bp, Homo sapiens
gctcagtctcctgattgct

SEQ ID NO: 7553292 - DNA, 22 bp, Homo sapiens
gctcagtctttgtggggtacgg

SEQ ID NO: 7553293 - DNA, 22 bp, Homo sapiens
gctcagtgaaacatcaaatagt

SEQ ID NO: 7553294 - DNA, 22 bp, Homo sapiens
gctccaggcagcatagtggatg

SEQ ID NO: 7553295 - DNA, 22 bp, Homo sapiens
gctccaggcagcatagtggatg

SEQ ID NO: 7553296 - DNA, 22 bp, Homo sapiens
gctccaggcagcatagtggatg

SEQ ID NO: 7553297 - DNA, 22 bp, Homo sapiens
gctccaggcagcatagtggatg

SEQ ID NO: 7553298 - DNA, 22 bp, Homo sapiens
gctccaggcagcatagtggatg

SEQ ID NO: 7553299 - DNA, 22 bp, Homo sapiens
gctccaggcagcatagtggatg

SEQ ID NO: 7553300 - DNA, 22 bp, Homo sapiens
gctccaggcagcatagtggatg

SEQ ID NO: 7553301 - DNA, 22 bp, Homo sapiens
gctccaggccccagcgttccgc

SEQ ID NO: 7553302 - DNA, 22 bp, Homo sapiens
gctccaggccccagcgttccgc

SEQ ID NO: 7553303 - DNA, 22 bp, Homo sapiens
gctccaggccccagcgttccgc

SEQ ID NO: 7553304 - DNA, 22 bp, Homo sapiens
gctccaggccacggcttcttgg

SEQ ID NO: 7553305 - DNA, 22 bp, Homo sapiens
gctccaggccacggcttcttgg

SEQ ID NO: 7553306 - DNA, 22 bp, Homo sapiens
gctccaggccacggcttcttgg

SEQ ID NO: 7553307 - DNA, 22 bp, Homo sapiens
gctccaggccacggcttcttgg

SEQ ID NO: 7553308 - DNA, 22 bp, Homo sapiens
gctccaggcagcatagtggatg

SEQ ID NO: 7553309 - DNA, 19 bp, Homo sapiens
gccctcctcactgagctct

SEQ ID NO: 7553310 - DNA, 19 bp, Homo sapiens
gccctcctcactgagctct

SEQ ID NO: 7553311 - DNA, 19 bp, Homo sapiens
gccctcctcactgagctct

SEQ ID NO: 7553312 - DNA, 23 bp, Homo sapiens
gccctccctcccaggtgggtgtt

SEQ ID NO: 7553313 - DNA, 23 bp, Homo sapiens
gccctccctcccaggtgggtgtt

SEQ ID NO: 7553314 - DNA, 19 bp, Homo sapiens
gccctcctcactgagctct

SEQ ID NO: 7553315 - DNA, 19 bp, Homo sapiens
gccctcctcactgagctct

SEQ ID NO: 7553316 - DNA, 19 bp, Homo sapiens
gccctcctcactgagctct

SEQ ID NO: 7553317 - DNA, 19 bp, Homo sapiens
gccctcctcactgagctct

SEQ ID NO: 7553318 - DNA, 22 bp, Homo sapiens
gccctgagttgagccttccaaa

SEQ ID NO: 7553319 - DNA, 22 bp, Homo sapiens
gccctgagttgagccttccaaa

SEQ ID NO: 7553320 - DNA, 22 bp, Homo sapiens
gccctcctggcaggcagtgatg

SEQ ID NO: 7553321 - DNA, 22 bp, Homo sapiens
gccctcctggcaggcagtgatg

SEQ ID NO: 7553322 - DNA, 22 bp, Homo sapiens
gccctcctgcaggggcttctgg

SEQ ID NO: 7553323 - DNA, 22 bp, Homo sapiens
gccctcctgcaggggcttctgg

SEQ ID NO: 7553324 - DNA, 22 bp, Homo sapiens
gccctcctgcaggggcttctgg

SEQ ID NO: 7553325 - DNA, 22 bp, Homo sapiens
gccctcctgcaggggcttctgg

SEQ ID NO: 7553326 - DNA, 23 bp, Homo sapiens
gccctccctcccaggtgggtgtt

SEQ ID NO: 7553327 - DNA, 23 bp, Homo sapiens
gccctccctcccaggtgggtgtt

SEQ ID NO: 7553328 - DNA, 22 bp, Homo sapiens
gccctccctacagcctatttct

SEQ ID NO: 7553329 - DNA, 23 bp, Homo sapiens
gccctccctcccaggtgggtgtt

SEQ ID NO: 7553330 - DNA, 23 bp, Homo sapiens
gccctccctcccaggtgggtgtt

SEQ ID NO: 7553331 - DNA, 23 bp, Homo sapiens
gccctccctcccaggtgggtgtt

SEQ ID NO: 7553332 - DNA, 23 bp, Homo sapiens
gccctccctcccaggtgggtgtt

SEQ ID NO: 7553333 - DNA, 22 bp, Homo sapiens
gccctccctacagcctatttct

SEQ ID NO: 7553334 - DNA, 22 bp, Homo sapiens
gccctccctacagcctatttct

SEQ ID NO: 7553335 - DNA, 22 bp, Homo sapiens
gccctccctacagcctatttct

SEQ ID NO: 7553336 - DNA, 22 bp, Homo sapiens
gccctccctacagcctatttct

SEQ ID NO: 7553337 - DNA, 22 bp, Homo sapiens
gccctccctacagcctatttct

SEQ ID NO: 7553338 - DNA, 22 bp, Homo sapiens
gccctccctacagcctatttct

SEQ ID NO: 7553339 - DNA, 22 bp, Homo sapiens
gccctcccctctgggtggtgag

SEQ ID NO: 7553340 - DNA, 22 bp, Homo sapiens
gccctcccctctgggtggtgag

SEQ ID NO: 7553341 - DNA, 22 bp, Homo sapiens
gccctcccctctgggtggtgag

SEQ ID NO: 7553342 - DNA, 22 bp, Homo sapiens
gccctccatggtgatccaggcc

SEQ ID NO: 7553343 - DNA, 22 bp, Homo sapiens
gccctcccctctgggtggtgag

SEQ ID NO: 7553344 - DNA, 22 bp, Homo sapiens
gccctccagctgttgcgcgtcg

SEQ ID NO: 7553345 - DNA, 22 bp, Homo sapiens
gccctcccctctgggtggtgag

SEQ ID NO: 7553346 - DNA, 22 bp, Homo sapiens
gccctcccctctgggtggtgag

SEQ ID NO: 7553347 - DNA, 22 bp, Homo sapiens
gccctcccctctgggtggtgag

SEQ ID NO: 7553348 - DNA, 22 bp, Homo sapiens
gccctcccctctgggtggtgag

SEQ ID NO: 7553349 - DNA, 22 bp, Homo sapiens
gccctcccctctgggtggtgag

SEQ ID NO: 7553350 - DNA, 22 bp, Homo sapiens
gccctgcaccccaatggcatga

SEQ ID NO: 7553351 - DNA, 22 bp, Homo sapiens
gccctgcaccccaatggcatga

SEQ ID NO: 7553352 - DNA, 19 bp, Homo sapiens
gccctgcaggaggtggggc

SEQ ID NO: 7553353 - DNA, 19 bp, Homo sapiens
gccctgcaggaggtggggc

SEQ ID NO: 7553354 - DNA, 22 bp, Homo sapiens
gccctgcagtgcggaggtggca

SEQ ID NO: 7553355 - DNA, 22 bp, Homo sapiens
gccctgcagtgcggaggtggca

SEQ ID NO: 7553356 - DNA, 22 bp, Homo sapiens
gccctgccctgagccgtagacc

SEQ ID NO: 7553357 - DNA, 22 bp, Homo sapiens
gccctgccctgagccgtagacc

SEQ ID NO: 7553358 - DNA, 22 bp, Homo sapiens
gccctgccctctcggcactcgc

SEQ ID NO: 7553359 - DNA, 22 bp, Homo sapiens
gccctgccctctcggcactcgc

SEQ ID NO: 7553360 - DNA, 22 bp, Homo sapiens
gccctgccctctcggcactcgc

SEQ ID NO: 7553361 - DNA, 22 bp, Homo sapiens
gccctgccctctcggcactcgc

SEQ ID NO: 7553362 - DNA, 22 bp, Homo sapiens
gccctgccctctcggcactcgc

SEQ ID NO: 7553363 - DNA, 22 bp, Homo sapiens
gccctgccctctcggcactcgc

SEQ ID NO: 7553364 - DNA, 22 bp, Homo sapiens
gccctgccctctcggcactcgc

SEQ ID NO: 7553365 - DNA, 22 bp, Homo sapiens
gccctgccctctcggcactcgc

SEQ ID NO: 7553366 - DNA, 22 bp, Homo sapiens
gccctgccctgagccgtagacc

SEQ ID NO: 7553367 - DNA, 22 bp, Homo sapiens
gccctgccctgttgaaactaga

SEQ ID NO: 7553368 - DNA, 22 bp, Homo sapiens
gccctgccctgagccgtagacc

SEQ ID NO: 7553369 - DNA, 22 bp, Homo sapiens
gccctgccctgagccgtagacc

SEQ ID NO: 7553370 - DNA, 22 bp, Homo sapiens
gccctgcaccccaatggcatga

SEQ ID NO: 7553371 - DNA, 22 bp, Homo sapiens
gccctgccctgagccgtagacc

SEQ ID NO: 7553372 - DNA, 23 bp, Homo sapiens
gccctgcccttagcacactcaca

SEQ ID NO: 7553373 - DNA, 23 bp, Homo sapiens
gccctgcccttagcacactcaca

SEQ ID NO: 7553374 - DNA, 22 bp, Homo sapiens
gccctgccctgttgaaactaga

SEQ ID NO: 7553375 - DNA, 22 bp, Homo sapiens
atttcttccttctcctagaaga

SEQ ID NO: 7553376 - DNA, 22 bp, Homo sapiens
atttcttcctctgtcagtaact

SEQ ID NO: 7553377 - DNA, 22 bp, Homo sapiens
atttcttccttctcctagaaga

SEQ ID NO: 7553378 - DNA, 22 bp, Homo sapiens
gccctgcctgccggtgtgggtc

SEQ ID NO: 7553379 - DNA, 22 bp, Homo sapiens
gccctgcctgccggtgtgggtc

SEQ ID NO: 7553380 - DNA, 22 bp, Homo sapiens
gccctgccgggtattttgtgct

SEQ ID NO: 7553381 - DNA, 22 bp, Homo sapiens
gccctgccgggtattttgtgct

SEQ ID NO: 7553382 - DNA, 23 bp, Homo sapiens
gccctgcccttagcacactcaca

SEQ ID NO: 7553383 - DNA, 23 bp, Homo sapiens
gccctgcccttagcacactcaca

SEQ ID NO: 7553384 - DNA, 23 bp, Homo sapiens
gccctgcccttagcacactcaca

SEQ ID NO: 7553385 - DNA, 22 bp, Homo sapiens
gcccaggagttcaagtctagtg

SEQ ID NO: 7553386 - DNA, 22 bp, Homo sapiens
gcccaggagttcaagtctagtg

SEQ ID NO: 7553387 - DNA, 22 bp, Homo sapiens
gcccaggagttcaagtctagtg

SEQ ID NO: 7553388 - DNA, 22 bp, Homo sapiens
gcccaggagttcaaggctgcag

SEQ ID NO: 7553389 - DNA, 22 bp, Homo sapiens
gcccaggagttcaaggctgcag

SEQ ID NO: 7553390 - DNA, 22 bp, Homo sapiens
gcccaggagttcaaggctgcag

SEQ ID NO: 7553391 - DNA, 22 bp, Homo sapiens
gcccaggagttcaaggctgcag

SEQ ID NO: 7553392 - DNA, 22 bp, Homo sapiens
gcccaggagttcaaggctgcag

SEQ ID NO: 7553393 - DNA, 22 bp, Homo sapiens
gcccaggagttcaaggctgcag

SEQ ID NO: 7553394 - DNA, 22 bp, Homo sapiens
gcccaggagttcaaggctgcag

SEQ ID NO: 7553395 - DNA, 22 bp, Homo sapiens
gcccaggagttcaaggctgcag

SEQ ID NO: 7553396 - DNA, 22 bp, Homo sapiens
gcccaggagttcaaggctgcag

SEQ ID NO: 7553397 - DNA, 22 bp, Homo sapiens
gcccaggagttcaaggctgcag

SEQ ID NO: 7553398 - DNA, 22 bp, Homo sapiens
gcccaggagttcaaggctgcag

SEQ ID NO: 7553399 - DNA, 22 bp, Homo sapiens
gcccaggagttcaaggctgcag

SEQ ID NO: 7553400 - DNA, 22 bp, Homo sapiens
gcccaggagttcaaggctgcag

SEQ ID NO: 7553401 - DNA, 22 bp, Homo sapiens
gcccaggaggttgggctgtgca

SEQ ID NO: 7553402 - DNA, 22 bp, Homo sapiens
gcccaggaggttgggctgtgca

SEQ ID NO: 7553403 - DNA, 22 bp, Homo sapiens
gcccaggaggttgggctgtgca

SEQ ID NO: 7553404 - DNA, 22 bp, Homo sapiens
gcccaggaggttgggctgtgca

SEQ ID NO: 7553405 - DNA, 22 bp, Homo sapiens
gcccaggaggttgggctgtgca

SEQ ID NO: 7553406 - DNA, 22 bp, Homo sapiens
gcccaggaggttgggctgtgca

SEQ ID NO: 7553407 - DNA, 22 bp, Homo sapiens
gcccaggaggttgggctgtgca

SEQ ID NO: 7553408 - DNA, 22 bp, Homo sapiens
gcccagcccctgggtggacgtg

SEQ ID NO: 7553409 - DNA, 22 bp, Homo sapiens
gcccagcccctgggtggacgtg

SEQ ID NO: 7553410 - DNA, 22 bp, Homo sapiens
gcccagcccctgggtggacgtg

SEQ ID NO: 7553411 - DNA, 22 bp, Homo sapiens
gcccaggaggtcaagtagctat

SEQ ID NO: 7553412 - DNA, 22 bp, Homo sapiens
gcccaggaggtcaagtagctat

SEQ ID NO: 7553413 - DNA, 22 bp, Homo sapiens
gcccagcccctgggtggacgtg

SEQ ID NO: 7553414 - DNA, 22 bp, Homo sapiens
gcccaggaggtggaggtgcagt

SEQ ID NO: 7553415 - DNA, 22 bp, Homo sapiens
gcccaggaggtggaggtgcagt

SEQ ID NO: 7553416 - DNA, 22 bp, Homo sapiens
gcccaggaggtggaggtgcagt

SEQ ID NO: 7553417 - DNA, 22 bp, Homo sapiens
gcccaggaggtggaggtgcagt

SEQ ID NO: 7553418 - DNA, 22 bp, Homo sapiens
gcccaggaggtggaggtgcagt

SEQ ID NO: 7553419 - DNA, 22 bp, Homo sapiens
gcccaggaggtggaggtgcagt

SEQ ID NO: 7553420 - DNA, 22 bp, Homo sapiens
gcccaggaggtggaggtgcagt

SEQ ID NO: 7553421 - DNA, 22 bp, Homo sapiens
gcccaggaggtggaggtgcagt

SEQ ID NO: 7553422 - DNA, 22 bp, Homo sapiens
gcccaggaggtggaggtgcagt

SEQ ID NO: 7553423 - DNA, 22 bp, Homo sapiens
gcccaggaggtggaggtgcagt

SEQ ID NO: 7553424 - DNA, 22 bp, Homo sapiens
gccccgcagtgcgtgctggtct

SEQ ID NO: 7553425 - DNA, 22 bp, Homo sapiens
gccctccaccagagcccttctc

SEQ ID NO: 7553426 - DNA, 22 bp, Homo sapiens
gcccctccatccatcaccgggg

SEQ ID NO: 7553427 - DNA, 22 bp, Homo sapiens
gccctccaccagagcccttctc

SEQ ID NO: 7553428 - DNA, 22 bp, Homo sapiens
gcccctccatccatcaccgggg

SEQ ID NO: 7553429 - DNA, 22 bp, Homo sapiens
gccctccaccagagcccttctc

SEQ ID NO: 7553430 - DNA, 22 bp, Homo sapiens
gccctccacctggtctctctgg

SEQ ID NO: 7553431 - DNA, 22 bp, Homo sapiens
gccctccatgagacacagtgta

SEQ ID NO: 7553432 - DNA, 22 bp, Homo sapiens
gccctccatgagacacagtgta

SEQ ID NO: 7553433 - DNA, 22 bp, Homo sapiens
gccctccatgagacacagtgta

SEQ ID NO: 7553434 - DNA, 22 bp, Homo sapiens
gccctccatgagacacagtgta

SEQ ID NO: 7553435 - DNA, 22 bp, Homo sapiens
gccctccagcctgtggaaccgg

SEQ ID NO: 7553436 - DNA, 22 bp, Homo sapiens
gccctccagcctgtggaaccgg

SEQ ID NO: 7553437 - DNA, 22 bp, Homo sapiens
gccctccagctgttgcgcgtcg

SEQ ID NO: 7553438 - DNA, 22 bp, Homo sapiens
gccctccatgagacacagtgta

SEQ ID NO: 7553439 - DNA, 22 bp, Homo sapiens
gcccccttgacctaatcacctt

SEQ ID NO: 7553440 - DNA, 21 bp, Homo sapiens
gccccctggactcctcatcca

SEQ ID NO: 7553441 - DNA, 21 bp, Homo sapiens
gccccctggactcctcatcca

SEQ ID NO: 7553442 - DNA, 21 bp, Homo sapiens
gccccctggactcctcatcca

SEQ ID NO: 7553443 - DNA, 22 bp, Homo sapiens
gcccaggagttgaagggctgac

SEQ ID NO: 7553444 - DNA, 22 bp, Homo sapiens
gccccctctttggagccagcca

SEQ ID NO: 7553445 - DNA, 22 bp, Homo sapiens
gcccaggagttgaagggctgac

SEQ ID NO: 7553446 - DNA, 22 bp, Homo sapiens
gcccaggagttgaagggctgac

SEQ ID NO: 7553447 - DNA, 22 bp, Homo sapiens
gcccaggagttgaagggctgac

SEQ ID NO: 7553448 - DNA, 22 bp, Homo sapiens
gcccaggagttgaagggctgac

SEQ ID NO: 7553449 - DNA, 22 bp, Homo sapiens
gcccaggagttgaagggctgac

SEQ ID NO: 7553450 - DNA, 22 bp, Homo sapiens
gcccaggagttgaagggctgac

SEQ ID NO: 7553451 - DNA, 22 bp, Homo sapiens
gcccaggagttgaagggctgac

SEQ ID NO: 7553452 - DNA, 22 bp, Homo sapiens
gcccaggagttcaagtctagtg

SEQ ID NO: 7553453 - DNA, 22 bp, Homo sapiens
gcccaggagttgaagggctgac

SEQ ID NO: 7553454 - DNA, 22 bp, Homo sapiens
gcccaggagttcaagtctagtg

SEQ ID NO: 7553455 - DNA, 22 bp, Homo sapiens
gcccaggagttcaagtctagtg

SEQ ID NO: 7553456 - DNA, 22 bp, Homo sapiens
gcccaggagttcaagtctagtg

SEQ ID NO: 7553457 - DNA, 22 bp, Homo sapiens
gcccaggagttcaagtctagtg

SEQ ID NO: 7553458 - DNA, 22 bp, Homo sapiens
gcccaggagttcaagtctagtg

SEQ ID NO: 7553459 - DNA, 22 bp, Homo sapiens
gcccaggagttcaagtctagtg

SEQ ID NO: 7553460 - DNA, 22 bp, Homo sapiens
gcccaggagttcaagtctagtg

SEQ ID NO: 7553461 - DNA, 22 bp, Homo sapiens
atttacatttatttgagaaggt

SEQ ID NO: 7553462 - DNA, 22 bp, Homo sapiens
atttacatttatttgagaaggt

SEQ ID NO: 7553463 - DNA, 22 bp, Homo sapiens
atttacatttatttgagaaggt

SEQ ID NO: 7553464 - DNA, 22 bp, Homo sapiens
atttaccagtgctgacatttga

SEQ ID NO: 7553465 - DNA, 22 bp, Homo sapiens
atttaccagtgctgacatttga

SEQ ID NO: 7553466 - DNA, 22 bp, Homo sapiens
atttaccatatgtactgagtat

SEQ ID NO: 7553467 - DNA, 22 bp, Homo sapiens
atttaccatatgtactgagtat

SEQ ID NO: 7553468 - DNA, 22 bp, Homo sapiens
atttaccatatgtactgagtat

SEQ ID NO: 7553469 - DNA, 22 bp, Homo sapiens
atttaccatcctgtgaatggcc

SEQ ID NO: 7553470 - DNA, 17 bp, Homo sapiens
atttacattgtcaccga

SEQ ID NO: 7553471 - DNA, 17 bp, Homo sapiens
atttacattgtcaccga

SEQ ID NO: 7553472 - DNA, 17 bp, Homo sapiens
atttacattgtcaccga

SEQ ID NO: 7553473 - DNA, 17 bp, Homo sapiens
atttacattgtcaccga

SEQ ID NO: 7553474 - DNA, 17 bp, Homo sapiens
atttacattgtcaccga

SEQ ID NO: 7553475 - DNA, 22 bp, Homo sapiens
atttacatttatttgagaaggt

SEQ ID NO: 7553476 - DNA, 22 bp, Homo sapiens
atttacatttatttgagaaggt

SEQ ID NO: 7553477 - DNA, 22 bp, Homo sapiens
atttacatttatttgagaaggt

SEQ ID NO: 7553478 - DNA, 22 bp, Homo sapiens
atttacatttatttgagaaggt

SEQ ID NO: 7553479 - DNA, 18 bp, Homo sapiens
gccagagggaagcaggtg

SEQ ID NO: 7553480 - DNA, 18 bp, Homo sapiens
gccagagggaagcaggtg

SEQ ID NO: 7553481 - DNA, 18 bp, Homo sapiens
gccagagggaagcaggtg

SEQ ID NO: 7553482 - DNA, 22 bp, Homo sapiens
gccagagggattcctggtgtgt

SEQ ID NO: 7553483 - DNA, 18 bp, Homo sapiens
gccagagggaagcaggtg

SEQ ID NO: 7553484 - DNA, 22 bp, Homo sapiens
gccagagggattcctggtgtgt

SEQ ID NO: 7553485 - DNA, 22 bp, Homo sapiens
gccagagggattcctggtgtgt

SEQ ID NO: 7553486 - DNA, 22 bp, Homo sapiens
gccagagggattcctggtgtgt

SEQ ID NO: 7553487 - DNA, 18 bp, Homo sapiens
gccagagggaagcaggtg

SEQ ID NO: 7553488 - DNA, 18 bp, Homo sapiens
gccagagggaagcaggtg

SEQ ID NO: 7553489 - DNA, 18 bp, Homo sapiens
gccagagggaagcaggtg

SEQ ID NO: 7553490 - DNA, 18 bp, Homo sapiens
gccagagggaagcaggtg

SEQ ID NO: 7553491 - DNA, 18 bp, Homo sapiens
gccagagggaagcaggtg

SEQ ID NO: 7553492 - DNA, 18 bp, Homo sapiens
gccagagggaagcaggtg

SEQ ID NO: 7553493 - DNA, 22 bp, Homo sapiens
atttactaatgtcatatcgcgt

SEQ ID NO: 7553494 - DNA, 22 bp, Homo sapiens
atttactaatgtcatatcgcgt

SEQ ID NO: 7553495 - DNA, 18 bp, Homo sapiens
atttacccagcaacgtgg

SEQ ID NO: 7553496 - DNA, 22 bp, Homo sapiens
atttactaatgtcatatcgcgt

SEQ ID NO: 7553497 - DNA, 22 bp, Homo sapiens
atttacataatagactttaggt

SEQ ID NO: 7553498 - DNA, 22 bp, Homo sapiens
atttacataatagactttaggt

SEQ ID NO: 7553499 - DNA, 22 bp, Homo sapiens
atttacattccatggtggttac

SEQ ID NO: 7553500 - DNA, 22 bp, Homo sapiens
atttacattccatggtggttac

SEQ ID NO: 7553501 - DNA, 22 bp, Homo sapiens
atttacagtttagcatttcaag

SEQ ID NO: 7553502 - DNA, 22 bp, Homo sapiens
atttacagtttagcatttcaag

SEQ ID NO: 7553503 - DNA, 22 bp, Homo sapiens
atttacagtttagcatttcaag

SEQ ID NO: 7553504 - DNA, 22 bp, Homo sapiens
atttacataatagactttaggt

SEQ ID NO: 7553505 - DNA, 22 bp, Homo sapiens
atttacataatagactttaggt

SEQ ID NO: 7553506 - DNA, 22 bp, Homo sapiens
atttacataatagactttaggt

SEQ ID NO: 7553507 - DNA, 22 bp, Homo sapiens
atttacataatagactttaggt

SEQ ID NO: 7553508 - DNA, 22 bp, Homo sapiens
atttacagtttagcatttcaag

SEQ ID NO: 7553509 - DNA, 22 bp, Homo sapiens
atttacataatagactttaggt

SEQ ID NO: 7553510 - DNA, 22 bp, Homo sapiens
atttacagtttagcatttcaag

SEQ ID NO: 7553511 - DNA, 22 bp, Homo sapiens
atttacagtttagcatttcaag

SEQ ID NO: 7553512 - DNA, 22 bp, Homo sapiens
atttacagtgtgcctactatat

SEQ ID NO: 7553513 - DNA, 22 bp, Homo sapiens
atttacagtgtgcctactatat

SEQ ID NO: 7553514 - DNA, 22 bp, Homo sapiens
atttacagtgtgcctactatat

SEQ ID NO: 7553515 - DNA, 23 bp, Homo sapiens
atttacaggttaaatgaaatcag

SEQ ID NO: 7553516 - DNA, 22 bp, Homo sapiens
atttacagtgtgcctactatat

SEQ ID NO: 7553517 - DNA, 22 bp, Homo sapiens
atttacagtgtgcctactatat

SEQ ID NO: 7553518 - DNA, 22 bp, Homo sapiens
atttacagacgtggattagtgc

SEQ ID NO: 7553519 - DNA, 22 bp, Homo sapiens
atttacagaccctcccactaag

SEQ ID NO: 7553520 - DNA, 22 bp, Homo sapiens
atttacagaccctcccactaag

SEQ ID NO: 7553521 - DNA, 18 bp, Homo sapiens
gccagagggcccaaggtc

SEQ ID NO: 7553522 - DNA, 18 bp, Homo sapiens
gccagagggcccaaggtc

SEQ ID NO: 7553523 - DNA, 18 bp, Homo sapiens
gccagagggcccaaggtc

SEQ ID NO: 7553524 - DNA, 22 bp, Homo sapiens
gccagagggattcctggtgtgt

SEQ ID NO: 7553525 - DNA, 18 bp, Homo sapiens
gccagagggcccaaggtc

SEQ ID NO: 7553526 - DNA, 18 bp, Homo sapiens
gccagagggcccaaggtc

SEQ ID NO: 7553527 - DNA, 18 bp, Homo sapiens
gccagagggcccaaggtc

SEQ ID NO: 7553528 - DNA, 18 bp, Homo sapiens
gccagagggcccaaggtc

SEQ ID NO: 7553529 - DNA, 22 bp, Homo sapiens
gccagaggggctcgaaggcgcg

SEQ ID NO: 7553530 - DNA, 22 bp, Homo sapiens
gccagaggggctcgaaggcgcg

SEQ ID NO: 7553531 - DNA, 22 bp, Homo sapiens
gccagaggggctcgaaggcgcg

SEQ ID NO: 7553532 - DNA, 22 bp, Homo sapiens
gccagaggggctcgaaggcgcg

SEQ ID NO: 7553533 - DNA, 22 bp, Homo sapiens
gccagaggggctcgaaggcgcg

SEQ ID NO: 7553534 - DNA, 18 bp, Homo sapiens
gccagaggtactactgat

SEQ ID NO: 7553535 - DNA, 22 bp, Homo sapiens
gccagaggggctcgaaggcgcg

SEQ ID NO: 7553536 - DNA, 22 bp, Homo sapiens
gccagaggggctcgaaggcgcg

SEQ ID NO: 7553537 - DNA, 22 bp, Homo sapiens
gccagaggtatcaaagatagta

SEQ ID NO: 7553538 - DNA, 22 bp, Homo sapiens
gccagaggtatcaaagatagta

SEQ ID NO: 7553539 - DNA, 22 bp, Homo sapiens
gccagaggtatcaaagatagta

SEQ ID NO: 7553540 - DNA, 22 bp, Homo sapiens
gccagaggtatcaaagatagta

SEQ ID NO: 7553541 - DNA, 22 bp, Homo sapiens
gccagaggtatcaaagatagta

SEQ ID NO: 7553542 - DNA, 22 bp, Homo sapiens
gccagaggtatcaaagatagta

SEQ ID NO: 7553543 - DNA, 18 bp, Homo sapiens
gccagaggtactactgat

SEQ ID NO: 7553544 - DNA, 18 bp, Homo sapiens
gccagaggtactactgat

SEQ ID NO: 7553545 - DNA, 18 bp, Homo sapiens
gccagaggtactactgat

SEQ ID NO: 7553546 - DNA, 18 bp, Homo sapiens
gccagaggtactactgat

SEQ ID NO: 7553547 - DNA, 18 bp, Homo sapiens
gccagaggtactactgat

SEQ ID NO: 7553548 - DNA, 18 bp, Homo sapiens
gccagaggtactactgat

SEQ ID NO: 7553549 - DNA, 22 bp, Homo sapiens
gccagaggttcaacaactgtct

SEQ ID NO: 7553550 - DNA, 22 bp, Homo sapiens
gccagaggttcaacaactgtct

SEQ ID NO: 7553551 - DNA, 22 bp, Homo sapiens
gccagaggttcaacaactgtct

SEQ ID NO: 7553552 - DNA, 22 bp, Homo sapiens
gccagaggttcaacaactgtct

SEQ ID NO: 7553553 - DNA, 22 bp, Homo sapiens
gcccactccagcttctcccaca

SEQ ID NO: 7553554 - DNA, 20 bp, Homo sapiens
gcccactctaatccactgtc

SEQ ID NO: 7553555 - DNA, 22 bp, Homo sapiens
gcccagccacagtcactttcat

SEQ ID NO: 7553556 - DNA, 22 bp, Homo sapiens
gcccagccacagtcactttcat

SEQ ID NO: 7553557 - DNA, 22 bp, Homo sapiens
gcccagccacagtcactttcat

SEQ ID NO: 7553558 - DNA, 22 bp, Homo sapiens
gcccagcaggggatggcagctc

SEQ ID NO: 7553559 - DNA, 22 bp, Homo sapiens
gcccagccacagtcactttcat

SEQ ID NO: 7553560 - DNA, 22 bp, Homo sapiens
gcccagcaggggatggcagctc

SEQ ID NO: 7553561 - DNA, 22 bp, Homo sapiens
gcccagcaggggatggcagctc

SEQ ID NO: 7553562 - DNA, 22 bp, Homo sapiens
gcccagcaggggatggcagctc

SEQ ID NO: 7553563 - DNA, 22 bp, Homo sapiens
gcccagcaggggatggcagctc

SEQ ID NO: 7553564 - DNA, 22 bp, Homo sapiens
gcccagcaggggatggcagctc

SEQ ID NO: 7553565 - DNA, 22 bp, Homo sapiens
gcccagcaggggatggcagctc

SEQ ID NO: 7553566 - DNA, 22 bp, Homo sapiens
gcccagcaggggatggcagctc

SEQ ID NO: 7553567 - DNA, 22 bp, Homo sapiens
gcccagcaggacagagtggttt

SEQ ID NO: 7553568 - DNA, 22 bp, Homo sapiens
gcccagcaggacagagtggttt

SEQ ID NO: 7553569 - DNA, 22 bp, Homo sapiens
gcccagcaggacagagtggttt

SEQ ID NO: 7553570 - DNA, 22 bp, Homo sapiens
gcccagcaggacagagtggttt

SEQ ID NO: 7553571 - DNA, 22 bp, Homo sapiens
gcccagcccagaaaggttcgga

SEQ ID NO: 7553572 - DNA, 22 bp, Homo sapiens
gcccagcccagaaaggttcgga

SEQ ID NO: 7553573 - DNA, 22 bp, Homo sapiens
gcccagcccagaaaggttcgga

SEQ ID NO: 7553574 - DNA, 22 bp, Homo sapiens
gcccagccagagctgtgtgatg

SEQ ID NO: 7553575 - DNA, 22 bp, Homo sapiens
gcccagccagagctgtgtgatg

SEQ ID NO: 7553576 - DNA, 22 bp, Homo sapiens
gcccagcccctgggtggacgtg

SEQ ID NO: 7553577 - DNA, 22 bp, Homo sapiens
gcccagcccctgggtggacgtg

SEQ ID NO: 7553578 - DNA, 22 bp, Homo sapiens
gcccagcccctgggtggacgtg

SEQ ID NO: 7553579 - DNA, 22 bp, Homo sapiens
gcccagcccagaaaggttcgga

SEQ ID NO: 7553580 - DNA, 22 bp, Homo sapiens
gcccagccagagctgtgtgatg

SEQ ID NO: 7553581 - DNA, 22 bp, Homo sapiens
gcccagccagagctgtgtgatg

SEQ ID NO: 7553582 - DNA, 22 bp, Homo sapiens
gcccagccagagctgtgtgatg

SEQ ID NO: 7553583 - DNA, 22 bp, Homo sapiens
gcccagccagagctgtgtgatg

SEQ ID NO: 7553584 - DNA, 22 bp, Homo sapiens
gcccagccagagctgtgtgatg

SEQ ID NO: 7553585 - DNA, 22 bp, Homo sapiens
gcccagccagagctgtgtgatg

SEQ ID NO: 7553586 - DNA, 22 bp, Homo sapiens
gcccagccacagtcactttcat

SEQ ID NO: 7553587 - DNA, 18 bp, Homo sapiens
attttgaacaatgctgta

SEQ ID NO: 7553588 - DNA, 18 bp, Homo sapiens
attttgaacaatgctgta

SEQ ID NO: 7553589 - DNA, 18 bp, Homo sapiens
attttgaacaatgctgta

SEQ ID NO: 7553590 - DNA, 22 bp, Homo sapiens
attttgaaatacttgaaggaaa

SEQ ID NO: 7553591 - DNA, 22 bp, Homo sapiens
attttgaaatacttgaaggaaa

SEQ ID NO: 7553592 - DNA, 22 bp, Homo sapiens
attttgaaatacttgaaggaaa

SEQ ID NO: 7553593 - DNA, 22 bp, Homo sapiens
attttgaaatacttgaaggaaa

SEQ ID NO: 7553594 - DNA, 18 bp, Homo sapiens
attttgaacaatgctgta

SEQ ID NO: 7553595 - DNA, 18 bp, Homo sapiens
attttgaacaatgctgta

SEQ ID NO: 7553596 - DNA, 18 bp, Homo sapiens
attttgaacaatgctgta

SEQ ID NO: 7553597 - DNA, 18 bp, Homo sapiens
attttgaacaatgctgta

SEQ ID NO: 7553598 - DNA, 18 bp, Homo sapiens
attttgaacaatgctgta

SEQ ID NO: 7553599 - DNA, 18 bp, Homo sapiens
attttgaacaatgctgta

SEQ ID NO: 7553600 - DNA, 22 bp, Homo sapiens
attttgaagggaattgaagttc

SEQ ID NO: 7553601 - DNA, 22 bp, Homo sapiens
attttgaagggaattgaagttc

SEQ ID NO: 7553602 - DNA, 22 bp, Homo sapiens
attttgaagggaattgaagttc

SEQ ID NO: 7553603 - DNA, 22 bp, Homo sapiens
attttgaagggaattgaagttc

SEQ ID NO: 7553604 - DNA, 18 bp, Homo sapiens
attttgaactgggaatat

SEQ ID NO: 7553605 - DNA, 18 bp, Homo sapiens
attttgaactgggaatat

SEQ ID NO: 7553606 - DNA, 22 bp, Homo sapiens
gcctggctccctctgcagctcc

SEQ ID NO: 7553607 - DNA, 22 bp, Homo sapiens
gcctggctccctctgcagctcc

SEQ ID NO: 7553608 - DNA, 22 bp, Homo sapiens
gcctggctcctaagagcacaac

SEQ ID NO: 7553609 - DNA, 22 bp, Homo sapiens
gcctggctcctaagagcacaac

SEQ ID NO: 7553610 - DNA, 22 bp, Homo sapiens
gcctggctcctaagagcacaac

SEQ ID NO: 7553611 - DNA, 22 bp, Homo sapiens
gcctggctcctaagagcacaac

SEQ ID NO: 7553612 - DNA, 22 bp, Homo sapiens
gcctggctccctctgcagctcc

SEQ ID NO: 7553613 - DNA, 22 bp, Homo sapiens
gcctggctccctctgcagctcc

SEQ ID NO: 7553614 - DNA, 22 bp, Homo sapiens
gcctggctcacagagcagcctt

SEQ ID NO: 7553615 - DNA, 22 bp, Homo sapiens
gcctggctcacagagcagcctt

SEQ ID NO: 7553616 - DNA, 22 bp, Homo sapiens
gcctggctcacagagcagcctt

SEQ ID NO: 7553617 - DNA, 22 bp, Homo sapiens
attttgaagggaattgaagttc

SEQ ID NO: 7553618 - DNA, 22 bp, Homo sapiens
attttgaaaccaagttatttcc

SEQ ID NO: 7553619 - DNA, 22 bp, Homo sapiens
attttgaaaccaagttatttcc

SEQ ID NO: 7553620 - DNA, 22 bp, Homo sapiens
attttgaaaccaagttatttcc

SEQ ID NO: 7553621 - DNA, 22 bp, Homo sapiens
attttgaaaagcatttgagtaa

SEQ ID NO: 7553622 - DNA, 22 bp, Homo sapiens
attttgaaaagcatttgagtaa

SEQ ID NO: 7553623 - DNA, 22 bp, Homo sapiens
attttgaaaagcatttgagtaa

SEQ ID NO: 7553624 - DNA, 22 bp, Homo sapiens
attttgaaaagcatttgagtaa

SEQ ID NO: 7553625 - DNA, 22 bp, Homo sapiens
attttgaaaagcatttgagtaa

SEQ ID NO: 7553626 - DNA, 22 bp, Homo sapiens
attttgaaatacttgaaggaaa

SEQ ID NO: 7553627 - DNA, 22 bp, Homo sapiens
attttgaaatacttgaaggaaa

SEQ ID NO: 7553628 - DNA, 22 bp, Homo sapiens
attttgaaaccaagttatttcc

SEQ ID NO: 7553629 - DNA, 22 bp, Homo sapiens
attttgaaaccaagttatttcc

SEQ ID NO: 7553630 - DNA, 22 bp, Homo sapiens
attttgaaaccaagttatttcc

SEQ ID NO: 7553631 - DNA, 22 bp, Homo sapiens
attttgaaaccaagttatttcc

SEQ ID NO: 7553632 - DNA, 22 bp, Homo sapiens
attttgaaaccaagttatttcc

SEQ ID NO: 7553633 - DNA, 22 bp, Homo sapiens
attttgaaaagcatttgagtaa

SEQ ID NO: 7553634 - DNA, 22 bp, Homo sapiens
attttgaaaagcatttgagtaa

SEQ ID NO: 7553635 - DNA, 22 bp, Homo sapiens
attttgaaaagcatttgagtaa

SEQ ID NO: 7553636 - DNA, 22 bp, Homo sapiens
attttcttctctccctggctgc

SEQ ID NO: 7553637 - DNA, 22 bp, Homo sapiens
attttcttctctccctggctgc

SEQ ID NO: 7553638 - DNA, 22 bp, Homo sapiens
attttcttctctccctggctgc

SEQ ID NO: 7553639 - DNA, 22 bp, Homo sapiens
attttcttctctccctggctgc

SEQ ID NO: 7553640 - DNA, 22 bp, Homo sapiens
attttcttctctccctggctgc

SEQ ID NO: 7553641 - DNA, 22 bp, Homo sapiens
attttcttctctccctggctgc

SEQ ID NO: 7553642 - DNA, 22 bp, Homo sapiens
attttctagatagatgatgcat

SEQ ID NO: 7553643 - DNA, 22 bp, Homo sapiens
attttctagatagatgatgcat

SEQ ID NO: 7553644 - DNA, 22 bp, Homo sapiens
attttctagatagatgatgcat

SEQ ID NO: 7553645 - DNA, 22 bp, Homo sapiens
attttctagatagatgatgcat

SEQ ID NO: 7553646 - DNA, 22 bp, Homo sapiens
attttcttctctccctggctgc

SEQ ID NO: 7553647 - DNA, 22 bp, Homo sapiens
attttcttctctccctggctgc

SEQ ID NO: 7553648 - DNA, 22 bp, Homo sapiens
attttctgtgtgcagataaata

SEQ ID NO: 7553649 - DNA, 22 bp, Homo sapiens
attttctgtgtgcagataaata

SEQ ID NO: 7553650 - DNA, 22 bp, Homo sapiens
attttactaagtggatatctgt

SEQ ID NO: 7553651 - DNA, 22 bp, Homo sapiens
attttactaagtggatatctgt

SEQ ID NO: 7553652 - DNA, 22 bp, Homo sapiens
attttactaagtggatatctgt

SEQ ID NO: 7553653 - DNA, 22 bp, Homo sapiens
attttactactccaattaatga

SEQ ID NO: 7553654 - DNA, 22 bp, Homo sapiens
attttactactccaattaatga

SEQ ID NO: 7553655 - DNA, 18 bp, Homo sapiens
gcctgccatccccacagc

SEQ ID NO: 7553656 - DNA, 22 bp, Homo sapiens
attttactactccaattaatga

SEQ ID NO: 7553657 - DNA, 22 bp, Homo sapiens
gcctgccatgagctaatgacac

SEQ ID NO: 7553658 - DNA, 21 bp, Homo sapiens
gcctgccccatgtttctgttg

SEQ ID NO: 7553659 - DNA, 22 bp, Homo sapiens
gcctgcccacggggctggcata

SEQ ID NO: 7553660 - DNA, 22 bp, Homo sapiens
gcctgcccacggggctggcata

SEQ ID NO: 7553661 - DNA, 22 bp, Homo sapiens
gcctgcccacggggctggcata

SEQ ID NO: 7553662 - DNA, 22 bp, Homo sapiens
gcctgcccacggggctggcata

SEQ ID NO: 7553663 - DNA, 22 bp, Homo sapiens
gcctgcccacggggctggcata

SEQ ID NO: 7553664 - DNA, 22 bp, Homo sapiens
gcctgcccacggggctggcata

SEQ ID NO: 7553665 - DNA, 22 bp, Homo sapiens
gcctgcccacggggctggcata

SEQ ID NO: 7553666 - DNA, 22 bp, Homo sapiens
gcctgcccacggggctggcata

SEQ ID NO: 7553667 - DNA, 22 bp, Homo sapiens
gcctgcccacggggctggcata

SEQ ID NO: 7553668 - DNA, 22 bp, Homo sapiens
gcctgcccacggggctggcata

SEQ ID NO: 7553669 - DNA, 22 bp, Homo sapiens
attttacataaggaaggtttaa

SEQ ID NO: 7553670 - DNA, 22 bp, Homo sapiens
attttacataaggaaggtttaa

SEQ ID NO: 7553671 - DNA, 22 bp, Homo sapiens
attttacataaggaaggtttaa

SEQ ID NO: 7553672 - DNA, 22 bp, Homo sapiens
attttacataaggaaggtttaa

SEQ ID NO: 7553673 - DNA, 22 bp, Homo sapiens
attttacataaggaaggtttaa

SEQ ID NO: 7553674 - DNA, 22 bp, Homo sapiens
attttactaagtggatatctgt

SEQ ID NO: 7553675 - DNA, 22 bp, Homo sapiens
attttaccttaaagtctatatt

SEQ ID NO: 7553676 - DNA, 22 bp, Homo sapiens
attttaccttaaagtctatatt

SEQ ID NO: 7553677 - DNA, 22 bp, Homo sapiens
attttacataaggaaggtttaa

SEQ ID NO: 7553678 - DNA, 22 bp, Homo sapiens
attttaccttaaagtctatatt

SEQ ID NO: 7553679 - DNA, 22 bp, Homo sapiens
attttacataaggaaggtttaa

SEQ ID NO: 7553680 - DNA, 23 bp, Homo sapiens
attttacaggtcagttccttgaa

SEQ ID NO: 7553681 - DNA, 23 bp, Homo sapiens
attttacaggtcagttccttgaa

SEQ ID NO: 7553682 - DNA, 23 bp, Homo sapiens
attttacaggtcagttccttgaa

SEQ ID NO: 7553683 - DNA, 23 bp, Homo sapiens
attttacaggtcagttccttgaa

SEQ ID NO: 7553684 - DNA, 23 bp, Homo sapiens
attttacaggtcagttccttgaa

SEQ ID NO: 7553685 - DNA, 23 bp, Homo sapiens
attttacaggtcagttccttgaa

SEQ ID NO: 7553686 - DNA, 23 bp, Homo sapiens
attttacaggtcagttccttgaa

SEQ ID NO: 7553687 - DNA, 23 bp, Homo sapiens
attttacaggtcagttccttgaa

SEQ ID NO: 7553688 - DNA, 22 bp, Homo sapiens
attttctagatagatgatgcat

SEQ ID NO: 7553689 - DNA, 22 bp, Homo sapiens
attttctagatagatgatgcat

SEQ ID NO: 7553690 - DNA, 22 bp, Homo sapiens
attttctagatagatgatgcat

SEQ ID NO: 7553691 - DNA, 22 bp, Homo sapiens
attttctagatagatgatgcat

SEQ ID NO: 7553692 - DNA, 22 bp, Homo sapiens
attttctagatagatgatgcat

SEQ ID NO: 7553693 - DNA, 22 bp, Homo sapiens
attttctagatagatgatgcat

SEQ ID NO: 7553694 - DNA, 18 bp, Homo sapiens
gcctgcctagagcttgcc

SEQ ID NO: 7553695 - DNA, 22 bp, Homo sapiens
gcctgcctagaattgcagcttt

SEQ ID NO: 7553696 - DNA, 22 bp, Homo sapiens
gcctgcctagaattgcagcttt

SEQ ID NO: 7553697 - DNA, 22 bp, Homo sapiens
gcctgcctagaattgcagcttt

SEQ ID NO: 7553698 - DNA, 22 bp, Homo sapiens
gcctgcctagaattgcagcttt

SEQ ID NO: 7553699 - DNA, 23 bp, Homo sapiens
gcctgccgcctggctgagaactg

SEQ ID NO: 7553700 - DNA, 23 bp, Homo sapiens
gcctgccgcctggctgagaactg

SEQ ID NO: 7553701 - DNA, 22 bp, Homo sapiens
gcctgccctgaaagaggtgaag

SEQ ID NO: 7553702 - DNA, 23 bp, Homo sapiens
gcctgccgcctggctgagaactg

SEQ ID NO: 7553703 - DNA, 22 bp, Homo sapiens
gcctgcctagaattgcagcttt

SEQ ID NO: 7553704 - DNA, 22 bp, Homo sapiens
gcctgcctagaattgcagcttt

SEQ ID NO: 7553705 - DNA, 22 bp, Homo sapiens
gcctgcctagaattgcagcttt

SEQ ID NO: 7553706 - DNA, 22 bp, Homo sapiens
gcctgcctagaattgcagcttt

SEQ ID NO: 7553707 - DNA, 22 bp, Homo sapiens
gcctgcctagaattgcagcttt

SEQ ID NO: 7553708 - DNA, 22 bp, Homo sapiens
gcctgcctagaattgcagcttt

SEQ ID NO: 7553709 - DNA, 22 bp, Homo sapiens
gcctgccccttcctgggcaggg

SEQ ID NO: 7553710 - DNA, 22 bp, Homo sapiens
gcctgccccttcctgggcaggg

SEQ ID NO: 7553711 - DNA, 22 bp, Homo sapiens
gcctgccccttcctgggcaggg

SEQ ID NO: 7553712 - DNA, 22 bp, Homo sapiens
gcctgccccttcctgggcaggg

SEQ ID NO: 7553713 - DNA, 22 bp, Homo sapiens
gcctgccccttcctgggcaggg

SEQ ID NO: 7553714 - DNA, 22 bp, Homo sapiens
gcctgccccttcctgggcaggg

SEQ ID NO: 7553715 - DNA, 21 bp, Homo sapiens
gcctgccccatgtttctgttg

SEQ ID NO: 7553716 - DNA, 22 bp, Homo sapiens
gcctgccccttcctgggcaggg

SEQ ID NO: 7553717 - DNA, 22 bp, Homo sapiens
gcctgccccttcctgggcaggg

SEQ ID NO: 7553718 - DNA, 22 bp, Homo sapiens
gcctgccccttcctgggcaggg

SEQ ID NO: 7553719 - DNA, 21 bp, Homo sapiens
gcctgccctctgtgatggcca

SEQ ID NO: 7553720 - DNA, 21 bp, Homo sapiens
gcctgccctctgtgatggcca

SEQ ID NO: 7553721 - DNA, 21 bp, Homo sapiens
gcctgccctctgtgatggcca

SEQ ID NO: 7553722 - DNA, 21 bp, Homo sapiens
gcctgccctctgtgatggcca

SEQ ID NO: 7553723 - DNA, 21 bp, Homo sapiens
gcctgccctctgtgatggcca

SEQ ID NO: 7553724 - DNA, 22 bp, Homo sapiens
gcctgccctgaaagaggtgaag

SEQ ID NO: 7553725 - DNA, 21 bp, Homo sapiens
gcctgccctctgtgatggcca

SEQ ID NO: 7553726 - DNA, 22 bp, Homo sapiens
gcctgccctgaaagaggtgaag

SEQ ID NO: 7553727 - DNA, 22 bp, Homo sapiens
gcctgccctgaaagaggtgaag

SEQ ID NO: 7553728 - DNA, 22 bp, Homo sapiens
gcctgccctgaaagaggtgaag

SEQ ID NO: 7553729 - DNA, 22 bp, Homo sapiens
atttgcatttacatagcataga

SEQ ID NO: 7553730 - DNA, 22 bp, Homo sapiens
atttgcatttacatagcataga

SEQ ID NO: 7553731 - DNA, 22 bp, Homo sapiens
atttgcatttacatagcataga

SEQ ID NO: 7553732 - DNA, 22 bp, Homo sapiens
atttgcatttacatagcataga

SEQ ID NO: 7553733 - DNA, 22 bp, Homo sapiens
atttgcatttagaaagatcact

SEQ ID NO: 7553734 - DNA, 22 bp, Homo sapiens
atttgcatttagaaagatcact

SEQ ID NO: 7553735 - DNA, 22 bp, Homo sapiens
atttgcattgtagaccctctaa

SEQ ID NO: 7553736 - DNA, 21 bp, Homo sapiens
atttgcattaaaatattacgc

SEQ ID NO: 7553737 - DNA, 21 bp, Homo sapiens
atttgcattaaaatattacgc

SEQ ID NO: 7553738 - DNA, 21 bp, Homo sapiens
atttgcattaaaatattacgc

SEQ ID NO: 7553739 - DNA, 20 bp, Homo sapiens
atttgcatctgaataactta

SEQ ID NO: 7553740 - DNA, 20 bp, Homo sapiens
atttgcatctgaataactta

SEQ ID NO: 7553741 - DNA, 22 bp, Homo sapiens
atttgcatatctgatagactaa

SEQ ID NO: 7553742 - DNA, 20 bp, Homo sapiens
atttgcatctgaataactta

SEQ ID NO: 7553743 - DNA, 20 bp, Homo sapiens
atttgcatctgaataactta

SEQ ID NO: 7553744 - DNA, 20 bp, Homo sapiens
atttgcatctgaataactta

SEQ ID NO: 7553745 - DNA, 22 bp, Homo sapiens
atttgcatgacctttgcaagtg

SEQ ID NO: 7553746 - DNA, 22 bp, Homo sapiens
atttgcatgacctttgcaagtg

SEQ ID NO: 7553747 - DNA, 23 bp, Homo sapiens
atttgcatggccggattatggat

SEQ ID NO: 7553748 - DNA, 23 bp, Homo sapiens
atttgcatggccggattatggat

SEQ ID NO: 7553749 - DNA, 22 bp, Homo sapiens
atttgcatgcttctattgtgaa

SEQ ID NO: 7553750 - DNA, 22 bp, Homo sapiens
atttgcatgcttctattgtgaa

SEQ ID NO: 7553751 - DNA, 22 bp, Homo sapiens
atttgcatgcttctattgtgaa

SEQ ID NO: 7553752 - DNA, 22 bp, Homo sapiens
atttgcctctgctttcaaggat

SEQ ID NO: 7553753 - DNA, 22 bp, Homo sapiens
atttgcctctgctttcaaggat

SEQ ID NO: 7553754 - DNA, 22 bp, Homo sapiens
atttgcatttagaaagatcact

SEQ ID NO: 7553755 - DNA, 22 bp, Homo sapiens
atttgccttactgaagaaggag

SEQ ID NO: 7553756 - DNA, 22 bp, Homo sapiens
atttgccttactgaagaaggag

SEQ ID NO: 7553757 - DNA, 22 bp, Homo sapiens
atttgcctgtaagacaaggcct

SEQ ID NO: 7553758 - DNA, 22 bp, Homo sapiens
atttgcctgtaagacaaggcct

SEQ ID NO: 7553759 - DNA, 22 bp, Homo sapiens
atttgcctgtaagacaaggcct

SEQ ID NO: 7553760 - DNA, 22 bp, Homo sapiens
atttgcctttcgaatcaacagg

SEQ ID NO: 7553761 - DNA, 22 bp, Homo sapiens
atttgcctttcgaatcaacagg

SEQ ID NO: 7553762 - DNA, 22 bp, Homo sapiens
atttgccttgtgatttgtaagt

SEQ ID NO: 7553763 - DNA, 22 bp, Homo sapiens
atttgccttggtgatttgtaaa

SEQ ID NO: 7553764 - DNA, 22 bp, Homo sapiens
atttgcctttcgaatcaacagg

SEQ ID NO: 7553765 - DNA, 22 bp, Homo sapiens
atttgccttgtgatttgtaagt

SEQ ID NO: 7553766 - DNA, 22 bp, Homo sapiens
atttgccttgtgatttgtaagt

SEQ ID NO: 7553767 - DNA, 22 bp, Homo sapiens
atttgccttgtgatttgtaagt

SEQ ID NO: 7553768 - DNA, 22 bp, Homo sapiens
atttgccttgtgatttgtaagt

SEQ ID NO: 7553769 - DNA, 22 bp, Homo sapiens
atttgccttgtgatttgtaagt

SEQ ID NO: 7553770 - DNA, 22 bp, Homo sapiens
atttgccttggtgatttgtaaa

SEQ ID NO: 7553771 - DNA, 22 bp, Homo sapiens
atttgccttggtgatttgtaaa

SEQ ID NO: 7553772 - DNA, 22 bp, Homo sapiens
atttgccttgtgaattggatat

SEQ ID NO: 7553773 - DNA, 22 bp, Homo sapiens
atttgccttgtgaattggatat

SEQ ID NO: 7553774 - DNA, 22 bp, Homo sapiens
atttgccttactgaagaaggag

SEQ ID NO: 7553775 - DNA, 22 bp, Homo sapiens
atttgccttggtgatttgtaaa

SEQ ID NO: 7553776 - DNA, 22 bp, Homo sapiens
attttaataagattcccaagta

SEQ ID NO: 7553777 - DNA, 22 bp, Homo sapiens
attttaataagattcccaagta

SEQ ID NO: 7553778 - DNA, 22 bp, Homo sapiens
attttaataagattcccaagta

SEQ ID NO: 7553779 - DNA, 22 bp, Homo sapiens
attttaataagattcccaagta

SEQ ID NO: 7553780 - DNA, 22 bp, Homo sapiens
attttaataagattcccaagta

SEQ ID NO: 7553781 - DNA, 22 bp, Homo sapiens
attttaataagatccatttggt

SEQ ID NO: 7553782 - DNA, 22 bp, Homo sapiens
attttaataagatccatttggt

SEQ ID NO: 7553783 - DNA, 22 bp, Homo sapiens
attttaataagattcccaagta

SEQ ID NO: 7553784 - DNA, 22 bp, Homo sapiens
attttaataagattcccaagta

SEQ ID NO: 7553785 - DNA, 22 bp, Homo sapiens
attttaaggcttatttaaaggc

SEQ ID NO: 7553786 - DNA, 22 bp, Homo sapiens
attttaaggcttatttaaaggc

SEQ ID NO: 7553787 - DNA, 22 bp, Homo sapiens
attttaataagatccatttggt

SEQ ID NO: 7553788 - DNA, 22 bp, Homo sapiens
attttaaggcttatttaaaggc

SEQ ID NO: 7553789 - DNA, 22 bp, Homo sapiens
attttaataagatccatttggt

SEQ ID NO: 7553790 - DNA, 22 bp, Homo sapiens
attttaataagatccatttggt

SEQ ID NO: 7553791 - DNA, 22 bp, Homo sapiens
attttaataagatccatttggt

SEQ ID NO: 7553792 - DNA, 22 bp, Homo sapiens
atttgtctttggacctgtgaga

SEQ ID NO: 7553793 - DNA, 22 bp, Homo sapiens
atttgtctttggacctgtgaga

SEQ ID NO: 7553794 - DNA, 22 bp, Homo sapiens
attttaaccctcttatatatac

SEQ ID NO: 7553795 - DNA, 22 bp, Homo sapiens
attttaaggcttatttaaaggc

SEQ ID NO: 7553796 - DNA, 22 bp, Homo sapiens
attttaaggcttatttaaaggc

SEQ ID NO: 7553797 - DNA, 23 bp, Homo sapiens
attttaaccttgactaacatgca

SEQ ID NO: 7553798 - DNA, 22 bp, Homo sapiens
attttaaggcttatttaaaggc

SEQ ID NO: 7553799 - DNA, 22 bp, Homo sapiens
attttaaggcttatttaaaggc

SEQ ID NO: 7553800 - DNA, 22 bp, Homo sapiens
attttaaggcttatttaaaggc

SEQ ID NO: 7553801 - DNA, 22 bp, Homo sapiens
attttaaggcttatttaaaggc

SEQ ID NO: 7553802 - DNA, 22 bp, Homo sapiens
atttgtctgcttgctgccttcc

SEQ ID NO: 7553803 - DNA, 22 bp, Homo sapiens
atttgccttttaaactcacaat

SEQ ID NO: 7553804 - DNA, 22 bp, Homo sapiens
atttgtctctgcactttactca

SEQ ID NO: 7553805 - DNA, 22 bp, Homo sapiens
atttgcctttcgaatcaacagg

SEQ ID NO: 7553806 - DNA, 22 bp, Homo sapiens
atttgtcttcagtaggttcttc

SEQ ID NO: 7553807 - DNA, 22 bp, Homo sapiens
atttgtctgcttgctgccttcc

SEQ ID NO: 7553808 - DNA, 22 bp, Homo sapiens
atttgcaattactcatgtcatt

SEQ ID NO: 7553809 - DNA, 22 bp, Homo sapiens
atttgcaattttactttgcagt

SEQ ID NO: 7553810 - DNA, 22 bp, Homo sapiens
atttgcaattttactttgcagt

SEQ ID NO: 7553811 - DNA, 22 bp, Homo sapiens
atttgcaattttactttgcagt

SEQ ID NO: 7553812 - DNA, 22 bp, Homo sapiens
atttgcaagcatgcacaaaagc

SEQ ID NO: 7553813 - DNA, 22 bp, Homo sapiens
atttgcaagcatgcacaaaagc

SEQ ID NO: 7553814 - DNA, 22 bp, Homo sapiens
atttgcaagagtaagaatttct

SEQ ID NO: 7553815 - DNA, 22 bp, Homo sapiens
atttgcaatgatttcagtgctt

SEQ ID NO: 7553816 - DNA, 22 bp, Homo sapiens
atttgcaagcatgcacaaaagc

SEQ ID NO: 7553817 - DNA, 22 bp, Homo sapiens
atttgcaagcatgcacaaaagc

SEQ ID NO: 7553818 - DNA, 22 bp, Homo sapiens
atttgcaaaggttaacagcagt

SEQ ID NO: 7553819 - DNA, 22 bp, Homo sapiens
atttgcaaaggttaacagcagt

SEQ ID NO: 7553820 - DNA, 22 bp, Homo sapiens
atttgcaaaggttaacagcagt

SEQ ID NO: 7553821 - DNA, 22 bp, Homo sapiens
atttgatttgtagatagtgtag

SEQ ID NO: 7553822 - DNA, 22 bp, Homo sapiens
atttgcaaagtcgtatctgtga

SEQ ID NO: 7553823 - DNA, 22 bp, Homo sapiens
atttgcaaagtcgtatctgtga

SEQ ID NO: 7553824 - DNA, 22 bp, Homo sapiens
atttgcaaagtcgtatctgtga

SEQ ID NO: 7553825 - DNA, 22 bp, Homo sapiens
atttgcaaagtcgtatctgtga

SEQ ID NO: 7553826 - DNA, 22 bp, Homo sapiens
atttgcaaagtcgtatctgtga

SEQ ID NO: 7553827 - DNA, 22 bp, Homo sapiens
atttgcaagagtaagaatttct

SEQ ID NO: 7553828 - DNA, 22 bp, Homo sapiens
atttgcaagagtaagaatttct

SEQ ID NO: 7553829 - DNA, 22 bp, Homo sapiens
atttgcagattctgtcaggttt

SEQ ID NO: 7553830 - DNA, 22 bp, Homo sapiens
atttgcagctaggatccaaagt

SEQ ID NO: 7553831 - DNA, 22 bp, Homo sapiens
atttgcagctaggatccaaagt

SEQ ID NO: 7553832 - DNA, 22 bp, Homo sapiens
atttgcaattttactttgcagt

SEQ ID NO: 7553833 - DNA, 22 bp, Homo sapiens
atttgcacatagtattatcttt

SEQ ID NO: 7553834 - DNA, 22 bp, Homo sapiens
atttgcacatagtattatcttt

SEQ ID NO: 7553835 - DNA, 22 bp, Homo sapiens
atttgcagagctctgaattttg

SEQ ID NO: 7553836 - DNA, 22 bp, Homo sapiens
atttgcagagctctgaattttg

SEQ ID NO: 7553837 - DNA, 22 bp, Homo sapiens
atttgcacacagtctcctgtgg

SEQ ID NO: 7553838 - DNA, 22 bp, Homo sapiens
atttgcatatctgatagactaa

SEQ ID NO: 7553839 - DNA, 22 bp, Homo sapiens
atttgcatatctgatagactaa

SEQ ID NO: 7553840 - DNA, 22 bp, Homo sapiens
atttgcataatagtgatttgta

SEQ ID NO: 7553841 - DNA, 22 bp, Homo sapiens
atttgcataatagtgatttgta

SEQ ID NO: 7553842 - DNA, 22 bp, Homo sapiens
atttgcataatagtgatttgta

SEQ ID NO: 7553843 - DNA, 22 bp, Homo sapiens
atttgcaggtgtcgattagtct

SEQ ID NO: 7553844 - DNA, 22 bp, Homo sapiens
atttgcataaggatgctactgt

SEQ ID NO: 7553845 - DNA, 22 bp, Homo sapiens
atttgcataaggatgctactgt

SEQ ID NO: 7553846 - DNA, 22 bp, Homo sapiens
atttcttccttctcctagaaga

SEQ ID NO: 7553847 - DNA, 22 bp, Homo sapiens
atttcttccttctcctagaaga

SEQ ID NO: 7553848 - DNA, 22 bp, Homo sapiens
atttcttccttctcctagaaga

SEQ ID NO: 7553849 - DNA, 22 bp, Homo sapiens
atttcttccttctcctagaaga

SEQ ID NO: 7553850 - DNA, 22 bp, Homo sapiens
atttcttgattccaccagtgaa

SEQ ID NO: 7553851 - DNA, 23 bp, Homo sapiens
atttgacagagcatagcatttct

SEQ ID NO: 7553852 - DNA, 23 bp, Homo sapiens
atttgacagagcatagcatttct

SEQ ID NO: 7553853 - DNA, 23 bp, Homo sapiens
atttgacagagcatagcatttct

SEQ ID NO: 7553854 - DNA, 23 bp, Homo sapiens
atttgacagagcatagcatttct

SEQ ID NO: 7553855 - DNA, 23 bp, Homo sapiens
atttgacagagcatagcatttct

SEQ ID NO: 7553856 - DNA, 22 bp, Homo sapiens
atttgacaacttctggtggcat

SEQ ID NO: 7553857 - DNA, 22 bp, Homo sapiens
atttgacaacttctggtggcat

SEQ ID NO: 7553858 - DNA, 22 bp, Homo sapiens
atttcttgattccaccagtgaa

SEQ ID NO: 7553859 - DNA, 22 bp, Homo sapiens
atttcttgattccaccagtgaa

SEQ ID NO: 7553860 - DNA, 22 bp, Homo sapiens
atttgacaacttctggtggcat

SEQ ID NO: 7553861 - DNA, 23 bp, Homo sapiens
atttgagaaagtatttttaagac

SEQ ID NO: 7553862 - DNA, 22 bp, Homo sapiens
atttgacattgacacacctatg

SEQ ID NO: 7553863 - DNA, 20 bp, Homo sapiens
atttgacttggagagagaaa

SEQ ID NO: 7553864 - DNA, 22 bp, Homo sapiens
atttgacattgacacacctatg

SEQ ID NO: 7553865 - DNA, 22 bp, Homo sapiens
atttgacagtgagttgtggatg

SEQ ID NO: 7553866 - DNA, 22 bp, Homo sapiens
atttgacattgacacacctatg

SEQ ID NO: 7553867 - DNA, 22 bp, Homo sapiens
atttgacattattctctcagtc

SEQ ID NO: 7553868 - DNA, 22 bp, Homo sapiens
atttgacagtgagttgtggatg

SEQ ID NO: 7553869 - DNA, 22 bp, Homo sapiens
atttgattgtgtctgagacgat

SEQ ID NO: 7553870 - DNA, 22 bp, Homo sapiens
atttgattgtgtctgagacgat

SEQ ID NO: 7553871 - DNA, 22 bp, Homo sapiens
atttgattagctgtgtaatttt

SEQ ID NO: 7553872 - DNA, 22 bp, Homo sapiens
atttgattagctgtgtaatttt

SEQ ID NO: 7553873 - DNA, 22 bp, Homo sapiens
atttgattagctgtgtaatttt

SEQ ID NO: 7553874 - DNA, 22 bp, Homo sapiens
atttgatagtatgacagggcag

SEQ ID NO: 7553875 - DNA, 22 bp, Homo sapiens
atttgattagctgtgtaatttt

SEQ ID NO: 7553876 - DNA, 22 bp, Homo sapiens
atttgaggatagttgggtactc

SEQ ID NO: 7553877 - DNA, 22 bp, Homo sapiens
atttgaggatagttgggtactc

SEQ ID NO: 7553878 - DNA, 22 bp, Homo sapiens
atttgagatggtaaataacttt

SEQ ID NO: 7553879 - DNA, 22 bp, Homo sapiens
atttgagatggtaaataacttt

SEQ ID NO: 7553880 - DNA, 22 bp, Homo sapiens
atttgagaaaggagggaacttt

SEQ ID NO: 7553881 - DNA, 22 bp, Homo sapiens
atttgagatggtaaataacttt

SEQ ID NO: 7553882 - DNA, 22 bp, Homo sapiens
atttgagatggtaaataacttt

SEQ ID NO: 7553883 - DNA, 23 bp, Homo sapiens
atttgagaaagtatttttaagac

SEQ ID NO: 7553884 - DNA, 23 bp, Homo sapiens
atttgagaaagtatttttaagac

SEQ ID NO: 7553885 - DNA, 22 bp, Homo sapiens
gcagatgcagagatggctgggg

SEQ ID NO: 7553886 - DNA, 22 bp, Homo sapiens
gcagatgcagaactcagtgggt

SEQ ID NO: 7553887 - DNA, 22 bp, Homo sapiens
gcagatgcagaactcagtgggt

SEQ ID NO: 7553888 - DNA, 22 bp, Homo sapiens
gcagatgccagatcatgcaggg

SEQ ID NO: 7553889 - DNA, 22 bp, Homo sapiens
gcagatgccactaggtgaagtg

SEQ ID NO: 7553890 - DNA, 22 bp, Homo sapiens
gcagatgccactaggtgaagtg

SEQ ID NO: 7553891 - DNA, 22 bp, Homo sapiens
gcagatgatgtagacagacagt

SEQ ID NO: 7553892 - DNA, 22 bp, Homo sapiens
gcagatgatgtagacagacagt

SEQ ID NO: 7553893 - DNA, 19 bp, Homo sapiens
gcagatgatgaggctggtc

SEQ ID NO: 7553894 - DNA, 19 bp, Homo sapiens
gcagatgatgaggctggtc

SEQ ID NO: 7553895 - DNA, 22 bp, Homo sapiens
gcagatgcaagggtactggggc

SEQ ID NO: 7553896 - DNA, 22 bp, Homo sapiens
gcagatgcaagggtactggggc

SEQ ID NO: 7553897 - DNA, 22 bp, Homo sapiens
gcagatgcaagggtactggggc

SEQ ID NO: 7553898 - DNA, 22 bp, Homo sapiens
gcagatgcaactgcaggtgagt

SEQ ID NO: 7553899 - DNA, 22 bp, Homo sapiens
gcagatgcaactgcaggtgagt

SEQ ID NO: 7553900 - DNA, 22 bp, Homo sapiens
gcagatgcaactgcaggtgagt

SEQ ID NO: 7553901 - DNA, 22 bp, Homo sapiens
gcagatgctgctcctctctaga

SEQ ID NO: 7553902 - DNA, 22 bp, Homo sapiens
gcagatgctgctcctctctaga

SEQ ID NO: 7553903 - DNA, 22 bp, Homo sapiens
gcagcaggtccgcatcatcatc

SEQ ID NO: 7553904 - DNA, 22 bp, Homo sapiens
gcagcaggtccgcatcatcatc

SEQ ID NO: 7553905 - DNA, 22 bp, Homo sapiens
gcagatgctgagatttatttct

SEQ ID NO: 7553906 - DNA, 22 bp, Homo sapiens
gcagatgctgagatttatttct

SEQ ID NO: 7553907 - DNA, 22 bp, Homo sapiens
gcagatgcctgaaggagctggg

SEQ ID NO: 7553908 - DNA, 22 bp, Homo sapiens
gcagatgcctgaaggagctggg

SEQ ID NO: 7553909 - DNA, 22 bp, Homo sapiens
gcagatgcctgaaggagctggg

SEQ ID NO: 7553910 - DNA, 22 bp, Homo sapiens
gcagatgccagatcatgcaggg

SEQ ID NO: 7553911 - DNA, 21 bp, Homo sapiens
gcagccaggactttgggctgg

SEQ ID NO: 7553912 - DNA, 21 bp, Homo sapiens
gcagccaggactttgggctgg

SEQ ID NO: 7553913 - DNA, 21 bp, Homo sapiens
gcagccaggactttgggctgg

SEQ ID NO: 7553914 - DNA, 22 bp, Homo sapiens
gcagccaggaagcctttccctc

SEQ ID NO: 7553915 - DNA, 22 bp, Homo sapiens
gcagccaggaagcctttccctc

SEQ ID NO: 7553916 - DNA, 21 bp, Homo sapiens
gcagccaggactttgggctgg

SEQ ID NO: 7553917 - DNA, 22 bp, Homo sapiens
gcagccaggaagcctttccctc

SEQ ID NO: 7553918 - DNA, 22 bp, Homo sapiens
gcagccaggaagcctttccctc

SEQ ID NO: 7553919 - DNA, 22 bp, Homo sapiens
gcagcaggtccgcatcatcatc

SEQ ID NO: 7553920 - DNA, 22 bp, Homo sapiens
gcagcaggtctgtcaatgtcat

SEQ ID NO: 7553921 - DNA, 22 bp, Homo sapiens
gcagccaggggctgtgacctgt

SEQ ID NO: 7553922 - DNA, 22 bp, Homo sapiens
gcagccaggggctgtgacctgt

SEQ ID NO: 7553923 - DNA, 22 bp, Homo sapiens
gcagccagggctaagctgggga

SEQ ID NO: 7553924 - DNA, 22 bp, Homo sapiens
gcagccaggggctgtgacctgt

SEQ ID NO: 7553925 - DNA, 22 bp, Homo sapiens
gcagccagggctaagctgggga

SEQ ID NO: 7553926 - DNA, 22 bp, Homo sapiens
gcagccaggggctgtgacctgt

SEQ ID NO: 7553927 - DNA, 22 bp, Homo sapiens
gcagccagggttaattatattt

SEQ ID NO: 7553928 - DNA, 22 bp, Homo sapiens
gcagccagggttaattatattt

SEQ ID NO: 7553929 - DNA, 22 bp, Homo sapiens
gcagccaggggctgtgacctgt

SEQ ID NO: 7553930 - DNA, 19 bp, Homo sapiens
gcagccaggtgctctacct

SEQ ID NO: 7553931 - DNA, 19 bp, Homo sapiens
gcagccaggtgctctacct

SEQ ID NO: 7553932 - DNA, 19 bp, Homo sapiens
gcagccaggtgctctacct

SEQ ID NO: 7553933 - DNA, 19 bp, Homo sapiens
gcagccaggtgctctacct

SEQ ID NO: 7553934 - DNA, 22 bp, Homo sapiens
gcagccaggtttgaggaccact

SEQ ID NO: 7553935 - DNA, 22 bp, Homo sapiens
gcagccaggtttgaggaccact

SEQ ID NO: 7553936 - DNA, 22 bp, Homo sapiens
gcagccaggtttgaggaccact

SEQ ID NO: 7553937 - DNA, 19 bp, Homo sapiens
gcagccaggtgctctacct

SEQ ID NO: 7553938 - DNA, 19 bp, Homo sapiens
gcagccaggtgctctacct

SEQ ID NO: 7553939 - DNA, 19 bp, Homo sapiens
gcagccaggtgctctacct

SEQ ID NO: 7553940 - DNA, 22 bp, Homo sapiens
gcagccagggctaagctgggga

SEQ ID NO: 7553941 - DNA, 22 bp, Homo sapiens
gcagccagggagagaaccaggg

SEQ ID NO: 7553942 - DNA, 22 bp, Homo sapiens
gcagccagggctaagctgggga

SEQ ID NO: 7553943 - DNA, 22 bp, Homo sapiens
gcagccagggctaagctgggga

SEQ ID NO: 7553944 - DNA, 22 bp, Homo sapiens
gcagccagggctaagctgggga

SEQ ID NO: 7553945 - DNA, 22 bp, Homo sapiens
gcagccagggagagaaccaggg

SEQ ID NO: 7553946 - DNA, 22 bp, Homo sapiens
gcagccagggagagaaccaggg

SEQ ID NO: 7553947 - DNA, 22 bp, Homo sapiens
gcagccagggagagaaccaggg

SEQ ID NO: 7553948 - DNA, 22 bp, Homo sapiens
gcagccagggagagaaccaggg

SEQ ID NO: 7553949 - DNA, 22 bp, Homo sapiens
gcagccagggagagaaccaggg

SEQ ID NO: 7553950 - DNA, 22 bp, Homo sapiens
gcagccagggagagaaccaggg

SEQ ID NO: 7553951 - DNA, 22 bp, Homo sapiens
gcagccaggctacagcgggctt

SEQ ID NO: 7553952 - DNA, 22 bp, Homo sapiens
gcagccaggctacagcgggctt

SEQ ID NO: 7553953 - DNA, 22 bp, Homo sapiens
gcagccaggctacagcgggctt

SEQ ID NO: 7553954 - DNA, 22 bp, Homo sapiens
gcagccaggctacagcgggctt

SEQ ID NO: 7553955 - DNA, 22 bp, Homo sapiens
gcagccttccgtggacctggac

SEQ ID NO: 7553956 - DNA, 22 bp, Homo sapiens
gcagccttcagtttggcaggag

SEQ ID NO: 7553957 - DNA, 22 bp, Homo sapiens
gcagccttcagtttggcaggag

SEQ ID NO: 7553958 - DNA, 22 bp, Homo sapiens
gcagccttcagtttggcaggag

SEQ ID NO: 7553959 - DNA, 22 bp, Homo sapiens
gcagcctgttgtaccagcctgt

SEQ ID NO: 7553960 - DNA, 22 bp, Homo sapiens
gcagccttcctgacctctaccc

SEQ ID NO: 7553961 - DNA, 22 bp, Homo sapiens
gcagccttccgtggacctggac

SEQ ID NO: 7553962 - DNA, 22 bp, Homo sapiens
gcagccttccgtggacctggac

SEQ ID NO: 7553963 - DNA, 22 bp, Homo sapiens
gcagccttggtgactgagtctg

SEQ ID NO: 7553964 - DNA, 22 bp, Homo sapiens
gcagccttcctgacctctaccc

SEQ ID NO: 7553965 - DNA, 22 bp, Homo sapiens
gcagccttggttgtgagatgaa

SEQ ID NO: 7553966 - DNA, 22 bp, Homo sapiens
gcagctttaaacattggaaata

SEQ ID NO: 7553967 - DNA, 22 bp, Homo sapiens
gcagctttaatctgaataagta

SEQ ID NO: 7553968 - DNA, 22 bp, Homo sapiens
gcaggagagtctgtgccaggtt

SEQ ID NO: 7553969 - DNA, 22 bp, Homo sapiens
gcaggagagtctgtgccaggtt

SEQ ID NO: 7553970 - DNA, 22 bp, Homo sapiens
gcaggagagtctgtgccaggtt

SEQ ID NO: 7553971 - DNA, 22 bp, Homo sapiens
gcaggagagtctgtgccaggtt

SEQ ID NO: 7553972 - DNA, 22 bp, Homo sapiens
gcaggagagtctgtgccaggtt

SEQ ID NO: 7553973 - DNA, 22 bp, Homo sapiens
gcaggagagtctgtgccaggtt

SEQ ID NO: 7553974 - DNA, 22 bp, Homo sapiens
gcaggagagtctgtgccaggtt

SEQ ID NO: 7553975 - DNA, 22 bp, Homo sapiens
gcaggagagtctgtgccaggtt

SEQ ID NO: 7553976 - DNA, 18 bp, Homo sapiens
gcaggagatgggtggggt

SEQ ID NO: 7553977 - DNA, 18 bp, Homo sapiens
gcaggagatgggtggggt

SEQ ID NO: 7553978 - DNA, 18 bp, Homo sapiens
gcaggagatgggtggggt

SEQ ID NO: 7553979 - DNA, 18 bp, Homo sapiens
gcaggagatgggtggggt

SEQ ID NO: 7553980 - DNA, 18 bp, Homo sapiens
gcaggagatgggtggggt

SEQ ID NO: 7553981 - DNA, 18 bp, Homo sapiens
gcaggagatgggtggggt

SEQ ID NO: 7553982 - DNA, 22 bp, Homo sapiens
gcaggagagtctgtgccaggtt

SEQ ID NO: 7553983 - DNA, 22 bp, Homo sapiens
gcaggagagtctgtgccaggtt

SEQ ID NO: 7553984 - DNA, 22 bp, Homo sapiens
gcaggagagtctgtgccaggtt

SEQ ID NO: 7553985 - DNA, 22 bp, Homo sapiens
gcagcctgaggccctttctggc

SEQ ID NO: 7553986 - DNA, 22 bp, Homo sapiens
gcagcctgaggccctttctggc

SEQ ID NO: 7553987 - DNA, 22 bp, Homo sapiens
gcagcctgatgatctgggttgt

SEQ ID NO: 7553988 - DNA, 22 bp, Homo sapiens
gcagcctgatgatctgggttgt

SEQ ID NO: 7553989 - DNA, 22 bp, Homo sapiens
gcagcctgggcaacagagtgag

SEQ ID NO: 7553990 - DNA, 22 bp, Homo sapiens
gcagcctgatgatctgggttgt

SEQ ID NO: 7553991 - DNA, 17 bp, Homo sapiens
gcagcctcttggtagtg

SEQ ID NO: 7553992 - DNA, 22 bp, Homo sapiens
gcagcctgaggccctttctggc

SEQ ID NO: 7553993 - DNA, 17 bp, Homo sapiens
gcagcctcttggtagtg

SEQ ID NO: 7553994 - DNA, 22 bp, Homo sapiens
gcagcctgaggccctttctggc

SEQ ID NO: 7553995 - DNA, 17 bp, Homo sapiens
gcagcctcttggtagtg

SEQ ID NO: 7553996 - DNA, 22 bp, Homo sapiens
gcagccaggtttgaggaccact

SEQ ID NO: 7553997 - DNA, 22 bp, Homo sapiens
gcagccaggtttgaggaccact

SEQ ID NO: 7553998 - DNA, 22 bp, Homo sapiens
gcagccaggtttgaggaccact

SEQ ID NO: 7553999 - DNA, 22 bp, Homo sapiens
gcagccaggtttgaggaccact

SEQ ID NO: 7554000 - DNA, 22 bp, Homo sapiens
gcagcctgttgtaccagcctgt

SEQ ID NO: 7554001 - DNA, 22 bp, Homo sapiens
gcagcctgttgtaccagcctgt

SEQ ID NO: 7554002 - DNA, 22 bp, Homo sapiens
gcagcctgttgtaccagcctgt

SEQ ID NO: 7554003 - DNA, 22 bp, Homo sapiens
gcagcctgttgtaccagcctgt

SEQ ID NO: 7554004 - DNA, 22 bp, Homo sapiens
gcagcctgggcaacagagtgag

SEQ ID NO: 7554005 - DNA, 22 bp, Homo sapiens
gcagcctgggcaacagagtgag

SEQ ID NO: 7554006 - DNA, 22 bp, Homo sapiens
gcagcctgggcaacagagtgag

SEQ ID NO: 7554007 - DNA, 22 bp, Homo sapiens
gcagcctgttgtaccagcctgt

SEQ ID NO: 7554008 - DNA, 22 bp, Homo sapiens
gcagcctgttgtaccagcctgt

SEQ ID NO: 7554009 - DNA, 22 bp, Homo sapiens
gcagcctgttgtaccagcctgt

SEQ ID NO: 7554010 - DNA, 22 bp, Homo sapiens
gcagcctgttgtaccagcctgt

SEQ ID NO: 7554011 - DNA, 22 bp, Homo sapiens
gcagcctgggcaacagagtgag

SEQ ID NO: 7554012 - DNA, 22 bp, Homo sapiens
gcagcctgggcaacagagtgag

SEQ ID NO: 7554013 - DNA, 22 bp, Homo sapiens
gcagcctgggcaacagagtgag

SEQ ID NO: 7554014 - DNA, 22 bp, Homo sapiens
gcagcctgggcaacagagtgag

SEQ ID NO: 7554015 - DNA, 22 bp, Homo sapiens
gcagcctgggcaacagagtgag

SEQ ID NO: 7554016 - DNA, 22 bp, Homo sapiens
gcagcctgggcaacagagtgag

SEQ ID NO: 7554017 - DNA, 22 bp, Homo sapiens
gcagcctgggcaacagagtgag

SEQ ID NO: 7554018 - DNA, 22 bp, Homo sapiens
gcagagttgatgcaagtactga

SEQ ID NO: 7554019 - DNA, 22 bp, Homo sapiens
gcagagttggagccagcccagg

SEQ ID NO: 7554020 - DNA, 22 bp, Homo sapiens
gcagagttctcttccagctaac

SEQ ID NO: 7554021 - DNA, 22 bp, Homo sapiens
gcagagttgatgcaagtactga

SEQ ID NO: 7554022 - DNA, 22 bp, Homo sapiens
gcagagttggagccagcccagg

SEQ ID NO: 7554023 - DNA, 22 bp, Homo sapiens
gcagagtttctggcacattgga

SEQ ID NO: 7554024 - DNA, 22 bp, Homo sapiens
gcagagttctcttccagctaac

SEQ ID NO: 7554025 - DNA, 22 bp, Homo sapiens
gcagagttcctggaaagcaacc

SEQ ID NO: 7554026 - DNA, 22 bp, Homo sapiens
gcagagttcctggaaagcaacc

SEQ ID NO: 7554027 - DNA, 22 bp, Homo sapiens
gcagaggggaagctgaggaatt

SEQ ID NO: 7554028 - DNA, 22 bp, Homo sapiens
gcagaggggaagctgaggaatt

SEQ ID NO: 7554029 - DNA, 22 bp, Homo sapiens
gcagaggggaagctgaggaatt

SEQ ID NO: 7554030 - DNA, 22 bp, Homo sapiens
gcagaggggaagctgaggaatt

SEQ ID NO: 7554031 - DNA, 22 bp, Homo sapiens
gcagagggcaggggtgtttgtt

SEQ ID NO: 7554032 - DNA, 22 bp, Homo sapiens
gcagagggcaggggtgtttgtt

SEQ ID NO: 7554033 - DNA, 22 bp, Homo sapiens
gcagagggcaggggtgtttgtt

SEQ ID NO: 7554034 - DNA, 22 bp, Homo sapiens
gcagagggcaggggtgtttgtt

SEQ ID NO: 7554035 - DNA, 22 bp, Homo sapiens
gcagaggctgtagggaaggttg

SEQ ID NO: 7554036 - DNA, 22 bp, Homo sapiens
gcagaggggaagctgaggaatt

SEQ ID NO: 7554037 - DNA, 22 bp, Homo sapiens
gcagaggggaagctgaggaatt

SEQ ID NO: 7554038 - DNA, 22 bp, Homo sapiens
gcagaggggaagctgaggaatt

SEQ ID NO: 7554039 - DNA, 22 bp, Homo sapiens
gcagaggggaagctgaggaatt

SEQ ID NO: 7554040 - DNA, 22 bp, Homo sapiens
gcagaggggaagctgaggaatt

SEQ ID NO: 7554041 - DNA, 22 bp, Homo sapiens
gcagagggcaggggtgtttgtt

SEQ ID NO: 7554042 - DNA, 22 bp, Homo sapiens
gcagaggggaagctgaggaatt

SEQ ID NO: 7554043 - DNA, 20 bp, Homo sapiens
gcagatgagactcacagagg

SEQ ID NO: 7554044 - DNA, 22 bp, Homo sapiens
gcagatgaagtttacaggaaac

SEQ ID NO: 7554045 - DNA, 18 bp, Homo sapiens
gcagatgagtagtgtacc

SEQ ID NO: 7554046 - DNA, 20 bp, Homo sapiens
gcagatgagactcacagagg

SEQ ID NO: 7554047 - DNA, 22 bp, Homo sapiens
gcagatgagtgagatagacttc

SEQ ID NO: 7554048 - DNA, 19 bp, Homo sapiens
gcagatgatgaggctggtc

SEQ ID NO: 7554049 - DNA, 22 bp, Homo sapiens
gcagagtttgaagtcaagatgt

SEQ ID NO: 7554050 - DNA, 22 bp, Homo sapiens
gcagagtttgaagtcaagatgt

SEQ ID NO: 7554051 - DNA, 22 bp, Homo sapiens
gcagagttgatgcaagtactga

SEQ ID NO: 7554052 - DNA, 22 bp, Homo sapiens
gcagagtttgaagtcaagatgt

SEQ ID NO: 7554053 - DNA, 22 bp, Homo sapiens
gcagataacttgtccaacacca

SEQ ID NO: 7554054 - DNA, 22 bp, Homo sapiens
gcagatcaacactctctttcaa

SEQ ID NO: 7554055 - DNA, 22 bp, Homo sapiens
gcagatagggtattaggagtaa

SEQ ID NO: 7554056 - DNA, 22 bp, Homo sapiens
gcagatgaagtttacaggaaac

SEQ ID NO: 7554057 - DNA, 22 bp, Homo sapiens
gcagatctttaacagggtcact

SEQ ID NO: 7554058 - DNA, 22 bp, Homo sapiens
gcagagtttctggcacattgga

SEQ ID NO: 7554059 - DNA, 22 bp, Homo sapiens
gcagatcaattgattgttcact

SEQ ID NO: 7554060 - DNA, 22 bp, Homo sapiens
gcagaggctgtagggaaggttg

SEQ ID NO: 7554061 - DNA, 22 bp, Homo sapiens
gcagaggctgtagggaaggttg

SEQ ID NO: 7554062 - DNA, 22 bp, Homo sapiens
gcagaggctgtagggaaggttg

SEQ ID NO: 7554063 - DNA, 22 bp, Homo sapiens
gcagaggctgtagggaaggttg

SEQ ID NO: 7554064 - DNA, 22 bp, Homo sapiens
gcagaggctgtagggaaggttg

SEQ ID NO: 7554065 - DNA, 22 bp, Homo sapiens
gcagaggctgtagggaaggttg

SEQ ID NO: 7554066 - DNA, 22 bp, Homo sapiens
gcagaggctgggtgtcccagtc

SEQ ID NO: 7554067 - DNA, 22 bp, Homo sapiens
gcagaggctgggtgtcccagtc

SEQ ID NO: 7554068 - DNA, 22 bp, Homo sapiens
gcagaggctgggtgtcccagtc

SEQ ID NO: 7554069 - DNA, 22 bp, Homo sapiens
gcagaggctgggtgtcccagtc

SEQ ID NO: 7554070 - DNA, 22 bp, Homo sapiens
gcagaggctgggtgtcccagtc

SEQ ID NO: 7554071 - DNA, 22 bp, Homo sapiens
gcagaggctctttaatgcttag

SEQ ID NO: 7554072 - DNA, 22 bp, Homo sapiens
gcagaggctctttaatgcttag

SEQ ID NO: 7554073 - DNA, 22 bp, Homo sapiens
gcagaggctgggtgtcccagtc

SEQ ID NO: 7554074 - DNA, 22 bp, Homo sapiens
gcagaggctctttaatgcttag

SEQ ID NO: 7554075 - DNA, 22 bp, Homo sapiens
gcagaggctccattttacagat

SEQ ID NO: 7554076 - DNA, 22 bp, Homo sapiens
gcagaggctccattttacagat

SEQ ID NO: 7554077 - DNA, 22 bp, Homo sapiens
gcagaggcctgaaggtggcggg

SEQ ID NO: 7554078 - DNA, 22 bp, Homo sapiens
gcagaggcctgaaggtggcggg

SEQ ID NO: 7554079 - DNA, 22 bp, Homo sapiens
gcagaggcctgaaggtggcggg

SEQ ID NO: 7554080 - DNA, 22 bp, Homo sapiens
gcagaggctccattttacagat

SEQ ID NO: 7554081 - DNA, 22 bp, Homo sapiens
gcagaggcctgaaggtggcggg

SEQ ID NO: 7554082 - DNA, 22 bp, Homo sapiens
gcagaggcctaggtggaaggcc

SEQ ID NO: 7554083 - DNA, 22 bp, Homo sapiens
gcagaggcctaggtggaaggcc

SEQ ID NO: 7554084 - DNA, 22 bp, Homo sapiens
gcagaggcctaggtggaaggcc

SEQ ID NO: 7554085 - DNA, 22 bp, Homo sapiens
gcagaggcctgaaggtggcggg

SEQ ID NO: 7554086 - DNA, 22 bp, Homo sapiens
gcagaggcctgaaggtggcggg

SEQ ID NO: 7554087 - DNA, 22 bp, Homo sapiens
gcagaggcctgaaggtggcggg

SEQ ID NO: 7554088 - DNA, 22 bp, Homo sapiens
gcagaggcctgaaggtggcggg

SEQ ID NO: 7554089 - DNA, 22 bp, Homo sapiens
gcagaggcctgaaggtggcggg

SEQ ID NO: 7554090 - DNA, 22 bp, Homo sapiens
gcagaggcctgaaggtggcggg

SEQ ID NO: 7554091 - DNA, 22 bp, Homo sapiens
gcagaagttaatcgaaggccat

SEQ ID NO: 7554092 - DNA, 22 bp, Homo sapiens
gcagaagtggtgctgtgccact

SEQ ID NO: 7554093 - DNA, 22 bp, Homo sapiens
gcagaagttaatcgaaggccat

SEQ ID NO: 7554094 - DNA, 22 bp, Homo sapiens
gcagaatacattttgttttcct

SEQ ID NO: 7554095 - DNA, 22 bp, Homo sapiens
gcagaatacatttgggattact

SEQ ID NO: 7554096 - DNA, 22 bp, Homo sapiens
gcagaatactgagagctgattg

SEQ ID NO: 7554097 - DNA, 22 bp, Homo sapiens
gcagaatactgagagctgattg

SEQ ID NO: 7554098 - DNA, 22 bp, Homo sapiens
gcagaatactgagagctgattg

SEQ ID NO: 7554099 - DNA, 22 bp, Homo sapiens
gcagaatactgagagctgattg

SEQ ID NO: 7554100 - DNA, 22 bp, Homo sapiens
gcagaatactgagagctgattg

SEQ ID NO: 7554101 - DNA, 21 bp, Homo sapiens
gcagaatagtctctgtcttca

SEQ ID NO: 7554102 - DNA, 22 bp, Homo sapiens
gcagaatagggcataactttgc

SEQ ID NO: 7554103 - DNA, 22 bp, Homo sapiens
gcagaatgtccaagctgggccc

SEQ ID NO: 7554104 - DNA, 22 bp, Homo sapiens
gcagaatgtcagtatggtcacc

SEQ ID NO: 7554105 - DNA, 22 bp, Homo sapiens
gcagaatgtccaagctgggccc

SEQ ID NO: 7554106 - DNA, 22 bp, Homo sapiens
gcagaatgtccaagctgggccc

SEQ ID NO: 7554107 - DNA, 22 bp, Homo sapiens
gcagaattctacagatgataaa

SEQ ID NO: 7554108 - DNA, 22 bp, Homo sapiens
gcagaatatattactgagcctc

SEQ ID NO: 7554109 - DNA, 22 bp, Homo sapiens
gcagaatagtgactttccttaa

SEQ ID NO: 7554110 - DNA, 22 bp, Homo sapiens
gcagaatatattactgagcctc

SEQ ID NO: 7554111 - DNA, 22 bp, Homo sapiens
gcagaatgtaggccttcagtgt

SEQ ID NO: 7554112 - DNA, 22 bp, Homo sapiens
gcagaatgtaggccttcagtgt

SEQ ID NO: 7554113 - DNA, 22 bp, Homo sapiens
gcagaatgtaggccttcagtgt

SEQ ID NO: 7554114 - DNA, 22 bp, Homo sapiens
gcagaggcctaggtggaaggcc

SEQ ID NO: 7554115 - DNA, 22 bp, Homo sapiens
gcagaggcctaggtggaaggcc

SEQ ID NO: 7554116 - DNA, 22 bp, Homo sapiens
gcagaggcctaggtggaaggcc

SEQ ID NO: 7554117 - DNA, 22 bp, Homo sapiens
gcagaggcctaggtggaaggcc

SEQ ID NO: 7554118 - DNA, 16 bp, Homo sapiens
gcagaggaaaggggag

SEQ ID NO: 7554119 - DNA, 22 bp, Homo sapiens
gcagaggccatcaactttgcca

SEQ ID NO: 7554120 - DNA, 22 bp, Homo sapiens
gcagaggcctaggtggaaggcc

SEQ ID NO: 7554121 - DNA, 22 bp, Homo sapiens
gcagaggcctaggtggaaggcc

SEQ ID NO: 7554122 - DNA, 16 bp, Homo sapiens
gcagaggaaaggggag

SEQ ID NO: 7554123 - DNA, 21 bp, Homo sapiens
gcagaggaatggtatacataa

SEQ ID NO: 7554124 - DNA, 16 bp, Homo sapiens
gcagaggaaaggggag

SEQ ID NO: 7554125 - DNA, 16 bp, Homo sapiens
gcagaggaaaggggag

SEQ ID NO: 7554126 - DNA, 16 bp, Homo sapiens
gcagaggaaaggggag

SEQ ID NO: 7554127 - DNA, 22 bp, Homo sapiens
gcagaattgaaatgtgtcactt

SEQ ID NO: 7554128 - DNA, 22 bp, Homo sapiens
gcagaatttaggaattaggaaa

SEQ ID NO: 7554129 - DNA, 22 bp, Homo sapiens
gcagaatttaggaattaggaaa

SEQ ID NO: 7554130 - DNA, 22 bp, Homo sapiens
gcagaattgaaatgtgtcactt

SEQ ID NO: 7554131 - DNA, 22 bp, Homo sapiens
gcagaatgtttccaaggtttgt

SEQ ID NO: 7554132 - DNA, 22 bp, Homo sapiens
gcagaattgaaatgtgtcactt

SEQ ID NO: 7554133 - DNA, 22 bp, Homo sapiens
gcagaattgatggagaacttaa

SEQ ID NO: 7554134 - DNA, 22 bp, Homo sapiens
gcagaagtggattctacaattt

SEQ ID NO: 7554135 - DNA, 22 bp, Homo sapiens
gcagaagtcagaccatctgaat

SEQ ID NO: 7554136 - DNA, 22 bp, Homo sapiens
gcagaagtggattctacaattt

SEQ ID NO: 7554137 - DNA, 22 bp, Homo sapiens
gcagaagtggattctacaattt

SEQ ID NO: 7554138 - DNA, 22 bp, Homo sapiens
gcagaagtcagaccatctgaat

SEQ ID NO: 7554139 - DNA, 22 bp, Homo sapiens
gcagaagtaggctctgtgtagg

SEQ ID NO: 7554140 - DNA, 22 bp, Homo sapiens
gcagaagtaggctctgtgtagg

SEQ ID NO: 7554141 - DNA, 22 bp, Homo sapiens
gcagaagtcagaccatctgaat

SEQ ID NO: 7554142 - DNA, 22 bp, Homo sapiens
gcagaagtacctcgttctagtt

SEQ ID NO: 7554143 - DNA, 22 bp, Homo sapiens
gcagaagtacctcgttctagtt

SEQ ID NO: 7554144 - DNA, 22 bp, Homo sapiens
gcagaaggtctggcacttcagg

SEQ ID NO: 7554145 - DNA, 22 bp, Homo sapiens
gcagaaggtctggcacttcagg

SEQ ID NO: 7554146 - DNA, 22 bp, Homo sapiens
gcagaaggttgtttgggaaagg

SEQ ID NO: 7554147 - DNA, 22 bp, Homo sapiens
gcagaaggttgtttgggaaagg

SEQ ID NO: 7554148 - DNA, 22 bp, Homo sapiens
gcagaaggttgtttgggaaagg

SEQ ID NO: 7554149 - DNA, 22 bp, Homo sapiens
gcagaaggttgtttgggaaagg

SEQ ID NO: 7554150 - DNA, 22 bp, Homo sapiens
gcagaaggtctggcacttcagg

SEQ ID NO: 7554151 - DNA, 22 bp, Homo sapiens
gcagaaggtctggcacttcagg

SEQ ID NO: 7554152 - DNA, 22 bp, Homo sapiens
gcagaaggtcaaagcaagatgt

SEQ ID NO: 7554153 - DNA, 22 bp, Homo sapiens
gcactgtgacccagagcaggtg

SEQ ID NO: 7554154 - DNA, 22 bp, Homo sapiens
gcactgtgacccagagcaggtg

SEQ ID NO: 7554155 - DNA, 22 bp, Homo sapiens
gcactgtgacccagagcaggtg

SEQ ID NO: 7554156 - DNA, 22 bp, Homo sapiens
gcactgtgacccagagcaggtg

SEQ ID NO: 7554157 - DNA, 22 bp, Homo sapiens
gcactgtgacccagagcaggtg

SEQ ID NO: 7554158 - DNA, 22 bp, Homo sapiens
gcactgtgacccagagcaggtg

SEQ ID NO: 7554159 - DNA, 22 bp, Homo sapiens
gcagaagggaataaggagcttt

SEQ ID NO: 7554160 - DNA, 22 bp, Homo sapiens
gcactgtgatcaaggctaagca

SEQ ID NO: 7554161 - DNA, 22 bp, Homo sapiens
gcactgtgatcaaggctaagca

SEQ ID NO: 7554162 - DNA, 22 bp, Homo sapiens
gcactgtgatcaaggctaagca

SEQ ID NO: 7554163 - DNA, 22 bp, Homo sapiens
gcactgtgatcaaggctaagca

SEQ ID NO: 7554164 - DNA, 22 bp, Homo sapiens
gcactgtgacccagagcaggtg

SEQ ID NO: 7554165 - DNA, 22 bp, Homo sapiens
gcactgtgacccagagcaggtg

SEQ ID NO: 7554166 - DNA, 22 bp, Homo sapiens
gcagaaggtcaaagcaagatgt

SEQ ID NO: 7554167 - DNA, 22 bp, Homo sapiens
gcagaaggtcaaagcaagatgt

SEQ ID NO: 7554168 - DNA, 22 bp, Homo sapiens
gcagaagggaataaggagcttt

SEQ ID NO: 7554169 - DNA, 22 bp, Homo sapiens
gcagaagggaataaggagcttt

SEQ ID NO: 7554170 - DNA, 22 bp, Homo sapiens
gcagaagggaataaggagcttt

SEQ ID NO: 7554171 - DNA, 22 bp, Homo sapiens
gcagaagggaataaggagcttt

SEQ ID NO: 7554172 - DNA, 22 bp, Homo sapiens
gcagaagggaataaggagcttt

SEQ ID NO: 7554173 - DNA, 22 bp, Homo sapiens
gcaacagcccaggttctgtgtg

SEQ ID NO: 7554174 - DNA, 22 bp, Homo sapiens
gcaacagcccaggttctgtgtg

SEQ ID NO: 7554175 - DNA, 22 bp, Homo sapiens
gcaacagcattctcattgacat

SEQ ID NO: 7554176 - DNA, 22 bp, Homo sapiens
gcaacagcccaggttctgtgtg

SEQ ID NO: 7554177 - DNA, 23 bp, Homo sapiens
gcaacagagaagtaggagatggc

SEQ ID NO: 7554178 - DNA, 23 bp, Homo sapiens
gcaacagagaagtaggagatggc

SEQ ID NO: 7554179 - DNA, 18 bp, Homo sapiens
gcaacagatcaacagaaa

SEQ ID NO: 7554180 - DNA, 18 bp, Homo sapiens
gcaacagatcaacagaaa

SEQ ID NO: 7554181 - DNA, 22 bp, Homo sapiens
gcaacattcatgttctgtaacc

SEQ ID NO: 7554182 - DNA, 22 bp, Homo sapiens
gcaacattcatgttctgtaacc

SEQ ID NO: 7554183 - DNA, 22 bp, Homo sapiens
gcaacattcatgttctgtaacc

SEQ ID NO: 7554184 - DNA, 22 bp, Homo sapiens
gcaacattgagtctaagtacca

SEQ ID NO: 7554185 - DNA, 22 bp, Homo sapiens
gcaacattgcttctgaacatag

SEQ ID NO: 7554186 - DNA, 22 bp, Homo sapiens
gcaacattgcttctgaacatag

SEQ ID NO: 7554187 - DNA, 22 bp, Homo sapiens
gcaacattgcttctgaacatag

SEQ ID NO: 7554188 - DNA, 22 bp, Homo sapiens
gcaacattaaaccaataattgt

SEQ ID NO: 7554189 - DNA, 22 bp, Homo sapiens
gcaacattaaaccaataattgt

SEQ ID NO: 7554190 - DNA, 22 bp, Homo sapiens
gcaacattaaaccaataattgt

SEQ ID NO: 7554191 - DNA, 22 bp, Homo sapiens
gcaacattaaaccaataattgt

SEQ ID NO: 7554192 - DNA, 21 bp, Homo sapiens
gcaaccagaccacagggcagt

SEQ ID NO: 7554193 - DNA, 22 bp, Homo sapiens
gcaacagcattctcattgacat

SEQ ID NO: 7554194 - DNA, 17 bp, Homo sapiens
gcaaccagcccccatct

SEQ ID NO: 7554195 - DNA, 22 bp, Homo sapiens
gcaacccaccagctgtggtgtc

SEQ ID NO: 7554196 - DNA, 19 bp, Homo sapiens
gcaaccttcccttggctcc

SEQ ID NO: 7554197 - DNA, 20 bp, Homo sapiens
gcaactagggagacacagct

SEQ ID NO: 7554198 - DNA, 22 bp, Homo sapiens
gcaactgaacatgtgtgtggcc

SEQ ID NO: 7554199 - DNA, 22 bp, Homo sapiens
gcaactgaacatgtgtgtggcc

SEQ ID NO: 7554200 - DNA, 20 bp, Homo sapiens
gcaactcacccacagcagct

SEQ ID NO: 7554201 - DNA, 20 bp, Homo sapiens
gcaactcacccacagcagct

SEQ ID NO: 7554202 - DNA, 22 bp, Homo sapiens
gcacacagggatttttgaatgg

SEQ ID NO: 7554203 - DNA, 22 bp, Homo sapiens
gcacacaggggagttctcagaa

SEQ ID NO: 7554204 - DNA, 22 bp, Homo sapiens
gcacacaggggagttctcagaa

SEQ ID NO: 7554205 - DNA, 22 bp, Homo sapiens
gcacacaggggagttctcagaa

SEQ ID NO: 7554206 - DNA, 22 bp, Homo sapiens
gcacacaggggagttctcagaa

SEQ ID NO: 7554207 - DNA, 22 bp, Homo sapiens
gcacacagggatttttgaatgg

SEQ ID NO: 7554208 - DNA, 22 bp, Homo sapiens
gcaactgttttgagcacccagt

SEQ ID NO: 7554209 - DNA, 22 bp, Homo sapiens
gcaaacaaggacatacatcctg

SEQ ID NO: 7554210 - DNA, 22 bp, Homo sapiens
gcaaatgctctccagcctgggt

SEQ ID NO: 7554211 - DNA, 22 bp, Homo sapiens
gcaaacaaggacatacatcctg

SEQ ID NO: 7554212 - DNA, 22 bp, Homo sapiens
gcaaacaagctgcctgaagatt

SEQ ID NO: 7554213 - DNA, 22 bp, Homo sapiens
gcaaacaaggacatacatcctg

SEQ ID NO: 7554214 - DNA, 22 bp, Homo sapiens
gcaaatggagtgaagagctgga

SEQ ID NO: 7554215 - DNA, 20 bp, Homo sapiens
gcaaatggacactcagggaa

SEQ ID NO: 7554216 - DNA, 20 bp, Homo sapiens
gcaaatggacactcagggaa

SEQ ID NO: 7554217 - DNA, 22 bp, Homo sapiens
gcaaatgctctccttggtcagg

SEQ ID NO: 7554218 - DNA, 22 bp, Homo sapiens
gcaaatgtggcttcctttctag

SEQ ID NO: 7554219 - DNA, 22 bp, Homo sapiens
gcaaatgtggcttcctttctag

SEQ ID NO: 7554220 - DNA, 22 bp, Homo sapiens
gcaaatgttcacggggagcata

SEQ ID NO: 7554221 - DNA, 22 bp, Homo sapiens
gcaacacagatcttctttgttg

SEQ ID NO: 7554222 - DNA, 22 bp, Homo sapiens
gcaacactttgcaggcgggcag

SEQ ID NO: 7554223 - DNA, 22 bp, Homo sapiens
gcaacacagatcttctttgttg

SEQ ID NO: 7554224 - DNA, 22 bp, Homo sapiens
gcaacaatggaggtttggaggg

SEQ ID NO: 7554225 - DNA, 22 bp, Homo sapiens
gcaaattcttaactggactgtg

SEQ ID NO: 7554226 - DNA, 22 bp, Homo sapiens
gcaaattcaacagcacattctc

SEQ ID NO: 7554227 - DNA, 22 bp, Homo sapiens
gcaaattcaacagcacattctc

SEQ ID NO: 7554228 - DNA, 22 bp, Homo sapiens
gcaaattctaggcccctctcca

SEQ ID NO: 7554229 - DNA, 22 bp, Homo sapiens
gcaaatgtttttgagtgtttac

SEQ ID NO: 7554230 - DNA, 22 bp, Homo sapiens
gcaaatggagtgaagagctgga

SEQ ID NO: 7554231 - DNA, 22 bp, Homo sapiens
gcaaatgttctatatttgctgt

SEQ ID NO: 7554232 - DNA, 22 bp, Homo sapiens
gcaaatgttctatatttgctgt

SEQ ID NO: 7554233 - DNA, 22 bp, Homo sapiens
gcaaaaaccacaattactttta

SEQ ID NO: 7554234 - DNA, 22 bp, Homo sapiens
gcaaaaaccacaattactttta

SEQ ID NO: 7554235 - DNA, 22 bp, Homo sapiens
gcaaaaaccacaattactttta

SEQ ID NO: 7554236 - DNA, 22 bp, Homo sapiens
gcaaaaaccacaattactttta

SEQ ID NO: 7554237 - DNA, 22 bp, Homo sapiens
gcaaaaaccacaattacttttg

SEQ ID NO: 7554238 - DNA, 22 bp, Homo sapiens
gcaaaaactgcaattacttttg

SEQ ID NO: 7554239 - DNA, 22 bp, Homo sapiens
gcaaaaactgcaattacttttg

SEQ ID NO: 7554240 - DNA, 22 bp, Homo sapiens
gcaaaaaccacaattacttttg

SEQ ID NO: 7554241 - DNA, 22 bp, Homo sapiens
gcaaaaaccacaattacttttg

SEQ ID NO: 7554242 - DNA, 22 bp, Homo sapiens
gcaaaaaccacaattacttttg

SEQ ID NO: 7554243 - DNA, 22 bp, Homo sapiens
gcaaaaaatgcttgttgcttag

SEQ ID NO: 7554244 - DNA, 22 bp, Homo sapiens
gcaaaaaatgcttgttgcttag

SEQ ID NO: 7554245 - DNA, 22 bp, Homo sapiens
gcaaaaaatgcttgttgcttag

SEQ ID NO: 7554246 - DNA, 22 bp, Homo sapiens
gcaaaaaatgcttgttgcttag

SEQ ID NO: 7554247 - DNA, 22 bp, Homo sapiens
gatttctgggctttatttcaga

SEQ ID NO: 7554248 - DNA, 22 bp, Homo sapiens
gatttctgggctttatttcaga

SEQ ID NO: 7554249 - DNA, 22 bp, Homo sapiens
gatttctgtaacacttcagata

SEQ ID NO: 7554250 - DNA, 22 bp, Homo sapiens
gatttctgtaacacttcagata

SEQ ID NO: 7554251 - DNA, 22 bp, Homo sapiens
atgtttctacagcgtccactga

SEQ ID NO: 7554252 - DNA, 22 bp, Homo sapiens
atgtttctacagcgtccactga

SEQ ID NO: 7554253 - DNA, 22 bp, Homo sapiens
atgtttctacagcgtccactga

SEQ ID NO: 7554254 - DNA, 22 bp, Homo sapiens
atgtttctaaaacttgcatggc

SEQ ID NO: 7554255 - DNA, 22 bp, Homo sapiens
atgtttctagttgtatgtcact

SEQ ID NO: 7554256 - DNA, 22 bp, Homo sapiens
atgtttctagttgtatgtcact

SEQ ID NO: 7554257 - DNA, 22 bp, Homo sapiens
atgtttctagttgtatgtcact

SEQ ID NO: 7554258 - DNA, 22 bp, Homo sapiens
atgtttctagttgtatgtcact

SEQ ID NO: 7554259 - DNA, 22 bp, Homo sapiens
atgtttctagagctttgtccca

SEQ ID NO: 7554260 - DNA, 22 bp, Homo sapiens
atgtttctacagcgtccactga

SEQ ID NO: 7554261 - DNA, 22 bp, Homo sapiens
atgtttctacagcgtccactga

SEQ ID NO: 7554262 - DNA, 22 bp, Homo sapiens
atgtttctacagcgtccactga

SEQ ID NO: 7554263 - DNA, 22 bp, Homo sapiens
atgtttctcactgtttctctat

SEQ ID NO: 7554264 - DNA, 22 bp, Homo sapiens
atgtttctcactgtttctctat

SEQ ID NO: 7554265 - DNA, 22 bp, Homo sapiens
atgtttctcactgtttctctat

SEQ ID NO: 7554266 - DNA, 22 bp, Homo sapiens
atgtttctagttgtatgtcact

SEQ ID NO: 7554267 - DNA, 22 bp, Homo sapiens
atgtttctagttgtatgtcact

SEQ ID NO: 7554268 - DNA, 22 bp, Homo sapiens
atgtttctataaagaagtttgg

SEQ ID NO: 7554269 - DNA, 22 bp, Homo sapiens
gcaaaatttacactccttcttc

SEQ ID NO: 7554270 - DNA, 22 bp, Homo sapiens
gcaaacaagctgcctgaagatt

SEQ ID NO: 7554271 - DNA, 22 bp, Homo sapiens
gcaaacaagctgcctgaagatt

SEQ ID NO: 7554272 - DNA, 22 bp, Homo sapiens
gcaaaatgatcttcttcaggct

SEQ ID NO: 7554273 - DNA, 22 bp, Homo sapiens
gcaaaattaaacttagcatcat

SEQ ID NO: 7554274 - DNA, 22 bp, Homo sapiens
gcaaaatttacactccttcttc

SEQ ID NO: 7554275 - DNA, 22 bp, Homo sapiens
gcaaaatttacactccttcttc

SEQ ID NO: 7554276 - DNA, 20 bp, Homo sapiens
gcaaaataggctctgttggt

SEQ ID NO: 7554277 - DNA, 20 bp, Homo sapiens
gcaaaataggctctgttggt

SEQ ID NO: 7554278 - DNA, 20 bp, Homo sapiens
gcaaaataggctctgttggt

SEQ ID NO: 7554279 - DNA, 20 bp, Homo sapiens
gcaaaataggctctgttggt

SEQ ID NO: 7554280 - DNA, 20 bp, Homo sapiens
gcaaaataggctctgttggt

SEQ ID NO: 7554281 - DNA, 20 bp, Homo sapiens
gcaaaataggctctgttggt

SEQ ID NO: 7554282 - DNA, 20 bp, Homo sapiens
gcaaaataggctctgttggt

SEQ ID NO: 7554283 - DNA, 22 bp, Homo sapiens
gcaaaagtacagccggatttct

SEQ ID NO: 7554284 - DNA, 22 bp, Homo sapiens
gcaaaagtacagccggatttct

SEQ ID NO: 7554285 - DNA, 22 bp, Homo sapiens
gcaaaagtacagccggatttct

SEQ ID NO: 7554286 - DNA, 22 bp, Homo sapiens
gcaaaagtacagccggatttct

SEQ ID NO: 7554287 - DNA, 22 bp, Homo sapiens
gcaaaacagtcgatgcctccca

SEQ ID NO: 7554288 - DNA, 22 bp, Homo sapiens
gcaaaactcgcaattacttttg

SEQ ID NO: 7554289 - DNA, 22 bp, Homo sapiens
gcaaaacagtcgatgcctccca

SEQ ID NO: 7554290 - DNA, 22 bp, Homo sapiens
gcaaaactcggacatctaatct

SEQ ID NO: 7554291 - DNA, 22 bp, Homo sapiens
gcaaaactcggacatctaatct

SEQ ID NO: 7554292 - DNA, 22 bp, Homo sapiens
gcaaaactcggacatctaatct

SEQ ID NO: 7554293 - DNA, 22 bp, Homo sapiens
gcaaaactcggacatctaatct

SEQ ID NO: 7554294 - DNA, 22 bp, Homo sapiens
gcaaaactcgcaattacttttg

SEQ ID NO: 7554295 - DNA, 22 bp, Homo sapiens
gcaaaaattccagggacgactc

SEQ ID NO: 7554296 - DNA, 22 bp, Homo sapiens
gcaaaaattccagggacgactc

SEQ ID NO: 7554297 - DNA, 22 bp, Homo sapiens
gcaaaacagtcgatgcctccca

SEQ ID NO: 7554298 - DNA, 22 bp, Homo sapiens
gcaaaaattccagggacgactc

SEQ ID NO: 7554299 - DNA, 22 bp, Homo sapiens
gcaaaaattccagggacgactc

SEQ ID NO: 7554300 - DNA, 22 bp, Homo sapiens
gcaaaaattccagggacgactc

SEQ ID NO: 7554301 - DNA, 22 bp, Homo sapiens
gcaaaaattccagggacgactc

SEQ ID NO: 7554302 - DNA, 22 bp, Homo sapiens
gcaaaaactgcaattacttttg

SEQ ID NO: 7554303 - DNA, 22 bp, Homo sapiens
gcaaaaactgcaattacttttg

SEQ ID NO: 7554304 - DNA, 22 bp, Homo sapiens
gcaaaaagtagtgctggttagg

SEQ ID NO: 7554305 - DNA, 22 bp, Homo sapiens
gcaaaaagtagtgctggttagg

SEQ ID NO: 7554306 - DNA, 22 bp, Homo sapiens
gcacaggctgttggccttcaga

SEQ ID NO: 7554307 - DNA, 22 bp, Homo sapiens
gcacaggctgttggccttcaga

SEQ ID NO: 7554308 - DNA, 22 bp, Homo sapiens
gcacaggctgttggccttcaga

SEQ ID NO: 7554309 - DNA, 22 bp, Homo sapiens
gcacaggctgttggccttcaga

SEQ ID NO: 7554310 - DNA, 22 bp, Homo sapiens
gcacaggctctcttggggacac

SEQ ID NO: 7554311 - DNA, 17 bp, Homo sapiens
gcacagaggccaaagga

SEQ ID NO: 7554312 - DNA, 17 bp, Homo sapiens
gcacagaggccaaagga

SEQ ID NO: 7554313 - DNA, 17 bp, Homo sapiens
gcacagaggccaaagga

SEQ ID NO: 7554314 - DNA, 22 bp, Homo sapiens
gcacaggctctcttggggacac

SEQ ID NO: 7554315 - DNA, 22 bp, Homo sapiens
gcacaggctctcttggggacac

SEQ ID NO: 7554316 - DNA, 22 bp, Homo sapiens
gcacagaggatgaggcagctct

SEQ ID NO: 7554317 - DNA, 22 bp, Homo sapiens
gcacagaggatgaggcagctct

SEQ ID NO: 7554318 - DNA, 22 bp, Homo sapiens
gcacagaggaagcacagactct

SEQ ID NO: 7554319 - DNA, 22 bp, Homo sapiens
gcacagaggatgaggcagctct

SEQ ID NO: 7554320 - DNA, 22 bp, Homo sapiens
gcacagaggatgaggcagctct

SEQ ID NO: 7554321 - DNA, 22 bp, Homo sapiens
gcacagaggatgaggcagctct

SEQ ID NO: 7554322 - DNA, 22 bp, Homo sapiens
gcacagggagacagccgtggcc

SEQ ID NO: 7554323 - DNA, 22 bp, Homo sapiens
gcacagggagacagccgtggcc

SEQ ID NO: 7554324 - DNA, 22 bp, Homo sapiens
gcacagggagcaggtctctggt

SEQ ID NO: 7554325 - DNA, 22 bp, Homo sapiens
gcacagggagcaggtctctggt

SEQ ID NO: 7554326 - DNA, 22 bp, Homo sapiens
gcacagggagcaggtctctggt

SEQ ID NO: 7554327 - DNA, 22 bp, Homo sapiens
gcacagggagacagccgtggcc

SEQ ID NO: 7554328 - DNA, 22 bp, Homo sapiens
gcacagggagacagccgtggcc

SEQ ID NO: 7554329 - DNA, 22 bp, Homo sapiens
gcacagggagacagccgtggcc

SEQ ID NO: 7554330 - DNA, 22 bp, Homo sapiens
gcacagggagacagccgtggcc

SEQ ID NO: 7554331 - DNA, 22 bp, Homo sapiens
gcacagggagacagccgtggcc

SEQ ID NO: 7554332 - DNA, 22 bp, Homo sapiens
gcacagggagacagccgtggcc

SEQ ID NO: 7554333 - DNA, 21 bp, Homo sapiens
gcacagggacagatcatcaca

SEQ ID NO: 7554334 - DNA, 21 bp, Homo sapiens
gcacagggacagatcatcaca

SEQ ID NO: 7554335 - DNA, 20 bp, Homo sapiens
gcacagagatgagcaaagta

SEQ ID NO: 7554336 - DNA, 23 bp, Homo sapiens
gcacagagcagttaggggaagat

SEQ ID NO: 7554337 - DNA, 23 bp, Homo sapiens
gcacagagcagttaggggaagat

SEQ ID NO: 7554338 - DNA, 23 bp, Homo sapiens
gcacagagcagttaggggaagat

SEQ ID NO: 7554339 - DNA, 18 bp, Homo sapiens
gcacagagcaagtttcat

SEQ ID NO: 7554340 - DNA, 23 bp, Homo sapiens
gcacagagcagttaggggaagat

SEQ ID NO: 7554341 - DNA, 23 bp, Homo sapiens
gcacagagcagttaggggaagat

SEQ ID NO: 7554342 - DNA, 18 bp, Homo sapiens
gcacagagcccaggctct

SEQ ID NO: 7554343 - DNA, 18 bp, Homo sapiens
gcacagagcccaggctct

SEQ ID NO: 7554344 - DNA, 18 bp, Homo sapiens
gcacagagcccaggctct

SEQ ID NO: 7554345 - DNA, 18 bp, Homo sapiens
gcacagagcccaggctct

SEQ ID NO: 7554346 - DNA, 23 bp, Homo sapiens
gcacagagcagttaggggaagat

SEQ ID NO: 7554347 - DNA, 18 bp, Homo sapiens
gcacagagcccaggctct

SEQ ID NO: 7554348 - DNA, 18 bp, Homo sapiens
gcacagagcccaggctct

SEQ ID NO: 7554349 - DNA, 23 bp, Homo sapiens
gcacagagcagttaggggaagat

SEQ ID NO: 7554350 - DNA, 23 bp, Homo sapiens
gcacagagcagttaggggaagat

SEQ ID NO: 7554351 - DNA, 23 bp, Homo sapiens
gcacagagcagttaggggaagat

SEQ ID NO: 7554352 - DNA, 22 bp, Homo sapiens
gcacagagctggccctccaggc

SEQ ID NO: 7554353 - DNA, 22 bp, Homo sapiens
gcacagagctggccctccaggc

SEQ ID NO: 7554354 - DNA, 22 bp, Homo sapiens
gcacagagctggccctccaggc

SEQ ID NO: 7554355 - DNA, 22 bp, Homo sapiens
gcacagagcctggtaccgagaa

SEQ ID NO: 7554356 - DNA, 22 bp, Homo sapiens
gcacagagcctggtaccgagaa

SEQ ID NO: 7554357 - DNA, 22 bp, Homo sapiens
gcacagagcctggtaccgagaa

SEQ ID NO: 7554358 - DNA, 18 bp, Homo sapiens
gcacagagcccaggctct

SEQ ID NO: 7554359 - DNA, 22 bp, Homo sapiens
gcacagagcctggtaccgagaa

SEQ ID NO: 7554360 - DNA, 22 bp, Homo sapiens
gcacagagcctggtaccgagaa

SEQ ID NO: 7554361 - DNA, 22 bp, Homo sapiens
gcacagaggaagcacagactct

SEQ ID NO: 7554362 - DNA, 22 bp, Homo sapiens
gcacagaggaagcacagactct

SEQ ID NO: 7554363 - DNA, 22 bp, Homo sapiens
gcacagagctggccctccaggc

SEQ ID NO: 7554364 - DNA, 22 bp, Homo sapiens
gcacagagctggccctccaggc

SEQ ID NO: 7554365 - DNA, 22 bp, Homo sapiens
gcacagaggaagcacagactct

SEQ ID NO: 7554366 - DNA, 22 bp, Homo sapiens
gcacagagctggccctccaggc

SEQ ID NO: 7554367 - DNA, 22 bp, Homo sapiens
gcacagagctggccctccaggc

SEQ ID NO: 7554368 - DNA, 22 bp, Homo sapiens
gcactgtagtgggggagaaatg

SEQ ID NO: 7554369 - DNA, 22 bp, Homo sapiens
gcactggtgtgaaacagtagat

SEQ ID NO: 7554370 - DNA, 22 bp, Homo sapiens
gcactgtagtgggggagaaatg

SEQ ID NO: 7554371 - DNA, 22 bp, Homo sapiens
gcactgtgaatatactagcaaa

SEQ ID NO: 7554372 - DNA, 22 bp, Homo sapiens
gcactgtgaatatactagcaaa

SEQ ID NO: 7554373 - DNA, 22 bp, Homo sapiens
gcactgtgacagcaagagtgag

SEQ ID NO: 7554374 - DNA, 22 bp, Homo sapiens
gcactgtgacagcaagagtgag

SEQ ID NO: 7554375 - DNA, 22 bp, Homo sapiens
gcactgtgacagcaagagtgag

SEQ ID NO: 7554376 - DNA, 22 bp, Homo sapiens
gcactgtgacagcaagagtgag

SEQ ID NO: 7554377 - DNA, 22 bp, Homo sapiens
gcactgtgaatatactagcaaa

SEQ ID NO: 7554378 - DNA, 22 bp, Homo sapiens
gcactgtgaatatactagcaaa

SEQ ID NO: 7554379 - DNA, 22 bp, Homo sapiens
gcactgtgaatatactagcaaa

SEQ ID NO: 7554380 - DNA, 22 bp, Homo sapiens
gcactggttaccctgagtggct

SEQ ID NO: 7554381 - DNA, 22 bp, Homo sapiens
gcactggtatcacctgagagct

SEQ ID NO: 7554382 - DNA, 22 bp, Homo sapiens
gcactggtatcacctgagagct

SEQ ID NO: 7554383 - DNA, 22 bp, Homo sapiens
gcactgggtgtgaggcagcgtc

SEQ ID NO: 7554384 - DNA, 22 bp, Homo sapiens
gcactgggtgtgaggcagcgtc

SEQ ID NO: 7554385 - DNA, 22 bp, Homo sapiens
gcactgggtgggagatctgaat

SEQ ID NO: 7554386 - DNA, 22 bp, Homo sapiens
gcactgggtgggagatctgaat

SEQ ID NO: 7554387 - DNA, 22 bp, Homo sapiens
gcactgggtgtgaggcagcgtc

SEQ ID NO: 7554388 - DNA, 22 bp, Homo sapiens
gcactgggtgtgaggcagcgtc

SEQ ID NO: 7554389 - DNA, 22 bp, Homo sapiens
gcactgggtgtgaggcagcgtc

SEQ ID NO: 7554390 - DNA, 22 bp, Homo sapiens
gcactgggtgtgaggcagcgtc

SEQ ID NO: 7554391 - DNA, 22 bp, Homo sapiens
gcactgggtgtgaggcagcgtc

SEQ ID NO: 7554392 - DNA, 22 bp, Homo sapiens
gcactgggtgtgaggcagcgtc

SEQ ID NO: 7554393 - DNA, 22 bp, Homo sapiens
gcactgggtgggagatctgaat

SEQ ID NO: 7554394 - DNA, 22 bp, Homo sapiens
gcactggggtcatagcctccag

SEQ ID NO: 7554395 - DNA, 22 bp, Homo sapiens
gcactggggtcatagcctccag

SEQ ID NO: 7554396 - DNA, 22 bp, Homo sapiens
gcactggggtcatagcctccag

SEQ ID NO: 7554397 - DNA, 22 bp, Homo sapiens
gcactggggtcatagcctccag

SEQ ID NO: 7554398 - DNA, 22 bp, Homo sapiens
gcactggggtcatagcctccag

SEQ ID NO: 7554399 - DNA, 22 bp, Homo sapiens
gcactgggggcagcagtgaggg

SEQ ID NO: 7554400 - DNA, 22 bp, Homo sapiens
gcactgggggcagcagtgaggg

SEQ ID NO: 7554401 - DNA, 22 bp, Homo sapiens
gcactgggggcagcagtgaggg

SEQ ID NO: 7554402 - DNA, 22 bp, Homo sapiens
gcactgggggcagcagtgaggg

SEQ ID NO: 7554403 - DNA, 22 bp, Homo sapiens
gcacagggcaacaggtctgtta

SEQ ID NO: 7554404 - DNA, 22 bp, Homo sapiens
gcacagggcaacaggtctgtta

SEQ ID NO: 7554405 - DNA, 22 bp, Homo sapiens
gcacagggcaacaggtctgtta

SEQ ID NO: 7554406 - DNA, 22 bp, Homo sapiens
gcacagggcaacaggtctgtta

SEQ ID NO: 7554407 - DNA, 22 bp, Homo sapiens
gcacagggaggctggcctggcc

SEQ ID NO: 7554408 - DNA, 22 bp, Homo sapiens
gcacagggcaacaggtctgtta

SEQ ID NO: 7554409 - DNA, 22 bp, Homo sapiens
gcacagggcaacaggtctgtta

SEQ ID NO: 7554410 - DNA, 22 bp, Homo sapiens
gcacagggaggctggcctggcc

SEQ ID NO: 7554411 - DNA, 22 bp, Homo sapiens
gcacagggaggctggcctggcc

SEQ ID NO: 7554412 - DNA, 22 bp, Homo sapiens
gcacagggagcaggtctctggt

SEQ ID NO: 7554413 - DNA, 22 bp, Homo sapiens
gcacagggagcaggtctctggt

SEQ ID NO: 7554414 - DNA, 22 bp, Homo sapiens
gcacagggaggctggcctggcc

SEQ ID NO: 7554415 - DNA, 22 bp, Homo sapiens
gcacagggaggctggcctggcc

SEQ ID NO: 7554416 - DNA, 22 bp, Homo sapiens
gcacagggaggctggcctggcc

SEQ ID NO: 7554417 - DNA, 22 bp, Homo sapiens
gcacagggaggctggcctggcc

SEQ ID NO: 7554418 - DNA, 22 bp, Homo sapiens
gcacagggccctgtgcgtaggt

SEQ ID NO: 7554419 - DNA, 22 bp, Homo sapiens
gcacagggccctgtgcgtaggt

SEQ ID NO: 7554420 - DNA, 22 bp, Homo sapiens
gcacagggccctgtgcgtaggt

SEQ ID NO: 7554421 - DNA, 22 bp, Homo sapiens
gcacagggccctgtgcgtaggt

SEQ ID NO: 7554422 - DNA, 22 bp, Homo sapiens
gcactcaggactctcatcagta

SEQ ID NO: 7554423 - DNA, 22 bp, Homo sapiens
gcacagggccctgtgcgtaggt

SEQ ID NO: 7554424 - DNA, 22 bp, Homo sapiens
gcactcaggactctcatcagta

SEQ ID NO: 7554425 - DNA, 21 bp, Homo sapiens
gcactcagtcactactcaaga

SEQ ID NO: 7554426 - DNA, 22 bp, Homo sapiens
gcactcagtaccaggtcactgc

SEQ ID NO: 7554427 - DNA, 22 bp, Homo sapiens
gcactcagtaccaggtcactgc

SEQ ID NO: 7554428 - DNA, 22 bp, Homo sapiens
gcactgggggcagcagtgaggg

SEQ ID NO: 7554429 - DNA, 22 bp, Homo sapiens
gcactgggggcagcagtgaggg

SEQ ID NO: 7554430 - DNA, 22 bp, Homo sapiens
gcactgggggcagcagtgaggg

SEQ ID NO: 7554431 - DNA, 22 bp, Homo sapiens
gcactgggggcagcagtgaggg

SEQ ID NO: 7554432 - DNA, 22 bp, Homo sapiens
gcaggagcagtcaggggcagct

SEQ ID NO: 7554433 - DNA, 22 bp, Homo sapiens
gcaggagcagtcaggggcagct

SEQ ID NO: 7554434 - DNA, 22 bp, Homo sapiens
gcaggagcagtcaggggcagct

SEQ ID NO: 7554435 - DNA, 22 bp, Homo sapiens
gcaggagcagtcaggggcagct

SEQ ID NO: 7554436 - DNA, 22 bp, Homo sapiens
gcaggagcagtcaggggcagct

SEQ ID NO: 7554437 - DNA, 22 bp, Homo sapiens
gcaggagccacttcagggatgc

SEQ ID NO: 7554438 - DNA, 22 bp, Homo sapiens
gcaggagcagtcaggggcagct

SEQ ID NO: 7554439 - DNA, 22 bp, Homo sapiens
gcaggagccacttcagggatgc

SEQ ID NO: 7554440 - DNA, 19 bp, Homo sapiens
gcaggataggctgagacta

SEQ ID NO: 7554441 - DNA, 22 bp, Homo sapiens
gcaggagccacttcagggatgc

SEQ ID NO: 7554442 - DNA, 22 bp, Homo sapiens
gcaggatgaactaacacctgca

SEQ ID NO: 7554443 - DNA, 22 bp, Homo sapiens
gcaggatgaactaacacctgca

SEQ ID NO: 7554444 - DNA, 22 bp, Homo sapiens
gcaggatgaactaacacctgca

SEQ ID NO: 7554445 - DNA, 22 bp, Homo sapiens
gcaggagccacttcagggatgc

SEQ ID NO: 7554446 - DNA, 18 bp, Homo sapiens
gcaggagatgggtggggt

SEQ ID NO: 7554447 - DNA, 22 bp, Homo sapiens
gcaggagcaaactgcagtgtgg

SEQ ID NO: 7554448 - DNA, 22 bp, Homo sapiens
gcaggagcaaactgcagtgtgg

SEQ ID NO: 7554449 - DNA, 22 bp, Homo sapiens
gcaggagcaaactgcagtgtgg

SEQ ID NO: 7554450 - DNA, 22 bp, Homo sapiens
gcaggagcaaactgcagtgtgg

SEQ ID NO: 7554451 - DNA, 22 bp, Homo sapiens
gcaggagcaaactgcagtgtgg

SEQ ID NO: 7554452 - DNA, 22 bp, Homo sapiens
gcaggagcaatggcctatcaga

SEQ ID NO: 7554453 - DNA, 22 bp, Homo sapiens
gcaggagcagtcaggggcagct

SEQ ID NO: 7554454 - DNA, 22 bp, Homo sapiens
gcaggagcaatggcctatcaga

SEQ ID NO: 7554455 - DNA, 22 bp, Homo sapiens
gcaggagcaatggcctatcaga

SEQ ID NO: 7554456 - DNA, 22 bp, Homo sapiens
gcaggagcagtcaggggcagct

SEQ ID NO: 7554457 - DNA, 22 bp, Homo sapiens
gcaggagcagtcaggggcagct

SEQ ID NO: 7554458 - DNA, 22 bp, Homo sapiens
gcaggagcagtcaggggcagct

SEQ ID NO: 7554459 - DNA, 22 bp, Homo sapiens
gcaggagcagtcaggggcagct

SEQ ID NO: 7554460 - DNA, 22 bp, Homo sapiens
gcaggcggaggttgcagtgagc

SEQ ID NO: 7554461 - DNA, 22 bp, Homo sapiens
gcaggatggtggaaggcctgct

SEQ ID NO: 7554462 - DNA, 22 bp, Homo sapiens
gcaggctaactacaatcaaggg

SEQ ID NO: 7554463 - DNA, 22 bp, Homo sapiens
gcaggctaactcataggctgtg

SEQ ID NO: 7554464 - DNA, 22 bp, Homo sapiens
gcaggctaatggaaatgcactg

SEQ ID NO: 7554465 - DNA, 22 bp, Homo sapiens
gcaggctagagaattgagttgt

SEQ ID NO: 7554466 - DNA, 22 bp, Homo sapiens
gcaggcgtgtttcacgtgccag

SEQ ID NO: 7554467 - DNA, 22 bp, Homo sapiens
gcaggcgtgtttcacgtgccag

SEQ ID NO: 7554468 - DNA, 14 bp, Homo sapiens
gcaggcggatcact

SEQ ID NO: 7554469 - DNA, 22 bp, Homo sapiens
gcaggatgggtgtagcccagca

SEQ ID NO: 7554470 - DNA, 22 bp, Homo sapiens
gcaggatgggtgtagcccagca

SEQ ID NO: 7554471 - DNA, 22 bp, Homo sapiens
gcaggatggtggaaggcctgct

SEQ ID NO: 7554472 - DNA, 22 bp, Homo sapiens
gcaggatggtggaaggcctgct

SEQ ID NO: 7554473 - DNA, 22 bp, Homo sapiens
gcaggatggtgccctttctgcc

SEQ ID NO: 7554474 - DNA, 22 bp, Homo sapiens
gcaggatggtgccctttctgcc

SEQ ID NO: 7554475 - DNA, 22 bp, Homo sapiens
gcaggatggtggaaggcctgct

SEQ ID NO: 7554476 - DNA, 22 bp, Homo sapiens
gcaggatggtggaaggcctgct

SEQ ID NO: 7554477 - DNA, 22 bp, Homo sapiens
gcaggatggtggaaggcctgct

SEQ ID NO: 7554478 - DNA, 22 bp, Homo sapiens
gcaggatgaaggcagaggctga

SEQ ID NO: 7554479 - DNA, 22 bp, Homo sapiens
gcaggatgaaggcagaggctga

SEQ ID NO: 7554480 - DNA, 22 bp, Homo sapiens
gcaggatgaaggcagaggctga

SEQ ID NO: 7554481 - DNA, 22 bp, Homo sapiens
gcaggatgaaggcagaggctga

SEQ ID NO: 7554482 - DNA, 22 bp, Homo sapiens
gcaggatgcaacagcttgtagt

SEQ ID NO: 7554483 - DNA, 21 bp, Homo sapiens
gcaggatgcatcttggtgtct

SEQ ID NO: 7554484 - DNA, 22 bp, Homo sapiens
gcaggatgccagggcagcagcg

SEQ ID NO: 7554485 - DNA, 22 bp, Homo sapiens
gcaggatgccagggcagcagcg

SEQ ID NO: 7554486 - DNA, 22 bp, Homo sapiens
gcaggatgccagggcagcagcg

SEQ ID NO: 7554487 - DNA, 22 bp, Homo sapiens
gcaggatgccagggcagcagcg

SEQ ID NO: 7554488 - DNA, 22 bp, Homo sapiens
gcaggatgccagggcagcagcg

SEQ ID NO: 7554489 - DNA, 22 bp, Homo sapiens
gcaggatgggtgtagcccagca

SEQ ID NO: 7554490 - DNA, 22 bp, Homo sapiens
gcaggatgggtgtagcccagca

SEQ ID NO: 7554491 - DNA, 22 bp, Homo sapiens
gcaggatgggagcttcactctg

SEQ ID NO: 7554492 - DNA, 22 bp, Homo sapiens
gcagggaggtttgctgacctgg

SEQ ID NO: 7554493 - DNA, 22 bp, Homo sapiens
gcagggaggtttgctgacctgg

SEQ ID NO: 7554494 - DNA, 22 bp, Homo sapiens
gcagggaggtttgctgacctgg

SEQ ID NO: 7554495 - DNA, 22 bp, Homo sapiens
gcagggagggcctttcatgaca

SEQ ID NO: 7554496 - DNA, 22 bp, Homo sapiens
gcagggagggcctttcatgaca

SEQ ID NO: 7554497 - DNA, 22 bp, Homo sapiens
gcagggagggcctttcatgaca

SEQ ID NO: 7554498 - DNA, 22 bp, Homo sapiens
gcagggagggcctttcatgaca

SEQ ID NO: 7554499 - DNA, 22 bp, Homo sapiens
gcagggaggaagagatgcttcc

SEQ ID NO: 7554500 - DNA, 22 bp, Homo sapiens
gcagggaggaagagatgcttcc

SEQ ID NO: 7554501 - DNA, 22 bp, Homo sapiens
gcagggaggaagagatgcttcc

SEQ ID NO: 7554502 - DNA, 22 bp, Homo sapiens
gcagggaggaagagatgcttcc

SEQ ID NO: 7554503 - DNA, 22 bp, Homo sapiens
gcagggaggaagagatgcttcc

SEQ ID NO: 7554504 - DNA, 22 bp, Homo sapiens
gcagggactttggcaacaggtg

SEQ ID NO: 7554505 - DNA, 22 bp, Homo sapiens
gcagggaggaagagatgcttcc

SEQ ID NO: 7554506 - DNA, 22 bp, Homo sapiens
gcagggaggaagagatgcttcc

SEQ ID NO: 7554507 - DNA, 22 bp, Homo sapiens
gcagggaggaagagatgcttcc

SEQ ID NO: 7554508 - DNA, 22 bp, Homo sapiens
gcagggaggaagagatgcttcc

SEQ ID NO: 7554509 - DNA, 22 bp, Homo sapiens
gcaggctgtggtatgttgggca

SEQ ID NO: 7554510 - DNA, 22 bp, Homo sapiens
gcaggctgtggtatgttgggca

SEQ ID NO: 7554511 - DNA, 22 bp, Homo sapiens
gcagggacgccagggacagcaa

SEQ ID NO: 7554512 - DNA, 22 bp, Homo sapiens
gcaggctgtggtatgttgggca

SEQ ID NO: 7554513 - DNA, 22 bp, Homo sapiens
gcaggctgtggtatgttgggca

SEQ ID NO: 7554514 - DNA, 22 bp, Homo sapiens
gcaggctgtggtatgttgggca

SEQ ID NO: 7554515 - DNA, 22 bp, Homo sapiens
gcagggacgccagggacagcaa

SEQ ID NO: 7554516 - DNA, 22 bp, Homo sapiens
gcagggactgtgatctcacaga

SEQ ID NO: 7554517 - DNA, 22 bp, Homo sapiens
gcagggactgtgatctcacaga

SEQ ID NO: 7554518 - DNA, 22 bp, Homo sapiens
gcagggactgtgatctcacaga

SEQ ID NO: 7554519 - DNA, 22 bp, Homo sapiens
gcagggactgtgatctcacaga

SEQ ID NO: 7554520 - DNA, 22 bp, Homo sapiens
gcaggctgtggtatgttgggca

SEQ ID NO: 7554521 - DNA, 22 bp, Homo sapiens
gcaggctgtggtatgttgggca

SEQ ID NO: 7554522 - DNA, 22 bp, Homo sapiens
gcaggctgtggtatgttgggca

SEQ ID NO: 7554523 - DNA, 22 bp, Homo sapiens
gcaggctgtgaggctcagatgg

SEQ ID NO: 7554524 - DNA, 22 bp, Homo sapiens
gcaggctgtgaggctcagatgg

SEQ ID NO: 7554525 - DNA, 22 bp, Homo sapiens
gcaggctgtgaggctcagatgg

SEQ ID NO: 7554526 - DNA, 22 bp, Homo sapiens
gcaggctgtgaggctcagatgg

SEQ ID NO: 7554527 - DNA, 22 bp, Homo sapiens
gcaggctgtgaggctcagatgg

SEQ ID NO: 7554528 - DNA, 22 bp, Homo sapiens
gcaggctgtgaggctcagatgg

SEQ ID NO: 7554529 - DNA, 22 bp, Homo sapiens
gcaggctgtgaggctcagatgg

SEQ ID NO: 7554530 - DNA, 22 bp, Homo sapiens
gcaggctgtgaggctcagatgg

SEQ ID NO: 7554531 - DNA, 22 bp, Homo sapiens
gcaggctgtgaggctcagatgg

SEQ ID NO: 7554532 - DNA, 22 bp, Homo sapiens
gcaggctgtctaaagttagagt

SEQ ID NO: 7554533 - DNA, 22 bp, Homo sapiens
gcaggctgtctaaagttagagt

SEQ ID NO: 7554534 - DNA, 22 bp, Homo sapiens
gcaggctgtctaaagttagagt

SEQ ID NO: 7554535 - DNA, 22 bp, Homo sapiens
gcaggctgtctaaagttagagt

SEQ ID NO: 7554536 - DNA, 22 bp, Homo sapiens
gcaggctgtctaaagttagagt

SEQ ID NO: 7554537 - DNA, 22 bp, Homo sapiens
gcaggctggtctgaccatccct

SEQ ID NO: 7554538 - DNA, 22 bp, Homo sapiens
gcaggctggtctgaccatccct

SEQ ID NO: 7554539 - DNA, 22 bp, Homo sapiens
gcaggctagggagctgcagtcc

SEQ ID NO: 7554540 - DNA, 22 bp, Homo sapiens
gcaggctatgagtttctcacca

SEQ ID NO: 7554541 - DNA, 22 bp, Homo sapiens
gcaggctgtagacaccaaacta

SEQ ID NO: 7554542 - DNA, 22 bp, Homo sapiens
gcaggctggtctgaccatccct

SEQ ID NO: 7554543 - DNA, 22 bp, Homo sapiens
gcaggctgtagacaccaaacta

SEQ ID NO: 7554544 - DNA, 22 bp, Homo sapiens
gcaggctgtagacaccaaacta

SEQ ID NO: 7554545 - DNA, 22 bp, Homo sapiens
gcaggctgtctaaagttagagt

SEQ ID NO: 7554546 - DNA, 22 bp, Homo sapiens
gcaggctgtctaaagttagagt

SEQ ID NO: 7554547 - DNA, 22 bp, Homo sapiens
gcaggctgtctaaagttagagt

SEQ ID NO: 7554548 - DNA, 22 bp, Homo sapiens
gcaggctgtagacaccaaacta

SEQ ID NO: 7554549 - DNA, 22 bp, Homo sapiens
gcaggctgtctaaagttagagt

SEQ ID NO: 7554550 - DNA, 22 bp, Homo sapiens
gcaggctgtctaaagttagagt

SEQ ID NO: 7554551 - DNA, 22 bp, Homo sapiens
gcaggctgtctaaagttagagt

SEQ ID NO: 7554552 - DNA, 22 bp, Homo sapiens
gcaggctgtctaaagttagagt

SEQ ID NO: 7554553 - DNA, 22 bp, Homo sapiens
gcaggctgtctaaagttagagt

SEQ ID NO: 7554554 - DNA, 22 bp, Homo sapiens
attgtaaaagtattctaagatt

SEQ ID NO: 7554555 - DNA, 22 bp, Homo sapiens
attgtaaaagtattctaagatt

SEQ ID NO: 7554556 - DNA, 22 bp, Homo sapiens
attgtaaaagtattctaagatt

SEQ ID NO: 7554557 - DNA, 22 bp, Homo sapiens
attgtaaaagtattctaagatt

SEQ ID NO: 7554558 - DNA, 22 bp, Homo sapiens
attgtaaaagtattctaagatt

SEQ ID NO: 7554559 - DNA, 22 bp, Homo sapiens
attgtaaaagtattctaagatt

SEQ ID NO: 7554560 - DNA, 22 bp, Homo sapiens
attgtaaaagtattctaagatt

SEQ ID NO: 7554561 - DNA, 22 bp, Homo sapiens
attgtaaaagtattctaagatt

SEQ ID NO: 7554562 - DNA, 22 bp, Homo sapiens
attgtaaaagtattctaagatt

SEQ ID NO: 7554563 - DNA, 22 bp, Homo sapiens
attgtaaagtactgtgtacaat

SEQ ID NO: 7554564 - DNA, 22 bp, Homo sapiens
attgtaaagtactgtgtacaat

SEQ ID NO: 7554565 - DNA, 22 bp, Homo sapiens
attgtaaagtactgtgtacaat

SEQ ID NO: 7554566 - DNA, 22 bp, Homo sapiens
attgtaaatagtgccacaataa

SEQ ID NO: 7554567 - DNA, 22 bp, Homo sapiens
attgtaaagtactgtgtacaat

SEQ ID NO: 7554568 - DNA, 22 bp, Homo sapiens
attgtaaagtactgtgtacaat

SEQ ID NO: 7554569 - DNA, 22 bp, Homo sapiens
attgtaaatagtgccacaataa

SEQ ID NO: 7554570 - DNA, 22 bp, Homo sapiens
attggcagttggctgtggttca

SEQ ID NO: 7554571 - DNA, 22 bp, Homo sapiens
attgtaaatagtgccacaataa

SEQ ID NO: 7554572 - DNA, 22 bp, Homo sapiens
attgtaaatagtgccacaataa

SEQ ID NO: 7554573 - DNA, 22 bp, Homo sapiens
attgtaaatagtgccacaataa

SEQ ID NO: 7554574 - DNA, 22 bp, Homo sapiens
attgtaaatagtgccacaataa

SEQ ID NO: 7554575 - DNA, 22 bp, Homo sapiens
attgtaaatagtgccacaataa

SEQ ID NO: 7554576 - DNA, 22 bp, Homo sapiens
attggttaactctgtgtgtcaa

SEQ ID NO: 7554577 - DNA, 22 bp, Homo sapiens
attggttaagacgcatcatgct

SEQ ID NO: 7554578 - DNA, 22 bp, Homo sapiens
attggtgtgccacaactagttt

SEQ ID NO: 7554579 - DNA, 22 bp, Homo sapiens
attggttacggcttttcaaatt

SEQ ID NO: 7554580 - DNA, 22 bp, Homo sapiens
attggttactcaatttgactga

SEQ ID NO: 7554581 - DNA, 22 bp, Homo sapiens
attggcagttagtgacgaggct

SEQ ID NO: 7554582 - DNA, 22 bp, Homo sapiens
attggcagttagtgacgaggct

SEQ ID NO: 7554583 - DNA, 22 bp, Homo sapiens
attggcagggccagcatctccc

SEQ ID NO: 7554584 - DNA, 22 bp, Homo sapiens
attggcagtaagactctttctt

SEQ ID NO: 7554585 - DNA, 22 bp, Homo sapiens
attggcagtgttttctgttcca

SEQ ID NO: 7554586 - DNA, 22 bp, Homo sapiens
attggcagggccagcatctccc

SEQ ID NO: 7554587 - DNA, 22 bp, Homo sapiens
attggcagggccagcatctccc

SEQ ID NO: 7554588 - DNA, 22 bp, Homo sapiens
attggcaggaaccgaggagggg

SEQ ID NO: 7554589 - DNA, 22 bp, Homo sapiens
attggcagggccagcatctccc

SEQ ID NO: 7554590 - DNA, 22 bp, Homo sapiens
attggcaggaaccgaggagggg

SEQ ID NO: 7554591 - DNA, 15 bp, Homo sapiens
gcaggtggatcactt

SEQ ID NO: 7554592 - DNA, 14 bp, Homo sapiens
gcaggtggatcact

SEQ ID NO: 7554593 - DNA, 22 bp, Homo sapiens
gcaggtggatcacctgaggtca

SEQ ID NO: 7554594 - DNA, 22 bp, Homo sapiens
gcaggtggatcacctgaggtca

SEQ ID NO: 7554595 - DNA, 22 bp, Homo sapiens
gcaggtggatcacctgaggtca

SEQ ID NO: 7554596 - DNA, 22 bp, Homo sapiens
gcaggtggatcacctgaggtca

SEQ ID NO: 7554597 - DNA, 22 bp, Homo sapiens
gcaggtggatcacctgaggtca

SEQ ID NO: 7554598 - DNA, 22 bp, Homo sapiens
gcaggtggatcacctgaggtca

SEQ ID NO: 7554599 - DNA, 22 bp, Homo sapiens
gcaggtggatcacctgaggtca

SEQ ID NO: 7554600 - DNA, 22 bp, Homo sapiens
gcaggtggatcacctgaggtca

SEQ ID NO: 7554601 - DNA, 22 bp, Homo sapiens
gcaggtggatcacctgaggtca

SEQ ID NO: 7554602 - DNA, 16 bp, Homo sapiens
gcaggtggatcacctg

SEQ ID NO: 7554603 - DNA, 22 bp, Homo sapiens
gcagggtgaaggtcacatagaa

SEQ ID NO: 7554604 - DNA, 22 bp, Homo sapiens
gcaggtggagcagtagtctggt

SEQ ID NO: 7554605 - DNA, 22 bp, Homo sapiens
gcagggtgaaggtcacatagaa

SEQ ID NO: 7554606 - DNA, 22 bp, Homo sapiens
gcaggtggatattgctacttga

SEQ ID NO: 7554607 - DNA, 22 bp, Homo sapiens
gcaggtggatattgctacttga

SEQ ID NO: 7554608 - DNA, 22 bp, Homo sapiens
gcaggtggatattgctacttga

SEQ ID NO: 7554609 - DNA, 22 bp, Homo sapiens
gcaggtggatattgctacttga

SEQ ID NO: 7554610 - DNA, 22 bp, Homo sapiens
gcaggtggatcaccacgtcagg

SEQ ID NO: 7554611 - DNA, 14 bp, Homo sapiens
gcaggtggatcacc

SEQ ID NO: 7554612 - DNA, 22 bp, Homo sapiens
gcaggtggatcaccacgtcagg

SEQ ID NO: 7554613 - DNA, 22 bp, Homo sapiens
gcaggtggatcaccacgtcagg

SEQ ID NO: 7554614 - DNA, 22 bp, Homo sapiens
gcaggtggatcaccacgtcagg

SEQ ID NO: 7554615 - DNA, 22 bp, Homo sapiens
gcagggaggtttgctgacctgg

SEQ ID NO: 7554616 - DNA, 22 bp, Homo sapiens
gcagggaggtttgctgacctgg

SEQ ID NO: 7554617 - DNA, 22 bp, Homo sapiens
gcagggaggtttgctgacctgg

SEQ ID NO: 7554618 - DNA, 22 bp, Homo sapiens
gcagggaggtttgctgacctgg

SEQ ID NO: 7554619 - DNA, 22 bp, Homo sapiens
gcagggatgctgaggctcagtg

SEQ ID NO: 7554620 - DNA, 22 bp, Homo sapiens
gcagggatgctgaggctcagtg

SEQ ID NO: 7554621 - DNA, 22 bp, Homo sapiens
gcagggattgtgcagggggcta

SEQ ID NO: 7554622 - DNA, 22 bp, Homo sapiens
gcagggattgtgcagggggcta

SEQ ID NO: 7554623 - DNA, 22 bp, Homo sapiens
gcagggattgtgcagggggcta

SEQ ID NO: 7554624 - DNA, 22 bp, Homo sapiens
gcagggattgtcaatgctgctc

SEQ ID NO: 7554625 - DNA, 22 bp, Homo sapiens
gcagggattgtcaatgctgctc

SEQ ID NO: 7554626 - DNA, 22 bp, Homo sapiens
gcagggatgctgaggctcagtg

SEQ ID NO: 7554627 - DNA, 22 bp, Homo sapiens
gcagggatgctgaggctcagtg

SEQ ID NO: 7554628 - DNA, 22 bp, Homo sapiens
gcaggggtggaggctgtcctgt

SEQ ID NO: 7554629 - DNA, 22 bp, Homo sapiens
gcaggggtagtgtcttcctgag

SEQ ID NO: 7554630 - DNA, 22 bp, Homo sapiens
gcaggggtagtgtcttcctgag

SEQ ID NO: 7554631 - DNA, 16 bp, Homo sapiens
gcaggggtgggtggag

SEQ ID NO: 7554632 - DNA, 22 bp, Homo sapiens
gcaggggtagagattgctggtg

SEQ ID NO: 7554633 - DNA, 22 bp, Homo sapiens
gcaggggtagagattgctggtg

SEQ ID NO: 7554634 - DNA, 22 bp, Homo sapiens
gcagggctggggctgctcctga

SEQ ID NO: 7554635 - DNA, 22 bp, Homo sapiens
gcaggggtagagattgctggtg

SEQ ID NO: 7554636 - DNA, 22 bp, Homo sapiens
gcaggggtagagattgctggtg

SEQ ID NO: 7554637 - DNA, 22 bp, Homo sapiens
gcagggctggggctgctcctga

SEQ ID NO: 7554638 - DNA, 22 bp, Homo sapiens
gcagggctgggatttgagccca

SEQ ID NO: 7554639 - DNA, 22 bp, Homo sapiens
gcagggtcgctctaggagatca

SEQ ID NO: 7554640 - DNA, 22 bp, Homo sapiens
gcagggtcgctctaggagatca

SEQ ID NO: 7554641 - DNA, 21 bp, Homo sapiens
gcagggtcctttccattccta

SEQ ID NO: 7554642 - DNA, 22 bp, Homo sapiens
gcagggtctgaggccacagagg

SEQ ID NO: 7554643 - DNA, 22 bp, Homo sapiens
gcagggtcttgagaggcagcca

SEQ ID NO: 7554644 - DNA, 22 bp, Homo sapiens
gcagggtcttgagaggcagcca

SEQ ID NO: 7554645 - DNA, 22 bp, Homo sapiens
gcagggtcttgagaggcagcca

SEQ ID NO: 7554646 - DNA, 22 bp, Homo sapiens
gcagggtcttgagaggcagcca

SEQ ID NO: 7554647 - DNA, 22 bp, Homo sapiens
gcagggtacattgggatgggat

SEQ ID NO: 7554648 - DNA, 22 bp, Homo sapiens
gcagggtacattgggatgggat

SEQ ID NO: 7554649 - DNA, 22 bp, Homo sapiens
gcagggtaggtgacaggtagtc

SEQ ID NO: 7554650 - DNA, 22 bp, Homo sapiens
gcagggtaggtgacaggtagtc

SEQ ID NO: 7554651 - DNA, 22 bp, Homo sapiens
gcagggtacattgggatgggat

SEQ ID NO: 7554652 - DNA, 22 bp, Homo sapiens
gcagggtacattgggatgggat

SEQ ID NO: 7554653 - DNA, 22 bp, Homo sapiens
gcagggtccatggaggcagccc

SEQ ID NO: 7554654 - DNA, 21 bp, Homo sapiens
gcagggtcctttccattccta

SEQ ID NO: 7554655 - DNA, 22 bp, Homo sapiens
gcagggtccatggaggcagccc

SEQ ID NO: 7554656 - DNA, 22 bp, Homo sapiens
gcagggtccatggaggcagccc

SEQ ID NO: 7554657 - DNA, 22 bp, Homo sapiens
gcagggtccatggaggcagccc

SEQ ID NO: 7554658 - DNA, 22 bp, Homo sapiens
gcattcagcctaaagagaaaag

SEQ ID NO: 7554659 - DNA, 22 bp, Homo sapiens
gcattcaggaaccggaagggta

SEQ ID NO: 7554660 - DNA, 22 bp, Homo sapiens
gcattcatatggaaggaaacta

SEQ ID NO: 7554661 - DNA, 18 bp, Homo sapiens
gcattcagtagtgaacaa

SEQ ID NO: 7554662 - DNA, 22 bp, Homo sapiens
gcattcaggaaccggaagggta

SEQ ID NO: 7554663 - DNA, 22 bp, Homo sapiens
gcattcatctagtatcactctg

SEQ ID NO: 7554664 - DNA, 22 bp, Homo sapiens
gcattcatatggaaggaaacta

SEQ ID NO: 7554665 - DNA, 22 bp, Homo sapiens
gcattcatcttcatgaaagcac

SEQ ID NO: 7554666 - DNA, 22 bp, Homo sapiens
gcattcatcaaaaatgttcctc

SEQ ID NO: 7554667 - DNA, 22 bp, Homo sapiens
gcattcatgtccttcctgaacg

SEQ ID NO: 7554668 - DNA, 22 bp, Homo sapiens
gcattcattcattcattaggta

SEQ ID NO: 7554669 - DNA, 22 bp, Homo sapiens
gcattcccaaaagacacttacc

SEQ ID NO: 7554670 - DNA, 21 bp, Homo sapiens
gcattcctaggaggtaagcat

SEQ ID NO: 7554671 - DNA, 22 bp, Homo sapiens
gcattcctacaggctgctatga

SEQ ID NO: 7554672 - DNA, 22 bp, Homo sapiens
gcattcctacaggctgctatga

SEQ ID NO: 7554673 - DNA, 15 bp, Homo sapiens
gcattcctcatttcc

SEQ ID NO: 7554674 - DNA, 21 bp, Homo sapiens
gcattcctaggaggtaagcat

SEQ ID NO: 7554675 - DNA, 22 bp, Homo sapiens
gcattcctgagaatgcagagtg

SEQ ID NO: 7554676 - DNA, 15 bp, Homo sapiens
gcattcctcatttcc

SEQ ID NO: 7554677 - DNA, 22 bp, Homo sapiens
gcattccttgagttccctgtgc

SEQ ID NO: 7554678 - DNA, 22 bp, Homo sapiens
gcattccttgagttccctgtgc

SEQ ID NO: 7554679 - DNA, 22 bp, Homo sapiens
gcattcctgtacctctctgcta

SEQ ID NO: 7554680 - DNA, 22 bp, Homo sapiens
gcattcctgtacctctctgcta

SEQ ID NO: 7554681 - DNA, 22 bp, Homo sapiens
gcattcctgagaatgcagagtg

SEQ ID NO: 7554682 - DNA, 22 bp, Homo sapiens
gcattcctgagaatgcagagtg

SEQ ID NO: 7554683 - DNA, 22 bp, Homo sapiens
gcattcctgagaatgcagagtg

SEQ ID NO: 7554684 - DNA, 22 bp, Homo sapiens
gcattccttggtttaaaacaag

SEQ ID NO: 7554685 - DNA, 22 bp, Homo sapiens
gcattccttggtttaaaacaag

SEQ ID NO: 7554686 - DNA, 22 bp, Homo sapiens
gcattccttgagttccctgtgc

SEQ ID NO: 7554687 - DNA, 22 bp, Homo sapiens
gcattccttgttagcatttgat

SEQ ID NO: 7554688 - DNA, 22 bp, Homo sapiens
gcattccttgttagcatttgat

SEQ ID NO: 7554689 - DNA, 22 bp, Homo sapiens
gccacgtagaagtgacaggaag

SEQ ID NO: 7554690 - DNA, 21 bp, Homo sapiens
gccacgtttcagtcttctcag

SEQ ID NO: 7554691 - DNA, 22 bp, Homo sapiens
gccacgcttactgcccaggtgt

SEQ ID NO: 7554692 - DNA, 22 bp, Homo sapiens
gccacgcttactgcccaggtgt

SEQ ID NO: 7554693 - DNA, 22 bp, Homo sapiens
gccaccttccaaaataatcaca

SEQ ID NO: 7554694 - DNA, 20 bp, Homo sapiens
gccacagttttctcactgca

SEQ ID NO: 7554695 - DNA, 20 bp, Homo sapiens
gccacagttttctcactgca

SEQ ID NO: 7554696 - DNA, 22 bp, Homo sapiens
gccacagtgggctggggccaga

SEQ ID NO: 7554697 - DNA, 22 bp, Homo sapiens
gccacagtcaggacggggagag

SEQ ID NO: 7554698 - DNA, 22 bp, Homo sapiens
gccacagtgggctggggccaga

SEQ ID NO: 7554699 - DNA, 22 bp, Homo sapiens
gccactcatgggaggtgtgcaa

SEQ ID NO: 7554700 - DNA, 22 bp, Homo sapiens
gccactattttcccacctttct

SEQ ID NO: 7554701 - DNA, 22 bp, Homo sapiens
gccactcaaatccagctttaga

SEQ ID NO: 7554702 - DNA, 22 bp, Homo sapiens
gccactcacatgtaccagatgc

SEQ ID NO: 7554703 - DNA, 22 bp, Homo sapiens
gccactgagcccggccattgtt

SEQ ID NO: 7554704 - DNA, 22 bp, Homo sapiens
gccactgagcccggccattgtt

SEQ ID NO: 7554705 - DNA, 22 bp, Homo sapiens
gccactgaacattagagctagt

SEQ ID NO: 7554706 - DNA, 22 bp, Homo sapiens
gccactggcatctagttggtag

SEQ ID NO: 7554707 - DNA, 22 bp, Homo sapiens
gccactggagacagtggggaag

SEQ ID NO: 7554708 - DNA, 22 bp, Homo sapiens
gccactggacccagaaagggaa

SEQ ID NO: 7554709 - DNA, 21 bp, Homo sapiens
gccactgcactccagcctggg

SEQ ID NO: 7554710 - DNA, 21 bp, Homo sapiens
gccactgcactccagcctggg

SEQ ID NO: 7554711 - DNA, 21 bp, Homo sapiens
gccactgcactccagcctggg

SEQ ID NO: 7554712 - DNA, 22 bp, Homo sapiens
gccactgattattcagcagaca

SEQ ID NO: 7554713 - DNA, 22 bp, Homo sapiens
gccactgcactccagcccaggc

SEQ ID NO: 7554714 - DNA, 22 bp, Homo sapiens
atttaaatgcttaagagggttt

SEQ ID NO: 7554715 - DNA, 22 bp, Homo sapiens
atttaaatgcttaagagggttt

SEQ ID NO: 7554716 - DNA, 22 bp, Homo sapiens
atttaaatgcttaagagggttt

SEQ ID NO: 7554717 - DNA, 22 bp, Homo sapiens
atttaaatgcttaagagggttt

SEQ ID NO: 7554718 - DNA, 22 bp, Homo sapiens
atttaaatgcttaagagggttt

SEQ ID NO: 7554719 - DNA, 22 bp, Homo sapiens
atttaaatgcttaagagggttt

SEQ ID NO: 7554720 - DNA, 22 bp, Homo sapiens
atttaaatgcttaagagggttt

SEQ ID NO: 7554721 - DNA, 22 bp, Homo sapiens
atttaaatgcttaagagggttt

SEQ ID NO: 7554722 - DNA, 22 bp, Homo sapiens
atttaaatgcttaagagggttt

SEQ ID NO: 7554723 - DNA, 22 bp, Homo sapiens
atttaaatgcttaagagggttt

SEQ ID NO: 7554724 - DNA, 22 bp, Homo sapiens
atttaaatgcttaagagggttt

SEQ ID NO: 7554725 - DNA, 22 bp, Homo sapiens
atttaaatgcttaagagggttt

SEQ ID NO: 7554726 - DNA, 22 bp, Homo sapiens
atttaaatgcttaagagggttt

SEQ ID NO: 7554727 - DNA, 22 bp, Homo sapiens
atttaaatgcttaagagggttt

SEQ ID NO: 7554728 - DNA, 22 bp, Homo sapiens
atttaaatgcttaagagggttt

SEQ ID NO: 7554729 - DNA, 22 bp, Homo sapiens
atttaaatgcttaagagggttt

SEQ ID NO: 7554730 - DNA, 22 bp, Homo sapiens
atttaaattttctgatggagag

SEQ ID NO: 7554731 - DNA, 22 bp, Homo sapiens
atttaaattttctgatggagag

SEQ ID NO: 7554732 - DNA, 22 bp, Homo sapiens
atttaaattttctgatggagag

SEQ ID NO: 7554733 - DNA, 22 bp, Homo sapiens
atttaaattttctgatggagag

SEQ ID NO: 7554734 - DNA, 22 bp, Homo sapiens
atttaaattttctgatggagag

SEQ ID NO: 7554735 - DNA, 16 bp, Homo sapiens
attgttttcaattaga

SEQ ID NO: 7554736 - DNA, 16 bp, Homo sapiens
attgttttcaattaga

SEQ ID NO: 7554737 - DNA, 16 bp, Homo sapiens
attgttttcaattaga

SEQ ID NO: 7554738 - DNA, 16 bp, Homo sapiens
attgttttcaattaga

SEQ ID NO: 7554739 - DNA, 16 bp, Homo sapiens
attgttttcaattaga

SEQ ID NO: 7554740 - DNA, 22 bp, Homo sapiens
attgttttgtagaatgaccctt

SEQ ID NO: 7554741 - DNA, 22 bp, Homo sapiens
attgttttgtagaatgaccctt

SEQ ID NO: 7554742 - DNA, 22 bp, Homo sapiens
attgttttgtagaatgaccctt

SEQ ID NO: 7554743 - DNA, 22 bp, Homo sapiens
attgttttccaaagatgctgct

SEQ ID NO: 7554744 - DNA, 22 bp, Homo sapiens
attgttttccaaagatgctgct

SEQ ID NO: 7554745 - DNA, 22 bp, Homo sapiens
attgttttccaaagatgctgct

SEQ ID NO: 7554746 - DNA, 23 bp, Homo sapiens
attgtttttggctctcagggaat

SEQ ID NO: 7554747 - DNA, 23 bp, Homo sapiens
attgtttttggctctcagggaat

SEQ ID NO: 7554748 - DNA, 22 bp, Homo sapiens
attgttttgtttcccagtgact

SEQ ID NO: 7554749 - DNA, 22 bp, Homo sapiens
attgttttgtttcccagtgact

SEQ ID NO: 7554750 - DNA, 22 bp, Homo sapiens
attgttttgtttcccagtgact

SEQ ID NO: 7554751 - DNA, 22 bp, Homo sapiens
attgttttgtttcccagtgact

SEQ ID NO: 7554752 - DNA, 22 bp, Homo sapiens
attgttttgtttcccagtgact

SEQ ID NO: 7554753 - DNA, 22 bp, Homo sapiens
atttaaagtggtagattggcag

SEQ ID NO: 7554754 - DNA, 23 bp, Homo sapiens
attgtttttggctctcagggaat

SEQ ID NO: 7554755 - DNA, 22 bp, Homo sapiens
attgtttccccggaattattca

SEQ ID NO: 7554756 - DNA, 22 bp, Homo sapiens
attgtttccccggaattattca

SEQ ID NO: 7554757 - DNA, 20 bp, Homo sapiens
attgtttcatttaatgtaca

SEQ ID NO: 7554758 - DNA, 20 bp, Homo sapiens
attgtttcatttaatgtaca

SEQ ID NO: 7554759 - DNA, 22 bp, Homo sapiens
attgtttccccggaattattca

SEQ ID NO: 7554760 - DNA, 22 bp, Homo sapiens
attgtttctgctttatttaggg

SEQ ID NO: 7554761 - DNA, 22 bp, Homo sapiens
attgtttccccggaattattca

SEQ ID NO: 7554762 - DNA, 22 bp, Homo sapiens
attgtttccccggaattattca

SEQ ID NO: 7554763 - DNA, 20 bp, Homo sapiens
attgtttcatttaatgtaca

SEQ ID NO: 7554764 - DNA, 22 bp, Homo sapiens
attgtttacactaacttcataa

SEQ ID NO: 7554765 - DNA, 21 bp, Homo sapiens
gccactgtgcacactaaccca

SEQ ID NO: 7554766 - DNA, 22 bp, Homo sapiens
gccactgtcctgtgcctgtgct

SEQ ID NO: 7554767 - DNA, 22 bp, Homo sapiens
attgttttaattccattgtgaa

SEQ ID NO: 7554768 - DNA, 22 bp, Homo sapiens
attgttttaattccattgtgaa

SEQ ID NO: 7554769 - DNA, 22 bp, Homo sapiens
attgttttaattccattgtgaa

SEQ ID NO: 7554770 - DNA, 22 bp, Homo sapiens
attgttttaattccattgtgaa

SEQ ID NO: 7554771 - DNA, 22 bp, Homo sapiens
attgttttaattccattgtgaa

SEQ ID NO: 7554772 - DNA, 22 bp, Homo sapiens
attgttttaattccattgtgaa

SEQ ID NO: 7554773 - DNA, 22 bp, Homo sapiens
attgttttaattccattgtgaa

SEQ ID NO: 7554774 - DNA, 22 bp, Homo sapiens
attgttttaattccattgtgaa

SEQ ID NO: 7554775 - DNA, 22 bp, Homo sapiens
attgttttattaaatgagccct

SEQ ID NO: 7554776 - DNA, 22 bp, Homo sapiens
attgttttattaaatgagccct

SEQ ID NO: 7554777 - DNA, 22 bp, Homo sapiens
attgttttattaaatgagccct

SEQ ID NO: 7554778 - DNA, 22 bp, Homo sapiens
attgttttattaaatgagccct

SEQ ID NO: 7554779 - DNA, 22 bp, Homo sapiens
gccactgtagagtatggacaag

SEQ ID NO: 7554780 - DNA, 22 bp, Homo sapiens
gccactgtactccagcctgcga

SEQ ID NO: 7554781 - DNA, 22 bp, Homo sapiens
gccactgtactccagcctgcga

SEQ ID NO: 7554782 - DNA, 22 bp, Homo sapiens
gccactgtagagtatggacaag

SEQ ID NO: 7554783 - DNA, 22 bp, Homo sapiens
gccactgtcataccctggcaat

SEQ ID NO: 7554784 - DNA, 22 bp, Homo sapiens
gccactgtcataccctggcaat

SEQ ID NO: 7554785 - DNA, 22 bp, Homo sapiens
gccactgtcataccctggcaat

SEQ ID NO: 7554786 - DNA, 22 bp, Homo sapiens
gccactgtcatcttgtgaagca

SEQ ID NO: 7554787 - DNA, 20 bp, Homo sapiens
gccactgggcaccagcaggg

SEQ ID NO: 7554788 - DNA, 22 bp, Homo sapiens
gccactggcgctgtgcagagtg

SEQ ID NO: 7554789 - DNA, 22 bp, Homo sapiens
gccactggcgctgtgcagagtg

SEQ ID NO: 7554790 - DNA, 20 bp, Homo sapiens
gccactgggcaccagcaggg

SEQ ID NO: 7554791 - DNA, 22 bp, Homo sapiens
gccactggcgctgtgcagagtg

SEQ ID NO: 7554792 - DNA, 22 bp, Homo sapiens
gccactggcgctgtgcagagtg

SEQ ID NO: 7554793 - DNA, 22 bp, Homo sapiens
gccactggcgctgtgcagagtg

SEQ ID NO: 7554794 - DNA, 22 bp, Homo sapiens
gcagtgccgaaggtagtggttg

SEQ ID NO: 7554795 - DNA, 22 bp, Homo sapiens
gcagtgccgaaggtagtggttg

SEQ ID NO: 7554796 - DNA, 22 bp, Homo sapiens
gcagtgccgaccatccttccca

SEQ ID NO: 7554797 - DNA, 18 bp, Homo sapiens
gcagtgccagcctctcct

SEQ ID NO: 7554798 - DNA, 18 bp, Homo sapiens
gcagtgccagcctctcct

SEQ ID NO: 7554799 - DNA, 18 bp, Homo sapiens
gcagtgccagcctctcct

SEQ ID NO: 7554800 - DNA, 22 bp, Homo sapiens
gcagtgctaagtagctggccca

SEQ ID NO: 7554801 - DNA, 22 bp, Homo sapiens
gcagtgccgaccatccttccca

SEQ ID NO: 7554802 - DNA, 22 bp, Homo sapiens
gcagtgccttgcttctctgtct

SEQ ID NO: 7554803 - DNA, 22 bp, Homo sapiens
gcagtgctaaggattctgcctt

SEQ ID NO: 7554804 - DNA, 20 bp, Homo sapiens
gcagtgctggtgcctctgct

SEQ ID NO: 7554805 - DNA, 22 bp, Homo sapiens
gcagtgctgagaggtgatcgga

SEQ ID NO: 7554806 - DNA, 22 bp, Homo sapiens
gcagtgctgagaggtgatcgga

SEQ ID NO: 7554807 - DNA, 22 bp, Homo sapiens
gcagtgctgatcccatggcaga

SEQ ID NO: 7554808 - DNA, 22 bp, Homo sapiens
gcagtgctgatcccatggcaga

SEQ ID NO: 7554809 - DNA, 22 bp, Homo sapiens
gcagtgctgagaggtgatcgga

SEQ ID NO: 7554810 - DNA, 22 bp, Homo sapiens
gcagtgctctgcctataatgga

SEQ ID NO: 7554811 - DNA, 22 bp, Homo sapiens
gcagtgctctgcctataatgga

SEQ ID NO: 7554812 - DNA, 22 bp, Homo sapiens
gcagtgctctgcctataatgga

SEQ ID NO: 7554813 - DNA, 22 bp, Homo sapiens
gcagtgctagcctcacagggtc

SEQ ID NO: 7554814 - DNA, 22 bp, Homo sapiens
gcagtgctagcctcacagggtc

SEQ ID NO: 7554815 - DNA, 22 bp, Homo sapiens
gcagtgcagtgggacagggcgc

SEQ ID NO: 7554816 - DNA, 22 bp, Homo sapiens
gcagtgccacaagatgggagga

SEQ ID NO: 7554817 - DNA, 22 bp, Homo sapiens
gcagtgccacaagatgggagga

SEQ ID NO: 7554818 - DNA, 22 bp, Homo sapiens
gcagtgccacaagatgggagga

SEQ ID NO: 7554819 - DNA, 22 bp, Homo sapiens
gcagtgccacaagatgggagga

SEQ ID NO: 7554820 - DNA, 22 bp, Homo sapiens
gcagtgccacaagatgggagga

SEQ ID NO: 7554821 - DNA, 22 bp, Homo sapiens
gcagtgcattactcacatgttt

SEQ ID NO: 7554822 - DNA, 22 bp, Homo sapiens
gcagtgcaggaacatagcttct

SEQ ID NO: 7554823 - DNA, 18 bp, Homo sapiens
gcagtgcaggaagaagag

SEQ ID NO: 7554824 - DNA, 22 bp, Homo sapiens
gcagtgcaggacaaatcagtgc

SEQ ID NO: 7554825 - DNA, 22 bp, Homo sapiens
gcagtgcagtgggacagggcgc

SEQ ID NO: 7554826 - DNA, 22 bp, Homo sapiens
attgtacaatgctgaggtttgg

SEQ ID NO: 7554827 - DNA, 22 bp, Homo sapiens
attgtacaatgctgaggtttgg

SEQ ID NO: 7554828 - DNA, 22 bp, Homo sapiens
attgtacaatgcctggaacatt

SEQ ID NO: 7554829 - DNA, 22 bp, Homo sapiens
attgtacaatgcctggaacatt

SEQ ID NO: 7554830 - DNA, 22 bp, Homo sapiens
attgtacaatgcctggaacatt

SEQ ID NO: 7554831 - DNA, 22 bp, Homo sapiens
attgtacaatgcctggaacatt

SEQ ID NO: 7554832 - DNA, 22 bp, Homo sapiens
attgtacaatgctgaggtttgg

SEQ ID NO: 7554833 - DNA, 22 bp, Homo sapiens
attgtacaatgctgaggtttgg

SEQ ID NO: 7554834 - DNA, 22 bp, Homo sapiens
attgtacaatgctgaggtttgg

SEQ ID NO: 7554835 - DNA, 22 bp, Homo sapiens
attgtacactagtggcagcagt

SEQ ID NO: 7554836 - DNA, 22 bp, Homo sapiens
attgtacactagtggcagcagt

SEQ ID NO: 7554837 - DNA, 22 bp, Homo sapiens
attgtacactagtggcagcagt

SEQ ID NO: 7554838 - DNA, 22 bp, Homo sapiens
gcagtgatttgtttcagcagca

SEQ ID NO: 7554839 - DNA, 22 bp, Homo sapiens
gcagtgattttgctcagataaa

SEQ ID NO: 7554840 - DNA, 20 bp, Homo sapiens
gcagtgatttgtctatgttt

SEQ ID NO: 7554841 - DNA, 22 bp, Homo sapiens
attgtacactagtggcagcagt

SEQ ID NO: 7554842 - DNA, 22 bp, Homo sapiens
gcagtgattggctttcacaaaa

SEQ ID NO: 7554843 - DNA, 22 bp, Homo sapiens
attgtacactagtggcagcagt

SEQ ID NO: 7554844 - DNA, 22 bp, Homo sapiens
gcagtgattggatcagagatgg

SEQ ID NO: 7554845 - DNA, 21 bp, Homo sapiens
gcagtgcagcttggagggtag

SEQ ID NO: 7554846 - DNA, 21 bp, Homo sapiens
gcagtgcagcttggagggtag

SEQ ID NO: 7554847 - DNA, 22 bp, Homo sapiens
gcagtgattttgctcagataaa

SEQ ID NO: 7554848 - DNA, 21 bp, Homo sapiens
gcagtgcagcttggagggtag

SEQ ID NO: 7554849 - DNA, 21 bp, Homo sapiens
gcagtgcagcttggagggtag

SEQ ID NO: 7554850 - DNA, 22 bp, Homo sapiens
attgtaattttagagaaagtgg

SEQ ID NO: 7554851 - DNA, 22 bp, Homo sapiens
attgtaagaggtttggctgtgt

SEQ ID NO: 7554852 - DNA, 22 bp, Homo sapiens
attgtaagtagaaatgttatgg

SEQ ID NO: 7554853 - DNA, 22 bp, Homo sapiens
attgtaacaacaatagtttagg

SEQ ID NO: 7554854 - DNA, 22 bp, Homo sapiens
attgtaagtagaaatgttatgg

SEQ ID NO: 7554855 - DNA, 22 bp, Homo sapiens
attgtaacatgttcagatcact

SEQ ID NO: 7554856 - DNA, 22 bp, Homo sapiens
attgtacaatgcctggaacatt

SEQ ID NO: 7554857 - DNA, 22 bp, Homo sapiens
attgtacaatgcctggaacatt

SEQ ID NO: 7554858 - DNA, 22 bp, Homo sapiens
attgtacaatgcctggaacatt

SEQ ID NO: 7554859 - DNA, 22 bp, Homo sapiens
attgtacaagtttggttattta

SEQ ID NO: 7554860 - DNA, 22 bp, Homo sapiens
attgtacaagtttggttattta

SEQ ID NO: 7554861 - DNA, 22 bp, Homo sapiens
attgtacaatgcctggaacatt

SEQ ID NO: 7554862 - DNA, 22 bp, Homo sapiens
attgtacaatgcctggaacatt

SEQ ID NO: 7554863 - DNA, 22 bp, Homo sapiens
attgtacaatgcctggaacatt

SEQ ID NO: 7554864 - DNA, 22 bp, Homo sapiens
attgtacaatgcctggaacatt

SEQ ID NO: 7554865 - DNA, 22 bp, Homo sapiens
attgtacaactgagggtggaat

SEQ ID NO: 7554866 - DNA, 22 bp, Homo sapiens
attgtacaagtttggttattta

SEQ ID NO: 7554867 - DNA, 22 bp, Homo sapiens
attgtacaagtttggttattta

SEQ ID NO: 7554868 - DNA, 22 bp, Homo sapiens
attgtacaactgagggtggaat

SEQ ID NO: 7554869 - DNA, 22 bp, Homo sapiens
attgtacaactgagggtggaat

SEQ ID NO: 7554870 - DNA, 22 bp, Homo sapiens
attgtacaactgagggtggaat

SEQ ID NO: 7554871 - DNA, 22 bp, Homo sapiens
attgtaattttagagaaagtgg

SEQ ID NO: 7554872 - DNA, 22 bp, Homo sapiens
attgtacaaaaaagtagacctt

SEQ ID NO: 7554873 - DNA, 22 bp, Homo sapiens
attgtacaaaaaagtagacctt

SEQ ID NO: 7554874 - DNA, 22 bp, Homo sapiens
attgtacaaaaaagtagacctt

SEQ ID NO: 7554875 - DNA, 22 bp, Homo sapiens
attgtacaaaaaagtagacctt

SEQ ID NO: 7554876 - DNA, 22 bp, Homo sapiens
attgttcactgtgaatcttgat

SEQ ID NO: 7554877 - DNA, 22 bp, Homo sapiens
attgttcactgtgaatcttgat

SEQ ID NO: 7554878 - DNA, 22 bp, Homo sapiens
attgttcactgtgaatcttgat

SEQ ID NO: 7554879 - DNA, 22 bp, Homo sapiens
attgttcaatgtaataattttg

SEQ ID NO: 7554880 - DNA, 22 bp, Homo sapiens
attgttcactgtgaatcttgat

SEQ ID NO: 7554881 - DNA, 22 bp, Homo sapiens
attgttcatgtatgaataaata

SEQ ID NO: 7554882 - DNA, 22 bp, Homo sapiens
attgttcagagtagggctctgt

SEQ ID NO: 7554883 - DNA, 22 bp, Homo sapiens
attgttcatgtatgaataaata

SEQ ID NO: 7554884 - DNA, 22 bp, Homo sapiens
attgttcattgtacacctagta

SEQ ID NO: 7554885 - DNA, 22 bp, Homo sapiens
attgttcattgtacacctagta

SEQ ID NO: 7554886 - DNA, 22 bp, Homo sapiens
attgttcattgtacacctagta

SEQ ID NO: 7554887 - DNA, 22 bp, Homo sapiens
attgttccacttccttgtttgc

SEQ ID NO: 7554888 - DNA, 22 bp, Homo sapiens
attgttcaatgtaataattttg

SEQ ID NO: 7554889 - DNA, 22 bp, Homo sapiens
attgttcaaagtgctttgcatg

SEQ ID NO: 7554890 - DNA, 22 bp, Homo sapiens
attgttcaatgtaataattttg

SEQ ID NO: 7554891 - DNA, 22 bp, Homo sapiens
attgttatgaaaataagatgtt

SEQ ID NO: 7554892 - DNA, 22 bp, Homo sapiens
attgttcaaagtgctttgcatg

SEQ ID NO: 7554893 - DNA, 21 bp, Homo sapiens
attgttagtaatagtccacac

SEQ ID NO: 7554894 - DNA, 21 bp, Homo sapiens
attgttatcattgtgctgtgt

SEQ ID NO: 7554895 - DNA, 22 bp, Homo sapiens
attgttatgaaaataagatgtt

SEQ ID NO: 7554896 - DNA, 22 bp, Homo sapiens
attgttatgaaaataagatgtt

SEQ ID NO: 7554897 - DNA, 22 bp, Homo sapiens
attgttaatgttgcactaaggt

SEQ ID NO: 7554898 - DNA, 22 bp, Homo sapiens
attgttaatgttgcactaaggt

SEQ ID NO: 7554899 - DNA, 22 bp, Homo sapiens
attgttaatgttgcactaaggt

SEQ ID NO: 7554900 - DNA, 20 bp, Homo sapiens
attgtgcagcccttggcaga

SEQ ID NO: 7554901 - DNA, 20 bp, Homo sapiens
gcagtgctggtgcctctgct

SEQ ID NO: 7554902 - DNA, 22 bp, Homo sapiens
attgtgcagcacagatcatgac

SEQ ID NO: 7554903 - DNA, 22 bp, Homo sapiens
attgttctggatatttacattg

SEQ ID NO: 7554904 - DNA, 22 bp, Homo sapiens
attgttctggatatttacattg

SEQ ID NO: 7554905 - DNA, 22 bp, Homo sapiens
attgttctggatatttacattg

SEQ ID NO: 7554906 - DNA, 22 bp, Homo sapiens
attgttctggatatttacattg

SEQ ID NO: 7554907 - DNA, 21 bp, Homo sapiens
attgttctggaggaaaggatt

SEQ ID NO: 7554908 - DNA, 21 bp, Homo sapiens
attgttctggaggaaaggatt

SEQ ID NO: 7554909 - DNA, 21 bp, Homo sapiens
attgttctggaggaaaggatt

SEQ ID NO: 7554910 - DNA, 22 bp, Homo sapiens
attgttctaagggtttaattaa

SEQ ID NO: 7554911 - DNA, 22 bp, Homo sapiens
attgttctaagggtttaattaa

SEQ ID NO: 7554912 - DNA, 22 bp, Homo sapiens
attgttccttagaaccatgcct

SEQ ID NO: 7554913 - DNA, 22 bp, Homo sapiens
attgttcctggaaaagaacagg

SEQ ID NO: 7554914 - DNA, 22 bp, Homo sapiens
attgttccctactgttcaactg

SEQ ID NO: 7554915 - DNA, 22 bp, Homo sapiens
attgttccatgttatatcacga

SEQ ID NO: 7554916 - DNA, 22 bp, Homo sapiens
attgttccacttccttgtttgc

SEQ ID NO: 7554917 - DNA, 22 bp, Homo sapiens
attgttctgtagtgacatgtag

SEQ ID NO: 7554918 - DNA, 18 bp, Homo sapiens
attgttctgtgacatgtc

SEQ ID NO: 7554919 - DNA, 22 bp, Homo sapiens
attgttctgtagtgacatgtag

SEQ ID NO: 7554920 - DNA, 22 bp, Homo sapiens
attgttctgtagtgacatgtag

SEQ ID NO: 7554921 - DNA, 22 bp, Homo sapiens
attgttgagtgcttcagctgta

SEQ ID NO: 7554922 - DNA, 22 bp, Homo sapiens
attgttgagtgcttcagctgta

SEQ ID NO: 7554923 - DNA, 22 bp, Homo sapiens
gcattcacattgtggttgcacg

SEQ ID NO: 7554924 - DNA, 22 bp, Homo sapiens
gcattattaatagctgcatgag

SEQ ID NO: 7554925 - DNA, 22 bp, Homo sapiens
gcattattaatagctgcatgag

SEQ ID NO: 7554926 - DNA, 22 bp, Homo sapiens
gcattattaactggaggaaaag

SEQ ID NO: 7554927 - DNA, 22 bp, Homo sapiens
attgtttacactaacttcataa

SEQ ID NO: 7554928 - DNA, 22 bp, Homo sapiens
attgtttacactaacttcataa

SEQ ID NO: 7554929 - DNA, 22 bp, Homo sapiens
attgtttacactaacttcataa

SEQ ID NO: 7554930 - DNA, 22 bp, Homo sapiens
attgtttacactaacttcataa

SEQ ID NO: 7554931 - DNA, 22 bp, Homo sapiens
attgttgggtctcactcctaga

SEQ ID NO: 7554932 - DNA, 22 bp, Homo sapiens
attgttgtctttacctgtattt

SEQ ID NO: 7554933 - DNA, 22 bp, Homo sapiens
attgttctggatatttacattg

SEQ ID NO: 7554934 - DNA, 22 bp, Homo sapiens
attgttgggtagtttgttcagc

SEQ ID NO: 7554935 - DNA, 22 bp, Homo sapiens
attgttgggtagtttgttcagc

SEQ ID NO: 7554936 - DNA, 22 bp, Homo sapiens
atattcaaattacatttactaa

SEQ ID NO: 7554937 - DNA, 22 bp, Homo sapiens
atattcaaattacatttactaa

SEQ ID NO: 7554938 - DNA, 22 bp, Homo sapiens
atattcaaattacatttactaa

SEQ ID NO: 7554939 - DNA, 22 bp, Homo sapiens
atattcaaattacatttactaa

SEQ ID NO: 7554940 - DNA, 22 bp, Homo sapiens
atattcaaattacatttactaa

SEQ ID NO: 7554941 - DNA, 22 bp, Homo sapiens
atattcaaattacatttactaa

SEQ ID NO: 7554942 - DNA, 22 bp, Homo sapiens
atattcaaattacatttactaa

SEQ ID NO: 7554943 - DNA, 22 bp, Homo sapiens
atattcaaattacatttactaa

SEQ ID NO: 7554944 - DNA, 22 bp, Homo sapiens
atattattctagtaacagtgat

SEQ ID NO: 7554945 - DNA, 22 bp, Homo sapiens
atattattctagtaacagtgat

SEQ ID NO: 7554946 - DNA, 22 bp, Homo sapiens
atattattctagtaacagtgat

SEQ ID NO: 7554947 - DNA, 22 bp, Homo sapiens
atattattctagtaacagtgat

SEQ ID NO: 7554948 - DNA, 22 bp, Homo sapiens
atattattttccctggagttgt

SEQ ID NO: 7554949 - DNA, 22 bp, Homo sapiens
atattattttccctggagttgt

SEQ ID NO: 7554950 - DNA, 22 bp, Homo sapiens
atattattttccctggagttgt

SEQ ID NO: 7554951 - DNA, 22 bp, Homo sapiens
atattattttccctggagttgt

SEQ ID NO: 7554952 - DNA, 22 bp, Homo sapiens
atattattttccctggagttgt

SEQ ID NO: 7554953 - DNA, 22 bp, Homo sapiens
atattattttccctggagttgt

SEQ ID NO: 7554954 - DNA, 22 bp, Homo sapiens
atattattttccctggagttgt

SEQ ID NO: 7554955 - DNA, 22 bp, Homo sapiens
atattcacactgtttagttaca

SEQ ID NO: 7554956 - DNA, 22 bp, Homo sapiens
atattcaagtgaggatggctaa

SEQ ID NO: 7554957 - DNA, 18 bp, Homo sapiens
atattcaagaagacagag

SEQ ID NO: 7554958 - DNA, 18 bp, Homo sapiens
atattcaagaagacagag

SEQ ID NO: 7554959 - DNA, 18 bp, Homo sapiens
atattcaagaagacagag

SEQ ID NO: 7554960 - DNA, 18 bp, Homo sapiens
atattcaagaagacagag

SEQ ID NO: 7554961 - DNA, 18 bp, Homo sapiens
atattcaagaagacagag

SEQ ID NO: 7554962 - DNA, 18 bp, Homo sapiens
atattcaagaagacagag

SEQ ID NO: 7554963 - DNA, 18 bp, Homo sapiens
atattcaagaagacagag

SEQ ID NO: 7554964 - DNA, 22 bp, Homo sapiens
atattcactcctggtgagacta

SEQ ID NO: 7554965 - DNA, 23 bp, Homo sapiens
atattcacgccgccagaggtccc

SEQ ID NO: 7554966 - DNA, 22 bp, Homo sapiens
atattcactcctggtgagacta

SEQ ID NO: 7554967 - DNA, 23 bp, Homo sapiens
atattcacgccgccagaggtccc

SEQ ID NO: 7554968 - DNA, 22 bp, Homo sapiens
atattcacagtaagtgtagcag

SEQ ID NO: 7554969 - DNA, 22 bp, Homo sapiens
atattcactgagcataaagcca

SEQ ID NO: 7554970 - DNA, 22 bp, Homo sapiens
atattcactgagcataaagcca

SEQ ID NO: 7554971 - DNA, 22 bp, Homo sapiens
atattcactgagcataaagcca

SEQ ID NO: 7554972 - DNA, 18 bp, Homo sapiens
ctgggtctccaggctgcc

SEQ ID NO: 7554973 - DNA, 22 bp, Homo sapiens
ctgggtctccggcagcctcggg

SEQ ID NO: 7554974 - DNA, 22 bp, Homo sapiens
ctgggtctccggcagcctcggg

SEQ ID NO: 7554975 - DNA, 18 bp, Homo sapiens
ctgggtctccaggctgcc

SEQ ID NO: 7554976 - DNA, 18 bp, Homo sapiens
ctgggtctccaggctgcc

SEQ ID NO: 7554977 - DNA, 18 bp, Homo sapiens
ctgggtctccaggctgcc

SEQ ID NO: 7554978 - DNA, 18 bp, Homo sapiens
ctgggtctccaggctgcc

SEQ ID NO: 7554979 - DNA, 22 bp, Homo sapiens
atattcactgagcataaagcca

SEQ ID NO: 7554980 - DNA, 22 bp, Homo sapiens
ctgggtggagcctggtcatctg

SEQ ID NO: 7554981 - DNA, 22 bp, Homo sapiens
ctgggtggagcctggtcatctg

SEQ ID NO: 7554982 - DNA, 22 bp, Homo sapiens
ctgggtggagcctggtcatctg

SEQ ID NO: 7554983 - DNA, 22 bp, Homo sapiens
ctgggtctccggcagcctcggg

SEQ ID NO: 7554984 - DNA, 22 bp, Homo sapiens
ctgggtctccggcagcctcggg

SEQ ID NO: 7554985 - DNA, 22 bp, Homo sapiens
ctgggtctccggcagcctcggg

SEQ ID NO: 7554986 - DNA, 22 bp, Homo sapiens
ctgggtggagcctggtcatctg

SEQ ID NO: 7554987 - DNA, 22 bp, Homo sapiens
ctgggtggagcctggtcatctg

SEQ ID NO: 7554988 - DNA, 22 bp, Homo sapiens
ctgggtggatcgcagccccagg

SEQ ID NO: 7554989 - DNA, 20 bp, Homo sapiens
ctgggtggcaagcaaggggg

SEQ ID NO: 7554990 - DNA, 20 bp, Homo sapiens
ctgggtggcaagcaaggggg

SEQ ID NO: 7554991 - DNA, 20 bp, Homo sapiens
ctgggtggcaagcaaggggg

SEQ ID NO: 7554992 - DNA, 20 bp, Homo sapiens
ctgggtggcaagcaaggggg

SEQ ID NO: 7554993 - DNA, 22 bp, Homo sapiens
ctgggtggatcgcagccccagg

SEQ ID NO: 7554994 - DNA, 22 bp, Homo sapiens
ctgggtggatcgcagccccagg

SEQ ID NO: 7554995 - DNA, 22 bp, Homo sapiens
ctgggtggatcgcagccccagg

SEQ ID NO: 7554996 - DNA, 22 bp, Homo sapiens
ctgggtggatcgcagccccagg

SEQ ID NO: 7554997 - DNA, 22 bp, Homo sapiens
ctgggtggatcgcagccccagg

SEQ ID NO: 7554998 - DNA, 22 bp, Homo sapiens
ctgggtggcagagcctgcagtg

SEQ ID NO: 7554999 - DNA, 22 bp, Homo sapiens
ctgggtggcgtctggggccagt

SEQ ID NO: 7555000 - DNA, 22 bp, Homo sapiens
ctgggtggcagagcctgcagtg

SEQ ID NO: 7555001 - DNA, 22 bp, Homo sapiens
ctgggtggcagagcctgcagtg

SEQ ID NO: 7555002 - DNA, 22 bp, Homo sapiens
ctgggtggcagagcctgcagtg

SEQ ID NO: 7555003 - DNA, 22 bp, Homo sapiens
ctgggtggcagagcctgcagtg

SEQ ID NO: 7555004 - DNA, 22 bp, Homo sapiens
ctgggtggcagagcctgcagtg

SEQ ID NO: 7555005 - DNA, 22 bp, Homo sapiens
ctgggtggcagagcctgcagtg

SEQ ID NO: 7555006 - DNA, 22 bp, Homo sapiens
ctgggtggcagagcctgcagtg

SEQ ID NO: 7555007 - DNA, 22 bp, Homo sapiens
ctgggtggcagagcctgcagtg

SEQ ID NO: 7555008 - DNA, 20 bp, Homo sapiens
ctgggtggcaagcaaggggg

SEQ ID NO: 7555009 - DNA, 22 bp, Homo sapiens
ctgggtggcagagcctgcagtg

SEQ ID NO: 7555010 - DNA, 22 bp, Homo sapiens
ctgggtggcagagcctgcagtg

SEQ ID NO: 7555011 - DNA, 22 bp, Homo sapiens
ctgggtggcagagcctgcagtg

SEQ ID NO: 7555012 - DNA, 20 bp, Homo sapiens
ctgggtggcaagcaaggggg

SEQ ID NO: 7555013 - DNA, 20 bp, Homo sapiens
ctgggtggcaagcaaggggg

SEQ ID NO: 7555014 - DNA, 20 bp, Homo sapiens
ctgggtggcaagcaaggggg

SEQ ID NO: 7555015 - DNA, 20 bp, Homo sapiens
ctgggtggcaagcaaggggg

SEQ ID NO: 7555016 - DNA, 22 bp, Homo sapiens
ctggtcagggtagtgttgcaga

SEQ ID NO: 7555017 - DNA, 22 bp, Homo sapiens
ctggtcagggctctttgggagc

SEQ ID NO: 7555018 - DNA, 22 bp, Homo sapiens
ctggtcagggtagtgttgcaga

SEQ ID NO: 7555019 - DNA, 22 bp, Homo sapiens
ctggtcaggggatggggctcag

SEQ ID NO: 7555020 - DNA, 22 bp, Homo sapiens
ctggtcaggggatggggctcag

SEQ ID NO: 7555021 - DNA, 22 bp, Homo sapiens
ctggtccagaatttatgattct

SEQ ID NO: 7555022 - DNA, 22 bp, Homo sapiens
ctggtcagggctctttgggagc

SEQ ID NO: 7555023 - DNA, 22 bp, Homo sapiens
ctggtcaggggatggggctcag

SEQ ID NO: 7555024 - DNA, 22 bp, Homo sapiens
ctggtcaggggatggggctcag

SEQ ID NO: 7555025 - DNA, 18 bp, Homo sapiens
ctggtcagggcaatgggc

SEQ ID NO: 7555026 - DNA, 18 bp, Homo sapiens
ctggtcagggcaatgggc

SEQ ID NO: 7555027 - DNA, 18 bp, Homo sapiens
ctggtcagggcaatgggc

SEQ ID NO: 7555028 - DNA, 18 bp, Homo sapiens
ctggtcagggcaatgggc

SEQ ID NO: 7555029 - DNA, 18 bp, Homo sapiens
ctggtcagggcaatgggc

SEQ ID NO: 7555030 - DNA, 22 bp, Homo sapiens
ctggtcaggaaggtggggacag

SEQ ID NO: 7555031 - DNA, 22 bp, Homo sapiens
ctggtcaggaaggtggggacag

SEQ ID NO: 7555032 - DNA, 22 bp, Homo sapiens
ctggtcaggctgaactgccaca

SEQ ID NO: 7555033 - DNA, 22 bp, Homo sapiens
ctgggtggcgtctggggccagt

SEQ ID NO: 7555034 - DNA, 22 bp, Homo sapiens
ctgggtggcgtctggggccagt

SEQ ID NO: 7555035 - DNA, 22 bp, Homo sapiens
ctgggtggcgtctggggccagt

SEQ ID NO: 7555036 - DNA, 22 bp, Homo sapiens
ctgggtggcgtctggggccagt

SEQ ID NO: 7555037 - DNA, 22 bp, Homo sapiens
ctgggtggcgtctggggccagt

SEQ ID NO: 7555038 - DNA, 22 bp, Homo sapiens
ctgggtggcgtctggggccagt

SEQ ID NO: 7555039 - DNA, 22 bp, Homo sapiens
ctgggtggcgtctggggccagt

SEQ ID NO: 7555040 - DNA, 22 bp, Homo sapiens
ctgggtggcgtctggggccagt

SEQ ID NO: 7555041 - DNA, 22 bp, Homo sapiens
ctgggtggctgtccagccagcc

SEQ ID NO: 7555042 - DNA, 22 bp, Homo sapiens
ctgggtggcgtctggggccagt

SEQ ID NO: 7555043 - DNA, 22 bp, Homo sapiens
ctgggtggcgtctggggccagt

SEQ ID NO: 7555044 - DNA, 22 bp, Homo sapiens
ctgggtggctgtccagccagcc

SEQ ID NO: 7555045 - DNA, 22 bp, Homo sapiens
ctgggtggctgtccagccagcc

SEQ ID NO: 7555046 - DNA, 22 bp, Homo sapiens
ctgggtggctgtccagccagcc

SEQ ID NO: 7555047 - DNA, 22 bp, Homo sapiens
ctgggtggctgtccagccagcc

SEQ ID NO: 7555048 - DNA, 22 bp, Homo sapiens
ctgggtggctgtccagccagcc

SEQ ID NO: 7555049 - DNA, 22 bp, Homo sapiens
ctgggtggctgtccagccagcc

SEQ ID NO: 7555050 - DNA, 22 bp, Homo sapiens
ctgggtggctgtccagccagcc

SEQ ID NO: 7555051 - DNA, 22 bp, Homo sapiens
atcaagaacttattttggaaat

SEQ ID NO: 7555052 - DNA, 22 bp, Homo sapiens
ctggtcctccttgccttcagat

SEQ ID NO: 7555053 - DNA, 22 bp, Homo sapiens
atcaagaatgttcattcttcta

SEQ ID NO: 7555054 - DNA, 22 bp, Homo sapiens
atcaagaatgttcattcttcta

SEQ ID NO: 7555055 - DNA, 22 bp, Homo sapiens
atcaagaacttattttggaaat

SEQ ID NO: 7555056 - DNA, 22 bp, Homo sapiens
atcaagaatgttcattcttcta

SEQ ID NO: 7555057 - DNA, 22 bp, Homo sapiens
ctggtcctaaagccctactcca

SEQ ID NO: 7555058 - DNA, 22 bp, Homo sapiens
ctggtccctggacctccctgga

SEQ ID NO: 7555059 - DNA, 22 bp, Homo sapiens
ctggtccctgtaggtatttgac

SEQ ID NO: 7555060 - DNA, 22 bp, Homo sapiens
ctggtcctaaagccctactcca

SEQ ID NO: 7555061 - DNA, 22 bp, Homo sapiens
ctggtccctggacctccctgga

SEQ ID NO: 7555062 - DNA, 22 bp, Homo sapiens
ctggtccctggacctccctgga

SEQ ID NO: 7555063 - DNA, 22 bp, Homo sapiens
ctggtccctgcagtgtgctggg

SEQ ID NO: 7555064 - DNA, 22 bp, Homo sapiens
ctggtccctgcagtgtgctggg

SEQ ID NO: 7555065 - DNA, 22 bp, Homo sapiens
ctggtcccagctctgccaccaa

SEQ ID NO: 7555066 - DNA, 22 bp, Homo sapiens
ctggtcccagcagagctctgag

SEQ ID NO: 7555067 - DNA, 22 bp, Homo sapiens
ctggtcccagcagagctctgag

SEQ ID NO: 7555068 - DNA, 22 bp, Homo sapiens
ctggtcccatcctggcttcatg

SEQ ID NO: 7555069 - DNA, 22 bp, Homo sapiens
ctggtcccatcctggcttcatg

SEQ ID NO: 7555070 - DNA, 22 bp, Homo sapiens
ctggtcccatcctggcttcatg

SEQ ID NO: 7555071 - DNA, 22 bp, Homo sapiens
ctggtccccagactgggcttag

SEQ ID NO: 7555072 - DNA, 22 bp, Homo sapiens
ctggtccccagactgggcttag

SEQ ID NO: 7555073 - DNA, 22 bp, Homo sapiens
ctggtccagttgtctcctaagc

SEQ ID NO: 7555074 - DNA, 22 bp, Homo sapiens
ctggtccagtggatgctgaggg

SEQ ID NO: 7555075 - DNA, 22 bp, Homo sapiens
ctggtccattctctccctgaag

SEQ ID NO: 7555076 - DNA, 22 bp, Homo sapiens
ctggtccagtggatgctgaggg

SEQ ID NO: 7555077 - DNA, 22 bp, Homo sapiens
ctggtccagtggatgctgaggg

SEQ ID NO: 7555078 - DNA, 22 bp, Homo sapiens
ctggtcccagcagagctctgag

SEQ ID NO: 7555079 - DNA, 22 bp, Homo sapiens
ctggtcccagcagagctctgag

SEQ ID NO: 7555080 - DNA, 22 bp, Homo sapiens
ctggtcccagaggcaagagatg

SEQ ID NO: 7555081 - DNA, 22 bp, Homo sapiens
ctggtcccagaggcaagagatg

SEQ ID NO: 7555082 - DNA, 22 bp, Homo sapiens
ctggtcccagaggcaagagatg

SEQ ID NO: 7555083 - DNA, 17 bp, Homo sapiens
ctggtcccaccaagccc

SEQ ID NO: 7555084 - DNA, 22 bp, Homo sapiens
ctggtccattctctccctgaag

SEQ ID NO: 7555085 - DNA, 22 bp, Homo sapiens
ctgggggcaagcagacagctgt

SEQ ID NO: 7555086 - DNA, 22 bp, Homo sapiens
ctgggggcaagcagacagctgt

SEQ ID NO: 7555087 - DNA, 22 bp, Homo sapiens
ctgggggcaagcagacagctgt

SEQ ID NO: 7555088 - DNA, 22 bp, Homo sapiens
ctgggggcaagcagacagctgt

SEQ ID NO: 7555089 - DNA, 22 bp, Homo sapiens
ctgggggcaagcagacagctgt

SEQ ID NO: 7555090 - DNA, 19 bp, Homo sapiens
ctggggctttggtactgcc

SEQ ID NO: 7555091 - DNA, 19 bp, Homo sapiens
ctggggctttggtactgcc

SEQ ID NO: 7555092 - DNA, 19 bp, Homo sapiens
ctggggctttggtactgcc

SEQ ID NO: 7555093 - DNA, 19 bp, Homo sapiens
ctggggctttggtactgcc

SEQ ID NO: 7555094 - DNA, 19 bp, Homo sapiens
ctggggctttggtactgcc

SEQ ID NO: 7555095 - DNA, 19 bp, Homo sapiens
ctggggctttggtactgcc

SEQ ID NO: 7555096 - DNA, 19 bp, Homo sapiens
ctggggctttggtactgcc

SEQ ID NO: 7555097 - DNA, 19 bp, Homo sapiens
ctggggctttggtactgcc

SEQ ID NO: 7555098 - DNA, 19 bp, Homo sapiens
ctggggctttggtactgcc

SEQ ID NO: 7555099 - DNA, 19 bp, Homo sapiens
ctggggctttggtactgcc

SEQ ID NO: 7555100 - DNA, 19 bp, Homo sapiens
ctggggctttggtactgcc

SEQ ID NO: 7555101 - DNA, 22 bp, Homo sapiens
ctgggggcaatggtcagagtgt

SEQ ID NO: 7555102 - DNA, 22 bp, Homo sapiens
ctgggggcaatggtcagagtgt

SEQ ID NO: 7555103 - DNA, 22 bp, Homo sapiens
atattattctagctcttgtgtg

SEQ ID NO: 7555104 - DNA, 22 bp, Homo sapiens
atattattctagctcttgtgtg

SEQ ID NO: 7555105 - DNA, 22 bp, Homo sapiens
atattattctagctcttgtgtg

SEQ ID NO: 7555106 - DNA, 22 bp, Homo sapiens
ctgggggcaatggtcagagtgt

SEQ ID NO: 7555107 - DNA, 22 bp, Homo sapiens
ctgggggcaatggtcagagtgt

SEQ ID NO: 7555108 - DNA, 22 bp, Homo sapiens
ctgggggcaagcagacagctgt

SEQ ID NO: 7555109 - DNA, 22 bp, Homo sapiens
ctgggggcaatggtcagagtgt

SEQ ID NO: 7555110 - DNA, 22 bp, Homo sapiens
atattattctagtaacagtgat

SEQ ID NO: 7555111 - DNA, 22 bp, Homo sapiens
atattattctagtaacagtgat

SEQ ID NO: 7555112 - DNA, 22 bp, Homo sapiens
atattattctagtaacagtgat

SEQ ID NO: 7555113 - DNA, 22 bp, Homo sapiens
atattattctagtaacagtgat

SEQ ID NO: 7555114 - DNA, 22 bp, Homo sapiens
atattattctagctcttgtgtg

SEQ ID NO: 7555115 - DNA, 22 bp, Homo sapiens
atattattctagctcttgtgtg

SEQ ID NO: 7555116 - DNA, 22 bp, Homo sapiens
atattattctagtaacagtgat

SEQ ID NO: 7555117 - DNA, 22 bp, Homo sapiens
atattattctagtaacagtgat

SEQ ID NO: 7555118 - DNA, 19 bp, Homo sapiens
ctgggaggtgttcagagaa

SEQ ID NO: 7555119 - DNA, 19 bp, Homo sapiens
ctgggaggtgttcagagaa

SEQ ID NO: 7555120 - DNA, 19 bp, Homo sapiens
ctgggaggtgttcagagaa

SEQ ID NO: 7555121 - DNA, 19 bp, Homo sapiens
ctgggaggtgttcagagaa

SEQ ID NO: 7555122 - DNA, 19 bp, Homo sapiens
ctgggaggtgttcagagaa

SEQ ID NO: 7555123 - DNA, 19 bp, Homo sapiens
ctgggaggtgttcagagaa

SEQ ID NO: 7555124 - DNA, 22 bp, Homo sapiens
ctggggcatgggcccctagagg

SEQ ID NO: 7555125 - DNA, 22 bp, Homo sapiens
ctggggcatgggcccctagagg

SEQ ID NO: 7555126 - DNA, 22 bp, Homo sapiens
ctggggcatgggcccctagagg

SEQ ID NO: 7555127 - DNA, 22 bp, Homo sapiens
ctggggcatctgacagataaat

SEQ ID NO: 7555128 - DNA, 22 bp, Homo sapiens
ctggggcatctgacagataaat

SEQ ID NO: 7555129 - DNA, 22 bp, Homo sapiens
ctggggcatctgacagataaat

SEQ ID NO: 7555130 - DNA, 22 bp, Homo sapiens
ctggggcatctgacagataaat

SEQ ID NO: 7555131 - DNA, 22 bp, Homo sapiens
ctggggctgtaggaggacttat

SEQ ID NO: 7555132 - DNA, 22 bp, Homo sapiens
ctggggctgtgggagacaaggc

SEQ ID NO: 7555133 - DNA, 22 bp, Homo sapiens
ctggggctgtgggagacaaggc

SEQ ID NO: 7555134 - DNA, 22 bp, Homo sapiens
ctggggctgtgggagacaaggc

SEQ ID NO: 7555135 - DNA, 22 bp, Homo sapiens
ctggggctgtaggaggacttat

SEQ ID NO: 7555136 - DNA, 22 bp, Homo sapiens
ctggggctgtaggaggacttat

SEQ ID NO: 7555137 - DNA, 22 bp, Homo sapiens
ctggggcatgggcccctagagg

SEQ ID NO: 7555138 - DNA, 22 bp, Homo sapiens
ctggggcatgggcccctagagg

SEQ ID NO: 7555139 - DNA, 22 bp, Homo sapiens
ctggggcatgggcccctagagg

SEQ ID NO: 7555140 - DNA, 22 bp, Homo sapiens
ctggggcatgggcccctagagg

SEQ ID NO: 7555141 - DNA, 22 bp, Homo sapiens
ctggggcatgggcccctagagg

SEQ ID NO: 7555142 - DNA, 23 bp, Homo sapiens
ctggggctttcaaatctgggcag

SEQ ID NO: 7555143 - DNA, 23 bp, Homo sapiens
ctggggctttcaaatctgggcag

SEQ ID NO: 7555144 - DNA, 23 bp, Homo sapiens
ctggggctttcaaatctgggcag

SEQ ID NO: 7555145 - DNA, 22 bp, Homo sapiens
ctggggcttcaatgcttcggtg

SEQ ID NO: 7555146 - DNA, 23 bp, Homo sapiens
ctggggctttcaaatctgggcag

SEQ ID NO: 7555147 - DNA, 22 bp, Homo sapiens
ctggggcttcaatgcttcggtg

SEQ ID NO: 7555148 - DNA, 22 bp, Homo sapiens
ctggggcttcaatgcttcggtg

SEQ ID NO: 7555149 - DNA, 22 bp, Homo sapiens
ctggggcttcaatgcttcggtg

SEQ ID NO: 7555150 - DNA, 22 bp, Homo sapiens
ctggggctgtgggagacaaggc

SEQ ID NO: 7555151 - DNA, 22 bp, Homo sapiens
ctggggctgtgggagacaaggc

SEQ ID NO: 7555152 - DNA, 22 bp, Homo sapiens
ctggggctgtgggagacaaggc

SEQ ID NO: 7555153 - DNA, 22 bp, Homo sapiens
ctgggaggattcattgaggtga

SEQ ID NO: 7555154 - DNA, 22 bp, Homo sapiens
ctgggaggattcattgaggtga

SEQ ID NO: 7555155 - DNA, 22 bp, Homo sapiens
ctgggaggattcattgaggtga

SEQ ID NO: 7555156 - DNA, 22 bp, Homo sapiens
ctgggaggcggaggttgcagtg

SEQ ID NO: 7555157 - DNA, 22 bp, Homo sapiens
ctgggaggcggaggttgcagtg

SEQ ID NO: 7555158 - DNA, 22 bp, Homo sapiens
ctgggaggcggaggttgcagtg

SEQ ID NO: 7555159 - DNA, 22 bp, Homo sapiens
ctgggaggcggaggttgcagtg

SEQ ID NO: 7555160 - DNA, 22 bp, Homo sapiens
ctgggaggacaacttggagctc

SEQ ID NO: 7555161 - DNA, 22 bp, Homo sapiens
ctgggaggatacacaagatcag

SEQ ID NO: 7555162 - DNA, 22 bp, Homo sapiens
ctgggaggatacacaagatcag

SEQ ID NO: 7555163 - DNA, 22 bp, Homo sapiens
ctgggaggatacacaagatcag

SEQ ID NO: 7555164 - DNA, 22 bp, Homo sapiens
ctgggaggatacacaagatcag

SEQ ID NO: 7555165 - DNA, 22 bp, Homo sapiens
ctgggaggattcattgaggtga

SEQ ID NO: 7555166 - DNA, 22 bp, Homo sapiens
ctgggaggatacacaagatcag

SEQ ID NO: 7555167 - DNA, 22 bp, Homo sapiens
ctgggaggacaacttggagctc

SEQ ID NO: 7555168 - DNA, 22 bp, Homo sapiens
ctgggaggacaacttggagctc

SEQ ID NO: 7555169 - DNA, 22 bp, Homo sapiens
ctgggaggacaacttggagctc

SEQ ID NO: 7555170 - DNA, 22 bp, Homo sapiens
ctgggaggacaacttggagctc

SEQ ID NO: 7555171 - DNA, 22 bp, Homo sapiens
ctgggaggacaacttggagctc

SEQ ID NO: 7555172 - DNA, 22 bp, Homo sapiens
ctgggaggacaacttggagctc

SEQ ID NO: 7555173 - DNA, 22 bp, Homo sapiens
ctgggaggacaacttggagctc

SEQ ID NO: 7555174 - DNA, 22 bp, Homo sapiens
ctgggagcttgttaggaatgca

SEQ ID NO: 7555175 - DNA, 22 bp, Homo sapiens
ctgggagcttgttaggaatgca

SEQ ID NO: 7555176 - DNA, 22 bp, Homo sapiens
ctgggagcttgttaggaatgca

SEQ ID NO: 7555177 - DNA, 22 bp, Homo sapiens
ctgggaggacaacttggagctc

SEQ ID NO: 7555178 - DNA, 19 bp, Homo sapiens
ctgggaggtgttcagagaa

SEQ ID NO: 7555179 - DNA, 22 bp, Homo sapiens
ctgggaggtggaggttgcattg

SEQ ID NO: 7555180 - DNA, 22 bp, Homo sapiens
ctgggaggtggaggttgcattg

SEQ ID NO: 7555181 - DNA, 22 bp, Homo sapiens
ctgggaggtggaggttgcattg

SEQ ID NO: 7555182 - DNA, 22 bp, Homo sapiens
ctgggaggtggaggttgcattg

SEQ ID NO: 7555183 - DNA, 22 bp, Homo sapiens
ctgggaggtgaacagaaaaact

SEQ ID NO: 7555184 - DNA, 22 bp, Homo sapiens
ctgggaggtgaacagaaaaact

SEQ ID NO: 7555185 - DNA, 22 bp, Homo sapiens
ctgggaggtgaacagaaaaact

SEQ ID NO: 7555186 - DNA, 22 bp, Homo sapiens
ctgggaggtgaacagaaaaact

SEQ ID NO: 7555187 - DNA, 22 bp, Homo sapiens
ctgggaggtgaacagaaaaact

SEQ ID NO: 7555188 - DNA, 22 bp, Homo sapiens
ctgggaggtgcagcaaaaatca

SEQ ID NO: 7555189 - DNA, 22 bp, Homo sapiens
ctgggaggggtagccaatccta

SEQ ID NO: 7555190 - DNA, 22 bp, Homo sapiens
ctgggaggggtagccaatccta

SEQ ID NO: 7555191 - DNA, 22 bp, Homo sapiens
ctgggaggcggaggttgtagtg

SEQ ID NO: 7555192 - DNA, 22 bp, Homo sapiens
ctgggaggcggaggttgtagtg

SEQ ID NO: 7555193 - DNA, 22 bp, Homo sapiens
ctgggaggcggaggttgtagtg

SEQ ID NO: 7555194 - DNA, 22 bp, Homo sapiens
ctgggaggcggaggttgtagtg

SEQ ID NO: 7555195 - DNA, 22 bp, Homo sapiens
ctgggaggcggaggttgtagtg

SEQ ID NO: 7555196 - DNA, 22 bp, Homo sapiens
ctgggaggcggaggttgtagtg

SEQ ID NO: 7555197 - DNA, 22 bp, Homo sapiens
ctgggaggattcattgaggtga

SEQ ID NO: 7555198 - DNA, 22 bp, Homo sapiens
ctgggaggcggaggttgtagtg

SEQ ID NO: 7555199 - DNA, 22 bp, Homo sapiens
ctgggaggggtagccaatccta

SEQ ID NO: 7555200 - DNA, 22 bp, Homo sapiens
ctgggaggggtagccaatccta

SEQ ID NO: 7555201 - DNA, 20 bp, Homo sapiens
ctgggaggtcttccaaatca

SEQ ID NO: 7555202 - DNA, 20 bp, Homo sapiens
ctgggaggtcttccaaatca

SEQ ID NO: 7555203 - DNA, 22 bp, Homo sapiens
atcacaaaggtctcagagcaca

SEQ ID NO: 7555204 - DNA, 22 bp, Homo sapiens
atcacaaaggtctcagagcaca

SEQ ID NO: 7555205 - DNA, 22 bp, Homo sapiens
atcacaaaggtctcagagcaca

SEQ ID NO: 7555206 - DNA, 22 bp, Homo sapiens
atcacaaaggtctcagagcaca

SEQ ID NO: 7555207 - DNA, 22 bp, Homo sapiens
atcacaaaggtctcagagcaca

SEQ ID NO: 7555208 - DNA, 22 bp, Homo sapiens
atcacaaaggtctcagagcaca

SEQ ID NO: 7555209 - DNA, 22 bp, Homo sapiens
atcacaaaggtctcagagcaca

SEQ ID NO: 7555210 - DNA, 22 bp, Homo sapiens
atcacaaaggtctcagagcaca

SEQ ID NO: 7555211 - DNA, 22 bp, Homo sapiens
atcacaaaggtctcagagcaca

SEQ ID NO: 7555212 - DNA, 22 bp, Homo sapiens
atcacaaagggttttctctgag

SEQ ID NO: 7555213 - DNA, 22 bp, Homo sapiens
atcacaaagggttttctctgag

SEQ ID NO: 7555214 - DNA, 22 bp, Homo sapiens
atcaagaattgggagctattga

SEQ ID NO: 7555215 - DNA, 22 bp, Homo sapiens
atcaagaatgttcattcttcta

SEQ ID NO: 7555216 - DNA, 22 bp, Homo sapiens
atcaagaattgggagctattga

SEQ ID NO: 7555217 - DNA, 22 bp, Homo sapiens
atcaagaattgggagctattga

SEQ ID NO: 7555218 - DNA, 22 bp, Homo sapiens
atcacaaagggttttctctgag

SEQ ID NO: 7555219 - DNA, 22 bp, Homo sapiens
atcacaaagggttttctctgag

SEQ ID NO: 7555220 - DNA, 22 bp, Homo sapiens
atcacaaaggctgcttcatgat

SEQ ID NO: 7555221 - DNA, 22 bp, Homo sapiens
atcacaaaggctgcttcatgat

SEQ ID NO: 7555222 - DNA, 22 bp, Homo sapiens
atcacaaagggttttctctgag

SEQ ID NO: 7555223 - DNA, 22 bp, Homo sapiens
atcacaaagggttttctctgag

SEQ ID NO: 7555224 - DNA, 22 bp, Homo sapiens
atcacaatgtacgttaaaatgt

SEQ ID NO: 7555225 - DNA, 22 bp, Homo sapiens
atcacactggacattggatact

SEQ ID NO: 7555226 - DNA, 22 bp, Homo sapiens
atcacactaagggttggggcat

SEQ ID NO: 7555227 - DNA, 22 bp, Homo sapiens
atcacactggacattggatact

SEQ ID NO: 7555228 - DNA, 22 bp, Homo sapiens
atcacacagagcattaggggcc

SEQ ID NO: 7555229 - DNA, 22 bp, Homo sapiens
atcacacagagcattaggggcc

SEQ ID NO: 7555230 - DNA, 22 bp, Homo sapiens
atcacacagcaaggtggaggca

SEQ ID NO: 7555231 - DNA, 22 bp, Homo sapiens
atcacacagcaaggtggaggca

SEQ ID NO: 7555232 - DNA, 22 bp, Homo sapiens
atcacaatccctctctctgata

SEQ ID NO: 7555233 - DNA, 22 bp, Homo sapiens
atcacaatcttcaaatcgattc

SEQ ID NO: 7555234 - DNA, 22 bp, Homo sapiens
atcacaatcttcaaatcgattc

SEQ ID NO: 7555235 - DNA, 22 bp, Homo sapiens
atcacaatgtacgttaaaatgt

SEQ ID NO: 7555236 - DNA, 22 bp, Homo sapiens
atcacaatgtacgttaaaatgt

SEQ ID NO: 7555237 - DNA, 22 bp, Homo sapiens
atcacaatgtacgttaaaatgt

SEQ ID NO: 7555238 - DNA, 22 bp, Homo sapiens
atcacaaaggtctcagagcaca

SEQ ID NO: 7555239 - DNA, 22 bp, Homo sapiens
atcacaaaggtctcagagcaca

SEQ ID NO: 7555240 - DNA, 22 bp, Homo sapiens
atcacaaaggtctcagagcaca

SEQ ID NO: 7555241 - DNA, 18 bp, Homo sapiens
atcacagagggggagtct

SEQ ID NO: 7555242 - DNA, 22 bp, Homo sapiens
atcacagattgtgaataactat

SEQ ID NO: 7555243 - DNA, 22 bp, Homo sapiens
atcacagattgtgaataactat

SEQ ID NO: 7555244 - DNA, 22 bp, Homo sapiens
atcacagattgtgaataactat

SEQ ID NO: 7555245 - DNA, 22 bp, Homo sapiens
atcacagattgtgaataactat

SEQ ID NO: 7555246 - DNA, 22 bp, Homo sapiens
atcacagattgtgaataactat

SEQ ID NO: 7555247 - DNA, 19 bp, Homo sapiens
atcacagacgtgcctcatc

SEQ ID NO: 7555248 - DNA, 22 bp, Homo sapiens
atcacagagattgcttttaaaa

SEQ ID NO: 7555249 - DNA, 22 bp, Homo sapiens
atcacactgttattttagttaa

SEQ ID NO: 7555250 - DNA, 22 bp, Homo sapiens
atcacactgttattttagttaa

SEQ ID NO: 7555251 - DNA, 22 bp, Homo sapiens
atcacacttttgtaaccatcag

SEQ ID NO: 7555252 - DNA, 22 bp, Homo sapiens
atcacactgttattttagttaa

SEQ ID NO: 7555253 - DNA, 22 bp, Homo sapiens
atcacagacaattgtcagacca

SEQ ID NO: 7555254 - DNA, 22 bp, Homo sapiens
atcacagacaattgtcagacca

SEQ ID NO: 7555255 - DNA, 22 bp, Homo sapiens
atcacagcacacctgacatgta

SEQ ID NO: 7555256 - DNA, 22 bp, Homo sapiens
atcacagcacacctgacatgta

SEQ ID NO: 7555257 - DNA, 22 bp, Homo sapiens
atcacagctagtaagtggagga

SEQ ID NO: 7555258 - DNA, 22 bp, Homo sapiens
atcacagctagtaagtggagga

SEQ ID NO: 7555259 - DNA, 22 bp, Homo sapiens
atcacagcacacctgacatgta

SEQ ID NO: 7555260 - DNA, 22 bp, Homo sapiens
atcacagctagtaagtggagga

SEQ ID NO: 7555261 - DNA, 22 bp, Homo sapiens
ctgtaaactaggtcatttttaa

SEQ ID NO: 7555262 - DNA, 22 bp, Homo sapiens
ctgtaaactaggtcatttttaa

SEQ ID NO: 7555263 - DNA, 20 bp, Homo sapiens
ctgtaaactgcgtctgtaat

SEQ ID NO: 7555264 - DNA, 20 bp, Homo sapiens
ctgtaaactgcgtctgtaat

SEQ ID NO: 7555265 - DNA, 22 bp, Homo sapiens
ctgtaaatatgaagaatatatg

SEQ ID NO: 7555266 - DNA, 22 bp, Homo sapiens
ctgtaaatggaactatgtagta

SEQ ID NO: 7555267 - DNA, 22 bp, Homo sapiens
ctgtaaatatgaagaatatatg

SEQ ID NO: 7555268 - DNA, 22 bp, Homo sapiens
ctgtaaatggaactatgtagta

SEQ ID NO: 7555269 - DNA, 22 bp, Homo sapiens
ctgtaaagacactaactatgga

SEQ ID NO: 7555270 - DNA, 22 bp, Homo sapiens
ctgtaaacttctggaggtcaag

SEQ ID NO: 7555271 - DNA, 22 bp, Homo sapiens
ctgtaaataatgacagttgact

SEQ ID NO: 7555272 - DNA, 22 bp, Homo sapiens
ctgtaatcccagctactcggga

SEQ ID NO: 7555273 - DNA, 22 bp, Homo sapiens
ctgtaatcccagctactcggga

SEQ ID NO: 7555274 - DNA, 22 bp, Homo sapiens
ctgtaatcccagctacctggga

SEQ ID NO: 7555275 - DNA, 22 bp, Homo sapiens
ctgtaatcccagctacctggga

SEQ ID NO: 7555276 - DNA, 22 bp, Homo sapiens
ctgtaatcccagctacctggga

SEQ ID NO: 7555277 - DNA, 22 bp, Homo sapiens
ctgtaatcccagctacctggga

SEQ ID NO: 7555278 - DNA, 22 bp, Homo sapiens
ctgtaatcccagctacctggga

SEQ ID NO: 7555279 - DNA, 22 bp, Homo sapiens
ctgtaatcccagctacctggga

SEQ ID NO: 7555280 - DNA, 22 bp, Homo sapiens
ctgtaatcccagctactcggga

SEQ ID NO: 7555281 - DNA, 22 bp, Homo sapiens
ctgtaatcccagctactcggga

SEQ ID NO: 7555282 - DNA, 22 bp, Homo sapiens
ctgtaatcccagctactcggga

SEQ ID NO: 7555283 - DNA, 22 bp, Homo sapiens
ctgtaatcccagctactcggga

SEQ ID NO: 7555284 - DNA, 22 bp, Homo sapiens
atcagagccctgatgacagact

SEQ ID NO: 7555285 - DNA, 22 bp, Homo sapiens
atcagagccctgatgacagact

SEQ ID NO: 7555286 - DNA, 22 bp, Homo sapiens
ctgtaagatgggataagacttt

SEQ ID NO: 7555287 - DNA, 22 bp, Homo sapiens
ctgtaatcccagctacctggga

SEQ ID NO: 7555288 - DNA, 22 bp, Homo sapiens
ctgtaatcccagctacctggga

SEQ ID NO: 7555289 - DNA, 21 bp, Homo sapiens
ctgtaagaaatcagttttatc

SEQ ID NO: 7555290 - DNA, 21 bp, Homo sapiens
ctgtaagaaatcagttttatc

SEQ ID NO: 7555291 - DNA, 22 bp, Homo sapiens
ctgtaatcccagctacctggga

SEQ ID NO: 7555292 - DNA, 22 bp, Homo sapiens
ctgtaacttaatgagaggcaga

SEQ ID NO: 7555293 - DNA, 22 bp, Homo sapiens
ctgtaactctgccaagaaggct

SEQ ID NO: 7555294 - DNA, 22 bp, Homo sapiens
ctgtaacttaatgagaggcaga

SEQ ID NO: 7555295 - DNA, 22 bp, Homo sapiens
ctgtaacttagcatggttacta

SEQ ID NO: 7555296 - DNA, 22 bp, Homo sapiens
ctgtaacctcctctttccattc

SEQ ID NO: 7555297 - DNA, 22 bp, Homo sapiens
ctgtaaccactccacctgcggc

SEQ ID NO: 7555298 - DNA, 22 bp, Homo sapiens
ctgtaacagatatcatttagca

SEQ ID NO: 7555299 - DNA, 22 bp, Homo sapiens
ctgtaacagatatcatttagca

SEQ ID NO: 7555300 - DNA, 22 bp, Homo sapiens
ctgtaaatatgaagaatatatg

SEQ ID NO: 7555301 - DNA, 22 bp, Homo sapiens
atcagcaggcatattaactgaa

SEQ ID NO: 7555302 - DNA, 22 bp, Homo sapiens
atcagcagctaaggaactaaca

SEQ ID NO: 7555303 - DNA, 22 bp, Homo sapiens
atcagcaggaagggcaccttta

SEQ ID NO: 7555304 - DNA, 22 bp, Homo sapiens
atcagcaggaagggcaccttta

SEQ ID NO: 7555305 - DNA, 22 bp, Homo sapiens
atcagcaggcatattaactgaa

SEQ ID NO: 7555306 - DNA, 22 bp, Homo sapiens
atcagcaggtgctggtggagac

SEQ ID NO: 7555307 - DNA, 22 bp, Homo sapiens
atcagcagtgtctacctcggtg

SEQ ID NO: 7555308 - DNA, 22 bp, Homo sapiens
atcagcagtgtctacctcggtg

SEQ ID NO: 7555309 - DNA, 22 bp, Homo sapiens
atcagcagtgagtggctttcat

SEQ ID NO: 7555310 - DNA, 22 bp, Homo sapiens
atcagcaggtgctggtggagac

SEQ ID NO: 7555311 - DNA, 22 bp, Homo sapiens
atcagcaggtgctggtggagac

SEQ ID NO: 7555312 - DNA, 22 bp, Homo sapiens
atcagcaggtgctggtggagac

SEQ ID NO: 7555313 - DNA, 22 bp, Homo sapiens
atcagcagatgctcaatgaaca

SEQ ID NO: 7555314 - DNA, 22 bp, Homo sapiens
atcagcagctaaggaactaaca

SEQ ID NO: 7555315 - DNA, 22 bp, Homo sapiens
atcagcagaccattttccaaat

SEQ ID NO: 7555316 - DNA, 22 bp, Homo sapiens
atcagcagaccattttccaaat

SEQ ID NO: 7555317 - DNA, 22 bp, Homo sapiens
atcagcagatgctcaatgaaca

SEQ ID NO: 7555318 - DNA, 22 bp, Homo sapiens
atcagcaatctcgtgtattagg

SEQ ID NO: 7555319 - DNA, 22 bp, Homo sapiens
atcagcatcgggtggtggtggg

SEQ ID NO: 7555320 - DNA, 22 bp, Homo sapiens
atcagcatctttaacaattacc

SEQ ID NO: 7555321 - DNA, 22 bp, Homo sapiens
atcagccaattacagaacatga

SEQ ID NO: 7555322 - DNA, 22 bp, Homo sapiens
atcagcccaccatcttcataac

SEQ ID NO: 7555323 - DNA, 22 bp, Homo sapiens
atcagcccgtttctgccttcta

SEQ ID NO: 7555324 - DNA, 22 bp, Homo sapiens
atcagctagataagtcaagcaa

SEQ ID NO: 7555325 - DNA, 19 bp, Homo sapiens
atcagctgaagccttcaga

SEQ ID NO: 7555326 - DNA, 22 bp, Homo sapiens
atcagctgatgaatggatgaat

SEQ ID NO: 7555327 - DNA, 22 bp, Homo sapiens
atcagctgaaaaacaggcagca

SEQ ID NO: 7555328 - DNA, 19 bp, Homo sapiens
atcagctgaagccttcaga

SEQ ID NO: 7555329 - DNA, 22 bp, Homo sapiens
atcagctcattttgatggaaat

SEQ ID NO: 7555330 - DNA, 22 bp, Homo sapiens
atcagctcaagaacgttcccca

SEQ ID NO: 7555331 - DNA, 22 bp, Homo sapiens
atcagctgaaaaacaggcagca

SEQ ID NO: 7555332 - DNA, 22 bp, Homo sapiens
atcagctgaaaaacaggcagca

SEQ ID NO: 7555333 - DNA, 20 bp, Homo sapiens
ctgtccttttgttggaagac

SEQ ID NO: 7555334 - DNA, 22 bp, Homo sapiens
ctgtcgctgccaacagggctgg

SEQ ID NO: 7555335 - DNA, 22 bp, Homo sapiens
ctgtctagttaggatgccagca

SEQ ID NO: 7555336 - DNA, 22 bp, Homo sapiens
ctgtctagttaggatgccagca

SEQ ID NO: 7555337 - DNA, 22 bp, Homo sapiens
ctgtctccagggcaggtgcagg

SEQ ID NO: 7555338 - DNA, 22 bp, Homo sapiens
ctgtctccagggcaggtgcagg

SEQ ID NO: 7555339 - DNA, 22 bp, Homo sapiens
ctgtctccagggcaggtgcagg

SEQ ID NO: 7555340 - DNA, 22 bp, Homo sapiens
ctgtctccagggcaggtgcagg

SEQ ID NO: 7555341 - DNA, 22 bp, Homo sapiens
ctgtctccagggcaggtgcagg

SEQ ID NO: 7555342 - DNA, 22 bp, Homo sapiens
ctgtctcaagactgcaggcact

SEQ ID NO: 7555343 - DNA, 22 bp, Homo sapiens
ctgtctatcccttccttccttt

SEQ ID NO: 7555344 - DNA, 22 bp, Homo sapiens
ctgtctatcccttccttccttt

SEQ ID NO: 7555345 - DNA, 22 bp, Homo sapiens
ctgtctcagcaggaagtcatca

SEQ ID NO: 7555346 - DNA, 22 bp, Homo sapiens
atcagctgctacattggcctct

SEQ ID NO: 7555347 - DNA, 19 bp, Homo sapiens
atcagctgaagccttcaga

SEQ ID NO: 7555348 - DNA, 22 bp, Homo sapiens
atcagctgctacattggcctct

SEQ ID NO: 7555349 - DNA, 22 bp, Homo sapiens
atcagctgatgaatggatgaat

SEQ ID NO: 7555350 - DNA, 22 bp, Homo sapiens
atcagctgatgaatggatgaat

SEQ ID NO: 7555351 - DNA, 22 bp, Homo sapiens
atcagcttaattctcaacaggt

SEQ ID NO: 7555352 - DNA, 22 bp, Homo sapiens
atcagctggaacaagtgtctga

SEQ ID NO: 7555353 - DNA, 20 bp, Homo sapiens
atcagctggagaacattatg

SEQ ID NO: 7555354 - DNA, 20 bp, Homo sapiens
atcagctggagaacattatg

SEQ ID NO: 7555355 - DNA, 22 bp, Homo sapiens
atcaggaaagagtggaactctg

SEQ ID NO: 7555356 - DNA, 22 bp, Homo sapiens
atcaggaaagagtggaactctg

SEQ ID NO: 7555357 - DNA, 22 bp, Homo sapiens
atcaggaaagagtggaactctg

SEQ ID NO: 7555358 - DNA, 22 bp, Homo sapiens
atcaggaaagagtggaactctg

SEQ ID NO: 7555359 - DNA, 22 bp, Homo sapiens
atcaggaaaaattgtgaaaggg

SEQ ID NO: 7555360 - DNA, 22 bp, Homo sapiens
atcaggaaagaaaagcttggcg

SEQ ID NO: 7555361 - DNA, 22 bp, Homo sapiens
atcaggaaagaaaagcttggcg

SEQ ID NO: 7555362 - DNA, 22 bp, Homo sapiens
atcaggaaagaaaagcttggcg

SEQ ID NO: 7555363 - DNA, 22 bp, Homo sapiens
atcaggaaagaaaagcttggcg

SEQ ID NO: 7555364 - DNA, 22 bp, Homo sapiens
atcaggaaaaattgtgaaaggg

SEQ ID NO: 7555365 - DNA, 22 bp, Homo sapiens
atcaggaaaaattgtgaaaggg

SEQ ID NO: 7555366 - DNA, 22 bp, Homo sapiens
atcagcttttctcatcagaaat

SEQ ID NO: 7555367 - DNA, 22 bp, Homo sapiens
atcagcttttctcatcagaaat

SEQ ID NO: 7555368 - DNA, 22 bp, Homo sapiens
atcagcttggaccaataagatg

SEQ ID NO: 7555369 - DNA, 22 bp, Homo sapiens
atcagcttggaccaataagatg

SEQ ID NO: 7555370 - DNA, 22 bp, Homo sapiens
atcaggtgatgctctggttccc

SEQ ID NO: 7555371 - DNA, 22 bp, Homo sapiens
atcagtttaactgtcaagagcc

SEQ ID NO: 7555372 - DNA, 22 bp, Homo sapiens
atcagtttaactgtcaagagcc

SEQ ID NO: 7555373 - DNA, 22 bp, Homo sapiens
atcagggtcttctttcagccta

SEQ ID NO: 7555374 - DNA, 22 bp, Homo sapiens
atcaggtagatttaatattctg

SEQ ID NO: 7555375 - DNA, 22 bp, Homo sapiens
ctgtctctgtcttaactcccag

SEQ ID NO: 7555376 - DNA, 22 bp, Homo sapiens
ctgtctctgataagctcgaggg

SEQ ID NO: 7555377 - DNA, 22 bp, Homo sapiens
ctgtctctgataagctcgaggg

SEQ ID NO: 7555378 - DNA, 22 bp, Homo sapiens
ctgtctctctaggacactgggg

SEQ ID NO: 7555379 - DNA, 22 bp, Homo sapiens
ctgtctctctaggacactgggg

SEQ ID NO: 7555380 - DNA, 22 bp, Homo sapiens
ctgtctctgataagctcgaggg

SEQ ID NO: 7555381 - DNA, 22 bp, Homo sapiens
ctgtctctgataagctcgaggg

SEQ ID NO: 7555382 - DNA, 22 bp, Homo sapiens
ctgtctctgataagctcgaggg

SEQ ID NO: 7555383 - DNA, 22 bp, Homo sapiens
ctgtctctgataagctcgaggg

SEQ ID NO: 7555384 - DNA, 22 bp, Homo sapiens
ctgtctctgataagctcgaggg

SEQ ID NO: 7555385 - DNA, 22 bp, Homo sapiens
ctgtctcctccactgcatggga

SEQ ID NO: 7555386 - DNA, 22 bp, Homo sapiens
ctgtctccgccctcttggtagg

SEQ ID NO: 7555387 - DNA, 22 bp, Homo sapiens
ctgtctcctccactgcatggga

SEQ ID NO: 7555388 - DNA, 22 bp, Homo sapiens
ctgtctcctccactgcatggga

SEQ ID NO: 7555389 - DNA, 22 bp, Homo sapiens
ctgtctcctccactgcatggga

SEQ ID NO: 7555390 - DNA, 22 bp, Homo sapiens
ctgtctcctccactgcatggga

SEQ ID NO: 7555391 - DNA, 22 bp, Homo sapiens
ctgtctccgccctcttggtagg

SEQ ID NO: 7555392 - DNA, 22 bp, Homo sapiens
ctgtctccgccctcttggtagg

SEQ ID NO: 7555393 - DNA, 22 bp, Homo sapiens
ctgtctccagggcaggtgcagg

SEQ ID NO: 7555394 - DNA, 22 bp, Homo sapiens
ctgtctcctccactgcatggga

SEQ ID NO: 7555395 - DNA, 22 bp, Homo sapiens
ctgtctcctccactgcatggga

SEQ ID NO: 7555396 - DNA, 22 bp, Homo sapiens
ctgtctcctccactgcatggga

SEQ ID NO: 7555397 - DNA, 22 bp, Homo sapiens
ctgtctcctcctttgttcttaa

SEQ ID NO: 7555398 - DNA, 22 bp, Homo sapiens
ctgtctcctcctttgttcttaa

SEQ ID NO: 7555399 - DNA, 22 bp, Homo sapiens
ctgtctcctcctttgttcttaa

SEQ ID NO: 7555400 - DNA, 23 bp, Homo sapiens
ctgtctcctgggctaggtggaat

SEQ ID NO: 7555401 - DNA, 23 bp, Homo sapiens
ctgtctcctgggctaggtggaat

SEQ ID NO: 7555402 - DNA, 22 bp, Homo sapiens
atcataaaattgcaccatttct

SEQ ID NO: 7555403 - DNA, 22 bp, Homo sapiens
atcataaaattgcaccatttct

SEQ ID NO: 7555404 - DNA, 22 bp, Homo sapiens
atcataaaattgcaccatttct

SEQ ID NO: 7555405 - DNA, 22 bp, Homo sapiens
atcataaaattgcaccatttct

SEQ ID NO: 7555406 - DNA, 22 bp, Homo sapiens
atcataaaattgcaccatttct

SEQ ID NO: 7555407 - DNA, 22 bp, Homo sapiens
atcataaaattgcaccatttct

SEQ ID NO: 7555408 - DNA, 22 bp, Homo sapiens
atcagtttttattaatgtagct

SEQ ID NO: 7555409 - DNA, 22 bp, Homo sapiens
atcagtttttattaatgtagct

SEQ ID NO: 7555410 - DNA, 22 bp, Homo sapiens
atcagttttgggggacatactg

SEQ ID NO: 7555411 - DNA, 22 bp, Homo sapiens
atcagttttgggggacatactg

SEQ ID NO: 7555412 - DNA, 22 bp, Homo sapiens
atcagtttttattaatgtagct

SEQ ID NO: 7555413 - DNA, 22 bp, Homo sapiens
atcagttttgttcactactata

SEQ ID NO: 7555414 - DNA, 22 bp, Homo sapiens
atcagttttgttcactactata

SEQ ID NO: 7555415 - DNA, 22 bp, Homo sapiens
atcagttttgttcactactata

SEQ ID NO: 7555416 - DNA, 22 bp, Homo sapiens
atcagttttgttcactactata

SEQ ID NO: 7555417 - DNA, 22 bp, Homo sapiens
atcagtttggtgctttcagtga

SEQ ID NO: 7555418 - DNA, 22 bp, Homo sapiens
atcagtttggtgctttcagtga

SEQ ID NO: 7555419 - DNA, 22 bp, Homo sapiens
atcagtttgtatatgaaacact

SEQ ID NO: 7555420 - DNA, 22 bp, Homo sapiens
atcagtttgtatatgaaacact

SEQ ID NO: 7555421 - DNA, 22 bp, Homo sapiens
atcagtttgtatatgaaacact

SEQ ID NO: 7555422 - DNA, 22 bp, Homo sapiens
atcagtttgtatatgaaacact

SEQ ID NO: 7555423 - DNA, 22 bp, Homo sapiens
atcagtttatacttataaatct

SEQ ID NO: 7555424 - DNA, 22 bp, Homo sapiens
atcagtttatacttataaatct

SEQ ID NO: 7555425 - DNA, 22 bp, Homo sapiens
atcagtttaactgtcaagagcc

SEQ ID NO: 7555426 - DNA, 22 bp, Homo sapiens
atcagtttatacttataaatct

SEQ ID NO: 7555427 - DNA, 22 bp, Homo sapiens
atcagtttatacttataaatct

SEQ ID NO: 7555428 - DNA, 22 bp, Homo sapiens
atcagtttcacttgcttgcaaa

SEQ ID NO: 7555429 - DNA, 22 bp, Homo sapiens
atcagtttctgtgaagaacaca

SEQ ID NO: 7555430 - DNA, 22 bp, Homo sapiens
atcagtttctgtgaagaacaca

SEQ ID NO: 7555431 - DNA, 22 bp, Homo sapiens
atcagtttgagtgctgtgtcaa

SEQ ID NO: 7555432 - DNA, 22 bp, Homo sapiens
atcagtttgataataaggcttg

SEQ ID NO: 7555433 - DNA, 22 bp, Homo sapiens
atcagtttggaacattcaggcc

SEQ ID NO: 7555434 - DNA, 22 bp, Homo sapiens
atcagtttctgtgaagaacaca

SEQ ID NO: 7555435 - DNA, 22 bp, Homo sapiens
atcagtttggtgctttcagtga

SEQ ID NO: 7555436 - DNA, 22 bp, Homo sapiens
atcagtttggtgctttcagtga

SEQ ID NO: 7555437 - DNA, 22 bp, Homo sapiens
atcagtttggaacattcaggcc

SEQ ID NO: 7555438 - DNA, 22 bp, Homo sapiens
atcagtttggaacattcaggcc

SEQ ID NO: 7555439 - DNA, 22 bp, Homo sapiens
atcataaaccactttgtaatct

SEQ ID NO: 7555440 - DNA, 22 bp, Homo sapiens
atcataaaccactttgtaatct

SEQ ID NO: 7555441 - DNA, 22 bp, Homo sapiens
atcataaaccactttgtaatct

SEQ ID NO: 7555442 - DNA, 22 bp, Homo sapiens
atcataaaccactttgtaatct

SEQ ID NO: 7555443 - DNA, 22 bp, Homo sapiens
atcataaaccactttgtaatct

SEQ ID NO: 7555444 - DNA, 22 bp, Homo sapiens
atcataaagtgctatctgattg

SEQ ID NO: 7555445 - DNA, 22 bp, Homo sapiens
atcataaaccactttgtaatct

SEQ ID NO: 7555446 - DNA, 22 bp, Homo sapiens
atcataaagtgctatctgattg

SEQ ID NO: 7555447 - DNA, 22 bp, Homo sapiens
atcataaagtgctatctgattg

SEQ ID NO: 7555448 - DNA, 22 bp, Homo sapiens
atcataaagtgctatctgattg

SEQ ID NO: 7555449 - DNA, 22 bp, Homo sapiens
atcataaagtgctatctgattg

SEQ ID NO: 7555450 - DNA, 22 bp, Homo sapiens
atcataaagtgctatctgattg

SEQ ID NO: 7555451 - DNA, 22 bp, Homo sapiens
atcataaagtgctatctgattg

SEQ ID NO: 7555452 - DNA, 22 bp, Homo sapiens
atcataaagtgctatctgattg

SEQ ID NO: 7555453 - DNA, 22 bp, Homo sapiens
atcataaagtgctatctgattg

SEQ ID NO: 7555454 - DNA, 22 bp, Homo sapiens
atcataactgtaattcatctac

SEQ ID NO: 7555455 - DNA, 22 bp, Homo sapiens
atcataagacccagccagtatt

SEQ ID NO: 7555456 - DNA, 22 bp, Homo sapiens
atcataaagtgctatctgattg

SEQ ID NO: 7555457 - DNA, 22 bp, Homo sapiens
atcataaagtgctatctgattg

SEQ ID NO: 7555458 - DNA, 22 bp, Homo sapiens
atcataaagtgctatctgattg

SEQ ID NO: 7555459 - DNA, 22 bp, Homo sapiens
atcatacactcacataaacaga

SEQ ID NO: 7555460 - DNA, 22 bp, Homo sapiens
atcatacactcacataaacaga

SEQ ID NO: 7555461 - DNA, 22 bp, Homo sapiens
atcatacactcacataaacaga

SEQ ID NO: 7555462 - DNA, 22 bp, Homo sapiens
atcatacactcacataaacaga

SEQ ID NO: 7555463 - DNA, 22 bp, Homo sapiens
atcatacactcacataaacaga

SEQ ID NO: 7555464 - DNA, 22 bp, Homo sapiens
atcatacactcacataaacaga

SEQ ID NO: 7555465 - DNA, 22 bp, Homo sapiens
atcataattgctccagtgatat

SEQ ID NO: 7555466 - DNA, 22 bp, Homo sapiens
atcataattgctccagtgatat

SEQ ID NO: 7555467 - DNA, 22 bp, Homo sapiens
atcatacactcacataaacaga

SEQ ID NO: 7555468 - DNA, 22 bp, Homo sapiens
atcatacactcacataaacaga

SEQ ID NO: 7555469 - DNA, 22 bp, Homo sapiens
atcatacactcacataaacaga

SEQ ID NO: 7555470 - DNA, 22 bp, Homo sapiens
atcataattgctccagtgatat

SEQ ID NO: 7555471 - DNA, 22 bp, Homo sapiens
cttccttgcggcccctgcctag

SEQ ID NO: 7555472 - DNA, 22 bp, Homo sapiens
cttccttgcggcccctgcctag

SEQ ID NO: 7555473 - DNA, 22 bp, Homo sapiens
cttccttgcggcccctgcctag

SEQ ID NO: 7555474 - DNA, 22 bp, Homo sapiens
cttccttgcggcccctgcctag

SEQ ID NO: 7555475 - DNA, 22 bp, Homo sapiens
cttccttgcggcccctgcctag

SEQ ID NO: 7555476 - DNA, 22 bp, Homo sapiens
cttccttgcggcccctgcctag

SEQ ID NO: 7555477 - DNA, 22 bp, Homo sapiens
cttccttctgtaagaccagttg

SEQ ID NO: 7555478 - DNA, 22 bp, Homo sapiens
cttccttctgtaagaccagttg

SEQ ID NO: 7555479 - DNA, 22 bp, Homo sapiens
cttccttctgtaagaccagttg

SEQ ID NO: 7555480 - DNA, 22 bp, Homo sapiens
cttccttctgaagcatagaagc

SEQ ID NO: 7555481 - DNA, 22 bp, Homo sapiens
cttccttgctgtctgctccagg

SEQ ID NO: 7555482 - DNA, 19 bp, Homo sapiens
cttccttgctccccatgtg

SEQ ID NO: 7555483 - DNA, 22 bp, Homo sapiens
cttccttgctgtctgctccagg

SEQ ID NO: 7555484 - DNA, 22 bp, Homo sapiens
cttccttgctgtctgctccagg

SEQ ID NO: 7555485 - DNA, 22 bp, Homo sapiens
cttccttgctgtctgctccagg

SEQ ID NO: 7555486 - DNA, 22 bp, Homo sapiens
cttccttgctgtctgctccagg

SEQ ID NO: 7555487 - DNA, 22 bp, Homo sapiens
cttccttgctgtctgctccagg

SEQ ID NO: 7555488 - DNA, 19 bp, Homo sapiens
cttccttgctccccatgtg

SEQ ID NO: 7555489 - DNA, 19 bp, Homo sapiens
cttccttgctccccatgtg

SEQ ID NO: 7555490 - DNA, 19 bp, Homo sapiens
cttccttgctccccatgtg

SEQ ID NO: 7555491 - DNA, 19 bp, Homo sapiens
cttccttgctccccatgtg

SEQ ID NO: 7555492 - DNA, 22 bp, Homo sapiens
cttccttctgaagcatagaagc

SEQ ID NO: 7555493 - DNA, 22 bp, Homo sapiens
cttccttctgaagcatagaagc

SEQ ID NO: 7555494 - DNA, 22 bp, Homo sapiens
cttccttctcactagcagcgcc

SEQ ID NO: 7555495 - DNA, 22 bp, Homo sapiens
cttccttccttccccgaaatgc

SEQ ID NO: 7555496 - DNA, 22 bp, Homo sapiens
cttccttccttccccgaaatgc

SEQ ID NO: 7555497 - DNA, 22 bp, Homo sapiens
cttccttccttccccgaaatgc

SEQ ID NO: 7555498 - DNA, 22 bp, Homo sapiens
cttccttctcactagcagcgcc

SEQ ID NO: 7555499 - DNA, 22 bp, Homo sapiens
cttccttccacaccttcagaat

SEQ ID NO: 7555500 - DNA, 22 bp, Homo sapiens
cttccttccacaccttcagaat

SEQ ID NO: 7555501 - DNA, 22 bp, Homo sapiens
cttccttccttccccgaaatgc

SEQ ID NO: 7555502 - DNA, 22 bp, Homo sapiens
cttcctctatgttcaggtagaa

SEQ ID NO: 7555503 - DNA, 22 bp, Homo sapiens
cttcctctcttgcccataagag

SEQ ID NO: 7555504 - DNA, 22 bp, Homo sapiens
cttcctctcttgcccataagag

SEQ ID NO: 7555505 - DNA, 22 bp, Homo sapiens
cttcctctcttgcccataagag

SEQ ID NO: 7555506 - DNA, 22 bp, Homo sapiens
cttcctctcaataagatgagaa

SEQ ID NO: 7555507 - DNA, 22 bp, Homo sapiens
cttcctctcaataagatgagaa

SEQ ID NO: 7555508 - DNA, 22 bp, Homo sapiens
cttcaagatatttctagaatca

SEQ ID NO: 7555509 - DNA, 22 bp, Homo sapiens
cttcaagatccatagatattgc

SEQ ID NO: 7555510 - DNA, 22 bp, Homo sapiens
cttcaagatccatagatattgc

SEQ ID NO: 7555511 - DNA, 22 bp, Homo sapiens
cttcaagatatttctagaatca

SEQ ID NO: 7555512 - DNA, 22 bp, Homo sapiens
cttcaagagaatgcagggatgt

SEQ ID NO: 7555513 - DNA, 22 bp, Homo sapiens
cttcaagagaatgcagggatgt

SEQ ID NO: 7555514 - DNA, 22 bp, Homo sapiens
cttcaagagaatgcagggatgt

SEQ ID NO: 7555515 - DNA, 22 bp, Homo sapiens
cttcaagtcgccaaatgctgaa

SEQ ID NO: 7555516 - DNA, 22 bp, Homo sapiens
cttcaagtcgccaaatgctgaa

SEQ ID NO: 7555517 - DNA, 22 bp, Homo sapiens
cttcaagtccagctcatgctct

SEQ ID NO: 7555518 - DNA, 22 bp, Homo sapiens
cttcaagtaattctgatggcta

SEQ ID NO: 7555519 - DNA, 22 bp, Homo sapiens
cttcaagtaattctgatggcta

SEQ ID NO: 7555520 - DNA, 22 bp, Homo sapiens
cttcaagtaattctgatggcta

SEQ ID NO: 7555521 - DNA, 22 bp, Homo sapiens
cttcaaggaagccacgttggga

SEQ ID NO: 7555522 - DNA, 22 bp, Homo sapiens
cttcaaggtggctaaatggggc

SEQ ID NO: 7555523 - DNA, 22 bp, Homo sapiens
cttcaatgaaattccatcagaa

SEQ ID NO: 7555524 - DNA, 22 bp, Homo sapiens
cttcaatgaaattccatcagaa

SEQ ID NO: 7555525 - DNA, 21 bp, Homo sapiens
cttcaattcaacactgccatg

SEQ ID NO: 7555526 - DNA, 21 bp, Homo sapiens
cttcaattcaacactgccatg

SEQ ID NO: 7555527 - DNA, 20 bp, Homo sapiens
cttcaagttatggttggcaa

SEQ ID NO: 7555528 - DNA, 22 bp, Homo sapiens
cttcaatacctgcgttgctagt

SEQ ID NO: 7555529 - DNA, 22 bp, Homo sapiens
cttcaatacctgcgttgctagt

SEQ ID NO: 7555530 - DNA, 22 bp, Homo sapiens
cttcaataggaactgcatggca

SEQ ID NO: 7555531 - DNA, 22 bp, Homo sapiens
cttcaataggaactgcatggca

SEQ ID NO: 7555532 - DNA, 22 bp, Homo sapiens
cttcaattgccaccagctagca

SEQ ID NO: 7555533 - DNA, 22 bp, Homo sapiens
cttcaattgccaccagctagca

SEQ ID NO: 7555534 - DNA, 22 bp, Homo sapiens
cttcaatttaaatggaagccac

SEQ ID NO: 7555535 - DNA, 22 bp, Homo sapiens
cttcaatttaaatggaagccac

SEQ ID NO: 7555536 - DNA, 22 bp, Homo sapiens
cttcaatttttggtatgatgga

SEQ ID NO: 7555537 - DNA, 22 bp, Homo sapiens
cttcaatttttggtatgatgga

SEQ ID NO: 7555538 - DNA, 22 bp, Homo sapiens
cttcacaaatggcctagagttc

SEQ ID NO: 7555539 - DNA, 22 bp, Homo sapiens
cttcacaacgacatctggttag

SEQ ID NO: 7555540 - DNA, 22 bp, Homo sapiens
cttcctctatgttcaggtagaa

SEQ ID NO: 7555541 - DNA, 22 bp, Homo sapiens
cttcctctatgttcaggtagaa

SEQ ID NO: 7555542 - DNA, 22 bp, Homo sapiens
cttcacaaagctctctttatgt

SEQ ID NO: 7555543 - DNA, 22 bp, Homo sapiens
cttcacaaaatatttcattata

SEQ ID NO: 7555544 - DNA, 22 bp, Homo sapiens
cttattcagaaggagaaatgga

SEQ ID NO: 7555545 - DNA, 22 bp, Homo sapiens
cttattcagaaggagaaatgga

SEQ ID NO: 7555546 - DNA, 21 bp, Homo sapiens
cttattcactgttatttatca

SEQ ID NO: 7555547 - DNA, 21 bp, Homo sapiens
cttattcactgttatttatca

SEQ ID NO: 7555548 - DNA, 22 bp, Homo sapiens
cttattcagaccttggattctt

SEQ ID NO: 7555549 - DNA, 22 bp, Homo sapiens
cttattcagaaggagaaatgga

SEQ ID NO: 7555550 - DNA, 22 bp, Homo sapiens
cttattcagatacagactcttg

SEQ ID NO: 7555551 - DNA, 22 bp, Homo sapiens
cttattcagatacagactcttg

SEQ ID NO: 7555552 - DNA, 22 bp, Homo sapiens
cttattcagcaagtttgggtac

SEQ ID NO: 7555553 - DNA, 22 bp, Homo sapiens
cttattcataagtcagacacac

SEQ ID NO: 7555554 - DNA, 22 bp, Homo sapiens
cttattcagcacttgctctgta

SEQ ID NO: 7555555 - DNA, 22 bp, Homo sapiens
cttattcagcacttgctctgta

SEQ ID NO: 7555556 - DNA, 22 bp, Homo sapiens
cttattcagcacttgctctgta

SEQ ID NO: 7555557 - DNA, 22 bp, Homo sapiens
cttcaacagttttagaacactg

SEQ ID NO: 7555558 - DNA, 22 bp, Homo sapiens
cttcaacagttttagaacactg

SEQ ID NO: 7555559 - DNA, 22 bp, Homo sapiens
cttcaacatacacagagagagg

SEQ ID NO: 7555560 - DNA, 22 bp, Homo sapiens
cttcaactgggcttcgatgtgg

SEQ ID NO: 7555561 - DNA, 22 bp, Homo sapiens
cttcaagaagacagcagagcat

SEQ ID NO: 7555562 - DNA, 22 bp, Homo sapiens
cttcaactttgtaagtagaatt

SEQ ID NO: 7555563 - DNA, 22 bp, Homo sapiens
cttcaacttccctagatgtcat

SEQ ID NO: 7555564 - DNA, 22 bp, Homo sapiens
cttcaacttccctagatgtcat

SEQ ID NO: 7555565 - DNA, 23 bp, Homo sapiens
cttattcattcatgtagcccatt

SEQ ID NO: 7555566 - DNA, 22 bp, Homo sapiens
cttattcataagtcagacacac

SEQ ID NO: 7555567 - DNA, 22 bp, Homo sapiens
cttattcatatattctcggtag

SEQ ID NO: 7555568 - DNA, 22 bp, Homo sapiens
cttcaaatgtgattttaataac

SEQ ID NO: 7555569 - DNA, 22 bp, Homo sapiens
cttcaaatgtgattttaataac

SEQ ID NO: 7555570 - DNA, 22 bp, Homo sapiens
cttcaaattcgaggagtagatg

SEQ ID NO: 7555571 - DNA, 22 bp, Homo sapiens
cttatgaagaccctacctccag

SEQ ID NO: 7555572 - DNA, 22 bp, Homo sapiens
cttatctgtaaaatggatacaa

SEQ ID NO: 7555573 - DNA, 22 bp, Homo sapiens
cttatgatctagaactaggtat

SEQ ID NO: 7555574 - DNA, 22 bp, Homo sapiens
cttatcttacttccccttcatg

SEQ ID NO: 7555575 - DNA, 22 bp, Homo sapiens
cttatggaagaaacctcagaga

SEQ ID NO: 7555576 - DNA, 22 bp, Homo sapiens
cttatgtaaaacggaaagggaa

SEQ ID NO: 7555577 - DNA, 22 bp, Homo sapiens
cttatgctgagaatgaaagaat

SEQ ID NO: 7555578 - DNA, 19 bp, Homo sapiens
cttatgcagctgagcttgg

SEQ ID NO: 7555579 - DNA, 22 bp, Homo sapiens
cttatgctgagaatgaaagaat

SEQ ID NO: 7555580 - DNA, 22 bp, Homo sapiens
cttatgtacacacatatattgt

SEQ ID NO: 7555581 - DNA, 22 bp, Homo sapiens
cttatgtacacacatatattgt

SEQ ID NO: 7555582 - DNA, 22 bp, Homo sapiens
cttatgtacacacatatattgt

SEQ ID NO: 7555583 - DNA, 22 bp, Homo sapiens
cttatgtaaaacggaaagggaa

SEQ ID NO: 7555584 - DNA, 22 bp, Homo sapiens
cttatgtaaactacagataata

SEQ ID NO: 7555585 - DNA, 22 bp, Homo sapiens
cttatgtaaactacagataata

SEQ ID NO: 7555586 - DNA, 22 bp, Homo sapiens
cttatgtaaactacagataata

SEQ ID NO: 7555587 - DNA, 22 bp, Homo sapiens
cttatgtataatgttccacata

SEQ ID NO: 7555588 - DNA, 22 bp, Homo sapiens
cttatgtacacacatatattgt

SEQ ID NO: 7555589 - DNA, 22 bp, Homo sapiens
cttatgtataatgttccacata

SEQ ID NO: 7555590 - DNA, 22 bp, Homo sapiens
cttatgtataatgttccacata

SEQ ID NO: 7555591 - DNA, 22 bp, Homo sapiens
cttatgtataatgttccacata

SEQ ID NO: 7555592 - DNA, 22 bp, Homo sapiens
cttatgtataatgttccacata

SEQ ID NO: 7555593 - DNA, 22 bp, Homo sapiens
cttatgtatatttggaacgtac

SEQ ID NO: 7555594 - DNA, 22 bp, Homo sapiens
cttatgtatatttggaacgtac

SEQ ID NO: 7555595 - DNA, 22 bp, Homo sapiens
cttattcaatgctggaaatgtt

SEQ ID NO: 7555596 - DNA, 22 bp, Homo sapiens
cttattatggcatgtaagtggg

SEQ ID NO: 7555597 - DNA, 22 bp, Homo sapiens
cttattcaatgctggaaatgtt

SEQ ID NO: 7555598 - DNA, 22 bp, Homo sapiens
cttattataaaatcctgtttga

SEQ ID NO: 7555599 - DNA, 22 bp, Homo sapiens
cttattataaaatcctgtttga

SEQ ID NO: 7555600 - DNA, 22 bp, Homo sapiens
cttattatggcatgtaagtggg

SEQ ID NO: 7555601 - DNA, 19 bp, Homo sapiens
cttattagagtgagagctt

SEQ ID NO: 7555602 - DNA, 22 bp, Homo sapiens
cttattagagttgtgttctgtt

SEQ ID NO: 7555603 - DNA, 22 bp, Homo sapiens
cttattagtgtctgtctgagtt

SEQ ID NO: 7555604 - DNA, 22 bp, Homo sapiens
cttattataaaatcctgtttga

SEQ ID NO: 7555605 - DNA, 22 bp, Homo sapiens
cttattagaaagaaaagacatg

SEQ ID NO: 7555606 - DNA, 22 bp, Homo sapiens
cttattagaaagaaaagacatg

SEQ ID NO: 7555607 - DNA, 22 bp, Homo sapiens
cttatgtatgctactttgtggt

SEQ ID NO: 7555608 - DNA, 22 bp, Homo sapiens
cttatgtatgctactttgtggt

SEQ ID NO: 7555609 - DNA, 22 bp, Homo sapiens
cttattaatggaatcctaatga

SEQ ID NO: 7555610 - DNA, 22 bp, Homo sapiens
cttattaatggaatcctaatga

SEQ ID NO: 7555611 - DNA, 22 bp, Homo sapiens
cttattaatggaatcctaatga

SEQ ID NO: 7555612 - DNA, 23 bp, Homo sapiens
atccatgtgagaatagactagca

SEQ ID NO: 7555613 - DNA, 22 bp, Homo sapiens
atccatggaggacaagagcaat

SEQ ID NO: 7555614 - DNA, 22 bp, Homo sapiens
atccatgattgcccagaggtgt

SEQ ID NO: 7555615 - DNA, 22 bp, Homo sapiens
atccattattgggccaataaag

SEQ ID NO: 7555616 - DNA, 20 bp, Homo sapiens
atccatgagagtctggattc

SEQ ID NO: 7555617 - DNA, 22 bp, Homo sapiens
atccatgattagtaggataaag

SEQ ID NO: 7555618 - DNA, 22 bp, Homo sapiens
atccatgattgcccagaggtgt

SEQ ID NO: 7555619 - DNA, 23 bp, Homo sapiens
atccatgcttaagtaatcatttg

SEQ ID NO: 7555620 - DNA, 23 bp, Homo sapiens
atccatgcttaagtaatcatttg

SEQ ID NO: 7555621 - DNA, 22 bp, Homo sapiens
atccatgattgcccagaggtgt

SEQ ID NO: 7555622 - DNA, 22 bp, Homo sapiens
atccattgtcttgttggcttct

SEQ ID NO: 7555623 - DNA, 22 bp, Homo sapiens
atccattgtggtcttgtacatt

SEQ ID NO: 7555624 - DNA, 22 bp, Homo sapiens
atccattgtcttgttggcttct

SEQ ID NO: 7555625 - DNA, 23 bp, Homo sapiens
atccatgtgagaatagactagca

SEQ ID NO: 7555626 - DNA, 23 bp, Homo sapiens
atccatgtgagaatagactagca

SEQ ID NO: 7555627 - DNA, 22 bp, Homo sapiens
atccattatctatcaacaggga

SEQ ID NO: 7555628 - DNA, 22 bp, Homo sapiens
atccattctatgtgaaatgtcc

SEQ ID NO: 7555629 - DNA, 21 bp, Homo sapiens
atccattctccggttaatgag

SEQ ID NO: 7555630 - DNA, 22 bp, Homo sapiens
atccatttcctccactataaag

SEQ ID NO: 7555631 - DNA, 22 bp, Homo sapiens
atccatttcagtgttccacttg

SEQ ID NO: 7555632 - DNA, 22 bp, Homo sapiens
atccatttaattgaggggaagg

SEQ ID NO: 7555633 - DNA, 22 bp, Homo sapiens
atccattgtggtcttgtacatt

SEQ ID NO: 7555634 - DNA, 22 bp, Homo sapiens
atccattctatgtgaaatgtcc

SEQ ID NO: 7555635 - DNA, 18 bp, Homo sapiens
atccatttaatgcctgga

SEQ ID NO: 7555636 - DNA, 18 bp, Homo sapiens
atccatttaatgcctgga

SEQ ID NO: 7555637 - DNA, 22 bp, Homo sapiens
cttagcaagaatcagctgctgg

SEQ ID NO: 7555638 - DNA, 22 bp, Homo sapiens
cttagcaagcattcaagtgcct

SEQ ID NO: 7555639 - DNA, 22 bp, Homo sapiens
cttatctgagaaagatgctaca

SEQ ID NO: 7555640 - DNA, 22 bp, Homo sapiens
cttagattttcaatgtgaacta

SEQ ID NO: 7555641 - DNA, 22 bp, Homo sapiens
cttagatgaagtcacagaaccc

SEQ ID NO: 7555642 - DNA, 22 bp, Homo sapiens
cttagatgaagtcacagaaccc

SEQ ID NO: 7555643 - DNA, 22 bp, Homo sapiens
cttagatgaagtcacagaaccc

SEQ ID NO: 7555644 - DNA, 22 bp, Homo sapiens
atccatttgacataatttcagc

SEQ ID NO: 7555645 - DNA, 22 bp, Homo sapiens
atccatttgaaagaacagtcca

SEQ ID NO: 7555646 - DNA, 22 bp, Homo sapiens
atccatttgacataatttcagc

SEQ ID NO: 7555647 - DNA, 22 bp, Homo sapiens
atccatttgacataatttcagc

SEQ ID NO: 7555648 - DNA, 22 bp, Homo sapiens
atccatttcctccactataaag

SEQ ID NO: 7555649 - DNA, 22 bp, Homo sapiens
atccatttcctccactataaag

SEQ ID NO: 7555650 - DNA, 22 bp, Homo sapiens
atccatttctatcttgctgagg

SEQ ID NO: 7555651 - DNA, 22 bp, Homo sapiens
atccatttctatcttgctgagg

SEQ ID NO: 7555652 - DNA, 22 bp, Homo sapiens
cttaatctcacctgcaaagtcc

SEQ ID NO: 7555653 - DNA, 22 bp, Homo sapiens
cttaatctcacctgcaaagtcc

SEQ ID NO: 7555654 - DNA, 22 bp, Homo sapiens
cttaatctcacctgcaaagtcc

SEQ ID NO: 7555655 - DNA, 22 bp, Homo sapiens
cttaatctcacctgcaaagtcc

SEQ ID NO: 7555656 - DNA, 22 bp, Homo sapiens
cttaatctcacctgcaaagtcc

SEQ ID NO: 7555657 - DNA, 22 bp, Homo sapiens
cttaatgaaaggttgcacatgg

SEQ ID NO: 7555658 - DNA, 22 bp, Homo sapiens
cttaatgaaaggttgcacatgg

SEQ ID NO: 7555659 - DNA, 22 bp, Homo sapiens
cttaatgaaaggttgcacatgg

SEQ ID NO: 7555660 - DNA, 22 bp, Homo sapiens
cttaatgaatgctgctgtattt

SEQ ID NO: 7555661 - DNA, 16 bp, Homo sapiens
cttaagtgctgaaagg

SEQ ID NO: 7555662 - DNA, 22 bp, Homo sapiens
cttaaggagtagtggtgatggc

SEQ ID NO: 7555663 - DNA, 22 bp, Homo sapiens
cttaaggcttcagcacaggtat

SEQ ID NO: 7555664 - DNA, 22 bp, Homo sapiens
cttaataaatggtagctgttat

SEQ ID NO: 7555665 - DNA, 22 bp, Homo sapiens
cttaataaatggtagctgttat

SEQ ID NO: 7555666 - DNA, 22 bp, Homo sapiens
cttaataaatggtagctgttat

SEQ ID NO: 7555667 - DNA, 22 bp, Homo sapiens
cttaataataggtgaggctatg

SEQ ID NO: 7555668 - DNA, 22 bp, Homo sapiens
cttaataaatggtagctgttat

SEQ ID NO: 7555669 - DNA, 22 bp, Homo sapiens
cttaataaatggtagctgttat

SEQ ID NO: 7555670 - DNA, 22 bp, Homo sapiens
cttaataataggtgaggctatg

SEQ ID NO: 7555671 - DNA, 20 bp, Homo sapiens
atccatcatgtccatgactt

SEQ ID NO: 7555672 - DNA, 20 bp, Homo sapiens
atccatcatgtccatgactt

SEQ ID NO: 7555673 - DNA, 22 bp, Homo sapiens
atccatcatttcaccgccacta

SEQ ID NO: 7555674 - DNA, 22 bp, Homo sapiens
atccatcatttcaccgccacta

SEQ ID NO: 7555675 - DNA, 22 bp, Homo sapiens
atccatccacgtaacatgtatt

SEQ ID NO: 7555676 - DNA, 21 bp, Homo sapiens
atccatccatcttggcctaac

SEQ ID NO: 7555677 - DNA, 21 bp, Homo sapiens
atccatccatcttggcctaac

SEQ ID NO: 7555678 - DNA, 22 bp, Homo sapiens
atccatcccatcttcaccaggg

SEQ ID NO: 7555679 - DNA, 22 bp, Homo sapiens
atccatccactgatgtttctga

SEQ ID NO: 7555680 - DNA, 21 bp, Homo sapiens
atccatccatcttggcctaac

SEQ ID NO: 7555681 - DNA, 22 bp, Homo sapiens
atccatcctaatgtgagtacca

SEQ ID NO: 7555682 - DNA, 22 bp, Homo sapiens
atccatctttcctgctgaactg

SEQ ID NO: 7555683 - DNA, 22 bp, Homo sapiens
atccatctttcctgctgaactg

SEQ ID NO: 7555684 - DNA, 22 bp, Homo sapiens
atccatcctgccatctgagtag

SEQ ID NO: 7555685 - DNA, 22 bp, Homo sapiens
atccatgaccctctcaacaacc

SEQ ID NO: 7555686 - DNA, 22 bp, Homo sapiens
atccatgaaggtacttctcagg

SEQ ID NO: 7555687 - DNA, 22 bp, Homo sapiens
atccatgaccctctcaacaacc

SEQ ID NO: 7555688 - DNA, 22 bp, Homo sapiens
atccatgaccctctcaacaacc

SEQ ID NO: 7555689 - DNA, 22 bp, Homo sapiens
atccatgaaggtacttctcagg

SEQ ID NO: 7555690 - DNA, 22 bp, Homo sapiens
atccatgatcaatttattacta

SEQ ID NO: 7555691 - DNA, 22 bp, Homo sapiens
atccatgatcaatttattacta

SEQ ID NO: 7555692 - DNA, 22 bp, Homo sapiens
atcatacatgtaactaagtaaa

SEQ ID NO: 7555693 - DNA, 22 bp, Homo sapiens
atcatacatgtaactaagtaaa

SEQ ID NO: 7555694 - DNA, 19 bp, Homo sapiens
atcatacatgttacactct

SEQ ID NO: 7555695 - DNA, 19 bp, Homo sapiens
atcatacatgttacactct

SEQ ID NO: 7555696 - DNA, 22 bp, Homo sapiens
atcatacatgtaactaagtaaa

SEQ ID NO: 7555697 - DNA, 22 bp, Homo sapiens
atcatacatgtaactaagtaaa

SEQ ID NO: 7555698 - DNA, 19 bp, Homo sapiens
atcatacatgttacactct

SEQ ID NO: 7555699 - DNA, 22 bp, Homo sapiens
atcatacagcctttgttagtgt

SEQ ID NO: 7555700 - DNA, 22 bp, Homo sapiens
atcatacagcctttgttagtgt

SEQ ID NO: 7555701 - DNA, 22 bp, Homo sapiens
atcatacatgtaactaagtaaa

SEQ ID NO: 7555702 - DNA, 22 bp, Homo sapiens
atcatacatgtaactaagtaaa

SEQ ID NO: 7555703 - DNA, 22 bp, Homo sapiens
atcatacatgtaactaagtaaa

SEQ ID NO: 7555704 - DNA, 22 bp, Homo sapiens
atcatacatacatggtcctcag

SEQ ID NO: 7555705 - DNA, 22 bp, Homo sapiens
atcatacatacatggtcctcag

SEQ ID NO: 7555706 - DNA, 22 bp, Homo sapiens
atcatacagaacctgagcactt

SEQ ID NO: 7555707 - DNA, 22 bp, Homo sapiens
atcatacactcacataaacaga

SEQ ID NO: 7555708 - DNA, 22 bp, Homo sapiens
atcatacagaacctgagcactt

SEQ ID NO: 7555709 - DNA, 22 bp, Homo sapiens
atcatacagaacctgagcactt

SEQ ID NO: 7555710 - DNA, 22 bp, Homo sapiens
atcatacagaacctgagcactt

SEQ ID NO: 7555711 - DNA, 22 bp, Homo sapiens
cttaacaaacagtgtggatata

SEQ ID NO: 7555712 - DNA, 22 bp, Homo sapiens
cttaacaagcccaactttcatt

SEQ ID NO: 7555713 - DNA, 22 bp, Homo sapiens
cttaacaagcccaactttcatt

SEQ ID NO: 7555714 - DNA, 22 bp, Homo sapiens
cttaaattttcatctacaagaa

SEQ ID NO: 7555715 - DNA, 22 bp, Homo sapiens
ctgtttctcccatgtccaagtg

SEQ ID NO: 7555716 - DNA, 22 bp, Homo sapiens
ctgtttctccacactcttccca

SEQ ID NO: 7555717 - DNA, 22 bp, Homo sapiens
atcataggtgtgttaccagtta

SEQ ID NO: 7555718 - DNA, 22 bp, Homo sapiens
atcataggtataagtaaattag

SEQ ID NO: 7555719 - DNA, 23 bp, Homo sapiens
atcataggccctagagagaaggc

SEQ ID NO: 7555720 - DNA, 22 bp, Homo sapiens
atcataggatttaggtccatct

SEQ ID NO: 7555721 - DNA, 22 bp, Homo sapiens
ctgtttctccacactcttccca

SEQ ID NO: 7555722 - DNA, 22 bp, Homo sapiens
atcatcatcattgctaacatct

SEQ ID NO: 7555723 - DNA, 22 bp, Homo sapiens
atcatcatcaacaagaaacatt

SEQ ID NO: 7555724 - DNA, 22 bp, Homo sapiens
atcatcagggacatttctgtgc

SEQ ID NO: 7555725 - DNA, 22 bp, Homo sapiens
atcatcatcaacaagaaacatt

SEQ ID NO: 7555726 - DNA, 22 bp, Homo sapiens
atcatcatcaacaagaaacatt

SEQ ID NO: 7555727 - DNA, 22 bp, Homo sapiens
cttaagaagcaagtctcagcaa

SEQ ID NO: 7555728 - DNA, 22 bp, Homo sapiens
cttaagaagcaagtctcagcaa

SEQ ID NO: 7555729 - DNA, 22 bp, Homo sapiens
cttaagaaattgcattctaatc

SEQ ID NO: 7555730 - DNA, 22 bp, Homo sapiens
cttaagaaattgcattctaatc

SEQ ID NO: 7555731 - DNA, 22 bp, Homo sapiens
cttaagaagcaagtctcagcaa

SEQ ID NO: 7555732 - DNA, 22 bp, Homo sapiens
cttaagaagcaagtctcagcaa

SEQ ID NO: 7555733 - DNA, 22 bp, Homo sapiens
cttaagaatattgaagttgtgg

SEQ ID NO: 7555734 - DNA, 22 bp, Homo sapiens
cttaagaatattgaagttgtgg

SEQ ID NO: 7555735 - DNA, 22 bp, Homo sapiens
cttaagaatattgaagttgtgg

SEQ ID NO: 7555736 - DNA, 22 bp, Homo sapiens
cttaagaatattgaagttgtgg

SEQ ID NO: 7555737 - DNA, 22 bp, Homo sapiens
cttaagagtctttctgtgttta

SEQ ID NO: 7555738 - DNA, 22 bp, Homo sapiens
cttaagagtctttctgtgttta

SEQ ID NO: 7555739 - DNA, 22 bp, Homo sapiens
cttaaggaaaagtctcttttaa

SEQ ID NO: 7555740 - DNA, 22 bp, Homo sapiens
cttaaggaaaagtctcttttaa

SEQ ID NO: 7555741 - DNA, 22 bp, Homo sapiens
cttaagcaaaatattctttcac

SEQ ID NO: 7555742 - DNA, 22 bp, Homo sapiens
cttaagattgtcagcttcagcc

SEQ ID NO: 7555743 - DNA, 21 bp, Homo sapiens
cttaacattttaaatgaaagg

SEQ ID NO: 7555744 - DNA, 21 bp, Homo sapiens
cttaacattttaaatgaaagg

SEQ ID NO: 7555745 - DNA, 21 bp, Homo sapiens
cttaacattttaaatgaaagg

SEQ ID NO: 7555746 - DNA, 21 bp, Homo sapiens
cttaacattttaaatgaaagg

SEQ ID NO: 7555747 - DNA, 22 bp, Homo sapiens
cttaagaaattgcattctaatc

SEQ ID NO: 7555748 - DNA, 22 bp, Homo sapiens
cttaagaaattgcattctaatc

SEQ ID NO: 7555749 - DNA, 22 bp, Homo sapiens
cttaagaaattgcattctaatc

SEQ ID NO: 7555750 - DNA, 22 bp, Homo sapiens
cttaacttgatgtctctctgct

SEQ ID NO: 7555751 - DNA, 22 bp, Homo sapiens
cttaacttgatgtctctctgct

SEQ ID NO: 7555752 - DNA, 22 bp, Homo sapiens
cttaacatcctgcatttttctt

SEQ ID NO: 7555753 - DNA, 22 bp, Homo sapiens
cttaacagcaagatctgtgtca

SEQ ID NO: 7555754 - DNA, 22 bp, Homo sapiens
cttaacagagagaagtgttgct

SEQ ID NO: 7555755 - DNA, 22 bp, Homo sapiens
cttaacagatacatctgtggtt

SEQ ID NO: 7555756 - DNA, 20 bp, Homo sapiens
cttaacacttctttgccagt

SEQ ID NO: 7555757 - DNA, 20 bp, Homo sapiens
cttaacaatggctctgatga

SEQ ID NO: 7555758 - DNA, 20 bp, Homo sapiens
cttaacaatggctctgatga

SEQ ID NO: 7555759 - DNA, 22 bp, Homo sapiens
cttcttaaagattacacaatga

SEQ ID NO: 7555760 - DNA, 22 bp, Homo sapiens
cttcttaaagattacacaatga

SEQ ID NO: 7555761 - DNA, 22 bp, Homo sapiens
cttctgttactgttagctgaag

SEQ ID NO: 7555762 - DNA, 22 bp, Homo sapiens
cttctgttactgttagctgaag

SEQ ID NO: 7555763 - DNA, 22 bp, Homo sapiens
cttcttaaatatttggctgact

SEQ ID NO: 7555764 - DNA, 22 bp, Homo sapiens
cttcttaaatatttggctgact

SEQ ID NO: 7555765 - DNA, 22 bp, Homo sapiens
cttcttaaagttgtcacagctg

SEQ ID NO: 7555766 - DNA, 22 bp, Homo sapiens
cttcttaactgtatatactatg

SEQ ID NO: 7555767 - DNA, 22 bp, Homo sapiens
cttcttaactgtatatactatg

SEQ ID NO: 7555768 - DNA, 22 bp, Homo sapiens
cttcttaatcccttatatattt

SEQ ID NO: 7555769 - DNA, 22 bp, Homo sapiens
cttcttaaattggattgctatt

SEQ ID NO: 7555770 - DNA, 22 bp, Homo sapiens
cttcttaactgtatatactatg

SEQ ID NO: 7555771 - DNA, 22 bp, Homo sapiens
cttcttaaattggattgctatt

SEQ ID NO: 7555772 - DNA, 22 bp, Homo sapiens
atctggctcgctaggctctggg

SEQ ID NO: 7555773 - DNA, 22 bp, Homo sapiens
atctggctcgctaggctctggg

SEQ ID NO: 7555774 - DNA, 22 bp, Homo sapiens
atctggctcctacacttgaaga

SEQ ID NO: 7555775 - DNA, 22 bp, Homo sapiens
atctggctcattcagggaacgg

SEQ ID NO: 7555776 - DNA, 22 bp, Homo sapiens
cttcttaatgacagattaaaat

SEQ ID NO: 7555777 - DNA, 22 bp, Homo sapiens
atctggctcacttagtctagga

SEQ ID NO: 7555778 - DNA, 22 bp, Homo sapiens
cttcttaatgacagattaaaat

SEQ ID NO: 7555779 - DNA, 22 bp, Homo sapiens
cttcttaatgacagattaaaat

SEQ ID NO: 7555780 - DNA, 22 bp, Homo sapiens
cttcttaatcccttatatattt

SEQ ID NO: 7555781 - DNA, 22 bp, Homo sapiens
atctggctctctcatttacaaa

SEQ ID NO: 7555782 - DNA, 22 bp, Homo sapiens
atctggctctctcatttacaaa

SEQ ID NO: 7555783 - DNA, 22 bp, Homo sapiens
atctgggtttcaaagaagcctt

SEQ ID NO: 7555784 - DNA, 22 bp, Homo sapiens
atctggctcttcctggagttcc

SEQ ID NO: 7555785 - DNA, 22 bp, Homo sapiens
atctggttcttcttaggcatca

SEQ ID NO: 7555786 - DNA, 22 bp, Homo sapiens
atctggtgctaacaaatgtgga

SEQ ID NO: 7555787 - DNA, 22 bp, Homo sapiens
atctgtatatttttcaatgcaa

SEQ ID NO: 7555788 - DNA, 22 bp, Homo sapiens
atctgtacaagattttatgcgt

SEQ ID NO: 7555789 - DNA, 22 bp, Homo sapiens
atctgtagaagatactctgaga

SEQ ID NO: 7555790 - DNA, 22 bp, Homo sapiens
atctgtactaattaattaatgt

SEQ ID NO: 7555791 - DNA, 22 bp, Homo sapiens
atctgtaattttgaatgcaaat

SEQ ID NO: 7555792 - DNA, 22 bp, Homo sapiens
atctgtaattttgaatgcaaat

SEQ ID NO: 7555793 - DNA, 22 bp, Homo sapiens
atctgtaattttgaatgcaaat

SEQ ID NO: 7555794 - DNA, 22 bp, Homo sapiens
atctgtaattttgaatgcaaat

SEQ ID NO: 7555795 - DNA, 22 bp, Homo sapiens
atctgtaattttgaatgcaaat

SEQ ID NO: 7555796 - DNA, 22 bp, Homo sapiens
atctgtaactgctatcatctcc

SEQ ID NO: 7555797 - DNA, 22 bp, Homo sapiens
atctgtccctcctcacagcctc

SEQ ID NO: 7555798 - DNA, 22 bp, Homo sapiens
atctgtccaccttcccatttac

SEQ ID NO: 7555799 - DNA, 22 bp, Homo sapiens
atctgtccagtcatctcgggat

SEQ ID NO: 7555800 - DNA, 22 bp, Homo sapiens
atctgtccaccttcccatttac

SEQ ID NO: 7555801 - DNA, 22 bp, Homo sapiens
atctgtcaggagcaaggactac

SEQ ID NO: 7555802 - DNA, 22 bp, Homo sapiens
atctgtcaagatagactctgca

SEQ ID NO: 7555803 - DNA, 22 bp, Homo sapiens
atctgtcaagatagactctgca

SEQ ID NO: 7555804 - DNA, 22 bp, Homo sapiens
atctgtcaggagcaaggactac

SEQ ID NO: 7555805 - DNA, 22 bp, Homo sapiens
atctgtaacacacagaggagaa

SEQ ID NO: 7555806 - DNA, 22 bp, Homo sapiens
atctgtaaatgcaaatgtagct

SEQ ID NO: 7555807 - DNA, 22 bp, Homo sapiens
atctgtaaataaaaagggaggt

SEQ ID NO: 7555808 - DNA, 22 bp, Homo sapiens
atctgtaaagataatcatatgt

SEQ ID NO: 7555809 - DNA, 22 bp, Homo sapiens
atctgtaactgctatcatctcc

SEQ ID NO: 7555810 - DNA, 22 bp, Homo sapiens
atctgtaacatcagtagcagaa

SEQ ID NO: 7555811 - DNA, 22 bp, Homo sapiens
atctgtaacacacagaggagaa

SEQ ID NO: 7555812 - DNA, 22 bp, Homo sapiens
atctgtaacatcagtagcagaa

SEQ ID NO: 7555813 - DNA, 22 bp, Homo sapiens
atctggttctttgtatttcctt

SEQ ID NO: 7555814 - DNA, 22 bp, Homo sapiens
atctggttcttcttaggcatca

SEQ ID NO: 7555815 - DNA, 22 bp, Homo sapiens
atctggttcttcttaggcatca

SEQ ID NO: 7555816 - DNA, 22 bp, Homo sapiens
atctggttcttcttaggcatca

SEQ ID NO: 7555817 - DNA, 22 bp, Homo sapiens
atctggttttggctgtgtccct

SEQ ID NO: 7555818 - DNA, 22 bp, Homo sapiens
atctgtaaagataatcatatgt

SEQ ID NO: 7555819 - DNA, 22 bp, Homo sapiens
atctggttttggctgtgtccct

SEQ ID NO: 7555820 - DNA, 22 bp, Homo sapiens
atctgtctggaggcctggcatg

SEQ ID NO: 7555821 - DNA, 22 bp, Homo sapiens
atctgtctgagtgcttaggacc

SEQ ID NO: 7555822 - DNA, 22 bp, Homo sapiens
atctgtctggaggcctggcatg

SEQ ID NO: 7555823 - DNA, 22 bp, Homo sapiens
atctgtctggaggcctggcatg

SEQ ID NO: 7555824 - DNA, 22 bp, Homo sapiens
atctgtctgggtgcagcagtcc

SEQ ID NO: 7555825 - DNA, 22 bp, Homo sapiens
atctgtctgggtgcagcagtcc

SEQ ID NO: 7555826 - DNA, 22 bp, Homo sapiens
atctgtctgggtgcagcagtcc

SEQ ID NO: 7555827 - DNA, 22 bp, Homo sapiens
atctgtctatgatatagtctgt

SEQ ID NO: 7555828 - DNA, 22 bp, Homo sapiens
atctgtctatgatatagtctgt

SEQ ID NO: 7555829 - DNA, 22 bp, Homo sapiens
atctgtctatgtggctatgtat

SEQ ID NO: 7555830 - DNA, 22 bp, Homo sapiens
atctgtctatgtggctatgtat

SEQ ID NO: 7555831 - DNA, 22 bp, Homo sapiens
atctgtctgagtgcttaggacc

SEQ ID NO: 7555832 - DNA, 22 bp, Homo sapiens
atctgtctgagtgcttaggacc

SEQ ID NO: 7555833 - DNA, 22 bp, Homo sapiens
atctgtcctctgtctggaggct

SEQ ID NO: 7555834 - DNA, 22 bp, Homo sapiens
atctgtcctctgtctggaggct

SEQ ID NO: 7555835 - DNA, 22 bp, Homo sapiens
atctgtcctctctacctttgac

SEQ ID NO: 7555836 - DNA, 22 bp, Homo sapiens
atctgtcctctctacctttgac

SEQ ID NO: 7555837 - DNA, 22 bp, Homo sapiens
atctgtccctggtccaagattt

SEQ ID NO: 7555838 - DNA, 22 bp, Homo sapiens
atctgtccctggtccaagattt

SEQ ID NO: 7555839 - DNA, 22 bp, Homo sapiens
atctgtcctaaatatacctaca

SEQ ID NO: 7555840 - DNA, 22 bp, Homo sapiens
atctgtcctaaatatacctaca

SEQ ID NO: 7555841 - DNA, 22 bp, Homo sapiens
atctgtcctccagcatctccat

SEQ ID NO: 7555842 - DNA, 22 bp, Homo sapiens
atctgtcctggagctaggcttc

SEQ ID NO: 7555843 - DNA, 22 bp, Homo sapiens
atctgtcctggagctaggcttc

SEQ ID NO: 7555844 - DNA, 22 bp, Homo sapiens
atctgtcctgtgacagtgggag

SEQ ID NO: 7555845 - DNA, 22 bp, Homo sapiens
atctgtcctgtgacagtgggag

SEQ ID NO: 7555846 - DNA, 18 bp, Homo sapiens
atctgtcctttctctgcc

SEQ ID NO: 7555847 - DNA, 18 bp, Homo sapiens
atctgtcctttctctgcc

SEQ ID NO: 7555848 - DNA, 22 bp, Homo sapiens
atctgtcttttattcatgagct

SEQ ID NO: 7555849 - DNA, 22 bp, Homo sapiens
atctgtcttttattcatgagct

SEQ ID NO: 7555850 - DNA, 22 bp, Homo sapiens
atctgtcttttaatgttaatgc

SEQ ID NO: 7555851 - DNA, 22 bp, Homo sapiens
atctgtcttttattcatgagct

SEQ ID NO: 7555852 - DNA, 22 bp, Homo sapiens
atctgtgagtatttttgtttat

SEQ ID NO: 7555853 - DNA, 22 bp, Homo sapiens
atctgtggatatgaccttcctg

SEQ ID NO: 7555854 - DNA, 22 bp, Homo sapiens
atctgtggatatgcacagagca

SEQ ID NO: 7555855 - DNA, 22 bp, Homo sapiens
atctgtgatcaagacagacagt

SEQ ID NO: 7555856 - DNA, 22 bp, Homo sapiens
atctgtgatcaagacagacagt

SEQ ID NO: 7555857 - DNA, 22 bp, Homo sapiens
atctgtgagtatttttgtttat

SEQ ID NO: 7555858 - DNA, 22 bp, Homo sapiens
atctgtgagtatttttgtttat

SEQ ID NO: 7555859 - DNA, 22 bp, Homo sapiens
atctgtggaaaggtaaccagta

SEQ ID NO: 7555860 - DNA, 22 bp, Homo sapiens
atctgtcttccaccacacatcc

SEQ ID NO: 7555861 - DNA, 22 bp, Homo sapiens
atctgtcttccaccacacatcc

SEQ ID NO: 7555862 - DNA, 22 bp, Homo sapiens
atctgtcttccaccacacatcc

SEQ ID NO: 7555863 - DNA, 22 bp, Homo sapiens
atctgtcttgccttgcatattt

SEQ ID NO: 7555864 - DNA, 22 bp, Homo sapiens
atctgtcttgccttgcatattt

SEQ ID NO: 7555865 - DNA, 22 bp, Homo sapiens
atcttatttaacacagcaaaac

SEQ ID NO: 7555866 - DNA, 22 bp, Homo sapiens
atcttatttaacacagcaaaac

SEQ ID NO: 7555867 - DNA, 22 bp, Homo sapiens
atctgttcttcaaaatattaca

SEQ ID NO: 7555868 - DNA, 22 bp, Homo sapiens
atctgttcttgtgtcagtaatt

SEQ ID NO: 7555869 - DNA, 22 bp, Homo sapiens
atctgttcttgtgtcagtaatt

SEQ ID NO: 7555870 - DNA, 22 bp, Homo sapiens
atcttatttaacacagcaaaac

SEQ ID NO: 7555871 - DNA, 22 bp, Homo sapiens
atcttcaaagaatttcttgtcc

SEQ ID NO: 7555872 - DNA, 22 bp, Homo sapiens
atcttcaaagaatttcttgtcc

SEQ ID NO: 7555873 - DNA, 23 bp, Homo sapiens
atctgttcatctgacacagattc

SEQ ID NO: 7555874 - DNA, 22 bp, Homo sapiens
atctgttcccctatgctctcta

SEQ ID NO: 7555875 - DNA, 22 bp, Homo sapiens
atctgttatttacccatctctg

SEQ ID NO: 7555876 - DNA, 22 bp, Homo sapiens
atctgtgtgttgagttctcagc

SEQ ID NO: 7555877 - DNA, 22 bp, Homo sapiens
atctgttatttacccatctctg

SEQ ID NO: 7555878 - DNA, 22 bp, Homo sapiens
atctgtgtgttattgtttatca

SEQ ID NO: 7555879 - DNA, 23 bp, Homo sapiens
atctgtgtgtgggtagggatgat

SEQ ID NO: 7555880 - DNA, 22 bp, Homo sapiens
atctgtgtgttcaggaagtcct

SEQ ID NO: 7555881 - DNA, 23 bp, Homo sapiens
atctgtgtgtgggtagggatgat

SEQ ID NO: 7555882 - DNA, 22 bp, Homo sapiens
atctgtgtccttataagagaca

SEQ ID NO: 7555883 - DNA, 22 bp, Homo sapiens
atctgtgtatgtgaccttatct

SEQ ID NO: 7555884 - DNA, 22 bp, Homo sapiens
atctgtgtatgtgaccttatct

SEQ ID NO: 7555885 - DNA, 22 bp, Homo sapiens
atctgtggctggtgagaggcag

SEQ ID NO: 7555886 - DNA, 22 bp, Homo sapiens
atctgtggtcaaaatagaaact

SEQ ID NO: 7555887 - DNA, 22 bp, Homo sapiens
atctgtggctggtgagaggcag

SEQ ID NO: 7555888 - DNA, 22 bp, Homo sapiens
atctgtggcgcaaacaaaggct

SEQ ID NO: 7555889 - DNA, 22 bp, Homo sapiens
atctgtggcgcaaacaaaggct

SEQ ID NO: 7555890 - DNA, 22 bp, Homo sapiens
atctgtggcagtgatgagtctt

SEQ ID NO: 7555891 - DNA, 22 bp, Homo sapiens
atctgtggcagtgatgagtctt

SEQ ID NO: 7555892 - DNA, 22 bp, Homo sapiens
atctgtggccaaaagactgttg

SEQ ID NO: 7555893 - DNA, 19 bp, Homo sapiens
cttctgcagggtgacagtg

SEQ ID NO: 7555894 - DNA, 19 bp, Homo sapiens
cttctgcagggtgacagtg

SEQ ID NO: 7555895 - DNA, 19 bp, Homo sapiens
cttctgcagggtgacagtg

SEQ ID NO: 7555896 - DNA, 22 bp, Homo sapiens
cttctgcccctgtagcctgagt

SEQ ID NO: 7555897 - DNA, 22 bp, Homo sapiens
cttctgcccctgtagcctgagt

SEQ ID NO: 7555898 - DNA, 22 bp, Homo sapiens
cttctgctgccgcctcggcaca

SEQ ID NO: 7555899 - DNA, 22 bp, Homo sapiens
cttctgtgatttggttaggata

SEQ ID NO: 7555900 - DNA, 22 bp, Homo sapiens
cttctgtgcaattgtggaggag

SEQ ID NO: 7555901 - DNA, 23 bp, Homo sapiens
cttctgtgcaagagggagggaaa

SEQ ID NO: 7555902 - DNA, 23 bp, Homo sapiens
cttctgtgcaagagggagggaaa

SEQ ID NO: 7555903 - DNA, 22 bp, Homo sapiens
cttctgtgcaattgtggaggag

SEQ ID NO: 7555904 - DNA, 22 bp, Homo sapiens
cttctgtgctaaatgcaaaacc

SEQ ID NO: 7555905 - DNA, 22 bp, Homo sapiens
cttctgtgttaaatgagtcttt

SEQ ID NO: 7555906 - DNA, 22 bp, Homo sapiens
cttctgtgtagaaaggtagccc

SEQ ID NO: 7555907 - DNA, 22 bp, Homo sapiens
cttctgtgtagaaaggtagccc

SEQ ID NO: 7555908 - DNA, 22 bp, Homo sapiens
cttctgtgtagaaaggtagccc

SEQ ID NO: 7555909 - DNA, 22 bp, Homo sapiens
cttctgttactgttagctgaag

SEQ ID NO: 7555910 - DNA, 22 bp, Homo sapiens
cttctgtgttttactatatgta

SEQ ID NO: 7555911 - DNA, 22 bp, Homo sapiens
cttctgttactgttagctgaag

SEQ ID NO: 7555912 - DNA, 22 bp, Homo sapiens
cttctgtgttttactatatgta

SEQ ID NO: 7555913 - DNA, 22 bp, Homo sapiens
cttctgtgttttactatatgta

SEQ ID NO: 7555914 - DNA, 22 bp, Homo sapiens
cttctgtgttttactatatgta

SEQ ID NO: 7555915 - DNA, 22 bp, Homo sapiens
cttctgtggtaaactttgttgt

SEQ ID NO: 7555916 - DNA, 22 bp, Homo sapiens
cttctgtggatgttggatgcat

SEQ ID NO: 7555917 - DNA, 22 bp, Homo sapiens
cttctgtgcttcacagttgcca

SEQ ID NO: 7555918 - DNA, 22 bp, Homo sapiens
cttctgtgcttcacagttgcca

SEQ ID NO: 7555919 - DNA, 22 bp, Homo sapiens
cttctgtgcttcacagttgcca

SEQ ID NO: 7555920 - DNA, 22 bp, Homo sapiens
cttctgtggatatgttctctct

SEQ ID NO: 7555921 - DNA, 22 bp, Homo sapiens
cttctgtggatatgttctctct

SEQ ID NO: 7555922 - DNA, 22 bp, Homo sapiens
cttctgtggatgttggatgcat

SEQ ID NO: 7555923 - DNA, 22 bp, Homo sapiens
cttctgcagaattaattcacta

SEQ ID NO: 7555924 - DNA, 22 bp, Homo sapiens
cttctgcaggccctgtctgacc

SEQ ID NO: 7555925 - DNA, 19 bp, Homo sapiens
cttctgcagggtgacagtg

SEQ ID NO: 7555926 - DNA, 22 bp, Homo sapiens
cttctgcaggccttattttagt

SEQ ID NO: 7555927 - DNA, 22 bp, Homo sapiens
cttctgcaggagtcaactctgg

SEQ ID NO: 7555928 - DNA, 22 bp, Homo sapiens
cttctgcaggccctgtctgacc

SEQ ID NO: 7555929 - DNA, 22 bp, Homo sapiens
cttctgattagcaagtttgtat

SEQ ID NO: 7555930 - DNA, 22 bp, Homo sapiens
cttctgcaagagcatcagttgt

SEQ ID NO: 7555931 - DNA, 22 bp, Homo sapiens
cttctgattagcaagtttgtat

SEQ ID NO: 7555932 - DNA, 22 bp, Homo sapiens
cttctgcaagagcatcagttgt

SEQ ID NO: 7555933 - DNA, 22 bp, Homo sapiens
cttctgcaataagttttggtcc

SEQ ID NO: 7555934 - DNA, 22 bp, Homo sapiens
cttctgcactgaccttttgtcc

SEQ ID NO: 7555935 - DNA, 22 bp, Homo sapiens
cttctgcaataagttttggtcc

SEQ ID NO: 7555936 - DNA, 22 bp, Homo sapiens
cttctgcactgaccttttgtcc

SEQ ID NO: 7555937 - DNA, 22 bp, Homo sapiens
cttctgagatgttgttttacag

SEQ ID NO: 7555938 - DNA, 22 bp, Homo sapiens
cttctgagatgttgttttacag

SEQ ID NO: 7555939 - DNA, 22 bp, Homo sapiens
cttctgagatgttgttttacag

SEQ ID NO: 7555940 - DNA, 22 bp, Homo sapiens
cttctgagatgttgttttacag

SEQ ID NO: 7555941 - DNA, 22 bp, Homo sapiens
cttctgagcagacctcctgggg

SEQ ID NO: 7555942 - DNA, 22 bp, Homo sapiens
cttctgagcagacctcctgggg

SEQ ID NO: 7555943 - DNA, 22 bp, Homo sapiens
cttctgagggcctttgcttcca

SEQ ID NO: 7555944 - DNA, 22 bp, Homo sapiens
cttctgagggcctttgcttcca

SEQ ID NO: 7555945 - DNA, 22 bp, Homo sapiens
cttctgagttaacagtagattt

SEQ ID NO: 7555946 - DNA, 22 bp, Homo sapiens
cttctgagttaacagtagattt

SEQ ID NO: 7555947 - DNA, 22 bp, Homo sapiens
cttctgatctggattcctaact

SEQ ID NO: 7555948 - DNA, 22 bp, Homo sapiens
cttctgagcagacctcctgggg

SEQ ID NO: 7555949 - DNA, 22 bp, Homo sapiens
cttctgaggactctaaagagga

SEQ ID NO: 7555950 - DNA, 22 bp, Homo sapiens
cttctgaggactctaaagagga

SEQ ID NO: 7555951 - DNA, 22 bp, Homo sapiens
cttctgaggcagctattcagtt

SEQ ID NO: 7555952 - DNA, 22 bp, Homo sapiens
cttctgaggcagctattcagtt

SEQ ID NO: 7555953 - DNA, 22 bp, Homo sapiens
cttctgaggactctaaagagga

SEQ ID NO: 7555954 - DNA, 22 bp, Homo sapiens
cttctgaggcagctattcagtt

SEQ ID NO: 7555955 - DNA, 22 bp, Homo sapiens
cttctgacccctggtctacagc

SEQ ID NO: 7555956 - DNA, 22 bp, Homo sapiens
cttctgactctgtttttgagca

SEQ ID NO: 7555957 - DNA, 22 bp, Homo sapiens
cttctgacttgagaccagttag

SEQ ID NO: 7555958 - DNA, 22 bp, Homo sapiens
cttctgagaggggctaggagca

SEQ ID NO: 7555959 - DNA, 22 bp, Homo sapiens
cttctgagaggggctaggagca

SEQ ID NO: 7555960 - DNA, 22 bp, Homo sapiens
cttctgagatgttgttttacag

SEQ ID NO: 7555961 - DNA, 22 bp, Homo sapiens
cttctgagatgttgttttacag

SEQ ID NO: 7555962 - DNA, 22 bp, Homo sapiens
cttctgagatgttgttttacag

SEQ ID NO: 7555963 - DNA, 22 bp, Homo sapiens
cttctgagatgttgttttacag

SEQ ID NO: 7555964 - DNA, 22 bp, Homo sapiens
cttctgagatgttgttttacag

SEQ ID NO: 7555965 - DNA, 22 bp, Homo sapiens
cttctgagatgttgttttacag

SEQ ID NO: 7555966 - DNA, 22 bp, Homo sapiens
cttctccttatatgtcccgttc

SEQ ID NO: 7555967 - DNA, 22 bp, Homo sapiens
cttctccttatatgtcccgttc

SEQ ID NO: 7555968 - DNA, 22 bp, Homo sapiens
cttctccttatatgtcccgttc

SEQ ID NO: 7555969 - DNA, 22 bp, Homo sapiens
cttctcggccgtgtggatgcgc

SEQ ID NO: 7555970 - DNA, 22 bp, Homo sapiens
atctctgaaggctccaggagag

SEQ ID NO: 7555971 - DNA, 23 bp, Homo sapiens
atctctctttattcttggggata

SEQ ID NO: 7555972 - DNA, 22 bp, Homo sapiens
atctctgatttacagcatctct

SEQ ID NO: 7555973 - DNA, 22 bp, Homo sapiens
atctctccttcagctgaggccc

SEQ ID NO: 7555974 - DNA, 22 bp, Homo sapiens
atctctccttcagctgaggccc

SEQ ID NO: 7555975 - DNA, 17 bp, Homo sapiens
atctctctaaggcaggc

SEQ ID NO: 7555976 - DNA, 22 bp, Homo sapiens
atctctccttcagctgaggccc

SEQ ID NO: 7555977 - DNA, 22 bp, Homo sapiens
atctctagtcttctccatggga

SEQ ID NO: 7555978 - DNA, 22 bp, Homo sapiens
atctctccttatgaagcattat

SEQ ID NO: 7555979 - DNA, 22 bp, Homo sapiens
atctctctatgcactgaggact

SEQ ID NO: 7555980 - DNA, 22 bp, Homo sapiens
atctctctatgcactgaggact

SEQ ID NO: 7555981 - DNA, 15 bp, Homo sapiens
atctctctagctgct

SEQ ID NO: 7555982 - DNA, 22 bp, Homo sapiens
atctctctgcccaggggctgtg

SEQ ID NO: 7555983 - DNA, 23 bp, Homo sapiens
atctctctggtggtcacagtcag

SEQ ID NO: 7555984 - DNA, 23 bp, Homo sapiens
atctctctggtggtcacagtcag

SEQ ID NO: 7555985 - DNA, 23 bp, Homo sapiens
atctctctggtggtcacagtcag

SEQ ID NO: 7555986 - DNA, 22 bp, Homo sapiens
cttccttgtggtccttctcatt

SEQ ID NO: 7555987 - DNA, 22 bp, Homo sapiens
cttccttggcttctggggtgtg

SEQ ID NO: 7555988 - DNA, 22 bp, Homo sapiens
cttccttgtggtccttctcatt

SEQ ID NO: 7555989 - DNA, 22 bp, Homo sapiens
cttccttgtggtccttctcatt

SEQ ID NO: 7555990 - DNA, 22 bp, Homo sapiens
cttccttgtggtccttctcatt

SEQ ID NO: 7555991 - DNA, 22 bp, Homo sapiens
cttccttggcttctggggtgtg

SEQ ID NO: 7555992 - DNA, 22 bp, Homo sapiens
cttccttggcttctggggtgtg

SEQ ID NO: 7555993 - DNA, 22 bp, Homo sapiens
cttcctttcagaggaaggcctg

SEQ ID NO: 7555994 - DNA, 22 bp, Homo sapiens
cttcctttcagaggaaggcctg

SEQ ID NO: 7555995 - DNA, 22 bp, Homo sapiens
cttcctttcagaggaaggcctg

SEQ ID NO: 7555996 - DNA, 22 bp, Homo sapiens
cttccttgtggtccttctcatt

SEQ ID NO: 7555997 - DNA, 22 bp, Homo sapiens
cttccttgtggtccttctcatt

SEQ ID NO: 7555998 - DNA, 18 bp, Homo sapiens
atctcccattggccaagg

SEQ ID NO: 7555999 - DNA, 22 bp, Homo sapiens
atctccccgagcttacctcctg

SEQ ID NO: 7556000 - DNA, 22 bp, Homo sapiens
atctccccgagcttacctcctg

SEQ ID NO: 7556001 - DNA, 22 bp, Homo sapiens
atctccccgagcttacctcctg

SEQ ID NO: 7556002 - DNA, 21 bp, Homo sapiens
atctccccttccttgtaggtg

SEQ ID NO: 7556003 - DNA, 21 bp, Homo sapiens
atctccccttccttgtaggtg

SEQ ID NO: 7556004 - DNA, 22 bp, Homo sapiens
atctctaaagtctgttcagctc

SEQ ID NO: 7556005 - DNA, 22 bp, Homo sapiens
atctctaatcaccagctctagc

SEQ ID NO: 7556006 - DNA, 22 bp, Homo sapiens
atctcgttttgagaactgtgtt

SEQ ID NO: 7556007 - DNA, 22 bp, Homo sapiens
atctctaatcaccagctctagc

SEQ ID NO: 7556008 - DNA, 22 bp, Homo sapiens
atctctaatttaaaaagtaaca

SEQ ID NO: 7556009 - DNA, 19 bp, Homo sapiens
atctcctttcttcaagctt

SEQ ID NO: 7556010 - DNA, 19 bp, Homo sapiens
atctcctttcttcaagctt

SEQ ID NO: 7556011 - DNA, 22 bp, Homo sapiens
atctcctggtccacccgggcgg

SEQ ID NO: 7556012 - DNA, 22 bp, Homo sapiens
atctccttggatcacgtttagt

SEQ ID NO: 7556013 - DNA, 23 bp, Homo sapiens
atctcctgagaacccacagtggt

SEQ ID NO: 7556014 - DNA, 20 bp, Homo sapiens
atctcctgctaccacccatt

SEQ ID NO: 7556015 - DNA, 20 bp, Homo sapiens
atctcctgctaccacccatt

SEQ ID NO: 7556016 - DNA, 23 bp, Homo sapiens
atctcctgagaacccacagtggt

SEQ ID NO: 7556017 - DNA, 22 bp, Homo sapiens
atctcctcccgcgccgagctcg

SEQ ID NO: 7556018 - DNA, 22 bp, Homo sapiens
atctcctcgcaggccagaacac

SEQ ID NO: 7556019 - DNA, 23 bp, Homo sapiens
atctcctgagaacccacagtggt

SEQ ID NO: 7556020 - DNA, 23 bp, Homo sapiens
atctcctgagaacccacagtggt

SEQ ID NO: 7556021 - DNA, 22 bp, Homo sapiens
atctcctcccgcgccgagctcg

SEQ ID NO: 7556022 - DNA, 22 bp, Homo sapiens
atctcctaaaagaagacagggc

SEQ ID NO: 7556023 - DNA, 22 bp, Homo sapiens
atctccgccatcgcgaacgcct

SEQ ID NO: 7556024 - DNA, 22 bp, Homo sapiens
ataaactggtaggaaaacagta

SEQ ID NO: 7556025 - DNA, 22 bp, Homo sapiens
ataaactggtaggaaaacagta

SEQ ID NO: 7556026 - DNA, 23 bp, Homo sapiens
ataaactgtcaaaagccagccct

SEQ ID NO: 7556027 - DNA, 22 bp, Homo sapiens
ataaactggtaggaaaacagta

SEQ ID NO: 7556028 - DNA, 22 bp, Homo sapiens
ataaactggtaggaaaacagta

SEQ ID NO: 7556029 - DNA, 22 bp, Homo sapiens
ataaactgggtatcaagaggcc

SEQ ID NO: 7556030 - DNA, 22 bp, Homo sapiens
ataaactgtgctggatgatgag

SEQ ID NO: 7556031 - DNA, 22 bp, Homo sapiens
ataaacttgagtctcagagtat

SEQ ID NO: 7556032 - DNA, 22 bp, Homo sapiens
ataaacttgagtctcagagtat

SEQ ID NO: 7556033 - DNA, 22 bp, Homo sapiens
ataaacttgagtctcagagtat

SEQ ID NO: 7556034 - DNA, 22 bp, Homo sapiens
ataaacttgagtctcagagtat

SEQ ID NO: 7556035 - DNA, 21 bp, Homo sapiens
ataaagacaaacactatttgg

SEQ ID NO: 7556036 - DNA, 22 bp, Homo sapiens
ataaactttagcggaaggagga

SEQ ID NO: 7556037 - DNA, 22 bp, Homo sapiens
ataaactttagcggaaggagga

SEQ ID NO: 7556038 - DNA, 21 bp, Homo sapiens
ataaagacaaacactatttgg

SEQ ID NO: 7556039 - DNA, 22 bp, Homo sapiens
ataaagaccagtatcttatgtt

SEQ ID NO: 7556040 - DNA, 22 bp, Homo sapiens
ataaagacatgcttacttgccc

SEQ ID NO: 7556041 - DNA, 22 bp, Homo sapiens
ataaagacatgcttacttgccc

SEQ ID NO: 7556042 - DNA, 22 bp, Homo sapiens
ataaacttgagtctcagagtat

SEQ ID NO: 7556043 - DNA, 22 bp, Homo sapiens
ataaacttgagtctcagagtat

SEQ ID NO: 7556044 - DNA, 22 bp, Homo sapiens
ataaagatttctttttctctac

SEQ ID NO: 7556045 - DNA, 22 bp, Homo sapiens
ataaagatttctttttctctac

SEQ ID NO: 7556046 - DNA, 22 bp, Homo sapiens
ataaagatttctttttctctac

SEQ ID NO: 7556047 - DNA, 22 bp, Homo sapiens
ataaagatttctttttctctac

SEQ ID NO: 7556048 - DNA, 22 bp, Homo sapiens
ataaagatttctttttctctac

SEQ ID NO: 7556049 - DNA, 22 bp, Homo sapiens
ataaagcaaataggactattgc

SEQ ID NO: 7556050 - DNA, 22 bp, Homo sapiens
ataaagatttttaggcatttct

SEQ ID NO: 7556051 - DNA, 22 bp, Homo sapiens
ataaagatttttaggcatttct

SEQ ID NO: 7556052 - DNA, 22 bp, Homo sapiens
ataaagaggatgtatttacagc

SEQ ID NO: 7556053 - DNA, 22 bp, Homo sapiens
ataaagaggatgtatttacagc

SEQ ID NO: 7556054 - DNA, 22 bp, Homo sapiens
ataaagaccagtatcttatgtt

SEQ ID NO: 7556055 - DNA, 22 bp, Homo sapiens
ataaagaccagtatcttatgtt

SEQ ID NO: 7556056 - DNA, 22 bp, Homo sapiens
ataaagaccagtatcttatgtt

SEQ ID NO: 7556057 - DNA, 22 bp, Homo sapiens
ataaagaggatgtatttacagc

SEQ ID NO: 7556058 - DNA, 22 bp, Homo sapiens
ataaagaggatgtatttacagc

SEQ ID NO: 7556059 - DNA, 22 bp, Homo sapiens
ataaagatttctttttctctac

SEQ ID NO: 7556060 - DNA, 22 bp, Homo sapiens
ataaagatttctttttctctac

SEQ ID NO: 7556061 - DNA, 22 bp, Homo sapiens
ataaagatagaatgctttcctg

SEQ ID NO: 7556062 - DNA, 22 bp, Homo sapiens
ataaagaggatgtatttacagc

SEQ ID NO: 7556063 - DNA, 22 bp, Homo sapiens
ataaagaggatgtatttacagc

SEQ ID NO: 7556064 - DNA, 22 bp, Homo sapiens
ataaagaggatgtatttacagc

SEQ ID NO: 7556065 - DNA, 22 bp, Homo sapiens
ataaagctatttttaattctgt

SEQ ID NO: 7556066 - DNA, 22 bp, Homo sapiens
ataaagctatttttaattctgt

SEQ ID NO: 7556067 - DNA, 22 bp, Homo sapiens
ataaagctattcctctcttttt

SEQ ID NO: 7556068 - DNA, 22 bp, Homo sapiens
ataaagctattcctctcttttt

SEQ ID NO: 7556069 - DNA, 22 bp, Homo sapiens
ataaagctattcctctcttttt

SEQ ID NO: 7556070 - DNA, 22 bp, Homo sapiens
ataaagctaagacttacatgaa

SEQ ID NO: 7556071 - DNA, 22 bp, Homo sapiens
ataaagctaagacttacatgaa

SEQ ID NO: 7556072 - DNA, 22 bp, Homo sapiens
ataaagctaagacttacatgaa

SEQ ID NO: 7556073 - DNA, 22 bp, Homo sapiens
ataaagctaagacttacatgaa

SEQ ID NO: 7556074 - DNA, 22 bp, Homo sapiens
ataaagctaagacttacatgaa

SEQ ID NO: 7556075 - DNA, 22 bp, Homo sapiens
ataaagcatctagtctgtcact

SEQ ID NO: 7556076 - DNA, 22 bp, Homo sapiens
ataaagcatactttgtatgact

SEQ ID NO: 7556077 - DNA, 22 bp, Homo sapiens
ataaagcatactttgtatgact

SEQ ID NO: 7556078 - DNA, 22 bp, Homo sapiens
ataaagcatactttgtatgact

SEQ ID NO: 7556079 - DNA, 22 bp, Homo sapiens
ataaagcatgcttgtttggaga

SEQ ID NO: 7556080 - DNA, 22 bp, Homo sapiens
ataaagcatgcttgtttggaga

SEQ ID NO: 7556081 - DNA, 22 bp, Homo sapiens
ataaagcatgcttgtttggaga

SEQ ID NO: 7556082 - DNA, 22 bp, Homo sapiens
ataaagcatctagtctgtcact

SEQ ID NO: 7556083 - DNA, 22 bp, Homo sapiens
ataaagcatctagtctgtcact

SEQ ID NO: 7556084 - DNA, 22 bp, Homo sapiens
ataaagcaggtccccagacact

SEQ ID NO: 7556085 - DNA, 22 bp, Homo sapiens
ataaagcatactttgtatgact

SEQ ID NO: 7556086 - DNA, 22 bp, Homo sapiens
ataaagcaatagattgtgtaat

SEQ ID NO: 7556087 - DNA, 22 bp, Homo sapiens
ataaagcaatagattgtgtaat

SEQ ID NO: 7556088 - DNA, 22 bp, Homo sapiens
ataaagcaatagattgtgtaat

SEQ ID NO: 7556089 - DNA, 22 bp, Homo sapiens
ataaagcaatagattgtgtaat

SEQ ID NO: 7556090 - DNA, 22 bp, Homo sapiens
ataaagcaaataggactattgc

SEQ ID NO: 7556091 - DNA, 22 bp, Homo sapiens
ataaagcaagcataccattaag

SEQ ID NO: 7556092 - DNA, 22 bp, Homo sapiens
ataaagcaagcataccattaag

SEQ ID NO: 7556093 - DNA, 22 bp, Homo sapiens
ataaagcaagcataccattaag

SEQ ID NO: 7556094 - DNA, 22 bp, Homo sapiens
ataaagcaagcataccattaag

SEQ ID NO: 7556095 - DNA, 22 bp, Homo sapiens
ataaagcaaataggactattgc

SEQ ID NO: 7556096 - DNA, 22 bp, Homo sapiens
ataaagcaaataggactattgc

SEQ ID NO: 7556097 - DNA, 22 bp, Homo sapiens
ataaactcatgctgaaaaccca

SEQ ID NO: 7556098 - DNA, 22 bp, Homo sapiens
ataaactcatgccaagaaatga

SEQ ID NO: 7556099 - DNA, 22 bp, Homo sapiens
ataaaccagaagtaaaagctac

SEQ ID NO: 7556100 - DNA, 22 bp, Homo sapiens
ataaacatctgtttctcttctg

SEQ ID NO: 7556101 - DNA, 22 bp, Homo sapiens
ataaaccagaagtaaaagctac

SEQ ID NO: 7556102 - DNA, 22 bp, Homo sapiens
ataaaccagaagtaaaagctac

SEQ ID NO: 7556103 - DNA, 22 bp, Homo sapiens
ataaaccagaagtaaaagctac

SEQ ID NO: 7556104 - DNA, 22 bp, Homo sapiens
ataaacctatgctaagctgtgg

SEQ ID NO: 7556105 - DNA, 22 bp, Homo sapiens
ataaactgaagggaacactgag

SEQ ID NO: 7556106 - DNA, 22 bp, Homo sapiens
ataaactgggtatcaagaggcc

SEQ ID NO: 7556107 - DNA, 22 bp, Homo sapiens
ataaactgggtatcaagaggcc

SEQ ID NO: 7556108 - DNA, 21 bp, Homo sapiens
ataaactgcatcaagttggtg

SEQ ID NO: 7556109 - DNA, 21 bp, Homo sapiens
ataaactgcatcaagttggtg

SEQ ID NO: 7556110 - DNA, 22 bp, Homo sapiens
ataaactgaagggaacactgag

SEQ ID NO: 7556111 - DNA, 22 bp, Homo sapiens
ataaactgaagggaacactgag

SEQ ID NO: 7556112 - DNA, 22 bp, Homo sapiens
ataaactgaagggaacactgag

SEQ ID NO: 7556113 - DNA, 22 bp, Homo sapiens
ataaactctattttgaggagat

SEQ ID NO: 7556114 - DNA, 22 bp, Homo sapiens
ataaactctgcctcagaagagc

SEQ ID NO: 7556115 - DNA, 22 bp, Homo sapiens
ataaactctgcctcagaagagc

SEQ ID NO: 7556116 - DNA, 22 bp, Homo sapiens
ataaaatcaactggctccagtt

SEQ ID NO: 7556117 - DNA, 22 bp, Homo sapiens
ataaaatcaactggctccagtt

SEQ ID NO: 7556118 - DNA, 22 bp, Homo sapiens
ataaaatcagagttggattgga

SEQ ID NO: 7556119 - DNA, 22 bp, Homo sapiens
ataaaatcagagttggattgga

SEQ ID NO: 7556120 - DNA, 22 bp, Homo sapiens
ataaaatcagagttggattgga

SEQ ID NO: 7556121 - DNA, 22 bp, Homo sapiens
ataaaatctttatgtgctctgc

SEQ ID NO: 7556122 - DNA, 22 bp, Homo sapiens
ataaaatctttatgtgctctgc

SEQ ID NO: 7556123 - DNA, 22 bp, Homo sapiens
ataaacatctgtttctcttctg

SEQ ID NO: 7556124 - DNA, 22 bp, Homo sapiens
ataaacatctgtttctcttctg

SEQ ID NO: 7556125 - DNA, 22 bp, Homo sapiens
ataaacatctgtttctcttctg

SEQ ID NO: 7556126 - DNA, 22 bp, Homo sapiens
ataaacatctgtttctcttctg

SEQ ID NO: 7556127 - DNA, 22 bp, Homo sapiens
ataaaatctttatgtgctctgc

SEQ ID NO: 7556128 - DNA, 22 bp, Homo sapiens
ataaacatctgtttctcttctg

SEQ ID NO: 7556129 - DNA, 22 bp, Homo sapiens
ctgcaggcttccagggctgtgg

SEQ ID NO: 7556130 - DNA, 22 bp, Homo sapiens
ctgcaggcttccagggctgtgg

SEQ ID NO: 7556131 - DNA, 22 bp, Homo sapiens
ctgcaggcttccagggctgtgg

SEQ ID NO: 7556132 - DNA, 22 bp, Homo sapiens
ctgcagggaactgaggcccaga

SEQ ID NO: 7556133 - DNA, 22 bp, Homo sapiens
ctgcaggctgagcgcctgccgg

SEQ ID NO: 7556134 - DNA, 22 bp, Homo sapiens
ctgcaggctgagcgcctgccgg

SEQ ID NO: 7556135 - DNA, 22 bp, Homo sapiens
ctgcaggctgagcgcctgccgg

SEQ ID NO: 7556136 - DNA, 22 bp, Homo sapiens
ctgcaggctgagcgcctgccgg

SEQ ID NO: 7556137 - DNA, 22 bp, Homo sapiens
ctgcagggaccacaagcaggtt

SEQ ID NO: 7556138 - DNA, 22 bp, Homo sapiens
ctgcagggaactgaggcccaga

SEQ ID NO: 7556139 - DNA, 22 bp, Homo sapiens
ctgcagggaactgaggcccaga

SEQ ID NO: 7556140 - DNA, 22 bp, Homo sapiens
ctgcagggaactgaggcccaga

SEQ ID NO: 7556141 - DNA, 22 bp, Homo sapiens
ctgcagggaactgaggcccaga

SEQ ID NO: 7556142 - DNA, 22 bp, Homo sapiens
ctgcagggaactgaggcccaga

SEQ ID NO: 7556143 - DNA, 22 bp, Homo sapiens
ctgcagggacccaagtctttgg

SEQ ID NO: 7556144 - DNA, 22 bp, Homo sapiens
ctgcagggacccaagtctttgg

SEQ ID NO: 7556145 - DNA, 22 bp, Homo sapiens
ctgcagggacccaagtctttgg

SEQ ID NO: 7556146 - DNA, 22 bp, Homo sapiens
ctgcagggacccaagtctttgg

SEQ ID NO: 7556147 - DNA, 22 bp, Homo sapiens
ctgcagggagaggggacagcct

SEQ ID NO: 7556148 - DNA, 22 bp, Homo sapiens
ctgcagggagaggggacagcct

SEQ ID NO: 7556149 - DNA, 22 bp, Homo sapiens
ctgcagggagaggggacagcct

SEQ ID NO: 7556150 - DNA, 22 bp, Homo sapiens
ctgcagggagaggggacagcct

SEQ ID NO: 7556151 - DNA, 22 bp, Homo sapiens
ctgcagggacccaagtctttgg

SEQ ID NO: 7556152 - DNA, 22 bp, Homo sapiens
ctgcagggagaggggacagcct

SEQ ID NO: 7556153 - DNA, 22 bp, Homo sapiens
ctgcagggaccacaagcaggtt

SEQ ID NO: 7556154 - DNA, 22 bp, Homo sapiens
ctgcagggaccacaagcaggtt

SEQ ID NO: 7556155 - DNA, 22 bp, Homo sapiens
ctgcagggaccacaagcaggtt

SEQ ID NO: 7556156 - DNA, 22 bp, Homo sapiens
ctgcagggaccacaagcaggtt

SEQ ID NO: 7556157 - DNA, 22 bp, Homo sapiens
ctgcagggaccacaagcaggtt

SEQ ID NO: 7556158 - DNA, 22 bp, Homo sapiens
ctgcagggaccacaagcaggtt

SEQ ID NO: 7556159 - DNA, 22 bp, Homo sapiens
ctgcagggaccacaagcaggtt

SEQ ID NO: 7556160 - DNA, 22 bp, Homo sapiens
agttctgtgctcactctacccc

SEQ ID NO: 7556161 - DNA, 21 bp, Homo sapiens
agttctgttatgctggactca

SEQ ID NO: 7556162 - DNA, 21 bp, Homo sapiens
agttctgttatgctggactca

SEQ ID NO: 7556163 - DNA, 22 bp, Homo sapiens
agttctgttgtctagggaagcc

SEQ ID NO: 7556164 - DNA, 22 bp, Homo sapiens
agttctgttgtctagggaagcc

SEQ ID NO: 7556165 - DNA, 21 bp, Homo sapiens
agttctgttatgctggactca

SEQ ID NO: 7556166 - DNA, 22 bp, Homo sapiens
agttcttattgaatagaaatca

SEQ ID NO: 7556167 - DNA, 22 bp, Homo sapiens
agttcttacaggggacctttga

SEQ ID NO: 7556168 - DNA, 22 bp, Homo sapiens
agttcttacaggggacctttga

SEQ ID NO: 7556169 - DNA, 22 bp, Homo sapiens
agttcttattttggaactgagg

SEQ ID NO: 7556170 - DNA, 22 bp, Homo sapiens
agttcttattgaatagaaatca

SEQ ID NO: 7556171 - DNA, 22 bp, Homo sapiens
agttcttattgaatagaaatca

SEQ ID NO: 7556172 - DNA, 22 bp, Homo sapiens
agttcttattgaatagaaatca

SEQ ID NO: 7556173 - DNA, 22 bp, Homo sapiens
agttcttattttggaactgagg

SEQ ID NO: 7556174 - DNA, 22 bp, Homo sapiens
agttttgtaattctcaaaaata

SEQ ID NO: 7556175 - DNA, 22 bp, Homo sapiens
agttttgtaattctcaaaaata

SEQ ID NO: 7556176 - DNA, 22 bp, Homo sapiens
agttttgtaattctcaaaaata

SEQ ID NO: 7556177 - DNA, 22 bp, Homo sapiens
agttttgggaatatgtaattat

SEQ ID NO: 7556178 - DNA, 22 bp, Homo sapiens
agttttgtaattctcaaaaata

SEQ ID NO: 7556179 - DNA, 22 bp, Homo sapiens
ataaaaatgagggcggtagcta

SEQ ID NO: 7556180 - DNA, 22 bp, Homo sapiens
ataaaaatgagggcggtagcta

SEQ ID NO: 7556181 - DNA, 22 bp, Homo sapiens
ataaaaatgagggcggtagcta

SEQ ID NO: 7556182 - DNA, 22 bp, Homo sapiens
ataaaaccaaagcagcagtgtt

SEQ ID NO: 7556183 - DNA, 22 bp, Homo sapiens
ataaaaatgagggcggtagcta

SEQ ID NO: 7556184 - DNA, 22 bp, Homo sapiens
ataaaaatgagggcggtagcta

SEQ ID NO: 7556185 - DNA, 22 bp, Homo sapiens
ataaaaatgagggcggtagcta

SEQ ID NO: 7556186 - DNA, 22 bp, Homo sapiens
ataaaaatgagggcggtagcta

SEQ ID NO: 7556187 - DNA, 22 bp, Homo sapiens
ataaaaatgagggcggtagcta

SEQ ID NO: 7556188 - DNA, 22 bp, Homo sapiens
ataaaaaggacagatgtggtct

SEQ ID NO: 7556189 - DNA, 22 bp, Homo sapiens
ataaaaaggacagatgtggtct

SEQ ID NO: 7556190 - DNA, 22 bp, Homo sapiens
ataaaaaggacagatgtggtct

SEQ ID NO: 7556191 - DNA, 22 bp, Homo sapiens
ataaaaaggacagatgtggtct

SEQ ID NO: 7556192 - DNA, 22 bp, Homo sapiens
ataaaaaggacagatgtggtct

SEQ ID NO: 7556193 - DNA, 22 bp, Homo sapiens
ataaaaaggacagatgtggtct

SEQ ID NO: 7556194 - DNA, 22 bp, Homo sapiens
ataaaaaggacagatgtggtct

SEQ ID NO: 7556195 - DNA, 22 bp, Homo sapiens
ataaaaaggacagatgtggtct

SEQ ID NO: 7556196 - DNA, 22 bp, Homo sapiens
ataaaacttattagaattgtgt

SEQ ID NO: 7556197 - DNA, 22 bp, Homo sapiens
ataaaacttattagaattgtgt

SEQ ID NO: 7556198 - DNA, 22 bp, Homo sapiens
ataaaacttattagaattgtgt

SEQ ID NO: 7556199 - DNA, 22 bp, Homo sapiens
ataaaacttattagaattgtgt

SEQ ID NO: 7556200 - DNA, 22 bp, Homo sapiens
ataaaacttattagaattgtgt

SEQ ID NO: 7556201 - DNA, 22 bp, Homo sapiens
ataaaacttattagaattgtgt

SEQ ID NO: 7556202 - DNA, 22 bp, Homo sapiens
ataaaacttattagaattgtgt

SEQ ID NO: 7556203 - DNA, 22 bp, Homo sapiens
ataaaacttattagaattgtgt

SEQ ID NO: 7556204 - DNA, 22 bp, Homo sapiens
ataaaagaagttttggtacttg

SEQ ID NO: 7556205 - DNA, 22 bp, Homo sapiens
ataaaagaagttttggtacttg

SEQ ID NO: 7556206 - DNA, 22 bp, Homo sapiens
ataaaagaagttttggtacttg

SEQ ID NO: 7556207 - DNA, 22 bp, Homo sapiens
ataaaagaagttttggtacttg

SEQ ID NO: 7556208 - DNA, 22 bp, Homo sapiens
ataaaacttgggtatgatccct

SEQ ID NO: 7556209 - DNA, 22 bp, Homo sapiens
ataaaacttgggtatgatccct

SEQ ID NO: 7556210 - DNA, 22 bp, Homo sapiens
ataaaacttgggtatgatccct

SEQ ID NO: 7556211 - DNA, 22 bp, Homo sapiens
ataaaacttgggtatgatccct

SEQ ID NO: 7556212 - DNA, 22 bp, Homo sapiens
ataaaacttgggtatgatccct

SEQ ID NO: 7556213 - DNA, 22 bp, Homo sapiens
ataaaacttgggtatgatccct

SEQ ID NO: 7556214 - DNA, 22 bp, Homo sapiens
ataaaacttattagaattgtgt

SEQ ID NO: 7556215 - DNA, 22 bp, Homo sapiens
ataaaacttattagaattgtgt

SEQ ID NO: 7556216 - DNA, 22 bp, Homo sapiens
ataaaacttgggtatgatccct

SEQ ID NO: 7556217 - DNA, 22 bp, Homo sapiens
ataaaagatcccttctgagctc

SEQ ID NO: 7556218 - DNA, 22 bp, Homo sapiens
ataaaagaagttttggtacttg

SEQ ID NO: 7556219 - DNA, 22 bp, Homo sapiens
ataaaagaagttttggtacttg

SEQ ID NO: 7556220 - DNA, 22 bp, Homo sapiens
ataaaagaagttttggtacttg

SEQ ID NO: 7556221 - DNA, 22 bp, Homo sapiens
ataaaagaagttttggtacttg

SEQ ID NO: 7556222 - DNA, 22 bp, Homo sapiens
ataaaagaagttttggtacttg

SEQ ID NO: 7556223 - DNA, 22 bp, Homo sapiens
ataaaagaagttttggtacttg

SEQ ID NO: 7556224 - DNA, 22 bp, Homo sapiens
ataaaaggaaagcctgttgtga

SEQ ID NO: 7556225 - DNA, 22 bp, Homo sapiens
ataaaaggaaagcctgttgtga

SEQ ID NO: 7556226 - DNA, 22 bp, Homo sapiens
ataaaaggaaagcctgttgtga

SEQ ID NO: 7556227 - DNA, 22 bp, Homo sapiens
ataaaagatcccttctgagctc

SEQ ID NO: 7556228 - DNA, 22 bp, Homo sapiens
ataaaagatcccttctgagctc

SEQ ID NO: 7556229 - DNA, 22 bp, Homo sapiens
ctgcaggctgagcgcctgccgg

SEQ ID NO: 7556230 - DNA, 22 bp, Homo sapiens
ctgcaggctcgaagacacggat

SEQ ID NO: 7556231 - DNA, 22 bp, Homo sapiens
ctgcaggctcgaagacacggat

SEQ ID NO: 7556232 - DNA, 22 bp, Homo sapiens
ctgcaggctcgaagacacggat

SEQ ID NO: 7556233 - DNA, 22 bp, Homo sapiens
agttctgtggctgtgccctgta

SEQ ID NO: 7556234 - DNA, 22 bp, Homo sapiens
agttctgtgacaatatcattac

SEQ ID NO: 7556235 - DNA, 22 bp, Homo sapiens
agttctgtgacaatatcattac

SEQ ID NO: 7556236 - DNA, 22 bp, Homo sapiens
agttctgtctgattctaatgca

SEQ ID NO: 7556237 - DNA, 22 bp, Homo sapiens
agttctggttgcccatgacatc

SEQ ID NO: 7556238 - DNA, 22 bp, Homo sapiens
agttctgtctgattctaatgca

SEQ ID NO: 7556239 - DNA, 22 bp, Homo sapiens
agttctgtctgattctaatgca

SEQ ID NO: 7556240 - DNA, 22 bp, Homo sapiens
agttctgtctgacaccgaagtt

SEQ ID NO: 7556241 - DNA, 22 bp, Homo sapiens
agttctgtcctccccactcttt

SEQ ID NO: 7556242 - DNA, 22 bp, Homo sapiens
agttctgtcctccccactcttt

SEQ ID NO: 7556243 - DNA, 22 bp, Homo sapiens
agttctggcgcccatgagcaga

SEQ ID NO: 7556244 - DNA, 22 bp, Homo sapiens
agttctggcgcccatgagcaga

SEQ ID NO: 7556245 - DNA, 22 bp, Homo sapiens
agttctggcccagggtttcttg

SEQ ID NO: 7556246 - DNA, 22 bp, Homo sapiens
agttctggtggtttggagatct

SEQ ID NO: 7556247 - DNA, 22 bp, Homo sapiens
agttctctggctcctttccaga

SEQ ID NO: 7556248 - DNA, 22 bp, Homo sapiens
agttctctggctcctttccaga

SEQ ID NO: 7556249 - DNA, 22 bp, Homo sapiens
agttctcttctcatcacccagg

SEQ ID NO: 7556250 - DNA, 22 bp, Homo sapiens
agttctcttccacagcctcctc

SEQ ID NO: 7556251 - DNA, 22 bp, Homo sapiens
agttctcttccacagcctcctc

SEQ ID NO: 7556252 - DNA, 22 bp, Homo sapiens
agttctcttggaagttatgtga

SEQ ID NO: 7556253 - DNA, 22 bp, Homo sapiens
agttctctttagctcatatggt

SEQ ID NO: 7556254 - DNA, 22 bp, Homo sapiens
agttctgaatgaggaatctggg

SEQ ID NO: 7556255 - DNA, 22 bp, Homo sapiens
agttctctttagctcatatggt

SEQ ID NO: 7556256 - DNA, 22 bp, Homo sapiens
agttctgactctgaatctggga

SEQ ID NO: 7556257 - DNA, 22 bp, Homo sapiens
agttctgctatcttgtcttctt

SEQ ID NO: 7556258 - DNA, 22 bp, Homo sapiens
agttctcaaggttaggaaaagt

SEQ ID NO: 7556259 - DNA, 22 bp, Homo sapiens
agttctcaaggttaggaaaagt

SEQ ID NO: 7556260 - DNA, 22 bp, Homo sapiens
agttctcaagacaattacctgt

SEQ ID NO: 7556261 - DNA, 22 bp, Homo sapiens
agttctcagaattgcacctcaa

SEQ ID NO: 7556262 - DNA, 22 bp, Homo sapiens
agttctcagaattgcacctcaa

SEQ ID NO: 7556263 - DNA, 22 bp, Homo sapiens
agttctcagcttagtatgctgt

SEQ ID NO: 7556264 - DNA, 22 bp, Homo sapiens
agttctcaggtcagctgagtct

SEQ ID NO: 7556265 - DNA, 22 bp, Homo sapiens
agttctcaggtcagctgagtct

SEQ ID NO: 7556266 - DNA, 22 bp, Homo sapiens
agttctcaggtcagctgagtct

SEQ ID NO: 7556267 - DNA, 22 bp, Homo sapiens
agttctcataaacgtccttgga

SEQ ID NO: 7556268 - DNA, 22 bp, Homo sapiens
agttctcatcatgaagcataag

SEQ ID NO: 7556269 - DNA, 22 bp, Homo sapiens
agttctcatcatgaagcataag

SEQ ID NO: 7556270 - DNA, 23 bp, Homo sapiens
agttctcattcatcacggcctat

SEQ ID NO: 7556271 - DNA, 23 bp, Homo sapiens
agttctcattcatcacggcctat

SEQ ID NO: 7556272 - DNA, 22 bp, Homo sapiens
agttctctatgaagtctattgt

SEQ ID NO: 7556273 - DNA, 22 bp, Homo sapiens
agttctcgagcgtccctgtttc

SEQ ID NO: 7556274 - DNA, 22 bp, Homo sapiens
agttctcattgcatgagacaga

SEQ ID NO: 7556275 - DNA, 22 bp, Homo sapiens
agttctcattgcatgagacaga

SEQ ID NO: 7556276 - DNA, 22 bp, Homo sapiens
agttctcatttcacaggcagtg

SEQ ID NO: 7556277 - DNA, 22 bp, Homo sapiens
agttctaattgcgttttcttgc

SEQ ID NO: 7556278 - DNA, 22 bp, Homo sapiens
agttctaattgcgttttcttgc

SEQ ID NO: 7556279 - DNA, 22 bp, Homo sapiens
agttctaaggtgagtagagagg

SEQ ID NO: 7556280 - DNA, 22 bp, Homo sapiens
agttctaagtaaatattttata

SEQ ID NO: 7556281 - DNA, 22 bp, Homo sapiens
agttctaagtaaatattttata

SEQ ID NO: 7556282 - DNA, 22 bp, Homo sapiens
agttctaagtaaatattttata

SEQ ID NO: 7556283 - DNA, 22 bp, Homo sapiens
agttcgagatctgctgatgaga

SEQ ID NO: 7556284 - DNA, 22 bp, Homo sapiens
agttctaagatgctccacagag

SEQ ID NO: 7556285 - DNA, 22 bp, Homo sapiens
agttcgagatctgctgatgaga

SEQ ID NO: 7556286 - DNA, 22 bp, Homo sapiens
agttccttgatgttctatggac

SEQ ID NO: 7556287 - DNA, 22 bp, Homo sapiens
agttccttttatctgagtctaa

SEQ ID NO: 7556288 - DNA, 22 bp, Homo sapiens
agttccttttatctgagtctaa

SEQ ID NO: 7556289 - DNA, 22 bp, Homo sapiens
agttctataattaaaatgaagg

SEQ ID NO: 7556290 - DNA, 21 bp, Homo sapiens
agttctatagtcttcacagcc

SEQ ID NO: 7556291 - DNA, 21 bp, Homo sapiens
agttctatagtcttcacagcc

SEQ ID NO: 7556292 - DNA, 22 bp, Homo sapiens
agttctattgggtaggttctgt

SEQ ID NO: 7556293 - DNA, 22 bp, Homo sapiens
agttctatttctaacatgttat

SEQ ID NO: 7556294 - DNA, 21 bp, Homo sapiens
agttctatagtcttcacagcc

SEQ ID NO: 7556295 - DNA, 22 bp, Homo sapiens
agttctatttctaacatgttat

SEQ ID NO: 7556296 - DNA, 22 bp, Homo sapiens
agttctcaagacaattacctgt

SEQ ID NO: 7556297 - DNA, 23 bp, Homo sapiens
agttctcaaaaccagcttgacaa

SEQ ID NO: 7556298 - DNA, 22 bp, Homo sapiens
ctgcctggtgcggtgcccaccc

SEQ ID NO: 7556299 - DNA, 22 bp, Homo sapiens
ctgcctggtgcggtgcccaccc

SEQ ID NO: 7556300 - DNA, 22 bp, Homo sapiens
ctgcctggtgcggtgcccaccc

SEQ ID NO: 7556301 - DNA, 22 bp, Homo sapiens
ctgcctggtgcggtgcccaccc

SEQ ID NO: 7556302 - DNA, 22 bp, Homo sapiens
ctgcctgtaactttctgaagca

SEQ ID NO: 7556303 - DNA, 22 bp, Homo sapiens
ctgcctgtaactttctgaagca

SEQ ID NO: 7556304 - DNA, 22 bp, Homo sapiens
ctgcctgtaactttctgaagca

SEQ ID NO: 7556305 - DNA, 22 bp, Homo sapiens
ctgcctgtattgtctgcttggg

SEQ ID NO: 7556306 - DNA, 22 bp, Homo sapiens
ctgcctgtattgtctgcttggg

SEQ ID NO: 7556307 - DNA, 22 bp, Homo sapiens
ctgcctgtgaacatactggggg

SEQ ID NO: 7556308 - DNA, 22 bp, Homo sapiens
ctgcctgtgatttttctctagt

SEQ ID NO: 7556309 - DNA, 22 bp, Homo sapiens
ctgcctgtgatttttctctagt

SEQ ID NO: 7556310 - DNA, 22 bp, Homo sapiens
ctgcctgtgaacatactggggg

SEQ ID NO: 7556311 - DNA, 22 bp, Homo sapiens
ctgcctgtgaacatactggggg

SEQ ID NO: 7556312 - DNA, 22 bp, Homo sapiens
ctgcctgtattgtctgcttggg

SEQ ID NO: 7556313 - DNA, 22 bp, Homo sapiens
ctgcctgtgcatgcagtcagaa

SEQ ID NO: 7556314 - DNA, 22 bp, Homo sapiens
ctgcctgtgcatgcagtcagaa

SEQ ID NO: 7556315 - DNA, 22 bp, Homo sapiens
ctgcctgtgatttttctctagt

SEQ ID NO: 7556316 - DNA, 22 bp, Homo sapiens
ctgcctgtgcatgcagtcagaa

SEQ ID NO: 7556317 - DNA, 22 bp, Homo sapiens
ctgcctgtgcatgcagtcagaa

SEQ ID NO: 7556318 - DNA, 22 bp, Homo sapiens
ctgcgtttagagtaggaggcat

SEQ ID NO: 7556319 - DNA, 22 bp, Homo sapiens
ctgcctgtgccaccgcctcatt

SEQ ID NO: 7556320 - DNA, 22 bp, Homo sapiens
ctgcctgtgccaccgcctcatt

SEQ ID NO: 7556321 - DNA, 22 bp, Homo sapiens
ctgcctgtgccaatgctccttt

SEQ ID NO: 7556322 - DNA, 22 bp, Homo sapiens
ctgcctgtgccaatgctccttt

SEQ ID NO: 7556323 - DNA, 22 bp, Homo sapiens
ctgcctgtgccaatgctccttt

SEQ ID NO: 7556324 - DNA, 22 bp, Homo sapiens
ctgcgttttgacatttcggggc

SEQ ID NO: 7556325 - DNA, 22 bp, Homo sapiens
ctgcgtttgggtagaggcgagt

SEQ ID NO: 7556326 - DNA, 22 bp, Homo sapiens
ctgctaaacctctctgagagct

SEQ ID NO: 7556327 - DNA, 22 bp, Homo sapiens
ctgctaaacctctctgagagct

SEQ ID NO: 7556328 - DNA, 22 bp, Homo sapiens
ctgctaaacctctctgagagct

SEQ ID NO: 7556329 - DNA, 22 bp, Homo sapiens
ctgctacagtttaaaggggaag

SEQ ID NO: 7556330 - DNA, 22 bp, Homo sapiens
ctgctacaccggaatagtgaca

SEQ ID NO: 7556331 - DNA, 22 bp, Homo sapiens
ctgcctgggttcaagtcctgtt

SEQ ID NO: 7556332 - DNA, 22 bp, Homo sapiens
ctgcctgggttcaagtcctgtt

SEQ ID NO: 7556333 - DNA, 22 bp, Homo sapiens
ctgcctgggttcaagtcctgtt

SEQ ID NO: 7556334 - DNA, 22 bp, Homo sapiens
ctgcctggaaggagcaagggga

SEQ ID NO: 7556335 - DNA, 22 bp, Homo sapiens
ctgcctggaaggagcaagggga

SEQ ID NO: 7556336 - DNA, 22 bp, Homo sapiens
ctgcctggaaggagcaagggga

SEQ ID NO: 7556337 - DNA, 22 bp, Homo sapiens
ctgcctggaaggagcaagggga

SEQ ID NO: 7556338 - DNA, 22 bp, Homo sapiens
ctgcctggaaggagcaagggga

SEQ ID NO: 7556339 - DNA, 22 bp, Homo sapiens
ataaagctcttagtagcagcct

SEQ ID NO: 7556340 - DNA, 22 bp, Homo sapiens
ctgcctggaaggagcaagggga

SEQ ID NO: 7556341 - DNA, 22 bp, Homo sapiens
ataaagctttgaaatggagata

SEQ ID NO: 7556342 - DNA, 22 bp, Homo sapiens
ataaagcttctgagtctagatc

SEQ ID NO: 7556343 - DNA, 22 bp, Homo sapiens
ataaagcttctgagtctagatc

SEQ ID NO: 7556344 - DNA, 22 bp, Homo sapiens
ataaagctcttagtagcagcct

SEQ ID NO: 7556345 - DNA, 22 bp, Homo sapiens
ataaagctatttttaattctgt

SEQ ID NO: 7556346 - DNA, 22 bp, Homo sapiens
ataaaggaaattccatgtctaa

SEQ ID NO: 7556347 - DNA, 22 bp, Homo sapiens
ataaaggataatccattagact

SEQ ID NO: 7556348 - DNA, 22 bp, Homo sapiens
ataaaggataatccattagact

SEQ ID NO: 7556349 - DNA, 22 bp, Homo sapiens
ataaaggaaattccatgtctaa

SEQ ID NO: 7556350 - DNA, 22 bp, Homo sapiens
ctgcctggaaggagcaagggga

SEQ ID NO: 7556351 - DNA, 22 bp, Homo sapiens
ataaaggataatccattagact

SEQ ID NO: 7556352 - DNA, 22 bp, Homo sapiens
ctgcctggtctcaggcatgggg

SEQ ID NO: 7556353 - DNA, 22 bp, Homo sapiens
ctgcctggtctcaggcatgggg

SEQ ID NO: 7556354 - DNA, 22 bp, Homo sapiens
ctgcctggtctcaggcatgggg

SEQ ID NO: 7556355 - DNA, 22 bp, Homo sapiens
ctgcctggtctcaggcatgggg

SEQ ID NO: 7556356 - DNA, 22 bp, Homo sapiens
ctgcctggtctcaggcatgggg

SEQ ID NO: 7556357 - DNA, 22 bp, Homo sapiens
ctgcctggtctcaggcatgggg

SEQ ID NO: 7556358 - DNA, 22 bp, Homo sapiens
ctgcctggtctcaggcatgggg

SEQ ID NO: 7556359 - DNA, 22 bp, Homo sapiens
ctgcctggtctcaggcatgggg

SEQ ID NO: 7556360 - DNA, 22 bp, Homo sapiens
ctgcctggtactttaggcactt

SEQ ID NO: 7556361 - DNA, 22 bp, Homo sapiens
ctgcctggtactttaggcactt

SEQ ID NO: 7556362 - DNA, 22 bp, Homo sapiens
ctgcctggtactttaggcactt

SEQ ID NO: 7556363 - DNA, 22 bp, Homo sapiens
ctgcctggtactttaggcactt

SEQ ID NO: 7556364 - DNA, 22 bp, Homo sapiens
ctgcctgggttcaagtcctgtt

SEQ ID NO: 7556365 - DNA, 22 bp, Homo sapiens
ctgcctgggttcaagtcctgtt

SEQ ID NO: 7556366 - DNA, 22 bp, Homo sapiens
ctgcctgggttcaagtcctgtt

SEQ ID NO: 7556367 - DNA, 19 bp, Homo sapiens
ctgctcaggtcagtctgtc

SEQ ID NO: 7556368 - DNA, 19 bp, Homo sapiens
ctgctcaggtcagtctgtc

SEQ ID NO: 7556369 - DNA, 19 bp, Homo sapiens
ctgctcaggtcagtctgtc

SEQ ID NO: 7556370 - DNA, 19 bp, Homo sapiens
ctgctcaggtcagtctgtc

SEQ ID NO: 7556371 - DNA, 19 bp, Homo sapiens
ctgctcaggtcagtctgtc

SEQ ID NO: 7556372 - DNA, 22 bp, Homo sapiens
ctgctcagcggaaggaagagcg

SEQ ID NO: 7556373 - DNA, 22 bp, Homo sapiens
ctgctcagcggaaggaagagcg

SEQ ID NO: 7556374 - DNA, 22 bp, Homo sapiens
ctgctcagaggaaggaatgtct

SEQ ID NO: 7556375 - DNA, 19 bp, Homo sapiens
ctgctcagagcagctccag

SEQ ID NO: 7556376 - DNA, 22 bp, Homo sapiens
ctgctcagaggaaggaatgtct

SEQ ID NO: 7556377 - DNA, 22 bp, Homo sapiens
ctgctcagcggaaggaagagcg

SEQ ID NO: 7556378 - DNA, 19 bp, Homo sapiens
ctgctcagagcagctccag

SEQ ID NO: 7556379 - DNA, 19 bp, Homo sapiens
ctgctcagagcagctccag

SEQ ID NO: 7556380 - DNA, 19 bp, Homo sapiens
ctgctcagagcagctccag

SEQ ID NO: 7556381 - DNA, 20 bp, Homo sapiens
ctgctcagaccaactcttct

SEQ ID NO: 7556382 - DNA, 20 bp, Homo sapiens
ctgctcagaccaactcttct

SEQ ID NO: 7556383 - DNA, 19 bp, Homo sapiens
ctgctcagagcagctccag

SEQ ID NO: 7556384 - DNA, 19 bp, Homo sapiens
ctgctcagagcagctccag

SEQ ID NO: 7556385 - DNA, 19 bp, Homo sapiens
ctgctcagagcagctccag

SEQ ID NO: 7556386 - DNA, 22 bp, Homo sapiens
ctgctattggaaggaggcatga

SEQ ID NO: 7556387 - DNA, 22 bp, Homo sapiens
ctgctcaagtgcgcacccaggg

SEQ ID NO: 7556388 - DNA, 22 bp, Homo sapiens
ctgctcacgccaccgttcatca

SEQ ID NO: 7556389 - DNA, 22 bp, Homo sapiens
ctgctcaagtgcgcacccaggg

SEQ ID NO: 7556390 - DNA, 22 bp, Homo sapiens
ctgctagggttcagcagtgcct

SEQ ID NO: 7556391 - DNA, 22 bp, Homo sapiens
ctgctagggttcagcagtgcct

SEQ ID NO: 7556392 - DNA, 22 bp, Homo sapiens
ctgctagcccgccggccagcga

SEQ ID NO: 7556393 - DNA, 22 bp, Homo sapiens
ctgctagggttcagcagtgcct

SEQ ID NO: 7556394 - DNA, 22 bp, Homo sapiens
ctgctagggttcagcagtgcct

SEQ ID NO: 7556395 - DNA, 22 bp, Homo sapiens
ctgctactggttctgcttgttc

SEQ ID NO: 7556396 - DNA, 22 bp, Homo sapiens
ctgctactgaaattagatagtc

SEQ ID NO: 7556397 - DNA, 22 bp, Homo sapiens
ctgctactcttgtatgtgtatt

SEQ ID NO: 7556398 - DNA, 21 bp, Homo sapiens
ctgctacttcatggaaaatag

SEQ ID NO: 7556399 - DNA, 21 bp, Homo sapiens
ctgctacttcatggaaaatag

SEQ ID NO: 7556400 - DNA, 22 bp, Homo sapiens
ctgctacttaccagctgtgtaa

SEQ ID NO: 7556401 - DNA, 22 bp, Homo sapiens
ctgctacttttgcctgagtaac

SEQ ID NO: 7556402 - DNA, 21 bp, Homo sapiens
ctgctacttttcttactgtag

SEQ ID NO: 7556403 - DNA, 22 bp, Homo sapiens
ctgctagcccaggatgcaggga

SEQ ID NO: 7556404 - DNA, 22 bp, Homo sapiens
ctgctagcccaggatgcaggga

SEQ ID NO: 7556405 - DNA, 22 bp, Homo sapiens
ctgctagcccaggatgcaggga

SEQ ID NO: 7556406 - DNA, 22 bp, Homo sapiens
ctgctagcccgccggccagcga

SEQ ID NO: 7556407 - DNA, 22 bp, Homo sapiens
ctgctgcccagtgtgcattggg

SEQ ID NO: 7556408 - DNA, 22 bp, Homo sapiens
ctgctgcccagtgtgcattggg

SEQ ID NO: 7556409 - DNA, 22 bp, Homo sapiens
ctgctgcccagtgtgcattggg

SEQ ID NO: 7556410 - DNA, 19 bp, Homo sapiens
ctgctcaggtcagtctgtc

SEQ ID NO: 7556411 - DNA, 22 bp, Homo sapiens
ctgctgcccagtgtgcattggg

SEQ ID NO: 7556412 - DNA, 22 bp, Homo sapiens
ctgctgggcagaggctgcatga

SEQ ID NO: 7556413 - DNA, 22 bp, Homo sapiens
ctgctgggcctggtctctgagg

SEQ ID NO: 7556414 - DNA, 22 bp, Homo sapiens
ctgctgggcagaggctgcatga

SEQ ID NO: 7556415 - DNA, 22 bp, Homo sapiens
ctgctgggcagaggctgcatga

SEQ ID NO: 7556416 - DNA, 22 bp, Homo sapiens
ctgctgggcctggtctctgagg

SEQ ID NO: 7556417 - DNA, 22 bp, Homo sapiens
ctgctgggcctggtctctgagg

SEQ ID NO: 7556418 - DNA, 22 bp, Homo sapiens
ctgctgggcctggtctctgagg

SEQ ID NO: 7556419 - DNA, 22 bp, Homo sapiens
ctgctgggcctggtctctgagg

SEQ ID NO: 7556420 - DNA, 22 bp, Homo sapiens
ctgctgggctcctcatgtgact

SEQ ID NO: 7556421 - DNA, 22 bp, Homo sapiens
ctgctgggctcctcatgtgact

SEQ ID NO: 7556422 - DNA, 22 bp, Homo sapiens
ctgctgggctcctcatgtgact

SEQ ID NO: 7556423 - DNA, 22 bp, Homo sapiens
ctgctgggctcctcatgtgact

SEQ ID NO: 7556424 - DNA, 22 bp, Homo sapiens
ctgctgggctcctcatgtgact

SEQ ID NO: 7556425 - DNA, 22 bp, Homo sapiens
ctgctgggctcctcatgtgact

SEQ ID NO: 7556426 - DNA, 22 bp, Homo sapiens
ctgctgggctcctcatgtgact

SEQ ID NO: 7556427 - DNA, 22 bp, Homo sapiens
ctgctggggaggcgcctcgacg

SEQ ID NO: 7556428 - DNA, 22 bp, Homo sapiens
ctgctgggggacacaggtccgg

SEQ ID NO: 7556429 - DNA, 22 bp, Homo sapiens
ctgctgggggacacaggtccgg

SEQ ID NO: 7556430 - DNA, 22 bp, Homo sapiens
ctgctgggggacacaggtccgg

SEQ ID NO: 7556431 - DNA, 22 bp, Homo sapiens
ctgctgggctcctcatgtgact

SEQ ID NO: 7556432 - DNA, 22 bp, Homo sapiens
ctgctgggctcctcatgtgact

SEQ ID NO: 7556433 - DNA, 22 bp, Homo sapiens
ctgctggggaggcgcctcgacg

SEQ ID NO: 7556434 - DNA, 22 bp, Homo sapiens
ctgctggggaggcgcctcgacg

SEQ ID NO: 7556435 - DNA, 22 bp, Homo sapiens
ctgctggggaggcgcctcgacg

SEQ ID NO: 7556436 - DNA, 22 bp, Homo sapiens
atacacatatcaggtgtataca

SEQ ID NO: 7556437 - DNA, 22 bp, Homo sapiens
atacacatatatacacgtttaa

SEQ ID NO: 7556438 - DNA, 22 bp, Homo sapiens
atacacatatatacacgtttaa

SEQ ID NO: 7556439 - DNA, 19 bp, Homo sapiens
atacacatacgtaaactga

SEQ ID NO: 7556440 - DNA, 19 bp, Homo sapiens
atacacatacgtaaactga

SEQ ID NO: 7556441 - DNA, 19 bp, Homo sapiens
atacacatacgtaaactga

SEQ ID NO: 7556442 - DNA, 19 bp, Homo sapiens
atacacatacgtaaactga

SEQ ID NO: 7556443 - DNA, 19 bp, Homo sapiens
atacacatacgtaaactga

SEQ ID NO: 7556444 - DNA, 19 bp, Homo sapiens
atacacatacgtaaactga

SEQ ID NO: 7556445 - DNA, 19 bp, Homo sapiens
atacacatacgtaaactga

SEQ ID NO: 7556446 - DNA, 21 bp, Homo sapiens
atacacatacacataaatgtg

SEQ ID NO: 7556447 - DNA, 21 bp, Homo sapiens
atacacatacacataaatgtg

SEQ ID NO: 7556448 - DNA, 21 bp, Homo sapiens
atacacatacacataaatgtg

SEQ ID NO: 7556449 - DNA, 21 bp, Homo sapiens
atacacatacacataaatgtg

SEQ ID NO: 7556450 - DNA, 21 bp, Homo sapiens
atacacatacacataaatgtg

SEQ ID NO: 7556451 - DNA, 21 bp, Homo sapiens
atacacatacacataaatgtg

SEQ ID NO: 7556452 - DNA, 21 bp, Homo sapiens
atacacatacacataaatgtg

SEQ ID NO: 7556453 - DNA, 21 bp, Homo sapiens
atacacatacacataaatgtg

SEQ ID NO: 7556454 - DNA, 22 bp, Homo sapiens
atacaagttgcccaaatgatta

SEQ ID NO: 7556455 - DNA, 22 bp, Homo sapiens
atacaagttgcccaaatgatta

SEQ ID NO: 7556456 - DNA, 22 bp, Homo sapiens
atacaagttgcccaaatgatta

SEQ ID NO: 7556457 - DNA, 22 bp, Homo sapiens
atacaagttgcccaaatgatta

SEQ ID NO: 7556458 - DNA, 22 bp, Homo sapiens
atacacaggtgctaggtcaata

SEQ ID NO: 7556459 - DNA, 22 bp, Homo sapiens
atacacaggcatgcttctgatt

SEQ ID NO: 7556460 - DNA, 22 bp, Homo sapiens
atacacaggtgctaggtcaata

SEQ ID NO: 7556461 - DNA, 22 bp, Homo sapiens
atacacaggtgctaggtcaata

SEQ ID NO: 7556462 - DNA, 22 bp, Homo sapiens
atacacaggtgctaggtcaata

SEQ ID NO: 7556463 - DNA, 22 bp, Homo sapiens
atacacaggcatgcttctgatt

SEQ ID NO: 7556464 - DNA, 22 bp, Homo sapiens
atacacatctatttaagagaca

SEQ ID NO: 7556465 - DNA, 22 bp, Homo sapiens
atacacatctatttaagagaca

SEQ ID NO: 7556466 - DNA, 22 bp, Homo sapiens
atacacatctatttaagagaca

SEQ ID NO: 7556467 - DNA, 22 bp, Homo sapiens
atacacatctatttaagagaca

SEQ ID NO: 7556468 - DNA, 22 bp, Homo sapiens
atacacatctatttaagagaca

SEQ ID NO: 7556469 - DNA, 22 bp, Homo sapiens
atacacatctatttaagagaca

SEQ ID NO: 7556470 - DNA, 22 bp, Homo sapiens
atacacatctatttaagagaca

SEQ ID NO: 7556471 - DNA, 22 bp, Homo sapiens
atacacatctatttaagagaca

SEQ ID NO: 7556472 - DNA, 22 bp, Homo sapiens
atacacatgcacacatgtgtgt

SEQ ID NO: 7556473 - DNA, 15 bp, Homo sapiens
atacacatgagggag

SEQ ID NO: 7556474 - DNA, 22 bp, Homo sapiens
atacacatgcacacatgtgtgt

SEQ ID NO: 7556475 - DNA, 22 bp, Homo sapiens
atacacatgcacacatgtgtgt

SEQ ID NO: 7556476 - DNA, 22 bp, Homo sapiens
atacacatgcacacatgtgtgt

SEQ ID NO: 7556477 - DNA, 22 bp, Homo sapiens
atacacatgcacacatgtgtgt

SEQ ID NO: 7556478 - DNA, 20 bp, Homo sapiens
atacacatgcagacagatgc

SEQ ID NO: 7556479 - DNA, 20 bp, Homo sapiens
atacacatattcttgcaact

SEQ ID NO: 7556480 - DNA, 20 bp, Homo sapiens
atacacatattcttgcaact

SEQ ID NO: 7556481 - DNA, 20 bp, Homo sapiens
atacacatattcttgcaact

SEQ ID NO: 7556482 - DNA, 20 bp, Homo sapiens
atacacatattcttgcaact

SEQ ID NO: 7556483 - DNA, 20 bp, Homo sapiens
atacacatattcttgcaact

SEQ ID NO: 7556484 - DNA, 22 bp, Homo sapiens
atacacatatgtgtgtatatgt

SEQ ID NO: 7556485 - DNA, 22 bp, Homo sapiens
atacacatatgtgtgtatatgt

SEQ ID NO: 7556486 - DNA, 22 bp, Homo sapiens
atacacatatgtgtgtatatgt

SEQ ID NO: 7556487 - DNA, 22 bp, Homo sapiens
atacacatatgtgtgtatatgt

SEQ ID NO: 7556488 - DNA, 22 bp, Homo sapiens
atacacatatgtgtgtatatgt

SEQ ID NO: 7556489 - DNA, 22 bp, Homo sapiens
atacacatatcaggtgtataca

SEQ ID NO: 7556490 - DNA, 22 bp, Homo sapiens
atacacatatgtgtgtatatgt

SEQ ID NO: 7556491 - DNA, 22 bp, Homo sapiens
atacaagttctcatgtgtatct

SEQ ID NO: 7556492 - DNA, 22 bp, Homo sapiens
atacaagttctcatgtgtatct

SEQ ID NO: 7556493 - DNA, 22 bp, Homo sapiens
atacaagttctcatgtgtatct

SEQ ID NO: 7556494 - DNA, 22 bp, Homo sapiens
atacaagttctcatgtgtatct

SEQ ID NO: 7556495 - DNA, 18 bp, Homo sapiens
ctgctgtgtcgtctgggc

SEQ ID NO: 7556496 - DNA, 18 bp, Homo sapiens
ctgctgtgtcgtctgggc

SEQ ID NO: 7556497 - DNA, 18 bp, Homo sapiens
ctgctgtgtcgtctgggc

SEQ ID NO: 7556498 - DNA, 22 bp, Homo sapiens
ctgctgtggtgtcaagcatctc

SEQ ID NO: 7556499 - DNA, 22 bp, Homo sapiens
ctgctgtggtgtcaagcatctc

SEQ ID NO: 7556500 - DNA, 22 bp, Homo sapiens
ctgctgtgtcagagtccagggg

SEQ ID NO: 7556501 - DNA, 22 bp, Homo sapiens
ctgctgtgtcagagtccagggg

SEQ ID NO: 7556502 - DNA, 22 bp, Homo sapiens
ctgctgtgtatcattttagatg

SEQ ID NO: 7556503 - DNA, 22 bp, Homo sapiens
ctgctgtgtcagagtccagggg

SEQ ID NO: 7556504 - DNA, 22 bp, Homo sapiens
ctgctgtgtcagagtccagggg

SEQ ID NO: 7556505 - DNA, 22 bp, Homo sapiens
ctgctgtggatgcaggacctca

SEQ ID NO: 7556506 - DNA, 22 bp, Homo sapiens
ctgctgtggccagccaggtcaa

SEQ ID NO: 7556507 - DNA, 22 bp, Homo sapiens
ctgctgtggccagccaggtcaa

SEQ ID NO: 7556508 - DNA, 22 bp, Homo sapiens
ctgctgtgggcagggtagctgg

SEQ ID NO: 7556509 - DNA, 21 bp, Homo sapiens
ctgctgtggcccccgacatgc

SEQ ID NO: 7556510 - DNA, 21 bp, Homo sapiens
ctgctgtggcccccgacatgc

SEQ ID NO: 7556511 - DNA, 22 bp, Homo sapiens
ctgctgtgggttaagacactgt

SEQ ID NO: 7556512 - DNA, 22 bp, Homo sapiens
ctgctgtgggttaagacactgt

SEQ ID NO: 7556513 - DNA, 22 bp, Homo sapiens
ctgctgtgggcagggtagctgg

SEQ ID NO: 7556514 - DNA, 22 bp, Homo sapiens
ctgctgtgcatatttatctagg

SEQ ID NO: 7556515 - DNA, 22 bp, Homo sapiens
ctgctgtgcatatttatctagg

SEQ ID NO: 7556516 - DNA, 22 bp, Homo sapiens
ctgctgtgccttaaaatgcaag

SEQ ID NO: 7556517 - DNA, 22 bp, Homo sapiens
ctgctgtgcctcttttcacgtg

SEQ ID NO: 7556518 - DNA, 22 bp, Homo sapiens
ctgctgtggatgcaggacctca

SEQ ID NO: 7556519 - DNA, 22 bp, Homo sapiens
ctgctgtgcttgtggccacccg

SEQ ID NO: 7556520 - DNA, 22 bp, Homo sapiens
ctgctgtgcttgtggccacccg

SEQ ID NO: 7556521 - DNA, 22 bp, Homo sapiens
ctgctgtgcttgtggccacccg

SEQ ID NO: 7556522 - DNA, 22 bp, Homo sapiens
ctgctgtgcttgtggccacccg

SEQ ID NO: 7556523 - DNA, 22 bp, Homo sapiens
ctgctgtgcaggtgcctatgat

SEQ ID NO: 7556524 - DNA, 22 bp, Homo sapiens
ctgctgtgcaggtgcctatgat

SEQ ID NO: 7556525 - DNA, 22 bp, Homo sapiens
ctgctgtgcagacagactctct

SEQ ID NO: 7556526 - DNA, 22 bp, Homo sapiens
ctgctgtgcagacagactctct

SEQ ID NO: 7556527 - DNA, 22 bp, Homo sapiens
ctgctgtgcagacagactctct

SEQ ID NO: 7556528 - DNA, 22 bp, Homo sapiens
ctgctgtgcaggtgcctatgat

SEQ ID NO: 7556529 - DNA, 22 bp, Homo sapiens
ctgctgtgcaggtgcctatgat

SEQ ID NO: 7556530 - DNA, 22 bp, Homo sapiens
ctgctggggtcagagcactggg

SEQ ID NO: 7556531 - DNA, 22 bp, Homo sapiens
ctgctggggtcagagcactggg

SEQ ID NO: 7556532 - DNA, 22 bp, Homo sapiens
ctgctgggggacacaggtccgg

SEQ ID NO: 7556533 - DNA, 22 bp, Homo sapiens
ctgctgggggacacaggtccgg

SEQ ID NO: 7556534 - DNA, 22 bp, Homo sapiens
ctgctgggggacacaggtccgg

SEQ ID NO: 7556535 - DNA, 22 bp, Homo sapiens
ctgctgggggacacaggtccgg

SEQ ID NO: 7556536 - DNA, 22 bp, Homo sapiens
ctgctgggggacacaggtccgg

SEQ ID NO: 7556537 - DNA, 22 bp, Homo sapiens
ctgctggggtcagagcactggg

SEQ ID NO: 7556538 - DNA, 22 bp, Homo sapiens
ctgctggggtcagagcactggg

SEQ ID NO: 7556539 - DNA, 22 bp, Homo sapiens
ctgctggggtcagagcactggg

SEQ ID NO: 7556540 - DNA, 22 bp, Homo sapiens
ctgctggggtcagagcactggg

SEQ ID NO: 7556541 - DNA, 22 bp, Homo sapiens
ctgctggggtcagagcactggg

SEQ ID NO: 7556542 - DNA, 22 bp, Homo sapiens
ctgctggggtcagagcactggg

SEQ ID NO: 7556543 - DNA, 22 bp, Homo sapiens
ctgctggggtcagagcactggg

SEQ ID NO: 7556544 - DNA, 22 bp, Homo sapiens
ctggcacacagcaggctctcag

SEQ ID NO: 7556545 - DNA, 22 bp, Homo sapiens
ctggcacacagcaggctctcag

SEQ ID NO: 7556546 - DNA, 22 bp, Homo sapiens
ctggcacacagcaggctctcag

SEQ ID NO: 7556547 - DNA, 22 bp, Homo sapiens
ctggcacacagcaggctctcag

SEQ ID NO: 7556548 - DNA, 22 bp, Homo sapiens
ctggcacacagcaggctctcag

SEQ ID NO: 7556549 - DNA, 22 bp, Homo sapiens
ctggcacacagcaggctctcag

SEQ ID NO: 7556550 - DNA, 22 bp, Homo sapiens
ctggcacacagaggccctcggg

SEQ ID NO: 7556551 - DNA, 22 bp, Homo sapiens
ctggcacacagaggccctcggg

SEQ ID NO: 7556552 - DNA, 22 bp, Homo sapiens
ctggcacacaagtatttccttt

SEQ ID NO: 7556553 - DNA, 22 bp, Homo sapiens
ctggcacacaagtatttccttt

SEQ ID NO: 7556554 - DNA, 22 bp, Homo sapiens
ctggcacaatgtcacttttgct

SEQ ID NO: 7556555 - DNA, 22 bp, Homo sapiens
ctggcaagtactgggccagctc

SEQ ID NO: 7556556 - DNA, 22 bp, Homo sapiens
ctggcaagtggttgggatggat

SEQ ID NO: 7556557 - DNA, 22 bp, Homo sapiens
ctggcaagtggttgggatggat

SEQ ID NO: 7556558 - DNA, 22 bp, Homo sapiens
ctggcaagtggttgggatggat

SEQ ID NO: 7556559 - DNA, 22 bp, Homo sapiens
ctggcacaaaagaaaactgcca

SEQ ID NO: 7556560 - DNA, 22 bp, Homo sapiens
ctggcacaaaagaaaactgcca

SEQ ID NO: 7556561 - DNA, 22 bp, Homo sapiens
ctggcacaactccacctcagcg

SEQ ID NO: 7556562 - DNA, 22 bp, Homo sapiens
ctggcacaactccacctcagcg

SEQ ID NO: 7556563 - DNA, 22 bp, Homo sapiens
ctggcacaactccacctcagcg

SEQ ID NO: 7556564 - DNA, 22 bp, Homo sapiens
ctggcacaactccacctcagcg

SEQ ID NO: 7556565 - DNA, 22 bp, Homo sapiens
ctggcacaaatggaaaccaagc

SEQ ID NO: 7556566 - DNA, 22 bp, Homo sapiens
ctggcaatgggagtagtagggt

SEQ ID NO: 7556567 - DNA, 22 bp, Homo sapiens
ctggcacaaaagaaaactgcca

SEQ ID NO: 7556568 - DNA, 22 bp, Homo sapiens
ctggcacacagcaggctctcag

SEQ ID NO: 7556569 - DNA, 22 bp, Homo sapiens
ctggcacacagtaggcaccaat

SEQ ID NO: 7556570 - DNA, 22 bp, Homo sapiens
ctggcacacagtaggcaccaat

SEQ ID NO: 7556571 - DNA, 22 bp, Homo sapiens
ctggcacacagtaggcaccaat

SEQ ID NO: 7556572 - DNA, 22 bp, Homo sapiens
ctggcacacagtaggcaccaat

SEQ ID NO: 7556573 - DNA, 22 bp, Homo sapiens
ctggcacacagtaggcaccaat

SEQ ID NO: 7556574 - DNA, 22 bp, Homo sapiens
ctggcacagagacagaaggatt

SEQ ID NO: 7556575 - DNA, 22 bp, Homo sapiens
ctggcacagagacagaaggatt

SEQ ID NO: 7556576 - DNA, 22 bp, Homo sapiens
ctggcacagagacagaaggatt

SEQ ID NO: 7556577 - DNA, 22 bp, Homo sapiens
ctggcacagagacagaaggatt

SEQ ID NO: 7556578 - DNA, 22 bp, Homo sapiens
ctggcacacgtggcagggtagg

SEQ ID NO: 7556579 - DNA, 22 bp, Homo sapiens
ctggcacacgtggcagggtagg

SEQ ID NO: 7556580 - DNA, 22 bp, Homo sapiens
ctggcacacgtggcagggtagg

SEQ ID NO: 7556581 - DNA, 22 bp, Homo sapiens
ctggcacacgtggcagggtagg

SEQ ID NO: 7556582 - DNA, 22 bp, Homo sapiens
ctggcacagccactgcaggcag

SEQ ID NO: 7556583 - DNA, 22 bp, Homo sapiens
ctggcacagccactgcaggcag

SEQ ID NO: 7556584 - DNA, 22 bp, Homo sapiens
ctggcacagagtgagcattcaa

SEQ ID NO: 7556585 - DNA, 22 bp, Homo sapiens
ctggcacagagtgagcattcaa

SEQ ID NO: 7556586 - DNA, 22 bp, Homo sapiens
ctggcacagccactgcaggcag

SEQ ID NO: 7556587 - DNA, 22 bp, Homo sapiens
ctggcacagccactgcaggcag

SEQ ID NO: 7556588 - DNA, 22 bp, Homo sapiens
ctggcacagagtgagcattcaa

SEQ ID NO: 7556589 - DNA, 22 bp, Homo sapiens
ctggcacagagacagaaggatt

SEQ ID NO: 7556590 - DNA, 22 bp, Homo sapiens
ctggcacagagtgagcattcaa

SEQ ID NO: 7556591 - DNA, 22 bp, Homo sapiens
ctggcacagagtgagcattcaa

SEQ ID NO: 7556592 - DNA, 22 bp, Homo sapiens
ctggcacagagtgagcattcaa

SEQ ID NO: 7556593 - DNA, 22 bp, Homo sapiens
ctggcacagagtgagcattcaa

SEQ ID NO: 7556594 - DNA, 22 bp, Homo sapiens
ctggcacagagtgagcattcaa

SEQ ID NO: 7556595 - DNA, 22 bp, Homo sapiens
ctggcacagagacagaaggatt

SEQ ID NO: 7556596 - DNA, 20 bp, Homo sapiens
atacacatgcagacagatgc

SEQ ID NO: 7556597 - DNA, 20 bp, Homo sapiens
atacacatgcagacagatgc

SEQ ID NO: 7556598 - DNA, 20 bp, Homo sapiens
atacacatgcagacagatgc

SEQ ID NO: 7556599 - DNA, 20 bp, Homo sapiens
atacacatgcagacagatgc

SEQ ID NO: 7556600 - DNA, 20 bp, Homo sapiens
atacacatgcagacagatgc

SEQ ID NO: 7556601 - DNA, 20 bp, Homo sapiens
atacacatgcagacagatgc

SEQ ID NO: 7556602 - DNA, 22 bp, Homo sapiens
atacacatgtgtatgtgcatgc

SEQ ID NO: 7556603 - DNA, 22 bp, Homo sapiens
atacacatgtgtatgtgcatgc

SEQ ID NO: 7556604 - DNA, 22 bp, Homo sapiens
atacacatgtgtatgtgcatgc

SEQ ID NO: 7556605 - DNA, 20 bp, Homo sapiens
atacacatgcagacagatgc

SEQ ID NO: 7556606 - DNA, 20 bp, Homo sapiens
atacacatgcagacagatgc

SEQ ID NO: 7556607 - DNA, 22 bp, Homo sapiens
atacacatgtgtatgtgcatgc

SEQ ID NO: 7556608 - DNA, 22 bp, Homo sapiens
atacacatgttattgtggaagc

SEQ ID NO: 7556609 - DNA, 22 bp, Homo sapiens
atacacattactttctgtctga

SEQ ID NO: 7556610 - DNA, 22 bp, Homo sapiens
atacacatgttattgtggaagc

SEQ ID NO: 7556611 - DNA, 22 bp, Homo sapiens
atacacatgtgtatgtgcatgc

SEQ ID NO: 7556612 - DNA, 22 bp, Homo sapiens
atacacatgtgtatgtgcatgc

SEQ ID NO: 7556613 - DNA, 22 bp, Homo sapiens
atacacattactttctgtctga

SEQ ID NO: 7556614 - DNA, 22 bp, Homo sapiens
atacacattactttctgtctga

SEQ ID NO: 7556615 - DNA, 22 bp, Homo sapiens
atacacattactttctgtctga

SEQ ID NO: 7556616 - DNA, 20 bp, Homo sapiens
atacacattcatagaaaaat

SEQ ID NO: 7556617 - DNA, 20 bp, Homo sapiens
atacacattcatagaaaaat

SEQ ID NO: 7556618 - DNA, 20 bp, Homo sapiens
atacacattcatagaaaaat

SEQ ID NO: 7556619 - DNA, 20 bp, Homo sapiens
atacacattcatagaaaaat

SEQ ID NO: 7556620 - DNA, 20 bp, Homo sapiens
atacacattcatagaaaaat

SEQ ID NO: 7556621 - DNA, 20 bp, Homo sapiens
atacacattcatagaaaaat

SEQ ID NO: 7556622 - DNA, 22 bp, Homo sapiens
ctggcaagtactgggccagctc

SEQ ID NO: 7556623 - DNA, 22 bp, Homo sapiens
ctggcaagtactgggccagctc

SEQ ID NO: 7556624 - DNA, 22 bp, Homo sapiens
ctggagtggccggtgctgtggc

SEQ ID NO: 7556625 - DNA, 22 bp, Homo sapiens
ctggcaagtactgggccagctc

SEQ ID NO: 7556626 - DNA, 22 bp, Homo sapiens
ctggagtggccggtgctgtggc

SEQ ID NO: 7556627 - DNA, 22 bp, Homo sapiens
ctggagtgcagtggcatgatca

SEQ ID NO: 7556628 - DNA, 22 bp, Homo sapiens
ctggagtggccggtgctgtggc

SEQ ID NO: 7556629 - DNA, 22 bp, Homo sapiens
ctggagtggccggtgctgtggc

SEQ ID NO: 7556630 - DNA, 22 bp, Homo sapiens
ctggagtgcagtggcatgatca

SEQ ID NO: 7556631 - DNA, 20 bp, Homo sapiens
atacacattcatagaaaaat

SEQ ID NO: 7556632 - DNA, 22 bp, Homo sapiens
atacatgtgggtctaaacatat

SEQ ID NO: 7556633 - DNA, 22 bp, Homo sapiens
atacatgtgggtctaaacatat

SEQ ID NO: 7556634 - DNA, 22 bp, Homo sapiens
atacatgtgggtctaaacatat

SEQ ID NO: 7556635 - DNA, 22 bp, Homo sapiens
atacatgtgtccctgatttatt

SEQ ID NO: 7556636 - DNA, 22 bp, Homo sapiens
atacatgtgtccctgatttatt

SEQ ID NO: 7556637 - DNA, 22 bp, Homo sapiens
atacatgtgtccctgatttatt

SEQ ID NO: 7556638 - DNA, 22 bp, Homo sapiens
atacatgtgtccctgatttatt

SEQ ID NO: 7556639 - DNA, 22 bp, Homo sapiens
atacatgtgtgtgcatacatgt

SEQ ID NO: 7556640 - DNA, 22 bp, Homo sapiens
atacatgtgtgtgcatacatgt

SEQ ID NO: 7556641 - DNA, 22 bp, Homo sapiens
atacatgtgtgtgcatacatgt

SEQ ID NO: 7556642 - DNA, 22 bp, Homo sapiens
atacatgtgtgtgcatacatgt

SEQ ID NO: 7556643 - DNA, 22 bp, Homo sapiens
atacatgtgtgagcgaagatgt

SEQ ID NO: 7556644 - DNA, 22 bp, Homo sapiens
ctggcagcttagcactctggtt

SEQ ID NO: 7556645 - DNA, 22 bp, Homo sapiens
ctggcagcttagcactctggtt

SEQ ID NO: 7556646 - DNA, 22 bp, Homo sapiens
atacatgtcatcatatgtttgt

SEQ ID NO: 7556647 - DNA, 22 bp, Homo sapiens
atacatgtacataaatgtagca

SEQ ID NO: 7556648 - DNA, 22 bp, Homo sapiens
atacatgtcatcatatgtttgt

SEQ ID NO: 7556649 - DNA, 22 bp, Homo sapiens
atacatgtcatcatatgtttgt

SEQ ID NO: 7556650 - DNA, 22 bp, Homo sapiens
atacatgtcatcatatgtttgt

SEQ ID NO: 7556651 - DNA, 22 bp, Homo sapiens
atacatgtacataaatgtagca

SEQ ID NO: 7556652 - DNA, 22 bp, Homo sapiens
atacatgtaactgcattgtaat

SEQ ID NO: 7556653 - DNA, 22 bp, Homo sapiens
atacatgtcatcatatgtttgt

SEQ ID NO: 7556654 - DNA, 22 bp, Homo sapiens
atacatgtgggtctaaacatat

SEQ ID NO: 7556655 - DNA, 22 bp, Homo sapiens
atacatgtgggtctaaacatat

SEQ ID NO: 7556656 - DNA, 22 bp, Homo sapiens
atacatgtgggtctaaacatat

SEQ ID NO: 7556657 - DNA, 22 bp, Homo sapiens
atacatgtgggtctaaacatat

SEQ ID NO: 7556658 - DNA, 22 bp, Homo sapiens
atacatgtgggtctaaacatat

SEQ ID NO: 7556659 - DNA, 22 bp, Homo sapiens
atacatgtgggtctaaacatat

SEQ ID NO: 7556660 - DNA, 22 bp, Homo sapiens
atacatgtaactgcattgtaat

SEQ ID NO: 7556661 - DNA, 22 bp, Homo sapiens
atacatgtaactgcattgtaat

SEQ ID NO: 7556662 - DNA, 22 bp, Homo sapiens
atacatgtaactgcattgtaat

SEQ ID NO: 7556663 - DNA, 22 bp, Homo sapiens
atacatgtaactgcattgtaat

SEQ ID NO: 7556664 - DNA, 22 bp, Homo sapiens
atacatgtaactgcattgtaat

SEQ ID NO: 7556665 - DNA, 22 bp, Homo sapiens
atacatggaagatgcttagcac

SEQ ID NO: 7556666 - DNA, 23 bp, Homo sapiens
atacatggccggatatgatgttc

SEQ ID NO: 7556667 - DNA, 23 bp, Homo sapiens
atacatggccggatatgatgttc

SEQ ID NO: 7556668 - DNA, 17 bp, Homo sapiens
atacatgtaaagtgctt

SEQ ID NO: 7556669 - DNA, 22 bp, Homo sapiens
atacatgggtctcctgtcttag

SEQ ID NO: 7556670 - DNA, 22 bp, Homo sapiens
atacatgcacatttttatacat

SEQ ID NO: 7556671 - DNA, 22 bp, Homo sapiens
atacatgatgggtgtatagttt

SEQ ID NO: 7556672 - DNA, 22 bp, Homo sapiens
atacatgatgggtgtatagttt

SEQ ID NO: 7556673 - DNA, 22 bp, Homo sapiens
atacatgatcactgtattataa

SEQ ID NO: 7556674 - DNA, 19 bp, Homo sapiens
atacatgcatttacatgct

SEQ ID NO: 7556675 - DNA, 22 bp, Homo sapiens
atacatgcgccatgttggtgtg

SEQ ID NO: 7556676 - DNA, 22 bp, Homo sapiens
atacatgcgccatgttggtgtg

SEQ ID NO: 7556677 - DNA, 19 bp, Homo sapiens
atacatgcatttacatgct

SEQ ID NO: 7556678 - DNA, 22 bp, Homo sapiens
ctggcacataattagtgatcct

SEQ ID NO: 7556679 - DNA, 22 bp, Homo sapiens
ctggcacataattagtgatcct

SEQ ID NO: 7556680 - DNA, 22 bp, Homo sapiens
ctggcacataattagtgatcct

SEQ ID NO: 7556681 - DNA, 22 bp, Homo sapiens
ctggcacatagcaaatctcaac

SEQ ID NO: 7556682 - DNA, 22 bp, Homo sapiens
ctggcacatagcaaatctcaac

SEQ ID NO: 7556683 - DNA, 22 bp, Homo sapiens
ctggcacataattagtgatcct

SEQ ID NO: 7556684 - DNA, 22 bp, Homo sapiens
ctggcacaggatccgagacctt

SEQ ID NO: 7556685 - DNA, 20 bp, Homo sapiens
ctggcacagggtccgtcctt

SEQ ID NO: 7556686 - DNA, 22 bp, Homo sapiens
ctggcacagttaacatatgcta

SEQ ID NO: 7556687 - DNA, 22 bp, Homo sapiens
ctggcacagttaacatatgcta

SEQ ID NO: 7556688 - DNA, 20 bp, Homo sapiens
ctggcacagggtccgtcctt

SEQ ID NO: 7556689 - DNA, 22 bp, Homo sapiens
ctggcacagcttgggccccatc

SEQ ID NO: 7556690 - DNA, 22 bp, Homo sapiens
ctggcacagcttgggccccatc

SEQ ID NO: 7556691 - DNA, 22 bp, Homo sapiens
ctggcacagcttgggccccatc

SEQ ID NO: 7556692 - DNA, 22 bp, Homo sapiens
ctggcacaggatccgagacctt

SEQ ID NO: 7556693 - DNA, 22 bp, Homo sapiens
ctggcacagccactgcaggcag

SEQ ID NO: 7556694 - DNA, 22 bp, Homo sapiens
ctggcacagcttgggccccatc

SEQ ID NO: 7556695 - DNA, 22 bp, Homo sapiens
ctggcacagccactgcaggcag

SEQ ID NO: 7556696 - DNA, 22 bp, Homo sapiens
ctggcacagcttgggccccatc

SEQ ID NO: 7556697 - DNA, 22 bp, Homo sapiens
ctggcacagccactgcaggcag

SEQ ID NO: 7556698 - DNA, 22 bp, Homo sapiens
ctggcacagccactgcaggcag

SEQ ID NO: 7556699 - DNA, 22 bp, Homo sapiens
ctggcacagccactgcaggcag

SEQ ID NO: 7556700 - DNA, 22 bp, Homo sapiens
ctggcctcagagggtcatggtg

SEQ ID NO: 7556701 - DNA, 22 bp, Homo sapiens
ctggcctcacctcagacttact

SEQ ID NO: 7556702 - DNA, 22 bp, Homo sapiens
ctggcctcagagggtcatggtg

SEQ ID NO: 7556703 - DNA, 22 bp, Homo sapiens
ctggcctcagagggtcatggtg

SEQ ID NO: 7556704 - DNA, 22 bp, Homo sapiens
ctggcctcagagggtcatggtg

SEQ ID NO: 7556705 - DNA, 22 bp, Homo sapiens
ctggcctcagagggtcatggtg

SEQ ID NO: 7556706 - DNA, 22 bp, Homo sapiens
ctggcctcagagggtcatggtg

SEQ ID NO: 7556707 - DNA, 22 bp, Homo sapiens
ctggcctcatagccaagctgtg

SEQ ID NO: 7556708 - DNA, 22 bp, Homo sapiens
ctggcctcatagccaagctgtg

SEQ ID NO: 7556709 - DNA, 22 bp, Homo sapiens
ctggcctcatagccaagctgtg

SEQ ID NO: 7556710 - DNA, 22 bp, Homo sapiens
ctggcctcatagccaagctgtg

SEQ ID NO: 7556711 - DNA, 22 bp, Homo sapiens
ctggcctcatagccaagctgtg

SEQ ID NO: 7556712 - DNA, 22 bp, Homo sapiens
ctggcctcatagccaagctgtg

SEQ ID NO: 7556713 - DNA, 22 bp, Homo sapiens
ctggcctcacctcagacttact

SEQ ID NO: 7556714 - DNA, 22 bp, Homo sapiens
ctggcctcggcagcaggaacag

SEQ ID NO: 7556715 - DNA, 23 bp, Homo sapiens
ctggcctccgacactggccaaga

SEQ ID NO: 7556716 - DNA, 23 bp, Homo sapiens
ctggcctccgacactggccaaga

SEQ ID NO: 7556717 - DNA, 23 bp, Homo sapiens
ctggcctccgacactggccaaga

SEQ ID NO: 7556718 - DNA, 22 bp, Homo sapiens
ctggcctaggaatggttttccg

SEQ ID NO: 7556719 - DNA, 22 bp, Homo sapiens
ctggcctaaaattgcttctgca

SEQ ID NO: 7556720 - DNA, 22 bp, Homo sapiens
ctggcctcacagaggctaagcc

SEQ ID NO: 7556721 - DNA, 22 bp, Homo sapiens
ctggcctcacagaggctaagcc

SEQ ID NO: 7556722 - DNA, 22 bp, Homo sapiens
ctggcctcacagaggctaagcc

SEQ ID NO: 7556723 - DNA, 22 bp, Homo sapiens
ctggcctcacagaggctaagcc

SEQ ID NO: 7556724 - DNA, 22 bp, Homo sapiens
ctggcctaggaatggttttccg

SEQ ID NO: 7556725 - DNA, 22 bp, Homo sapiens
ctggcctcacctcagacttact

SEQ ID NO: 7556726 - DNA, 22 bp, Homo sapiens
ctggcctcacagaggctaagcc

SEQ ID NO: 7556727 - DNA, 22 bp, Homo sapiens
ctggccggtatttgcctctggg

SEQ ID NO: 7556728 - DNA, 22 bp, Homo sapiens
ctggccggtatttgcctctggg

SEQ ID NO: 7556729 - DNA, 22 bp, Homo sapiens
ctggccgcctggggccgggtga

SEQ ID NO: 7556730 - DNA, 22 bp, Homo sapiens
ctggcctaaaattgcttctgca

SEQ ID NO: 7556731 - DNA, 22 bp, Homo sapiens
ctggcctaaaattgcttctgca

SEQ ID NO: 7556732 - DNA, 22 bp, Homo sapiens
ctggcctaaaaatacagaacaa

SEQ ID NO: 7556733 - DNA, 22 bp, Homo sapiens
ctggcctaaaaatacagaacaa

SEQ ID NO: 7556734 - DNA, 22 bp, Homo sapiens
ctggcctaaaaatacagaacaa

SEQ ID NO: 7556735 - DNA, 22 bp, Homo sapiens
ctggcctaaaaatacagaacaa

SEQ ID NO: 7556736 - DNA, 22 bp, Homo sapiens
ctggcccttctcttgcttcctg

SEQ ID NO: 7556737 - DNA, 22 bp, Homo sapiens
ctggcccttgacttacagcagg

SEQ ID NO: 7556738 - DNA, 22 bp, Homo sapiens
ctggcccttctcttgcttcctg

SEQ ID NO: 7556739 - DNA, 22 bp, Homo sapiens
ctggcccttgacttacagcagg

SEQ ID NO: 7556740 - DNA, 22 bp, Homo sapiens
ctggcccttgacttacagcagg

SEQ ID NO: 7556741 - DNA, 22 bp, Homo sapiens
ctggcccttgacttacagcagg

SEQ ID NO: 7556742 - DNA, 22 bp, Homo sapiens
ctggccctatgagcctcctgat

SEQ ID NO: 7556743 - DNA, 22 bp, Homo sapiens
ctggccctatgagcctcctgat

SEQ ID NO: 7556744 - DNA, 22 bp, Homo sapiens
ctggccctatgagcctcctgat

SEQ ID NO: 7556745 - DNA, 22 bp, Homo sapiens
ctggccctatgagcctcctgat

SEQ ID NO: 7556746 - DNA, 22 bp, Homo sapiens
ctggccctatgagcctcctgat

SEQ ID NO: 7556747 - DNA, 22 bp, Homo sapiens
ctggccagaggttcctctgccc

SEQ ID NO: 7556748 - DNA, 22 bp, Homo sapiens
ctggccagaggttcctctgccc

SEQ ID NO: 7556749 - DNA, 22 bp, Homo sapiens
ctggccagaggttcctctgccc

SEQ ID NO: 7556750 - DNA, 22 bp, Homo sapiens
ctggccagaggttcctctgccc

SEQ ID NO: 7556751 - DNA, 22 bp, Homo sapiens
ctggccagaggttcctctgccc

SEQ ID NO: 7556752 - DNA, 22 bp, Homo sapiens
ctggccagaggttcctctgccc

SEQ ID NO: 7556753 - DNA, 22 bp, Homo sapiens
ctggccctatgagcctcctgat

SEQ ID NO: 7556754 - DNA, 22 bp, Homo sapiens
ctggccctaggcaaacacagat

SEQ ID NO: 7556755 - DNA, 22 bp, Homo sapiens
ctggccagactacacatgtgtg

SEQ ID NO: 7556756 - DNA, 22 bp, Homo sapiens
ctggccagactacacatgtgtg

SEQ ID NO: 7556757 - DNA, 22 bp, Homo sapiens
ctggccagaggttcctctgccc

SEQ ID NO: 7556758 - DNA, 22 bp, Homo sapiens
ctggccagactacacatgtgtg

SEQ ID NO: 7556759 - DNA, 20 bp, Homo sapiens
ctggccagaacgcctacaca

SEQ ID NO: 7556760 - DNA, 20 bp, Homo sapiens
ctggccagaacgcctacaca

SEQ ID NO: 7556761 - DNA, 20 bp, Homo sapiens
ctggccagaacgcctacaca

SEQ ID NO: 7556762 - DNA, 20 bp, Homo sapiens
ctggccagaacgcctacaca

SEQ ID NO: 7556763 - DNA, 22 bp, Homo sapiens
ctggccagaagcacctttggcg

SEQ ID NO: 7556764 - DNA, 22 bp, Homo sapiens
ctggccagaagcacctttggcg

SEQ ID NO: 7556765 - DNA, 22 bp, Homo sapiens
ctggccagaagcacctttggcg

SEQ ID NO: 7556766 - DNA, 22 bp, Homo sapiens
ctggccagactacacatgtgtg

SEQ ID NO: 7556767 - DNA, 22 bp, Homo sapiens
ctggccagactacacatgtgtg

SEQ ID NO: 7556768 - DNA, 22 bp, Homo sapiens
ctggccagactacacatgtgtg

SEQ ID NO: 7556769 - DNA, 22 bp, Homo sapiens
ctggccagactacacatgtgtg

SEQ ID NO: 7556770 - DNA, 22 bp, Homo sapiens
ctggccagactacacatgtgtg

SEQ ID NO: 7556771 - DNA, 22 bp, Homo sapiens
ctggccagaagcacctttggcg

SEQ ID NO: 7556772 - DNA, 22 bp, Homo sapiens
ctggccagaagcacctttggcg

SEQ ID NO: 7556773 - DNA, 22 bp, Homo sapiens
ctggccagaagcacctttggcg

SEQ ID NO: 7556774 - DNA, 22 bp, Homo sapiens
ctggcaggtttggtgtctggtg

SEQ ID NO: 7556775 - DNA, 22 bp, Homo sapiens
ctggcaggtttggtgtctggtg

SEQ ID NO: 7556776 - DNA, 22 bp, Homo sapiens
ctggcaggtttggtgtctggtg

SEQ ID NO: 7556777 - DNA, 22 bp, Homo sapiens
ctggcaggtttggtgtctggtg

SEQ ID NO: 7556778 - DNA, 22 bp, Homo sapiens
ctggcaggtttggtgtctggtg

SEQ ID NO: 7556779 - DNA, 22 bp, Homo sapiens
ctggcaggttatagagctgccc

SEQ ID NO: 7556780 - DNA, 22 bp, Homo sapiens
ctggcaggttatagagctgccc

SEQ ID NO: 7556781 - DNA, 22 bp, Homo sapiens
ctggcaggttatagagctgccc

SEQ ID NO: 7556782 - DNA, 22 bp, Homo sapiens
ctggcaggtttggtgtctggtg

SEQ ID NO: 7556783 - DNA, 22 bp, Homo sapiens
ctggcaggtttggtgtctggtg

SEQ ID NO: 7556784 - DNA, 22 bp, Homo sapiens
ctggcaggtttggtgtctggtg

SEQ ID NO: 7556785 - DNA, 22 bp, Homo sapiens
ctggcaggtttggtgtctggtg

SEQ ID NO: 7556786 - DNA, 22 bp, Homo sapiens
ctggcaggtttggtgtctggtg

SEQ ID NO: 7556787 - DNA, 22 bp, Homo sapiens
ctggcagtattaagagaagtga

SEQ ID NO: 7556788 - DNA, 22 bp, Homo sapiens
ctggcagtattaagagaagtga

SEQ ID NO: 7556789 - DNA, 22 bp, Homo sapiens
ctggccactgcgggcctctgcc

SEQ ID NO: 7556790 - DNA, 22 bp, Homo sapiens
ctggccactggaggtggcaccc

SEQ ID NO: 7556791 - DNA, 22 bp, Homo sapiens
ctggccactgcgggcctctgcc

SEQ ID NO: 7556792 - DNA, 22 bp, Homo sapiens
ctggccactggaggtggcaccc

SEQ ID NO: 7556793 - DNA, 22 bp, Homo sapiens
ctggccactgcgggcctctgcc

SEQ ID NO: 7556794 - DNA, 22 bp, Homo sapiens
ctggccactgcgggcctctgcc

SEQ ID NO: 7556795 - DNA, 22 bp, Homo sapiens
ctggccactgcgggcctctgcc

SEQ ID NO: 7556796 - DNA, 22 bp, Homo sapiens
ctggccactgcgggcctctgcc

SEQ ID NO: 7556797 - DNA, 22 bp, Homo sapiens
ctggccactgcgggcctctgcc

SEQ ID NO: 7556798 - DNA, 22 bp, Homo sapiens
ctggccactgcgggcctctgcc

SEQ ID NO: 7556799 - DNA, 22 bp, Homo sapiens
ctggccactgcgggcctctgcc

SEQ ID NO: 7556800 - DNA, 20 bp, Homo sapiens
ctggccagaacgcctacaca

SEQ ID NO: 7556801 - DNA, 22 bp, Homo sapiens
ctggccactggtggtcataggc

SEQ ID NO: 7556802 - DNA, 22 bp, Homo sapiens
ctggccactggtggtcataggc

SEQ ID NO: 7556803 - DNA, 20 bp, Homo sapiens
ctggccagaacgcctacaca

SEQ ID NO: 7556804 - DNA, 20 bp, Homo sapiens
ctggccagaacgcctacaca

SEQ ID NO: 7556805 - DNA, 20 bp, Homo sapiens
ctggccagaacgcctacaca

SEQ ID NO: 7556806 - DNA, 20 bp, Homo sapiens
ctggccagaacgcctacaca

SEQ ID NO: 7556807 - DNA, 22 bp, Homo sapiens
ctggccactggtggtcataggc

SEQ ID NO: 7556808 - DNA, 22 bp, Homo sapiens
ctggccactggaggtggcaccc

SEQ ID NO: 7556809 - DNA, 22 bp, Homo sapiens
ctggccactggtggtcataggc

SEQ ID NO: 7556810 - DNA, 22 bp, Homo sapiens
ctggccactggaggtggcaccc

SEQ ID NO: 7556811 - DNA, 22 bp, Homo sapiens
ctggccactggaggtggcaccc

SEQ ID NO: 7556812 - DNA, 22 bp, Homo sapiens
ctggcaggtggaggttgcagtg

SEQ ID NO: 7556813 - DNA, 22 bp, Homo sapiens
ctggcaggtggaggttgcagtg

SEQ ID NO: 7556814 - DNA, 22 bp, Homo sapiens
ctggcaggtggaggttgcagtg

SEQ ID NO: 7556815 - DNA, 22 bp, Homo sapiens
ctggcaggtggaggttgcagtg

SEQ ID NO: 7556816 - DNA, 22 bp, Homo sapiens
ctggcaggtggaggttgcagtg

SEQ ID NO: 7556817 - DNA, 22 bp, Homo sapiens
ctggcaggtggatggggactcc

SEQ ID NO: 7556818 - DNA, 22 bp, Homo sapiens
ctggcaggtggatggggactcc

SEQ ID NO: 7556819 - DNA, 22 bp, Homo sapiens
ctggcaggtggatggggactcc

SEQ ID NO: 7556820 - DNA, 22 bp, Homo sapiens
ctggcaggtggatggggactcc

SEQ ID NO: 7556821 - DNA, 22 bp, Homo sapiens
ctggcaggtggatggggactcc

SEQ ID NO: 7556822 - DNA, 22 bp, Homo sapiens
ctggcaggttatagagctgccc

SEQ ID NO: 7556823 - DNA, 22 bp, Homo sapiens
ctggcaggttatagagctgccc

SEQ ID NO: 7556824 - DNA, 22 bp, Homo sapiens
ctggcaggtggatggggactcc

SEQ ID NO: 7556825 - DNA, 22 bp, Homo sapiens
ctggcaggtggatggggactcc

SEQ ID NO: 7556826 - DNA, 22 bp, Homo sapiens
ctggcaggttatagagctgccc

SEQ ID NO: 7556827 - DNA, 22 bp, Homo sapiens
ctggcaggttatagagctgccc

SEQ ID NO: 7556828 - DNA, 22 bp, Homo sapiens
ctggcaggttatagagctgccc

SEQ ID NO: 7556829 - DNA, 22 bp, Homo sapiens
ctggcaggttatagagctgccc

SEQ ID NO: 7556830 - DNA, 22 bp, Homo sapiens
ctggcaggttatagagctgccc

SEQ ID NO: 7556831 - DNA, 22 bp, Homo sapiens
ctggcaggttatagagctgccc

SEQ ID NO: 7556832 - DNA, 22 bp, Homo sapiens
ctggcaggtggaggttgcagtg

SEQ ID NO: 7556833 - DNA, 22 bp, Homo sapiens
ctggcaggtggaggttgcagtg

SEQ ID NO: 7556834 - DNA, 22 bp, Homo sapiens
ctggcaggtggaggttgcagtg

SEQ ID NO: 7556835 - DNA, 22 bp, Homo sapiens
ctggcaggtggaggttgcagtg

SEQ ID NO: 7556836 - DNA, 22 bp, Homo sapiens
ctggcaggtggaggttgcagtg

SEQ ID NO: 7556837 - DNA, 22 bp, Homo sapiens
ctggcaggtggaggttgcagtg

SEQ ID NO: 7556838 - DNA, 22 bp, Homo sapiens
ctggcaggtggaggttgcagtg

SEQ ID NO: 7556839 - DNA, 22 bp, Homo sapiens
ctggcaggtctcgctgacgtgt

SEQ ID NO: 7556840 - DNA, 22 bp, Homo sapiens
ctggcaggtctcgctgacgtgt

SEQ ID NO: 7556841 - DNA, 22 bp, Homo sapiens
ctggcaggtctcgctgacgtgt

SEQ ID NO: 7556842 - DNA, 22 bp, Homo sapiens
ctggcaggtctcgctgacgtgt

SEQ ID NO: 7556843 - DNA, 22 bp, Homo sapiens
ctggcaggtctcgctgacgtgt

SEQ ID NO: 7556844 - DNA, 22 bp, Homo sapiens
ctggcagcttcaggacactcgg

SEQ ID NO: 7556845 - DNA, 22 bp, Homo sapiens
ctggcaggtccagctggactca

SEQ ID NO: 7556846 - DNA, 22 bp, Homo sapiens
ctggcagcttattagaaatgca

SEQ ID NO: 7556847 - DNA, 22 bp, Homo sapiens
ctggcagcttattagaaatgca

SEQ ID NO: 7556848 - DNA, 22 bp, Homo sapiens
ctggcaggtccagctggactca

SEQ ID NO: 7556849 - DNA, 22 bp, Homo sapiens
ctggcaggtctcgctgacgtgt

SEQ ID NO: 7556850 - DNA, 22 bp, Homo sapiens
ctggcaggtccagctggactca

SEQ ID NO: 7556851 - DNA, 22 bp, Homo sapiens
ctggcaggtccagctggactca

SEQ ID NO: 7556852 - DNA, 22 bp, Homo sapiens
ctggcaggtccagctggactca

SEQ ID NO: 7556853 - DNA, 19 bp, Homo sapiens
ctggctgcaatgccagggt

SEQ ID NO: 7556854 - DNA, 19 bp, Homo sapiens
ctggctgcaatgccagggt

SEQ ID NO: 7556855 - DNA, 19 bp, Homo sapiens
ctggctgcaatgccagggt

SEQ ID NO: 7556856 - DNA, 19 bp, Homo sapiens
ctggctgcaatgccagggt

SEQ ID NO: 7556857 - DNA, 19 bp, Homo sapiens
ctggctgcaatgccagggt

SEQ ID NO: 7556858 - DNA, 19 bp, Homo sapiens
ctggctgcaatgccagggt

SEQ ID NO: 7556859 - DNA, 19 bp, Homo sapiens
ctggctgcaatgccagggt

SEQ ID NO: 7556860 - DNA, 19 bp, Homo sapiens
ctggctgcaatgccagggt

SEQ ID NO: 7556861 - DNA, 22 bp, Homo sapiens
ctggctgatctcaatcatggct

SEQ ID NO: 7556862 - DNA, 22 bp, Homo sapiens
ctggctgatctcaatcatggct

SEQ ID NO: 7556863 - DNA, 22 bp, Homo sapiens
ctggctgatctcctgaatgtct

SEQ ID NO: 7556864 - DNA, 22 bp, Homo sapiens
ctggctgcaaaatctattcact

SEQ ID NO: 7556865 - DNA, 22 bp, Homo sapiens
ctggctgcaaaatctattcact

SEQ ID NO: 7556866 - DNA, 22 bp, Homo sapiens
ctggctgattttctcacttctc

SEQ ID NO: 7556867 - DNA, 22 bp, Homo sapiens
ctggctgaggcagagcctgggg

SEQ ID NO: 7556868 - DNA, 22 bp, Homo sapiens
ctggctgaggcagagcctgggg

SEQ ID NO: 7556869 - DNA, 22 bp, Homo sapiens
ctggctgaggcagagcctgggg

SEQ ID NO: 7556870 - DNA, 22 bp, Homo sapiens
ctggctgaggtcaccagtagct

SEQ ID NO: 7556871 - DNA, 22 bp, Homo sapiens
ctggctgagttactccactgag

SEQ ID NO: 7556872 - DNA, 22 bp, Homo sapiens
ctggctgagttactccactgag

SEQ ID NO: 7556873 - DNA, 22 bp, Homo sapiens
ctggctgatctcaatcatggct

SEQ ID NO: 7556874 - DNA, 22 bp, Homo sapiens
atataatagtttcataaaggct

SEQ ID NO: 7556875 - DNA, 22 bp, Homo sapiens
atataatagtttcataaaggct

SEQ ID NO: 7556876 - DNA, 22 bp, Homo sapiens
atataatacaacctgctaagtg

SEQ ID NO: 7556877 - DNA, 19 bp, Homo sapiens
ctggctgcaatgccagggt

SEQ ID NO: 7556878 - DNA, 19 bp, Homo sapiens
ctggctgcaatgccagggt

SEQ ID NO: 7556879 - DNA, 22 bp, Homo sapiens
atataatacaacctgctaagtg

SEQ ID NO: 7556880 - DNA, 19 bp, Homo sapiens
ctggctgcaatgccagggt

SEQ ID NO: 7556881 - DNA, 22 bp, Homo sapiens
atatacacatttgcttatgtgt

SEQ ID NO: 7556882 - DNA, 22 bp, Homo sapiens
atatacacatttgcttatgtgt

SEQ ID NO: 7556883 - DNA, 22 bp, Homo sapiens
atatacacatttgcttatgtgt

SEQ ID NO: 7556884 - DNA, 22 bp, Homo sapiens
atatacacatttgcttatgtgt

SEQ ID NO: 7556885 - DNA, 22 bp, Homo sapiens
atatacacatgtgtatacattt

SEQ ID NO: 7556886 - DNA, 22 bp, Homo sapiens
atatacacatgtgtatacattt

SEQ ID NO: 7556887 - DNA, 22 bp, Homo sapiens
atataatagtttcataaaggct

SEQ ID NO: 7556888 - DNA, 22 bp, Homo sapiens
atatacacatgtgtatacattt

SEQ ID NO: 7556889 - DNA, 22 bp, Homo sapiens
atatacactccactgatacagg

SEQ ID NO: 7556890 - DNA, 22 bp, Homo sapiens
atatacactccactgatacagg

SEQ ID NO: 7556891 - DNA, 22 bp, Homo sapiens
atatacactgtttcagttgaag

SEQ ID NO: 7556892 - DNA, 22 bp, Homo sapiens
atatacactgtttcagttgaag

SEQ ID NO: 7556893 - DNA, 22 bp, Homo sapiens
atatacactgtttcagttgaag

SEQ ID NO: 7556894 - DNA, 22 bp, Homo sapiens
atatacactgtttcagttgaag

SEQ ID NO: 7556895 - DNA, 22 bp, Homo sapiens
atatacagggagaaacagctta

SEQ ID NO: 7556896 - DNA, 22 bp, Homo sapiens
atatacagggagaaacagctta

SEQ ID NO: 7556897 - DNA, 22 bp, Homo sapiens
atatacagggagaaacagctta

SEQ ID NO: 7556898 - DNA, 22 bp, Homo sapiens
atatacagggagaaacagctta

SEQ ID NO: 7556899 - DNA, 22 bp, Homo sapiens
atatacactccactgatacagg

SEQ ID NO: 7556900 - DNA, 22 bp, Homo sapiens
atatacactcaccatggtattt

SEQ ID NO: 7556901 - DNA, 22 bp, Homo sapiens
atatacactcaccatggtattt

SEQ ID NO: 7556902 - DNA, 22 bp, Homo sapiens
atatacactcaccatggtattt

SEQ ID NO: 7556903 - DNA, 22 bp, Homo sapiens
atatacactccactgatacagg

SEQ ID NO: 7556904 - DNA, 22 bp, Homo sapiens
atatacactccactgatacagg

SEQ ID NO: 7556905 - DNA, 22 bp, Homo sapiens
atatacactccactgatacagg

SEQ ID NO: 7556906 - DNA, 22 bp, Homo sapiens
atatacaggtggtatgtgtaaa

SEQ ID NO: 7556907 - DNA, 22 bp, Homo sapiens
atatacaggtggtatgtgtaaa

SEQ ID NO: 7556908 - DNA, 22 bp, Homo sapiens
atatacaggtggtatgtgtaaa

SEQ ID NO: 7556909 - DNA, 22 bp, Homo sapiens
atatacaggtggtatgtgtaaa

SEQ ID NO: 7556910 - DNA, 22 bp, Homo sapiens
atatacaggtggtatgtgtaaa

SEQ ID NO: 7556911 - DNA, 22 bp, Homo sapiens
atatacagggagaaacagctta

SEQ ID NO: 7556912 - DNA, 22 bp, Homo sapiens
atatacaggtggtatgtgtaaa

SEQ ID NO: 7556913 - DNA, 22 bp, Homo sapiens
atatacaggtggtatgtgtaaa

SEQ ID NO: 7556914 - DNA, 22 bp, Homo sapiens
atatacagggagaaacagctta

SEQ ID NO: 7556915 - DNA, 22 bp, Homo sapiens
atatacagggagaaacagctta

SEQ ID NO: 7556916 - DNA, 22 bp, Homo sapiens
atatacagtatgtactgtggtt

SEQ ID NO: 7556917 - DNA, 22 bp, Homo sapiens
atatacagtatgtactgtggtt

SEQ ID NO: 7556918 - DNA, 22 bp, Homo sapiens
atatacagtatgtactgtggtt

SEQ ID NO: 7556919 - DNA, 22 bp, Homo sapiens
atatacagtatgtactgtggtt

SEQ ID NO: 7556920 - DNA, 22 bp, Homo sapiens
atatacaggtggtatgtgtaaa

SEQ ID NO: 7556921 - DNA, 22 bp, Homo sapiens
atatacagtatgtactgtggtt

SEQ ID NO: 7556922 - DNA, 22 bp, Homo sapiens
atatacagtatgtactgtggtt

SEQ ID NO: 7556923 - DNA, 22 bp, Homo sapiens
atatacaggtggtatgtgtaaa

SEQ ID NO: 7556924 - DNA, 22 bp, Homo sapiens
atatacaggtggtatgtgtaaa

SEQ ID NO: 7556925 - DNA, 22 bp, Homo sapiens
atatacaggtggtatgtgtaaa

SEQ ID NO: 7556926 - DNA, 22 bp, Homo sapiens
ctgggagctggaatgggagaag

SEQ ID NO: 7556927 - DNA, 22 bp, Homo sapiens
ctgggagctggaatgggagaag

SEQ ID NO: 7556928 - DNA, 22 bp, Homo sapiens
ctgggagaggctgctccgctct

SEQ ID NO: 7556929 - DNA, 22 bp, Homo sapiens
ctgggagaggctgctccgctct

SEQ ID NO: 7556930 - DNA, 22 bp, Homo sapiens
ctgggagaggctgctccgctct

SEQ ID NO: 7556931 - DNA, 22 bp, Homo sapiens
ctgggagaggaacctcgagggt

SEQ ID NO: 7556932 - DNA, 22 bp, Homo sapiens
atatacttggagactatcattg

SEQ ID NO: 7556933 - DNA, 22 bp, Homo sapiens
ctgggagaggaacctcgagggt

SEQ ID NO: 7556934 - DNA, 22 bp, Homo sapiens
atatacttggagactatcattg

SEQ ID NO: 7556935 - DNA, 22 bp, Homo sapiens
atatacttggagactatcattg

SEQ ID NO: 7556936 - DNA, 22 bp, Homo sapiens
atatacttggagactatcattg

SEQ ID NO: 7556937 - DNA, 22 bp, Homo sapiens
atatacttggagactatcattg

SEQ ID NO: 7556938 - DNA, 22 bp, Homo sapiens
atatacttggagactatcattg

SEQ ID NO: 7556939 - DNA, 22 bp, Homo sapiens
ctgggagaggaacctcgagggt

SEQ ID NO: 7556940 - DNA, 22 bp, Homo sapiens
atatacttggagactatcattg

SEQ ID NO: 7556941 - DNA, 22 bp, Homo sapiens
atatacttggagactatcattg

SEQ ID NO: 7556942 - DNA, 22 bp, Homo sapiens
atatacttggagactatcattg

SEQ ID NO: 7556943 - DNA, 22 bp, Homo sapiens
ctgggagctgtcaggagcgtgt

SEQ ID NO: 7556944 - DNA, 22 bp, Homo sapiens
ctgggagctgtcaggagcgtgt

SEQ ID NO: 7556945 - DNA, 22 bp, Homo sapiens
ctgggagctgtcaggagcgtgt

SEQ ID NO: 7556946 - DNA, 22 bp, Homo sapiens
ctgggagctgtcaggagcgtgt

SEQ ID NO: 7556947 - DNA, 22 bp, Homo sapiens
ctgggagctgtcaggagcgtgt

SEQ ID NO: 7556948 - DNA, 22 bp, Homo sapiens
ctgggagctgtcaggagcgtgt

SEQ ID NO: 7556949 - DNA, 22 bp, Homo sapiens
ctgggagcttggagcctttggt

SEQ ID NO: 7556950 - DNA, 22 bp, Homo sapiens
ctgggagcttggagcctttggt

SEQ ID NO: 7556951 - DNA, 22 bp, Homo sapiens
ctgggagcttgttaggaatgca

SEQ ID NO: 7556952 - DNA, 22 bp, Homo sapiens
ctgggagcttgttaggaatgca

SEQ ID NO: 7556953 - DNA, 22 bp, Homo sapiens
ctgggagctggatgccctgccc

SEQ ID NO: 7556954 - DNA, 22 bp, Homo sapiens
ctgggagctggatgccctgccc

SEQ ID NO: 7556955 - DNA, 22 bp, Homo sapiens
ctgggagctggatgccctgccc

SEQ ID NO: 7556956 - DNA, 22 bp, Homo sapiens
ctgggagctggatgccctgccc

SEQ ID NO: 7556957 - DNA, 22 bp, Homo sapiens
ctgggagctggatgccctgccc

SEQ ID NO: 7556958 - DNA, 20 bp, Homo sapiens
atataccatcccacaacagg

SEQ ID NO: 7556959 - DNA, 20 bp, Homo sapiens
atataccatcccacaacagg

SEQ ID NO: 7556960 - DNA, 20 bp, Homo sapiens
atataccatcccacaacagg

SEQ ID NO: 7556961 - DNA, 22 bp, Homo sapiens
atatacatgggaatatgtggag

SEQ ID NO: 7556962 - DNA, 22 bp, Homo sapiens
atatacatgggaatatgtggag

SEQ ID NO: 7556963 - DNA, 22 bp, Homo sapiens
atatacatgggaatatgtggag

SEQ ID NO: 7556964 - DNA, 20 bp, Homo sapiens
atataccatcccacaacagg

SEQ ID NO: 7556965 - DNA, 20 bp, Homo sapiens
atataccatcccacaacagg

SEQ ID NO: 7556966 - DNA, 19 bp, Homo sapiens
atatacatactgtgtgcat

SEQ ID NO: 7556967 - DNA, 22 bp, Homo sapiens
atatacatgggaatatgtggag

SEQ ID NO: 7556968 - DNA, 22 bp, Homo sapiens
atatacatgggaatatgtggag

SEQ ID NO: 7556969 - DNA, 22 bp, Homo sapiens
atatacagttttacagggtttc

SEQ ID NO: 7556970 - DNA, 19 bp, Homo sapiens
atatacatactgtgtgcat

SEQ ID NO: 7556971 - DNA, 19 bp, Homo sapiens
atatacatactgtgtgcat

SEQ ID NO: 7556972 - DNA, 19 bp, Homo sapiens
atatacatactgtgtgcat

SEQ ID NO: 7556973 - DNA, 22 bp, Homo sapiens
atatacttccccattatggggg

SEQ ID NO: 7556974 - DNA, 22 bp, Homo sapiens
atatacttccccattatggggg

SEQ ID NO: 7556975 - DNA, 22 bp, Homo sapiens
atatacttggagactatcattg

SEQ ID NO: 7556976 - DNA, 22 bp, Homo sapiens
atatacttgatttaactgagca

SEQ ID NO: 7556977 - DNA, 22 bp, Homo sapiens
atatacttgatttaactgagca

SEQ ID NO: 7556978 - DNA, 22 bp, Homo sapiens
atatacttccccattatggggg

SEQ ID NO: 7556979 - DNA, 22 bp, Homo sapiens
atatacttccccattatggggg

SEQ ID NO: 7556980 - DNA, 22 bp, Homo sapiens
atatacttccccattatggggg

SEQ ID NO: 7556981 - DNA, 22 bp, Homo sapiens
atatacttgatttaactgagca

SEQ ID NO: 7556982 - DNA, 22 bp, Homo sapiens
atatactgatagctgcacttct

SEQ ID NO: 7556983 - DNA, 22 bp, Homo sapiens
atatactgatagctgcacttct

SEQ ID NO: 7556984 - DNA, 22 bp, Homo sapiens
atatacctcattctttgagtgc

SEQ ID NO: 7556985 - DNA, 21 bp, Homo sapiens
atatacgtatatggtgctcac

SEQ ID NO: 7556986 - DNA, 22 bp, Homo sapiens
atatactgaggagactttatat

SEQ ID NO: 7556987 - DNA, 22 bp, Homo sapiens
atatacctgaagttggtaatta

SEQ ID NO: 7556988 - DNA, 22 bp, Homo sapiens
atatacctgaagttggtaatta

SEQ ID NO: 7556989 - DNA, 22 bp, Homo sapiens
atatacctcattctttgagtgc

SEQ ID NO: 7556990 - DNA, 22 bp, Homo sapiens
ctggctcttgcgactcagcttg

SEQ ID NO: 7556991 - DNA, 22 bp, Homo sapiens
ctggctcttgcgactcagcttg

SEQ ID NO: 7556992 - DNA, 22 bp, Homo sapiens
ctggctcttggctagggagagt

SEQ ID NO: 7556993 - DNA, 22 bp, Homo sapiens
ctggctcttgcgactcagcttg

SEQ ID NO: 7556994 - DNA, 22 bp, Homo sapiens
ctggctcttggctagggagagt

SEQ ID NO: 7556995 - DNA, 22 bp, Homo sapiens
ctggctcttggctagggagagt

SEQ ID NO: 7556996 - DNA, 22 bp, Homo sapiens
ctggctcttggctagggagagt

SEQ ID NO: 7556997 - DNA, 22 bp, Homo sapiens
ctggctcttggctagggagagt

SEQ ID NO: 7556998 - DNA, 19 bp, Homo sapiens
ctggctcttgggtggagga

SEQ ID NO: 7556999 - DNA, 22 bp, Homo sapiens
ctggctcttggctagggagagt

SEQ ID NO: 7557000 - DNA, 19 bp, Homo sapiens
ctggctcttgggtggagga

SEQ ID NO: 7557001 - DNA, 19 bp, Homo sapiens
ctggctcttgggtggagga

SEQ ID NO: 7557002 - DNA, 22 bp, Homo sapiens
atataaagtgtttagaaagctg

SEQ ID NO: 7557003 - DNA, 22 bp, Homo sapiens
atataaagtgtttagaaagctg

SEQ ID NO: 7557004 - DNA, 22 bp, Homo sapiens
atataaagagcttagtatagtg

SEQ ID NO: 7557005 - DNA, 22 bp, Homo sapiens
atataaagagcttagtatagtg

SEQ ID NO: 7557006 - DNA, 22 bp, Homo sapiens
atataaagtgtttagaaagctg

SEQ ID NO: 7557007 - DNA, 22 bp, Homo sapiens
atataaagtgtttagaaagctg

SEQ ID NO: 7557008 - DNA, 22 bp, Homo sapiens
ctggctctttcctagctaggct

SEQ ID NO: 7557009 - DNA, 22 bp, Homo sapiens
ctggctctttcctagctaggct

SEQ ID NO: 7557010 - DNA, 22 bp, Homo sapiens
ctggctctttcctagctaggct

SEQ ID NO: 7557011 - DNA, 22 bp, Homo sapiens
ctggctctttcctagctaggct

SEQ ID NO: 7557012 - DNA, 22 bp, Homo sapiens
ctggctctttcctagctaggct

SEQ ID NO: 7557013 - DNA, 19 bp, Homo sapiens
ctggctcttgggtggagga

SEQ ID NO: 7557014 - DNA, 19 bp, Homo sapiens
ctggctcttgggtggagga

SEQ ID NO: 7557015 - DNA, 22 bp, Homo sapiens
ctggctctttcagccgctggag

SEQ ID NO: 7557016 - DNA, 22 bp, Homo sapiens
ctggctctttcagccgctggag

SEQ ID NO: 7557017 - DNA, 22 bp, Homo sapiens
ctggctctttcagccgctggag

SEQ ID NO: 7557018 - DNA, 22 bp, Homo sapiens
ctggctctttcagccgctggag

SEQ ID NO: 7557019 - DNA, 22 bp, Homo sapiens
ctggctgacaccttgatagcag

SEQ ID NO: 7557020 - DNA, 22 bp, Homo sapiens
ctggctgacaccttgatagcag

SEQ ID NO: 7557021 - DNA, 22 bp, Homo sapiens
ctggctgacacaaaggtatcga

SEQ ID NO: 7557022 - DNA, 22 bp, Homo sapiens
ctggctgacaccttgatagcag

SEQ ID NO: 7557023 - DNA, 22 bp, Homo sapiens
ctggctgaatcctagtctcata

SEQ ID NO: 7557024 - DNA, 22 bp, Homo sapiens
ctggctgaatcctagtctcata

SEQ ID NO: 7557025 - DNA, 22 bp, Homo sapiens
ctggctctttcctagctaggct

SEQ ID NO: 7557026 - DNA, 22 bp, Homo sapiens
ctggctgaagctgggctctcct

SEQ ID NO: 7557027 - DNA, 22 bp, Homo sapiens
ctggctctttcctagctaggct

SEQ ID NO: 7557028 - DNA, 22 bp, Homo sapiens
atataaagagcttagtatagtg

SEQ ID NO: 7557029 - DNA, 22 bp, Homo sapiens
atataaagagcttagtatagtg

SEQ ID NO: 7557030 - DNA, 22 bp, Homo sapiens
atataaagaagtggaaaatgag

SEQ ID NO: 7557031 - DNA, 22 bp, Homo sapiens
atataaagagcttagtatagtg

SEQ ID NO: 7557032 - DNA, 22 bp, Homo sapiens
atataaagagcttagtatagtg

SEQ ID NO: 7557033 - DNA, 22 bp, Homo sapiens
atataaagagcttagtatagtg

SEQ ID NO: 7557034 - DNA, 23 bp, Homo sapiens
atataaacaccagatagattgta

SEQ ID NO: 7557035 - DNA, 22 bp, Homo sapiens
atataaagaagtggaaaatgag

SEQ ID NO: 7557036 - DNA, 22 bp, Homo sapiens
atataaagaagtggaaaatgag

SEQ ID NO: 7557037 - DNA, 22 bp, Homo sapiens
atataaagaagtggaaaatgag

SEQ ID NO: 7557038 - DNA, 22 bp, Homo sapiens
atataaagaagtggaaaatgag

SEQ ID NO: 7557039 - DNA, 22 bp, Homo sapiens
atagttttatagatattgtgta

SEQ ID NO: 7557040 - DNA, 22 bp, Homo sapiens
atagttttatagatattgtgta

SEQ ID NO: 7557041 - DNA, 22 bp, Homo sapiens
atagttttatagatattgtgta

SEQ ID NO: 7557042 - DNA, 22 bp, Homo sapiens
atagttttaaaacctcaggaag

SEQ ID NO: 7557043 - DNA, 22 bp, Homo sapiens
atagttttaaaacctcaggaag

SEQ ID NO: 7557044 - DNA, 22 bp, Homo sapiens
atagtttgtgaaacacagcagt

SEQ ID NO: 7557045 - DNA, 22 bp, Homo sapiens
atagttttaaaacctcaggaag

SEQ ID NO: 7557046 - DNA, 22 bp, Homo sapiens
atagttttatagatattgtgta

SEQ ID NO: 7557047 - DNA, 23 bp, Homo sapiens
atagttttccctggttcttgcca

SEQ ID NO: 7557048 - DNA, 23 bp, Homo sapiens
atagttttccctggttcttgcca

SEQ ID NO: 7557049 - DNA, 23 bp, Homo sapiens
atagttttccctggttcttgcca

SEQ ID NO: 7557050 - DNA, 22 bp, Homo sapiens
atagttttatagatattgtgta

SEQ ID NO: 7557051 - DNA, 22 bp, Homo sapiens
atagttttatagatattgtgta

SEQ ID NO: 7557052 - DNA, 22 bp, Homo sapiens
atagttttctatgcactgttat

SEQ ID NO: 7557053 - DNA, 22 bp, Homo sapiens
atagttttctatgcactgttat

SEQ ID NO: 7557054 - DNA, 22 bp, Homo sapiens
atagttttctatgcactgttat

SEQ ID NO: 7557055 - DNA, 22 bp, Homo sapiens
atagttttctatgcactgttat

SEQ ID NO: 7557056 - DNA, 22 bp, Homo sapiens
atagttttctatgcactgttat

SEQ ID NO: 7557057 - DNA, 23 bp, Homo sapiens
atagttttccctggttcttgcca

SEQ ID NO: 7557058 - DNA, 22 bp, Homo sapiens
atagttttgctgtcaggtccta

SEQ ID NO: 7557059 - DNA, 22 bp, Homo sapiens
atagttttgctgtcaggtccta

SEQ ID NO: 7557060 - DNA, 23 bp, Homo sapiens
atataaacaccagatagattgta

SEQ ID NO: 7557061 - DNA, 23 bp, Homo sapiens
atataaacaccagatagattgta

SEQ ID NO: 7557062 - DNA, 22 bp, Homo sapiens
ctggctcacaggtgagatgcat

SEQ ID NO: 7557063 - DNA, 22 bp, Homo sapiens
ctggctcacaggtgagatgcat

SEQ ID NO: 7557064 - DNA, 22 bp, Homo sapiens
ctggctcacaggtgagatgcat

SEQ ID NO: 7557065 - DNA, 22 bp, Homo sapiens
atagtgcagggaaggccaatct

SEQ ID NO: 7557066 - DNA, 22 bp, Homo sapiens
atagtgcagtggactgagttaa

SEQ ID NO: 7557067 - DNA, 22 bp, Homo sapiens
atagtggaaactggagggaaga

SEQ ID NO: 7557068 - DNA, 22 bp, Homo sapiens
atagtgggtacaggggcagaga

SEQ ID NO: 7557069 - DNA, 22 bp, Homo sapiens
atagtggttggatatgtcagag

SEQ ID NO: 7557070 - DNA, 22 bp, Homo sapiens
atagtggttggatatgtcagag

SEQ ID NO: 7557071 - DNA, 22 bp, Homo sapiens
atagtgggaattacgatatact

SEQ ID NO: 7557072 - DNA, 22 bp, Homo sapiens
ctggctcacaggtgagatgcat

SEQ ID NO: 7557073 - DNA, 22 bp, Homo sapiens
atagtggtgagctgcatttatg

SEQ ID NO: 7557074 - DNA, 22 bp, Homo sapiens
atagtttaccttccagatggct

SEQ ID NO: 7557075 - DNA, 22 bp, Homo sapiens
atagtttgggcaaagaggacct

SEQ ID NO: 7557076 - DNA, 22 bp, Homo sapiens
atagtttgctttaatacaactg

SEQ ID NO: 7557077 - DNA, 22 bp, Homo sapiens
ctggctcaatttgtactgctgt

SEQ ID NO: 7557078 - DNA, 22 bp, Homo sapiens
ctggctcaatttgtactgctgt

SEQ ID NO: 7557079 - DNA, 22 bp, Homo sapiens
ctggctcacaggtgagatgcat

SEQ ID NO: 7557080 - DNA, 22 bp, Homo sapiens
ctggctcaatttgtactgctgt

SEQ ID NO: 7557081 - DNA, 22 bp, Homo sapiens
ctggctcaatttgtactgctgt

SEQ ID NO: 7557082 - DNA, 22 bp, Homo sapiens
ctggctcaatttgtactgctgt

SEQ ID NO: 7557083 - DNA, 22 bp, Homo sapiens
ctggctcaataaatattagctg

SEQ ID NO: 7557084 - DNA, 22 bp, Homo sapiens
ctggctcaataaatattagctg

SEQ ID NO: 7557085 - DNA, 22 bp, Homo sapiens
ctggctcaataaatattagctg

SEQ ID NO: 7557086 - DNA, 22 bp, Homo sapiens
ctggctcaatttgtactgctgt

SEQ ID NO: 7557087 - DNA, 22 bp, Homo sapiens
ctggctcaatttgtactgctgt

SEQ ID NO: 7557088 - DNA, 22 bp, Homo sapiens
ctggctagcacctcagctcaga

SEQ ID NO: 7557089 - DNA, 22 bp, Homo sapiens
ctggcgcaacagaaaatctgga

SEQ ID NO: 7557090 - DNA, 22 bp, Homo sapiens
ctggcgtgaaggtggccatgag

SEQ ID NO: 7557091 - DNA, 22 bp, Homo sapiens
ctggcgagcaggaggcgacggc

SEQ ID NO: 7557092 - DNA, 22 bp, Homo sapiens
ctggcgagcaggaggcgacggc

SEQ ID NO: 7557093 - DNA, 22 bp, Homo sapiens
ctggcgagggtcgctggggact

SEQ ID NO: 7557094 - DNA, 22 bp, Homo sapiens
ctggcgagggtcgctggggact

SEQ ID NO: 7557095 - DNA, 22 bp, Homo sapiens
ctggctagataaaaccagccaa

SEQ ID NO: 7557096 - DNA, 22 bp, Homo sapiens
ctggctaaagagcaagaagatg

SEQ ID NO: 7557097 - DNA, 22 bp, Homo sapiens
ctggcgtgaaggtggccatgag

SEQ ID NO: 7557098 - DNA, 22 bp, Homo sapiens
ctggcgtgaaggtggccatgag

SEQ ID NO: 7557099 - DNA, 22 bp, Homo sapiens
ctggcgtgaaggtggccatgag

SEQ ID NO: 7557100 - DNA, 22 bp, Homo sapiens
ctggccttgaggaggccaccaa

SEQ ID NO: 7557101 - DNA, 22 bp, Homo sapiens
ctggccttgaggaggccaccaa

SEQ ID NO: 7557102 - DNA, 22 bp, Homo sapiens
ctggccttgaggaggccaccaa

SEQ ID NO: 7557103 - DNA, 22 bp, Homo sapiens
ctggccttgttcctccccaagt

SEQ ID NO: 7557104 - DNA, 22 bp, Homo sapiens
ctggccttggtgcttgcagaca

SEQ ID NO: 7557105 - DNA, 21 bp, Homo sapiens
ctggccttcaactgattggat

SEQ ID NO: 7557106 - DNA, 21 bp, Homo sapiens
ctggccttcaactgattggat

SEQ ID NO: 7557107 - DNA, 22 bp, Homo sapiens
ctggccttcagactcggactga

SEQ ID NO: 7557108 - DNA, 19 bp, Homo sapiens
ctggcctgtgtcctgtgct

SEQ ID NO: 7557109 - DNA, 22 bp, Homo sapiens
ctggccttttgtttctggagaa

SEQ ID NO: 7557110 - DNA, 22 bp, Homo sapiens
ctggcctttcgtgagagctggg

SEQ ID NO: 7557111 - DNA, 22 bp, Homo sapiens
ctggcctttcgtgagagctggg

SEQ ID NO: 7557112 - DNA, 22 bp, Homo sapiens
ctggcctttcgtgagagctggg

SEQ ID NO: 7557113 - DNA, 22 bp, Homo sapiens
ctggcctttaaaatgaccttat

SEQ ID NO: 7557114 - DNA, 22 bp, Homo sapiens
ctggcctttaaaatgaccttat

SEQ ID NO: 7557115 - DNA, 19 bp, Homo sapiens
ctggcctgtgtcctgtgct

SEQ ID NO: 7557116 - DNA, 19 bp, Homo sapiens
ctggcctgtgtcctgtgct

SEQ ID NO: 7557117 - DNA, 19 bp, Homo sapiens
ctggcctgtgtcctgtgct

SEQ ID NO: 7557118 - DNA, 19 bp, Homo sapiens
ctggcctgtgtcctgtgct

SEQ ID NO: 7557119 - DNA, 19 bp, Homo sapiens
ctggcctgtgtcctgtgct

SEQ ID NO: 7557120 - DNA, 19 bp, Homo sapiens
ctggcctgtgtcctgtgct

SEQ ID NO: 7557121 - DNA, 19 bp, Homo sapiens
ctggcctgtgtcctgtgct

SEQ ID NO: 7557122 - DNA, 19 bp, Homo sapiens
ctggcctgtgtcctgtgct

SEQ ID NO: 7557123 - DNA, 22 bp, Homo sapiens
ctggcctgtgggctgtctccgg

SEQ ID NO: 7557124 - DNA, 22 bp, Homo sapiens
ctggcctctgtgttcaccatag

SEQ ID NO: 7557125 - DNA, 22 bp, Homo sapiens
ctggcctcggcagcaggaacag

SEQ ID NO: 7557126 - DNA, 22 bp, Homo sapiens
ctggcctgtgggctgtctccgg

SEQ ID NO: 7557127 - DNA, 22 bp, Homo sapiens
ctggcctctctgagcagggagc

SEQ ID NO: 7557128 - DNA, 22 bp, Homo sapiens
ctggcctctctgagcagggagc

SEQ ID NO: 7557129 - DNA, 22 bp, Homo sapiens
ctggcctctctgagcagggagc

SEQ ID NO: 7557130 - DNA, 22 bp, Homo sapiens
ctggcctctctgagcagggagc

SEQ ID NO: 7557131 - DNA, 22 bp, Homo sapiens
ctggcctcggcagcaggaacag

SEQ ID NO: 7557132 - DNA, 22 bp, Homo sapiens
ctggcctctctgagcagggagc

SEQ ID NO: 7557133 - DNA, 22 bp, Homo sapiens
ctggcctctctgagcagggagc

SEQ ID NO: 7557134 - DNA, 22 bp, Homo sapiens
ctggcctctctgagcagggagc

SEQ ID NO: 7557135 - DNA, 22 bp, Homo sapiens
ctggcctctgtgttcaccatag

SEQ ID NO: 7557136 - DNA, 22 bp, Homo sapiens
ctggcctctctgagcagggagc

SEQ ID NO: 7557137 - DNA, 22 bp, Homo sapiens
agtgccttggctgtgatgggga

SEQ ID NO: 7557138 - DNA, 22 bp, Homo sapiens
agtgccttgggtattttgagta

SEQ ID NO: 7557139 - DNA, 19 bp, Homo sapiens
agtgccttgctctctaggt

SEQ ID NO: 7557140 - DNA, 19 bp, Homo sapiens
agtgccttgctctctaggt

SEQ ID NO: 7557141 - DNA, 22 bp, Homo sapiens
agtgccttggctgtgatgggga

SEQ ID NO: 7557142 - DNA, 22 bp, Homo sapiens
agtgccttgggtattttgagta

SEQ ID NO: 7557143 - DNA, 22 bp, Homo sapiens
agtgccttgtgtgtgggcagcc

SEQ ID NO: 7557144 - DNA, 22 bp, Homo sapiens
agtgccttgtgtgtgggcagcc

SEQ ID NO: 7557145 - DNA, 22 bp, Homo sapiens
agtgccttgtgtgtgggcagcc

SEQ ID NO: 7557146 - DNA, 22 bp, Homo sapiens
agtgcgtggacccctggctgct

SEQ ID NO: 7557147 - DNA, 22 bp, Homo sapiens
agtgcgtgggcaggcatggaag

SEQ ID NO: 7557148 - DNA, 22 bp, Homo sapiens
agtgcgtggacccctggctgct

SEQ ID NO: 7557149 - DNA, 22 bp, Homo sapiens
agtgcgcaaaaatagaagctgt

SEQ ID NO: 7557150 - DNA, 22 bp, Homo sapiens
agtgctgggtactgttcccatt

SEQ ID NO: 7557151 - DNA, 22 bp, Homo sapiens
agtgctgtcagttttatagata

SEQ ID NO: 7557152 - DNA, 22 bp, Homo sapiens
agtgcgtggtttacagctagtt

SEQ ID NO: 7557153 - DNA, 22 bp, Homo sapiens
agtgcgtggtttacagctagtt

SEQ ID NO: 7557154 - DNA, 22 bp, Homo sapiens
agtgcgtgggcaggcatggaag

SEQ ID NO: 7557155 - DNA, 22 bp, Homo sapiens
agtgcgtgggcaggcatggaag

SEQ ID NO: 7557156 - DNA, 22 bp, Homo sapiens
agtgcgtggtttacagctagtt

SEQ ID NO: 7557157 - DNA, 22 bp, Homo sapiens
agtgccttaaacagcatcggag

SEQ ID NO: 7557158 - DNA, 22 bp, Homo sapiens
agtgccttacaagagtgagggg

SEQ ID NO: 7557159 - DNA, 22 bp, Homo sapiens
agtgccttacaagagtgagggg

SEQ ID NO: 7557160 - DNA, 22 bp, Homo sapiens
agtgccttctctgggctaggtc

SEQ ID NO: 7557161 - DNA, 22 bp, Homo sapiens
agtgcctggaccccatgacata

SEQ ID NO: 7557162 - DNA, 22 bp, Homo sapiens
agtgccctttacaacttcttga

SEQ ID NO: 7557163 - DNA, 22 bp, Homo sapiens
agtgcctctgcaggtccgagtt

SEQ ID NO: 7557164 - DNA, 22 bp, Homo sapiens
agtgcctctgcaggtccgagtt

SEQ ID NO: 7557165 - DNA, 22 bp, Homo sapiens
agtgcctggaccccatgacata

SEQ ID NO: 7557166 - DNA, 22 bp, Homo sapiens
agtgcctcttgtctacggtttt

SEQ ID NO: 7557167 - DNA, 22 bp, Homo sapiens
agtgcctggaccccatgacata

SEQ ID NO: 7557168 - DNA, 22 bp, Homo sapiens
agtgcctggaccccatgacata

SEQ ID NO: 7557169 - DNA, 22 bp, Homo sapiens
agtgccctgtggcttcagcaat

SEQ ID NO: 7557170 - DNA, 22 bp, Homo sapiens
agtgcccttcatgaagcaagag

SEQ ID NO: 7557171 - DNA, 22 bp, Homo sapiens
agtgccctgtcactggaactga

SEQ ID NO: 7557172 - DNA, 22 bp, Homo sapiens
agtgccctgtcactggaactga

SEQ ID NO: 7557173 - DNA, 22 bp, Homo sapiens
agtgccctgtcactggaactga

SEQ ID NO: 7557174 - DNA, 22 bp, Homo sapiens
agtgccctggttataggtgtgg

SEQ ID NO: 7557175 - DNA, 22 bp, Homo sapiens
agtgccctggttataggtgtgg

SEQ ID NO: 7557176 - DNA, 22 bp, Homo sapiens
agtgccctgggccttccaggac

SEQ ID NO: 7557177 - DNA, 22 bp, Homo sapiens
agtgccaggagcaaggagctcc

SEQ ID NO: 7557178 - DNA, 22 bp, Homo sapiens
agtgccaggagcaaggagctcc

SEQ ID NO: 7557179 - DNA, 22 bp, Homo sapiens
agtgccaggagcaaggagctcc

SEQ ID NO: 7557180 - DNA, 20 bp, Homo sapiens
agtgccagggcaggtgagag

SEQ ID NO: 7557181 - DNA, 20 bp, Homo sapiens
agtgccagggcaggtgagag

SEQ ID NO: 7557182 - DNA, 23 bp, Homo sapiens
agtgccagggagatcaggacgga

SEQ ID NO: 7557183 - DNA, 22 bp, Homo sapiens
agtgccaggagcaaggagctcc

SEQ ID NO: 7557184 - DNA, 23 bp, Homo sapiens
agtgccagggagatcaggacgga

SEQ ID NO: 7557185 - DNA, 23 bp, Homo sapiens
agtgccagggagatcaggacgga

SEQ ID NO: 7557186 - DNA, 22 bp, Homo sapiens
agtgccatggaggaacagatgc

SEQ ID NO: 7557187 - DNA, 21 bp, Homo sapiens
agtgccagtaggtatggagga

SEQ ID NO: 7557188 - DNA, 21 bp, Homo sapiens
agtgccagtaggtatggagga

SEQ ID NO: 7557189 - DNA, 20 bp, Homo sapiens
agtgccagggcaggtgagag

SEQ ID NO: 7557190 - DNA, 21 bp, Homo sapiens
agtgccagtaggtatggagga

SEQ ID NO: 7557191 - DNA, 21 bp, Homo sapiens
agtgccagtaggtatggagga

SEQ ID NO: 7557192 - DNA, 20 bp, Homo sapiens
agtgccagggcaggtgagag

SEQ ID NO: 7557193 - DNA, 20 bp, Homo sapiens
agtgccctccgacattgttt

SEQ ID NO: 7557194 - DNA, 22 bp, Homo sapiens
agtgccctcgtgcccagggcct

SEQ ID NO: 7557195 - DNA, 22 bp, Homo sapiens
agtgccctcgtgcccagggcct

SEQ ID NO: 7557196 - DNA, 22 bp, Homo sapiens
agtgccccatgggtgcctgggg

SEQ ID NO: 7557197 - DNA, 22 bp, Homo sapiens
agtgcccacctctcttcagcta

SEQ ID NO: 7557198 - DNA, 22 bp, Homo sapiens
agtgcccacgccacactggtgg

SEQ ID NO: 7557199 - DNA, 22 bp, Homo sapiens
agtgcccagttaggttggagca

SEQ ID NO: 7557200 - DNA, 22 bp, Homo sapiens
agtgcccagttaggttggagca

SEQ ID NO: 7557201 - DNA, 22 bp, Homo sapiens
agtgcccggacaactggacaga

SEQ ID NO: 7557202 - DNA, 22 bp, Homo sapiens
agtgcccggggtgccagacaca

SEQ ID NO: 7557203 - DNA, 22 bp, Homo sapiens
agtgccctggacggcggcccca

SEQ ID NO: 7557204 - DNA, 22 bp, Homo sapiens
agtgccctggacggcggcccca

SEQ ID NO: 7557205 - DNA, 22 bp, Homo sapiens
agtgccctgctggggcaggaga

SEQ ID NO: 7557206 - DNA, 22 bp, Homo sapiens
agtgcccacctctcttcagcta

SEQ ID NO: 7557207 - DNA, 22 bp, Homo sapiens
agtgccctgctggggcaggaga

SEQ ID NO: 7557208 - DNA, 22 bp, Homo sapiens
agtgccctgctggggcaggaga

SEQ ID NO: 7557209 - DNA, 22 bp, Homo sapiens
agtgccctgggccttccaggac

SEQ ID NO: 7557210 - DNA, 22 bp, Homo sapiens
agtgccctgggccttccaggac

SEQ ID NO: 7557211 - DNA, 22 bp, Homo sapiens
agtgccctggcccagctggacc

SEQ ID NO: 7557212 - DNA, 22 bp, Homo sapiens
agtgccctggcccagctggacc

SEQ ID NO: 7557213 - DNA, 22 bp, Homo sapiens
agtgccctggcccagctggacc

SEQ ID NO: 7557214 - DNA, 22 bp, Homo sapiens
agtgcagggggaaagggtgtct

SEQ ID NO: 7557215 - DNA, 22 bp, Homo sapiens
agtgcattatatgtttcaatgg

SEQ ID NO: 7557216 - DNA, 22 bp, Homo sapiens
agtgcattatatgtttcaatgg

SEQ ID NO: 7557217 - DNA, 22 bp, Homo sapiens
agtgcattatatgtttcaatgg

SEQ ID NO: 7557218 - DNA, 22 bp, Homo sapiens
agtgcattcctggggaagaagc

SEQ ID NO: 7557219 - DNA, 22 bp, Homo sapiens
agtgcattcagtattcataggc

SEQ ID NO: 7557220 - DNA, 22 bp, Homo sapiens
agtgcattatatgtttcaatgg

SEQ ID NO: 7557221 - DNA, 22 bp, Homo sapiens
agtgcattcagtattcataggc

SEQ ID NO: 7557222 - DNA, 22 bp, Homo sapiens
agtgcattcagtattcataggc

SEQ ID NO: 7557223 - DNA, 22 bp, Homo sapiens
agtgcattctctaattacaggt

SEQ ID NO: 7557224 - DNA, 22 bp, Homo sapiens
agtgcattctctaattacaggt

SEQ ID NO: 7557225 - DNA, 22 bp, Homo sapiens
agtgcattctggcagaacaggt

SEQ ID NO: 7557226 - DNA, 22 bp, Homo sapiens
agtgcattctccatcatctagg

SEQ ID NO: 7557227 - DNA, 22 bp, Homo sapiens
agtgcattctccatcatctagg

SEQ ID NO: 7557228 - DNA, 22 bp, Homo sapiens
agtgcattctgtcatcttggtt

SEQ ID NO: 7557229 - DNA, 22 bp, Homo sapiens
agtgcattctgtcatcttggtt

SEQ ID NO: 7557230 - DNA, 22 bp, Homo sapiens
agtgcattctgtcatcttggtt

SEQ ID NO: 7557231 - DNA, 22 bp, Homo sapiens
agtgcattgcatctctgcttca

SEQ ID NO: 7557232 - DNA, 22 bp, Homo sapiens
agtgcattgcatctctgcttca

SEQ ID NO: 7557233 - DNA, 22 bp, Homo sapiens
agtgcatttggggtagtggaag

SEQ ID NO: 7557234 - DNA, 22 bp, Homo sapiens
agtgccaagtagaaatgaattt

SEQ ID NO: 7557235 - DNA, 22 bp, Homo sapiens
agtgccaagtagaaatgaattt

SEQ ID NO: 7557236 - DNA, 22 bp, Homo sapiens
agtgccaaggtattaatttata

SEQ ID NO: 7557237 - DNA, 22 bp, Homo sapiens
agtgccaaggtattaatttata

SEQ ID NO: 7557238 - DNA, 22 bp, Homo sapiens
agtgccaaggtattaatttata

SEQ ID NO: 7557239 - DNA, 19 bp, Homo sapiens
agtgccaagggtggattgt

SEQ ID NO: 7557240 - DNA, 19 bp, Homo sapiens
agtgccaagggtggattgt

SEQ ID NO: 7557241 - DNA, 22 bp, Homo sapiens
agtgccaagagtgagccatgag

SEQ ID NO: 7557242 - DNA, 22 bp, Homo sapiens
agtgccaagagtgagccatgag

SEQ ID NO: 7557243 - DNA, 22 bp, Homo sapiens
agtgccagctccacacagcagc

SEQ ID NO: 7557244 - DNA, 22 bp, Homo sapiens
agtgccagctccacacagcagc

SEQ ID NO: 7557245 - DNA, 22 bp, Homo sapiens
agtgccaaacagtacataacat

SEQ ID NO: 7557246 - DNA, 21 bp, Homo sapiens
agtgccaaaacggaaggtggc

SEQ ID NO: 7557247 - DNA, 21 bp, Homo sapiens
agtgccaaaacggaaggtggc

SEQ ID NO: 7557248 - DNA, 22 bp, Homo sapiens
agtgcattgcatctctgcttca

SEQ ID NO: 7557249 - DNA, 22 bp, Homo sapiens
agtgccaaatattgctggtgta

SEQ ID NO: 7557250 - DNA, 20 bp, Homo sapiens
agtgccaaatgttgtttgtt

SEQ ID NO: 7557251 - DNA, 22 bp, Homo sapiens
agtgccaaatcgagggctctga

SEQ ID NO: 7557252 - DNA, 20 bp, Homo sapiens
agtgccaaatgttgtttgtt

SEQ ID NO: 7557253 - DNA, 22 bp, Homo sapiens
agtgccaacggggcaggagagg

SEQ ID NO: 7557254 - DNA, 22 bp, Homo sapiens
agtgccaacggggcaggagagg

SEQ ID NO: 7557255 - DNA, 22 bp, Homo sapiens
agtgccaaaaaaaggacttaat

SEQ ID NO: 7557256 - DNA, 19 bp, Homo sapiens
agtgcattttatgtttcaa

SEQ ID NO: 7557257 - DNA, 19 bp, Homo sapiens
agtgcattttatgtttcaa

SEQ ID NO: 7557258 - DNA, 19 bp, Homo sapiens
agtgcattttatgtttcaa

SEQ ID NO: 7557259 - DNA, 22 bp, Homo sapiens
agtgcattgcatctctgcttca

SEQ ID NO: 7557260 - DNA, 19 bp, Homo sapiens
agtgcattttatgtttcaa

SEQ ID NO: 7557261 - DNA, 22 bp, Homo sapiens
agtgatttcctggcaccctaca

SEQ ID NO: 7557262 - DNA, 22 bp, Homo sapiens
agtgatttcctggcaccctaca

SEQ ID NO: 7557263 - DNA, 22 bp, Homo sapiens
agtgcagggcctgcccagcagg

SEQ ID NO: 7557264 - DNA, 22 bp, Homo sapiens
agtgcagggggaaagggtgtct

SEQ ID NO: 7557265 - DNA, 22 bp, Homo sapiens
agtgcagggcctgcccagcagg

SEQ ID NO: 7557266 - DNA, 22 bp, Homo sapiens
agtgcagggcctgcccagcagg

SEQ ID NO: 7557267 - DNA, 22 bp, Homo sapiens
agtgatttatgtatgtgcacgt

SEQ ID NO: 7557268 - DNA, 22 bp, Homo sapiens
agtgatttatggaaggccaaaa

SEQ ID NO: 7557269 - DNA, 22 bp, Homo sapiens
agtgatttcatcattttatcaa

SEQ ID NO: 7557270 - DNA, 22 bp, Homo sapiens
agtgatttcatcattttatcaa

SEQ ID NO: 7557271 - DNA, 22 bp, Homo sapiens
agtgatttcacgcttagggcta

SEQ ID NO: 7557272 - DNA, 21 bp, Homo sapiens
agtgatttatgagagaatgac

SEQ ID NO: 7557273 - DNA, 22 bp, Homo sapiens
agtgatttcatcattttatcaa

SEQ ID NO: 7557274 - DNA, 22 bp, Homo sapiens
agtgatttcatcattttatcaa

SEQ ID NO: 7557275 - DNA, 22 bp, Homo sapiens
agtgattcccagacttcctggg

SEQ ID NO: 7557276 - DNA, 21 bp, Homo sapiens
agtgattatgggtttttacat

SEQ ID NO: 7557277 - DNA, 22 bp, Homo sapiens
agtgattctttaaagtggtatt

SEQ ID NO: 7557278 - DNA, 22 bp, Homo sapiens
agtgattgtgtagaaccatccc

SEQ ID NO: 7557279 - DNA, 20 bp, Homo sapiens
agtgatttatctttttccac

SEQ ID NO: 7557280 - DNA, 20 bp, Homo sapiens
agtgatttatctttttccac

SEQ ID NO: 7557281 - DNA, 20 bp, Homo sapiens
agtgatttatctttttccac

SEQ ID NO: 7557282 - DNA, 22 bp, Homo sapiens
agtgatttactaccatattggg

SEQ ID NO: 7557283 - DNA, 22 bp, Homo sapiens
agtgatttactaccatattggg

SEQ ID NO: 7557284 - DNA, 22 bp, Homo sapiens
agtgatttactaccatattggg

SEQ ID NO: 7557285 - DNA, 22 bp, Homo sapiens
agtgattgttttaaaaatgcct

SEQ ID NO: 7557286 - DNA, 22 bp, Homo sapiens
agtgatgtgggagagtatagct

SEQ ID NO: 7557287 - DNA, 22 bp, Homo sapiens
agtgatgtgaggtgtgagaggg

SEQ ID NO: 7557288 - DNA, 22 bp, Homo sapiens
agtgatgtgggagagtatagct

SEQ ID NO: 7557289 - DNA, 22 bp, Homo sapiens
agtgatgtgggagagtatagct

SEQ ID NO: 7557290 - DNA, 22 bp, Homo sapiens
agtgatgtctaacttgatccct

SEQ ID NO: 7557291 - DNA, 22 bp, Homo sapiens
agtgatgtctcagagacggaag

SEQ ID NO: 7557292 - DNA, 22 bp, Homo sapiens
agtgatgtctcagagacggaag

SEQ ID NO: 7557293 - DNA, 22 bp, Homo sapiens
agtgatgtaggtggattctggc

SEQ ID NO: 7557294 - DNA, 22 bp, Homo sapiens
agtgatgtcacaaactatggtg

SEQ ID NO: 7557295 - DNA, 23 bp, Homo sapiens
agtgatgtcacccacagacaagg

SEQ ID NO: 7557296 - DNA, 22 bp, Homo sapiens
agtgatgttgactagctataag

SEQ ID NO: 7557297 - DNA, 22 bp, Homo sapiens
agtgattaaagctaggataaaa

SEQ ID NO: 7557298 - DNA, 22 bp, Homo sapiens
agtgatgttgactagctataag

SEQ ID NO: 7557299 - DNA, 22 bp, Homo sapiens
agtgatgttgactagctataag

SEQ ID NO: 7557300 - DNA, 22 bp, Homo sapiens
agtgatgttgattttaccactt

SEQ ID NO: 7557301 - DNA, 22 bp, Homo sapiens
agtgatgttaataaatgatgtt

SEQ ID NO: 7557302 - DNA, 22 bp, Homo sapiens
agtgatgttgactagctataag

SEQ ID NO: 7557303 - DNA, 22 bp, Homo sapiens
agtgatgtgggagagtatagct

SEQ ID NO: 7557304 - DNA, 22 bp, Homo sapiens
agtgatgttaataaatgatgtt

SEQ ID NO: 7557305 - DNA, 22 bp, Homo sapiens
agtgatgttaataaatgatgtt

SEQ ID NO: 7557306 - DNA, 22 bp, Homo sapiens
agtggcagaactacctttttat

SEQ ID NO: 7557307 - DNA, 22 bp, Homo sapiens
agtggcagaagccaagtctgca

SEQ ID NO: 7557308 - DNA, 22 bp, Homo sapiens
agtggcacaattttgactcccc

SEQ ID NO: 7557309 - DNA, 22 bp, Homo sapiens
agtggcagaactacctttttat

SEQ ID NO: 7557310 - DNA, 22 bp, Homo sapiens
agtggcaatgtagagagtgatc

SEQ ID NO: 7557311 - DNA, 22 bp, Homo sapiens
agtggcaatgggagtggagaca

SEQ ID NO: 7557312 - DNA, 22 bp, Homo sapiens
agtggcaatgggagtggagaca

SEQ ID NO: 7557313 - DNA, 22 bp, Homo sapiens
agtggcaatgggagtggagaca

SEQ ID NO: 7557314 - DNA, 22 bp, Homo sapiens
agtggcaatgggagtggagaca

SEQ ID NO: 7557315 - DNA, 22 bp, Homo sapiens
agtggcaatgtagagagtgatc

SEQ ID NO: 7557316 - DNA, 22 bp, Homo sapiens
agtggcaatgtagagagtgatc

SEQ ID NO: 7557317 - DNA, 22 bp, Homo sapiens
agtggcaattgacaacaaagga

SEQ ID NO: 7557318 - DNA, 22 bp, Homo sapiens
agtggcaattgacaacaaagga

SEQ ID NO: 7557319 - DNA, 20 bp, Homo sapiens
agtggcagggaaatggaaag

SEQ ID NO: 7557320 - DNA, 20 bp, Homo sapiens
agtggcagggaaatggaaag

SEQ ID NO: 7557321 - DNA, 20 bp, Homo sapiens
agtggcagggaaatggaaag

SEQ ID NO: 7557322 - DNA, 20 bp, Homo sapiens
agtggcagggaaatggaaag

SEQ ID NO: 7557323 - DNA, 20 bp, Homo sapiens
agtggcagggaaatggaaag

SEQ ID NO: 7557324 - DNA, 22 bp, Homo sapiens
agtggcagggacttcatataaa

SEQ ID NO: 7557325 - DNA, 22 bp, Homo sapiens
agtggcagtggggcagggccct

SEQ ID NO: 7557326 - DNA, 22 bp, Homo sapiens
agtggcagggctggctgctgca

SEQ ID NO: 7557327 - DNA, 22 bp, Homo sapiens
agtggcagtggggcagggccct

SEQ ID NO: 7557328 - DNA, 22 bp, Homo sapiens
agtggcagtggggcagggccct

SEQ ID NO: 7557329 - DNA, 22 bp, Homo sapiens
agtggcagtggggcagggccct

SEQ ID NO: 7557330 - DNA, 22 bp, Homo sapiens
agtggcagtggggcagggccct

SEQ ID NO: 7557331 - DNA, 22 bp, Homo sapiens
agtggaggttattgagttaagg

SEQ ID NO: 7557332 - DNA, 22 bp, Homo sapiens
agtggagtgagtggcagaagga

SEQ ID NO: 7557333 - DNA, 22 bp, Homo sapiens
agtggagttgagttgatggatt

SEQ ID NO: 7557334 - DNA, 22 bp, Homo sapiens
agtggagttgagttgatggatt

SEQ ID NO: 7557335 - DNA, 22 bp, Homo sapiens
agtggagttgagttgatggatt

SEQ ID NO: 7557336 - DNA, 22 bp, Homo sapiens
agtggatggtattgggaccagg

SEQ ID NO: 7557337 - DNA, 22 bp, Homo sapiens
agtggatggtattgggaccagg

SEQ ID NO: 7557338 - DNA, 22 bp, Homo sapiens
agtggcaaagtcttcagaagtt

SEQ ID NO: 7557339 - DNA, 22 bp, Homo sapiens
agtggcaaaagcaggcttaggc

SEQ ID NO: 7557340 - DNA, 22 bp, Homo sapiens
agtggcaaagtcttcagaagtt

SEQ ID NO: 7557341 - DNA, 22 bp, Homo sapiens
agtggcaaagtcttcagaagtt

SEQ ID NO: 7557342 - DNA, 22 bp, Homo sapiens
agtggatggtattgggaccagg

SEQ ID NO: 7557343 - DNA, 22 bp, Homo sapiens
agtggcaagagggtctattgtt

SEQ ID NO: 7557344 - DNA, 22 bp, Homo sapiens
agtggcaagagggtctattgtt

SEQ ID NO: 7557345 - DNA, 20 bp, Homo sapiens
agtggcaaggtctctgctca

SEQ ID NO: 7557346 - DNA, 20 bp, Homo sapiens
agtggcaaggtctctgctca

SEQ ID NO: 7557347 - DNA, 20 bp, Homo sapiens
agtggcaaggtctctgctca

SEQ ID NO: 7557348 - DNA, 22 bp, Homo sapiens
agtggcaagtcaatgatagtga

SEQ ID NO: 7557349 - DNA, 22 bp, Homo sapiens
agtggccaacttatatgaaaaa

SEQ ID NO: 7557350 - DNA, 22 bp, Homo sapiens
agtggcattttaatggatgtca

SEQ ID NO: 7557351 - DNA, 22 bp, Homo sapiens
agtggccaatatgtcatgctct

SEQ ID NO: 7557352 - DNA, 22 bp, Homo sapiens
agtggccaacttatatgaaaaa

SEQ ID NO: 7557353 - DNA, 22 bp, Homo sapiens
agtggcatccctttaacagggt

SEQ ID NO: 7557354 - DNA, 22 bp, Homo sapiens
agtggcagtggggcagggccct

SEQ ID NO: 7557355 - DNA, 22 bp, Homo sapiens
agtggcagtggggcagggccct

SEQ ID NO: 7557356 - DNA, 22 bp, Homo sapiens
agtggcagtggggcagggccct

SEQ ID NO: 7557357 - DNA, 22 bp, Homo sapiens
agtggcagtttgggagctacag

SEQ ID NO: 7557358 - DNA, 22 bp, Homo sapiens
agtggcagtttgggagctacag

SEQ ID NO: 7557359 - DNA, 22 bp, Homo sapiens
agtggcagtggggcagggccct

SEQ ID NO: 7557360 - DNA, 22 bp, Homo sapiens
agtggcagtttgggagctacag

SEQ ID NO: 7557361 - DNA, 22 bp, Homo sapiens
agtggcagtttgggagctacag

SEQ ID NO: 7557362 - DNA, 22 bp, Homo sapiens
agtggcagttttatatttcatg

SEQ ID NO: 7557363 - DNA, 22 bp, Homo sapiens
agtggcagttttatatttcatg

SEQ ID NO: 7557364 - DNA, 22 bp, Homo sapiens
agtggccaatatgtcatgctct

SEQ ID NO: 7557365 - DNA, 22 bp, Homo sapiens
agtggccaccatgccagctctc

SEQ ID NO: 7557366 - DNA, 22 bp, Homo sapiens
agtggccaccatgccagctctc

SEQ ID NO: 7557367 - DNA, 22 bp, Homo sapiens
agtggccaccatgccagctctc

SEQ ID NO: 7557368 - DNA, 22 bp, Homo sapiens
agtggccaatatgtcatgctct

SEQ ID NO: 7557369 - DNA, 22 bp, Homo sapiens
agtggccactagaagctcagct

SEQ ID NO: 7557370 - DNA, 22 bp, Homo sapiens
agtggccacccactgagacagg

SEQ ID NO: 7557371 - DNA, 22 bp, Homo sapiens
agtggccactagaagctcagct

SEQ ID NO: 7557372 - DNA, 22 bp, Homo sapiens
agtggccacccactgagacagg

SEQ ID NO: 7557373 - DNA, 22 bp, Homo sapiens
agtggccactagaagctcagct

SEQ ID NO: 7557374 - DNA, 22 bp, Homo sapiens
agtggccaggaaaggtccagcc

SEQ ID NO: 7557375 - DNA, 22 bp, Homo sapiens
agtggccaggaaaggtccagcc

SEQ ID NO: 7557376 - DNA, 22 bp, Homo sapiens
agtggccagcagcctagcctag

SEQ ID NO: 7557377 - DNA, 22 bp, Homo sapiens
agtggccagcagcctagcctag

SEQ ID NO: 7557378 - DNA, 20 bp, Homo sapiens
agtggccactgcagagatgc

SEQ ID NO: 7557379 - DNA, 20 bp, Homo sapiens
agtggccactgcagagatgc

SEQ ID NO: 7557380 - DNA, 20 bp, Homo sapiens
agtggccactgcagagatgc

SEQ ID NO: 7557381 - DNA, 20 bp, Homo sapiens
agtggccactgcagagatgc

SEQ ID NO: 7557382 - DNA, 22 bp, Homo sapiens
agtggccactgacttggaaatc

SEQ ID NO: 7557383 - DNA, 20 bp, Homo sapiens
agtggccactgcagagatgc

SEQ ID NO: 7557384 - DNA, 22 bp, Homo sapiens
agtggaggttacagctgtacat

SEQ ID NO: 7557385 - DNA, 22 bp, Homo sapiens
agtggaggttacagctgtacat

SEQ ID NO: 7557386 - DNA, 22 bp, Homo sapiens
agtggaggttattgagttaagg

SEQ ID NO: 7557387 - DNA, 22 bp, Homo sapiens
agtggaggttattgagttaagg

SEQ ID NO: 7557388 - DNA, 22 bp, Homo sapiens
agtggaggttacagctgtacat

SEQ ID NO: 7557389 - DNA, 22 bp, Homo sapiens
agtggaggttacagctgtacat

SEQ ID NO: 7557390 - DNA, 22 bp, Homo sapiens
agtggagcttttcctatcagag

SEQ ID NO: 7557391 - DNA, 22 bp, Homo sapiens
agtggaggcactaattggattt

SEQ ID NO: 7557392 - DNA, 22 bp, Homo sapiens
agtggaggttacagctgtacat

SEQ ID NO: 7557393 - DNA, 22 bp, Homo sapiens
agtggaggttacagctgtacat

SEQ ID NO: 7557394 - DNA, 22 bp, Homo sapiens
agtggaggttacagctgtacat

SEQ ID NO: 7557395 - DNA, 22 bp, Homo sapiens
agtggaggttacagctgtacat

SEQ ID NO: 7557396 - DNA, 22 bp, Homo sapiens
agtggagcgtgttacctttgct

SEQ ID NO: 7557397 - DNA, 22 bp, Homo sapiens
agtggagctaaggtatctttta

SEQ ID NO: 7557398 - DNA, 22 bp, Homo sapiens
agtggagcttttcctatcagag

SEQ ID NO: 7557399 - DNA, 20 bp, Homo sapiens
agtggagcagcccaagcagc

SEQ ID NO: 7557400 - DNA, 22 bp, Homo sapiens
agtggagcagagaggggatctt

SEQ ID NO: 7557401 - DNA, 22 bp, Homo sapiens
agtggaggcactaattggattt

SEQ ID NO: 7557402 - DNA, 22 bp, Homo sapiens
agtggaggcactaattggattt

SEQ ID NO: 7557403 - DNA, 22 bp, Homo sapiens
agtggagcttttcctatcagag

SEQ ID NO: 7557404 - DNA, 22 bp, Homo sapiens
agtggaggcactaattggattt

SEQ ID NO: 7557405 - DNA, 22 bp, Homo sapiens
agtggagaatatgcagaaagcc

SEQ ID NO: 7557406 - DNA, 22 bp, Homo sapiens
agtggagaatatgcagaaagcc

SEQ ID NO: 7557407 - DNA, 22 bp, Homo sapiens
agtggagaagaggatggtctcc

SEQ ID NO: 7557408 - DNA, 22 bp, Homo sapiens
agtggagaatatgcagaaagcc

SEQ ID NO: 7557409 - DNA, 22 bp, Homo sapiens
agtggagacaggacagtcgata

SEQ ID NO: 7557410 - DNA, 22 bp, Homo sapiens
agtggagaccccacttctacat

SEQ ID NO: 7557411 - DNA, 22 bp, Homo sapiens
agtggagacaggacagtcgata

SEQ ID NO: 7557412 - DNA, 22 bp, Homo sapiens
agtggagaatatgcagaaagcc

SEQ ID NO: 7557413 - DNA, 22 bp, Homo sapiens
agtggagacaggacagtcgata

SEQ ID NO: 7557414 - DNA, 22 bp, Homo sapiens
agtggagaagaggatggtctcc

SEQ ID NO: 7557415 - DNA, 22 bp, Homo sapiens
agtggacttttagtatccttat

SEQ ID NO: 7557416 - DNA, 22 bp, Homo sapiens
agtggacattctgcacttggag

SEQ ID NO: 7557417 - DNA, 22 bp, Homo sapiens
agtggacaaccatgctgagatt

SEQ ID NO: 7557418 - DNA, 22 bp, Homo sapiens
agtggaccagaagactgaagct

SEQ ID NO: 7557419 - DNA, 22 bp, Homo sapiens
agtggaccagaagactgaagct

SEQ ID NO: 7557420 - DNA, 22 bp, Homo sapiens
agtgcttttatatcattaatcc

SEQ ID NO: 7557421 - DNA, 22 bp, Homo sapiens
agtgcttttatatcattaatcc

SEQ ID NO: 7557422 - DNA, 22 bp, Homo sapiens
agtgctttgtggagaatttgta

SEQ ID NO: 7557423 - DNA, 22 bp, Homo sapiens
agtgcttttatatcattaatcc

SEQ ID NO: 7557424 - DNA, 22 bp, Homo sapiens
agtgcttttatatcattaatcc

SEQ ID NO: 7557425 - DNA, 22 bp, Homo sapiens
agtgcttttattatatacagga

SEQ ID NO: 7557426 - DNA, 22 bp, Homo sapiens
agtgcttttattatatacagga

SEQ ID NO: 7557427 - DNA, 22 bp, Homo sapiens
agtgcttttattatatacagga

SEQ ID NO: 7557428 - DNA, 18 bp, Homo sapiens
agtggaaaacaaatacac

SEQ ID NO: 7557429 - DNA, 22 bp, Homo sapiens
agtgcttttgtcattgaatctt

SEQ ID NO: 7557430 - DNA, 22 bp, Homo sapiens
agtgcttttgtcattgaatctt

SEQ ID NO: 7557431 - DNA, 22 bp, Homo sapiens
agtggaaggtcaggggacagtg

SEQ ID NO: 7557432 - DNA, 22 bp, Homo sapiens
agtggaaggtcaggggacagtg

SEQ ID NO: 7557433 - DNA, 22 bp, Homo sapiens
agtggaaggtcaggggacagtg

SEQ ID NO: 7557434 - DNA, 22 bp, Homo sapiens
agtggaaggtcaggggacagtg

SEQ ID NO: 7557435 - DNA, 22 bp, Homo sapiens
agtggaaggtcaggggacagtg

SEQ ID NO: 7557436 - DNA, 22 bp, Homo sapiens
agtggaatttcatgaagatcca

SEQ ID NO: 7557437 - DNA, 22 bp, Homo sapiens
agtggacaaccatgctgagatt

SEQ ID NO: 7557438 - DNA, 22 bp, Homo sapiens
agtggacaaccatgctgagatt

SEQ ID NO: 7557439 - DNA, 22 bp, Homo sapiens
agtggaacactacattgttgtt

SEQ ID NO: 7557440 - DNA, 21 bp, Homo sapiens
agtggaacccttagggtcagg

SEQ ID NO: 7557441 - DNA, 18 bp, Homo sapiens
agtggaaaacaaatacac

SEQ ID NO: 7557442 - DNA, 18 bp, Homo sapiens
agtggaaaacaaatacac

SEQ ID NO: 7557443 - DNA, 22 bp, Homo sapiens
agtggaaggtcaggggacagtg

SEQ ID NO: 7557444 - DNA, 22 bp, Homo sapiens
agtggaaggctgggaaatgcgg

SEQ ID NO: 7557445 - DNA, 22 bp, Homo sapiens
agtggaagagccatgttccaac

SEQ ID NO: 7557446 - DNA, 22 bp, Homo sapiens
agtggaaggctgggaaatgcgg

SEQ ID NO: 7557447 - DNA, 22 bp, Homo sapiens
agtggaagagccatgttccaac

SEQ ID NO: 7557448 - DNA, 22 bp, Homo sapiens
agtctcaagtgttagtattatt

SEQ ID NO: 7557449 - DNA, 22 bp, Homo sapiens
agtctcaagtgttagtattatt

SEQ ID NO: 7557450 - DNA, 22 bp, Homo sapiens
agtctcaagggatgtctctata

SEQ ID NO: 7557451 - DNA, 23 bp, Homo sapiens
agtctcaagctggagaattacct

SEQ ID NO: 7557452 - DNA, 23 bp, Homo sapiens
agtctcaagctggagaattacct

SEQ ID NO: 7557453 - DNA, 22 bp, Homo sapiens
agtctcaagcaccgaaagctgt

SEQ ID NO: 7557454 - DNA, 22 bp, Homo sapiens
agtctatttttggttcttcggg

SEQ ID NO: 7557455 - DNA, 22 bp, Homo sapiens
agtctattttagctgcatatgt

SEQ ID NO: 7557456 - DNA, 22 bp, Homo sapiens
agtctattttagctgcatatgt

SEQ ID NO: 7557457 - DNA, 22 bp, Homo sapiens
agtctattttcagaagcagttt

SEQ ID NO: 7557458 - DNA, 22 bp, Homo sapiens
agtctattttcagaagcagttt

SEQ ID NO: 7557459 - DNA, 22 bp, Homo sapiens
agtctattttgcttattctatg

SEQ ID NO: 7557460 - DNA, 22 bp, Homo sapiens
agtctattttgcttattctatg

SEQ ID NO: 7557461 - DNA, 22 bp, Homo sapiens
agtctattttgcttattctatg

SEQ ID NO: 7557462 - DNA, 22 bp, Homo sapiens
agtctattttagctgcatatgt

SEQ ID NO: 7557463 - DNA, 22 bp, Homo sapiens
agtctatttcagtcttactagt

SEQ ID NO: 7557464 - DNA, 22 bp, Homo sapiens
agtctatttccccttctcttga

SEQ ID NO: 7557465 - DNA, 22 bp, Homo sapiens
agtctatttcagtcttactagt

SEQ ID NO: 7557466 - DNA, 22 bp, Homo sapiens
ctcacagtgtaatattgaaccc

SEQ ID NO: 7557467 - DNA, 21 bp, Homo sapiens
ctcacagtctgttttccttgc

SEQ ID NO: 7557468 - DNA, 22 bp, Homo sapiens
ctcacagtgatgtcttatgaca

SEQ ID NO: 7557469 - DNA, 22 bp, Homo sapiens
ctcacagtgatgtcttatgaca

SEQ ID NO: 7557470 - DNA, 21 bp, Homo sapiens
ctcacagtctgttttccttgc

SEQ ID NO: 7557471 - DNA, 22 bp, Homo sapiens
ctcacagtgatgtcttatgaca

SEQ ID NO: 7557472 - DNA, 20 bp, Homo sapiens
ctcacagtcaatgcagaggt

SEQ ID NO: 7557473 - DNA, 20 bp, Homo sapiens
ctcacagtcaatgcagaggt

SEQ ID NO: 7557474 - DNA, 20 bp, Homo sapiens
ctcacagtcaatgcagaggt

SEQ ID NO: 7557475 - DNA, 22 bp, Homo sapiens
agtctcagaaaatatgcttttt

SEQ ID NO: 7557476 - DNA, 22 bp, Homo sapiens
agtctcagaaaatatgcttttt

SEQ ID NO: 7557477 - DNA, 22 bp, Homo sapiens
agtctcagaaaagaagcatgga

SEQ ID NO: 7557478 - DNA, 22 bp, Homo sapiens
agtctcagaaaagaagcatgga

SEQ ID NO: 7557479 - DNA, 22 bp, Homo sapiens
agtctcagaaaagaagcatgga

SEQ ID NO: 7557480 - DNA, 22 bp, Homo sapiens
agtctcacttcttgagctatgc

SEQ ID NO: 7557481 - DNA, 19 bp, Homo sapiens
agtctcacccaagcagtct

SEQ ID NO: 7557482 - DNA, 22 bp, Homo sapiens
agtctcaagtgttagtattatt

SEQ ID NO: 7557483 - DNA, 22 bp, Homo sapiens
agtctattgcctaacagagagg

SEQ ID NO: 7557484 - DNA, 22 bp, Homo sapiens
agtctatttcagtcttactagt

SEQ ID NO: 7557485 - DNA, 22 bp, Homo sapiens
agtctatattgtgaaagtaaaa

SEQ ID NO: 7557486 - DNA, 22 bp, Homo sapiens
agtctattgcctaacagagagg

SEQ ID NO: 7557487 - DNA, 22 bp, Homo sapiens
agtctatattgtgaaagtaaaa

SEQ ID NO: 7557488 - DNA, 22 bp, Homo sapiens
agtctagtaggatctctgggct

SEQ ID NO: 7557489 - DNA, 22 bp, Homo sapiens
agtctatactggactgttgtga

SEQ ID NO: 7557490 - DNA, 22 bp, Homo sapiens
agtctagtaggatctctgggct

SEQ ID NO: 7557491 - DNA, 22 bp, Homo sapiens
agtctaggtaggacaccccagg

SEQ ID NO: 7557492 - DNA, 22 bp, Homo sapiens
agtctaggtacgggtccaactt

SEQ ID NO: 7557493 - DNA, 22 bp, Homo sapiens
agtctagggattgaagcatgat

SEQ ID NO: 7557494 - DNA, 22 bp, Homo sapiens
agtctagggtggggtccacagg

SEQ ID NO: 7557495 - DNA, 22 bp, Homo sapiens
agtctagggattgaagcatgat

SEQ ID NO: 7557496 - DNA, 22 bp, Homo sapiens
agtctagggaatactgaaaggt

SEQ ID NO: 7557497 - DNA, 22 bp, Homo sapiens
agtctaggcagccctgcagggt

SEQ ID NO: 7557498 - DNA, 22 bp, Homo sapiens
agtctaggcagccctgcagggt

SEQ ID NO: 7557499 - DNA, 22 bp, Homo sapiens
agtctaggcagccctgcagggt

SEQ ID NO: 7557500 - DNA, 20 bp, Homo sapiens
agtctaggattttggcagct

SEQ ID NO: 7557501 - DNA, 20 bp, Homo sapiens
agtctaggattttggcagct

SEQ ID NO: 7557502 - DNA, 20 bp, Homo sapiens
agtctaggagagggtaaagc

SEQ ID NO: 7557503 - DNA, 22 bp, Homo sapiens
agtctagatgtgtactaggtta

SEQ ID NO: 7557504 - DNA, 22 bp, Homo sapiens
agtctagatccccagtgctgtc

SEQ ID NO: 7557505 - DNA, 22 bp, Homo sapiens
agtctagatgatcctaggaata

SEQ ID NO: 7557506 - DNA, 22 bp, Homo sapiens
agtctagatccccagtgctgtc

SEQ ID NO: 7557507 - DNA, 22 bp, Homo sapiens
agtctagatccccagtgctgtc

SEQ ID NO: 7557508 - DNA, 22 bp, Homo sapiens
agtctagaggatgggtccagat

SEQ ID NO: 7557509 - DNA, 22 bp, Homo sapiens
agtctagagattctgaagggaa

SEQ ID NO: 7557510 - DNA, 22 bp, Homo sapiens
agtctagaatgtgcaccaagct

SEQ ID NO: 7557511 - DNA, 22 bp, Homo sapiens
agtctagaggatgggtccagat

SEQ ID NO: 7557512 - DNA, 22 bp, Homo sapiens
agtctagaaacaaggtagagct

SEQ ID NO: 7557513 - DNA, 22 bp, Homo sapiens
agtctagaatgtgcaccaagct

SEQ ID NO: 7557514 - DNA, 22 bp, Homo sapiens
agtctacatttctaacaagctc

SEQ ID NO: 7557515 - DNA, 22 bp, Homo sapiens
agtctacatttctaacaagctc

SEQ ID NO: 7557516 - DNA, 22 bp, Homo sapiens
agtctacatttttgttaatggt

SEQ ID NO: 7557517 - DNA, 22 bp, Homo sapiens
agtctacaatcttaaatgaact

SEQ ID NO: 7557518 - DNA, 22 bp, Homo sapiens
agtcctgggtctggagaatgga

SEQ ID NO: 7557519 - DNA, 22 bp, Homo sapiens
ctcacattccacttgtgccaac

SEQ ID NO: 7557520 - DNA, 22 bp, Homo sapiens
ctcacattccacttgtgccaac

SEQ ID NO: 7557521 - DNA, 23 bp, Homo sapiens
ctcaccaagcgccgccgctgtgt

SEQ ID NO: 7557522 - DNA, 23 bp, Homo sapiens
ctcaccaagcgccgccgctgtgt

SEQ ID NO: 7557523 - DNA, 23 bp, Homo sapiens
ctcaccaagcgccgccgctgtgt

SEQ ID NO: 7557524 - DNA, 22 bp, Homo sapiens
ctcacattcacaggacagaagg

SEQ ID NO: 7557525 - DNA, 22 bp, Homo sapiens
ctcacattccacttgtgccaac

SEQ ID NO: 7557526 - DNA, 22 bp, Homo sapiens
ctcacatgatggcctttttcat

SEQ ID NO: 7557527 - DNA, 22 bp, Homo sapiens
ctcacattcacaggacagaagg

SEQ ID NO: 7557528 - DNA, 22 bp, Homo sapiens
ctcacattcacaggacagaagg

SEQ ID NO: 7557529 - DNA, 22 bp, Homo sapiens
ctcaccacagagcctgtccagc

SEQ ID NO: 7557530 - DNA, 22 bp, Homo sapiens
ctcaccacagagcctgtccagc

SEQ ID NO: 7557531 - DNA, 22 bp, Homo sapiens
ctcaccacagagcctgtccagc

SEQ ID NO: 7557532 - DNA, 22 bp, Homo sapiens
ctcaccacagagcctgtccagc

SEQ ID NO: 7557533 - DNA, 22 bp, Homo sapiens
ctcaccacagagcctgtccagc

SEQ ID NO: 7557534 - DNA, 23 bp, Homo sapiens
ctcaccaagcgccgccgctgtgt

SEQ ID NO: 7557535 - DNA, 22 bp, Homo sapiens
ctcacagtttcacagtgtagat

SEQ ID NO: 7557536 - DNA, 22 bp, Homo sapiens
ctcacagttttctgtagtccaa

SEQ ID NO: 7557537 - DNA, 22 bp, Homo sapiens
ctcacagttttctgtagtccaa

SEQ ID NO: 7557538 - DNA, 22 bp, Homo sapiens
ctcacatagtaagcagtcagta

SEQ ID NO: 7557539 - DNA, 22 bp, Homo sapiens
ctcacagtttcacagtgtagat

SEQ ID NO: 7557540 - DNA, 22 bp, Homo sapiens
ctcacatacctgttttcccttt

SEQ ID NO: 7557541 - DNA, 22 bp, Homo sapiens
ctcacatgatggcctttttcat

SEQ ID NO: 7557542 - DNA, 22 bp, Homo sapiens
ctcacagtgtcaacattaacta

SEQ ID NO: 7557543 - DNA, 22 bp, Homo sapiens
ctcacagtgtcaacattaacta

SEQ ID NO: 7557544 - DNA, 22 bp, Homo sapiens
ctcacagtgtaatattgaaccc

SEQ ID NO: 7557545 - DNA, 22 bp, Homo sapiens
ctcacagtgtaatattgaaccc

SEQ ID NO: 7557546 - DNA, 22 bp, Homo sapiens
ctcacagtgtaatattgaaccc

SEQ ID NO: 7557547 - DNA, 22 bp, Homo sapiens
ctcacagttggagaatttagat

SEQ ID NO: 7557548 - DNA, 22 bp, Homo sapiens
ctcacagttggctcattaatga

SEQ ID NO: 7557549 - DNA, 22 bp, Homo sapiens
ctcacagttggctcattaatga

SEQ ID NO: 7557550 - DNA, 22 bp, Homo sapiens
ctcacagttgtggtacctggtt

SEQ ID NO: 7557551 - DNA, 22 bp, Homo sapiens
ctcacagttgtggtacctggtt

SEQ ID NO: 7557552 - DNA, 22 bp, Homo sapiens
ctcacagttggctcattaatga

SEQ ID NO: 7557553 - DNA, 22 bp, Homo sapiens
agtctttatacagaaatatatg

SEQ ID NO: 7557554 - DNA, 22 bp, Homo sapiens
agtctttatacagaaatatatg

SEQ ID NO: 7557555 - DNA, 22 bp, Homo sapiens
agtctttatctcgctcctggat

SEQ ID NO: 7557556 - DNA, 22 bp, Homo sapiens
agtctttatctcgctcctggat

SEQ ID NO: 7557557 - DNA, 22 bp, Homo sapiens
agtctttatctcgctcctggat

SEQ ID NO: 7557558 - DNA, 22 bp, Homo sapiens
agtctttatacagaaatatatg

SEQ ID NO: 7557559 - DNA, 22 bp, Homo sapiens
agtctttatgattgtcaaagta

SEQ ID NO: 7557560 - DNA, 22 bp, Homo sapiens
agtctttatgattgtcaaagta

SEQ ID NO: 7557561 - DNA, 22 bp, Homo sapiens
agtctttatgattgtcaaagta

SEQ ID NO: 7557562 - DNA, 22 bp, Homo sapiens
agtctttatgattgtcaaagta

SEQ ID NO: 7557563 - DNA, 22 bp, Homo sapiens
agtctttattcactattgataa

SEQ ID NO: 7557564 - DNA, 22 bp, Homo sapiens
agtctttattcactattgataa

SEQ ID NO: 7557565 - DNA, 22 bp, Homo sapiens
agtctttattcactattgataa

SEQ ID NO: 7557566 - DNA, 22 bp, Homo sapiens
agtctttattcactattgataa

SEQ ID NO: 7557567 - DNA, 22 bp, Homo sapiens
agtctttattcactattgataa

SEQ ID NO: 7557568 - DNA, 22 bp, Homo sapiens
agtctttattcagccaagtact

SEQ ID NO: 7557569 - DNA, 22 bp, Homo sapiens
agtctttattcagccaagtact

SEQ ID NO: 7557570 - DNA, 22 bp, Homo sapiens
agtctttattcagccaagtact

SEQ ID NO: 7557571 - DNA, 22 bp, Homo sapiens
agtcttctgctctgtcactaac

SEQ ID NO: 7557572 - DNA, 18 bp, Homo sapiens
agtcttctgatccatttt

SEQ ID NO: 7557573 - DNA, 18 bp, Homo sapiens
agtcttctgatccatttt

SEQ ID NO: 7557574 - DNA, 18 bp, Homo sapiens
agtcttctgatccatttt

SEQ ID NO: 7557575 - DNA, 18 bp, Homo sapiens
agtcttctgatccatttt

SEQ ID NO: 7557576 - DNA, 22 bp, Homo sapiens
agtctttatacagaaatatatg

SEQ ID NO: 7557577 - DNA, 22 bp, Homo sapiens
agtctttatacagaaatatatg

SEQ ID NO: 7557578 - DNA, 22 bp, Homo sapiens
agtctttatacagaaatatatg

SEQ ID NO: 7557579 - DNA, 22 bp, Homo sapiens
agtctttatacagaaatatatg

SEQ ID NO: 7557580 - DNA, 22 bp, Homo sapiens
agtcttctgctctgtcactaac

SEQ ID NO: 7557581 - DNA, 22 bp, Homo sapiens
agtcttctgggtgtttccagag

SEQ ID NO: 7557582 - DNA, 22 bp, Homo sapiens
agtcttctgggtgtttccagag

SEQ ID NO: 7557583 - DNA, 22 bp, Homo sapiens
agtcttctgctctgtcactaac

SEQ ID NO: 7557584 - DNA, 22 bp, Homo sapiens
agtcttctgggtgtttccagag

SEQ ID NO: 7557585 - DNA, 22 bp, Homo sapiens
agtctttgaagttctgacagag

SEQ ID NO: 7557586 - DNA, 21 bp, Homo sapiens
agtctttgataaagacaaagt

SEQ ID NO: 7557587 - DNA, 21 bp, Homo sapiens
agtctttgataaagacaaagt

SEQ ID NO: 7557588 - DNA, 22 bp, Homo sapiens
agtctttggttataagagacag

SEQ ID NO: 7557589 - DNA, 19 bp, Homo sapiens
agtctttgcctggggcctt

SEQ ID NO: 7557590 - DNA, 22 bp, Homo sapiens
agtctttccttttggaagaaaa

SEQ ID NO: 7557591 - DNA, 22 bp, Homo sapiens
agtctttgaagttctgacagag

SEQ ID NO: 7557592 - DNA, 22 bp, Homo sapiens
agtctttatttagagttaggac

SEQ ID NO: 7557593 - DNA, 22 bp, Homo sapiens
agtctttatttagagttaggac

SEQ ID NO: 7557594 - DNA, 22 bp, Homo sapiens
agtctttatttagagttaggac

SEQ ID NO: 7557595 - DNA, 18 bp, Homo sapiens
agtctttatttctttcat

SEQ ID NO: 7557596 - DNA, 22 bp, Homo sapiens
agtctttattgtcgtcactaga

SEQ ID NO: 7557597 - DNA, 22 bp, Homo sapiens
agtctttattgtcgtcactaga

SEQ ID NO: 7557598 - DNA, 22 bp, Homo sapiens
agtctttattgtcgtcactaga

SEQ ID NO: 7557599 - DNA, 22 bp, Homo sapiens
agtctttattgtcgtcactaga

SEQ ID NO: 7557600 - DNA, 18 bp, Homo sapiens
agtctttatttctttcat

SEQ ID NO: 7557601 - DNA, 18 bp, Homo sapiens
agtctttatttctttcat

SEQ ID NO: 7557602 - DNA, 18 bp, Homo sapiens
agtctttatttctttcat

SEQ ID NO: 7557603 - DNA, 18 bp, Homo sapiens
agtctttatttctttcat

SEQ ID NO: 7557604 - DNA, 22 bp, Homo sapiens
agtgaaatcaggttttgactgc

SEQ ID NO: 7557605 - DNA, 22 bp, Homo sapiens
agtgaaatcaggttttgactgc

SEQ ID NO: 7557606 - DNA, 22 bp, Homo sapiens
agtgaaatatgcccattgctgt

SEQ ID NO: 7557607 - DNA, 22 bp, Homo sapiens
agtgaaatagcatttatgaagc

SEQ ID NO: 7557608 - DNA, 22 bp, Homo sapiens
agtgaaatagcatttatgaagc

SEQ ID NO: 7557609 - DNA, 22 bp, Homo sapiens
agtgaaataaagctgcctatgg

SEQ ID NO: 7557610 - DNA, 22 bp, Homo sapiens
agtgaaataaagctgcctatgg

SEQ ID NO: 7557611 - DNA, 22 bp, Homo sapiens
agtgaaaggttgagaatattct

SEQ ID NO: 7557612 - DNA, 22 bp, Homo sapiens
agtgaaaggttgagaatattct

SEQ ID NO: 7557613 - DNA, 22 bp, Homo sapiens
agtgaaaggaaaaactgatatt

SEQ ID NO: 7557614 - DNA, 22 bp, Homo sapiens
agtgaaaggttgagaatattct

SEQ ID NO: 7557615 - DNA, 22 bp, Homo sapiens
agtgaaatactgtcgtttttag

SEQ ID NO: 7557616 - DNA, 22 bp, Homo sapiens
agtgaaatagcatttatgaagc

SEQ ID NO: 7557617 - DNA, 22 bp, Homo sapiens
agtgaaaacctaatcatgcagt

SEQ ID NO: 7557618 - DNA, 22 bp, Homo sapiens
agtgaaaacctaatcatgcagt

SEQ ID NO: 7557619 - DNA, 22 bp, Homo sapiens
agtgaaaacctaatcatgcagt

SEQ ID NO: 7557620 - DNA, 22 bp, Homo sapiens
agtgaaaacctaatcatgcagt

SEQ ID NO: 7557621 - DNA, 22 bp, Homo sapiens
agtgaaaacctaatcatgcagt

SEQ ID NO: 7557622 - DNA, 22 bp, Homo sapiens
agtgaaaacactagttcttgcc

SEQ ID NO: 7557623 - DNA, 22 bp, Homo sapiens
agtcttttattcaaggctaagt

SEQ ID NO: 7557624 - DNA, 22 bp, Homo sapiens
agtctttggttataagagacag

SEQ ID NO: 7557625 - DNA, 22 bp, Homo sapiens
agtgaaaacactagttcttgcc

SEQ ID NO: 7557626 - DNA, 22 bp, Homo sapiens
agtgaaaacactagttcttgcc

SEQ ID NO: 7557627 - DNA, 22 bp, Homo sapiens
agtgaaaacctaatcatgcagt

SEQ ID NO: 7557628 - DNA, 22 bp, Homo sapiens
agtgaaaacctaatcatgcagt

SEQ ID NO: 7557629 - DNA, 22 bp, Homo sapiens
agtgaaaacctaatcatgcagt

SEQ ID NO: 7557630 - DNA, 22 bp, Homo sapiens
agtgaaaggaaaaactgatatt

SEQ ID NO: 7557631 - DNA, 22 bp, Homo sapiens
agtgaaaggaaaaactgatatt

SEQ ID NO: 7557632 - DNA, 22 bp, Homo sapiens
agtgaaaggaaaaactgatatt

SEQ ID NO: 7557633 - DNA, 22 bp, Homo sapiens
agtgaaacagagcacagcatgc

SEQ ID NO: 7557634 - DNA, 22 bp, Homo sapiens
agtgaaaagatgcatttctctg

SEQ ID NO: 7557635 - DNA, 22 bp, Homo sapiens
agtgaaaagatgcatttctctg

SEQ ID NO: 7557636 - DNA, 19 bp, Homo sapiens
agtgaaatggagtattcaa

SEQ ID NO: 7557637 - DNA, 22 bp, Homo sapiens
agtgaaattcctggtctttgtt

SEQ ID NO: 7557638 - DNA, 22 bp, Homo sapiens
agtgaaatgattctgagcaaga

SEQ ID NO: 7557639 - DNA, 22 bp, Homo sapiens
agtgaaatgattctgagcaaga

SEQ ID NO: 7557640 - DNA, 22 bp, Homo sapiens
agtgaaatcctggtcaacaggt

SEQ ID NO: 7557641 - DNA, 22 bp, Homo sapiens
agtgaaatcctggtcaacaggt

SEQ ID NO: 7557642 - DNA, 22 bp, Homo sapiens
agtgaaatcctggtcaacaggt

SEQ ID NO: 7557643 - DNA, 22 bp, Homo sapiens
agtgaaatcctggtcaacaggt

SEQ ID NO: 7557644 - DNA, 22 bp, Homo sapiens
agtgaaatcctggtcaacaggt

SEQ ID NO: 7557645 - DNA, 22 bp, Homo sapiens
agtgaaatgactgaatcagata

SEQ ID NO: 7557646 - DNA, 22 bp, Homo sapiens
agtgaaatgatagtgtaaatac

SEQ ID NO: 7557647 - DNA, 22 bp, Homo sapiens
agtgaaatgactgaatcagata

SEQ ID NO: 7557648 - DNA, 22 bp, Homo sapiens
agtgaaatgactgaatcagata

SEQ ID NO: 7557649 - DNA, 22 bp, Homo sapiens
agtgaaattgctgtaagaggaa

SEQ ID NO: 7557650 - DNA, 22 bp, Homo sapiens
agtgacttaaaggaacttactg

SEQ ID NO: 7557651 - DNA, 22 bp, Homo sapiens
agtgacttctccgtggcaggat

SEQ ID NO: 7557652 - DNA, 22 bp, Homo sapiens
agtgacttctcctaatgtcata

SEQ ID NO: 7557653 - DNA, 22 bp, Homo sapiens
agtgacttctcctaatgtcata

SEQ ID NO: 7557654 - DNA, 22 bp, Homo sapiens
agtgaaattgctgtaagaggaa

SEQ ID NO: 7557655 - DNA, 22 bp, Homo sapiens
agtgaaattcctggtctttgtt

SEQ ID NO: 7557656 - DNA, 21 bp, Homo sapiens
agtgaaattgcatcagaggga

SEQ ID NO: 7557657 - DNA, 22 bp, Homo sapiens
agtgagggactagtgctgggga

SEQ ID NO: 7557658 - DNA, 22 bp, Homo sapiens
agtgagggactagtgctgggga

SEQ ID NO: 7557659 - DNA, 22 bp, Homo sapiens
agtgaggctaataggcaatggt

SEQ ID NO: 7557660 - DNA, 17 bp, Homo sapiens
agtgacttggaaagagc

SEQ ID NO: 7557661 - DNA, 22 bp, Homo sapiens
agtgacttcttaaaccatggtc

SEQ ID NO: 7557662 - DNA, 22 bp, Homo sapiens
agtgacttcttaaaccatggtc

SEQ ID NO: 7557663 - DNA, 22 bp, Homo sapiens
agtgaggggattcaggcaaggt

SEQ ID NO: 7557664 - DNA, 22 bp, Homo sapiens
agtgaggggattcaggcaaggt

SEQ ID NO: 7557665 - DNA, 22 bp, Homo sapiens
agtgaggggattcaggcaaggt

SEQ ID NO: 7557666 - DNA, 22 bp, Homo sapiens
agtgagggactccatgactcct

SEQ ID NO: 7557667 - DNA, 22 bp, Homo sapiens
agtgagggactccatgactcct

SEQ ID NO: 7557668 - DNA, 22 bp, Homo sapiens
agtgagggactagtgctgggga

SEQ ID NO: 7557669 - DNA, 22 bp, Homo sapiens
agtgagggactagtgctgggga

SEQ ID NO: 7557670 - DNA, 22 bp, Homo sapiens
agtgagggactagtgctgggga

SEQ ID NO: 7557671 - DNA, 22 bp, Homo sapiens
agtgagggactagtgctgggga

SEQ ID NO: 7557672 - DNA, 22 bp, Homo sapiens
agtgagggactccatgactcct

SEQ ID NO: 7557673 - DNA, 22 bp, Homo sapiens
agtgagggactagtgctgggga

SEQ ID NO: 7557674 - DNA, 22 bp, Homo sapiens
agtgagggactagtgctgggga

SEQ ID NO: 7557675 - DNA, 22 bp, Homo sapiens
agtgaggggcagctgagtgggc

SEQ ID NO: 7557676 - DNA, 22 bp, Homo sapiens
agtgaggggcagctgagtgggc

SEQ ID NO: 7557677 - DNA, 22 bp, Homo sapiens
agtgaggggcagctgagtgggc

SEQ ID NO: 7557678 - DNA, 22 bp, Homo sapiens
agtgaggggcagctgagtgggc

SEQ ID NO: 7557679 - DNA, 22 bp, Homo sapiens
agtgaggggcagctgagtgggc

SEQ ID NO: 7557680 - DNA, 22 bp, Homo sapiens
agtgaggggattcaggcaaggt

SEQ ID NO: 7557681 - DNA, 22 bp, Homo sapiens
agtgaggggattcaggcaaggt

SEQ ID NO: 7557682 - DNA, 22 bp, Homo sapiens
agtgaggggattcaggcaaggt

SEQ ID NO: 7557683 - DNA, 22 bp, Homo sapiens
agtgagtggagagctctaggtt

SEQ ID NO: 7557684 - DNA, 22 bp, Homo sapiens
agtgagtcaaacatatcctgac

SEQ ID NO: 7557685 - DNA, 22 bp, Homo sapiens
agtgagtggaccctgcaaggaa

SEQ ID NO: 7557686 - DNA, 22 bp, Homo sapiens
agtgagtggagagctctaggtt

SEQ ID NO: 7557687 - DNA, 22 bp, Homo sapiens
agtgaggtcatactggagaggg

SEQ ID NO: 7557688 - DNA, 22 bp, Homo sapiens
agtgagtcaaaaaacttagata

SEQ ID NO: 7557689 - DNA, 22 bp, Homo sapiens
agtgaggtaattagagctgctg

SEQ ID NO: 7557690 - DNA, 22 bp, Homo sapiens
agtgaggggcagctgagtgggc

SEQ ID NO: 7557691 - DNA, 22 bp, Homo sapiens
agtgaggtcatactggagaggg

SEQ ID NO: 7557692 - DNA, 22 bp, Homo sapiens
agtgaggtcatactggagaggg

SEQ ID NO: 7557693 - DNA, 22 bp, Homo sapiens
agtgaggtcaggatctcaggga

SEQ ID NO: 7557694 - DNA, 22 bp, Homo sapiens
agtgaggtaattagagctgctg

SEQ ID NO: 7557695 - DNA, 22 bp, Homo sapiens
agtgagtggatgtaggaattgg

SEQ ID NO: 7557696 - DNA, 19 bp, Homo sapiens
agtgagtggggaaggccct

SEQ ID NO: 7557697 - DNA, 20 bp, Homo sapiens
agtgagttatcagctacagt

SEQ ID NO: 7557698 - DNA, 20 bp, Homo sapiens
agtgagttatcagctacagt

SEQ ID NO: 7557699 - DNA, 22 bp, Homo sapiens
agtgagtttagggtgcaggtgt

SEQ ID NO: 7557700 - DNA, 22 bp, Homo sapiens
agtgataaaggtgtgatatgaa

SEQ ID NO: 7557701 - DNA, 22 bp, Homo sapiens
agtgagttgatggaaaactcag

SEQ ID NO: 7557702 - DNA, 22 bp, Homo sapiens
agtgagttgaacattgataatg

SEQ ID NO: 7557703 - DNA, 22 bp, Homo sapiens
agtgagttgaacattgataatg

SEQ ID NO: 7557704 - DNA, 22 bp, Homo sapiens
agtgataggacatatggatttt

SEQ ID NO: 7557705 - DNA, 22 bp, Homo sapiens
agtgatagcaaataaaatgtaa

SEQ ID NO: 7557706 - DNA, 22 bp, Homo sapiens
agtgataatgtggtaattattt

SEQ ID NO: 7557707 - DNA, 22 bp, Homo sapiens
agtgataaaggtgtgatatgaa

SEQ ID NO: 7557708 - DNA, 22 bp, Homo sapiens
agtgataaccatgtgtgaatta

SEQ ID NO: 7557709 - DNA, 22 bp, Homo sapiens
agtgataaccatgtgtgaatta

SEQ ID NO: 7557710 - DNA, 22 bp, Homo sapiens
agtgatatatgttgccagagag

SEQ ID NO: 7557711 - DNA, 22 bp, Homo sapiens
agtgatagcaaataaaatgtaa

SEQ ID NO: 7557712 - DNA, 22 bp, Homo sapiens
agtgataggacatatggatttt

SEQ ID NO: 7557713 - DNA, 22 bp, Homo sapiens
agtgatcaatgcttgtcattgt

SEQ ID NO: 7557714 - DNA, 22 bp, Homo sapiens
agtgatcagcttgaagtagttt

SEQ ID NO: 7557715 - DNA, 22 bp, Homo sapiens
agtgatcagtgagtgaagcagg

SEQ ID NO: 7557716 - DNA, 22 bp, Homo sapiens
agtgatcagtgagtgaagcagg

SEQ ID NO: 7557717 - DNA, 22 bp, Homo sapiens
agtgatggtgagtgagaagctc

SEQ ID NO: 7557718 - DNA, 22 bp, Homo sapiens
agtgatggggccctgcactgat

SEQ ID NO: 7557719 - DNA, 22 bp, Homo sapiens
agtgatgggtaatgggaacaga

SEQ ID NO: 7557720 - DNA, 22 bp, Homo sapiens
agtgatggggccctgcactgat

SEQ ID NO: 7557721 - DNA, 22 bp, Homo sapiens
agtgatggtgagtgagaagctc

SEQ ID NO: 7557722 - DNA, 22 bp, Homo sapiens
agtgatggtttccagtcactga

SEQ ID NO: 7557723 - DNA, 22 bp, Homo sapiens
agtgatggtttccagtcactga

SEQ ID NO: 7557724 - DNA, 22 bp, Homo sapiens
agtgatgtaacaaacagagtta

SEQ ID NO: 7557725 - DNA, 22 bp, Homo sapiens
agtgatgtaacaaacagagtta

SEQ ID NO: 7557726 - DNA, 22 bp, Homo sapiens
agtgatggtttccagtcactga

SEQ ID NO: 7557727 - DNA, 22 bp, Homo sapiens
agtgatggtttccagtcactga

SEQ ID NO: 7557728 - DNA, 22 bp, Homo sapiens
agtgatgtaacaaacagagtta

SEQ ID NO: 7557729 - DNA, 22 bp, Homo sapiens
agtgatgccacacaatgctttg

SEQ ID NO: 7557730 - DNA, 22 bp, Homo sapiens
agtgatcttttaaaaagaagtg

SEQ ID NO: 7557731 - DNA, 22 bp, Homo sapiens
agtgatctgactcccagttaga

SEQ ID NO: 7557732 - DNA, 22 bp, Homo sapiens
agtgatggagcttcctctgcta

SEQ ID NO: 7557733 - DNA, 22 bp, Homo sapiens
agtgatggcagtgaataaggct

SEQ ID NO: 7557734 - DNA, 22 bp, Homo sapiens
agtgatggggccctgcactgat

SEQ ID NO: 7557735 - DNA, 22 bp, Homo sapiens
agtgatggggccctgcactgat

SEQ ID NO: 7557736 - DNA, 22 bp, Homo sapiens
agtgatggcatcgggtccagca

SEQ ID NO: 7557737 - DNA, 22 bp, Homo sapiens
agtgatggcatcgggtccagca

SEQ ID NO: 7557738 - DNA, 22 bp, Homo sapiens
agtgatggcatatatagatgtg

SEQ ID NO: 7557739 - DNA, 22 bp, Homo sapiens
agtgatggcatcgggtccagca

SEQ ID NO: 7557740 - DNA, 22 bp, Homo sapiens
agtgatggcatatatagatgtg

SEQ ID NO: 7557741 - DNA, 22 bp, Homo sapiens
agtggggccgcggtcctgccct

SEQ ID NO: 7557742 - DNA, 22 bp, Homo sapiens
agtggggccgcggtcctgccct

SEQ ID NO: 7557743 - DNA, 22 bp, Homo sapiens
agtggggagtttccagatgtgt

SEQ ID NO: 7557744 - DNA, 22 bp, Homo sapiens
agtggggagtttccagatgtgt

SEQ ID NO: 7557745 - DNA, 22 bp, Homo sapiens
agtggctgaagcatcaaaggca

SEQ ID NO: 7557746 - DNA, 22 bp, Homo sapiens
agtggctcccatgtcttgcact

SEQ ID NO: 7557747 - DNA, 22 bp, Homo sapiens
agtggctcttgggtcactgggc

SEQ ID NO: 7557748 - DNA, 22 bp, Homo sapiens
agtggctcttgggtcactgggc

SEQ ID NO: 7557749 - DNA, 22 bp, Homo sapiens
agtggctcttgggtcactgggc

SEQ ID NO: 7557750 - DNA, 22 bp, Homo sapiens
agtggctcttgggtcactgggc

SEQ ID NO: 7557751 - DNA, 22 bp, Homo sapiens
agtggctcttgggtcactgggc

SEQ ID NO: 7557752 - DNA, 22 bp, Homo sapiens
agtggctctccaagaagtcaca

SEQ ID NO: 7557753 - DNA, 22 bp, Homo sapiens
agtggctctccaagaagtcaca

SEQ ID NO: 7557754 - DNA, 22 bp, Homo sapiens
agtggctctccaagaagtcaca

SEQ ID NO: 7557755 - DNA, 22 bp, Homo sapiens
agtggctccaaaccgtagtcat

SEQ ID NO: 7557756 - DNA, 22 bp, Homo sapiens
agtggctagatcatgagtgagc

SEQ ID NO: 7557757 - DNA, 22 bp, Homo sapiens
agtggctccaaaccgtagtcat

SEQ ID NO: 7557758 - DNA, 22 bp, Homo sapiens
agtggctccaaaccgtagtcat

SEQ ID NO: 7557759 - DNA, 21 bp, Homo sapiens
agtggctctcagcttgctaag

SEQ ID NO: 7557760 - DNA, 22 bp, Homo sapiens
agtggctcccatgtcttgcact

SEQ ID NO: 7557761 - DNA, 21 bp, Homo sapiens
agtggctctcagcttgctaag

SEQ ID NO: 7557762 - DNA, 22 bp, Homo sapiens
agtgggtcagagagctccagat

SEQ ID NO: 7557763 - DNA, 22 bp, Homo sapiens
agtgggtgacagtgaacacgta

SEQ ID NO: 7557764 - DNA, 22 bp, Homo sapiens
agtgggtgacagtgaacacgta

SEQ ID NO: 7557765 - DNA, 22 bp, Homo sapiens
agtgggtgacagttaacaggtt

SEQ ID NO: 7557766 - DNA, 22 bp, Homo sapiens
agtgggtgagcttggtctagat

SEQ ID NO: 7557767 - DNA, 22 bp, Homo sapiens
agtgggtgacagttaacaggtt

SEQ ID NO: 7557768 - DNA, 22 bp, Homo sapiens
agtgggtgacagtgaacacgta

SEQ ID NO: 7557769 - DNA, 22 bp, Homo sapiens
agtgggtaggcctctggtgcct

SEQ ID NO: 7557770 - DNA, 22 bp, Homo sapiens
agtgggtactgggcaggcagag

SEQ ID NO: 7557771 - DNA, 22 bp, Homo sapiens
agtgggtgataagaccaaggag

SEQ ID NO: 7557772 - DNA, 22 bp, Homo sapiens
agtgggtgataagaccaaggag

SEQ ID NO: 7557773 - DNA, 20 bp, Homo sapiens
agtgggtgatgaaggaatag

SEQ ID NO: 7557774 - DNA, 22 bp, Homo sapiens
agtgggtgataagaccaaggag

SEQ ID NO: 7557775 - DNA, 20 bp, Homo sapiens
agtgggtgatgaaggaatag

SEQ ID NO: 7557776 - DNA, 20 bp, Homo sapiens
agtgggtgatgaaggaatag

SEQ ID NO: 7557777 - DNA, 22 bp, Homo sapiens
agtgggtgagcttggtctagat

SEQ ID NO: 7557778 - DNA, 22 bp, Homo sapiens
agtgggtgagcttggtctagat

SEQ ID NO: 7557779 - DNA, 22 bp, Homo sapiens
agtgggtgagcttggtctagat

SEQ ID NO: 7557780 - DNA, 22 bp, Homo sapiens
agtgggtgagcttggtctagat

SEQ ID NO: 7557781 - DNA, 22 bp, Homo sapiens
agtgggtgagcttggtctagat

SEQ ID NO: 7557782 - DNA, 22 bp, Homo sapiens
agtggcccttagtggcaaagtc

SEQ ID NO: 7557783 - DNA, 22 bp, Homo sapiens
agtggcctggagccccgcctgg

SEQ ID NO: 7557784 - DNA, 22 bp, Homo sapiens
agtggcctggagccccgcctgg

SEQ ID NO: 7557785 - DNA, 22 bp, Homo sapiens
agtggcctggagccccgcctgg

SEQ ID NO: 7557786 - DNA, 22 bp, Homo sapiens
agtggcctggagccccgcctgg

SEQ ID NO: 7557787 - DNA, 22 bp, Homo sapiens
agtggcctggagccccgcctgg

SEQ ID NO: 7557788 - DNA, 22 bp, Homo sapiens
agtggcctggagccccgcctgg

SEQ ID NO: 7557789 - DNA, 22 bp, Homo sapiens
agtggcggggattagcagtgtt

SEQ ID NO: 7557790 - DNA, 22 bp, Homo sapiens
agtggcggggattagcagtgtt

SEQ ID NO: 7557791 - DNA, 22 bp, Homo sapiens
agtggctaataacagctaaaca

SEQ ID NO: 7557792 - DNA, 22 bp, Homo sapiens
agtggctaataacagctaaaca

SEQ ID NO: 7557793 - DNA, 23 bp, Homo sapiens
agtggccttccaggttgtgtttc

SEQ ID NO: 7557794 - DNA, 22 bp, Homo sapiens
agtggctcagagtctattgagg

SEQ ID NO: 7557795 - DNA, 22 bp, Homo sapiens
agtggctcagagtctattgagg

SEQ ID NO: 7557796 - DNA, 22 bp, Homo sapiens
agtggctatgcatgactggaat

SEQ ID NO: 7557797 - DNA, 22 bp, Homo sapiens
agtggctatgcatgactggaat

SEQ ID NO: 7557798 - DNA, 22 bp, Homo sapiens
agtggctagatcatgagtgagc

SEQ ID NO: 7557799 - DNA, 22 bp, Homo sapiens
agtggccctggagtgactcgta

SEQ ID NO: 7557800 - DNA, 22 bp, Homo sapiens
agtggcccctagggaacagcct

SEQ ID NO: 7557801 - DNA, 22 bp, Homo sapiens
agtggccccacagtagggctta

SEQ ID NO: 7557802 - DNA, 22 bp, Homo sapiens
agtggccccacagtagggctta

SEQ ID NO: 7557803 - DNA, 22 bp, Homo sapiens
agtggccatggcaggtgagcat

SEQ ID NO: 7557804 - DNA, 22 bp, Homo sapiens
agtggccatggcaggtgagcat

SEQ ID NO: 7557805 - DNA, 22 bp, Homo sapiens
agtggccatggcaggtgagcat

SEQ ID NO: 7557806 - DNA, 22 bp, Homo sapiens
agtggccatccctcaggtaggc

SEQ ID NO: 7557807 - DNA, 22 bp, Homo sapiens
agtggccatccctcaggtaggc

SEQ ID NO: 7557808 - DNA, 22 bp, Homo sapiens
agtggccatccctcaggtaggc

SEQ ID NO: 7557809 - DNA, 22 bp, Homo sapiens
agtggccagtgctgctctgggg

SEQ ID NO: 7557810 - DNA, 22 bp, Homo sapiens
agtggccagtgctgctctgggg

SEQ ID NO: 7557811 - DNA, 22 bp, Homo sapiens
agtggccagtgctgctctgggg

SEQ ID NO: 7557812 - DNA, 22 bp, Homo sapiens
agtggccagtgaaggcggcagc

SEQ ID NO: 7557813 - DNA, 22 bp, Homo sapiens
agtggccagtgctgctctgggg

SEQ ID NO: 7557814 - DNA, 22 bp, Homo sapiens
agtggccagtgaaggcggcagc

SEQ ID NO: 7557815 - DNA, 22 bp, Homo sapiens
ctctggagttcttcaagctact

SEQ ID NO: 7557816 - DNA, 20 bp, Homo sapiens
ctctggagttggggaacatt

SEQ ID NO: 7557817 - DNA, 20 bp, Homo sapiens
ctctggagttggggaacatt

SEQ ID NO: 7557818 - DNA, 20 bp, Homo sapiens
ctctggagttggggaacatt

SEQ ID NO: 7557819 - DNA, 20 bp, Homo sapiens
ctctggagttggggaacatt

SEQ ID NO: 7557820 - DNA, 20 bp, Homo sapiens
ctctggagttggggaacatt

SEQ ID NO: 7557821 - DNA, 21 bp, Homo sapiens
ctctggagtttgaaggctggg

SEQ ID NO: 7557822 - DNA, 21 bp, Homo sapiens
ctctggagtttgaaggctggg

SEQ ID NO: 7557823 - DNA, 21 bp, Homo sapiens
ctctggagtttgaaggctggg

SEQ ID NO: 7557824 - DNA, 21 bp, Homo sapiens
ctctggagtttgaaggctggg

SEQ ID NO: 7557825 - DNA, 22 bp, Homo sapiens
ctctggagttctcatgaggaac

SEQ ID NO: 7557826 - DNA, 22 bp, Homo sapiens
ctctggagttctcatgaggaac

SEQ ID NO: 7557827 - DNA, 22 bp, Homo sapiens
ctctggagttcttcaagctact

SEQ ID NO: 7557828 - DNA, 22 bp, Homo sapiens
ctctggagttcttcaagctact

SEQ ID NO: 7557829 - DNA, 22 bp, Homo sapiens
ctctggagttctcatgaggaac

SEQ ID NO: 7557830 - DNA, 22 bp, Homo sapiens
ctctggagttctcatgaggaac

SEQ ID NO: 7557831 - DNA, 22 bp, Homo sapiens
ctctggagttctcatgaggaac

SEQ ID NO: 7557832 - DNA, 22 bp, Homo sapiens
ctctggagttctcatgaggaac

SEQ ID NO: 7557833 - DNA, 22 bp, Homo sapiens
ctctggagtgtctggccagggt

SEQ ID NO: 7557834 - DNA, 22 bp, Homo sapiens
ctctggagtgtctggccagggt

SEQ ID NO: 7557835 - DNA, 22 bp, Homo sapiens
ctctggagtgtctggccagggt

SEQ ID NO: 7557836 - DNA, 22 bp, Homo sapiens
ctctggagtgtctggccagggt

SEQ ID NO: 7557837 - DNA, 22 bp, Homo sapiens
ctctggagtgtctggccagggt

SEQ ID NO: 7557838 - DNA, 22 bp, Homo sapiens
ctctggagtgtctggccagggt

SEQ ID NO: 7557839 - DNA, 22 bp, Homo sapiens
ctctggagttagtgatctgggc

SEQ ID NO: 7557840 - DNA, 22 bp, Homo sapiens
ctctggagttcccttgatctga

SEQ ID NO: 7557841 - DNA, 22 bp, Homo sapiens
ctctggagttcccttgatctga

SEQ ID NO: 7557842 - DNA, 22 bp, Homo sapiens
ctctggagttagtgatctgggc

SEQ ID NO: 7557843 - DNA, 22 bp, Homo sapiens
agtgggtgcaaccatggctagg

SEQ ID NO: 7557844 - DNA, 22 bp, Homo sapiens
agtgggtgcaaccatggctagg

SEQ ID NO: 7557845 - DNA, 22 bp, Homo sapiens
agtgggtgcaaccatggctagg

SEQ ID NO: 7557846 - DNA, 22 bp, Homo sapiens
agtgggtgcaaccatggctagg

SEQ ID NO: 7557847 - DNA, 22 bp, Homo sapiens
agtgggtggcgcagaggaggaa

SEQ ID NO: 7557848 - DNA, 22 bp, Homo sapiens
agtgggtggcgcagaggaggaa

SEQ ID NO: 7557849 - DNA, 22 bp, Homo sapiens
agtgggtggcgcagaggaggaa

SEQ ID NO: 7557850 - DNA, 22 bp, Homo sapiens
agtgggtggcgcagaggaggaa

SEQ ID NO: 7557851 - DNA, 22 bp, Homo sapiens
agtgggtggcgcagaggaggaa

SEQ ID NO: 7557852 - DNA, 22 bp, Homo sapiens
agtgggtggcgcagaggaggaa

SEQ ID NO: 7557853 - DNA, 22 bp, Homo sapiens
agtgggtggcgcagaggaggaa

SEQ ID NO: 7557854 - DNA, 22 bp, Homo sapiens
agtgggtggcgcagaggaggaa

SEQ ID NO: 7557855 - DNA, 22 bp, Homo sapiens
agtgggtggcgcagaggaggaa

SEQ ID NO: 7557856 - DNA, 22 bp, Homo sapiens
agtgggtgggtgtctgacagtt

SEQ ID NO: 7557857 - DNA, 22 bp, Homo sapiens
agtgggtgggtgtctgacagtt

SEQ ID NO: 7557858 - DNA, 22 bp, Homo sapiens
agtgggtgggtgtctgacagtt

SEQ ID NO: 7557859 - DNA, 22 bp, Homo sapiens
agtgggtgggtgtctgacagtt

SEQ ID NO: 7557860 - DNA, 20 bp, Homo sapiens
agtgggtgtaagttattgcc

SEQ ID NO: 7557861 - DNA, 20 bp, Homo sapiens
agtgggtgtaagttattgcc

SEQ ID NO: 7557862 - DNA, 22 bp, Homo sapiens
agtgggtgggtgtctgacagtt

SEQ ID NO: 7557863 - DNA, 22 bp, Homo sapiens
agtgggtgggtgtctgacagtt

SEQ ID NO: 7557864 - DNA, 22 bp, Homo sapiens
agtgggtgggtgtctgacagtt

SEQ ID NO: 7557865 - DNA, 22 bp, Homo sapiens
agtgggtgggtgtctgacagtt

SEQ ID NO: 7557866 - DNA, 22 bp, Homo sapiens
agtgggtgggtgtctgacagtt

SEQ ID NO: 7557867 - DNA, 22 bp, Homo sapiens
agtggtaactaagtcctgctta

SEQ ID NO: 7557868 - DNA, 22 bp, Homo sapiens
agtgggtgtagtcttcctcctg

SEQ ID NO: 7557869 - DNA, 22 bp, Homo sapiens
agtgggtgtagtcttcctcctg

SEQ ID NO: 7557870 - DNA, 22 bp, Homo sapiens
agtggtaactaagtcctgctta

SEQ ID NO: 7557871 - DNA, 22 bp, Homo sapiens
agtggtagaaaatgcagctcga

SEQ ID NO: 7557872 - DNA, 22 bp, Homo sapiens
agtggtagaattccatataccc

SEQ ID NO: 7557873 - DNA, 22 bp, Homo sapiens
agtggtagaaaatgcagctcga

SEQ ID NO: 7557874 - DNA, 19 bp, Homo sapiens
agtggtagatgagcaggag

SEQ ID NO: 7557875 - DNA, 19 bp, Homo sapiens
agtggtagatgagcaggag

SEQ ID NO: 7557876 - DNA, 22 bp, Homo sapiens
agtggtagacaatttaaaaata

SEQ ID NO: 7557877 - DNA, 22 bp, Homo sapiens
agtggtagagagatactttagg

SEQ ID NO: 7557878 - DNA, 22 bp, Homo sapiens
agtggtagagtcaaggttgtaa

SEQ ID NO: 7557879 - DNA, 22 bp, Homo sapiens
ctctggagtgggtggccgggag

SEQ ID NO: 7557880 - DNA, 22 bp, Homo sapiens
agtggtctagtctgaggattat

SEQ ID NO: 7557881 - DNA, 22 bp, Homo sapiens
agtggtccttaagctgctgggt

SEQ ID NO: 7557882 - DNA, 22 bp, Homo sapiens
agtggtcctgcaaacccgtgtg

SEQ ID NO: 7557883 - DNA, 22 bp, Homo sapiens
agtggtcaaagactagatttca

SEQ ID NO: 7557884 - DNA, 22 bp, Homo sapiens
agtggtataagtctgaagatca

SEQ ID NO: 7557885 - DNA, 22 bp, Homo sapiens
agtggtagcattgggacttgca

SEQ ID NO: 7557886 - DNA, 22 bp, Homo sapiens
agtggtaggggccatgccaaca

SEQ ID NO: 7557887 - DNA, 19 bp, Homo sapiens
agtggtagatgagcaggag

SEQ ID NO: 7557888 - DNA, 22 bp, Homo sapiens
agtggtagcattgggacttgca

SEQ ID NO: 7557889 - DNA, 22 bp, Homo sapiens
agtgtatttgagcatctcctta

SEQ ID NO: 7557890 - DNA, 22 bp, Homo sapiens
agtgtattgtctcacagttctt

SEQ ID NO: 7557891 - DNA, 19 bp, Homo sapiens
agtgtatttttttctgtag

SEQ ID NO: 7557892 - DNA, 22 bp, Homo sapiens
agtgtatttgtctggcttctcc

SEQ ID NO: 7557893 - DNA, 22 bp, Homo sapiens
agtgtcaaattaaataatctgg

SEQ ID NO: 7557894 - DNA, 22 bp, Homo sapiens
agtgtcaaatcagcatctgggt

SEQ ID NO: 7557895 - DNA, 22 bp, Homo sapiens
agtgtcaaatgtgtgccaagct

SEQ ID NO: 7557896 - DNA, 22 bp, Homo sapiens
agtgtcaactgtctacagggag

SEQ ID NO: 7557897 - DNA, 22 bp, Homo sapiens
agtgtcaaattaaataatctgg

SEQ ID NO: 7557898 - DNA, 22 bp, Homo sapiens
agtgtcaaattaaataatctgg

SEQ ID NO: 7557899 - DNA, 22 bp, Homo sapiens
agtgtcaactcggaataaggat

SEQ ID NO: 7557900 - DNA, 21 bp, Homo sapiens
ctctggagtttgaaggctggg

SEQ ID NO: 7557901 - DNA, 21 bp, Homo sapiens
ctctggagtttgaaggctggg

SEQ ID NO: 7557902 - DNA, 21 bp, Homo sapiens
ctctggagtttgaaggctggg

SEQ ID NO: 7557903 - DNA, 21 bp, Homo sapiens
ctctggagtttgaaggctggg

SEQ ID NO: 7557904 - DNA, 22 bp, Homo sapiens
agtgtacaaaatgatagataaa

SEQ ID NO: 7557905 - DNA, 22 bp, Homo sapiens
agtgtacaaaatgatagataaa

SEQ ID NO: 7557906 - DNA, 22 bp, Homo sapiens
ctctggatatgcactgggtgag

SEQ ID NO: 7557907 - DNA, 22 bp, Homo sapiens
agtgtattctgcatgggagact

SEQ ID NO: 7557908 - DNA, 22 bp, Homo sapiens
agtgtattcagaatgtagcaaa

SEQ ID NO: 7557909 - DNA, 22 bp, Homo sapiens
agtgtattgattggaacagcct

SEQ ID NO: 7557910 - DNA, 22 bp, Homo sapiens
agtgtattgattggaacagcct

SEQ ID NO: 7557911 - DNA, 22 bp, Homo sapiens
agtgtattatgcagcggaggtc

SEQ ID NO: 7557912 - DNA, 22 bp, Homo sapiens
agtgtacaaaatgatagataaa

SEQ ID NO: 7557913 - DNA, 22 bp, Homo sapiens
agtgtacaaaatgatagataaa

SEQ ID NO: 7557914 - DNA, 22 bp, Homo sapiens
agtgtattcagaatgtagcaaa

SEQ ID NO: 7557915 - DNA, 22 bp, Homo sapiens
agtgtattatgcagcggaggtc

SEQ ID NO: 7557916 - DNA, 22 bp, Homo sapiens
agtgtcagctaattattcatga

SEQ ID NO: 7557917 - DNA, 22 bp, Homo sapiens
agtgtcagcctgggcaaggaac

SEQ ID NO: 7557918 - DNA, 22 bp, Homo sapiens
agtgtcagcctgggcaaggaac

SEQ ID NO: 7557919 - DNA, 22 bp, Homo sapiens
agtgtcagttgccttgtcataa

SEQ ID NO: 7557920 - DNA, 17 bp, Homo sapiens
agtgtcagggcccttcc

SEQ ID NO: 7557921 - DNA, 17 bp, Homo sapiens
agtgtcagggcccttcc

SEQ ID NO: 7557922 - DNA, 22 bp, Homo sapiens
agtgtcataaggagaaattaca

SEQ ID NO: 7557923 - DNA, 22 bp, Homo sapiens
agtgtcataaggagaaattaca

SEQ ID NO: 7557924 - DNA, 22 bp, Homo sapiens
agtgtcatgaatcaaagattat

SEQ ID NO: 7557925 - DNA, 22 bp, Homo sapiens
agtgtcatcgtgaaaacatagc

SEQ ID NO: 7557926 - DNA, 22 bp, Homo sapiens
agtgtcattccagggaccctcg

SEQ ID NO: 7557927 - DNA, 22 bp, Homo sapiens
agtgtcatttccacgacattca

SEQ ID NO: 7557928 - DNA, 21 bp, Homo sapiens
agtgtcattcccaagctgtga

SEQ ID NO: 7557929 - DNA, 19 bp, Homo sapiens
agtgtcagaattcattgaa

SEQ ID NO: 7557930 - DNA, 17 bp, Homo sapiens
agtgtcagaagacagtt

SEQ ID NO: 7557931 - DNA, 17 bp, Homo sapiens
agtgtcagaagacagtt

SEQ ID NO: 7557932 - DNA, 22 bp, Homo sapiens
agtgtcacagacccaatcagga

SEQ ID NO: 7557933 - DNA, 17 bp, Homo sapiens
agtgtcagaagacagtt

SEQ ID NO: 7557934 - DNA, 22 bp, Homo sapiens
agtgtcaattctcaaatctcgg

SEQ ID NO: 7557935 - DNA, 22 bp, Homo sapiens
agtgtcacaaacctgccttgta

SEQ ID NO: 7557936 - DNA, 22 bp, Homo sapiens
agtgtcaattctcaaatctcgg

SEQ ID NO: 7557937 - DNA, 22 bp, Homo sapiens
agtgtcacaaacctgccttgta

SEQ ID NO: 7557938 - DNA, 22 bp, Homo sapiens
agtgtcacagacccaatcagga

SEQ ID NO: 7557939 - DNA, 22 bp, Homo sapiens
agtgtcaactgtctacagggag

SEQ ID NO: 7557940 - DNA, 22 bp, Homo sapiens
agtgtcaaggttgagaaaccct

SEQ ID NO: 7557941 - DNA, 22 bp, Homo sapiens
agtgtcaagtacatggtagtga

SEQ ID NO: 7557942 - DNA, 22 bp, Homo sapiens
agtgtcaagtgaggagggaaag

SEQ ID NO: 7557943 - DNA, 22 bp, Homo sapiens
agtgtcaagtgaggagggaaag

SEQ ID NO: 7557944 - DNA, 22 bp, Homo sapiens
agtgtcaataatttctttttgg

SEQ ID NO: 7557945 - DNA, 22 bp, Homo sapiens
agtgtcaataatttctttttgg

SEQ ID NO: 7557946 - DNA, 22 bp, Homo sapiens
agtgtcaagtacatggtagtga

SEQ ID NO: 7557947 - DNA, 22 bp, Homo sapiens
agtgtcaatgccaacagtatat

SEQ ID NO: 7557948 - DNA, 22 bp, Homo sapiens
agtgtcaatgccaacagtatat

SEQ ID NO: 7557949 - DNA, 22 bp, Homo sapiens
agtgtcaatgccaacagtatat

SEQ ID NO: 7557950 - DNA, 22 bp, Homo sapiens
agtgtcaatgctctgttaaaaa

SEQ ID NO: 7557951 - DNA, 22 bp, Homo sapiens
agtgtcaatgctctgttaaaaa

SEQ ID NO: 7557952 - DNA, 22 bp, Homo sapiens
agtgtcaatgctctgttaaaaa

SEQ ID NO: 7557953 - DNA, 22 bp, Homo sapiens
agtgtctggtctctgaactaaa

SEQ ID NO: 7557954 - DNA, 22 bp, Homo sapiens
agtgtctgggctcccttggagc

SEQ ID NO: 7557955 - DNA, 22 bp, Homo sapiens
agtgtctggtctctgaactaaa

SEQ ID NO: 7557956 - DNA, 22 bp, Homo sapiens
agtgtctggtctctgaactaaa

SEQ ID NO: 7557957 - DNA, 22 bp, Homo sapiens
agtgtctttggctaagtgctgt

SEQ ID NO: 7557958 - DNA, 22 bp, Homo sapiens
agtgtctttgtcaaattacagg

SEQ ID NO: 7557959 - DNA, 22 bp, Homo sapiens
agtgtctttctctctccaagtg

SEQ ID NO: 7557960 - DNA, 22 bp, Homo sapiens
agtgtctttgacacattcaaag

SEQ ID NO: 7557961 - DNA, 22 bp, Homo sapiens
agtgtctgggctcccttggagc

SEQ ID NO: 7557962 - DNA, 22 bp, Homo sapiens
agtgtctgggctcccttggagc

SEQ ID NO: 7557963 - DNA, 22 bp, Homo sapiens
agtgtctggtctctgaactaaa

SEQ ID NO: 7557964 - DNA, 22 bp, Homo sapiens
agtgtctgggctcccttggagc

SEQ ID NO: 7557965 - DNA, 20 bp, Homo sapiens
agtgtctgggcctcaggccc

SEQ ID NO: 7557966 - DNA, 20 bp, Homo sapiens
agtgtctgggcctcaggccc

SEQ ID NO: 7557967 - DNA, 22 bp, Homo sapiens
agtgtcctcctctgggagccag

SEQ ID NO: 7557968 - DNA, 22 bp, Homo sapiens
agtgtcctcctctgggagccag

SEQ ID NO: 7557969 - DNA, 22 bp, Homo sapiens
agtgtcccctctgaggagtgag

SEQ ID NO: 7557970 - DNA, 22 bp, Homo sapiens
agtgtcccctctgaggagtgag

SEQ ID NO: 7557971 - DNA, 22 bp, Homo sapiens
agtgtcctcaggctttgttcct

SEQ ID NO: 7557972 - DNA, 22 bp, Homo sapiens
agtgtccaactcagcttgtcaa

SEQ ID NO: 7557973 - DNA, 21 bp, Homo sapiens
agtgtcatttgatcattgtta

SEQ ID NO: 7557974 - DNA, 22 bp, Homo sapiens
agtgtcccctacagaggcattc

SEQ ID NO: 7557975 - DNA, 22 bp, Homo sapiens
agtgtcccctccaagggcctgg

SEQ ID NO: 7557976 - DNA, 22 bp, Homo sapiens
agtgtcccctccaagggcctgg

SEQ ID NO: 7557977 - DNA, 22 bp, Homo sapiens
agtgtcccctccaagggcctgg

SEQ ID NO: 7557978 - DNA, 22 bp, Homo sapiens
agtgtgagtaattcagggaggg

SEQ ID NO: 7557979 - DNA, 22 bp, Homo sapiens
agtgtgagtaattcagggaggg

SEQ ID NO: 7557980 - DNA, 22 bp, Homo sapiens
agtgtgagtaattcagggaggg

SEQ ID NO: 7557981 - DNA, 22 bp, Homo sapiens
agtgtgagctaatagcagagcc

SEQ ID NO: 7557982 - DNA, 22 bp, Homo sapiens
agtgtgagcctacaggccaaag

SEQ ID NO: 7557983 - DNA, 23 bp, Homo sapiens
agtgtgacttttttgactgtcac

SEQ ID NO: 7557984 - DNA, 19 bp, Homo sapiens
agtgtgagactccatctca

SEQ ID NO: 7557985 - DNA, 22 bp, Homo sapiens
agtgtgagatgattgaggagca

SEQ ID NO: 7557986 - DNA, 22 bp, Homo sapiens
agtgtgacataagagccctgga

SEQ ID NO: 7557987 - DNA, 22 bp, Homo sapiens
agtgtgacataagagccctgga

SEQ ID NO: 7557988 - DNA, 22 bp, Homo sapiens
agtgtgacattttcatgaattt

SEQ ID NO: 7557989 - DNA, 22 bp, Homo sapiens
agtgtgacattttcatgaattt

SEQ ID NO: 7557990 - DNA, 22 bp, Homo sapiens
agtgtgaccttatttggaaaca

SEQ ID NO: 7557991 - DNA, 22 bp, Homo sapiens
agtgtgaccttatttggaaaca

SEQ ID NO: 7557992 - DNA, 22 bp, Homo sapiens
agtgtgaccttatttggaaaca

SEQ ID NO: 7557993 - DNA, 22 bp, Homo sapiens
agtgtgactacattacaagagt

SEQ ID NO: 7557994 - DNA, 22 bp, Homo sapiens
agtgtgactacattacaagagt

SEQ ID NO: 7557995 - DNA, 22 bp, Homo sapiens
agtgtctttgtctctcaagcac

SEQ ID NO: 7557996 - DNA, 22 bp, Homo sapiens
agtgtctttgtctctcaagcac

SEQ ID NO: 7557997 - DNA, 22 bp, Homo sapiens
agtgtctttgtctctcaagcac

SEQ ID NO: 7557998 - DNA, 22 bp, Homo sapiens
agtgtgaagagcagcacaaatg

SEQ ID NO: 7557999 - DNA, 22 bp, Homo sapiens
agtgtgaagagcagcacaaatg

SEQ ID NO: 7558000 - DNA, 22 bp, Homo sapiens
agtgtgacaaatctatggctca

SEQ ID NO: 7558001 - DNA, 22 bp, Homo sapiens
agtgtgacagtcctgctgcttt

SEQ ID NO: 7558002 - DNA, 22 bp, Homo sapiens
ctgagccagctggcatgtgcta

SEQ ID NO: 7558003 - DNA, 22 bp, Homo sapiens
ctgagccagctggcatgtgcta

SEQ ID NO: 7558004 - DNA, 22 bp, Homo sapiens
ctgagccagctggcatgtgcta

SEQ ID NO: 7558005 - DNA, 22 bp, Homo sapiens
ctgagccagctggcatgtgcta

SEQ ID NO: 7558006 - DNA, 22 bp, Homo sapiens
ctgagccagctggcatgtgcta

SEQ ID NO: 7558007 - DNA, 22 bp, Homo sapiens
ctgagccagctggcatgtgcta

SEQ ID NO: 7558008 - DNA, 22 bp, Homo sapiens
ctgagccagctggcatgtgcta

SEQ ID NO: 7558009 - DNA, 22 bp, Homo sapiens
ctgagccagcgggctcactttt

SEQ ID NO: 7558010 - DNA, 22 bp, Homo sapiens
ctgagccagcgggctcactttt

SEQ ID NO: 7558011 - DNA, 22 bp, Homo sapiens
ctgagccagcgggctcactttt

SEQ ID NO: 7558012 - DNA, 22 bp, Homo sapiens
ctgagccagggccacacatgga

SEQ ID NO: 7558013 - DNA, 22 bp, Homo sapiens
ctgagccagggccacacatgga

SEQ ID NO: 7558014 - DNA, 22 bp, Homo sapiens
ctgagccagcgggctcactttt

SEQ ID NO: 7558015 - DNA, 22 bp, Homo sapiens
ctgagccagctggcatgtgcta

SEQ ID NO: 7558016 - DNA, 22 bp, Homo sapiens
ctgagccagctggcatgtgcta

SEQ ID NO: 7558017 - DNA, 22 bp, Homo sapiens
ctgagccagctggcatgtgcta

SEQ ID NO: 7558018 - DNA, 22 bp, Homo sapiens
ctgagctcacgccattctcctt

SEQ ID NO: 7558019 - DNA, 22 bp, Homo sapiens
ctgagctcagtcccagctctac

SEQ ID NO: 7558020 - DNA, 22 bp, Homo sapiens
ctgagctcaagtgatctgccca

SEQ ID NO: 7558021 - DNA, 22 bp, Homo sapiens
ctgagctcacgccattctcctt

SEQ ID NO: 7558022 - DNA, 22 bp, Homo sapiens
ctgagctcacgccattctcctt

SEQ ID NO: 7558023 - DNA, 22 bp, Homo sapiens
ctgagctctaatgtcagccttg

SEQ ID NO: 7558024 - DNA, 22 bp, Homo sapiens
ctgagctcagtcccagctctac

SEQ ID NO: 7558025 - DNA, 22 bp, Homo sapiens
ctgagctctaatgtcagccttg

SEQ ID NO: 7558026 - DNA, 22 bp, Homo sapiens
ctgagctctaatgtcagccttg

SEQ ID NO: 7558027 - DNA, 22 bp, Homo sapiens
ctgagctctaatgtcagccttg

SEQ ID NO: 7558028 - DNA, 22 bp, Homo sapiens
ctgagctattttccactactat

SEQ ID NO: 7558029 - DNA, 22 bp, Homo sapiens
ctgagctattttccactactat

SEQ ID NO: 7558030 - DNA, 22 bp, Homo sapiens
ctgagctatgaactgcagccta

SEQ ID NO: 7558031 - DNA, 22 bp, Homo sapiens
ctgagctcaagcgatcctccca

SEQ ID NO: 7558032 - DNA, 22 bp, Homo sapiens
ctgagctcaagcgatcctccca

SEQ ID NO: 7558033 - DNA, 22 bp, Homo sapiens
ctgagctcaagcgatcctccca

SEQ ID NO: 7558034 - DNA, 22 bp, Homo sapiens
ctgagctatagaattgtcagca

SEQ ID NO: 7558035 - DNA, 22 bp, Homo sapiens
ctgagccagggccacacatgga

SEQ ID NO: 7558036 - DNA, 22 bp, Homo sapiens
ctgagccagggccacacatgga

SEQ ID NO: 7558037 - DNA, 22 bp, Homo sapiens
ctgagccagggccacacatgga

SEQ ID NO: 7558038 - DNA, 22 bp, Homo sapiens
ctgagcagccccaccagccatt

SEQ ID NO: 7558039 - DNA, 22 bp, Homo sapiens
agttaactcattttataatgcc

SEQ ID NO: 7558040 - DNA, 22 bp, Homo sapiens
ctgagcagccccaccagccatt

SEQ ID NO: 7558041 - DNA, 22 bp, Homo sapiens
agttaactattttaagattgtt

SEQ ID NO: 7558042 - DNA, 22 bp, Homo sapiens
agttaactaaattaagagacaa

SEQ ID NO: 7558043 - DNA, 22 bp, Homo sapiens
agttaactattttaagattgtt

SEQ ID NO: 7558044 - DNA, 22 bp, Homo sapiens
ctgagcagccccaccagccatt

SEQ ID NO: 7558045 - DNA, 22 bp, Homo sapiens
ctgagccaaggggacagtgaca

SEQ ID NO: 7558046 - DNA, 19 bp, Homo sapiens
ctgagcagcggcagcactt

SEQ ID NO: 7558047 - DNA, 19 bp, Homo sapiens
ctgagcagcggcagcactt

SEQ ID NO: 7558048 - DNA, 22 bp, Homo sapiens
ctgagcagccccaccagccatt

SEQ ID NO: 7558049 - DNA, 22 bp, Homo sapiens
ctgagcagccccaccagccatt

SEQ ID NO: 7558050 - DNA, 22 bp, Homo sapiens
agttaacacaagtaagattcca

SEQ ID NO: 7558051 - DNA, 22 bp, Homo sapiens
agttaacaagttggcaatcaac

SEQ ID NO: 7558052 - DNA, 22 bp, Homo sapiens
agttaacacatccagaatagag

SEQ ID NO: 7558053 - DNA, 22 bp, Homo sapiens
agttaacacatccagaatagag

SEQ ID NO: 7558054 - DNA, 22 bp, Homo sapiens
agttaacacatccagaatagag

SEQ ID NO: 7558055 - DNA, 22 bp, Homo sapiens
agttaactaaactgtgagtaaa

SEQ ID NO: 7558056 - DNA, 22 bp, Homo sapiens
agttaacatttgagctaaaagg

SEQ ID NO: 7558057 - DNA, 22 bp, Homo sapiens
agttaacacatccagaatagag

SEQ ID NO: 7558058 - DNA, 22 bp, Homo sapiens
agttaacatttgagctaaaagg

SEQ ID NO: 7558059 - DNA, 22 bp, Homo sapiens
agttaacatttgagctaaaagg

SEQ ID NO: 7558060 - DNA, 22 bp, Homo sapiens
ctgagccagcgggctcactttt

SEQ ID NO: 7558061 - DNA, 22 bp, Homo sapiens
ctgagccagagggagtcgggtc

SEQ ID NO: 7558062 - DNA, 22 bp, Homo sapiens
ctgagccagcgggctcactttt

SEQ ID NO: 7558063 - DNA, 22 bp, Homo sapiens
ctgagccagagggagtcgggtc

SEQ ID NO: 7558064 - DNA, 22 bp, Homo sapiens
ctgagccactgcttgttcagtg

SEQ ID NO: 7558065 - DNA, 22 bp, Homo sapiens
ctgagccactgcttgttcagtg

SEQ ID NO: 7558066 - DNA, 22 bp, Homo sapiens
ctgagccaccggcagggacatc

SEQ ID NO: 7558067 - DNA, 22 bp, Homo sapiens
ctgagccactgcttgttcagtg

SEQ ID NO: 7558068 - DNA, 22 bp, Homo sapiens
ctgagccaccggcagggacatc

SEQ ID NO: 7558069 - DNA, 22 bp, Homo sapiens
ctgagccaccggcagggacatc

SEQ ID NO: 7558070 - DNA, 22 bp, Homo sapiens
ctgagccaaggggacagtgaca

SEQ ID NO: 7558071 - DNA, 22 bp, Homo sapiens
ctgagccaaggggacagtgaca

SEQ ID NO: 7558072 - DNA, 22 bp, Homo sapiens
ctgagctgacatcttcctcttt

SEQ ID NO: 7558073 - DNA, 22 bp, Homo sapiens
ctgagctgaaacttgagaggct

SEQ ID NO: 7558074 - DNA, 22 bp, Homo sapiens
ctgagctgaaacttgagaggct

SEQ ID NO: 7558075 - DNA, 22 bp, Homo sapiens
ctgagctgaaacttgagaggct

SEQ ID NO: 7558076 - DNA, 20 bp, Homo sapiens
ctgagctgagctccatgggt

SEQ ID NO: 7558077 - DNA, 20 bp, Homo sapiens
ctgagctgagctccatgggt

SEQ ID NO: 7558078 - DNA, 20 bp, Homo sapiens
ctgagctgagctccatgggt

SEQ ID NO: 7558079 - DNA, 20 bp, Homo sapiens
ctgagctgagctccatgggt

SEQ ID NO: 7558080 - DNA, 20 bp, Homo sapiens
ctgagctgagctccatgggt

SEQ ID NO: 7558081 - DNA, 22 bp, Homo sapiens
ctgagctgcagtcctggctctg

SEQ ID NO: 7558082 - DNA, 22 bp, Homo sapiens
ctgagctgcagtcctggctctg

SEQ ID NO: 7558083 - DNA, 22 bp, Homo sapiens
ctgagctgcagtcctggctctg

SEQ ID NO: 7558084 - DNA, 22 bp, Homo sapiens
ctgagctgcagtcctggctctg

SEQ ID NO: 7558085 - DNA, 22 bp, Homo sapiens
ctgagctgcagtcctggctctg

SEQ ID NO: 7558086 - DNA, 20 bp, Homo sapiens
ctgagctgagctccatgggt

SEQ ID NO: 7558087 - DNA, 20 bp, Homo sapiens
ctgagctgagctccatgggt

SEQ ID NO: 7558088 - DNA, 22 bp, Homo sapiens
ctgagctgctttgcttttgggg

SEQ ID NO: 7558089 - DNA, 22 bp, Homo sapiens
ctgagctgctcccgctgcagcg

SEQ ID NO: 7558090 - DNA, 22 bp, Homo sapiens
ctgagctgctcccgctgcagcg

SEQ ID NO: 7558091 - DNA, 22 bp, Homo sapiens
ctgagctgctcccgctgcagcg

SEQ ID NO: 7558092 - DNA, 22 bp, Homo sapiens
ctgagctgcggcaggcacctgg

SEQ ID NO: 7558093 - DNA, 22 bp, Homo sapiens
ctgagctgcggcaggcacctgg

SEQ ID NO: 7558094 - DNA, 22 bp, Homo sapiens
ctgagctgctcccgctgcagcg

SEQ ID NO: 7558095 - DNA, 22 bp, Homo sapiens
ctgagctgctcccgctgcagcg

SEQ ID NO: 7558096 - DNA, 22 bp, Homo sapiens
ctgagctgctcccgctgcagcg

SEQ ID NO: 7558097 - DNA, 22 bp, Homo sapiens
ctgagctgctcccgctgcagcg

SEQ ID NO: 7558098 - DNA, 22 bp, Homo sapiens
ctgagctgctcccgctgcagcg

SEQ ID NO: 7558099 - DNA, 22 bp, Homo sapiens
ctgagctgctcccgctgcagcg

SEQ ID NO: 7558100 - DNA, 22 bp, Homo sapiens
agttccagctgtgaccagaaaa

SEQ ID NO: 7558101 - DNA, 22 bp, Homo sapiens
agttccagctgtgaccagaaaa

SEQ ID NO: 7558102 - DNA, 23 bp, Homo sapiens
agttccagaaaaatgctcaagca

SEQ ID NO: 7558103 - DNA, 22 bp, Homo sapiens
agttccagaactggaaaaggac

SEQ ID NO: 7558104 - DNA, 22 bp, Homo sapiens
agttccagaactggaaaaggac

SEQ ID NO: 7558105 - DNA, 22 bp, Homo sapiens
agttcccaaattacaggccaca

SEQ ID NO: 7558106 - DNA, 22 bp, Homo sapiens
agttccatgtctgggtttgtga

SEQ ID NO: 7558107 - DNA, 22 bp, Homo sapiens
agttccagtgtgagagaacatg

SEQ ID NO: 7558108 - DNA, 23 bp, Homo sapiens
agttcctaagggctttgaactta

SEQ ID NO: 7558109 - DNA, 22 bp, Homo sapiens
agttcctaatttagtattgccg

SEQ ID NO: 7558110 - DNA, 22 bp, Homo sapiens
agttccttacatgtactgttaa

SEQ ID NO: 7558111 - DNA, 22 bp, Homo sapiens
agttccttcctgagctattgct

SEQ ID NO: 7558112 - DNA, 21 bp, Homo sapiens
agttcctgcttcattgtcttt

SEQ ID NO: 7558113 - DNA, 22 bp, Homo sapiens
agttcctgaacttcttaatgac

SEQ ID NO: 7558114 - DNA, 19 bp, Homo sapiens
agttatttctaaatttacc

SEQ ID NO: 7558115 - DNA, 22 bp, Homo sapiens
agttatttcagtaacataatag

SEQ ID NO: 7558116 - DNA, 22 bp, Homo sapiens
agttatttcagtaacataatag

SEQ ID NO: 7558117 - DNA, 23 bp, Homo sapiens
agttcataatttcttatttgtgt

SEQ ID NO: 7558118 - DNA, 19 bp, Homo sapiens
agttatttctaaatttacc

SEQ ID NO: 7558119 - DNA, 21 bp, Homo sapiens
agttcatactgagtaacaaaa

SEQ ID NO: 7558120 - DNA, 21 bp, Homo sapiens
agttcatactgagtaacaaaa

SEQ ID NO: 7558121 - DNA, 21 bp, Homo sapiens
agttcatactgagtaacaaaa

SEQ ID NO: 7558122 - DNA, 22 bp, Homo sapiens
agttcatattgaaagcaggtga

SEQ ID NO: 7558123 - DNA, 21 bp, Homo sapiens
agttcatactgagtaacaaaa

SEQ ID NO: 7558124 - DNA, 23 bp, Homo sapiens
agttcataatttcttatttgtgt

SEQ ID NO: 7558125 - DNA, 22 bp, Homo sapiens
agttcatcttacttagagtaca

SEQ ID NO: 7558126 - DNA, 22 bp, Homo sapiens
agttcatggaagattcaatgga

SEQ ID NO: 7558127 - DNA, 22 bp, Homo sapiens
agttcatgtggtttaacttaat

SEQ ID NO: 7558128 - DNA, 22 bp, Homo sapiens
agttcattttatttgtcagggt

SEQ ID NO: 7558129 - DNA, 22 bp, Homo sapiens
agttcattttatttgtcagggt

SEQ ID NO: 7558130 - DNA, 22 bp, Homo sapiens
agttcatttaaatcaggtactt

SEQ ID NO: 7558131 - DNA, 22 bp, Homo sapiens
agttccaatcctggcatttatt

SEQ ID NO: 7558132 - DNA, 23 bp, Homo sapiens
agttccagaaaaatgctcaagca

SEQ ID NO: 7558133 - DNA, 23 bp, Homo sapiens
agttccagaaaaatgctcaagca

SEQ ID NO: 7558134 - DNA, 23 bp, Homo sapiens
agttccagaaaaatgctcaagca

SEQ ID NO: 7558135 - DNA, 22 bp, Homo sapiens
agtgtgggggctttggtgtcac

SEQ ID NO: 7558136 - DNA, 17 bp, Homo sapiens
agtgttctgggttgccc

SEQ ID NO: 7558137 - DNA, 22 bp, Homo sapiens
agtgtttatggaatcttagtta

SEQ ID NO: 7558138 - DNA, 22 bp, Homo sapiens
agtgtttatggaatcttagtta

SEQ ID NO: 7558139 - DNA, 19 bp, Homo sapiens
agtgtttatgtagtgccta

SEQ ID NO: 7558140 - DNA, 18 bp, Homo sapiens
agtgttctcgttttataa

SEQ ID NO: 7558141 - DNA, 18 bp, Homo sapiens
agtgttctcgttttataa

SEQ ID NO: 7558142 - DNA, 19 bp, Homo sapiens
agtgttctgagtactcctc

SEQ ID NO: 7558143 - DNA, 17 bp, Homo sapiens
agtgttctgggttgccc

SEQ ID NO: 7558144 - DNA, 22 bp, Homo sapiens
agtgtttcaagtgatgctttgg

SEQ ID NO: 7558145 - DNA, 22 bp, Homo sapiens
agtgtttcaagtgatgctttgg

SEQ ID NO: 7558146 - DNA, 22 bp, Homo sapiens
agtgtttcaagaagcaggaagt

SEQ ID NO: 7558147 - DNA, 22 bp, Homo sapiens
agtgtttcaagtgatgctttgg

SEQ ID NO: 7558148 - DNA, 22 bp, Homo sapiens
agtgtttcaagtgatgctttgg

SEQ ID NO: 7558149 - DNA, 18 bp, Homo sapiens
agtgtttatttaggtgaa

SEQ ID NO: 7558150 - DNA, 22 bp, Homo sapiens
agtgtttcaagaagcaggaagt

SEQ ID NO: 7558151 - DNA, 22 bp, Homo sapiens
agtgtttattagatttcccttt

SEQ ID NO: 7558152 - DNA, 23 bp, Homo sapiens
agtgtttatgttcagtgaccctc

SEQ ID NO: 7558153 - DNA, 22 bp, Homo sapiens
agtgtttattgtgtgccacaca

SEQ ID NO: 7558154 - DNA, 22 bp, Homo sapiens
agtgtttattgtgtgccacaca

SEQ ID NO: 7558155 - DNA, 22 bp, Homo sapiens
agtgtggctgcgtagggctctc

SEQ ID NO: 7558156 - DNA, 22 bp, Homo sapiens
agtgtgggccacgcagctgagc

SEQ ID NO: 7558157 - DNA, 22 bp, Homo sapiens
agtgtgggccacgcagctgagc

SEQ ID NO: 7558158 - DNA, 22 bp, Homo sapiens
agtgtgggccacgcagctgagc

SEQ ID NO: 7558159 - DNA, 22 bp, Homo sapiens
agtgtgggccacgcagctgagc

SEQ ID NO: 7558160 - DNA, 17 bp, Homo sapiens
agtgtggccctggttaa

SEQ ID NO: 7558161 - DNA, 22 bp, Homo sapiens
agtgtggctgcgtagggctctc

SEQ ID NO: 7558162 - DNA, 22 bp, Homo sapiens
agtgtggctgcgtagggctctc

SEQ ID NO: 7558163 - DNA, 22 bp, Homo sapiens
agtgtggctgcgtagggctctc

SEQ ID NO: 7558164 - DNA, 22 bp, Homo sapiens
agtgtggcaggaatgactagaa

SEQ ID NO: 7558165 - DNA, 22 bp, Homo sapiens
agtgtggccaatgaggatgggc

SEQ ID NO: 7558166 - DNA, 22 bp, Homo sapiens
agtgtggccaatgaggatgggc

SEQ ID NO: 7558167 - DNA, 22 bp, Homo sapiens
agtgtgggcccccaggttagcc

SEQ ID NO: 7558168 - DNA, 22 bp, Homo sapiens
agtgtgggccacgcagctgagc

SEQ ID NO: 7558169 - DNA, 22 bp, Homo sapiens
agtgtgggccacgcagctgagc

SEQ ID NO: 7558170 - DNA, 22 bp, Homo sapiens
agtgtgggccacgcagctgagc

SEQ ID NO: 7558171 - DNA, 22 bp, Homo sapiens
agtgtgggcccccaggttagcc

SEQ ID NO: 7558172 - DNA, 22 bp, Homo sapiens
agtgtgggggctttggtgtcac

SEQ ID NO: 7558173 - DNA, 22 bp, Homo sapiens
agtgtgggggctttggtgtcac

SEQ ID NO: 7558174 - DNA, 22 bp, Homo sapiens
agtgtgggcccccaggttagcc

SEQ ID NO: 7558175 - DNA, 22 bp, Homo sapiens
agtgtgggcccccaggttagcc

SEQ ID NO: 7558176 - DNA, 22 bp, Homo sapiens
agtgtgcatttgcagaagaccc

SEQ ID NO: 7558177 - DNA, 22 bp, Homo sapiens
agtgtgcatttgcagaagaccc

SEQ ID NO: 7558178 - DNA, 20 bp, Homo sapiens
agtgtgcatttagagtctgc

SEQ ID NO: 7558179 - DNA, 22 bp, Homo sapiens
agtgtgatttattggaagaggt

SEQ ID NO: 7558180 - DNA, 20 bp, Homo sapiens
agtgtgcatttagagtctgc

SEQ ID NO: 7558181 - DNA, 22 bp, Homo sapiens
agtgtgcccagtaattggctga

SEQ ID NO: 7558182 - DNA, 22 bp, Homo sapiens
agtgtgctagcaagaactgggg

SEQ ID NO: 7558183 - DNA, 22 bp, Homo sapiens
agtgtgctagcaagaactgggg

SEQ ID NO: 7558184 - DNA, 22 bp, Homo sapiens
agtgtgctcaattcaagtcttt

SEQ ID NO: 7558185 - DNA, 22 bp, Homo sapiens
agtgtgctattgcaccatcata

SEQ ID NO: 7558186 - DNA, 22 bp, Homo sapiens
agtgtgctattgcaccatcata

SEQ ID NO: 7558187 - DNA, 22 bp, Homo sapiens
agtgtgctattgcaccatcata

SEQ ID NO: 7558188 - DNA, 22 bp, Homo sapiens
agtgtgagtgctcatgtccatc

SEQ ID NO: 7558189 - DNA, 22 bp, Homo sapiens
agtgtgagtgctcatgtccatc

SEQ ID NO: 7558190 - DNA, 22 bp, Homo sapiens
agtgtgcatggtggaggcttgc

SEQ ID NO: 7558191 - DNA, 22 bp, Homo sapiens
agtgtgagttacaaagtgtgaa

SEQ ID NO: 7558192 - DNA, 22 bp, Homo sapiens
agtgtgagttacaaagtgtgaa

SEQ ID NO: 7558193 - DNA, 22 bp, Homo sapiens
agtgtgctgagcaggtgggggt

SEQ ID NO: 7558194 - DNA, 22 bp, Homo sapiens
agtgtgctctggttgccatgct

SEQ ID NO: 7558195 - DNA, 22 bp, Homo sapiens
agtgtgctctggttgccatgct

SEQ ID NO: 7558196 - DNA, 22 bp, Homo sapiens
agtgtgctcaattcaagtcttt

SEQ ID NO: 7558197 - DNA, 22 bp, Homo sapiens
agtgtgctgcttaaacagttgt

SEQ ID NO: 7558198 - DNA, 22 bp, Homo sapiens
agtgtgctgtttccagaagggc

SEQ ID NO: 7558199 - DNA, 22 bp, Homo sapiens
agtgtgctgagcaggtgggggt

SEQ ID NO: 7558200 - DNA, 22 bp, Homo sapiens
agtgtgctgtttccagaagggc

SEQ ID NO: 7558201 - DNA, 22 bp, Homo sapiens
agtgtgcttcactgggaggtga

SEQ ID NO: 7558202 - DNA, 22 bp, Homo sapiens
agtgtgcttaagtttatcagga

SEQ ID NO: 7558203 - DNA, 22 bp, Homo sapiens
agtgtgcttaagtttatcagga

SEQ ID NO: 7558204 - DNA, 22 bp, Homo sapiens
agtgtgctgtttccagaagggc

SEQ ID NO: 7558205 - DNA, 22 bp, Homo sapiens
agtgtggagccactgagtggct

SEQ ID NO: 7558206 - DNA, 22 bp, Homo sapiens
agtgtggattggctggagctat

SEQ ID NO: 7558207 - DNA, 22 bp, Homo sapiens
agtgtggacttttcctaggagg

SEQ ID NO: 7558208 - DNA, 22 bp, Homo sapiens
agtgtggagcatcgagggcaga

SEQ ID NO: 7558209 - DNA, 22 bp, Homo sapiens
agtgtggacttttcctaggagg

SEQ ID NO: 7558210 - DNA, 22 bp, Homo sapiens
agttaaatgtcagtagcttaac

SEQ ID NO: 7558211 - DNA, 22 bp, Homo sapiens
agttaaatgtcagtagcttaac

SEQ ID NO: 7558212 - DNA, 22 bp, Homo sapiens
agttaaatgtcagtagcttaac

SEQ ID NO: 7558213 - DNA, 22 bp, Homo sapiens
agttaacacaagtaagattcca

SEQ ID NO: 7558214 - DNA, 22 bp, Homo sapiens
agttaacacaagtaagattcca

SEQ ID NO: 7558215 - DNA, 22 bp, Homo sapiens
agttaaatcattactgacagag

SEQ ID NO: 7558216 - DNA, 22 bp, Homo sapiens
agttaaagtctgaaatagagaa

SEQ ID NO: 7558217 - DNA, 22 bp, Homo sapiens
agttaaatcattactgacagag

SEQ ID NO: 7558218 - DNA, 22 bp, Homo sapiens
agttaaagaaagataattcgcc

SEQ ID NO: 7558219 - DNA, 22 bp, Homo sapiens
agttaaacttgcctttattcct

SEQ ID NO: 7558220 - DNA, 22 bp, Homo sapiens
agttaaactctagtagatacaa

SEQ ID NO: 7558221 - DNA, 22 bp, Homo sapiens
agttaaagtctgaaatagagaa

SEQ ID NO: 7558222 - DNA, 22 bp, Homo sapiens
agttaaagtctgaaatagagaa

SEQ ID NO: 7558223 - DNA, 22 bp, Homo sapiens
agttaaagtctgaaatagagaa

SEQ ID NO: 7558224 - DNA, 22 bp, Homo sapiens
agttaaagaaagataattcgcc

SEQ ID NO: 7558225 - DNA, 22 bp, Homo sapiens
agtgtttgtaaactacagatct

SEQ ID NO: 7558226 - DNA, 22 bp, Homo sapiens
agtgtttgtaaactacagatct

SEQ ID NO: 7558227 - DNA, 22 bp, Homo sapiens
agtgtttgtaaactacagatct

SEQ ID NO: 7558228 - DNA, 22 bp, Homo sapiens
agtgtttgtcccgttagaaatg

SEQ ID NO: 7558229 - DNA, 22 bp, Homo sapiens
agtgtttgtcccgttagaaatg

SEQ ID NO: 7558230 - DNA, 22 bp, Homo sapiens
agtgttttattagaacacagcc

SEQ ID NO: 7558231 - DNA, 22 bp, Homo sapiens
agtgttttattagaacacagcc

SEQ ID NO: 7558232 - DNA, 22 bp, Homo sapiens
agtgttttgctaatcctattaa

SEQ ID NO: 7558233 - DNA, 22 bp, Homo sapiens
agtgttttgctaatcctattaa

SEQ ID NO: 7558234 - DNA, 22 bp, Homo sapiens
agtgttttatttcagcactttg

SEQ ID NO: 7558235 - DNA, 22 bp, Homo sapiens
agtgttttggagtgggaaggca

SEQ ID NO: 7558236 - DNA, 21 bp, Homo sapiens
agttaaacctttagagaacta

SEQ ID NO: 7558237 - DNA, 22 bp, Homo sapiens
agtgtttttcaggagcagaaca

SEQ ID NO: 7558238 - DNA, 22 bp, Homo sapiens
agtgtttttgggtagggtgagt

SEQ ID NO: 7558239 - DNA, 17 bp, Homo sapiens
agtgtttccttatcatt

SEQ ID NO: 7558240 - DNA, 17 bp, Homo sapiens
agtgtttccttatcatt

SEQ ID NO: 7558241 - DNA, 17 bp, Homo sapiens
agtgtttccttatcatt

SEQ ID NO: 7558242 - DNA, 17 bp, Homo sapiens
agtgtttccttatcatt

SEQ ID NO: 7558243 - DNA, 20 bp, Homo sapiens
agtgtttctcaacatggggc

SEQ ID NO: 7558244 - DNA, 20 bp, Homo sapiens
agtgtttctcaacatggggc

SEQ ID NO: 7558245 - DNA, 22 bp, Homo sapiens
agtgtttctaagtagatgtgaa

SEQ ID NO: 7558246 - DNA, 22 bp, Homo sapiens
agtgtttctaagtagatgtgaa

SEQ ID NO: 7558247 - DNA, 22 bp, Homo sapiens
agtgtttctaagtagatgtgaa

SEQ ID NO: 7558248 - DNA, 22 bp, Homo sapiens
agtgtttcacagcactttttct

SEQ ID NO: 7558249 - DNA, 22 bp, Homo sapiens
agtgtttcaatcctaggggttg

SEQ ID NO: 7558250 - DNA, 22 bp, Homo sapiens
agtgtttcaatcctaggggttg

SEQ ID NO: 7558251 - DNA, 22 bp, Homo sapiens
agtgtttcaatcctaggggttg

SEQ ID NO: 7558252 - DNA, 22 bp, Homo sapiens
agtgtttcaccgtatgttctca

SEQ ID NO: 7558253 - DNA, 22 bp, Homo sapiens
agtgtttcacagcactttttct

SEQ ID NO: 7558254 - DNA, 22 bp, Homo sapiens
agtgtttcacagcactttttct

SEQ ID NO: 7558255 - DNA, 22 bp, Homo sapiens
agtgtttcaccgtatgttctca

SEQ ID NO: 7558256 - DNA, 22 bp, Homo sapiens
agtgtttcccagtaggatgaaa

SEQ ID NO: 7558257 - DNA, 22 bp, Homo sapiens
agtgtttcccagtaggatgaaa

SEQ ID NO: 7558258 - DNA, 22 bp, Homo sapiens
agtgtttcctgagtgttatcat

SEQ ID NO: 7558259 - DNA, 22 bp, Homo sapiens
agtgtttcctgagtgttatcat

SEQ ID NO: 7558260 - DNA, 19 bp, Homo sapiens
agtgtttcatgtgctttta

SEQ ID NO: 7558261 - DNA, 22 bp, Homo sapiens
agtgtttcaccgtatgttctca

SEQ ID NO: 7558262 - DNA, 19 bp, Homo sapiens
agtgtttcatgtgctttta

SEQ ID NO: 7558263 - DNA, 19 bp, Homo sapiens
agtgtttcatgtgctttta

SEQ ID NO: 7558264 - DNA, 20 bp, Homo sapiens
agtgtttgctcacagtctcc

SEQ ID NO: 7558265 - DNA, 20 bp, Homo sapiens
agtgtttgctcacagtctcc

SEQ ID NO: 7558266 - DNA, 20 bp, Homo sapiens
agtgtttgctcacagtctcc

SEQ ID NO: 7558267 - DNA, 20 bp, Homo sapiens
agtgtttgctcacagtctcc

SEQ ID NO: 7558268 - DNA, 22 bp, Homo sapiens
agtgtttgggggccttgtaaca

SEQ ID NO: 7558269 - DNA, 22 bp, Homo sapiens
agtgtttgagtttgcggcattg

SEQ ID NO: 7558270 - DNA, 22 bp, Homo sapiens
agtgtttgagacacatttcact

SEQ ID NO: 7558271 - DNA, 22 bp, Homo sapiens
agtgtttgcatctcattgattt

SEQ ID NO: 7558272 - DNA, 22 bp, Homo sapiens
agtgtttgcatctcattgattt

SEQ ID NO: 7558273 - DNA, 20 bp, Homo sapiens
agtgtttctcaacatggggc

SEQ ID NO: 7558274 - DNA, 22 bp, Homo sapiens
agtgtttctcagaagggcctat

SEQ ID NO: 7558275 - DNA, 22 bp, Homo sapiens
agtgtttctggaatcagtgttt

SEQ ID NO: 7558276 - DNA, 22 bp, Homo sapiens
agtgtttctggcaaatgaaagt

SEQ ID NO: 7558277 - DNA, 22 bp, Homo sapiens
agtgtttctggaatcagtgttt

SEQ ID NO: 7558278 - DNA, 22 bp, Homo sapiens
agtgtttctcagaagggcctat

SEQ ID NO: 7558279 - DNA, 22 bp, Homo sapiens
agtgtttctggaatcagtgttt

SEQ ID NO: 7558280 - DNA, 22 bp, Homo sapiens
agtgtttctggcaaatgaaagt

SEQ ID NO: 7558281 - DNA, 22 bp, Homo sapiens
agtgtttctgtgccccagtgtt

SEQ ID NO: 7558282 - DNA, 22 bp, Homo sapiens
agtgtttgagacacatttcact

SEQ ID NO: 7558283 - DNA, 22 bp, Homo sapiens
agtgtttctgtgccccagtgtt

SEQ ID NO: 7558284 - DNA, 22 bp, Homo sapiens
agtgtttgagacacatttcact

SEQ ID NO: 7558285 - DNA, 22 bp, Homo sapiens
cctggggctttctttgtatcat

SEQ ID NO: 7558286 - DNA, 22 bp, Homo sapiens
cctggggctttctttgtatcat

SEQ ID NO: 7558287 - DNA, 22 bp, Homo sapiens
cctgggggccaggaaggtgtga

SEQ ID NO: 7558288 - DNA, 22 bp, Homo sapiens
cctggggctctgcacagagcag

SEQ ID NO: 7558289 - DNA, 22 bp, Homo sapiens
cctggggctctgcacagagcag

SEQ ID NO: 7558290 - DNA, 22 bp, Homo sapiens
cctggggctctgcacagagcag

SEQ ID NO: 7558291 - DNA, 22 bp, Homo sapiens
cctggggtatataggtgaatat

SEQ ID NO: 7558292 - DNA, 22 bp, Homo sapiens
cctggggtatataggtgaatat

SEQ ID NO: 7558293 - DNA, 22 bp, Homo sapiens
cctggggtatataggtgaatat

SEQ ID NO: 7558294 - DNA, 20 bp, Homo sapiens
cctggggtacactggcatgt

SEQ ID NO: 7558295 - DNA, 20 bp, Homo sapiens
cctggggtacactggcatgt

SEQ ID NO: 7558296 - DNA, 20 bp, Homo sapiens
cctggggtacactggcatgt

SEQ ID NO: 7558297 - DNA, 20 bp, Homo sapiens
cctggggtacactggcatgt

SEQ ID NO: 7558298 - DNA, 22 bp, Homo sapiens
cctgggggccaggaaggtgtga

SEQ ID NO: 7558299 - DNA, 22 bp, Homo sapiens
cctggggctccagagcagcgga

SEQ ID NO: 7558300 - DNA, 22 bp, Homo sapiens
cctggggctctgcacagagcag

SEQ ID NO: 7558301 - DNA, 22 bp, Homo sapiens
cctggggctctgcacagagcag

SEQ ID NO: 7558302 - DNA, 22 bp, Homo sapiens
cctggggctctgcacagagcag

SEQ ID NO: 7558303 - DNA, 22 bp, Homo sapiens
cctggggctctgcacagagcag

SEQ ID NO: 7558304 - DNA, 22 bp, Homo sapiens
cctggggctctgcacagagcag

SEQ ID NO: 7558305 - DNA, 22 bp, Homo sapiens
cctggggctctgcacagagcag

SEQ ID NO: 7558306 - DNA, 22 bp, Homo sapiens
cctggggctctgcacagagcag

SEQ ID NO: 7558307 - DNA, 22 bp, Homo sapiens
cctgggctttgagggcaggatg

SEQ ID NO: 7558308 - DNA, 22 bp, Homo sapiens
cctgggctttgagggcaggatg

SEQ ID NO: 7558309 - DNA, 20 bp, Homo sapiens
aggtcctggttctctgggat

SEQ ID NO: 7558310 - DNA, 20 bp, Homo sapiens
aggtcctggttctctgggat

SEQ ID NO: 7558311 - DNA, 22 bp, Homo sapiens
cctgggctttgagggcaggatg

SEQ ID NO: 7558312 - DNA, 19 bp, Homo sapiens
aggtcctgatcagcaagga

SEQ ID NO: 7558313 - DNA, 19 bp, Homo sapiens
aggtcctgatcagcaagga

SEQ ID NO: 7558314 - DNA, 22 bp, Homo sapiens
aggtcctgatgatctctgagag

SEQ ID NO: 7558315 - DNA, 22 bp, Homo sapiens
aggtcctgatgatctctgagag

SEQ ID NO: 7558316 - DNA, 22 bp, Homo sapiens
aggtcctgatgatctctgagag

SEQ ID NO: 7558317 - DNA, 19 bp, Homo sapiens
aggtcctgatcagcaagga

SEQ ID NO: 7558318 - DNA, 19 bp, Homo sapiens
aggtcctgatcagcaagga

SEQ ID NO: 7558319 - DNA, 22 bp, Homo sapiens
aggtcctgatgatctctgagag

SEQ ID NO: 7558320 - DNA, 20 bp, Homo sapiens
aggtcctgggactggcagag

SEQ ID NO: 7558321 - DNA, 20 bp, Homo sapiens
aggtcctgggactggcagag

SEQ ID NO: 7558322 - DNA, 22 bp, Homo sapiens
aggtcctggactgctcttgtta

SEQ ID NO: 7558323 - DNA, 22 bp, Homo sapiens
aggtcctggactgctcttgtta

SEQ ID NO: 7558324 - DNA, 23 bp, Homo sapiens
aggtcctggacatatgtgcatca

SEQ ID NO: 7558325 - DNA, 23 bp, Homo sapiens
aggtcctggacatatgtgcatca

SEQ ID NO: 7558326 - DNA, 23 bp, Homo sapiens
aggtcctggacatatgtgcatca

SEQ ID NO: 7558327 - DNA, 23 bp, Homo sapiens
aggtcctggacatatgtgcatca

SEQ ID NO: 7558328 - DNA, 23 bp, Homo sapiens
aggtcctggacatatgtgcatca

SEQ ID NO: 7558329 - DNA, 22 bp, Homo sapiens
aggtcctggactgctcttgtta

SEQ ID NO: 7558330 - DNA, 22 bp, Homo sapiens
aggtcctggactgctcttgtta

SEQ ID NO: 7558331 - DNA, 22 bp, Homo sapiens
aggtcctggactgctcttgtta

SEQ ID NO: 7558332 - DNA, 22 bp, Homo sapiens
aggtcctggtgaccatggagtt

SEQ ID NO: 7558333 - DNA, 20 bp, Homo sapiens
aggtcctggttctctgggat

SEQ ID NO: 7558334 - DNA, 20 bp, Homo sapiens
aggtcctggttctctgggat

SEQ ID NO: 7558335 - DNA, 20 bp, Homo sapiens
aggtcctggttctctgggat

SEQ ID NO: 7558336 - DNA, 22 bp, Homo sapiens
aggtcctggtcttgagtcttaa

SEQ ID NO: 7558337 - DNA, 22 bp, Homo sapiens
aggtcctggtgaccatggagtt

SEQ ID NO: 7558338 - DNA, 22 bp, Homo sapiens
aggtcctggtgaccatggagtt

SEQ ID NO: 7558339 - DNA, 22 bp, Homo sapiens
aggtcctggtcttgagtcttaa

SEQ ID NO: 7558340 - DNA, 22 bp, Homo sapiens
aggtcctggtcttgagtcttaa

SEQ ID NO: 7558341 - DNA, 22 bp, Homo sapiens
aggtcctgggagttctagtgtg

SEQ ID NO: 7558342 - DNA, 22 bp, Homo sapiens
aggtcctgggagttctagtgtg

SEQ ID NO: 7558343 - DNA, 22 bp, Homo sapiens
aggtcctgggagttctagtgtg

SEQ ID NO: 7558344 - DNA, 22 bp, Homo sapiens
cctgtgccagctgggccctgcc

SEQ ID NO: 7558345 - DNA, 22 bp, Homo sapiens
cctgtgccagctgggccctgcc

SEQ ID NO: 7558346 - DNA, 21 bp, Homo sapiens
cctgtgccagtctatgtgttc

SEQ ID NO: 7558347 - DNA, 21 bp, Homo sapiens
cctgtgccagtctatgtgttc

SEQ ID NO: 7558348 - DNA, 22 bp, Homo sapiens
cctgtgggagcccaggcagata

SEQ ID NO: 7558349 - DNA, 22 bp, Homo sapiens
cctgtgggagcccaggcagata

SEQ ID NO: 7558350 - DNA, 22 bp, Homo sapiens
cctgtgggagcccaggcagata

SEQ ID NO: 7558351 - DNA, 22 bp, Homo sapiens
aggtgcagctggtggagtctgg

SEQ ID NO: 7558352 - DNA, 22 bp, Homo sapiens
cctgtgccagccccttctgctg

SEQ ID NO: 7558353 - DNA, 22 bp, Homo sapiens
cctgtgccagctgggccctgcc

SEQ ID NO: 7558354 - DNA, 22 bp, Homo sapiens
cctgtgccagctgggccctgcc

SEQ ID NO: 7558355 - DNA, 22 bp, Homo sapiens
aggtgcaggagctgtgcaggga

SEQ ID NO: 7558356 - DNA, 22 bp, Homo sapiens
cctgtgccagccccttctgctg

SEQ ID NO: 7558357 - DNA, 22 bp, Homo sapiens
aggtgcagctggtggagtctgg

SEQ ID NO: 7558358 - DNA, 22 bp, Homo sapiens
aggtgcagctggtggagtctgg

SEQ ID NO: 7558359 - DNA, 22 bp, Homo sapiens
aggtgcagctggtggagtctgg

SEQ ID NO: 7558360 - DNA, 22 bp, Homo sapiens
aggtgcagctggtggagtctgg

SEQ ID NO: 7558361 - DNA, 22 bp, Homo sapiens
aggtgcagcatgagtccaacgg

SEQ ID NO: 7558362 - DNA, 22 bp, Homo sapiens
aggtgcagcatgagtccaacgg

SEQ ID NO: 7558363 - DNA, 22 bp, Homo sapiens
aggtgcagcatgagtccaacgg

SEQ ID NO: 7558364 - DNA, 21 bp, Homo sapiens
aggtgcagaggcctcactcac

SEQ ID NO: 7558365 - DNA, 22 bp, Homo sapiens
aggtgcagcatgagtccaacgg

SEQ ID NO: 7558366 - DNA, 22 bp, Homo sapiens
aggtgcagcatgagtccaacgg

SEQ ID NO: 7558367 - DNA, 23 bp, Homo sapiens
aggtgcagccctggacctgcccc

SEQ ID NO: 7558368 - DNA, 23 bp, Homo sapiens
aggtgcagccctggacctgcccc

SEQ ID NO: 7558369 - DNA, 18 bp, Homo sapiens
aggtgcagcctctgaggc

SEQ ID NO: 7558370 - DNA, 18 bp, Homo sapiens
aggtgcagcctctgaggc

SEQ ID NO: 7558371 - DNA, 22 bp, Homo sapiens
aggtgcagctgacaccatgtgg

SEQ ID NO: 7558372 - DNA, 22 bp, Homo sapiens
aggtgcagctggtggagtctgg

SEQ ID NO: 7558373 - DNA, 22 bp, Homo sapiens
aggtgcagctggtggagtctgg

SEQ ID NO: 7558374 - DNA, 22 bp, Homo sapiens
aggtgcagctggtggagtctgg

SEQ ID NO: 7558375 - DNA, 22 bp, Homo sapiens
aggtgcagctggtggagtctgg

SEQ ID NO: 7558376 - DNA, 18 bp, Homo sapiens
aggtgcagcctctgaggc

SEQ ID NO: 7558377 - DNA, 22 bp, Homo sapiens
aggtgcagctgacaccatgtgg

SEQ ID NO: 7558378 - DNA, 18 bp, Homo sapiens
aggtgcagcctctgaggc

SEQ ID NO: 7558379 - DNA, 18 bp, Homo sapiens
aggtgcagcctctgaggc

SEQ ID NO: 7558380 - DNA, 22 bp, Homo sapiens
aggtgcagctgacaccatgtgg

SEQ ID NO: 7558381 - DNA, 22 bp, Homo sapiens
aggtgcagctgacaccatgtgg

SEQ ID NO: 7558382 - DNA, 22 bp, Homo sapiens
aggtgcagctgacaccatgtgg

SEQ ID NO: 7558383 - DNA, 22 bp, Homo sapiens
aggtgcagctgacaccatgtgg

SEQ ID NO: 7558384 - DNA, 22 bp, Homo sapiens
aggtgcagctgacaccatgtgg

SEQ ID NO: 7558385 - DNA, 17 bp, Homo sapiens
aggtgcagaggcagagc

SEQ ID NO: 7558386 - DNA, 17 bp, Homo sapiens
aggtgcagaggcagagc

SEQ ID NO: 7558387 - DNA, 17 bp, Homo sapiens
aggtgcagaggcagagc

SEQ ID NO: 7558388 - DNA, 17 bp, Homo sapiens
aggtgcagaggcagagc

SEQ ID NO: 7558389 - DNA, 21 bp, Homo sapiens
aggtgcagagccagggaccag

SEQ ID NO: 7558390 - DNA, 17 bp, Homo sapiens
aggtgcagaggcagagc

SEQ ID NO: 7558391 - DNA, 17 bp, Homo sapiens
aggtgcagaggcagagc

SEQ ID NO: 7558392 - DNA, 17 bp, Homo sapiens
aggtgcagaggcagagc

SEQ ID NO: 7558393 - DNA, 17 bp, Homo sapiens
aggtgcagaggcagagc

SEQ ID NO: 7558394 - DNA, 17 bp, Homo sapiens
aggtgcagaggcagagc

SEQ ID NO: 7558395 - DNA, 22 bp, Homo sapiens
cctgggtccaattctggcttgt

SEQ ID NO: 7558396 - DNA, 22 bp, Homo sapiens
cctgggtccaattctggcttgt

SEQ ID NO: 7558397 - DNA, 22 bp, Homo sapiens
cctgggtcactcaggcaggcgg

SEQ ID NO: 7558398 - DNA, 22 bp, Homo sapiens
cctgggtccaccctgtgaagta

SEQ ID NO: 7558399 - DNA, 17 bp, Homo sapiens
aggtgcagaggcagagc

SEQ ID NO: 7558400 - DNA, 17 bp, Homo sapiens
aggtgcagaggcagagc

SEQ ID NO: 7558401 - DNA, 21 bp, Homo sapiens
aggtgcagagccagggaccag

SEQ ID NO: 7558402 - DNA, 21 bp, Homo sapiens
aggtgcagagccagggaccag

SEQ ID NO: 7558403 - DNA, 22 bp, Homo sapiens
cctgggtcaccaggcccaggca

SEQ ID NO: 7558404 - DNA, 22 bp, Homo sapiens
cctgggtcaccaggcccaggca

SEQ ID NO: 7558405 - DNA, 22 bp, Homo sapiens
cctgggtacccttggcggcctt

SEQ ID NO: 7558406 - DNA, 22 bp, Homo sapiens
cctgggtagactttgaagcatt

SEQ ID NO: 7558407 - DNA, 22 bp, Homo sapiens
cctgggtatagaagagccgctg

SEQ ID NO: 7558408 - DNA, 22 bp, Homo sapiens
cctgggtatagaagagccgctg

SEQ ID NO: 7558409 - DNA, 22 bp, Homo sapiens
cctgggtcaccaggcccaggca

SEQ ID NO: 7558410 - DNA, 22 bp, Homo sapiens
cctgggtcaccaggcccaggca

SEQ ID NO: 7558411 - DNA, 22 bp, Homo sapiens
cctgggtcactcaggcaggcgg

SEQ ID NO: 7558412 - DNA, 22 bp, Homo sapiens
cctgggtcactcaggcaggcgg

SEQ ID NO: 7558413 - DNA, 22 bp, Homo sapiens
cctgggtcactcaggcaggcgg

SEQ ID NO: 7558414 - DNA, 22 bp, Homo sapiens
cctgggtcactcaggcaggcgg

SEQ ID NO: 7558415 - DNA, 22 bp, Homo sapiens
cctggggtatataggtgaatat

SEQ ID NO: 7558416 - DNA, 22 bp, Homo sapiens
cctggggtcacttgcagccgca

SEQ ID NO: 7558417 - DNA, 22 bp, Homo sapiens
cctggggtcacttgcagccgca

SEQ ID NO: 7558418 - DNA, 22 bp, Homo sapiens
cctggggtcacttgcagccgca

SEQ ID NO: 7558419 - DNA, 22 bp, Homo sapiens
cctggggtcagggacgctgtgc

SEQ ID NO: 7558420 - DNA, 22 bp, Homo sapiens
cctggggtcagggacgctgtgc

SEQ ID NO: 7558421 - DNA, 22 bp, Homo sapiens
cctggggtcagggacgctgtgc

SEQ ID NO: 7558422 - DNA, 22 bp, Homo sapiens
cctgggtacccttggcggcctt

SEQ ID NO: 7558423 - DNA, 22 bp, Homo sapiens
cctgggtacccttggcggcctt

SEQ ID NO: 7558424 - DNA, 22 bp, Homo sapiens
cctgggtacgcagggctcctct

SEQ ID NO: 7558425 - DNA, 22 bp, Homo sapiens
cctgggtacgcagggctcctct

SEQ ID NO: 7558426 - DNA, 22 bp, Homo sapiens
cctgggtagactttgaagcatt

SEQ ID NO: 7558427 - DNA, 22 bp, Homo sapiens
cctgggtacgcagggctcctct

SEQ ID NO: 7558428 - DNA, 22 bp, Homo sapiens
cctgtgggaggttctgtgagtc

SEQ ID NO: 7558429 - DNA, 22 bp, Homo sapiens
cctgtgggaggttctgtgagtc

SEQ ID NO: 7558430 - DNA, 22 bp, Homo sapiens
cctgtgggaggggcctggcgcg

SEQ ID NO: 7558431 - DNA, 22 bp, Homo sapiens
cctgtgggaggttctgtgagtc

SEQ ID NO: 7558432 - DNA, 22 bp, Homo sapiens
cctgtgggaggttctgtgagtc

SEQ ID NO: 7558433 - DNA, 22 bp, Homo sapiens
cctgtgggagggagcggctgga

SEQ ID NO: 7558434 - DNA, 22 bp, Homo sapiens
cctgtgggagggagcggctgga

SEQ ID NO: 7558435 - DNA, 22 bp, Homo sapiens
cctgtgggagcccaggcagata

SEQ ID NO: 7558436 - DNA, 22 bp, Homo sapiens
cctgtgggagggagcggctgga

SEQ ID NO: 7558437 - DNA, 22 bp, Homo sapiens
cctgtgggagggagcggctgga

SEQ ID NO: 7558438 - DNA, 22 bp, Homo sapiens
cctgtgggccctggacagagac

SEQ ID NO: 7558439 - DNA, 22 bp, Homo sapiens
cctgtgggccaaggacctgcca

SEQ ID NO: 7558440 - DNA, 22 bp, Homo sapiens
cctgtgggccaaggacctgcca

SEQ ID NO: 7558441 - DNA, 22 bp, Homo sapiens
cctgtgggccaaggacctgcca

SEQ ID NO: 7558442 - DNA, 22 bp, Homo sapiens
cctgtgggccaaggacctgcca

SEQ ID NO: 7558443 - DNA, 22 bp, Homo sapiens
cctgtgggccctggacagagac

SEQ ID NO: 7558444 - DNA, 22 bp, Homo sapiens
cctgtgggccctggacagagac

SEQ ID NO: 7558445 - DNA, 22 bp, Homo sapiens
cctgtgggccctggacagagac

SEQ ID NO: 7558446 - DNA, 22 bp, Homo sapiens
cctgtgggccctggacagagac

SEQ ID NO: 7558447 - DNA, 22 bp, Homo sapiens
cctgtgggcgcagctggagtca

SEQ ID NO: 7558448 - DNA, 22 bp, Homo sapiens
cctgtgggcctgcacgtgggga

SEQ ID NO: 7558449 - DNA, 22 bp, Homo sapiens
cctgtgggccctggacagagac

SEQ ID NO: 7558450 - DNA, 22 bp, Homo sapiens
cctgtgggcgcagctggagtca

SEQ ID NO: 7558451 - DNA, 22 bp, Homo sapiens
cctgtggggctgaaagaggctt

SEQ ID NO: 7558452 - DNA, 22 bp, Homo sapiens
cctgtggggccatctcagtcac

SEQ ID NO: 7558453 - DNA, 22 bp, Homo sapiens
cctgtgggtacaacagggtcac

SEQ ID NO: 7558454 - DNA, 22 bp, Homo sapiens
cctgtgggtacaacagggtcac

SEQ ID NO: 7558455 - DNA, 22 bp, Homo sapiens
aggtggcaaggggcgcctctct

SEQ ID NO: 7558456 - DNA, 22 bp, Homo sapiens
cctgtgggtcacatgggtgact

SEQ ID NO: 7558457 - DNA, 22 bp, Homo sapiens
cctgtgggtacaacagggtcac

SEQ ID NO: 7558458 - DNA, 22 bp, Homo sapiens
cctgtgggcttgagtgtagggt

SEQ ID NO: 7558459 - DNA, 22 bp, Homo sapiens
cctgtgggcttgagtgtagggt

SEQ ID NO: 7558460 - DNA, 22 bp, Homo sapiens
cctgtgggcttgagtgtagggt

SEQ ID NO: 7558461 - DNA, 22 bp, Homo sapiens
cctgtggggccatctcagtcac

SEQ ID NO: 7558462 - DNA, 22 bp, Homo sapiens
cctgtggggccatctcagtcac

SEQ ID NO: 7558463 - DNA, 22 bp, Homo sapiens
aggtggcagagtgacaggctga

SEQ ID NO: 7558464 - DNA, 22 bp, Homo sapiens
aggtggcagagtgacaggctga

SEQ ID NO: 7558465 - DNA, 22 bp, Homo sapiens
aggtggcagagtgacaggctga

SEQ ID NO: 7558466 - DNA, 22 bp, Homo sapiens
aggtggcagagtgacaggctga

SEQ ID NO: 7558467 - DNA, 22 bp, Homo sapiens
aggtggcagagtgacaggctga

SEQ ID NO: 7558468 - DNA, 22 bp, Homo sapiens
aggtggcagaggactcctcctg

SEQ ID NO: 7558469 - DNA, 22 bp, Homo sapiens
aggtggcagagctggcccagcg

SEQ ID NO: 7558470 - DNA, 22 bp, Homo sapiens
aggtggcagagtgacaggctga

SEQ ID NO: 7558471 - DNA, 22 bp, Homo sapiens
aggtggcagaggactcctcctg

SEQ ID NO: 7558472 - DNA, 22 bp, Homo sapiens
aggtggcagaggactcctcctg

SEQ ID NO: 7558473 - DNA, 22 bp, Homo sapiens
aggtggcagagctggcccagcg

SEQ ID NO: 7558474 - DNA, 22 bp, Homo sapiens
aggtggcagactaacagaagga

SEQ ID NO: 7558475 - DNA, 22 bp, Homo sapiens
aggtggcagagctggcccagcg

SEQ ID NO: 7558476 - DNA, 22 bp, Homo sapiens
aggtggcagactaacagaagga

SEQ ID NO: 7558477 - DNA, 22 bp, Homo sapiens
aggtggcagactaacagaagga

SEQ ID NO: 7558478 - DNA, 22 bp, Homo sapiens
aggtggcagactaacagaagga

SEQ ID NO: 7558479 - DNA, 22 bp, Homo sapiens
aggtggcagagctggcccagcg

SEQ ID NO: 7558480 - DNA, 22 bp, Homo sapiens
aggtggcagagctggcccagcg

SEQ ID NO: 7558481 - DNA, 22 bp, Homo sapiens
aggtggcagagctggcccagcg

SEQ ID NO: 7558482 - DNA, 22 bp, Homo sapiens
aggtggcagagctggcccagcg

SEQ ID NO: 7558483 - DNA, 22 bp, Homo sapiens
ccttccagatgtaagagctgat

SEQ ID NO: 7558484 - DNA, 22 bp, Homo sapiens
ccttccagatgtaagagctgat

SEQ ID NO: 7558485 - DNA, 22 bp, Homo sapiens
ccttccagatgtaagagctgat

SEQ ID NO: 7558486 - DNA, 22 bp, Homo sapiens
ccttccagatgtaagagctgat

SEQ ID NO: 7558487 - DNA, 22 bp, Homo sapiens
ccttccagatgtaagagctgat

SEQ ID NO: 7558488 - DNA, 22 bp, Homo sapiens
ccttccagagttcagtctgccc

SEQ ID NO: 7558489 - DNA, 22 bp, Homo sapiens
ccttccagagttcagtctgccc

SEQ ID NO: 7558490 - DNA, 22 bp, Homo sapiens
ccttccagagttcagtctgccc

SEQ ID NO: 7558491 - DNA, 22 bp, Homo sapiens
ccttccagaggcgtgacaccct

SEQ ID NO: 7558492 - DNA, 22 bp, Homo sapiens
ccttccagaggcgtgacaccct

SEQ ID NO: 7558493 - DNA, 22 bp, Homo sapiens
ccttccagagttcagtctgccc

SEQ ID NO: 7558494 - DNA, 22 bp, Homo sapiens
ccttccagaggcgtgacaccct

SEQ ID NO: 7558495 - DNA, 22 bp, Homo sapiens
ccttccagaggcgtgacaccct

SEQ ID NO: 7558496 - DNA, 22 bp, Homo sapiens
ccttccagaggcgtgacaccct

SEQ ID NO: 7558497 - DNA, 21 bp, Homo sapiens
ccttccaccttctgccatgtg

SEQ ID NO: 7558498 - DNA, 21 bp, Homo sapiens
ccttccaccttctgccatgtg

SEQ ID NO: 7558499 - DNA, 22 bp, Homo sapiens
ccttccaagtgcttgccgcttt

SEQ ID NO: 7558500 - DNA, 22 bp, Homo sapiens
ccttccaagtgcttgccgcttt

SEQ ID NO: 7558501 - DNA, 22 bp, Homo sapiens
ccttccaagtgcttgccgcttt

SEQ ID NO: 7558502 - DNA, 22 bp, Homo sapiens
ccttccaagtgctgctttttcc

SEQ ID NO: 7558503 - DNA, 22 bp, Homo sapiens
ccttccaagtgctgctttttcc

SEQ ID NO: 7558504 - DNA, 22 bp, Homo sapiens
ccttccagaaagcacttagtta

SEQ ID NO: 7558505 - DNA, 22 bp, Homo sapiens
ccttccagaaagcacttagtta

SEQ ID NO: 7558506 - DNA, 22 bp, Homo sapiens
ccttccagaggcgtgacaccct

SEQ ID NO: 7558507 - DNA, 19 bp, Homo sapiens
ccttccagaactaaattaa

SEQ ID NO: 7558508 - DNA, 19 bp, Homo sapiens
ccttccagctccttttcag

SEQ ID NO: 7558509 - DNA, 22 bp, Homo sapiens
ccttccagccccatctcatcgt

SEQ ID NO: 7558510 - DNA, 22 bp, Homo sapiens
ccttccagccccatctcatcgt

SEQ ID NO: 7558511 - DNA, 19 bp, Homo sapiens
ccttccagctccttttcag

SEQ ID NO: 7558512 - DNA, 22 bp, Homo sapiens
ccttccaggagtctctgcaggt

SEQ ID NO: 7558513 - DNA, 22 bp, Homo sapiens
ccttccaggagtctctgcaggt

SEQ ID NO: 7558514 - DNA, 22 bp, Homo sapiens
ccttccaggagtctctgcaggt

SEQ ID NO: 7558515 - DNA, 22 bp, Homo sapiens
ccttccaggagtctctgcaggt

SEQ ID NO: 7558516 - DNA, 22 bp, Homo sapiens
ccttccaggagtctctgcaggt

SEQ ID NO: 7558517 - DNA, 22 bp, Homo sapiens
ccttccaggagtctctgcaggt

SEQ ID NO: 7558518 - DNA, 22 bp, Homo sapiens
ccttccagccccatctcatcgt

SEQ ID NO: 7558519 - DNA, 22 bp, Homo sapiens
ccttccagccccatctcatcgt

SEQ ID NO: 7558520 - DNA, 22 bp, Homo sapiens
ccttccagatgtaagagctgat

SEQ ID NO: 7558521 - DNA, 22 bp, Homo sapiens
ccttccagatgtaagagctgat

SEQ ID NO: 7558522 - DNA, 22 bp, Homo sapiens
ccttccaggctggaggcttggg

SEQ ID NO: 7558523 - DNA, 22 bp, Homo sapiens
ccttccaggagtctctgcaggt

SEQ ID NO: 7558524 - DNA, 22 bp, Homo sapiens
ccttccaggctggaggcttggg

SEQ ID NO: 7558525 - DNA, 22 bp, Homo sapiens
ccttccagggctctccagaacc

SEQ ID NO: 7558526 - DNA, 22 bp, Homo sapiens
ccttccagggctctccagaacc

SEQ ID NO: 7558527 - DNA, 22 bp, Homo sapiens
ccttccagggagcaggcagtgt

SEQ ID NO: 7558528 - DNA, 22 bp, Homo sapiens
ccttccagggagcaggcagtgt

SEQ ID NO: 7558529 - DNA, 22 bp, Homo sapiens
ccttccagggagcaggcagtgt

SEQ ID NO: 7558530 - DNA, 22 bp, Homo sapiens
aggtggcagcagaatcagggag

SEQ ID NO: 7558531 - DNA, 22 bp, Homo sapiens
aggtggcagcagcctggtgaaa

SEQ ID NO: 7558532 - DNA, 22 bp, Homo sapiens
aggtggcagcagcctggtgaaa

SEQ ID NO: 7558533 - DNA, 22 bp, Homo sapiens
aggtggcagcagcctggtgaaa

SEQ ID NO: 7558534 - DNA, 22 bp, Homo sapiens
aggtggcagcaggagatgtgga

SEQ ID NO: 7558535 - DNA, 22 bp, Homo sapiens
aggtggcagcagcctggtgaaa

SEQ ID NO: 7558536 - DNA, 22 bp, Homo sapiens
aggtggcagcagcctggtgaaa

SEQ ID NO: 7558537 - DNA, 22 bp, Homo sapiens
aggtggcagcagaatcagggag

SEQ ID NO: 7558538 - DNA, 22 bp, Homo sapiens
aggtggcagcaggagatgtgga

SEQ ID NO: 7558539 - DNA, 22 bp, Homo sapiens
aggtggcagatgggggtgctcg

SEQ ID NO: 7558540 - DNA, 22 bp, Homo sapiens
aggtggcagatgggggtgctcg

SEQ ID NO: 7558541 - DNA, 22 bp, Homo sapiens
aggtggcagatgggggtgctcg

SEQ ID NO: 7558542 - DNA, 22 bp, Homo sapiens
aggtggcagcagaatcagggag

SEQ ID NO: 7558543 - DNA, 22 bp, Homo sapiens
aggtggcagcagaatcagggag

SEQ ID NO: 7558544 - DNA, 22 bp, Homo sapiens
aggtggcagagtgacaggctga

SEQ ID NO: 7558545 - DNA, 22 bp, Homo sapiens
aggtggcagagtgacaggctga

SEQ ID NO: 7558546 - DNA, 22 bp, Homo sapiens
aggtggcagatgggggtgctcg

SEQ ID NO: 7558547 - DNA, 22 bp, Homo sapiens
aggtggcagatgggggtgctcg

SEQ ID NO: 7558548 - DNA, 22 bp, Homo sapiens
ccttcattcattaatttagccc

SEQ ID NO: 7558549 - DNA, 22 bp, Homo sapiens
ccttcattcattaatttagccc

SEQ ID NO: 7558550 - DNA, 22 bp, Homo sapiens
ccttcattgcatctttaagaga

SEQ ID NO: 7558551 - DNA, 22 bp, Homo sapiens
ccttccaaaggagccacatctg

SEQ ID NO: 7558552 - DNA, 22 bp, Homo sapiens
ccttccaaaggagccacatctg

SEQ ID NO: 7558553 - DNA, 22 bp, Homo sapiens
ccttccaagtgctgctttttcc

SEQ ID NO: 7558554 - DNA, 22 bp, Homo sapiens
cctgtttatctatctagagatg

SEQ ID NO: 7558555 - DNA, 22 bp, Homo sapiens
cctgtttggtacaatctgccaa

SEQ ID NO: 7558556 - DNA, 22 bp, Homo sapiens
ccttcattcagctatagcatcc

SEQ ID NO: 7558557 - DNA, 22 bp, Homo sapiens
cctgtttcagaatttttagtga

SEQ ID NO: 7558558 - DNA, 22 bp, Homo sapiens
aggtggcaggaggtcagagaaa

SEQ ID NO: 7558559 - DNA, 22 bp, Homo sapiens
aggtggcaggaggtcagagaaa

SEQ ID NO: 7558560 - DNA, 22 bp, Homo sapiens
aggtggcaggaggtcagagaaa

SEQ ID NO: 7558561 - DNA, 22 bp, Homo sapiens
aggtggcaggaggtcagagaaa

SEQ ID NO: 7558562 - DNA, 22 bp, Homo sapiens
aggtggcaggaggtcagagaaa

SEQ ID NO: 7558563 - DNA, 22 bp, Homo sapiens
aggtggcagccgagacataagg

SEQ ID NO: 7558564 - DNA, 22 bp, Homo sapiens
aggtggcagccgagacataagg

SEQ ID NO: 7558565 - DNA, 22 bp, Homo sapiens
aggtggcagttgtggaaccatc

SEQ ID NO: 7558566 - DNA, 22 bp, Homo sapiens
cctgttgtttagcacttagaac

SEQ ID NO: 7558567 - DNA, 22 bp, Homo sapiens
cctgtttaccactgaggggcag

SEQ ID NO: 7558568 - DNA, 22 bp, Homo sapiens
cctgaggttatccatctacctg

SEQ ID NO: 7558569 - DNA, 19 bp, Homo sapiens
cctgaggtggggtggaagg

SEQ ID NO: 7558570 - DNA, 18 bp, Homo sapiens
cctgaggtgggaggaagg

SEQ ID NO: 7558571 - DNA, 19 bp, Homo sapiens
cctgaggtggggtggaagg

SEQ ID NO: 7558572 - DNA, 22 bp, Homo sapiens
cctgaggttgaagtataaattg

SEQ ID NO: 7558573 - DNA, 22 bp, Homo sapiens
cctgaggttgaagtataaattg

SEQ ID NO: 7558574 - DNA, 22 bp, Homo sapiens
cctgaggttatccatctacctg

SEQ ID NO: 7558575 - DNA, 22 bp, Homo sapiens
cctgaggttatccatctacctg

SEQ ID NO: 7558576 - DNA, 18 bp, Homo sapiens
cctgaggtgggaggaagg

SEQ ID NO: 7558577 - DNA, 19 bp, Homo sapiens
cctgaggtggggtggaagg

SEQ ID NO: 7558578 - DNA, 22 bp, Homo sapiens
cctgaggtggctgcagcactgc

SEQ ID NO: 7558579 - DNA, 18 bp, Homo sapiens
cctgaggtgggaggaagg

SEQ ID NO: 7558580 - DNA, 18 bp, Homo sapiens
cctgaggtgggaggaagg

SEQ ID NO: 7558581 - DNA, 22 bp, Homo sapiens
cctgaggtggctgcagcactgc

SEQ ID NO: 7558582 - DNA, 18 bp, Homo sapiens
cctgaggtgggaggaagg

SEQ ID NO: 7558583 - DNA, 22 bp, Homo sapiens
cctgaggtggctgcagcactgc

SEQ ID NO: 7558584 - DNA, 22 bp, Homo sapiens
cctgaggtggctgcagcactgc

SEQ ID NO: 7558585 - DNA, 22 bp, Homo sapiens
cctgaggtggctgcagcactgc

SEQ ID NO: 7558586 - DNA, 22 bp, Homo sapiens
cctgagtcaagatgtatggtaa

SEQ ID NO: 7558587 - DNA, 22 bp, Homo sapiens
cctgagtccaaaagtctttagc

SEQ ID NO: 7558588 - DNA, 22 bp, Homo sapiens
cctgagtccaaaagtctttagc

SEQ ID NO: 7558589 - DNA, 22 bp, Homo sapiens
cctgagtagctggaattaaagg

SEQ ID NO: 7558590 - DNA, 22 bp, Homo sapiens
cctgagtaacatggtgagaacc

SEQ ID NO: 7558591 - DNA, 22 bp, Homo sapiens
cctgagtagctggaattaaagg

SEQ ID NO: 7558592 - DNA, 22 bp, Homo sapiens
agggtgggctagactcttcccc

SEQ ID NO: 7558593 - DNA, 22 bp, Homo sapiens
agggtgggctagactcttcccc

SEQ ID NO: 7558594 - DNA, 22 bp, Homo sapiens
agggtgggctagactcttcccc

SEQ ID NO: 7558595 - DNA, 22 bp, Homo sapiens
agggtgggctagactcttcccc

SEQ ID NO: 7558596 - DNA, 22 bp, Homo sapiens
agggtgggctagactcttcccc

SEQ ID NO: 7558597 - DNA, 22 bp, Homo sapiens
cctgagtcccataatgttgcca

SEQ ID NO: 7558598 - DNA, 22 bp, Homo sapiens
cctgagtcccataatgttgcca

SEQ ID NO: 7558599 - DNA, 21 bp, Homo sapiens
cctgaggtttctggcctctgt

SEQ ID NO: 7558600 - DNA, 21 bp, Homo sapiens
cctgaggtttctggcctctgt

SEQ ID NO: 7558601 - DNA, 22 bp, Homo sapiens
cctgaggttgaagtataaattg

SEQ ID NO: 7558602 - DNA, 22 bp, Homo sapiens
cctgaggtttttggatagttgt

SEQ ID NO: 7558603 - DNA, 22 bp, Homo sapiens
cctgaggtttttggatagttgt

SEQ ID NO: 7558604 - DNA, 22 bp, Homo sapiens
cctgagtagctggaattaaagg

SEQ ID NO: 7558605 - DNA, 22 bp, Homo sapiens
cctgagtagctggaattaaagg

SEQ ID NO: 7558606 - DNA, 22 bp, Homo sapiens
cctgagtaacatggtgagaacc

SEQ ID NO: 7558607 - DNA, 22 bp, Homo sapiens
cctgaggtttttggatagttgt

SEQ ID NO: 7558608 - DNA, 22 bp, Homo sapiens
cctgaggtttttggatagttgt

SEQ ID NO: 7558609 - DNA, 22 bp, Homo sapiens
cctgaggttatccatctacctg

SEQ ID NO: 7558610 - DNA, 22 bp, Homo sapiens
agggttaggtcacgctgcctgg

SEQ ID NO: 7558611 - DNA, 19 bp, Homo sapiens
agggttacccgctgccacc

SEQ ID NO: 7558612 - DNA, 19 bp, Homo sapiens
agggttacccgctgccacc

SEQ ID NO: 7558613 - DNA, 22 bp, Homo sapiens
agggtgggctagactcttcccc

SEQ ID NO: 7558614 - DNA, 22 bp, Homo sapiens
agggtgggctagactcttcccc

SEQ ID NO: 7558615 - DNA, 22 bp, Homo sapiens
agggtgggctagactcttcccc

SEQ ID NO: 7558616 - DNA, 22 bp, Homo sapiens
agggttagtctttgcagctagg

SEQ ID NO: 7558617 - DNA, 22 bp, Homo sapiens
agggttataaatcatcttacat

SEQ ID NO: 7558618 - DNA, 22 bp, Homo sapiens
agggttcagtgaggtgtactcc

SEQ ID NO: 7558619 - DNA, 22 bp, Homo sapiens
agggttcccatcacctccttcc

SEQ ID NO: 7558620 - DNA, 20 bp, Homo sapiens
agggttcccttgttcagcag

SEQ ID NO: 7558621 - DNA, 22 bp, Homo sapiens
agggttgcctctgagtgctccg

SEQ ID NO: 7558622 - DNA, 22 bp, Homo sapiens
agggttgcaggggccatgccca

SEQ ID NO: 7558623 - DNA, 22 bp, Homo sapiens
agggttgcatttttagaggctc

SEQ ID NO: 7558624 - DNA, 22 bp, Homo sapiens
agggttgcagcagaggcccagt

SEQ ID NO: 7558625 - DNA, 22 bp, Homo sapiens
aggtaaaatgagtctccattat

SEQ ID NO: 7558626 - DNA, 22 bp, Homo sapiens
aggtaaaatagatagtatttct

SEQ ID NO: 7558627 - DNA, 22 bp, Homo sapiens
aggtaaaatagatagtatttct

SEQ ID NO: 7558628 - DNA, 22 bp, Homo sapiens
aggtaaaatagatagtatttct

SEQ ID NO: 7558629 - DNA, 22 bp, Homo sapiens
agggttttgtttcttgaagcac

SEQ ID NO: 7558630 - DNA, 22 bp, Homo sapiens
agggttttgtgaggctcaaact

SEQ ID NO: 7558631 - DNA, 22 bp, Homo sapiens
aggtaaaatagatagtatttct

SEQ ID NO: 7558632 - DNA, 22 bp, Homo sapiens
aggtaaagaaaggtgtaacatt

SEQ ID NO: 7558633 - DNA, 22 bp, Homo sapiens
aggtaaaatgagtctccattat

SEQ ID NO: 7558634 - DNA, 22 bp, Homo sapiens
aggtaaacaggagaaaatgaga

SEQ ID NO: 7558635 - DNA, 22 bp, Homo sapiens
aggtaaacaggagaaaatgaga

SEQ ID NO: 7558636 - DNA, 21 bp, Homo sapiens
agggttttatagatctcttcc

SEQ ID NO: 7558637 - DNA, 22 bp, Homo sapiens
agggttttggctgaagttcagc

SEQ ID NO: 7558638 - DNA, 22 bp, Homo sapiens
agggttttcatttctgagcatt

SEQ ID NO: 7558639 - DNA, 22 bp, Homo sapiens
agggttgtaagtgtatggtttc

SEQ ID NO: 7558640 - DNA, 22 bp, Homo sapiens
agggttgtatgtgagaatatgt

SEQ ID NO: 7558641 - DNA, 23 bp, Homo sapiens
agggttgtgtgcttcatgatcat

SEQ ID NO: 7558642 - DNA, 22 bp, Homo sapiens
agggttgcttgagcccaggagt

SEQ ID NO: 7558643 - DNA, 22 bp, Homo sapiens
agggttgtaagtgtatggtttc

SEQ ID NO: 7558644 - DNA, 22 bp, Homo sapiens
agggttgtaagtgtatggtttc

SEQ ID NO: 7558645 - DNA, 22 bp, Homo sapiens
aggtatttatgagagcacatat

SEQ ID NO: 7558646 - DNA, 22 bp, Homo sapiens
aggtatttatgagagcacatat

SEQ ID NO: 7558647 - DNA, 22 bp, Homo sapiens
aggtatttatgagagcacatat

SEQ ID NO: 7558648 - DNA, 22 bp, Homo sapiens
aggtacagcaatataagaggtc

SEQ ID NO: 7558649 - DNA, 22 bp, Homo sapiens
aggtacagcaatataagaggtc

SEQ ID NO: 7558650 - DNA, 22 bp, Homo sapiens
aggtacagcaatataagaggtc

SEQ ID NO: 7558651 - DNA, 17 bp, Homo sapiens
aggtatttaaggagctg

SEQ ID NO: 7558652 - DNA, 22 bp, Homo sapiens
aggtattgaccacctccttgat

SEQ ID NO: 7558653 - DNA, 22 bp, Homo sapiens
aggtattccagtggtcaccaag

SEQ ID NO: 7558654 - DNA, 22 bp, Homo sapiens
aggtattcagatgaagtgctga

SEQ ID NO: 7558655 - DNA, 22 bp, Homo sapiens
aggtcacacaactgtcagaggc

SEQ ID NO: 7558656 - DNA, 22 bp, Homo sapiens
aggtcacacaactgtcagaggc

SEQ ID NO: 7558657 - DNA, 22 bp, Homo sapiens
aggtcacacaactgtcagaggc

SEQ ID NO: 7558658 - DNA, 22 bp, Homo sapiens
aggtcacacttggatcatagaa

SEQ ID NO: 7558659 - DNA, 22 bp, Homo sapiens
aggtcacagctttctcgtgagg

SEQ ID NO: 7558660 - DNA, 22 bp, Homo sapiens
aggtcacagctttctcgtgagg

SEQ ID NO: 7558661 - DNA, 22 bp, Homo sapiens
aggtcacaggctttgaaatcaa

SEQ ID NO: 7558662 - DNA, 22 bp, Homo sapiens
aggtacagatgaaagtctagtt

SEQ ID NO: 7558663 - DNA, 22 bp, Homo sapiens
aggtacagatgaaagtctagtt

SEQ ID NO: 7558664 - DNA, 22 bp, Homo sapiens
aggtacagatgaaagtctagtt

SEQ ID NO: 7558665 - DNA, 22 bp, Homo sapiens
aggtacagatgaaagtctagtt

SEQ ID NO: 7558666 - DNA, 22 bp, Homo sapiens
aggtacagatgaaagtctagtt

SEQ ID NO: 7558667 - DNA, 22 bp, Homo sapiens
aggtaattttgtgttaatgatt

SEQ ID NO: 7558668 - DNA, 22 bp, Homo sapiens
aggtaattttgtgttaatgatt

SEQ ID NO: 7558669 - DNA, 22 bp, Homo sapiens
aggtaatttctccaaacatgct

SEQ ID NO: 7558670 - DNA, 22 bp, Homo sapiens
aggtaattgtatgttccaagca

SEQ ID NO: 7558671 - DNA, 22 bp, Homo sapiens
aggtacaaaagagtatatgaga

SEQ ID NO: 7558672 - DNA, 22 bp, Homo sapiens
aggtaatttctccaaacatgct

SEQ ID NO: 7558673 - DNA, 22 bp, Homo sapiens
aggtaattactagagttattta

SEQ ID NO: 7558674 - DNA, 22 bp, Homo sapiens
aggtaattactagagttattta

SEQ ID NO: 7558675 - DNA, 20 bp, Homo sapiens
aggtaatgggagaaaatgtt

SEQ ID NO: 7558676 - DNA, 20 bp, Homo sapiens
aggtaatgggagaaaatgtt

SEQ ID NO: 7558677 - DNA, 22 bp, Homo sapiens
aggtaaggtttggaggcagtgg

SEQ ID NO: 7558678 - DNA, 22 bp, Homo sapiens
aggtaaggtttggaggcagtgg

SEQ ID NO: 7558679 - DNA, 22 bp, Homo sapiens
aggtaatagggttcagaattat

SEQ ID NO: 7558680 - DNA, 22 bp, Homo sapiens
aggtaaggtttggaggcagtgg

SEQ ID NO: 7558681 - DNA, 22 bp, Homo sapiens
aggtaaggtttggaggcagtgg

SEQ ID NO: 7558682 - DNA, 22 bp, Homo sapiens
aggtaactggctaactgaacga

SEQ ID NO: 7558683 - DNA, 22 bp, Homo sapiens
aggtaacattgcctccatctga

SEQ ID NO: 7558684 - DNA, 22 bp, Homo sapiens
aggtaactgtggctaggtaact

SEQ ID NO: 7558685 - DNA, 22 bp, Homo sapiens
aggtaactgtggctaggtaact

SEQ ID NO: 7558686 - DNA, 22 bp, Homo sapiens
aggtaagcatggtggctgctgt

SEQ ID NO: 7558687 - DNA, 22 bp, Homo sapiens
aggtaagccttgcctgagaaaa

SEQ ID NO: 7558688 - DNA, 22 bp, Homo sapiens
aggtaagcgctattatgatctt

SEQ ID NO: 7558689 - DNA, 22 bp, Homo sapiens
aggtaaggctgtaagctaagcc

SEQ ID NO: 7558690 - DNA, 22 bp, Homo sapiens
aggtaaggctgtaagctaagcc

SEQ ID NO: 7558691 - DNA, 22 bp, Homo sapiens
aggtaaggggctcccaagtccc

SEQ ID NO: 7558692 - DNA, 22 bp, Homo sapiens
aggtaagggtcacagttcatat

SEQ ID NO: 7558693 - DNA, 22 bp, Homo sapiens
aggtaaggctgtaagctaagcc

SEQ ID NO: 7558694 - DNA, 22 bp, Homo sapiens
aggtaaggaaattgaggcaatt

SEQ ID NO: 7558695 - DNA, 22 bp, Homo sapiens
aggtaaggctgtaagctaagcc

SEQ ID NO: 7558696 - DNA, 22 bp, Homo sapiens
aggtaaggctgtaagctaagcc

SEQ ID NO: 7558697 - DNA, 22 bp, Homo sapiens
aggtaaggaaattgaggcaatt

SEQ ID NO: 7558698 - DNA, 22 bp, Homo sapiens
aggtaaattcagcagtgacatt

SEQ ID NO: 7558699 - DNA, 22 bp, Homo sapiens
aggtaacactacttagtatact

SEQ ID NO: 7558700 - DNA, 22 bp, Homo sapiens
aggtaacactacttagtatact

SEQ ID NO: 7558701 - DNA, 22 bp, Homo sapiens
aggtaacatgtggtgctataag

SEQ ID NO: 7558702 - DNA, 22 bp, Homo sapiens
aggtaacactacttagtatact

SEQ ID NO: 7558703 - DNA, 22 bp, Homo sapiens
aggtaacagcttcagcttcaga

SEQ ID NO: 7558704 - DNA, 22 bp, Homo sapiens
aggtaacactacttagtatact

SEQ ID NO: 7558705 - DNA, 22 bp, Homo sapiens
aggtaacactacttagtatact

SEQ ID NO: 7558706 - DNA, 22 bp, Homo sapiens
aggtaacactacttagtatact

SEQ ID NO: 7558707 - DNA, 22 bp, Homo sapiens
aggtaaagacagtgaaagaggg

SEQ ID NO: 7558708 - DNA, 22 bp, Homo sapiens
aggtaaagaaaggtgtaacatt

SEQ ID NO: 7558709 - DNA, 22 bp, Homo sapiens
aggtaaagaaaggtgtaacatt

SEQ ID NO: 7558710 - DNA, 22 bp, Homo sapiens
aggtaaagaaaggtgtaacatt

SEQ ID NO: 7558711 - DNA, 22 bp, Homo sapiens
aggtaaagacagtgaaagaggg

SEQ ID NO: 7558712 - DNA, 22 bp, Homo sapiens
aggtaaagacagtgaaagaggg

SEQ ID NO: 7558713 - DNA, 22 bp, Homo sapiens
aggtaaagacagtgaaagaggg

SEQ ID NO: 7558714 - DNA, 22 bp, Homo sapiens
aggtaaagacagtgaaagaggg

SEQ ID NO: 7558715 - DNA, 22 bp, Homo sapiens
aggtaaagactgcaaggagaat

SEQ ID NO: 7558716 - DNA, 22 bp, Homo sapiens
aggtaaagactgcaaggagaat

SEQ ID NO: 7558717 - DNA, 22 bp, Homo sapiens
aggtaaagactgcaaggagaat

SEQ ID NO: 7558718 - DNA, 22 bp, Homo sapiens
aggtaaatgtcagagcctttaa

SEQ ID NO: 7558719 - DNA, 19 bp, Homo sapiens
aggtcagtggctcaggcat

SEQ ID NO: 7558720 - DNA, 22 bp, Homo sapiens
aggtcagtgtagtggtttgggc

SEQ ID NO: 7558721 - DNA, 22 bp, Homo sapiens
aggtcagtgtagtggtttgggc

SEQ ID NO: 7558722 - DNA, 22 bp, Homo sapiens
aggtcaggtatcagcaggtatt

SEQ ID NO: 7558723 - DNA, 22 bp, Homo sapiens
aggtcaggtatcagcaggtatt

SEQ ID NO: 7558724 - DNA, 22 bp, Homo sapiens
aggtcagtgtagtggtttgggc

SEQ ID NO: 7558725 - DNA, 22 bp, Homo sapiens
cctgggagaactgctgggttgg

SEQ ID NO: 7558726 - DNA, 21 bp, Homo sapiens
cctgggagaattgggtgtggc

SEQ ID NO: 7558727 - DNA, 21 bp, Homo sapiens
cctgggagaattgggtgtggc

SEQ ID NO: 7558728 - DNA, 22 bp, Homo sapiens
aggtcaggtatcagcaggtatt

SEQ ID NO: 7558729 - DNA, 22 bp, Homo sapiens
aggtcaggtatcagcaggtatt

SEQ ID NO: 7558730 - DNA, 22 bp, Homo sapiens
aggtcaggtatcagcaggtatt

SEQ ID NO: 7558731 - DNA, 22 bp, Homo sapiens
aggtcagggtattcacgtctgt

SEQ ID NO: 7558732 - DNA, 22 bp, Homo sapiens
aggtcagggtattcacgtctgt

SEQ ID NO: 7558733 - DNA, 22 bp, Homo sapiens
aggtcagggtattcacgtctgt

SEQ ID NO: 7558734 - DNA, 22 bp, Homo sapiens
aggtcaggaggttaagagtctt

SEQ ID NO: 7558735 - DNA, 22 bp, Homo sapiens
aggtcagggtattcacgtctgt

SEQ ID NO: 7558736 - DNA, 22 bp, Homo sapiens
aggtcagggtattcacgtctgt

SEQ ID NO: 7558737 - DNA, 22 bp, Homo sapiens
aggtcaggaggttaagagtctt

SEQ ID NO: 7558738 - DNA, 22 bp, Homo sapiens
cctgggaggctgtgggtctgct

SEQ ID NO: 7558739 - DNA, 22 bp, Homo sapiens
cctgggaggctgtgggtctgct

SEQ ID NO: 7558740 - DNA, 22 bp, Homo sapiens
cctgggaggctgtgggtctgct

SEQ ID NO: 7558741 - DNA, 22 bp, Homo sapiens
cctgggaggctgtgggtctgct

SEQ ID NO: 7558742 - DNA, 22 bp, Homo sapiens
cctgggaggctgaggctgcagt

SEQ ID NO: 7558743 - DNA, 22 bp, Homo sapiens
cctgggaggctgaggctgcagt

SEQ ID NO: 7558744 - DNA, 22 bp, Homo sapiens
cctgggaggctgaggctgcagt

SEQ ID NO: 7558745 - DNA, 22 bp, Homo sapiens
cctgggaggctgaggctgcagt

SEQ ID NO: 7558746 - DNA, 22 bp, Homo sapiens
cctgggaggctgaggctgcagt

SEQ ID NO: 7558747 - DNA, 21 bp, Homo sapiens
cctgggagaattgggtgtggc

SEQ ID NO: 7558748 - DNA, 21 bp, Homo sapiens
cctgggagaattgggtgtggc

SEQ ID NO: 7558749 - DNA, 21 bp, Homo sapiens
cctgggagaattgggtgtggc

SEQ ID NO: 7558750 - DNA, 21 bp, Homo sapiens
cctgggagaattgggtgtggc

SEQ ID NO: 7558751 - DNA, 22 bp, Homo sapiens
cctgggaggtggaggttgcagt

SEQ ID NO: 7558752 - DNA, 22 bp, Homo sapiens
cctgggaggtggaggttgcagt

SEQ ID NO: 7558753 - DNA, 22 bp, Homo sapiens
cctgggaggtggaggttgcagt

SEQ ID NO: 7558754 - DNA, 22 bp, Homo sapiens
cctgggaggtggaggttgcagt

SEQ ID NO: 7558755 - DNA, 22 bp, Homo sapiens
cctgggaggtggaggttgcagt

SEQ ID NO: 7558756 - DNA, 22 bp, Homo sapiens
cctgggaggtggaggttgcagt

SEQ ID NO: 7558757 - DNA, 22 bp, Homo sapiens
cctgggaggtggaggttgcagt

SEQ ID NO: 7558758 - DNA, 22 bp, Homo sapiens
cctgggaggtggaggttgcagc

SEQ ID NO: 7558759 - DNA, 22 bp, Homo sapiens
cctgggaggtggaggttgcagc

SEQ ID NO: 7558760 - DNA, 22 bp, Homo sapiens
cctgggaggtggaggttgcagc

SEQ ID NO: 7558761 - DNA, 22 bp, Homo sapiens
cctgggaggtggaggttgcagc

SEQ ID NO: 7558762 - DNA, 22 bp, Homo sapiens
cctgggaggtggaggttgcagc

SEQ ID NO: 7558763 - DNA, 22 bp, Homo sapiens
cctgggaggtggaggttgcagc

SEQ ID NO: 7558764 - DNA, 22 bp, Homo sapiens
cctgggaggtggaggttgcagc

SEQ ID NO: 7558765 - DNA, 22 bp, Homo sapiens
cctgggagggcaagtgctgatg

SEQ ID NO: 7558766 - DNA, 22 bp, Homo sapiens
cctgggagggcaagtgctgatg

SEQ ID NO: 7558767 - DNA, 22 bp, Homo sapiens
cctgggagggcaagtgctgatg

SEQ ID NO: 7558768 - DNA, 22 bp, Homo sapiens
cctgggagggcaagtgctgatg

SEQ ID NO: 7558769 - DNA, 22 bp, Homo sapiens
cctgggagggcaagtgctgatg

SEQ ID NO: 7558770 - DNA, 22 bp, Homo sapiens
cctgggagggcaagtgctgatg

SEQ ID NO: 7558771 - DNA, 22 bp, Homo sapiens
cctgggagggcaagtgctgatg

SEQ ID NO: 7558772 - DNA, 22 bp, Homo sapiens
cctgggaggctgtgggtctgct

SEQ ID NO: 7558773 - DNA, 22 bp, Homo sapiens
cctgggaggctgtttccagcct

SEQ ID NO: 7558774 - DNA, 22 bp, Homo sapiens
cctgggaggctgtttccagcct

SEQ ID NO: 7558775 - DNA, 22 bp, Homo sapiens
cctgggaggctgtttccagcct

SEQ ID NO: 7558776 - DNA, 22 bp, Homo sapiens
cctgggaggctgtgggtctgct

SEQ ID NO: 7558777 - DNA, 22 bp, Homo sapiens
aggtcaccatggcatgctccac

SEQ ID NO: 7558778 - DNA, 22 bp, Homo sapiens
aggtcaccatggcatgctccac

SEQ ID NO: 7558779 - DNA, 22 bp, Homo sapiens
aggtcaccatggcatgctccac

SEQ ID NO: 7558780 - DNA, 22 bp, Homo sapiens
aggtcaccatggcatgctccac

SEQ ID NO: 7558781 - DNA, 22 bp, Homo sapiens
aggtcaccatggcatgctccac

SEQ ID NO: 7558782 - DNA, 22 bp, Homo sapiens
aggtcacatggataatgatcag

SEQ ID NO: 7558783 - DNA, 22 bp, Homo sapiens
aggtcacatggataatgatcag

SEQ ID NO: 7558784 - DNA, 22 bp, Homo sapiens
aggtcacatggataatgatcag

SEQ ID NO: 7558785 - DNA, 22 bp, Homo sapiens
aggtcacatacaaatgctcctt

SEQ ID NO: 7558786 - DNA, 22 bp, Homo sapiens
aggtcacagggttgaagtactt

SEQ ID NO: 7558787 - DNA, 22 bp, Homo sapiens
aggtcacagggttgaagtactt

SEQ ID NO: 7558788 - DNA, 22 bp, Homo sapiens
aggtcacaggctttgaaatcaa

SEQ ID NO: 7558789 - DNA, 22 bp, Homo sapiens
aggtcaccatggcatgctccac

SEQ ID NO: 7558790 - DNA, 22 bp, Homo sapiens
aggtcacccgtttgactatcca

SEQ ID NO: 7558791 - DNA, 22 bp, Homo sapiens
aggtcacccgtttgactatcca

SEQ ID NO: 7558792 - DNA, 22 bp, Homo sapiens
aggtcacccgtttgactatcca

SEQ ID NO: 7558793 - DNA, 22 bp, Homo sapiens
aggtcaccatggcatgctccac

SEQ ID NO: 7558794 - DNA, 22 bp, Homo sapiens
aggtcaccatggcatgctccac

SEQ ID NO: 7558795 - DNA, 22 bp, Homo sapiens
aggtcaccatggcatgctccac

SEQ ID NO: 7558796 - DNA, 22 bp, Homo sapiens
aggtcacttcctgtctggataa

SEQ ID NO: 7558797 - DNA, 22 bp, Homo sapiens
aggtcacttggtgttattcagc

SEQ ID NO: 7558798 - DNA, 22 bp, Homo sapiens
aggtcagaaaaggagagcattg

SEQ ID NO: 7558799 - DNA, 22 bp, Homo sapiens
aggtcagaaaaggagagcattg

SEQ ID NO: 7558800 - DNA, 20 bp, Homo sapiens
aggtcactgttagggcattc

SEQ ID NO: 7558801 - DNA, 20 bp, Homo sapiens
aggtcactgttagggcattc

SEQ ID NO: 7558802 - DNA, 22 bp, Homo sapiens
aggtcacgtcctgtgatgtcat

SEQ ID NO: 7558803 - DNA, 22 bp, Homo sapiens
aggtcacgtcctgtgatgtcat

SEQ ID NO: 7558804 - DNA, 22 bp, Homo sapiens
aggtcacccgtttgactatcca

SEQ ID NO: 7558805 - DNA, 22 bp, Homo sapiens
aggtcacccgtttgactatcca

SEQ ID NO: 7558806 - DNA, 22 bp, Homo sapiens
aggtcagacacagtgctgggtg

SEQ ID NO: 7558807 - DNA, 22 bp, Homo sapiens
aggtcagacagggtgtctttct

SEQ ID NO: 7558808 - DNA, 22 bp, Homo sapiens
aggtcagaaaaggagagcattg

SEQ ID NO: 7558809 - DNA, 22 bp, Homo sapiens
aggtcagaagtgccagggaatt

SEQ ID NO: 7558810 - DNA, 22 bp, Homo sapiens
aggtcagaaaaggagagcattg

SEQ ID NO: 7558811 - DNA, 22 bp, Homo sapiens
aggtcagaaaaggagagcattg

SEQ ID NO: 7558812 - DNA, 22 bp, Homo sapiens
aggtcagaaaaggagagcattg

SEQ ID NO: 7558813 - DNA, 22 bp, Homo sapiens
aggtcagaagtgccagggaatt

SEQ ID NO: 7558814 - DNA, 22 bp, Homo sapiens
aggtcagcatgctcctctctgt

SEQ ID NO: 7558815 - DNA, 22 bp, Homo sapiens
aggtcagcatgctcctctctgt

SEQ ID NO: 7558816 - DNA, 21 bp, Homo sapiens
aggtcagcccagctctggaag

SEQ ID NO: 7558817 - DNA, 21 bp, Homo sapiens
aggtcagcccagctctggaag

SEQ ID NO: 7558818 - DNA, 22 bp, Homo sapiens
aggtcagctgcactggtgtaat

SEQ ID NO: 7558819 - DNA, 22 bp, Homo sapiens
aggtcagctagacagctctctg

SEQ ID NO: 7558820 - DNA, 22 bp, Homo sapiens
aggtcagccctctctgggcagg

SEQ ID NO: 7558821 - DNA, 21 bp, Homo sapiens
aggtcagcccagctctggaag

SEQ ID NO: 7558822 - DNA, 22 bp, Homo sapiens
aggtcagcaggccaggggcgaa

SEQ ID NO: 7558823 - DNA, 22 bp, Homo sapiens
aggtcagcaggccaggggcgaa

SEQ ID NO: 7558824 - DNA, 22 bp, Homo sapiens
aggtcagcatgagtagaaggta

SEQ ID NO: 7558825 - DNA, 22 bp, Homo sapiens
aggtcagcaggccaggggcgaa

SEQ ID NO: 7558826 - DNA, 22 bp, Homo sapiens
aggtcagatgggagatgggatg

SEQ ID NO: 7558827 - DNA, 22 bp, Homo sapiens
aggtcagacagggtgtctttct

SEQ ID NO: 7558828 - DNA, 22 bp, Homo sapiens
aggtcagatgggagatgggatg

SEQ ID NO: 7558829 - DNA, 22 bp, Homo sapiens
aggtcagatgggagatgggatg

SEQ ID NO: 7558830 - DNA, 22 bp, Homo sapiens
aggtcagatgggagatgggatg

SEQ ID NO: 7558831 - DNA, 22 bp, Homo sapiens
aggtcagctgtgtgtgcatgag

SEQ ID NO: 7558832 - DNA, 22 bp, Homo sapiens
aggtcagctgctgataggcagc

SEQ ID NO: 7558833 - DNA, 22 bp, Homo sapiens
aggtcagctgctgataggcagc

SEQ ID NO: 7558834 - DNA, 22 bp, Homo sapiens
aggtcagctgcactggtgtaat

SEQ ID NO: 7558835 - DNA, 18 bp, Homo sapiens
aggtcaggaaagcagagt

SEQ ID NO: 7558836 - DNA, 18 bp, Homo sapiens
aggtcaggaaagcagagt

SEQ ID NO: 7558837 - DNA, 18 bp, Homo sapiens
aggtcaggaaagcagagt

SEQ ID NO: 7558838 - DNA, 18 bp, Homo sapiens
aggtcaggaaagcagagt

SEQ ID NO: 7558839 - DNA, 22 bp, Homo sapiens
aggtcagctgtgtgtgcatgag

SEQ ID NO: 7558840 - DNA, 22 bp, Homo sapiens
aggtcagctgtgtgtgcatgag

SEQ ID NO: 7558841 - DNA, 22 bp, Homo sapiens
aggtcaggaggttaagagtctt

SEQ ID NO: 7558842 - DNA, 22 bp, Homo sapiens
aggtcaggaggttaagagtctt

SEQ ID NO: 7558843 - DNA, 22 bp, Homo sapiens
aggtcaggaggcctctgccatt

SEQ ID NO: 7558844 - DNA, 22 bp, Homo sapiens
aggtcaggaggcctctgccatt

SEQ ID NO: 7558845 - DNA, 22 bp, Homo sapiens
aggtcaggaggcctctgccatt

SEQ ID NO: 7558846 - DNA, 22 bp, Homo sapiens
aggtcaggaggcctctgccatt

SEQ ID NO: 7558847 - DNA, 22 bp, Homo sapiens
aggtcaggaggcctctgccatt

SEQ ID NO: 7558848 - DNA, 22 bp, Homo sapiens
aggtcaggaggcctctgccatt

SEQ ID NO: 7558849 - DNA, 18 bp, Homo sapiens
aggtcaggaaagcagagt

SEQ ID NO: 7558850 - DNA, 22 bp, Homo sapiens
agtaacaaagaaagcctttgga

SEQ ID NO: 7558851 - DNA, 18 bp, Homo sapiens
agtaaatgttaaatattg

SEQ ID NO: 7558852 - DNA, 22 bp, Homo sapiens
agtaaatttctgcatgtgtact

SEQ ID NO: 7558853 - DNA, 22 bp, Homo sapiens
agtaaatgtttatcacacagat

SEQ ID NO: 7558854 - DNA, 18 bp, Homo sapiens
agtaaatgttaaatattg

SEQ ID NO: 7558855 - DNA, 18 bp, Homo sapiens
agtaaatggtttattttc

SEQ ID NO: 7558856 - DNA, 22 bp, Homo sapiens
agtaaatggtggtttttatcat

SEQ ID NO: 7558857 - DNA, 22 bp, Homo sapiens
agtaaatggtggtttttatcat

SEQ ID NO: 7558858 - DNA, 22 bp, Homo sapiens
agtaaatggcccagggttatca

SEQ ID NO: 7558859 - DNA, 22 bp, Homo sapiens
agtaaatgattattttgccaac

SEQ ID NO: 7558860 - DNA, 18 bp, Homo sapiens
agtaaatgctaaggtctg

SEQ ID NO: 7558861 - DNA, 18 bp, Homo sapiens
agtaaatgctaaggtctg

SEQ ID NO: 7558862 - DNA, 22 bp, Homo sapiens
agtaaatcagacctcattatgt

SEQ ID NO: 7558863 - DNA, 22 bp, Homo sapiens
agtaaatgaaagcaattttaga

SEQ ID NO: 7558864 - DNA, 22 bp, Homo sapiens
agtaaatgaaagcaattttaga

SEQ ID NO: 7558865 - DNA, 22 bp, Homo sapiens
agtaaatgattattttgccaac

SEQ ID NO: 7558866 - DNA, 22 bp, Homo sapiens
agtaaatgaaagcaattttaga

SEQ ID NO: 7558867 - DNA, 22 bp, Homo sapiens
agtaaaggtctttcagtgccgg

SEQ ID NO: 7558868 - DNA, 22 bp, Homo sapiens
agtaaataacagagaaaatggg

SEQ ID NO: 7558869 - DNA, 22 bp, Homo sapiens
agtaaataacagagaaaatggg

SEQ ID NO: 7558870 - DNA, 22 bp, Homo sapiens
agtaaataacagagaaaatggg

SEQ ID NO: 7558871 - DNA, 22 bp, Homo sapiens
agtaaataacagagaaaatggg

SEQ ID NO: 7558872 - DNA, 22 bp, Homo sapiens
agtaaataacagagaaaatggg

SEQ ID NO: 7558873 - DNA, 22 bp, Homo sapiens
agtaaataacagagaaaatggg

SEQ ID NO: 7558874 - DNA, 22 bp, Homo sapiens
agtaaataacagagaaaatggg

SEQ ID NO: 7558875 - DNA, 22 bp, Homo sapiens
agtaaataacagagaaaatggg

SEQ ID NO: 7558876 - DNA, 22 bp, Homo sapiens
agtaaataacagagaaaatggg

SEQ ID NO: 7558877 - DNA, 22 bp, Homo sapiens
agtaaataacagagaaaatggg

SEQ ID NO: 7558878 - DNA, 22 bp, Homo sapiens
agtaaaggaaggaccttggaag

SEQ ID NO: 7558879 - DNA, 22 bp, Homo sapiens
agtaaagtaccaaagtgtgagt

SEQ ID NO: 7558880 - DNA, 22 bp, Homo sapiens
agtaaagtaccaaagtgtgagt

SEQ ID NO: 7558881 - DNA, 22 bp, Homo sapiens
agtaaagcggtgtcacagaatg

SEQ ID NO: 7558882 - DNA, 22 bp, Homo sapiens
agtaaagcggtgtcacagaatg

SEQ ID NO: 7558883 - DNA, 22 bp, Homo sapiens
agtaaagcttagtagtaggaaa

SEQ ID NO: 7558884 - DNA, 22 bp, Homo sapiens
agtaaagcttagtagtaggaaa

SEQ ID NO: 7558885 - DNA, 18 bp, Homo sapiens
agtaaagcttattacatg

SEQ ID NO: 7558886 - DNA, 18 bp, Homo sapiens
agtaaagcttattacatg

SEQ ID NO: 7558887 - DNA, 22 bp, Homo sapiens
agtaaacatgtaattgttcatt

SEQ ID NO: 7558888 - DNA, 22 bp, Homo sapiens
agtaaacatgtaattgttcatt

SEQ ID NO: 7558889 - DNA, 22 bp, Homo sapiens
agtaaacatgtaattgttcatt

SEQ ID NO: 7558890 - DNA, 22 bp, Homo sapiens
agtaaacatgtaattgttcatt

SEQ ID NO: 7558891 - DNA, 22 bp, Homo sapiens
agtaaacatgtaattgttcatt

SEQ ID NO: 7558892 - DNA, 22 bp, Homo sapiens
agtaaacatatttgtggtggga

SEQ ID NO: 7558893 - DNA, 22 bp, Homo sapiens
agtaaacatcaccctggggtga

SEQ ID NO: 7558894 - DNA, 22 bp, Homo sapiens
agtaaacatgtaattgttcatt

SEQ ID NO: 7558895 - DNA, 22 bp, Homo sapiens
agtaaacatgtaattgttcatt

SEQ ID NO: 7558896 - DNA, 22 bp, Homo sapiens
agtaaacatttcagatttattt

SEQ ID NO: 7558897 - DNA, 22 bp, Homo sapiens
agtaaacatttcagatttattt

SEQ ID NO: 7558898 - DNA, 22 bp, Homo sapiens
agtaaacatttcagatttattt

SEQ ID NO: 7558899 - DNA, 22 bp, Homo sapiens
agtaaacatgtaattgttcatt

SEQ ID NO: 7558900 - DNA, 22 bp, Homo sapiens
agtaaacatttcagatttattt

SEQ ID NO: 7558901 - DNA, 22 bp, Homo sapiens
agtaaacatttcagatttattt

SEQ ID NO: 7558902 - DNA, 22 bp, Homo sapiens
agtaaacatttcagatttattt

SEQ ID NO: 7558903 - DNA, 22 bp, Homo sapiens
agtaaacagtttcttagaagaa

SEQ ID NO: 7558904 - DNA, 22 bp, Homo sapiens
agtaaacataatttacctgtag

SEQ ID NO: 7558905 - DNA, 22 bp, Homo sapiens
agtaaacagtttcttagaagaa

SEQ ID NO: 7558906 - DNA, 22 bp, Homo sapiens
agtaaacataatttacctgtag

SEQ ID NO: 7558907 - DNA, 22 bp, Homo sapiens
agtaaacatagaatgttcttcc

SEQ ID NO: 7558908 - DNA, 22 bp, Homo sapiens
agtaaacatagaatgttcttcc

SEQ ID NO: 7558909 - DNA, 22 bp, Homo sapiens
agtaaacatagaatgttcttcc

SEQ ID NO: 7558910 - DNA, 22 bp, Homo sapiens
agtaaacatagaatgttcttcc

SEQ ID NO: 7558911 - DNA, 22 bp, Homo sapiens
agtaaacataatttacctgtag

SEQ ID NO: 7558912 - DNA, 22 bp, Homo sapiens
agtaaacattttcatattttct

SEQ ID NO: 7558913 - DNA, 22 bp, Homo sapiens
agtaaacattttcatattttct

SEQ ID NO: 7558914 - DNA, 22 bp, Homo sapiens
agtaaacattttcatattttct

SEQ ID NO: 7558915 - DNA, 22 bp, Homo sapiens
agtaaacattttcatattttct

SEQ ID NO: 7558916 - DNA, 22 bp, Homo sapiens
agtaaacattttcatattttct

SEQ ID NO: 7558917 - DNA, 22 bp, Homo sapiens
agtaaacatttcagatttattt

SEQ ID NO: 7558918 - DNA, 22 bp, Homo sapiens
agtaaactgtgggtacagatgt

SEQ ID NO: 7558919 - DNA, 22 bp, Homo sapiens
agtaaactgtgggtacagatgt

SEQ ID NO: 7558920 - DNA, 22 bp, Homo sapiens
agtaaagcggtgtcacagaatg

SEQ ID NO: 7558921 - DNA, 22 bp, Homo sapiens
agtaaagcggtgtcacagaatg

SEQ ID NO: 7558922 - DNA, 22 bp, Homo sapiens
agtaaagcctactcaaccacac

SEQ ID NO: 7558923 - DNA, 22 bp, Homo sapiens
agtaaagcattgtcttcagagt

SEQ ID NO: 7558924 - DNA, 22 bp, Homo sapiens
agtaaagcagagttgcagtaca

SEQ ID NO: 7558925 - DNA, 22 bp, Homo sapiens
agtaaagcagagttgcagtaca

SEQ ID NO: 7558926 - DNA, 23 bp, Homo sapiens
agtaaagcaattgttggcgagag

SEQ ID NO: 7558927 - DNA, 22 bp, Homo sapiens
agtaaagcagagttgcagtaca

SEQ ID NO: 7558928 - DNA, 22 bp, Homo sapiens
agtaaagcagagttgcagtaca

SEQ ID NO: 7558929 - DNA, 22 bp, Homo sapiens
agtaaagcagagttgcagtaca

SEQ ID NO: 7558930 - DNA, 22 bp, Homo sapiens
agtaaagcagagttgcagtaca

SEQ ID NO: 7558931 - DNA, 21 bp, Homo sapiens
ccttctccattacagtaagct

SEQ ID NO: 7558932 - DNA, 21 bp, Homo sapiens
ccttctccattacagtaagct

SEQ ID NO: 7558933 - DNA, 20 bp, Homo sapiens
ccttctccagcttgttcttg

SEQ ID NO: 7558934 - DNA, 21 bp, Homo sapiens
ccttctccattacagtaagct

SEQ ID NO: 7558935 - DNA, 21 bp, Homo sapiens
ccttctccattacagtaagct

SEQ ID NO: 7558936 - DNA, 21 bp, Homo sapiens
ccttctccattacagtaagct

SEQ ID NO: 7558937 - DNA, 22 bp, Homo sapiens
ccttccagtgactaaggaggaa

SEQ ID NO: 7558938 - DNA, 20 bp, Homo sapiens
ccttctccagcttgttcttg

SEQ ID NO: 7558939 - DNA, 20 bp, Homo sapiens
ccttctccagcttgttcttg

SEQ ID NO: 7558940 - DNA, 20 bp, Homo sapiens
ccttctccagcttgttcttg

SEQ ID NO: 7558941 - DNA, 22 bp, Homo sapiens
ccttctcccctctgcagggtgt

SEQ ID NO: 7558942 - DNA, 22 bp, Homo sapiens
ccttctccctctgagaggaacc

SEQ ID NO: 7558943 - DNA, 22 bp, Homo sapiens
ccttctccctctgagaggaacc

SEQ ID NO: 7558944 - DNA, 22 bp, Homo sapiens
ccttctcccctctgcagggtgt

SEQ ID NO: 7558945 - DNA, 22 bp, Homo sapiens
ccttctcccctctgcagggtgt

SEQ ID NO: 7558946 - DNA, 22 bp, Homo sapiens
ccttctcccctctgcagggtgt

SEQ ID NO: 7558947 - DNA, 22 bp, Homo sapiens
ccttctcccctctgcagggtgt

SEQ ID NO: 7558948 - DNA, 21 bp, Homo sapiens
ccttctccattacagtaagct

SEQ ID NO: 7558949 - DNA, 22 bp, Homo sapiens
ccttccaggtgcaggcaagcct

SEQ ID NO: 7558950 - DNA, 22 bp, Homo sapiens
ccttccaggtgcaggcaagcct

SEQ ID NO: 7558951 - DNA, 22 bp, Homo sapiens
ccttccaggtgcaggcaagcct

SEQ ID NO: 7558952 - DNA, 22 bp, Homo sapiens
ccttccaggttttggctccatt

SEQ ID NO: 7558953 - DNA, 22 bp, Homo sapiens
ccttccaggttttggctccatt

SEQ ID NO: 7558954 - DNA, 22 bp, Homo sapiens
ccttccagggctctccagaacc

SEQ ID NO: 7558955 - DNA, 22 bp, Homo sapiens
ccttccagggctctccagaacc

SEQ ID NO: 7558956 - DNA, 22 bp, Homo sapiens
ccttccagggtttttgccaatc

SEQ ID NO: 7558957 - DNA, 22 bp, Homo sapiens
ccttccagggtttttgccaatc

SEQ ID NO: 7558958 - DNA, 22 bp, Homo sapiens
ccttccagggtttttgccaatc

SEQ ID NO: 7558959 - DNA, 22 bp, Homo sapiens
ccttccaggttttggctccatt

SEQ ID NO: 7558960 - DNA, 22 bp, Homo sapiens
ccttccagtatgttaagatggt

SEQ ID NO: 7558961 - DNA, 22 bp, Homo sapiens
ccttccagtatgttaagatggt

SEQ ID NO: 7558962 - DNA, 22 bp, Homo sapiens
ccttccaggttttggctccatt

SEQ ID NO: 7558963 - DNA, 22 bp, Homo sapiens
ccttccaggttttggctccatt

SEQ ID NO: 7558964 - DNA, 22 bp, Homo sapiens
ccttccaggttttggctccatt

SEQ ID NO: 7558965 - DNA, 22 bp, Homo sapiens
ccttccaggttttggctccatt

SEQ ID NO: 7558966 - DNA, 22 bp, Homo sapiens
ccttccagtgactaaggaggaa

SEQ ID NO: 7558967 - DNA, 22 bp, Homo sapiens
ccttccagtgactaaggaggaa

SEQ ID NO: 7558968 - DNA, 22 bp, Homo sapiens
ccttccagtgactaaggaggaa

SEQ ID NO: 7558969 - DNA, 22 bp, Homo sapiens
ccttccagtatgttaagatggt

SEQ ID NO: 7558970 - DNA, 22 bp, Homo sapiens
ccttccagtatgttaagatggt

SEQ ID NO: 7558971 - DNA, 16 bp, Homo sapiens
ccttccagtccagcag

SEQ ID NO: 7558972 - DNA, 22 bp, Homo sapiens
ccttctccctctgagaggaacc

SEQ ID NO: 7558973 - DNA, 22 bp, Homo sapiens
ccttctccctctgagaggaacc

SEQ ID NO: 7558974 - DNA, 22 bp, Homo sapiens
ccttctccctctgagaggaacc

SEQ ID NO: 7558975 - DNA, 22 bp, Homo sapiens
ccttctcctgccttgggttcat

SEQ ID NO: 7558976 - DNA, 22 bp, Homo sapiens
ccttctcctgccttgggttcat

SEQ ID NO: 7558977 - DNA, 22 bp, Homo sapiens
ccttctcctgccttgggttcat

SEQ ID NO: 7558978 - DNA, 22 bp, Homo sapiens
ccttctcctgccttgggttcat

SEQ ID NO: 7558979 - DNA, 22 bp, Homo sapiens
ccttctcctgccttgggttcat

SEQ ID NO: 7558980 - DNA, 22 bp, Homo sapiens
ccttctctaccatgtgaggaaa

SEQ ID NO: 7558981 - DNA, 22 bp, Homo sapiens
ccttctcctgccttgggttcat

SEQ ID NO: 7558982 - DNA, 22 bp, Homo sapiens
ccttctctactcctgatgcatg

SEQ ID NO: 7558983 - DNA, 22 bp, Homo sapiens
ccttctctactcctgatgcatg

SEQ ID NO: 7558984 - DNA, 22 bp, Homo sapiens
ccttctctactcctgatgcatg

SEQ ID NO: 7558985 - DNA, 22 bp, Homo sapiens
ccttctctactcctgatgcatg

SEQ ID NO: 7558986 - DNA, 22 bp, Homo sapiens
agtaaaaattgaggtgcaaaat

SEQ ID NO: 7558987 - DNA, 22 bp, Homo sapiens
agtaaacagtaggaactgagaa

SEQ ID NO: 7558988 - DNA, 22 bp, Homo sapiens
agtaaacagtaggaactgagaa

SEQ ID NO: 7558989 - DNA, 22 bp, Homo sapiens
agtaaaaattgaggtgcaaaat

SEQ ID NO: 7558990 - DNA, 22 bp, Homo sapiens
agtaaacagtaggaactgagaa

SEQ ID NO: 7558991 - DNA, 22 bp, Homo sapiens
agtaaacagtatctttagtgtc

SEQ ID NO: 7558992 - DNA, 22 bp, Homo sapiens
agtaaacagtatctttagtgtc

SEQ ID NO: 7558993 - DNA, 22 bp, Homo sapiens
agtaaacagtatctttagtgtc

SEQ ID NO: 7558994 - DNA, 22 bp, Homo sapiens
agtaaacagtttcttagaagaa

SEQ ID NO: 7558995 - DNA, 22 bp, Homo sapiens
agtaaacagtttcttagaagaa

SEQ ID NO: 7558996 - DNA, 22 bp, Homo sapiens
agtaaacagtttcttagaagaa

SEQ ID NO: 7558997 - DNA, 22 bp, Homo sapiens
agtaaaaattgaggtgcaaaat

SEQ ID NO: 7558998 - DNA, 22 bp, Homo sapiens
agtaaaaattgaggtgcaaaat

SEQ ID NO: 7558999 - DNA, 22 bp, Homo sapiens
agtaaaaattgaggtgcaaaat

SEQ ID NO: 7559000 - DNA, 22 bp, Homo sapiens
agtaaaaatatgcttgtggcta

SEQ ID NO: 7559001 - DNA, 22 bp, Homo sapiens
agtaaaaatatgcttgtggcta

SEQ ID NO: 7559002 - DNA, 22 bp, Homo sapiens
ccttctctctgaagaccccaaa

SEQ ID NO: 7559003 - DNA, 22 bp, Homo sapiens
ccttctctctgaagaccccaaa

SEQ ID NO: 7559004 - DNA, 22 bp, Homo sapiens
agtagacatgagcaatgataat

SEQ ID NO: 7559005 - DNA, 22 bp, Homo sapiens
agtagacattttgcaacatctg

SEQ ID NO: 7559006 - DNA, 19 bp, Homo sapiens
agtagacattttcatgttt

SEQ ID NO: 7559007 - DNA, 19 bp, Homo sapiens
agtagacattttcatgttt

SEQ ID NO: 7559008 - DNA, 22 bp, Homo sapiens
agtagacatgagcaatgataat

SEQ ID NO: 7559009 - DNA, 22 bp, Homo sapiens
agtagacatgagcaatgataat

SEQ ID NO: 7559010 - DNA, 22 bp, Homo sapiens
agtagacagacagaacacagcc

SEQ ID NO: 7559011 - DNA, 22 bp, Homo sapiens
agtagacagacagaacacagcc

SEQ ID NO: 7559012 - DNA, 22 bp, Homo sapiens
agtagacaatatggatttaatg

SEQ ID NO: 7559013 - DNA, 22 bp, Homo sapiens
agtagacaatatggatttaatg

SEQ ID NO: 7559014 - DNA, 22 bp, Homo sapiens
agtagaataattggattacagt

SEQ ID NO: 7559015 - DNA, 22 bp, Homo sapiens
agtagaaatgtagtgtagagaa

SEQ ID NO: 7559016 - DNA, 22 bp, Homo sapiens
agtagaatagatggatactatt

SEQ ID NO: 7559017 - DNA, 22 bp, Homo sapiens
agtagaataattggattacagt

SEQ ID NO: 7559018 - DNA, 22 bp, Homo sapiens
agtagaatagatggatactatt

SEQ ID NO: 7559019 - DNA, 20 bp, Homo sapiens
agtagacaactgcaggtgtg

SEQ ID NO: 7559020 - DNA, 22 bp, Homo sapiens
agtagaatcagcctcttgatgg

SEQ ID NO: 7559021 - DNA, 22 bp, Homo sapiens
agtagaatcagcctcttgatgg

SEQ ID NO: 7559022 - DNA, 22 bp, Homo sapiens
agtagaatcagcctcttgatgg

SEQ ID NO: 7559023 - DNA, 22 bp, Homo sapiens
agtagaatcccttgcaatgtcc

SEQ ID NO: 7559024 - DNA, 22 bp, Homo sapiens
agtagaatgttctatgtcaatg

SEQ ID NO: 7559025 - DNA, 20 bp, Homo sapiens
agtagacaactgcaggtgtg

SEQ ID NO: 7559026 - DNA, 22 bp, Homo sapiens
agtagaggccaggcctccctgg

SEQ ID NO: 7559027 - DNA, 22 bp, Homo sapiens
agtagacattttgcaacatctg

SEQ ID NO: 7559028 - DNA, 22 bp, Homo sapiens
agtagatagattctaagcacta

SEQ ID NO: 7559029 - DNA, 22 bp, Homo sapiens
agtagatagattctaagcacta

SEQ ID NO: 7559030 - DNA, 22 bp, Homo sapiens
agtagattccagtgatagttaa

SEQ ID NO: 7559031 - DNA, 22 bp, Homo sapiens
agtagattccagtgatagttaa

SEQ ID NO: 7559032 - DNA, 22 bp, Homo sapiens
agtagattttagattacatagt

SEQ ID NO: 7559033 - DNA, 22 bp, Homo sapiens
agtagattttagattacatagt

SEQ ID NO: 7559034 - DNA, 19 bp, Homo sapiens
agtagcagaaagtgcagtg

SEQ ID NO: 7559035 - DNA, 19 bp, Homo sapiens
agtagcagaaagtgcagtg

SEQ ID NO: 7559036 - DNA, 19 bp, Homo sapiens
agtagcagaaagtgcagtg

SEQ ID NO: 7559037 - DNA, 19 bp, Homo sapiens
agtagcagaaagtgcagtg

SEQ ID NO: 7559038 - DNA, 19 bp, Homo sapiens
agtagcagaaagtgcagtg

SEQ ID NO: 7559039 - DNA, 22 bp, Homo sapiens
agtagcacaattttgtccctaa

SEQ ID NO: 7559040 - DNA, 23 bp, Homo sapiens
agtagcacatacagtacttgttc

SEQ ID NO: 7559041 - DNA, 22 bp, Homo sapiens
agtagcaatgtttgagaagcac

SEQ ID NO: 7559042 - DNA, 22 bp, Homo sapiens
agtagatttttgaatgtaagtt

SEQ ID NO: 7559043 - DNA, 22 bp, Homo sapiens
agtaacaaagtgggagaatgat

SEQ ID NO: 7559044 - DNA, 22 bp, Homo sapiens
agtaacaaagtgggagaatgat

SEQ ID NO: 7559045 - DNA, 22 bp, Homo sapiens
agtaacaaatagctgcctttaa

SEQ ID NO: 7559046 - DNA, 22 bp, Homo sapiens
agtaacaaatagctgcctttaa

SEQ ID NO: 7559047 - DNA, 22 bp, Homo sapiens
agtaacaaatagctgcctttaa

SEQ ID NO: 7559048 - DNA, 22 bp, Homo sapiens
agtaacaaatattcattggatt

SEQ ID NO: 7559049 - DNA, 22 bp, Homo sapiens
agtaacaaatagctgcctttaa

SEQ ID NO: 7559050 - DNA, 22 bp, Homo sapiens
agtaacaaatattcattggatt

SEQ ID NO: 7559051 - DNA, 22 bp, Homo sapiens
agtaacaaatgcatctgggcat

SEQ ID NO: 7559052 - DNA, 22 bp, Homo sapiens
agtaacactattttcatatgta

SEQ ID NO: 7559053 - DNA, 22 bp, Homo sapiens
agtaacaaagtgggagaatgat

SEQ ID NO: 7559054 - DNA, 22 bp, Homo sapiens
agtaacactattttcatatgta

SEQ ID NO: 7559055 - DNA, 22 bp, Homo sapiens
agtaacacaagaggtccttgcg

SEQ ID NO: 7559056 - DNA, 22 bp, Homo sapiens
agtaacacttggaatgatagca

SEQ ID NO: 7559057 - DNA, 22 bp, Homo sapiens
agtaacactattttcatatgta

SEQ ID NO: 7559058 - DNA, 22 bp, Homo sapiens
agtaacacttggaatgatagca

SEQ ID NO: 7559059 - DNA, 22 bp, Homo sapiens
agtaacagaaggcctgacttaa

SEQ ID NO: 7559060 - DNA, 22 bp, Homo sapiens
agtaacaagtgccaacgttaga

SEQ ID NO: 7559061 - DNA, 22 bp, Homo sapiens
agtaacaagtgccaacgttaga

SEQ ID NO: 7559062 - DNA, 22 bp, Homo sapiens
agtaacaagtgccaacgttaga

SEQ ID NO: 7559063 - DNA, 22 bp, Homo sapiens
agtaacaagtgccaacgttaga

SEQ ID NO: 7559064 - DNA, 22 bp, Homo sapiens
agtaacaagtgccaacgttaga

SEQ ID NO: 7559065 - DNA, 22 bp, Homo sapiens
agtaacaagtgccaacgttaga

SEQ ID NO: 7559066 - DNA, 22 bp, Homo sapiens
agtacatacttcaaatgtactt

SEQ ID NO: 7559067 - DNA, 22 bp, Homo sapiens
agtacagttataagtggtcttg

SEQ ID NO: 7559068 - DNA, 22 bp, Homo sapiens
agtacatacttcaaatgtactt

SEQ ID NO: 7559069 - DNA, 22 bp, Homo sapiens
agtacatacttcaaatgtactt

SEQ ID NO: 7559070 - DNA, 22 bp, Homo sapiens
agtacatacttcaaatgtactt

SEQ ID NO: 7559071 - DNA, 22 bp, Homo sapiens
agtacatacttcaaatgtactt

SEQ ID NO: 7559072 - DNA, 22 bp, Homo sapiens
agtacagtggtcataatataaa

SEQ ID NO: 7559073 - DNA, 22 bp, Homo sapiens
agtacagtggtcataatataaa

SEQ ID NO: 7559074 - DNA, 22 bp, Homo sapiens
agtaacagcatctccactggaa

SEQ ID NO: 7559075 - DNA, 22 bp, Homo sapiens
agtaacagaaggcctgacttaa

SEQ ID NO: 7559076 - DNA, 22 bp, Homo sapiens
agtaacagagcatgggttcaga

SEQ ID NO: 7559077 - DNA, 22 bp, Homo sapiens
agtagaaatgtaagaaggatta

SEQ ID NO: 7559078 - DNA, 22 bp, Homo sapiens
agtagaaatgtaagaaggatta

SEQ ID NO: 7559079 - DNA, 22 bp, Homo sapiens
agtagaaatgtaagaaggatta

SEQ ID NO: 7559080 - DNA, 22 bp, Homo sapiens
agtagaaagttgcaggaggaat

SEQ ID NO: 7559081 - DNA, 22 bp, Homo sapiens
agtagaaagttgcaggaggaat

SEQ ID NO: 7559082 - DNA, 22 bp, Homo sapiens
agtagaaagttgcaggaggaat

SEQ ID NO: 7559083 - DNA, 22 bp, Homo sapiens
agtagaaatgtagtgtagagaa

SEQ ID NO: 7559084 - DNA, 22 bp, Homo sapiens
agtagaaatgtaagaaggatta

SEQ ID NO: 7559085 - DNA, 22 bp, Homo sapiens
agtagaaatgtaagaaggatta

SEQ ID NO: 7559086 - DNA, 22 bp, Homo sapiens
agtagaaatgtaagaaggatta

SEQ ID NO: 7559087 - DNA, 20 bp, Homo sapiens
agtagcagtgtgacattgac

SEQ ID NO: 7559088 - DNA, 20 bp, Homo sapiens
agtagcagtgtgacattgac

SEQ ID NO: 7559089 - DNA, 20 bp, Homo sapiens
agtagcagtgtgacattgac

SEQ ID NO: 7559090 - DNA, 20 bp, Homo sapiens
agtagcagtgtgacattgac

SEQ ID NO: 7559091 - DNA, 22 bp, Homo sapiens
agtagcagtgacagctgaggta

SEQ ID NO: 7559092 - DNA, 22 bp, Homo sapiens
agtagcagtgacagctgaggta

SEQ ID NO: 7559093 - DNA, 22 bp, Homo sapiens
agtagcagagttggactatgca

SEQ ID NO: 7559094 - DNA, 22 bp, Homo sapiens
agtagcagtgacagctgaggta

SEQ ID NO: 7559095 - DNA, 22 bp, Homo sapiens
agtagcagtgacagctgaggta

SEQ ID NO: 7559096 - DNA, 22 bp, Homo sapiens
agtagcagtgacagctgaggta

SEQ ID NO: 7559097 - DNA, 22 bp, Homo sapiens
agtagcagaaggtcttgaaggg

SEQ ID NO: 7559098 - DNA, 22 bp, Homo sapiens
agtagcagaaggtcttgaaggg

SEQ ID NO: 7559099 - DNA, 22 bp, Homo sapiens
agtagcagaaggtcttgaaggg

SEQ ID NO: 7559100 - DNA, 19 bp, Homo sapiens
agtagcagaaagtgcagtg

SEQ ID NO: 7559101 - DNA, 22 bp, Homo sapiens
agtagcagaaggtcttgaaggg

SEQ ID NO: 7559102 - DNA, 22 bp, Homo sapiens
agtagcagagttggactatgca

SEQ ID NO: 7559103 - DNA, 22 bp, Homo sapiens
agtagcagagttggactatgca

SEQ ID NO: 7559104 - DNA, 20 bp, Homo sapiens
agtagcagtaatatggaaga

SEQ ID NO: 7559105 - DNA, 20 bp, Homo sapiens
agtagcagtaatatggaaga

SEQ ID NO: 7559106 - DNA, 18 bp, Homo sapiens
agtaggcactgtggggtt

SEQ ID NO: 7559107 - DNA, 18 bp, Homo sapiens
agtaggcactgtggggtt

SEQ ID NO: 7559108 - DNA, 22 bp, Homo sapiens
agtaggcagaagtggcattcgg

SEQ ID NO: 7559109 - DNA, 20 bp, Homo sapiens
agtaggcaaaggaaagatct

SEQ ID NO: 7559110 - DNA, 20 bp, Homo sapiens
agtaggcaaaggaaagatct

SEQ ID NO: 7559111 - DNA, 22 bp, Homo sapiens
agtaggaggcgggagcatgaag

SEQ ID NO: 7559112 - DNA, 22 bp, Homo sapiens
agtaggaggcgggagcatgaag

SEQ ID NO: 7559113 - DNA, 22 bp, Homo sapiens
agtaggaggcgggagcatgaag

SEQ ID NO: 7559114 - DNA, 22 bp, Homo sapiens
agtaggaggcgggagcatgaag

SEQ ID NO: 7559115 - DNA, 22 bp, Homo sapiens
agtaggaggcgggagcatgaag

SEQ ID NO: 7559116 - DNA, 22 bp, Homo sapiens
agtaggactaggggttgaggca

SEQ ID NO: 7559117 - DNA, 22 bp, Homo sapiens
agtagccattcttttatttctt

SEQ ID NO: 7559118 - DNA, 22 bp, Homo sapiens
agtagcataaatagtggtagta

SEQ ID NO: 7559119 - DNA, 22 bp, Homo sapiens
agtagcatgtgcacagtaattt

SEQ ID NO: 7559120 - DNA, 22 bp, Homo sapiens
agtagccaattaagtggcaagc

SEQ ID NO: 7559121 - DNA, 22 bp, Homo sapiens
agtaggcagggaataatacaaa

SEQ ID NO: 7559122 - DNA, 22 bp, Homo sapiens
agtaggctgttttatgggccaa

SEQ ID NO: 7559123 - DNA, 22 bp, Homo sapiens
agtaggcatagaaagaagcacc

SEQ ID NO: 7559124 - DNA, 22 bp, Homo sapiens
agtaggcattgtgaaactgcat

SEQ ID NO: 7559125 - DNA, 22 bp, Homo sapiens
agtaggcattgtgaaactgcat

SEQ ID NO: 7559126 - DNA, 22 bp, Homo sapiens
agtaggcatttaataaacatga

SEQ ID NO: 7559127 - DNA, 20 bp, Homo sapiens
agtaggggaatgcaagagca

SEQ ID NO: 7559128 - DNA, 20 bp, Homo sapiens
agtaggggaatgcaagagca

SEQ ID NO: 7559129 - DNA, 20 bp, Homo sapiens
agtaggggaatgcaagagca

SEQ ID NO: 7559130 - DNA, 20 bp, Homo sapiens
agtaggggaatgcaagagca

SEQ ID NO: 7559131 - DNA, 22 bp, Homo sapiens
agtagggagaccggaggccgcc

SEQ ID NO: 7559132 - DNA, 20 bp, Homo sapiens
agtaggggaatgcaagagca

SEQ ID NO: 7559133 - DNA, 22 bp, Homo sapiens
agtagggagaccggaggccgcc

SEQ ID NO: 7559134 - DNA, 22 bp, Homo sapiens
agtagggagaccggaggccgcc

SEQ ID NO: 7559135 - DNA, 22 bp, Homo sapiens
agtagggagaccggaggccgcc

SEQ ID NO: 7559136 - DNA, 22 bp, Homo sapiens
agtaggcatttaataaacatga

SEQ ID NO: 7559137 - DNA, 22 bp, Homo sapiens
agtagggagaccggaggccgcc

SEQ ID NO: 7559138 - DNA, 22 bp, Homo sapiens
agtagggaatacattggggtaa

SEQ ID NO: 7559139 - DNA, 22 bp, Homo sapiens
agtcaaggctattatgtgggaa

SEQ ID NO: 7559140 - DNA, 22 bp, Homo sapiens
agtcaagattctggcactagca

SEQ ID NO: 7559141 - DNA, 23 bp, Homo sapiens
agtcaagatgcatctgtgaggaa

SEQ ID NO: 7559142 - DNA, 22 bp, Homo sapiens
agtcaaggtggaccagaaaaat

SEQ ID NO: 7559143 - DNA, 22 bp, Homo sapiens
agtcaatattcaagtgtaaata

SEQ ID NO: 7559144 - DNA, 22 bp, Homo sapiens
agtcaatattcaagtgtaaata

SEQ ID NO: 7559145 - DNA, 22 bp, Homo sapiens
agtcaataaaagctttagattc

SEQ ID NO: 7559146 - DNA, 22 bp, Homo sapiens
agtcaataaaagctttagattc

SEQ ID NO: 7559147 - DNA, 22 bp, Homo sapiens
agtatttctgaatattatcata

SEQ ID NO: 7559148 - DNA, 22 bp, Homo sapiens
agtatttctgaatattatcata

SEQ ID NO: 7559149 - DNA, 22 bp, Homo sapiens
agtatttctgaatattatcata

SEQ ID NO: 7559150 - DNA, 22 bp, Homo sapiens
agtatttctgctcatgaaagag

SEQ ID NO: 7559151 - DNA, 22 bp, Homo sapiens
agtatttctgctcatgaaagag

SEQ ID NO: 7559152 - DNA, 22 bp, Homo sapiens
agtcaagagacttaaaatattt

SEQ ID NO: 7559153 - DNA, 22 bp, Homo sapiens
agtcacactggttgtttacagt

SEQ ID NO: 7559154 - DNA, 22 bp, Homo sapiens
agtcacagaaacccaggtgtgg

SEQ ID NO: 7559155 - DNA, 22 bp, Homo sapiens
agtcacagaaacccaggtgtgg

SEQ ID NO: 7559156 - DNA, 22 bp, Homo sapiens
agtcacactggttgtttacagt

SEQ ID NO: 7559157 - DNA, 22 bp, Homo sapiens
agtcacaataccgtgtgtcagt

SEQ ID NO: 7559158 - DNA, 22 bp, Homo sapiens
agtcacacactgtcagttctgc

SEQ ID NO: 7559159 - DNA, 22 bp, Homo sapiens
agtcacacactgtcagttctgc

SEQ ID NO: 7559160 - DNA, 22 bp, Homo sapiens
agtcaattatctctaggtcatc

SEQ ID NO: 7559161 - DNA, 22 bp, Homo sapiens
agtcaattatctctaggtcatc

SEQ ID NO: 7559162 - DNA, 22 bp, Homo sapiens
agtcacaataccgtgtgtcagt

SEQ ID NO: 7559163 - DNA, 22 bp, Homo sapiens
agtcaattcttttcaactcaag

SEQ ID NO: 7559164 - DNA, 22 bp, Homo sapiens
agtcacagaaacccaggtgtgg

SEQ ID NO: 7559165 - DNA, 22 bp, Homo sapiens
agtcacagaaacccaggtgtgg

SEQ ID NO: 7559166 - DNA, 22 bp, Homo sapiens
agtcacagaaacccaggtgtgg

SEQ ID NO: 7559167 - DNA, 22 bp, Homo sapiens
agtcacagaaacccaggtgtgg

SEQ ID NO: 7559168 - DNA, 22 bp, Homo sapiens
agtcacagaatgatggctccag

SEQ ID NO: 7559169 - DNA, 22 bp, Homo sapiens
agtcacagaatgatggctccag

SEQ ID NO: 7559170 - DNA, 22 bp, Homo sapiens
agtcacagaatgatggctccag

SEQ ID NO: 7559171 - DNA, 22 bp, Homo sapiens
agtcacagaatgatggctccag

SEQ ID NO: 7559172 - DNA, 19 bp, Homo sapiens
agtcacagaccttgtctcc

SEQ ID NO: 7559173 - DNA, 19 bp, Homo sapiens
agtcacagaccttgtctcc

SEQ ID NO: 7559174 - DNA, 22 bp, Homo sapiens
agtcacaggcaagagggctcca

SEQ ID NO: 7559175 - DNA, 22 bp, Homo sapiens
agtcacaggcaagagggctcca

SEQ ID NO: 7559176 - DNA, 22 bp, Homo sapiens
agtcacaggcaagagggctcca

SEQ ID NO: 7559177 - DNA, 22 bp, Homo sapiens
agtcacaggcaagagggctcca

SEQ ID NO: 7559178 - DNA, 20 bp, Homo sapiens
agtcacaggcctggaacatg

SEQ ID NO: 7559179 - DNA, 22 bp, Homo sapiens
agtcacaggcaagagggctcca

SEQ ID NO: 7559180 - DNA, 20 bp, Homo sapiens
agtcacaggcctggaacatg

SEQ ID NO: 7559181 - DNA, 20 bp, Homo sapiens
agtcacaggcctggaacatg

SEQ ID NO: 7559182 - DNA, 20 bp, Homo sapiens
agtcacaggcctggaacatg

SEQ ID NO: 7559183 - DNA, 22 bp, Homo sapiens
agtcacagggtacacaaggatt

SEQ ID NO: 7559184 - DNA, 22 bp, Homo sapiens
agtcacagggtacacaaggatt

SEQ ID NO: 7559185 - DNA, 22 bp, Homo sapiens
agtcacagggggcccctgcaac

SEQ ID NO: 7559186 - DNA, 22 bp, Homo sapiens
agtcacagggggcccctgcaac

SEQ ID NO: 7559187 - DNA, 19 bp, Homo sapiens
agtcacagggaagaggaac

SEQ ID NO: 7559188 - DNA, 19 bp, Homo sapiens
agtcacagggaagaggaac

SEQ ID NO: 7559189 - DNA, 19 bp, Homo sapiens
agtcacagggaagaggaac

SEQ ID NO: 7559190 - DNA, 22 bp, Homo sapiens
agtcacagggggcccctgcaac

SEQ ID NO: 7559191 - DNA, 22 bp, Homo sapiens
agtcacagggggcccctgcaac

SEQ ID NO: 7559192 - DNA, 22 bp, Homo sapiens
agtcacatgcattttcttcaat

SEQ ID NO: 7559193 - DNA, 22 bp, Homo sapiens
agtcacatgcattttcttcaat

SEQ ID NO: 7559194 - DNA, 20 bp, Homo sapiens
agtcacatgcatacacaagt

SEQ ID NO: 7559195 - DNA, 20 bp, Homo sapiens
agtcacatgcatacacaagt

SEQ ID NO: 7559196 - DNA, 20 bp, Homo sapiens
agtcacatgcatacacaagt

SEQ ID NO: 7559197 - DNA, 22 bp, Homo sapiens
agtcacatgatccctgggcctg

SEQ ID NO: 7559198 - DNA, 20 bp, Homo sapiens
agtcacatgcatacacaagt

SEQ ID NO: 7559199 - DNA, 20 bp, Homo sapiens
agtcacatgcatacacaagt

SEQ ID NO: 7559200 - DNA, 22 bp, Homo sapiens
agtcacatgagtttctctttat

SEQ ID NO: 7559201 - DNA, 22 bp, Homo sapiens
agtcacatgaggaaggggaagg

SEQ ID NO: 7559202 - DNA, 22 bp, Homo sapiens
agtcacatagtgttttggaatc

SEQ ID NO: 7559203 - DNA, 22 bp, Homo sapiens
agtcacatagtgttttggaatc

SEQ ID NO: 7559204 - DNA, 22 bp, Homo sapiens
agtcacatcgattataaaattt

SEQ ID NO: 7559205 - DNA, 22 bp, Homo sapiens
agtcacatcgattataaaattt

SEQ ID NO: 7559206 - DNA, 22 bp, Homo sapiens
agtcacatcgattataaaattt

SEQ ID NO: 7559207 - DNA, 23 bp, Homo sapiens
agtcacatcttagcagccaggtc

SEQ ID NO: 7559208 - DNA, 22 bp, Homo sapiens
agtcacatcgattataaaattt

SEQ ID NO: 7559209 - DNA, 22 bp, Homo sapiens
agtcacatgagcactaattagg

SEQ ID NO: 7559210 - DNA, 22 bp, Homo sapiens
agtcacatcgattataaaattt

SEQ ID NO: 7559211 - DNA, 23 bp, Homo sapiens
agtcacatcttagcagccaggtc

SEQ ID NO: 7559212 - DNA, 22 bp, Homo sapiens
agtcacatgagcactaattagg

SEQ ID NO: 7559213 - DNA, 22 bp, Homo sapiens
agtcacatgagcactaattagg

SEQ ID NO: 7559214 - DNA, 22 bp, Homo sapiens
agtcacagtttccctgagagag

SEQ ID NO: 7559215 - DNA, 22 bp, Homo sapiens
agtcacatagctctggtttctt

SEQ ID NO: 7559216 - DNA, 22 bp, Homo sapiens
agtcacatagaagtgggtttaa

SEQ ID NO: 7559217 - DNA, 22 bp, Homo sapiens
agtcacagtttccctgagagag

SEQ ID NO: 7559218 - DNA, 22 bp, Homo sapiens
agtcacagtttccctgagagag

SEQ ID NO: 7559219 - DNA, 22 bp, Homo sapiens
agtcacagttctgctgtctgag

SEQ ID NO: 7559220 - DNA, 22 bp, Homo sapiens
agtcacagttctgctgtctgag

SEQ ID NO: 7559221 - DNA, 22 bp, Homo sapiens
agtcacagttctgctgtctgag

SEQ ID NO: 7559222 - DNA, 22 bp, Homo sapiens
agtcacagttctgctgtctgag

SEQ ID NO: 7559223 - DNA, 22 bp, Homo sapiens
agtcacagttctgctgtctgag

SEQ ID NO: 7559224 - DNA, 22 bp, Homo sapiens
agtcacagttcctacccagtaa

SEQ ID NO: 7559225 - DNA, 22 bp, Homo sapiens
agtcacagttcctacccagtaa

SEQ ID NO: 7559226 - DNA, 22 bp, Homo sapiens
agtcacagttcctacccagtaa

SEQ ID NO: 7559227 - DNA, 22 bp, Homo sapiens
agtcacagttagactacccaag

SEQ ID NO: 7559228 - DNA, 22 bp, Homo sapiens
agtcacagttcctacccagtaa

SEQ ID NO: 7559229 - DNA, 20 bp, Homo sapiens
agtcacagtatcagtcttag

SEQ ID NO: 7559230 - DNA, 20 bp, Homo sapiens
agtcacagtatcagtcttag

SEQ ID NO: 7559231 - DNA, 22 bp, Homo sapiens
agtcacaggttcttgggattag

SEQ ID NO: 7559232 - DNA, 22 bp, Homo sapiens
agtcacaggttcttgggattag

SEQ ID NO: 7559233 - DNA, 22 bp, Homo sapiens
ctagcctgggatttgaacttat

SEQ ID NO: 7559234 - DNA, 22 bp, Homo sapiens
ctagcctgggatttgaacttat

SEQ ID NO: 7559235 - DNA, 22 bp, Homo sapiens
ctagagaaaatgatagcaggaa

SEQ ID NO: 7559236 - DNA, 22 bp, Homo sapiens
ctagagaaaatgatagcaggaa

SEQ ID NO: 7559237 - DNA, 22 bp, Homo sapiens
ctagagaaaatgatagcaggaa

SEQ ID NO: 7559238 - DNA, 22 bp, Homo sapiens
ctagagaaaatgatagcaggaa

SEQ ID NO: 7559239 - DNA, 22 bp, Homo sapiens
ctagagaaaaagcttaggtacg

SEQ ID NO: 7559240 - DNA, 22 bp, Homo sapiens
ctagagaaaaagcttaggtacg

SEQ ID NO: 7559241 - DNA, 22 bp, Homo sapiens
ctagagaaaaagcttaggtacg

SEQ ID NO: 7559242 - DNA, 22 bp, Homo sapiens
ctagagaaaactgtgtatcttg

SEQ ID NO: 7559243 - DNA, 22 bp, Homo sapiens
ctagagaaaactgtgtatcttg

SEQ ID NO: 7559244 - DNA, 22 bp, Homo sapiens
ctagagaaaactgtgtatcttg

SEQ ID NO: 7559245 - DNA, 22 bp, Homo sapiens
ctagctttttatgacaatcttg

SEQ ID NO: 7559246 - DNA, 22 bp, Homo sapiens
ctagctttttatgacaatcttg

SEQ ID NO: 7559247 - DNA, 22 bp, Homo sapiens
ctagctttttatgacaatcttg

SEQ ID NO: 7559248 - DNA, 22 bp, Homo sapiens
ctagctttgtccattgtcttgc

SEQ ID NO: 7559249 - DNA, 22 bp, Homo sapiens
ctagctttgtccattgtcttgc

SEQ ID NO: 7559250 - DNA, 22 bp, Homo sapiens
ctagctccatataaagcaggat

SEQ ID NO: 7559251 - DNA, 22 bp, Homo sapiens
ctagctgtaagagggatgtggc

SEQ ID NO: 7559252 - DNA, 22 bp, Homo sapiens
ctagctgtgtaaaccgagctgc

SEQ ID NO: 7559253 - DNA, 22 bp, Homo sapiens
ctagcttagggaaactgacaga

SEQ ID NO: 7559254 - DNA, 22 bp, Homo sapiens
agtcacattctggggtactggg

SEQ ID NO: 7559255 - DNA, 22 bp, Homo sapiens
agtcacattctggggtactggg

SEQ ID NO: 7559256 - DNA, 22 bp, Homo sapiens
agtcacatggactcaggatgac

SEQ ID NO: 7559257 - DNA, 22 bp, Homo sapiens
agtcacatgggattagaaccca

SEQ ID NO: 7559258 - DNA, 22 bp, Homo sapiens
agtcacatgggattagaaccca

SEQ ID NO: 7559259 - DNA, 22 bp, Homo sapiens
agtcacatgggattagaaccca

SEQ ID NO: 7559260 - DNA, 22 bp, Homo sapiens
agtcacatggcagagagaagtt

SEQ ID NO: 7559261 - DNA, 22 bp, Homo sapiens
agtcacatggactcaggatgac

SEQ ID NO: 7559262 - DNA, 22 bp, Homo sapiens
agtcacatggactcaggatgac

SEQ ID NO: 7559263 - DNA, 22 bp, Homo sapiens
agtcacatggactcaggatgac

SEQ ID NO: 7559264 - DNA, 22 bp, Homo sapiens
agtcacatttgggggtgtcaaa

SEQ ID NO: 7559265 - DNA, 21 bp, Homo sapiens
agtcacattgggggtttaggg

SEQ ID NO: 7559266 - DNA, 20 bp, Homo sapiens
agtcacattgagcttttgga

SEQ ID NO: 7559267 - DNA, 22 bp, Homo sapiens
ctagacagaggcaagcgcatta

SEQ ID NO: 7559268 - DNA, 22 bp, Homo sapiens
ctagacacagtttttgctccca

SEQ ID NO: 7559269 - DNA, 23 bp, Homo sapiens
ctagaattttgctaaaagactag

SEQ ID NO: 7559270 - DNA, 22 bp, Homo sapiens
agtcacatttgggggtgtcaaa

SEQ ID NO: 7559271 - DNA, 23 bp, Homo sapiens
ctagaattttgctaaaagactag

SEQ ID NO: 7559272 - DNA, 22 bp, Homo sapiens
ctaggaaagacacagagagttt

SEQ ID NO: 7559273 - DNA, 22 bp, Homo sapiens
ctaggaaagacacagagagttt

SEQ ID NO: 7559274 - DNA, 19 bp, Homo sapiens
ctagcttgtcatttgtgtg

SEQ ID NO: 7559275 - DNA, 22 bp, Homo sapiens
ctaggaaagacacagagagttt

SEQ ID NO: 7559276 - DNA, 22 bp, Homo sapiens
ctaggaaagacacagagagttt

SEQ ID NO: 7559277 - DNA, 22 bp, Homo sapiens
ctaggaaatactgtttcaaggc

SEQ ID NO: 7559278 - DNA, 22 bp, Homo sapiens
ctaggaaagtgattcttcaatt

SEQ ID NO: 7559279 - DNA, 22 bp, Homo sapiens
ctaggaaagacacagagagttt

SEQ ID NO: 7559280 - DNA, 22 bp, Homo sapiens
ctaggaaagacacagagagttt

SEQ ID NO: 7559281 - DNA, 22 bp, Homo sapiens
ctaggaaagacacagagagttt

SEQ ID NO: 7559282 - DNA, 22 bp, Homo sapiens
ctaggaaatttaaaatatgatt

SEQ ID NO: 7559283 - DNA, 22 bp, Homo sapiens
ctaggaaatttaaaatatgatt

SEQ ID NO: 7559284 - DNA, 22 bp, Homo sapiens
ctaggaaatgaatacagtacac

SEQ ID NO: 7559285 - DNA, 22 bp, Homo sapiens
ctaggaaagtgattcttcaatt

SEQ ID NO: 7559286 - DNA, 22 bp, Homo sapiens
ctaggaaatgaatacagtacac

SEQ ID NO: 7559287 - DNA, 22 bp, Homo sapiens
ctaggaaatgaatacagtacac

SEQ ID NO: 7559288 - DNA, 22 bp, Homo sapiens
ctaggaaatactgtttcaaggc

SEQ ID NO: 7559289 - DNA, 22 bp, Homo sapiens
ctaggaaatactgtttcaaggc

SEQ ID NO: 7559290 - DNA, 22 bp, Homo sapiens
ctaggaaatgaatacagtacac

SEQ ID NO: 7559291 - DNA, 22 bp, Homo sapiens
ctaggaatagcaaagtaggaca

SEQ ID NO: 7559292 - DNA, 20 bp, Homo sapiens
ctaggaactatggtctggct

SEQ ID NO: 7559293 - DNA, 22 bp, Homo sapiens
ctaggaacagttcaacagttta

SEQ ID NO: 7559294 - DNA, 22 bp, Homo sapiens
ctaggaggcgggggctgcagta

SEQ ID NO: 7559295 - DNA, 22 bp, Homo sapiens
ctaggaggcgggggctgcagta

SEQ ID NO: 7559296 - DNA, 22 bp, Homo sapiens
ctaggaggcgggggctgcagta

SEQ ID NO: 7559297 - DNA, 22 bp, Homo sapiens
ctaggaatcaccaagattctag

SEQ ID NO: 7559298 - DNA, 22 bp, Homo sapiens
ctaggaccactgtaacaaagta

SEQ ID NO: 7559299 - DNA, 22 bp, Homo sapiens
ctaggcacctgggccctgtggc

SEQ ID NO: 7559300 - DNA, 18 bp, Homo sapiens
ctaggcaccaggcacccc

SEQ ID NO: 7559301 - DNA, 18 bp, Homo sapiens
ctaggcaccaggcacccc

SEQ ID NO: 7559302 - DNA, 22 bp, Homo sapiens
ctaggcaagtaaggagttgcgg

SEQ ID NO: 7559303 - DNA, 22 bp, Homo sapiens
ctaggcaagtaaggagttgcgg

SEQ ID NO: 7559304 - DNA, 22 bp, Homo sapiens
ctaggcacactgggccctttac

SEQ ID NO: 7559305 - DNA, 22 bp, Homo sapiens
ctaggaggcgggggctgcagta

SEQ ID NO: 7559306 - DNA, 22 bp, Homo sapiens
ctaggcaaagtattaatgagtg

SEQ ID NO: 7559307 - DNA, 22 bp, Homo sapiens
ctaggcagactgagctctaggg

SEQ ID NO: 7559308 - DNA, 22 bp, Homo sapiens
ctaggcagactgagctctaggg

SEQ ID NO: 7559309 - DNA, 22 bp, Homo sapiens
ctaggcagactgagctctaggg

SEQ ID NO: 7559310 - DNA, 22 bp, Homo sapiens
ctaggcacttgtaaggccgctc

SEQ ID NO: 7559311 - DNA, 22 bp, Homo sapiens
ctaggcactcacgtggctttag

SEQ ID NO: 7559312 - DNA, 22 bp, Homo sapiens
ctattgggtatttattgagcac

SEQ ID NO: 7559313 - DNA, 17 bp, Homo sapiens
ctattgggccatttctt

SEQ ID NO: 7559314 - DNA, 22 bp, Homo sapiens
ctattgggccaaagaagatgcc

SEQ ID NO: 7559315 - DNA, 22 bp, Homo sapiens
ctattgggtcagaaatgagaaa

SEQ ID NO: 7559316 - DNA, 22 bp, Homo sapiens
ctattgggtcagccttctggct

SEQ ID NO: 7559317 - DNA, 22 bp, Homo sapiens
ctatttacgctgctggggatca

SEQ ID NO: 7559318 - DNA, 22 bp, Homo sapiens
ctatttacgctgctggggatca

SEQ ID NO: 7559319 - DNA, 22 bp, Homo sapiens
ctatttaagaataaaaggggca

SEQ ID NO: 7559320 - DNA, 22 bp, Homo sapiens
ctatttatctatttctgaatga

SEQ ID NO: 7559321 - DNA, 22 bp, Homo sapiens
ctatttatctatttctgaatga

SEQ ID NO: 7559322 - DNA, 22 bp, Homo sapiens
ctatttatctatttctgaatga

SEQ ID NO: 7559323 - DNA, 22 bp, Homo sapiens
ctatttatctatttctgaatga

SEQ ID NO: 7559324 - DNA, 22 bp, Homo sapiens
ctatttatctatttctgaatga

SEQ ID NO: 7559325 - DNA, 22 bp, Homo sapiens
agtcctgggtctggagaatgga

SEQ ID NO: 7559326 - DNA, 22 bp, Homo sapiens
agtcctgggtctggagaatgga

SEQ ID NO: 7559327 - DNA, 22 bp, Homo sapiens
agtcctgggtccagcaggtcct

SEQ ID NO: 7559328 - DNA, 22 bp, Homo sapiens
ctatttatctatttctgaatga

SEQ ID NO: 7559329 - DNA, 22 bp, Homo sapiens
agtcctgggtccagcaggtcct

SEQ ID NO: 7559330 - DNA, 22 bp, Homo sapiens
ctattgggatcctgacaaatct

SEQ ID NO: 7559331 - DNA, 21 bp, Homo sapiens
ctattggaaaagaaaatattt

SEQ ID NO: 7559332 - DNA, 22 bp, Homo sapiens
ctattgcttttgtgtgctccca

SEQ ID NO: 7559333 - DNA, 22 bp, Homo sapiens
ctattgcttttgtgtgctccca

SEQ ID NO: 7559334 - DNA, 21 bp, Homo sapiens
ctattggaaaagaaaatattt

SEQ ID NO: 7559335 - DNA, 22 bp, Homo sapiens
ctattgcccaaatctcaaccgc

SEQ ID NO: 7559336 - DNA, 22 bp, Homo sapiens
ctattgctatcattctggtggt

SEQ ID NO: 7559337 - DNA, 22 bp, Homo sapiens
ctattgctatcattctggtggt

SEQ ID NO: 7559338 - DNA, 22 bp, Homo sapiens
ctattgcatttgcatcttcatc

SEQ ID NO: 7559339 - DNA, 22 bp, Homo sapiens
ctattgcccaaatctcaaccgc

SEQ ID NO: 7559340 - DNA, 22 bp, Homo sapiens
ctattgcatttgcatcttcatc

SEQ ID NO: 7559341 - DNA, 19 bp, Homo sapiens
ctattgcacatagctgaag

SEQ ID NO: 7559342 - DNA, 22 bp, Homo sapiens
ctattgcatcctccacctcgat

SEQ ID NO: 7559343 - DNA, 19 bp, Homo sapiens
ctattgcacatagctgaag

SEQ ID NO: 7559344 - DNA, 22 bp, Homo sapiens
ctattgaattaactattaaagt

SEQ ID NO: 7559345 - DNA, 22 bp, Homo sapiens
ctattgaattaactattaaagt

SEQ ID NO: 7559346 - DNA, 22 bp, Homo sapiens
ctattgaattaactattaaagt

SEQ ID NO: 7559347 - DNA, 22 bp, Homo sapiens
ctattgaattaactattaaagt

SEQ ID NO: 7559348 - DNA, 22 bp, Homo sapiens
ctattgaaagtgtacaattcaa

SEQ ID NO: 7559349 - DNA, 22 bp, Homo sapiens
ctattgaaagtgtacaattcaa

SEQ ID NO: 7559350 - DNA, 22 bp, Homo sapiens
ctattgaaagtgtacaattcaa

SEQ ID NO: 7559351 - DNA, 22 bp, Homo sapiens
ctattgaatagcccaaatcatt

SEQ ID NO: 7559352 - DNA, 22 bp, Homo sapiens
ctattgaatagcccaaatcatt

SEQ ID NO: 7559353 - DNA, 22 bp, Homo sapiens
ctatcttttgttcattttgagt

SEQ ID NO: 7559354 - DNA, 22 bp, Homo sapiens
ctatctttcgattctagcttaa

SEQ ID NO: 7559355 - DNA, 22 bp, Homo sapiens
ctatctttcgattctagcttaa

SEQ ID NO: 7559356 - DNA, 22 bp, Homo sapiens
ctatctgtaaatttgaggttct

SEQ ID NO: 7559357 - DNA, 22 bp, Homo sapiens
ctatctcttgttttcctgaagc

SEQ ID NO: 7559358 - DNA, 22 bp, Homo sapiens
ctatcttggtccagtctacacc

SEQ ID NO: 7559359 - DNA, 22 bp, Homo sapiens
ctatctgtaaatttgaggttct

SEQ ID NO: 7559360 - DNA, 18 bp, Homo sapiens
ctatccctggagcttggg

SEQ ID NO: 7559361 - DNA, 22 bp, Homo sapiens
ctatccattaaagccttggaaa

SEQ ID NO: 7559362 - DNA, 22 bp, Homo sapiens
ctatcccatccttctagctgac

SEQ ID NO: 7559363 - DNA, 22 bp, Homo sapiens
ctatcccatccttctagctgac

SEQ ID NO: 7559364 - DNA, 19 bp, Homo sapiens
ctatctcaaatcttttccc

SEQ ID NO: 7559365 - DNA, 20 bp, Homo sapiens
ctatctcctggcgtgccttc

SEQ ID NO: 7559366 - DNA, 22 bp, Homo sapiens
ctatgaccccagcatgaataag

SEQ ID NO: 7559367 - DNA, 22 bp, Homo sapiens
ctatgaccccagcatgaataag

SEQ ID NO: 7559368 - DNA, 22 bp, Homo sapiens
ctatgagaagaaaacaagatta

SEQ ID NO: 7559369 - DNA, 22 bp, Homo sapiens
ctatgaaaggatttggagttgt

SEQ ID NO: 7559370 - DNA, 22 bp, Homo sapiens
ctatgaaaggatttggagttgt

SEQ ID NO: 7559371 - DNA, 22 bp, Homo sapiens
ctatgaaatgtcagattctgca

SEQ ID NO: 7559372 - DNA, 22 bp, Homo sapiens
ctatgaaatgtcagattctgca

SEQ ID NO: 7559373 - DNA, 22 bp, Homo sapiens
ctatgacacaggccattatata

SEQ ID NO: 7559374 - DNA, 22 bp, Homo sapiens
ctatgacacaggccattatata

SEQ ID NO: 7559375 - DNA, 22 bp, Homo sapiens
ctatgaatgtatataggcagat

SEQ ID NO: 7559376 - DNA, 22 bp, Homo sapiens
ctattctgcttgaaattattct

SEQ ID NO: 7559377 - DNA, 22 bp, Homo sapiens
ctattctgcttgaaattattct

SEQ ID NO: 7559378 - DNA, 22 bp, Homo sapiens
ctattctgattaccagatattg

SEQ ID NO: 7559379 - DNA, 22 bp, Homo sapiens
ctattctagtctgtcatgtcca

SEQ ID NO: 7559380 - DNA, 22 bp, Homo sapiens
ctattctagattacagtataaa

SEQ ID NO: 7559381 - DNA, 22 bp, Homo sapiens
ctattctagtctgtcatgtcca

SEQ ID NO: 7559382 - DNA, 22 bp, Homo sapiens
ctattctagattacagtataaa

SEQ ID NO: 7559383 - DNA, 22 bp, Homo sapiens
ctattctagattacagtataaa

SEQ ID NO: 7559384 - DNA, 19 bp, Homo sapiens
agtcagctagttcctatac

SEQ ID NO: 7559385 - DNA, 22 bp, Homo sapiens
agtcagctgcagcagctttggt

SEQ ID NO: 7559386 - DNA, 22 bp, Homo sapiens
agtcagctacaagttcattcac

SEQ ID NO: 7559387 - DNA, 22 bp, Homo sapiens
agtcagcagcctggccaggaga

SEQ ID NO: 7559388 - DNA, 22 bp, Homo sapiens
agtcagctggatactcttgtag

SEQ ID NO: 7559389 - DNA, 22 bp, Homo sapiens
agtcagcattttcactgagcta

SEQ ID NO: 7559390 - DNA, 19 bp, Homo sapiens
agtcagcatgcatgtgact

SEQ ID NO: 7559391 - DNA, 22 bp, Homo sapiens
agtcagcatctgcactgtgctg

SEQ ID NO: 7559392 - DNA, 22 bp, Homo sapiens
agtcagcatctgcactgtgctg

SEQ ID NO: 7559393 - DNA, 22 bp, Homo sapiens
agtcagcagtgaaagcacagcc

SEQ ID NO: 7559394 - DNA, 22 bp, Homo sapiens
agtcagcagtgaaagcacagcc

SEQ ID NO: 7559395 - DNA, 22 bp, Homo sapiens
agtcagcagtgaaagcacagcc

SEQ ID NO: 7559396 - DNA, 22 bp, Homo sapiens
agtcagcagtgaaagcacagcc

SEQ ID NO: 7559397 - DNA, 22 bp, Homo sapiens
agtcagcagcctggccaggaga

SEQ ID NO: 7559398 - DNA, 22 bp, Homo sapiens
agtcagcagcctggccaggaga

SEQ ID NO: 7559399 - DNA, 22 bp, Homo sapiens
agtcagcagcctggccaggaga

SEQ ID NO: 7559400 - DNA, 22 bp, Homo sapiens
agtcaggaagctggagctgggg

SEQ ID NO: 7559401 - DNA, 22 bp, Homo sapiens
agtcaggaagctggagctgggg

SEQ ID NO: 7559402 - DNA, 22 bp, Homo sapiens
agtcaggaagctggagctgggg

SEQ ID NO: 7559403 - DNA, 22 bp, Homo sapiens
agtcaggaagctggagctgggg

SEQ ID NO: 7559404 - DNA, 22 bp, Homo sapiens
agtcaggacacagcatgaacat

SEQ ID NO: 7559405 - DNA, 22 bp, Homo sapiens
agtcaggaaaagctttcctgga

SEQ ID NO: 7559406 - DNA, 22 bp, Homo sapiens
agtcagcttgtctctagggttg

SEQ ID NO: 7559407 - DNA, 22 bp, Homo sapiens
agtcaggaacctcagcaagtct

SEQ ID NO: 7559408 - DNA, 22 bp, Homo sapiens
agtcagcttggctcctcccatg

SEQ ID NO: 7559409 - DNA, 22 bp, Homo sapiens
agtcagcttggctcctcccatg

SEQ ID NO: 7559410 - DNA, 22 bp, Homo sapiens
agtcaggagctgctgcattgta

SEQ ID NO: 7559411 - DNA, 22 bp, Homo sapiens
agtcaggagctgctgcattgta

SEQ ID NO: 7559412 - DNA, 22 bp, Homo sapiens
agtcaggagatattttgatatg

SEQ ID NO: 7559413 - DNA, 22 bp, Homo sapiens
agtcaggagctgctgcattgta

SEQ ID NO: 7559414 - DNA, 22 bp, Homo sapiens
agtcaggatatgccttgtgggc

SEQ ID NO: 7559415 - DNA, 22 bp, Homo sapiens
agtcaggagctgctgcattgta

SEQ ID NO: 7559416 - DNA, 22 bp, Homo sapiens
agtcaggagatattttgatatg

SEQ ID NO: 7559417 - DNA, 22 bp, Homo sapiens
agtcaggacacagcatgaacat

SEQ ID NO: 7559418 - DNA, 22 bp, Homo sapiens
agtcaggacacagcatgaacat

SEQ ID NO: 7559419 - DNA, 22 bp, Homo sapiens
agtcaggacacagcatgaacat

SEQ ID NO: 7559420 - DNA, 20 bp, Homo sapiens
ctagtctttgctatctgcta

SEQ ID NO: 7559421 - DNA, 22 bp, Homo sapiens
ctagtctgtgtgggaccagggc

SEQ ID NO: 7559422 - DNA, 22 bp, Homo sapiens
ctagtgaaatttgcaagtaatt

SEQ ID NO: 7559423 - DNA, 22 bp, Homo sapiens
agtcaggatatgccttgtgggc

SEQ ID NO: 7559424 - DNA, 22 bp, Homo sapiens
agtcaggatttaaactcagaca

SEQ ID NO: 7559425 - DNA, 22 bp, Homo sapiens
agtcaggatatgccttgtgggc

SEQ ID NO: 7559426 - DNA, 22 bp, Homo sapiens
agtcaggatttaaactcagaca

SEQ ID NO: 7559427 - DNA, 22 bp, Homo sapiens
ctatatctacatttgctgtttg

SEQ ID NO: 7559428 - DNA, 22 bp, Homo sapiens
ctagtgaaatttgcaagtaatt

SEQ ID NO: 7559429 - DNA, 22 bp, Homo sapiens
ctatatcataaatctgaagagg

SEQ ID NO: 7559430 - DNA, 22 bp, Homo sapiens
ctatattctggaatgtccattt

SEQ ID NO: 7559431 - DNA, 22 bp, Homo sapiens
ctatattctggaatgtccattt

SEQ ID NO: 7559432 - DNA, 22 bp, Homo sapiens
ctatattggtaatatttgctca

SEQ ID NO: 7559433 - DNA, 22 bp, Homo sapiens
ctatattggtaatatttgctca

SEQ ID NO: 7559434 - DNA, 22 bp, Homo sapiens
ctatattggtggccatttggaa

SEQ ID NO: 7559435 - DNA, 22 bp, Homo sapiens
ctatcacagagggttgttttga

SEQ ID NO: 7559436 - DNA, 22 bp, Homo sapiens
ctatcaagaggtagcagtgact

SEQ ID NO: 7559437 - DNA, 22 bp, Homo sapiens
ctatccatatcctgggcatggc

SEQ ID NO: 7559438 - DNA, 22 bp, Homo sapiens
ctatcactctctatttgttctt

SEQ ID NO: 7559439 - DNA, 22 bp, Homo sapiens
ctatcattttacatggttggtg

SEQ ID NO: 7559440 - DNA, 22 bp, Homo sapiens
ctatcaaacagccattaatata

SEQ ID NO: 7559441 - DNA, 22 bp, Homo sapiens
ctatatttggtgagggatgtct

SEQ ID NO: 7559442 - DNA, 22 bp, Homo sapiens
ctatcaaacagccattaatata

SEQ ID NO: 7559443 - DNA, 22 bp, Homo sapiens
ctatcaaacagccattaatata

SEQ ID NO: 7559444 - DNA, 22 bp, Homo sapiens
ctatatttggtgagggatgtct

SEQ ID NO: 7559445 - DNA, 22 bp, Homo sapiens
ctatatttcttggctttaaaca

SEQ ID NO: 7559446 - DNA, 22 bp, Homo sapiens
ctatatttcttggctttaaaca

SEQ ID NO: 7559447 - DNA, 22 bp, Homo sapiens
ctatatttcttggctttaaaca

SEQ ID NO: 7559448 - DNA, 22 bp, Homo sapiens
ctatatttcttggctttaaaca

SEQ ID NO: 7559449 - DNA, 22 bp, Homo sapiens
catgtgtgagtgagcagtcttc

SEQ ID NO: 7559450 - DNA, 22 bp, Homo sapiens
catgtgtgagtgagcagtcttc

SEQ ID NO: 7559451 - DNA, 22 bp, Homo sapiens
catgtgtgagtatatcttatcc

SEQ ID NO: 7559452 - DNA, 22 bp, Homo sapiens
catgtgtgggacccttaggttg

SEQ ID NO: 7559453 - DNA, 22 bp, Homo sapiens
catgtgtgcaccaaccctatgt

SEQ ID NO: 7559454 - DNA, 22 bp, Homo sapiens
catgtgtggagggcatgcatgg

SEQ ID NO: 7559455 - DNA, 22 bp, Homo sapiens
catgtgtggagggcatgcatgg

SEQ ID NO: 7559456 - DNA, 22 bp, Homo sapiens
catgtgtgacaaactgcctgca

SEQ ID NO: 7559457 - DNA, 22 bp, Homo sapiens
catgtgtgagtatatcttatcc

SEQ ID NO: 7559458 - DNA, 23 bp, Homo sapiens
catgtgtgacagtatcactgttt

SEQ ID NO: 7559459 - DNA, 22 bp, Homo sapiens
catgtgtgacaaactgcctgca

SEQ ID NO: 7559460 - DNA, 22 bp, Homo sapiens
catgtgtgacaaactgcctgca

SEQ ID NO: 7559461 - DNA, 23 bp, Homo sapiens
catgtgtgacagtatcactgttt

SEQ ID NO: 7559462 - DNA, 22 bp, Homo sapiens
aggcacagggatgcggagccag

SEQ ID NO: 7559463 - DNA, 22 bp, Homo sapiens
aggcacagggatgcggagccag

SEQ ID NO: 7559464 - DNA, 22 bp, Homo sapiens
aggcacagggatgcggagccag

SEQ ID NO: 7559465 - DNA, 22 bp, Homo sapiens
aggcacagggatgcggagccag

SEQ ID NO: 7559466 - DNA, 22 bp, Homo sapiens
catgtgtgggacccttaggttg

SEQ ID NO: 7559467 - DNA, 22 bp, Homo sapiens
catgtgtggtctgtggctatct

SEQ ID NO: 7559468 - DNA, 22 bp, Homo sapiens
aggcacaggtggacttcacagt

SEQ ID NO: 7559469 - DNA, 22 bp, Homo sapiens
aggcacaggtggacttcacagt

SEQ ID NO: 7559470 - DNA, 22 bp, Homo sapiens
aggcacagggatgcggagccag

SEQ ID NO: 7559471 - DNA, 22 bp, Homo sapiens
aggcacagggatgcggagccag

SEQ ID NO: 7559472 - DNA, 22 bp, Homo sapiens
aggcacagggatgcggagccag

SEQ ID NO: 7559473 - DNA, 22 bp, Homo sapiens
aggcacaggtggacttcacagt

SEQ ID NO: 7559474 - DNA, 22 bp, Homo sapiens
aggcacaggtggacttcacagt

SEQ ID NO: 7559475 - DNA, 22 bp, Homo sapiens
aggcacaggtggacttcacagt

SEQ ID NO: 7559476 - DNA, 22 bp, Homo sapiens
aggcacaggtggacttcacagt

SEQ ID NO: 7559477 - DNA, 22 bp, Homo sapiens
catgtgtgaagactgcgggcca

SEQ ID NO: 7559478 - DNA, 22 bp, Homo sapiens
catgtgtctttatggagccaca

SEQ ID NO: 7559479 - DNA, 22 bp, Homo sapiens
catgtgtgaatcttgtgatcat

SEQ ID NO: 7559480 - DNA, 22 bp, Homo sapiens
catgtgtgaatcttgtgatcat

SEQ ID NO: 7559481 - DNA, 22 bp, Homo sapiens
catgtgtgaatcttgtgatcat

SEQ ID NO: 7559482 - DNA, 22 bp, Homo sapiens
catgtgtgaatcttgtgatcat

SEQ ID NO: 7559483 - DNA, 21 bp, Homo sapiens
catgtgtcttgtgttactgct

SEQ ID NO: 7559484 - DNA, 22 bp, Homo sapiens
catgtgtctttatggagccaca

SEQ ID NO: 7559485 - DNA, 22 bp, Homo sapiens
catgtgtcctagctattctcct

SEQ ID NO: 7559486 - DNA, 22 bp, Homo sapiens
catgtctgagtagagtgtgatt

SEQ ID NO: 7559487 - DNA, 22 bp, Homo sapiens
aggatgaataactgaaatggtg

SEQ ID NO: 7559488 - DNA, 22 bp, Homo sapiens
aggatgaatatttagtgggata

SEQ ID NO: 7559489 - DNA, 22 bp, Homo sapiens
aggatgaatatttagtgggata

SEQ ID NO: 7559490 - DNA, 22 bp, Homo sapiens
aggatctgttgaataaatttga

SEQ ID NO: 7559491 - DNA, 22 bp, Homo sapiens
aggatcttatgtaataattatg

SEQ ID NO: 7559492 - DNA, 22 bp, Homo sapiens
aggatcttcattgtgctgcaaa

SEQ ID NO: 7559493 - DNA, 22 bp, Homo sapiens
aggatcttgctgtagaggatag

SEQ ID NO: 7559494 - DNA, 22 bp, Homo sapiens
aggatgaatatttagtgggata

SEQ ID NO: 7559495 - DNA, 22 bp, Homo sapiens
aggatgaatatttagtgggata

SEQ ID NO: 7559496 - DNA, 22 bp, Homo sapiens
aggatgactggaacccaagtga

SEQ ID NO: 7559497 - DNA, 22 bp, Homo sapiens
aggatgactggaacccaagtga

SEQ ID NO: 7559498 - DNA, 22 bp, Homo sapiens
catgtctgagtagagtgtgatt

SEQ ID NO: 7559499 - DNA, 22 bp, Homo sapiens
catgtctgagtagagtgtgatt

SEQ ID NO: 7559500 - DNA, 22 bp, Homo sapiens
catgtccttctcattgcctcat

SEQ ID NO: 7559501 - DNA, 22 bp, Homo sapiens
catgtctactgaggctttatgg

SEQ ID NO: 7559502 - DNA, 22 bp, Homo sapiens
catgtctctgaaatgtggtaga

SEQ ID NO: 7559503 - DNA, 22 bp, Homo sapiens
aggatgagaagattggaatctt

SEQ ID NO: 7559504 - DNA, 22 bp, Homo sapiens
aggatgagaagattggaatctt

SEQ ID NO: 7559505 - DNA, 22 bp, Homo sapiens
catgtccttctcattgcctcat

SEQ ID NO: 7559506 - DNA, 22 bp, Homo sapiens
aggataattggcatttgtaggc

SEQ ID NO: 7559507 - DNA, 22 bp, Homo sapiens
aggataattggcatttgtaggc

SEQ ID NO: 7559508 - DNA, 22 bp, Homo sapiens
aggataataatagtgctcactc

SEQ ID NO: 7559509 - DNA, 22 bp, Homo sapiens
aggataaattctccaaagtgtg

SEQ ID NO: 7559510 - DNA, 22 bp, Homo sapiens
aggataactttgaaagtaaatt

SEQ ID NO: 7559511 - DNA, 22 bp, Homo sapiens
aggataaaggtcattattccca

SEQ ID NO: 7559512 - DNA, 22 bp, Homo sapiens
aggataaaggtcattattccca

SEQ ID NO: 7559513 - DNA, 22 bp, Homo sapiens
aggataaaggtcattattccca

SEQ ID NO: 7559514 - DNA, 22 bp, Homo sapiens
aggataaaggtcattattccca

SEQ ID NO: 7559515 - DNA, 22 bp, Homo sapiens
aggataaattctccaaagtgtg

SEQ ID NO: 7559516 - DNA, 22 bp, Homo sapiens
aggataaatgatctagattttc

SEQ ID NO: 7559517 - DNA, 22 bp, Homo sapiens
aggataaatgatctagattttc

SEQ ID NO: 7559518 - DNA, 22 bp, Homo sapiens
aggataaatgatctagattttc

SEQ ID NO: 7559519 - DNA, 23 bp, Homo sapiens
aggataaactaaactcattttgg

SEQ ID NO: 7559520 - DNA, 23 bp, Homo sapiens
aggataaactaaactcattttgg

SEQ ID NO: 7559521 - DNA, 23 bp, Homo sapiens
aggataaactaaactcattttgg

SEQ ID NO: 7559522 - DNA, 23 bp, Homo sapiens
aggataaactaaactcattttgg

SEQ ID NO: 7559523 - DNA, 22 bp, Homo sapiens
aggagtttggcacatgtatgca

SEQ ID NO: 7559524 - DNA, 22 bp, Homo sapiens
aggagtttggcacatgtatgca

SEQ ID NO: 7559525 - DNA, 22 bp, Homo sapiens
aggagtttggggattagtcagg

SEQ ID NO: 7559526 - DNA, 22 bp, Homo sapiens
aggagtttcaaagcttccatgt

SEQ ID NO: 7559527 - DNA, 22 bp, Homo sapiens
aggagtttcctttagtttctgg

SEQ ID NO: 7559528 - DNA, 22 bp, Homo sapiens
aggagtttatccgagggcataa

SEQ ID NO: 7559529 - DNA, 22 bp, Homo sapiens
aggagtttatccgagggcataa

SEQ ID NO: 7559530 - DNA, 23 bp, Homo sapiens
aggagttgagggttgggttggca

SEQ ID NO: 7559531 - DNA, 22 bp, Homo sapiens
aggagtgttccatccaagccct

SEQ ID NO: 7559532 - DNA, 22 bp, Homo sapiens
aggagtgttcagcgtggggatg

SEQ ID NO: 7559533 - DNA, 22 bp, Homo sapiens
aggagtgttgcttcagggaagc

SEQ ID NO: 7559534 - DNA, 22 bp, Homo sapiens
aggagtgttgcttcagggaagc

SEQ ID NO: 7559535 - DNA, 22 bp, Homo sapiens
aggagttatggcagaatcaaat

SEQ ID NO: 7559536 - DNA, 21 bp, Homo sapiens
aggagttgctgtggcctggtt

SEQ ID NO: 7559537 - DNA, 21 bp, Homo sapiens
aggagttgctgtggcctggtt

SEQ ID NO: 7559538 - DNA, 22 bp, Homo sapiens
aggagttggtcaccgtggccca

SEQ ID NO: 7559539 - DNA, 23 bp, Homo sapiens
aggatcctggtacaggagcagag

SEQ ID NO: 7559540 - DNA, 23 bp, Homo sapiens
aggatcctggtacaggagcagag

SEQ ID NO: 7559541 - DNA, 22 bp, Homo sapiens
aggatccagccagggtggagtt

SEQ ID NO: 7559542 - DNA, 22 bp, Homo sapiens
aggatcctccttagaaaagacc

SEQ ID NO: 7559543 - DNA, 22 bp, Homo sapiens
aggatcatgtggtcattcctga

SEQ ID NO: 7559544 - DNA, 22 bp, Homo sapiens
aggatcatataagctccagcta

SEQ ID NO: 7559545 - DNA, 22 bp, Homo sapiens
aggatcagtgaatactcagggt

SEQ ID NO: 7559546 - DNA, 22 bp, Homo sapiens
aggatcctttggccacttctta

SEQ ID NO: 7559547 - DNA, 22 bp, Homo sapiens
aggatcctttttctgctgtttg

SEQ ID NO: 7559548 - DNA, 20 bp, Homo sapiens
aggatctgagatagaatgga

SEQ ID NO: 7559549 - DNA, 22 bp, Homo sapiens
aggatctgtgcctcaacccaga

SEQ ID NO: 7559550 - DNA, 22 bp, Homo sapiens
aggatctgggtattccttttct

SEQ ID NO: 7559551 - DNA, 22 bp, Homo sapiens
aggatcaaatgaaatattttga

SEQ ID NO: 7559552 - DNA, 22 bp, Homo sapiens
aggatcaaatgatcctcaggtc

SEQ ID NO: 7559553 - DNA, 22 bp, Homo sapiens
aggatcaggccctctagggtag

SEQ ID NO: 7559554 - DNA, 22 bp, Homo sapiens
aggatatttgtaaagattttga

SEQ ID NO: 7559555 - DNA, 22 bp, Homo sapiens
aggatatttgtaaagattttga

SEQ ID NO: 7559556 - DNA, 22 bp, Homo sapiens
aggatatttgcttaagatagct

SEQ ID NO: 7559557 - DNA, 22 bp, Homo sapiens
aggatattgtatccatctgagt

SEQ ID NO: 7559558 - DNA, 22 bp, Homo sapiens
aggatattgtatccatctgagt

SEQ ID NO: 7559559 - DNA, 22 bp, Homo sapiens
aggatcagagctttgtttctga

SEQ ID NO: 7559560 - DNA, 22 bp, Homo sapiens
aggatcaggccctctagggtag

SEQ ID NO: 7559561 - DNA, 22 bp, Homo sapiens
aggatcaagaggcccctgactg

SEQ ID NO: 7559562 - DNA, 22 bp, Homo sapiens
aggatcaagaggcggccggaac

SEQ ID NO: 7559563 - DNA, 22 bp, Homo sapiens
aggatcaagttggttgagcttt

SEQ ID NO: 7559564 - DNA, 22 bp, Homo sapiens
aggatcaagttggttgagcttt

SEQ ID NO: 7559565 - DNA, 22 bp, Homo sapiens
aggatcagggtggtggaagtca

SEQ ID NO: 7559566 - DNA, 22 bp, Homo sapiens
aggatcagggtggtggaagtca

SEQ ID NO: 7559567 - DNA, 22 bp, Homo sapiens
aggatcagtgaatactcagggt

SEQ ID NO: 7559568 - DNA, 22 bp, Homo sapiens
aggatcagtgaatactcagggt

SEQ ID NO: 7559569 - DNA, 22 bp, Homo sapiens
aggatagaagccccatgttctt

SEQ ID NO: 7559570 - DNA, 22 bp, Homo sapiens
aggatagaagccccatgttctt

SEQ ID NO: 7559571 - DNA, 22 bp, Homo sapiens
aggatagaagccccatgttctt

SEQ ID NO: 7559572 - DNA, 22 bp, Homo sapiens
aggatacaagtctcagaatgct

SEQ ID NO: 7559573 - DNA, 22 bp, Homo sapiens
aggatatccctacacatcactg

SEQ ID NO: 7559574 - DNA, 22 bp, Homo sapiens
aggatataaaaagactatttgg

SEQ ID NO: 7559575 - DNA, 22 bp, Homo sapiens
aggatataaaaagactatttgg

SEQ ID NO: 7559576 - DNA, 22 bp, Homo sapiens
aggcacagtgcctggaatcaaa

SEQ ID NO: 7559577 - DNA, 22 bp, Homo sapiens
aggcacagtgcctggaatcaaa

SEQ ID NO: 7559578 - DNA, 22 bp, Homo sapiens
aggcacagtggccctgtttggg

SEQ ID NO: 7559579 - DNA, 22 bp, Homo sapiens
aggcacagtggccctgtttggg

SEQ ID NO: 7559580 - DNA, 22 bp, Homo sapiens
aggcacagtggctcacacctgt

SEQ ID NO: 7559581 - DNA, 22 bp, Homo sapiens
aggcacagtggctcacacctgt

SEQ ID NO: 7559582 - DNA, 22 bp, Homo sapiens
aggcacagtggctcacacctgt

SEQ ID NO: 7559583 - DNA, 22 bp, Homo sapiens
aggcacagtggccctgtttggg

SEQ ID NO: 7559584 - DNA, 22 bp, Homo sapiens
aggcacagtggctcacacctgt

SEQ ID NO: 7559585 - DNA, 22 bp, Homo sapiens
aggcacagtggctcacacctgt

SEQ ID NO: 7559586 - DNA, 22 bp, Homo sapiens
aggcacagtggctcacacctgt

SEQ ID NO: 7559587 - DNA, 22 bp, Homo sapiens
aggcacagtggctcacacctgt

SEQ ID NO: 7559588 - DNA, 22 bp, Homo sapiens
aggcacagtggctcacacctgt

SEQ ID NO: 7559589 - DNA, 20 bp, Homo sapiens
aggcacagttcctagttggg

SEQ ID NO: 7559590 - DNA, 20 bp, Homo sapiens
aggcacagttcctagttggg

SEQ ID NO: 7559591 - DNA, 20 bp, Homo sapiens
aggcacagttcctagttggg

SEQ ID NO: 7559592 - DNA, 20 bp, Homo sapiens
aggcacagttcctagttggg

SEQ ID NO: 7559593 - DNA, 20 bp, Homo sapiens
aggcacagttcctagttggg

SEQ ID NO: 7559594 - DNA, 20 bp, Homo sapiens
aggcacagttcctagttggg

SEQ ID NO: 7559595 - DNA, 19 bp, Homo sapiens
aggcacaggttgtctggac

SEQ ID NO: 7559596 - DNA, 22 bp, Homo sapiens
aggcacagtgcctggaatcaaa

SEQ ID NO: 7559597 - DNA, 22 bp, Homo sapiens
aggcacagtgcctggaatcaaa

SEQ ID NO: 7559598 - DNA, 22 bp, Homo sapiens
aggcacagtgcctggaatcaaa

SEQ ID NO: 7559599 - DNA, 19 bp, Homo sapiens
aggcacaggttgtctggac

SEQ ID NO: 7559600 - DNA, 19 bp, Homo sapiens
aggcacaggttgtctggac

SEQ ID NO: 7559601 - DNA, 22 bp, Homo sapiens
aggcacagtgcctggaatcaaa

SEQ ID NO: 7559602 - DNA, 22 bp, Homo sapiens
aggcacagtgcctggaatcaaa

SEQ ID NO: 7559603 - DNA, 22 bp, Homo sapiens
aggcacagtgcctggaatcaaa

SEQ ID NO: 7559604 - DNA, 22 bp, Homo sapiens
aggcacagtgcctggaatcaaa

SEQ ID NO: 7559605 - DNA, 22 bp, Homo sapiens
aggcacaggtggacttcacagt

SEQ ID NO: 7559606 - DNA, 22 bp, Homo sapiens
aggcacaggtggacttcacagt

SEQ ID NO: 7559607 - DNA, 19 bp, Homo sapiens
aggcacaggttgtctggac

SEQ ID NO: 7559608 - DNA, 22 bp, Homo sapiens
aggcacaggtggacttcacagt

SEQ ID NO: 7559609 - DNA, 19 bp, Homo sapiens
aggcacaggttgtctggac

SEQ ID NO: 7559610 - DNA, 19 bp, Homo sapiens
aggcacaggttgtctggac

SEQ ID NO: 7559611 - DNA, 19 bp, Homo sapiens
aggcacaggttgtctggac

SEQ ID NO: 7559612 - DNA, 19 bp, Homo sapiens
aggcacaggttgtctggac

SEQ ID NO: 7559613 - DNA, 22 bp, Homo sapiens
aggcactgaaggaagcttgcgc

SEQ ID NO: 7559614 - DNA, 22 bp, Homo sapiens
aggcactgaaggaagcttgcgc

SEQ ID NO: 7559615 - DNA, 22 bp, Homo sapiens
aggcactgaaggaagcttgcgc

SEQ ID NO: 7559616 - DNA, 22 bp, Homo sapiens
aggcactgaagtggtaaatgta

SEQ ID NO: 7559617 - DNA, 22 bp, Homo sapiens
aggcactgaagtggtaaatgta

SEQ ID NO: 7559618 - DNA, 22 bp, Homo sapiens
aggcactgaaggaagcttgcgc

SEQ ID NO: 7559619 - DNA, 22 bp, Homo sapiens
aggcactgaatatccagtaaaa

SEQ ID NO: 7559620 - DNA, 22 bp, Homo sapiens
aggcactgaatatccagtaaaa

SEQ ID NO: 7559621 - DNA, 23 bp, Homo sapiens
aggcactgaatgtgtcagtgagt

SEQ ID NO: 7559622 - DNA, 22 bp, Homo sapiens
aggcactgaagtggtaaatgta

SEQ ID NO: 7559623 - DNA, 22 bp, Homo sapiens
aggcactgaatatccagtaaaa

SEQ ID NO: 7559624 - DNA, 22 bp, Homo sapiens
aggcactgaagtggtaaatgta

SEQ ID NO: 7559625 - DNA, 22 bp, Homo sapiens
aggcactgaaaggtggccagag

SEQ ID NO: 7559626 - DNA, 22 bp, Homo sapiens
aggcacataatcatcctagcta

SEQ ID NO: 7559627 - DNA, 22 bp, Homo sapiens
aggcactgaaaggtggccagag

SEQ ID NO: 7559628 - DNA, 22 bp, Homo sapiens
aggcactgaaaggtggccagag

SEQ ID NO: 7559629 - DNA, 22 bp, Homo sapiens
aggcactgaaaggtggccagag

SEQ ID NO: 7559630 - DNA, 22 bp, Homo sapiens
aggcactgaaaggtggccagag

SEQ ID NO: 7559631 - DNA, 22 bp, Homo sapiens
aggcacagtttcatccccgggc

SEQ ID NO: 7559632 - DNA, 22 bp, Homo sapiens
aggcacagtttcatccccgggc

SEQ ID NO: 7559633 - DNA, 20 bp, Homo sapiens
aggcacagttcctagttggg

SEQ ID NO: 7559634 - DNA, 22 bp, Homo sapiens
aggcactgaagaactctttttg

SEQ ID NO: 7559635 - DNA, 22 bp, Homo sapiens
aggcactgaagaactctttttg

SEQ ID NO: 7559636 - DNA, 22 bp, Homo sapiens
aggcactgaaaggtggccagag

SEQ ID NO: 7559637 - DNA, 22 bp, Homo sapiens
aggcactgaagaactctttttg

SEQ ID NO: 7559638 - DNA, 22 bp, Homo sapiens
aggcactgaaaggtggccagag

SEQ ID NO: 7559639 - DNA, 22 bp, Homo sapiens
aggcagagagcagtggccgtct

SEQ ID NO: 7559640 - DNA, 22 bp, Homo sapiens
aggcagagagcagtggccgtct

SEQ ID NO: 7559641 - DNA, 22 bp, Homo sapiens
aggcagagagcagtggccgtct

SEQ ID NO: 7559642 - DNA, 22 bp, Homo sapiens
aggcagagagcagtggccgtct

SEQ ID NO: 7559643 - DNA, 22 bp, Homo sapiens
aggcagagagcagtggccgtct

SEQ ID NO: 7559644 - DNA, 22 bp, Homo sapiens
aggcagagagcagtggccgtct

SEQ ID NO: 7559645 - DNA, 22 bp, Homo sapiens
aggcagagagcagtggccgtct

SEQ ID NO: 7559646 - DNA, 22 bp, Homo sapiens
aggcagagagcagtggccgtct

SEQ ID NO: 7559647 - DNA, 22 bp, Homo sapiens
aggcagagagcagtggccgtct

SEQ ID NO: 7559648 - DNA, 22 bp, Homo sapiens
aggcagagagcagtggccgtct

SEQ ID NO: 7559649 - DNA, 16 bp, Homo sapiens
aggcagagatttaccc

SEQ ID NO: 7559650 - DNA, 16 bp, Homo sapiens
aggcagagatttaccc

SEQ ID NO: 7559651 - DNA, 16 bp, Homo sapiens
aggcagagatttaccc

SEQ ID NO: 7559652 - DNA, 16 bp, Homo sapiens
aggcagagatttaccc

SEQ ID NO: 7559653 - DNA, 23 bp, Homo sapiens
aggcagagccaaggtcaaaaccc

SEQ ID NO: 7559654 - DNA, 23 bp, Homo sapiens
aggcagagccaaggtcaaaaccc

SEQ ID NO: 7559655 - DNA, 16 bp, Homo sapiens
aggcagagatttaccc

SEQ ID NO: 7559656 - DNA, 22 bp, Homo sapiens
aggcactgattctcagagttac

SEQ ID NO: 7559657 - DNA, 22 bp, Homo sapiens
aggcactgattctcagagttac

SEQ ID NO: 7559658 - DNA, 22 bp, Homo sapiens
aggcactgattctcagagttac

SEQ ID NO: 7559659 - DNA, 22 bp, Homo sapiens
aggcactgattctgttttccat

SEQ ID NO: 7559660 - DNA, 22 bp, Homo sapiens
aggcactgattctgttttccat

SEQ ID NO: 7559661 - DNA, 22 bp, Homo sapiens
aggcactgcagattacaggcgc

SEQ ID NO: 7559662 - DNA, 22 bp, Homo sapiens
aggcactttaggatcaggttga

SEQ ID NO: 7559663 - DNA, 22 bp, Homo sapiens
aggcactttaggatcaggttga

SEQ ID NO: 7559664 - DNA, 22 bp, Homo sapiens
aggcactttgaaatttggagct

SEQ ID NO: 7559665 - DNA, 22 bp, Homo sapiens
aggcactttgaaatttggagct

SEQ ID NO: 7559666 - DNA, 22 bp, Homo sapiens
aggcactttgaaatttggagct

SEQ ID NO: 7559667 - DNA, 22 bp, Homo sapiens
aggcactttgaaatttggagct

SEQ ID NO: 7559668 - DNA, 22 bp, Homo sapiens
aggcagagagcagtggccgtct

SEQ ID NO: 7559669 - DNA, 22 bp, Homo sapiens
aggcactttctgtatgctagtt

SEQ ID NO: 7559670 - DNA, 22 bp, Homo sapiens
aggcactttccttgaggagttt

SEQ ID NO: 7559671 - DNA, 22 bp, Homo sapiens
aggcactgattctgttttccat

SEQ ID NO: 7559672 - DNA, 22 bp, Homo sapiens
aggcactttccttgaggagttt

SEQ ID NO: 7559673 - DNA, 23 bp, Homo sapiens
aggcactgaatgtgtcagtgagt

SEQ ID NO: 7559674 - DNA, 23 bp, Homo sapiens
aggcactgaatgtgtcagtgagt

SEQ ID NO: 7559675 - DNA, 23 bp, Homo sapiens
aggcactgaatgtgtcagtgagt

SEQ ID NO: 7559676 - DNA, 23 bp, Homo sapiens
aggcactgaatgtgtcagtgagt

SEQ ID NO: 7559677 - DNA, 23 bp, Homo sapiens
aggcactgaatgtgtcagtgagt

SEQ ID NO: 7559678 - DNA, 22 bp, Homo sapiens
aggcactgacaattctggactg

SEQ ID NO: 7559679 - DNA, 22 bp, Homo sapiens
aggcactgacaattctggactg

SEQ ID NO: 7559680 - DNA, 22 bp, Homo sapiens
aggcactgacaattctggactg

SEQ ID NO: 7559681 - DNA, 23 bp, Homo sapiens
aggcactgaatgtgtcagtgagt

SEQ ID NO: 7559682 - DNA, 22 bp, Homo sapiens
aggcactgacaattctggactg

SEQ ID NO: 7559683 - DNA, 22 bp, Homo sapiens
aggcactgacaattctggactg

SEQ ID NO: 7559684 - DNA, 22 bp, Homo sapiens
aggcactgacagattctgtgtc

SEQ ID NO: 7559685 - DNA, 22 bp, Homo sapiens
aggcactgacagattctgtgtc

SEQ ID NO: 7559686 - DNA, 22 bp, Homo sapiens
aggcactgacagattctgtgtc

SEQ ID NO: 7559687 - DNA, 22 bp, Homo sapiens
aggcactgacctgcttccttga

SEQ ID NO: 7559688 - DNA, 22 bp, Homo sapiens
aggcactgacagattctgtgtc

SEQ ID NO: 7559689 - DNA, 22 bp, Homo sapiens
aggcactgacagattctgtgtc

SEQ ID NO: 7559690 - DNA, 22 bp, Homo sapiens
aggcactgacaattctggactg

SEQ ID NO: 7559691 - DNA, 22 bp, Homo sapiens
aggcactgacagattctgtgtc

SEQ ID NO: 7559692 - DNA, 22 bp, Homo sapiens
aggcactgactcaagggagcca

SEQ ID NO: 7559693 - DNA, 22 bp, Homo sapiens
aggcactgagaggctgtgttgc

SEQ ID NO: 7559694 - DNA, 22 bp, Homo sapiens
aggcactgagaggctgtgttgc

SEQ ID NO: 7559695 - DNA, 22 bp, Homo sapiens
aggcactgagaggctgtgttgc

SEQ ID NO: 7559696 - DNA, 22 bp, Homo sapiens
aggcactgactcaagggagcca

SEQ ID NO: 7559697 - DNA, 22 bp, Homo sapiens
aggcactgattctcagagttac

SEQ ID NO: 7559698 - DNA, 22 bp, Homo sapiens
aggcactgacctgcttccttga

SEQ ID NO: 7559699 - DNA, 22 bp, Homo sapiens
aggcactgacctgcttccttga

SEQ ID NO: 7559700 - DNA, 22 bp, Homo sapiens
aggcactgactcaagggagcca

SEQ ID NO: 7559701 - DNA, 22 bp, Homo sapiens
aggcactgactcaagggagcca

SEQ ID NO: 7559702 - DNA, 22 bp, Homo sapiens
aggcactgactcaagggagcca

SEQ ID NO: 7559703 - DNA, 22 bp, Homo sapiens
aggcactgactcaagggagcca

SEQ ID NO: 7559704 - DNA, 22 bp, Homo sapiens
aggcactgactcaagggagcca

SEQ ID NO: 7559705 - DNA, 22 bp, Homo sapiens
aggcactgactcaagggagcca

SEQ ID NO: 7559706 - DNA, 22 bp, Homo sapiens
aggcactgactcaagggagcca

SEQ ID NO: 7559707 - DNA, 22 bp, Homo sapiens
aggcaggcccctgagaatagac

SEQ ID NO: 7559708 - DNA, 22 bp, Homo sapiens
aggcaggcccctgagaatagac

SEQ ID NO: 7559709 - DNA, 22 bp, Homo sapiens
aggcaggcccctgagaatagac

SEQ ID NO: 7559710 - DNA, 22 bp, Homo sapiens
aggcaggccctctggaaaggta

SEQ ID NO: 7559711 - DNA, 22 bp, Homo sapiens
aggcaggcccctgagaatagac

SEQ ID NO: 7559712 - DNA, 22 bp, Homo sapiens
aggcaggcccctgagaatagac

SEQ ID NO: 7559713 - DNA, 22 bp, Homo sapiens
aggcaggcccctgagaatagac

SEQ ID NO: 7559714 - DNA, 22 bp, Homo sapiens
aggcaggcccctgagaatagac

SEQ ID NO: 7559715 - DNA, 22 bp, Homo sapiens
aggcaggcccctgagaatagac

SEQ ID NO: 7559716 - DNA, 23 bp, Homo sapiens
aggcaggcagttcagctgttgtt

SEQ ID NO: 7559717 - DNA, 21 bp, Homo sapiens
aggcaggattcaaacacagag

SEQ ID NO: 7559718 - DNA, 21 bp, Homo sapiens
aggcaggattcaaacacagag

SEQ ID NO: 7559719 - DNA, 23 bp, Homo sapiens
aggcaggcagttcagctgttgtt

SEQ ID NO: 7559720 - DNA, 22 bp, Homo sapiens
ccaaagacagacttgactagag

SEQ ID NO: 7559721 - DNA, 22 bp, Homo sapiens
ccaaagacagacttgactagag

SEQ ID NO: 7559722 - DNA, 21 bp, Homo sapiens
ccaaagaactgccatttgtca

SEQ ID NO: 7559723 - DNA, 22 bp, Homo sapiens
ccaaagaaacccaagctcaggg

SEQ ID NO: 7559724 - DNA, 22 bp, Homo sapiens
ccaaagcaagtcacatgatcaa

SEQ ID NO: 7559725 - DNA, 22 bp, Homo sapiens
ccaaagagctagaattataggc

SEQ ID NO: 7559726 - DNA, 22 bp, Homo sapiens
ccaaagagctagaattataggc

SEQ ID NO: 7559727 - DNA, 20 bp, Homo sapiens
ccaaagactgccccttccag

SEQ ID NO: 7559728 - DNA, 20 bp, Homo sapiens
ccaaagactgccccttccag

SEQ ID NO: 7559729 - DNA, 22 bp, Homo sapiens
ccaaaggatgtccctgtgtttt

SEQ ID NO: 7559730 - DNA, 22 bp, Homo sapiens
ccaaagcaagtcacatgatcaa

SEQ ID NO: 7559731 - DNA, 21 bp, Homo sapiens
aggcaggattcaaacacagag

SEQ ID NO: 7559732 - DNA, 21 bp, Homo sapiens
aggcaggattcaaacacagag

SEQ ID NO: 7559733 - DNA, 21 bp, Homo sapiens
aggcaggattcaaacacagag

SEQ ID NO: 7559734 - DNA, 21 bp, Homo sapiens
aggcaggattcaaacacagag

SEQ ID NO: 7559735 - DNA, 18 bp, Homo sapiens
aggcaggatcctggcctc

SEQ ID NO: 7559736 - DNA, 21 bp, Homo sapiens
aggcaggattcaaacacagag

SEQ ID NO: 7559737 - DNA, 18 bp, Homo sapiens
aggcaggatcctggcctc

SEQ ID NO: 7559738 - DNA, 18 bp, Homo sapiens
aggcaggatcctggcctc

SEQ ID NO: 7559739 - DNA, 22 bp, Homo sapiens
ccaaaataacagcccaattcac

SEQ ID NO: 7559740 - DNA, 22 bp, Homo sapiens
ccaaaataacagcccaattcac

SEQ ID NO: 7559741 - DNA, 22 bp, Homo sapiens
ccaaaataacagcccaattcac

SEQ ID NO: 7559742 - DNA, 22 bp, Homo sapiens
ccaaaatattagtgcttaagta

SEQ ID NO: 7559743 - DNA, 22 bp, Homo sapiens
ccaaaatattagtgcttaagta

SEQ ID NO: 7559744 - DNA, 22 bp, Homo sapiens
ccaaaatattagtgcttaagta

SEQ ID NO: 7559745 - DNA, 22 bp, Homo sapiens
ccaaaatattagtgcttaagta

SEQ ID NO: 7559746 - DNA, 22 bp, Homo sapiens
ccaaaattaagcctcttatgtt

SEQ ID NO: 7559747 - DNA, 22 bp, Homo sapiens
ccaaaattattacatttgtagg

SEQ ID NO: 7559748 - DNA, 22 bp, Homo sapiens
ccaaaattattacatttgtagg

SEQ ID NO: 7559749 - DNA, 22 bp, Homo sapiens
ccaaaattaagcctcttatgtt

SEQ ID NO: 7559750 - DNA, 22 bp, Homo sapiens
ccaaaatgtttgaatgcatgtg

SEQ ID NO: 7559751 - DNA, 22 bp, Homo sapiens
ccaaaattattacatttgtagg

SEQ ID NO: 7559752 - DNA, 22 bp, Homo sapiens
ccaaaattattacatttgtagg

SEQ ID NO: 7559753 - DNA, 22 bp, Homo sapiens
ccaaaattattacatttgtagg

SEQ ID NO: 7559754 - DNA, 22 bp, Homo sapiens
ccaaacaaatccccattcttag

SEQ ID NO: 7559755 - DNA, 22 bp, Homo sapiens
ccaaacaaatccccattcttag

SEQ ID NO: 7559756 - DNA, 22 bp, Homo sapiens
ccaaaatgtttgaatgcatgtg

SEQ ID NO: 7559757 - DNA, 22 bp, Homo sapiens
ccaaacaaatccccattcttag

SEQ ID NO: 7559758 - DNA, 22 bp, Homo sapiens
ccaaacatttcaaatttagaga

SEQ ID NO: 7559759 - DNA, 22 bp, Homo sapiens
ccaaagaaacccaagctcaggg

SEQ ID NO: 7559760 - DNA, 22 bp, Homo sapiens
ccaaagaaacccaagctcaggg

SEQ ID NO: 7559761 - DNA, 22 bp, Homo sapiens
ccaaactgggccagtcagctgt

SEQ ID NO: 7559762 - DNA, 22 bp, Homo sapiens
ccaaaccatccatctccaggct

SEQ ID NO: 7559763 - DNA, 22 bp, Homo sapiens
ccaaactgtttcgtatttatgc

SEQ ID NO: 7559764 - DNA, 22 bp, Homo sapiens
aggcaggctcaatgcccagtct

SEQ ID NO: 7559765 - DNA, 22 bp, Homo sapiens
aggcaggctcaatgcccagtct

SEQ ID NO: 7559766 - DNA, 22 bp, Homo sapiens
aggcaggctcaatgcccagtct

SEQ ID NO: 7559767 - DNA, 22 bp, Homo sapiens
aggcaggctcaatgcccagtct

SEQ ID NO: 7559768 - DNA, 22 bp, Homo sapiens
aggcaggctcaatgcccagtct

SEQ ID NO: 7559769 - DNA, 22 bp, Homo sapiens
aggcaggctcaatgcccagtct

SEQ ID NO: 7559770 - DNA, 22 bp, Homo sapiens
aggcaggctcaggcccatgctt

SEQ ID NO: 7559771 - DNA, 22 bp, Homo sapiens
aggcaggctcaggcccatgctt

SEQ ID NO: 7559772 - DNA, 22 bp, Homo sapiens
aggcaggctcaggcccatgctt

SEQ ID NO: 7559773 - DNA, 22 bp, Homo sapiens
aggcaggctagtcgcttgagcc

SEQ ID NO: 7559774 - DNA, 22 bp, Homo sapiens
aggcaggctcaatgcccagtct

SEQ ID NO: 7559775 - DNA, 18 bp, Homo sapiens
aggcaggcggatcacaag

SEQ ID NO: 7559776 - DNA, 22 bp, Homo sapiens
aggcaggctagtcgcttgagcc

SEQ ID NO: 7559777 - DNA, 22 bp, Homo sapiens
aggcaggctagtcgcttgagcc

SEQ ID NO: 7559778 - DNA, 22 bp, Homo sapiens
aggcaggctagtcgcttgagcc

SEQ ID NO: 7559779 - DNA, 22 bp, Homo sapiens
aggcaggctagtcgcttgagcc

SEQ ID NO: 7559780 - DNA, 22 bp, Homo sapiens
aggcaggctagtcgcttgagcc

SEQ ID NO: 7559781 - DNA, 22 bp, Homo sapiens
aggcaggctagtcgcttgagcc

SEQ ID NO: 7559782 - DNA, 22 bp, Homo sapiens
aggcaggctagtcgcttgagcc

SEQ ID NO: 7559783 - DNA, 22 bp, Homo sapiens
aggcaggctctgggtatgtgca

SEQ ID NO: 7559784 - DNA, 22 bp, Homo sapiens
aggcaggctctgggtatgtgca

SEQ ID NO: 7559785 - DNA, 22 bp, Homo sapiens
aggcaggctcaggcccatgctt

SEQ ID NO: 7559786 - DNA, 22 bp, Homo sapiens
aggcaggctcaggcccatgctt

SEQ ID NO: 7559787 - DNA, 22 bp, Homo sapiens
aggcaggctcaggcccatgctt

SEQ ID NO: 7559788 - DNA, 22 bp, Homo sapiens
aggcaggctgctatggagtaga

SEQ ID NO: 7559789 - DNA, 22 bp, Homo sapiens
aggcaggctgctatggagtaga

SEQ ID NO: 7559790 - DNA, 22 bp, Homo sapiens
aggcaggctgctatggagtaga

SEQ ID NO: 7559791 - DNA, 22 bp, Homo sapiens
aggcaggctgctatggagtaga

SEQ ID NO: 7559792 - DNA, 22 bp, Homo sapiens
aggcaggctgctatggagtaga

SEQ ID NO: 7559793 - DNA, 22 bp, Homo sapiens
aggcaggctgctatggagtaga

SEQ ID NO: 7559794 - DNA, 22 bp, Homo sapiens
aggcaggctgctatggagtaga

SEQ ID NO: 7559795 - DNA, 22 bp, Homo sapiens
aggcaggctctgggtatgtgca

SEQ ID NO: 7559796 - DNA, 22 bp, Homo sapiens
aggcaggccctctggaaaggta

SEQ ID NO: 7559797 - DNA, 22 bp, Homo sapiens
aggcaggccctctggaaaggta

SEQ ID NO: 7559798 - DNA, 22 bp, Homo sapiens
aggcaggccctctggaaaggta

SEQ ID NO: 7559799 - DNA, 22 bp, Homo sapiens
aggcaggccctgggccatcccg

SEQ ID NO: 7559800 - DNA, 22 bp, Homo sapiens
aggcaggccctctggaaaggta

SEQ ID NO: 7559801 - DNA, 22 bp, Homo sapiens
aggcaggccctctggaaaggta

SEQ ID NO: 7559802 - DNA, 22 bp, Homo sapiens
aggcaggccctctggaaaggta

SEQ ID NO: 7559803 - DNA, 22 bp, Homo sapiens
aggcaggccctctggaaaggta

SEQ ID NO: 7559804 - DNA, 22 bp, Homo sapiens
aggcaggccctgggccatcccg

SEQ ID NO: 7559805 - DNA, 22 bp, Homo sapiens
aggcaggccctgggccatcccg

SEQ ID NO: 7559806 - DNA, 22 bp, Homo sapiens
aggcaggccctgggccatcccg

SEQ ID NO: 7559807 - DNA, 22 bp, Homo sapiens
aggcaggccctgggccatcccg

SEQ ID NO: 7559808 - DNA, 22 bp, Homo sapiens
aggcaggccctgggccatcccg

SEQ ID NO: 7559809 - DNA, 22 bp, Homo sapiens
aggcaggccctgggccatcccg

SEQ ID NO: 7559810 - DNA, 22 bp, Homo sapiens
aggcaggccgtgtccctcctca

SEQ ID NO: 7559811 - DNA, 22 bp, Homo sapiens
aggcaggccgtgtccctcctca

SEQ ID NO: 7559812 - DNA, 22 bp, Homo sapiens
aggcaggccgtgtccctcctca

SEQ ID NO: 7559813 - DNA, 22 bp, Homo sapiens
aggcaggccctgggccatcccg

SEQ ID NO: 7559814 - DNA, 22 bp, Homo sapiens
aggcaggcctacacaatgggag

SEQ ID NO: 7559815 - DNA, 22 bp, Homo sapiens
aggcaggcctacacaatgggag

SEQ ID NO: 7559816 - DNA, 22 bp, Homo sapiens
aggcaggcctacacaatgggag

SEQ ID NO: 7559817 - DNA, 18 bp, Homo sapiens
aggcaggcggatcacaag

SEQ ID NO: 7559818 - DNA, 18 bp, Homo sapiens
aggcaggcggatcacaag

SEQ ID NO: 7559819 - DNA, 18 bp, Homo sapiens
aggcaggcggatcacaag

SEQ ID NO: 7559820 - DNA, 18 bp, Homo sapiens
aggcaggcggatcacaag

SEQ ID NO: 7559821 - DNA, 18 bp, Homo sapiens
aggcaggcggatcacaag

SEQ ID NO: 7559822 - DNA, 18 bp, Homo sapiens
aggcaggcggatcacaag

SEQ ID NO: 7559823 - DNA, 18 bp, Homo sapiens
aggcaggcggatcacaag

SEQ ID NO: 7559824 - DNA, 18 bp, Homo sapiens
aggcaggcggatcacaag

SEQ ID NO: 7559825 - DNA, 22 bp, Homo sapiens
aggcaggcctacacaatgggag

SEQ ID NO: 7559826 - DNA, 22 bp, Homo sapiens
aggcaggcctacacaatgggag

SEQ ID NO: 7559827 - DNA, 22 bp, Homo sapiens
aggcaggcctacacaatgggag

SEQ ID NO: 7559828 - DNA, 22 bp, Homo sapiens
aggcaggcctacacaatgggag

SEQ ID NO: 7559829 - DNA, 22 bp, Homo sapiens
aggcaggcctacacaatgggag

SEQ ID NO: 7559830 - DNA, 22 bp, Homo sapiens
aggcaggcctacacaatgggag

SEQ ID NO: 7559831 - DNA, 22 bp, Homo sapiens
aggcaggccgtgtccctcctca

SEQ ID NO: 7559832 - DNA, 22 bp, Homo sapiens
aggcaggcctacacaatgggag

SEQ ID NO: 7559833 - DNA, 22 bp, Homo sapiens
aggcaggcctacacaatgggag

SEQ ID NO: 7559834 - DNA, 20 bp, Homo sapiens
aggcagagcgcacttttaga

SEQ ID NO: 7559835 - DNA, 20 bp, Homo sapiens
aggcagagcgcacttttaga

SEQ ID NO: 7559836 - DNA, 20 bp, Homo sapiens
aggcagagcgcacttttaga

SEQ ID NO: 7559837 - DNA, 22 bp, Homo sapiens
aggcagagctaggaagaattgt

SEQ ID NO: 7559838 - DNA, 22 bp, Homo sapiens
aggcagagctaggaagaattgt

SEQ ID NO: 7559839 - DNA, 22 bp, Homo sapiens
aggcagagctaggaagaattgt

SEQ ID NO: 7559840 - DNA, 22 bp, Homo sapiens
aggcagagctaggaagaattgt

SEQ ID NO: 7559841 - DNA, 20 bp, Homo sapiens
aggcagagcgcacttttaga

SEQ ID NO: 7559842 - DNA, 22 bp, Homo sapiens
aggcagagctaggaagaattgt

SEQ ID NO: 7559843 - DNA, 23 bp, Homo sapiens
aggcagagccaaggtcaaaaccc

SEQ ID NO: 7559844 - DNA, 23 bp, Homo sapiens
aggcagagccaaggtcaaaaccc

SEQ ID NO: 7559845 - DNA, 23 bp, Homo sapiens
aggcagagccaaggtcaaaaccc

SEQ ID NO: 7559846 - DNA, 20 bp, Homo sapiens
aggcagagcgcacttttaga

SEQ ID NO: 7559847 - DNA, 20 bp, Homo sapiens
aggcagagcgcacttttaga

SEQ ID NO: 7559848 - DNA, 20 bp, Homo sapiens
aggcagagcgcacttttaga

SEQ ID NO: 7559849 - DNA, 20 bp, Homo sapiens
aggcagagcgcacttttaga

SEQ ID NO: 7559850 - DNA, 20 bp, Homo sapiens
aggcagagcgcacttttaga

SEQ ID NO: 7559851 - DNA, 20 bp, Homo sapiens
aggcagagcgcacttttaga

SEQ ID NO: 7559852 - DNA, 22 bp, Homo sapiens
aggcagagctgatgttctgtga

SEQ ID NO: 7559853 - DNA, 22 bp, Homo sapiens
aggcagagctgatgttctgtga

SEQ ID NO: 7559854 - DNA, 22 bp, Homo sapiens
aggcagagctgatgttctgtga

SEQ ID NO: 7559855 - DNA, 22 bp, Homo sapiens
aggcagagctgatgttctgtga

SEQ ID NO: 7559856 - DNA, 22 bp, Homo sapiens
aggcagagctgatgttctgtga

SEQ ID NO: 7559857 - DNA, 22 bp, Homo sapiens
aggcagagctgatgttctgtga

SEQ ID NO: 7559858 - DNA, 22 bp, Homo sapiens
aggcagagctaggaagaattgt

SEQ ID NO: 7559859 - DNA, 22 bp, Homo sapiens
aggcagagctaggaagaattgt

SEQ ID NO: 7559860 - DNA, 22 bp, Homo sapiens
aggcagagctaggaagaattgt

SEQ ID NO: 7559861 - DNA, 22 bp, Homo sapiens
aggcagagctgatgttctgtga

SEQ ID NO: 7559862 - DNA, 22 bp, Homo sapiens
aggcagagctgatgttctgtga

SEQ ID NO: 7559863 - DNA, 22 bp, Homo sapiens
aggcagagctgatgttctgtga

SEQ ID NO: 7559864 - DNA, 22 bp, Homo sapiens
aggcagagctgatgttctgtga

SEQ ID NO: 7559865 - DNA, 22 bp, Homo sapiens
aggcagaggaagggtggatttg

SEQ ID NO: 7559866 - DNA, 22 bp, Homo sapiens
aggcagaggaagggtggatttg

SEQ ID NO: 7559867 - DNA, 22 bp, Homo sapiens
aggcagaggaagggtggatttg

SEQ ID NO: 7559868 - DNA, 22 bp, Homo sapiens
aggcagaggaagggtggatttg

SEQ ID NO: 7559869 - DNA, 22 bp, Homo sapiens
aggcagaggaagggtggatttg

SEQ ID NO: 7559870 - DNA, 22 bp, Homo sapiens
aggcagaggaagggtggatttg

SEQ ID NO: 7559871 - DNA, 22 bp, Homo sapiens
aggcagaggaagggtggatttg

SEQ ID NO: 7559872 - DNA, 22 bp, Homo sapiens
aggcagaggaagggtggatttg

SEQ ID NO: 7559873 - DNA, 22 bp, Homo sapiens
aggcagagctgggttttgaaat

SEQ ID NO: 7559874 - DNA, 22 bp, Homo sapiens
aggcagagctgggttttgaaat

SEQ ID NO: 7559875 - DNA, 22 bp, Homo sapiens
aggcagaggaagggtggatttg

SEQ ID NO: 7559876 - DNA, 22 bp, Homo sapiens
aggcagagctgggttttgaaat

SEQ ID NO: 7559877 - DNA, 22 bp, Homo sapiens
aggcagagctgggttttgaaat

SEQ ID NO: 7559878 - DNA, 22 bp, Homo sapiens
aggcagagctgggttttgaaat

SEQ ID NO: 7559879 - DNA, 22 bp, Homo sapiens
aggcagagctgggttttgaaat

SEQ ID NO: 7559880 - DNA, 22 bp, Homo sapiens
aggcagagctgggttttgaaat

SEQ ID NO: 7559881 - DNA, 19 bp, Homo sapiens
aggcagaggcttggctagc

SEQ ID NO: 7559882 - DNA, 19 bp, Homo sapiens
aggcagaggcttggctagc

SEQ ID NO: 7559883 - DNA, 22 bp, Homo sapiens
aggcagaggagaatgatcttcc

SEQ ID NO: 7559884 - DNA, 19 bp, Homo sapiens
aggcagaggcttggctagc

SEQ ID NO: 7559885 - DNA, 22 bp, Homo sapiens
aggcagaggagaatgatcttcc

SEQ ID NO: 7559886 - DNA, 22 bp, Homo sapiens
aggcagaggagaatgatcttcc

SEQ ID NO: 7559887 - DNA, 22 bp, Homo sapiens
aggcagaggagaatgatcttcc

SEQ ID NO: 7559888 - DNA, 22 bp, Homo sapiens
aggcagaggagaatgatcttcc

SEQ ID NO: 7559889 - DNA, 22 bp, Homo sapiens
aggcagaggagaatgatcttcc

SEQ ID NO: 7559890 - DNA, 22 bp, Homo sapiens
aggcagaggagaatgatcttcc

SEQ ID NO: 7559891 - DNA, 22 bp, Homo sapiens
aggcagaggagaatgatcttcc

SEQ ID NO: 7559892 - DNA, 22 bp, Homo sapiens
aggcagaggaagggtggatttg

SEQ ID NO: 7559893 - DNA, 22 bp, Homo sapiens
aggcagaggagaatgatcttcc

SEQ ID NO: 7559894 - DNA, 22 bp, Homo sapiens
aggcagaggagaatgatcttcc

SEQ ID NO: 7559895 - DNA, 22 bp, Homo sapiens
aggcagaggagaatgatcttcc

SEQ ID NO: 7559896 - DNA, 22 bp, Homo sapiens
aggcagaggagaatgatcttcc

SEQ ID NO: 7559897 - DNA, 22 bp, Homo sapiens
aggcagctttctgtaggggtgt

SEQ ID NO: 7559898 - DNA, 22 bp, Homo sapiens
aggcagctttgtagtaaagcta

SEQ ID NO: 7559899 - DNA, 22 bp, Homo sapiens
aggcagctttgtagtaaagcta

SEQ ID NO: 7559900 - DNA, 22 bp, Homo sapiens
aggcagctttgtagtaaagcta

SEQ ID NO: 7559901 - DNA, 22 bp, Homo sapiens
aggcaggaaaatcgcttgaacc

SEQ ID NO: 7559902 - DNA, 22 bp, Homo sapiens
ccaaaaggaactttttgaaggt

SEQ ID NO: 7559903 - DNA, 22 bp, Homo sapiens
ccaaaataacagcccaattcac

SEQ ID NO: 7559904 - DNA, 22 bp, Homo sapiens
aggcagctttctggtgcaccat

SEQ ID NO: 7559905 - DNA, 22 bp, Homo sapiens
aggcagctttctggtgcaccat

SEQ ID NO: 7559906 - DNA, 22 bp, Homo sapiens
aggcagctttctggtgcaccat

SEQ ID NO: 7559907 - DNA, 22 bp, Homo sapiens
aggcagctttctgtaggggtgt

SEQ ID NO: 7559908 - DNA, 22 bp, Homo sapiens
aggcagctttctgtaggggtgt

SEQ ID NO: 7559909 - DNA, 22 bp, Homo sapiens
aggcagctttctgtaggggtgt

SEQ ID NO: 7559910 - DNA, 22 bp, Homo sapiens
aggcagctttcagtgtctctca

SEQ ID NO: 7559911 - DNA, 22 bp, Homo sapiens
aggcagctttcagtgtctctca

SEQ ID NO: 7559912 - DNA, 22 bp, Homo sapiens
aggcagctttctggtgcaccat

SEQ ID NO: 7559913 - DNA, 22 bp, Homo sapiens
aggcagcttaagccctggccca

SEQ ID NO: 7559914 - DNA, 22 bp, Homo sapiens
aggcagcttaagccctggccca

SEQ ID NO: 7559915 - DNA, 22 bp, Homo sapiens
aggcagcttaagccctggccca

SEQ ID NO: 7559916 - DNA, 22 bp, Homo sapiens
aggcagcttaagccctggccca

SEQ ID NO: 7559917 - DNA, 22 bp, Homo sapiens
aggcagcttaagccctggccca

SEQ ID NO: 7559918 - DNA, 22 bp, Homo sapiens
aggcagctgtgaggactggatt

SEQ ID NO: 7559919 - DNA, 22 bp, Homo sapiens
aggcagcttctgattagcagcg

SEQ ID NO: 7559920 - DNA, 22 bp, Homo sapiens
aggcagcttctgattagcagcg

SEQ ID NO: 7559921 - DNA, 22 bp, Homo sapiens
aggcagcttctgattagcagcg

SEQ ID NO: 7559922 - DNA, 22 bp, Homo sapiens
aggcagcttctgattagcagcg

SEQ ID NO: 7559923 - DNA, 22 bp, Homo sapiens
aggcagcttaagccctggccca

SEQ ID NO: 7559924 - DNA, 22 bp, Homo sapiens
aggcagcttaagccctggccca

SEQ ID NO: 7559925 - DNA, 22 bp, Homo sapiens
aggcagctttaactggtagtag

SEQ ID NO: 7559926 - DNA, 22 bp, Homo sapiens
aggcagctttaactggtagtag

SEQ ID NO: 7559927 - DNA, 22 bp, Homo sapiens
aggcagcttctgattagcagcg

SEQ ID NO: 7559928 - DNA, 22 bp, Homo sapiens
aggcagcttctgattagcagcg

SEQ ID NO: 7559929 - DNA, 22 bp, Homo sapiens
aggcagctttcagtgtctctca

SEQ ID NO: 7559930 - DNA, 22 bp, Homo sapiens
aggcagctttcagtgtctctca

SEQ ID NO: 7559931 - DNA, 22 bp, Homo sapiens
aggcagctttcagtgtctctca

SEQ ID NO: 7559932 - DNA, 22 bp, Homo sapiens
aggcagctttcagtgtctctca

SEQ ID NO: 7559933 - DNA, 22 bp, Homo sapiens
aggcagctttaactggtagtag

SEQ ID NO: 7559934 - DNA, 22 bp, Homo sapiens
aggcagctttaactggtagtag

SEQ ID NO: 7559935 - DNA, 21 bp, Homo sapiens
aggcagcgattttcatattgc

SEQ ID NO: 7559936 - DNA, 19 bp, Homo sapiens
aggcagaggcttggctagc

SEQ ID NO: 7559937 - DNA, 19 bp, Homo sapiens
aggcagaggcttggctagc

SEQ ID NO: 7559938 - DNA, 19 bp, Homo sapiens
aggcagaggcttggctagc

SEQ ID NO: 7559939 - DNA, 22 bp, Homo sapiens
aggcagcgtagcaaggctagta

SEQ ID NO: 7559940 - DNA, 22 bp, Homo sapiens
aggcagcgtagcaaggctagta

SEQ ID NO: 7559941 - DNA, 22 bp, Homo sapiens
aggcagctggcagcacccaggg

SEQ ID NO: 7559942 - DNA, 22 bp, Homo sapiens
aggcagctggcagcacccaggg

SEQ ID NO: 7559943 - DNA, 22 bp, Homo sapiens
aggcagctggcagcacccaggg

SEQ ID NO: 7559944 - DNA, 22 bp, Homo sapiens
aggcagctggcagcacccaggg

SEQ ID NO: 7559945 - DNA, 22 bp, Homo sapiens
aggcagctggcagcacccaggg

SEQ ID NO: 7559946 - DNA, 22 bp, Homo sapiens
aggcagctggcagcacccaggg

SEQ ID NO: 7559947 - DNA, 22 bp, Homo sapiens
aggcagctggcagcacccaggg

SEQ ID NO: 7559948 - DNA, 22 bp, Homo sapiens
aggcagctggcaaattctagag

SEQ ID NO: 7559949 - DNA, 22 bp, Homo sapiens
aggcagctgtgaggactggatt

SEQ ID NO: 7559950 - DNA, 22 bp, Homo sapiens
aggcagctgtgaggactggatt

SEQ ID NO: 7559951 - DNA, 22 bp, Homo sapiens
aggcagctgtgaggactggatt

SEQ ID NO: 7559952 - DNA, 22 bp, Homo sapiens
aggcagctgtgaggactggatt

SEQ ID NO: 7559953 - DNA, 22 bp, Homo sapiens
aggcagctgtgaggactggatt

SEQ ID NO: 7559954 - DNA, 22 bp, Homo sapiens
aggcagctgtgaggactggatt

SEQ ID NO: 7559955 - DNA, 22 bp, Homo sapiens
aggcagctgtgaggactggatt

SEQ ID NO: 7559956 - DNA, 22 bp, Homo sapiens
aggcagctgtgaggactggatt

SEQ ID NO: 7559957 - DNA, 23 bp, Homo sapiens
aggcagctgggtagcatctttct

SEQ ID NO: 7559958 - DNA, 23 bp, Homo sapiens
aggcagctgggtagcatctttct

SEQ ID NO: 7559959 - DNA, 20 bp, Homo sapiens
aggcagctgggaaatgaggg

SEQ ID NO: 7559960 - DNA, 20 bp, Homo sapiens
aggcagctgggaaatgaggg

SEQ ID NO: 7559961 - DNA, 20 bp, Homo sapiens
aggcagctgggaaatgaggg

SEQ ID NO: 7559962 - DNA, 20 bp, Homo sapiens
aggcagctgggaaatgaggg

SEQ ID NO: 7559963 - DNA, 20 bp, Homo sapiens
aggcagctggccaggcaggt

SEQ ID NO: 7559964 - DNA, 20 bp, Homo sapiens
aggcagctggccaggcaggt

SEQ ID NO: 7559965 - DNA, 20 bp, Homo sapiens
aggcagctggccaggcaggt

SEQ ID NO: 7559966 - DNA, 20 bp, Homo sapiens
aggcagctggccaggcaggt

SEQ ID NO: 7559967 - DNA, 20 bp, Homo sapiens
aggcagctggccaggcaggt

SEQ ID NO: 7559968 - DNA, 20 bp, Homo sapiens
aggcagctggccaggcaggt

SEQ ID NO: 7559969 - DNA, 20 bp, Homo sapiens
aggcagctggccaggcaggt

SEQ ID NO: 7559970 - DNA, 20 bp, Homo sapiens
aggcagctggccaggcaggt

SEQ ID NO: 7559971 - DNA, 20 bp, Homo sapiens
aggcagctggccaggcaggt

SEQ ID NO: 7559972 - DNA, 22 bp, Homo sapiens
aggagcagattggtaagatcat

SEQ ID NO: 7559973 - DNA, 22 bp, Homo sapiens
aggagcagattggtaagatcat

SEQ ID NO: 7559974 - DNA, 22 bp, Homo sapiens
aggagcagattggtaagatcat

SEQ ID NO: 7559975 - DNA, 22 bp, Homo sapiens
aggagcagattggtaagatcat

SEQ ID NO: 7559976 - DNA, 22 bp, Homo sapiens
aggagatggagctcagtgggca

SEQ ID NO: 7559977 - DNA, 22 bp, Homo sapiens
aggagatggagctcagtgggca

SEQ ID NO: 7559978 - DNA, 22 bp, Homo sapiens
aggagatggagctcagtgggca

SEQ ID NO: 7559979 - DNA, 22 bp, Homo sapiens
aggagcagattggtaagatcat

SEQ ID NO: 7559980 - DNA, 22 bp, Homo sapiens
aggagcagcccactcctgtcct

SEQ ID NO: 7559981 - DNA, 22 bp, Homo sapiens
aggagcagcccactcctgtcct

SEQ ID NO: 7559982 - DNA, 22 bp, Homo sapiens
aggagcagcccactcctgtcct

SEQ ID NO: 7559983 - DNA, 22 bp, Homo sapiens
aggagcagcccactcctgtcct

SEQ ID NO: 7559984 - DNA, 22 bp, Homo sapiens
aggagcagcccactcctgtcct

SEQ ID NO: 7559985 - DNA, 22 bp, Homo sapiens
aggagcagcccactcctgtcct

SEQ ID NO: 7559986 - DNA, 22 bp, Homo sapiens
aggagcagcccactcctgtcct

SEQ ID NO: 7559987 - DNA, 22 bp, Homo sapiens
aggagcagcccactcctgtcct

SEQ ID NO: 7559988 - DNA, 22 bp, Homo sapiens
aggagccaaattactagctctg

SEQ ID NO: 7559989 - DNA, 22 bp, Homo sapiens
aggagccaaacatattgagaga

SEQ ID NO: 7559990 - DNA, 22 bp, Homo sapiens
aggagccaaacatattgagaga

SEQ ID NO: 7559991 - DNA, 22 bp, Homo sapiens
aggagccaaattttagactctg

SEQ ID NO: 7559992 - DNA, 22 bp, Homo sapiens
aggagccaaattttagactctg

SEQ ID NO: 7559993 - DNA, 22 bp, Homo sapiens
aggagccaaattactagctctg

SEQ ID NO: 7559994 - DNA, 22 bp, Homo sapiens
aggagcagcttctgaaccatgt

SEQ ID NO: 7559995 - DNA, 22 bp, Homo sapiens
aggagcagcttctgaaccatgt

SEQ ID NO: 7559996 - DNA, 22 bp, Homo sapiens
aggagcagcttctgaaccatgt

SEQ ID NO: 7559997 - DNA, 22 bp, Homo sapiens
aggagcagcttctgaaccatgt

SEQ ID NO: 7559998 - DNA, 22 bp, Homo sapiens
aggagcagcttctgaaccatgt

SEQ ID NO: 7559999 - DNA, 22 bp, Homo sapiens
aggagcagcttctgaaccatgt

SEQ ID NO: 7560000 - DNA, 22 bp, Homo sapiens
aggagcagcttctgaaccatgt

SEQ ID NO: 7560001 - DNA, 22 bp, Homo sapiens
aggagcagcccactcctgtcct

SEQ ID NO: 7560002 - DNA, 22 bp, Homo sapiens
aggagccaaaagctgaacaaga

SEQ ID NO: 7560003 - DNA, 22 bp, Homo sapiens
aggagccaaaagctgaacaaga

SEQ ID NO: 7560004 - DNA, 21 bp, Homo sapiens
aggagcattgttgtggtggag

SEQ ID NO: 7560005 - DNA, 21 bp, Homo sapiens
aggagcattgttgtggtggag

SEQ ID NO: 7560006 - DNA, 22 bp, Homo sapiens
aggagcagcttctgaaccatgt

SEQ ID NO: 7560007 - DNA, 22 bp, Homo sapiens
aggagcagcttctgaaccatgt

SEQ ID NO: 7560008 - DNA, 22 bp, Homo sapiens
cagtgcttttcaaagttctatg

SEQ ID NO: 7560009 - DNA, 22 bp, Homo sapiens
cagtgcttttaaaacaacatca

SEQ ID NO: 7560010 - DNA, 22 bp, Homo sapiens
cagtgcttttaaaacaacatca

SEQ ID NO: 7560011 - DNA, 22 bp, Homo sapiens
cagtgcttggggagcggagaga

SEQ ID NO: 7560012 - DNA, 22 bp, Homo sapiens
cagtgcttggggagcggagaga

SEQ ID NO: 7560013 - DNA, 22 bp, Homo sapiens
cagtgctttgggaggctgagga

SEQ ID NO: 7560014 - DNA, 22 bp, Homo sapiens
aggagccacctaggagctgttt

SEQ ID NO: 7560015 - DNA, 20 bp, Homo sapiens
cagtgcttcctcctttcttt

SEQ ID NO: 7560016 - DNA, 17 bp, Homo sapiens
cagtgcttctgcttctt

SEQ ID NO: 7560017 - DNA, 22 bp, Homo sapiens
cagtggaaatattggcagcatc

SEQ ID NO: 7560018 - DNA, 22 bp, Homo sapiens
cagtggaaatcagagtgagagt

SEQ ID NO: 7560019 - DNA, 22 bp, Homo sapiens
cagtggaaactatgctgctgga

SEQ ID NO: 7560020 - DNA, 22 bp, Homo sapiens
cagtgcttttcaaagttctatg

SEQ ID NO: 7560021 - DNA, 22 bp, Homo sapiens
cagtgcttttttaccttccaac

SEQ ID NO: 7560022 - DNA, 22 bp, Homo sapiens
cagtggaaactatgctgctgga

SEQ ID NO: 7560023 - DNA, 22 bp, Homo sapiens
cagtgcttttttaccttccaac

SEQ ID NO: 7560024 - DNA, 22 bp, Homo sapiens
aggagccaagatgctgtctggc

SEQ ID NO: 7560025 - DNA, 22 bp, Homo sapiens
aggagccaagatgctgtctggc

SEQ ID NO: 7560026 - DNA, 22 bp, Homo sapiens
aggagccaaattttagactctg

SEQ ID NO: 7560027 - DNA, 22 bp, Homo sapiens
aggagccaagatggggcaagta

SEQ ID NO: 7560028 - DNA, 22 bp, Homo sapiens
aggagccaagatggggcaagta

SEQ ID NO: 7560029 - DNA, 22 bp, Homo sapiens
aggagccaagatggggcaagta

SEQ ID NO: 7560030 - DNA, 22 bp, Homo sapiens
aggagccaagatgctgtctggc

SEQ ID NO: 7560031 - DNA, 22 bp, Homo sapiens
aggagccaagatggggcaagta

SEQ ID NO: 7560032 - DNA, 22 bp, Homo sapiens
aggagccaaggaaaacagtatt

SEQ ID NO: 7560033 - DNA, 22 bp, Homo sapiens
aggagccaagcagaactaagga

SEQ ID NO: 7560034 - DNA, 22 bp, Homo sapiens
aggagccaaggaaaacagtatt

SEQ ID NO: 7560035 - DNA, 22 bp, Homo sapiens
aggagccaaggaaaacagtatt

SEQ ID NO: 7560036 - DNA, 22 bp, Homo sapiens
aggagccacctaggagctgttt

SEQ ID NO: 7560037 - DNA, 22 bp, Homo sapiens
aggagccaatctgataaagcca

SEQ ID NO: 7560038 - DNA, 22 bp, Homo sapiens
cagtggaaatcagagtgagagt

SEQ ID NO: 7560039 - DNA, 22 bp, Homo sapiens
cagtggaaatattggcagcatc

SEQ ID NO: 7560040 - DNA, 22 bp, Homo sapiens
cagtggaaatcagagtgagagt

SEQ ID NO: 7560041 - DNA, 22 bp, Homo sapiens
cagtggaaatcagagtgagagt

SEQ ID NO: 7560042 - DNA, 22 bp, Homo sapiens
cagtggaaatcagagtgagagt

SEQ ID NO: 7560043 - DNA, 22 bp, Homo sapiens
cagtggaaatattggcagcatc

SEQ ID NO: 7560044 - DNA, 22 bp, Homo sapiens
cagtggaagactcagctctccc

SEQ ID NO: 7560045 - DNA, 22 bp, Homo sapiens
cagtggaaatcagagtgagagt

SEQ ID NO: 7560046 - DNA, 22 bp, Homo sapiens
cagtggaagactcagctctccc

SEQ ID NO: 7560047 - DNA, 22 bp, Homo sapiens
cagtggaatacgagcagatgtc

SEQ ID NO: 7560048 - DNA, 22 bp, Homo sapiens
cagtggaatacgagcagatgtc

SEQ ID NO: 7560049 - DNA, 22 bp, Homo sapiens
cagtggaatatataggggattt

SEQ ID NO: 7560050 - DNA, 22 bp, Homo sapiens
cagtggaagctggctgtgaaga

SEQ ID NO: 7560051 - DNA, 22 bp, Homo sapiens
cagtggaatatataggggattt

SEQ ID NO: 7560052 - DNA, 22 bp, Homo sapiens
cagtggacacttcctctacaat

SEQ ID NO: 7560053 - DNA, 22 bp, Homo sapiens
cagtggaatatataggggattt

SEQ ID NO: 7560054 - DNA, 23 bp, Homo sapiens
cagtggagactcatgcttcctta

SEQ ID NO: 7560055 - DNA, 23 bp, Homo sapiens
cagtggagactcatgcttcctta

SEQ ID NO: 7560056 - DNA, 23 bp, Homo sapiens
cagtggagactcatgcttcctta

SEQ ID NO: 7560057 - DNA, 22 bp, Homo sapiens
cagtggagagacttttactctt

SEQ ID NO: 7560058 - DNA, 22 bp, Homo sapiens
aggagctgatagtctatggaga

SEQ ID NO: 7560059 - DNA, 22 bp, Homo sapiens
aggagctgatagtctatggaga

SEQ ID NO: 7560060 - DNA, 22 bp, Homo sapiens
aggagctggcctagaaaggaga

SEQ ID NO: 7560061 - DNA, 22 bp, Homo sapiens
aggagctggcctagaaaggaga

SEQ ID NO: 7560062 - DNA, 22 bp, Homo sapiens
aggagctggcctagaaaggaga

SEQ ID NO: 7560063 - DNA, 22 bp, Homo sapiens
aggagctggcctagaaaggaga

SEQ ID NO: 7560064 - DNA, 22 bp, Homo sapiens
aggagctggccactaggatgca

SEQ ID NO: 7560065 - DNA, 22 bp, Homo sapiens
aggagctggcctagaaaggaga

SEQ ID NO: 7560066 - DNA, 22 bp, Homo sapiens
aggagctggcctagaaaggaga

SEQ ID NO: 7560067 - DNA, 22 bp, Homo sapiens
aggagctggcctagaaaggaga

SEQ ID NO: 7560068 - DNA, 22 bp, Homo sapiens
aggagctggcctagaaaggaga

SEQ ID NO: 7560069 - DNA, 22 bp, Homo sapiens
aggagctggcctagaaaggaga

SEQ ID NO: 7560070 - DNA, 22 bp, Homo sapiens
aggagctgatgattctttgatc

SEQ ID NO: 7560071 - DNA, 22 bp, Homo sapiens
aggagctgatagtctatggaga

SEQ ID NO: 7560072 - DNA, 22 bp, Homo sapiens
aggagctggccactaggatgca

SEQ ID NO: 7560073 - DNA, 22 bp, Homo sapiens
aggagctggccactaggatgca

SEQ ID NO: 7560074 - DNA, 22 bp, Homo sapiens
aggagctgatagtctatggaga

SEQ ID NO: 7560075 - DNA, 22 bp, Homo sapiens
aggagctgatagtctatggaga

SEQ ID NO: 7560076 - DNA, 22 bp, Homo sapiens
aggagctggccactaggatgca

SEQ ID NO: 7560077 - DNA, 22 bp, Homo sapiens
aggagctggccactaggatgca

SEQ ID NO: 7560078 - DNA, 22 bp, Homo sapiens
aggagctggccactaggatgca

SEQ ID NO: 7560079 - DNA, 22 bp, Homo sapiens
aggagctggccactaggatgca

SEQ ID NO: 7560080 - DNA, 22 bp, Homo sapiens
aggagctgggagaaggactaaa

SEQ ID NO: 7560081 - DNA, 22 bp, Homo sapiens
aggagctgggagaaggactaaa

SEQ ID NO: 7560082 - DNA, 22 bp, Homo sapiens
aggagctgggagaaggactaaa

SEQ ID NO: 7560083 - DNA, 22 bp, Homo sapiens
aggagctgggagaaggactaaa

SEQ ID NO: 7560084 - DNA, 22 bp, Homo sapiens
aggagctgggagaaggactaaa

SEQ ID NO: 7560085 - DNA, 22 bp, Homo sapiens
aggagctgggagaaggactaaa

SEQ ID NO: 7560086 - DNA, 22 bp, Homo sapiens
aggagctgggagaaggactaaa

SEQ ID NO: 7560087 - DNA, 22 bp, Homo sapiens
aggagctgggcccaaggatgct

SEQ ID NO: 7560088 - DNA, 22 bp, Homo sapiens
aggagctgggcccaaggatgct

SEQ ID NO: 7560089 - DNA, 22 bp, Homo sapiens
aggagctgggcccaaggatgct

SEQ ID NO: 7560090 - DNA, 22 bp, Homo sapiens
aggagctgggcccaaggatgct

SEQ ID NO: 7560091 - DNA, 22 bp, Homo sapiens
aggagctgggcccaaggatgct

SEQ ID NO: 7560092 - DNA, 22 bp, Homo sapiens
aggagctgggcccaaggatgct

SEQ ID NO: 7560093 - DNA, 22 bp, Homo sapiens
aggagctgggagaaggactaaa

SEQ ID NO: 7560094 - DNA, 17 bp, Homo sapiens
aggagctgggggtggtg

SEQ ID NO: 7560095 - DNA, 17 bp, Homo sapiens
aggagctgggggtggtg

SEQ ID NO: 7560096 - DNA, 17 bp, Homo sapiens
aggagctgggggtggtg

SEQ ID NO: 7560097 - DNA, 17 bp, Homo sapiens
aggagctgggggtggtg

SEQ ID NO: 7560098 - DNA, 17 bp, Homo sapiens
aggagctgggggtggtg

SEQ ID NO: 7560099 - DNA, 22 bp, Homo sapiens
aggagctgggctgctgctggga

SEQ ID NO: 7560100 - DNA, 22 bp, Homo sapiens
aggagctgggctgctgctggga

SEQ ID NO: 7560101 - DNA, 22 bp, Homo sapiens
aggagctgggctgctgctggga

SEQ ID NO: 7560102 - DNA, 22 bp, Homo sapiens
aggagctgggcccaaggatgct

SEQ ID NO: 7560103 - DNA, 22 bp, Homo sapiens
aggagctgggctgctgctggga

SEQ ID NO: 7560104 - DNA, 22 bp, Homo sapiens
aggagctgggctgctgctggga

SEQ ID NO: 7560105 - DNA, 22 bp, Homo sapiens
aggagctgggctgctgctggga

SEQ ID NO: 7560106 - DNA, 22 bp, Homo sapiens
aggagctgggcccaaggatgct

SEQ ID NO: 7560107 - DNA, 22 bp, Homo sapiens
aggagctgggctgctgctggga

SEQ ID NO: 7560108 - DNA, 22 bp, Homo sapiens
aggagctgggctgctgctggga

SEQ ID NO: 7560109 - DNA, 22 bp, Homo sapiens
aggagctgggctgctgctggga

SEQ ID NO: 7560110 - DNA, 22 bp, Homo sapiens
aggagctgggctgctgctggga

SEQ ID NO: 7560111 - DNA, 22 bp, Homo sapiens
aggagctgggctgctgctggga

SEQ ID NO: 7560112 - DNA, 22 bp, Homo sapiens
aggagctgggctgctgctggga

SEQ ID NO: 7560113 - DNA, 22 bp, Homo sapiens
aggagctgggctgctgctggga

SEQ ID NO: 7560114 - DNA, 23 bp, Homo sapiens
cagtctgcagcccacttgggcag

SEQ ID NO: 7560115 - DNA, 23 bp, Homo sapiens
cagtctgcagcccacttgggcag

SEQ ID NO: 7560116 - DNA, 22 bp, Homo sapiens
cagtctgaacactgggctactc

SEQ ID NO: 7560117 - DNA, 22 bp, Homo sapiens
cagtctgaacactgggctactc

SEQ ID NO: 7560118 - DNA, 22 bp, Homo sapiens
aggacaagacaaggaccagaga

SEQ ID NO: 7560119 - DNA, 22 bp, Homo sapiens
aggacaagacaaggaccagaga

SEQ ID NO: 7560120 - DNA, 22 bp, Homo sapiens
aggacaagacaaggaccagaga

SEQ ID NO: 7560121 - DNA, 22 bp, Homo sapiens
aggacaagacaaggaccagaga

SEQ ID NO: 7560122 - DNA, 22 bp, Homo sapiens
aggacaaaggaccagatctgga

SEQ ID NO: 7560123 - DNA, 22 bp, Homo sapiens
aggacaaaggaccagatctgga

SEQ ID NO: 7560124 - DNA, 22 bp, Homo sapiens
aggacaagacaaggaccagaga

SEQ ID NO: 7560125 - DNA, 22 bp, Homo sapiens
aggacaagacaaggaccagaga

SEQ ID NO: 7560126 - DNA, 22 bp, Homo sapiens
aggacaaaggaccagatctgga

SEQ ID NO: 7560127 - DNA, 22 bp, Homo sapiens
aggacaaaggaccagatctgga

SEQ ID NO: 7560128 - DNA, 22 bp, Homo sapiens
aggacaaaggaccagatctgga

SEQ ID NO: 7560129 - DNA, 22 bp, Homo sapiens
aggaatttttctagccggagtt

SEQ ID NO: 7560130 - DNA, 22 bp, Homo sapiens
aggaattttgtatggatactgt

SEQ ID NO: 7560131 - DNA, 22 bp, Homo sapiens
aggacaaaggaccagatctgga

SEQ ID NO: 7560132 - DNA, 22 bp, Homo sapiens
aggacaaaggaccagatctgga

SEQ ID NO: 7560133 - DNA, 22 bp, Homo sapiens
cagtgaggagtccagggcagag

SEQ ID NO: 7560134 - DNA, 22 bp, Homo sapiens
cagtgaggagtccagggcagag

SEQ ID NO: 7560135 - DNA, 22 bp, Homo sapiens
cagtgaggagtccagggcagag

SEQ ID NO: 7560136 - DNA, 22 bp, Homo sapiens
cagtgaggagtccagggcagag

SEQ ID NO: 7560137 - DNA, 20 bp, Homo sapiens
cagtgaggaggtgctggggg

SEQ ID NO: 7560138 - DNA, 22 bp, Homo sapiens
cagtgaggagtccagggcagag

SEQ ID NO: 7560139 - DNA, 22 bp, Homo sapiens
cagtgaggagtccagggcagag

SEQ ID NO: 7560140 - DNA, 22 bp, Homo sapiens
cagtgaggagtccagggcagag

SEQ ID NO: 7560141 - DNA, 22 bp, Homo sapiens
cagtgaggagtccagggcagag

SEQ ID NO: 7560142 - DNA, 22 bp, Homo sapiens
cagtgaggagtccagggcagag

SEQ ID NO: 7560143 - DNA, 18 bp, Homo sapiens
cagtgaggatgaagggtt

SEQ ID NO: 7560144 - DNA, 22 bp, Homo sapiens
cagtgaggagtccagggcagag

SEQ ID NO: 7560145 - DNA, 18 bp, Homo sapiens
cagtgaggatgaagggtt

SEQ ID NO: 7560146 - DNA, 18 bp, Homo sapiens
cagtgaggatgaagggtt

SEQ ID NO: 7560147 - DNA, 18 bp, Homo sapiens
cagtgaggatgaagggtt

SEQ ID NO: 7560148 - DNA, 22 bp, Homo sapiens
cagtgaggatgataattaaggt

SEQ ID NO: 7560149 - DNA, 22 bp, Homo sapiens
aggaattactcatctgtggtat

SEQ ID NO: 7560150 - DNA, 22 bp, Homo sapiens
aggaattactcatctgtggtat

SEQ ID NO: 7560151 - DNA, 22 bp, Homo sapiens
aggaattactcatctgtggtat

SEQ ID NO: 7560152 - DNA, 22 bp, Homo sapiens
aggaattcaagaccagctgggc

SEQ ID NO: 7560153 - DNA, 22 bp, Homo sapiens
aggaattcaagaccagctgggc

SEQ ID NO: 7560154 - DNA, 22 bp, Homo sapiens
aggaattcaagaccagctgggc

SEQ ID NO: 7560155 - DNA, 22 bp, Homo sapiens
aggaattcaagaccagctgggc

SEQ ID NO: 7560156 - DNA, 22 bp, Homo sapiens
aggaattcaagaccagctgggc

SEQ ID NO: 7560157 - DNA, 22 bp, Homo sapiens
aggaattcaagaccagctgggc

SEQ ID NO: 7560158 - DNA, 22 bp, Homo sapiens
aggaattatagtagtatttgtc

SEQ ID NO: 7560159 - DNA, 22 bp, Homo sapiens
aggaattatttgtcttagtctt

SEQ ID NO: 7560160 - DNA, 22 bp, Homo sapiens
aggaattatttgtcttagtctt

SEQ ID NO: 7560161 - DNA, 22 bp, Homo sapiens
aggaattgcctggggcctggga

SEQ ID NO: 7560162 - DNA, 22 bp, Homo sapiens
aggaattgagatcctaggtttt

SEQ ID NO: 7560163 - DNA, 22 bp, Homo sapiens
aggaattcctgggaaggcacag

SEQ ID NO: 7560164 - DNA, 22 bp, Homo sapiens
aggaattctgtctctagacatt

SEQ ID NO: 7560165 - DNA, 22 bp, Homo sapiens
aggaattctgtctctagacatt

SEQ ID NO: 7560166 - DNA, 22 bp, Homo sapiens
aggaattgagatcctaggtttt

SEQ ID NO: 7560167 - DNA, 22 bp, Homo sapiens
aggaattcaagaccagctgggc

SEQ ID NO: 7560168 - DNA, 22 bp, Homo sapiens
aggaattcaagaccagctgggc

SEQ ID NO: 7560169 - DNA, 22 bp, Homo sapiens
aggaattcaagaccagctgggc

SEQ ID NO: 7560170 - DNA, 22 bp, Homo sapiens
aggaattcaagaccagctgggc

SEQ ID NO: 7560171 - DNA, 22 bp, Homo sapiens
aggaatttggggttacatgatg

SEQ ID NO: 7560172 - DNA, 22 bp, Homo sapiens
aggaatttggggttacatgatg

SEQ ID NO: 7560173 - DNA, 22 bp, Homo sapiens
aggaatttggggttacatgatg

SEQ ID NO: 7560174 - DNA, 22 bp, Homo sapiens
aggaatttgctggaacacagat

SEQ ID NO: 7560175 - DNA, 22 bp, Homo sapiens
aggaatttgctggaacacagat

SEQ ID NO: 7560176 - DNA, 22 bp, Homo sapiens
aggaattttaatatgcttgtct

SEQ ID NO: 7560177 - DNA, 22 bp, Homo sapiens
aggaattttaatatgcttgtct

SEQ ID NO: 7560178 - DNA, 22 bp, Homo sapiens
aggaatttggggttacatgatg

SEQ ID NO: 7560179 - DNA, 22 bp, Homo sapiens
aggaattttacatctcagagag

SEQ ID NO: 7560180 - DNA, 22 bp, Homo sapiens
aggaattttacaagctggttgc

SEQ ID NO: 7560181 - DNA, 22 bp, Homo sapiens
aggaattttgtatggatactgt

SEQ ID NO: 7560182 - DNA, 22 bp, Homo sapiens
aggaattttcacagttgggtat

SEQ ID NO: 7560183 - DNA, 22 bp, Homo sapiens
aggaattttacatctcagagag

SEQ ID NO: 7560184 - DNA, 22 bp, Homo sapiens
aggaatttgagtgctgtaggaa

SEQ ID NO: 7560185 - DNA, 19 bp, Homo sapiens
aggaatttctcagggaggc

SEQ ID NO: 7560186 - DNA, 19 bp, Homo sapiens
aggaatttctcagggaggc

SEQ ID NO: 7560187 - DNA, 22 bp, Homo sapiens
aggaatttagacagggcataaa

SEQ ID NO: 7560188 - DNA, 22 bp, Homo sapiens
aggaatttagacagggcataaa

SEQ ID NO: 7560189 - DNA, 22 bp, Homo sapiens
aggaatttaagggctcagagag

SEQ ID NO: 7560190 - DNA, 22 bp, Homo sapiens
aggaatttaagggctcagagag

SEQ ID NO: 7560191 - DNA, 22 bp, Homo sapiens
aggaattgtgttgtagtggaga

SEQ ID NO: 7560192 - DNA, 20 bp, Homo sapiens
aggagatgatccagagtcag

SEQ ID NO: 7560193 - DNA, 20 bp, Homo sapiens
aggagatgatccagagtcag

SEQ ID NO: 7560194 - DNA, 21 bp, Homo sapiens
cagtgcaggggttagcgtgta

SEQ ID NO: 7560195 - DNA, 21 bp, Homo sapiens
cagtgcaggggttagcgtgta

SEQ ID NO: 7560196 - DNA, 21 bp, Homo sapiens
cagtgcaggggttagcgtgta

SEQ ID NO: 7560197 - DNA, 20 bp, Homo sapiens
aggagatgatccagagtcag

SEQ ID NO: 7560198 - DNA, 20 bp, Homo sapiens
aggagatgatccagagtcag

SEQ ID NO: 7560199 - DNA, 23 bp, Homo sapiens
cagtgcagggcaactcagactcc

SEQ ID NO: 7560200 - DNA, 23 bp, Homo sapiens
cagtgcagggcaactcagactcc

SEQ ID NO: 7560201 - DNA, 23 bp, Homo sapiens
cagtgcagggcaactcagactcc

SEQ ID NO: 7560202 - DNA, 22 bp, Homo sapiens
cagtgcaggctgggggccctgc

SEQ ID NO: 7560203 - DNA, 22 bp, Homo sapiens
cagtgcaggcttgtggccgcag

SEQ ID NO: 7560204 - DNA, 22 bp, Homo sapiens
cagtgcaggcttgtggccgcag

SEQ ID NO: 7560205 - DNA, 22 bp, Homo sapiens
cagtgcaggctgggggccctgc

SEQ ID NO: 7560206 - DNA, 22 bp, Homo sapiens
cagtgcaggctgggggccctgc

SEQ ID NO: 7560207 - DNA, 22 bp, Homo sapiens
cagtgcaggcttgtggccgcag

SEQ ID NO: 7560208 - DNA, 23 bp, Homo sapiens
cagtgcagggcaactcagactcc

SEQ ID NO: 7560209 - DNA, 23 bp, Homo sapiens
cagtgcagggcaactcagactcc

SEQ ID NO: 7560210 - DNA, 23 bp, Homo sapiens
cagtgcagggcaactcagactcc

SEQ ID NO: 7560211 - DNA, 22 bp, Homo sapiens
cagtgcaggctgggggccctgc

SEQ ID NO: 7560212 - DNA, 22 bp, Homo sapiens
cagtgcaggctgggggccctgc

SEQ ID NO: 7560213 - DNA, 22 bp, Homo sapiens
cagtgcaggaagtgagatgcct

SEQ ID NO: 7560214 - DNA, 22 bp, Homo sapiens
cagtgcaggaagtgagatgcct

SEQ ID NO: 7560215 - DNA, 22 bp, Homo sapiens
cagtgcaggaagtgagatgcct

SEQ ID NO: 7560216 - DNA, 22 bp, Homo sapiens
cagtgcaggaagtgagatgcct

SEQ ID NO: 7560217 - DNA, 22 bp, Homo sapiens
cagtgcaggaagtgagatgcct

SEQ ID NO: 7560218 - DNA, 22 bp, Homo sapiens
cagtgcaggaagtgagatgcct

SEQ ID NO: 7560219 - DNA, 22 bp, Homo sapiens
cagtgcaggaagtgagatgcct

SEQ ID NO: 7560220 - DNA, 22 bp, Homo sapiens
cagtgcagctgccccgctggta

SEQ ID NO: 7560221 - DNA, 22 bp, Homo sapiens
cagtgcagccaaggacaggcac

SEQ ID NO: 7560222 - DNA, 22 bp, Homo sapiens
cagtgcagccaaggacaggcac

SEQ ID NO: 7560223 - DNA, 22 bp, Homo sapiens
cagtgcagctgccccgctggta

SEQ ID NO: 7560224 - DNA, 22 bp, Homo sapiens
cagtgcagccaaggacaggcac

SEQ ID NO: 7560225 - DNA, 22 bp, Homo sapiens
cagtgcagccaaggacaggcac

SEQ ID NO: 7560226 - DNA, 22 bp, Homo sapiens
cagtgcagccaaggacaggcac

SEQ ID NO: 7560227 - DNA, 22 bp, Homo sapiens
cagtgaggctctgctgagcggt

SEQ ID NO: 7560228 - DNA, 22 bp, Homo sapiens
cagtgaggctctgctgagcggt

SEQ ID NO: 7560229 - DNA, 22 bp, Homo sapiens
cagtgaggctctgctgagcggt

SEQ ID NO: 7560230 - DNA, 22 bp, Homo sapiens
cagtgaggctctgctgagcggt

SEQ ID NO: 7560231 - DNA, 22 bp, Homo sapiens
cagtgaggctctgctgagcggt

SEQ ID NO: 7560232 - DNA, 22 bp, Homo sapiens
cagtgagggaagatctcagcac

SEQ ID NO: 7560233 - DNA, 22 bp, Homo sapiens
cagtgagggaagatctcagcac

SEQ ID NO: 7560234 - DNA, 22 bp, Homo sapiens
cagtgagggaagatctcagcac

SEQ ID NO: 7560235 - DNA, 22 bp, Homo sapiens
cagtgagggaagatctcagcac

SEQ ID NO: 7560236 - DNA, 22 bp, Homo sapiens
cagtgagggaagatctcagcac

SEQ ID NO: 7560237 - DNA, 17 bp, Homo sapiens
cagtgaggcctttcctc

SEQ ID NO: 7560238 - DNA, 22 bp, Homo sapiens
cagtgaggctctgctgagcggt

SEQ ID NO: 7560239 - DNA, 22 bp, Homo sapiens
cagtgaggctctgctgagcggt

SEQ ID NO: 7560240 - DNA, 22 bp, Homo sapiens
cagtgaggctctgctgagcggt

SEQ ID NO: 7560241 - DNA, 17 bp, Homo sapiens
cagtgaggcctttcctc

SEQ ID NO: 7560242 - DNA, 21 bp, Homo sapiens
cagtgaggccctcctgttccc

SEQ ID NO: 7560243 - DNA, 17 bp, Homo sapiens
cagtgaggcctttcctc

SEQ ID NO: 7560244 - DNA, 21 bp, Homo sapiens
cagtgaggccctcctgttccc

SEQ ID NO: 7560245 - DNA, 21 bp, Homo sapiens
cagtgaggccctcctgttccc

SEQ ID NO: 7560246 - DNA, 21 bp, Homo sapiens
cagtgaggccctcctgttccc

SEQ ID NO: 7560247 - DNA, 22 bp, Homo sapiens
cagtgagggcattcagtgctgg

SEQ ID NO: 7560248 - DNA, 22 bp, Homo sapiens
cagtgagggcattcagtgctgg

SEQ ID NO: 7560249 - DNA, 22 bp, Homo sapiens
cagtgagggcattcagtgctgg

SEQ ID NO: 7560250 - DNA, 22 bp, Homo sapiens
cagtgagggcattcagtgctgg

SEQ ID NO: 7560251 - DNA, 22 bp, Homo sapiens
cagtgagggcattcagtgctgg

SEQ ID NO: 7560252 - DNA, 22 bp, Homo sapiens
cagtgagggcattcagtgctgg

SEQ ID NO: 7560253 - DNA, 22 bp, Homo sapiens
cagtgagggcattcagtgctgg

SEQ ID NO: 7560254 - DNA, 22 bp, Homo sapiens
cagtgagggcattcagtgctgg

SEQ ID NO: 7560255 - DNA, 22 bp, Homo sapiens
cagtgagggcattcagtgctgg

SEQ ID NO: 7560256 - DNA, 22 bp, Homo sapiens
cagtgagggcattcagtgctgg

SEQ ID NO: 7560257 - DNA, 22 bp, Homo sapiens
cagtgagggcccccttccaggt

SEQ ID NO: 7560258 - DNA, 22 bp, Homo sapiens
cagtgagggcccccttccaggt

SEQ ID NO: 7560259 - DNA, 22 bp, Homo sapiens
cagtgagggcccccttccaggt

SEQ ID NO: 7560260 - DNA, 22 bp, Homo sapiens
cagtgagggcccccttccaggt

SEQ ID NO: 7560261 - DNA, 17 bp, Homo sapiens
cagtgcagataagtgag

SEQ ID NO: 7560262 - DNA, 22 bp, Homo sapiens
cagtgcagccaaggacaggcac

SEQ ID NO: 7560263 - DNA, 22 bp, Homo sapiens
cagtgcagccaaggacaggcac

SEQ ID NO: 7560264 - DNA, 22 bp, Homo sapiens
cagtgcagccaaggacaggcac

SEQ ID NO: 7560265 - DNA, 22 bp, Homo sapiens
cagtgcagccaaggacaggcac

SEQ ID NO: 7560266 - DNA, 17 bp, Homo sapiens
cagtgcagataagtgag

SEQ ID NO: 7560267 - DNA, 22 bp, Homo sapiens
catcatttcacttagatgaagt

SEQ ID NO: 7560268 - DNA, 22 bp, Homo sapiens
catcatttcacttagatgaagt

SEQ ID NO: 7560269 - DNA, 22 bp, Homo sapiens
catcatttcacttagatgaagt

SEQ ID NO: 7560270 - DNA, 22 bp, Homo sapiens
catcatttgttcacttgattcc

SEQ ID NO: 7560271 - DNA, 22 bp, Homo sapiens
catcatttgttcacttgattcc

SEQ ID NO: 7560272 - DNA, 22 bp, Homo sapiens
catcatttgttcacttgattcc

SEQ ID NO: 7560273 - DNA, 22 bp, Homo sapiens
catcatttgtttgcatgcagga

SEQ ID NO: 7560274 - DNA, 22 bp, Homo sapiens
catcatttgttcacttgattcc

SEQ ID NO: 7560275 - DNA, 22 bp, Homo sapiens
catcatttgtttgcatgcagga

SEQ ID NO: 7560276 - DNA, 22 bp, Homo sapiens
catcatttgtttgcatgcagga

SEQ ID NO: 7560277 - DNA, 22 bp, Homo sapiens
catcatttgtttgcatgcagga

SEQ ID NO: 7560278 - DNA, 22 bp, Homo sapiens
catcatttgtttgcatgcagga

SEQ ID NO: 7560279 - DNA, 20 bp, Homo sapiens
catcattttaaaatctctcc

SEQ ID NO: 7560280 - DNA, 22 bp, Homo sapiens
catcattttattaaccaagaaa

SEQ ID NO: 7560281 - DNA, 22 bp, Homo sapiens
catcattttattaaccaagaaa

SEQ ID NO: 7560282 - DNA, 22 bp, Homo sapiens
catcattttattaaccaagaaa

SEQ ID NO: 7560283 - DNA, 22 bp, Homo sapiens
catcatttaattataggggctg

SEQ ID NO: 7560284 - DNA, 22 bp, Homo sapiens
catcatttcacttagatgaagt

SEQ ID NO: 7560285 - DNA, 22 bp, Homo sapiens
catcatttcacttagatgaagt

SEQ ID NO: 7560286 - DNA, 22 bp, Homo sapiens
catcatttcacttagatgaagt

SEQ ID NO: 7560287 - DNA, 22 bp, Homo sapiens
catcatttcacttagatgaagt

SEQ ID NO: 7560288 - DNA, 23 bp, Homo sapiens
catcattgttatgggtgctacta

SEQ ID NO: 7560289 - DNA, 22 bp, Homo sapiens
catcattgttagggactctaac

SEQ ID NO: 7560290 - DNA, 22 bp, Homo sapiens
catcatttaattataggggctg

SEQ ID NO: 7560291 - DNA, 22 bp, Homo sapiens
catcattcctaggtgcagagct

SEQ ID NO: 7560292 - DNA, 19 bp, Homo sapiens
catcattatcagttcactg

SEQ ID NO: 7560293 - DNA, 22 bp, Homo sapiens
catcattcctaggtgcagagct

SEQ ID NO: 7560294 - DNA, 22 bp, Homo sapiens
catcattcctaggtgcagagct

SEQ ID NO: 7560295 - DNA, 22 bp, Homo sapiens
catcattaccttgtaaccaata

SEQ ID NO: 7560296 - DNA, 22 bp, Homo sapiens
catcattaccatcattagtagt

SEQ ID NO: 7560297 - DNA, 22 bp, Homo sapiens
catcattaccatcattagtagt

SEQ ID NO: 7560298 - DNA, 22 bp, Homo sapiens
catcattaccatcattagtagt

SEQ ID NO: 7560299 - DNA, 22 bp, Homo sapiens
catcatgccccgctacagtgca

SEQ ID NO: 7560300 - DNA, 21 bp, Homo sapiens
catcatgcttgtgttggagaa

SEQ ID NO: 7560301 - DNA, 22 bp, Homo sapiens
aggagtggtgcaggacctgcca

SEQ ID NO: 7560302 - DNA, 22 bp, Homo sapiens
aggagtggtgcaggacctgcca

SEQ ID NO: 7560303 - DNA, 22 bp, Homo sapiens
aggagtggtgcaggacctgcca

SEQ ID NO: 7560304 - DNA, 22 bp, Homo sapiens
aggagtggtgcaggacctgcca

SEQ ID NO: 7560305 - DNA, 22 bp, Homo sapiens
aggagtgggggcgagaagttaa

SEQ ID NO: 7560306 - DNA, 22 bp, Homo sapiens
aggagtgggggcgagaagttaa

SEQ ID NO: 7560307 - DNA, 22 bp, Homo sapiens
aggagtgggggcgagaagttaa

SEQ ID NO: 7560308 - DNA, 22 bp, Homo sapiens
aggagtgggggcgagaagttaa

SEQ ID NO: 7560309 - DNA, 22 bp, Homo sapiens
aggagtgggggcgagaagttaa

SEQ ID NO: 7560310 - DNA, 22 bp, Homo sapiens
aggagtggtgcaggacctgcca

SEQ ID NO: 7560311 - DNA, 22 bp, Homo sapiens
aggagtgtgaagagcctagatc

SEQ ID NO: 7560312 - DNA, 22 bp, Homo sapiens
aggagtggtgcaggacctgcca

SEQ ID NO: 7560313 - DNA, 22 bp, Homo sapiens
aggagtggtgcaggacctgcca

SEQ ID NO: 7560314 - DNA, 22 bp, Homo sapiens
aggagtggtgcaggacctgcca

SEQ ID NO: 7560315 - DNA, 22 bp, Homo sapiens
aggagtgtggccagggctctgg

SEQ ID NO: 7560316 - DNA, 22 bp, Homo sapiens
aggagtgtgaagagcctagatc

SEQ ID NO: 7560317 - DNA, 22 bp, Homo sapiens
aggagtgttcagcgtggggatg

SEQ ID NO: 7560318 - DNA, 22 bp, Homo sapiens
aggagtgtgaagagcctagatc

SEQ ID NO: 7560319 - DNA, 22 bp, Homo sapiens
aggagtgtggccagggctctgg

SEQ ID NO: 7560320 - DNA, 22 bp, Homo sapiens
aggagtgttagagtagagctgg

SEQ ID NO: 7560321 - DNA, 22 bp, Homo sapiens
aggaggtgttgatagaaggttt

SEQ ID NO: 7560322 - DNA, 22 bp, Homo sapiens
aggaggttgccagtctgggggt

SEQ ID NO: 7560323 - DNA, 22 bp, Homo sapiens
aggaggtgttgatagaaggttt

SEQ ID NO: 7560324 - DNA, 22 bp, Homo sapiens
aggagtatctaataatctgaga

SEQ ID NO: 7560325 - DNA, 22 bp, Homo sapiens
aggagtgggggcgagaagttaa

SEQ ID NO: 7560326 - DNA, 22 bp, Homo sapiens
aggagtatctaataatctgaga

SEQ ID NO: 7560327 - DNA, 22 bp, Homo sapiens
aggagtcacctgcccaaagtca

SEQ ID NO: 7560328 - DNA, 22 bp, Homo sapiens
aggagtcacctgcccaaagtca

SEQ ID NO: 7560329 - DNA, 22 bp, Homo sapiens
catcatttttgtaagctggtag

SEQ ID NO: 7560330 - DNA, 22 bp, Homo sapiens
catcatttttgtaagctggtag

SEQ ID NO: 7560331 - DNA, 22 bp, Homo sapiens
catcatttttgtaagctggtag

SEQ ID NO: 7560332 - DNA, 20 bp, Homo sapiens
catcattttaaaatctctcc

SEQ ID NO: 7560333 - DNA, 22 bp, Homo sapiens
catcattttattaaccaagaaa

SEQ ID NO: 7560334 - DNA, 22 bp, Homo sapiens
catcattttattaaccaagaaa

SEQ ID NO: 7560335 - DNA, 22 bp, Homo sapiens
catcattttgtatccaagggga

SEQ ID NO: 7560336 - DNA, 22 bp, Homo sapiens
catcattttattaaccaagaaa

SEQ ID NO: 7560337 - DNA, 22 bp, Homo sapiens
aggaggggcatagaaatgtaat

SEQ ID NO: 7560338 - DNA, 22 bp, Homo sapiens
aggaggggcaatgatagtctgg

SEQ ID NO: 7560339 - DNA, 21 bp, Homo sapiens
aggaggctgtctctttcagct

SEQ ID NO: 7560340 - DNA, 22 bp, Homo sapiens
aggaggctggttcaggccatat

SEQ ID NO: 7560341 - DNA, 22 bp, Homo sapiens
aggaggctggttcaggccatat

SEQ ID NO: 7560342 - DNA, 22 bp, Homo sapiens
aggaggctggttcaggccatat

SEQ ID NO: 7560343 - DNA, 22 bp, Homo sapiens
aggaggctggttcaggccatat

SEQ ID NO: 7560344 - DNA, 22 bp, Homo sapiens
aggaggctggttcaggccatat

SEQ ID NO: 7560345 - DNA, 22 bp, Homo sapiens
aggaggctggttcaggccatat

SEQ ID NO: 7560346 - DNA, 22 bp, Homo sapiens
aggaggctggttcaggccatat

SEQ ID NO: 7560347 - DNA, 22 bp, Homo sapiens
aggaggctggttcaggccatat

SEQ ID NO: 7560348 - DNA, 22 bp, Homo sapiens
aggaggctggttcaggccatat

SEQ ID NO: 7560349 - DNA, 22 bp, Homo sapiens
aggaggctggttcaggccatat

SEQ ID NO: 7560350 - DNA, 22 bp, Homo sapiens
aggaggctggttcaggccatat

SEQ ID NO: 7560351 - DNA, 22 bp, Homo sapiens
aggaggctggttcaggccatat

SEQ ID NO: 7560352 - DNA, 22 bp, Homo sapiens
aggaggctggttcaggccatat

SEQ ID NO: 7560353 - DNA, 22 bp, Homo sapiens
aggaggggcaatgatagtctgg

SEQ ID NO: 7560354 - DNA, 22 bp, Homo sapiens
aggagggtggcctcatgtgagt

SEQ ID NO: 7560355 - DNA, 22 bp, Homo sapiens
aggagggtggcctcatgtgagt

SEQ ID NO: 7560356 - DNA, 22 bp, Homo sapiens
aggagggtggcctcatgtgagt

SEQ ID NO: 7560357 - DNA, 22 bp, Homo sapiens
aggagggtggcctcatgtgagt

SEQ ID NO: 7560358 - DNA, 22 bp, Homo sapiens
aggagggtggcctcatgtgagt

SEQ ID NO: 7560359 - DNA, 22 bp, Homo sapiens
aggagggtggcctcatgtgagt

SEQ ID NO: 7560360 - DNA, 22 bp, Homo sapiens
aggagggtggggtctgcctgtc

SEQ ID NO: 7560361 - DNA, 22 bp, Homo sapiens
aggagggtggggtctgcctgtc

SEQ ID NO: 7560362 - DNA, 22 bp, Homo sapiens
aggagggtggggtctgcctgtc

SEQ ID NO: 7560363 - DNA, 22 bp, Homo sapiens
aggagggtgggaagcagtttta

SEQ ID NO: 7560364 - DNA, 22 bp, Homo sapiens
aggagggttctctggacagagg

SEQ ID NO: 7560365 - DNA, 22 bp, Homo sapiens
aggagggttctctggacagagg

SEQ ID NO: 7560366 - DNA, 22 bp, Homo sapiens
aggagggttctctggacagagg

SEQ ID NO: 7560367 - DNA, 22 bp, Homo sapiens
aggagggtggggtctgcctgtc

SEQ ID NO: 7560368 - DNA, 22 bp, Homo sapiens
aggagggttctctggacagagg

SEQ ID NO: 7560369 - DNA, 22 bp, Homo sapiens
aggagggttctctggacagagg

SEQ ID NO: 7560370 - DNA, 22 bp, Homo sapiens
aggagggttctctggacagagg

SEQ ID NO: 7560371 - DNA, 22 bp, Homo sapiens
aggagggtggggtctgcctgtc

SEQ ID NO: 7560372 - DNA, 22 bp, Homo sapiens
aggagggtggggtctgcctgtc

SEQ ID NO: 7560373 - DNA, 22 bp, Homo sapiens
aggagggtggggtctgcctgtc

SEQ ID NO: 7560374 - DNA, 22 bp, Homo sapiens
aggagggttctctggacagagg

SEQ ID NO: 7560375 - DNA, 22 bp, Homo sapiens
aggagggttctctggacagagg

SEQ ID NO: 7560376 - DNA, 22 bp, Homo sapiens
aggagggtttcaatgggatgag

SEQ ID NO: 7560377 - DNA, 22 bp, Homo sapiens
aggagggtttcaatgggatgag

SEQ ID NO: 7560378 - DNA, 22 bp, Homo sapiens
aggagggtttcaatgggatgag

SEQ ID NO: 7560379 - DNA, 22 bp, Homo sapiens
aggagggtttcaatgggatgag

SEQ ID NO: 7560380 - DNA, 22 bp, Homo sapiens
aggagggttgaggaggatactt

SEQ ID NO: 7560381 - DNA, 22 bp, Homo sapiens
aggagggttgaggaggatactt

SEQ ID NO: 7560382 - DNA, 22 bp, Homo sapiens
aggagggttgaggaggatactt

SEQ ID NO: 7560383 - DNA, 20 bp, Homo sapiens
aggagggtttctctgacaca

SEQ ID NO: 7560384 - DNA, 22 bp, Homo sapiens
aggaggtcagagccccatgctg

SEQ ID NO: 7560385 - DNA, 22 bp, Homo sapiens
aggaggtcagagccccatgctg

SEQ ID NO: 7560386 - DNA, 22 bp, Homo sapiens
aggaggtagtcttataaatgtt

SEQ ID NO: 7560387 - DNA, 20 bp, Homo sapiens
aggagggtttctctgacaca

SEQ ID NO: 7560388 - DNA, 20 bp, Homo sapiens
aggagggtttctctgacaca

SEQ ID NO: 7560389 - DNA, 22 bp, Homo sapiens
aggagggtttcaatgggatgag

SEQ ID NO: 7560390 - DNA, 22 bp, Homo sapiens
aggagggtttcaatgggatgag

SEQ ID NO: 7560391 - DNA, 22 bp, Homo sapiens
aggagggtttcaatgggatgag

SEQ ID NO: 7560392 - DNA, 22 bp, Homo sapiens
aggaggtgagcggtcatgtggt

SEQ ID NO: 7560393 - DNA, 22 bp, Homo sapiens
aggaggtgagcggtcatgtggt

SEQ ID NO: 7560394 - DNA, 22 bp, Homo sapiens
aggaggtgagcggtcatgtggt

SEQ ID NO: 7560395 - DNA, 22 bp, Homo sapiens
aggaggtgagcggtcatgtggt

SEQ ID NO: 7560396 - DNA, 22 bp, Homo sapiens
aggaggtgagcggtcatgtggt

SEQ ID NO: 7560397 - DNA, 23 bp, Homo sapiens
catcatgcaatcttgggatttct

SEQ ID NO: 7560398 - DNA, 22 bp, Homo sapiens
aggaggtgagcggtcatgtggt

SEQ ID NO: 7560399 - DNA, 22 bp, Homo sapiens
catcatgccccgctacagtgca

SEQ ID NO: 7560400 - DNA, 22 bp, Homo sapiens
aggaggtgagcggtcatgtggt

SEQ ID NO: 7560401 - DNA, 22 bp, Homo sapiens
aggaggtcagagccccatgctg

SEQ ID NO: 7560402 - DNA, 22 bp, Homo sapiens
aggaggtgacagcctgcatctg

SEQ ID NO: 7560403 - DNA, 22 bp, Homo sapiens
aggaggtgacagcctgcatctg

SEQ ID NO: 7560404 - DNA, 22 bp, Homo sapiens
aggaggtgacagcctgcatctg

SEQ ID NO: 7560405 - DNA, 22 bp, Homo sapiens
aggaggtgacagcctgcatctg

SEQ ID NO: 7560406 - DNA, 22 bp, Homo sapiens
aggaggtgacagcctgcatctg

SEQ ID NO: 7560407 - DNA, 22 bp, Homo sapiens
aggaggtgacagcctgcatctg

SEQ ID NO: 7560408 - DNA, 22 bp, Homo sapiens
cagttctctgtgcctcgctggg

SEQ ID NO: 7560409 - DNA, 21 bp, Homo sapiens
cagttctcttagatttccagt

SEQ ID NO: 7560410 - DNA, 22 bp, Homo sapiens
cagttctcttgatcgtctcttg

SEQ ID NO: 7560411 - DNA, 22 bp, Homo sapiens
cagttctctttccactggaggc

SEQ ID NO: 7560412 - DNA, 22 bp, Homo sapiens
cagttctacttggatgtctgca

SEQ ID NO: 7560413 - DNA, 22 bp, Homo sapiens
cagttctaattaataggagtaa

SEQ ID NO: 7560414 - DNA, 22 bp, Homo sapiens
cagttccttgagaatggttgct

SEQ ID NO: 7560415 - DNA, 21 bp, Homo sapiens
cagttcgtcttagaaaatggc

SEQ ID NO: 7560416 - DNA, 22 bp, Homo sapiens
cagttcctcaaaggttaaatgt

SEQ ID NO: 7560417 - DNA, 22 bp, Homo sapiens
cagttcctatgggcaaaacaca

SEQ ID NO: 7560418 - DNA, 22 bp, Homo sapiens
cagttcccttcttctggcccct

SEQ ID NO: 7560419 - DNA, 22 bp, Homo sapiens
cagttccctaatgtgtagaaga

SEQ ID NO: 7560420 - DNA, 22 bp, Homo sapiens
cagttctgactttcataatgtc

SEQ ID NO: 7560421 - DNA, 22 bp, Homo sapiens
cagttctctttccactggaggc

SEQ ID NO: 7560422 - DNA, 22 bp, Homo sapiens
cagttctctttccactggaggc

SEQ ID NO: 7560423 - DNA, 22 bp, Homo sapiens
catattttagttgctgaacagc

SEQ ID NO: 7560424 - DNA, 22 bp, Homo sapiens
catattttagttgctgaacagc

SEQ ID NO: 7560425 - DNA, 22 bp, Homo sapiens
catattttagttgctgaacagc

SEQ ID NO: 7560426 - DNA, 22 bp, Homo sapiens
catattttagttgctgaacagc

SEQ ID NO: 7560427 - DNA, 19 bp, Homo sapiens
catatttttgggctggcat

SEQ ID NO: 7560428 - DNA, 19 bp, Homo sapiens
catatttttgggctggcat

SEQ ID NO: 7560429 - DNA, 22 bp, Homo sapiens
catattttagttgctgaacagc

SEQ ID NO: 7560430 - DNA, 19 bp, Homo sapiens
catatttttgggctggcat

SEQ ID NO: 7560431 - DNA, 22 bp, Homo sapiens
catcactacaaatttaagaaat

SEQ ID NO: 7560432 - DNA, 22 bp, Homo sapiens
catcactacaaatttaagaaat

SEQ ID NO: 7560433 - DNA, 22 bp, Homo sapiens
catcactacaaatttaagaaat

SEQ ID NO: 7560434 - DNA, 22 bp, Homo sapiens
catcacatttaattaaaatgtc

SEQ ID NO: 7560435 - DNA, 22 bp, Homo sapiens
catcacatttaattaaaatgtc

SEQ ID NO: 7560436 - DNA, 19 bp, Homo sapiens
catatttttgggctggcat

SEQ ID NO: 7560437 - DNA, 22 bp, Homo sapiens
catcacatttaattaaaatgtc

SEQ ID NO: 7560438 - DNA, 22 bp, Homo sapiens
cagttcaagagaaatactactg

SEQ ID NO: 7560439 - DNA, 22 bp, Homo sapiens
cagttcaagagaaatactactg

SEQ ID NO: 7560440 - DNA, 22 bp, Homo sapiens
cagttcaaagttaagcagcagt

SEQ ID NO: 7560441 - DNA, 22 bp, Homo sapiens
cagttcaaagttaagcagcagt

SEQ ID NO: 7560442 - DNA, 22 bp, Homo sapiens
cagttcaagagaaatactactg

SEQ ID NO: 7560443 - DNA, 22 bp, Homo sapiens
cagttcagactacccacattgt

SEQ ID NO: 7560444 - DNA, 22 bp, Homo sapiens
cagttcagactacccacattgt

SEQ ID NO: 7560445 - DNA, 22 bp, Homo sapiens
cagttcacactgtgctatctgc

SEQ ID NO: 7560446 - DNA, 22 bp, Homo sapiens
cagttcacactgtgctatctgc

SEQ ID NO: 7560447 - DNA, 22 bp, Homo sapiens
cagttcacactgtgctatctgc

SEQ ID NO: 7560448 - DNA, 22 bp, Homo sapiens
cagttcacactgtgctatctgc

SEQ ID NO: 7560449 - DNA, 22 bp, Homo sapiens
cagttcatccccatgttttcaa

SEQ ID NO: 7560450 - DNA, 22 bp, Homo sapiens
cagttcatagtcttcatgtctc

SEQ ID NO: 7560451 - DNA, 22 bp, Homo sapiens
cagttcatccccatgttttcaa

SEQ ID NO: 7560452 - DNA, 22 bp, Homo sapiens
cagttcatagtcttcatgtctc

SEQ ID NO: 7560453 - DNA, 23 bp, Homo sapiens
cagttcccactgtctgtcacaag

SEQ ID NO: 7560454 - DNA, 22 bp, Homo sapiens
cagttccatcttcatctttccc

SEQ ID NO: 7560455 - DNA, 22 bp, Homo sapiens
cagttccatcttcatctttccc

SEQ ID NO: 7560456 - DNA, 19 bp, Homo sapiens
cagttccagcttcttgacc

SEQ ID NO: 7560457 - DNA, 19 bp, Homo sapiens
cagttccagcttcttgacc

SEQ ID NO: 7560458 - DNA, 22 bp, Homo sapiens
cagttcagctgtcagcctccca

SEQ ID NO: 7560459 - DNA, 22 bp, Homo sapiens
cagttcaggtgcattagtaatc

SEQ ID NO: 7560460 - DNA, 22 bp, Homo sapiens
cagttataggagccattgtata

SEQ ID NO: 7560461 - DNA, 22 bp, Homo sapiens
cagttattatcttagagagaca

SEQ ID NO: 7560462 - DNA, 22 bp, Homo sapiens
cagttattatcttagagagaca

SEQ ID NO: 7560463 - DNA, 22 bp, Homo sapiens
cagttattatgaggtcattagg

SEQ ID NO: 7560464 - DNA, 22 bp, Homo sapiens
cagttattatgaggtcattagg

SEQ ID NO: 7560465 - DNA, 22 bp, Homo sapiens
cagttataggagccattgtata

SEQ ID NO: 7560466 - DNA, 22 bp, Homo sapiens
cagttataggagccattgtata

SEQ ID NO: 7560467 - DNA, 17 bp, Homo sapiens
aggagctgggggtggtg

SEQ ID NO: 7560468 - DNA, 22 bp, Homo sapiens
cagttattatgaggtcattagg

SEQ ID NO: 7560469 - DNA, 22 bp, Homo sapiens
cagttattctagttccacatct

SEQ ID NO: 7560470 - DNA, 22 bp, Homo sapiens
cagttattctagttccacatct

SEQ ID NO: 7560471 - DNA, 21 bp, Homo sapiens
cagttattcttgatgtgtgtg

SEQ ID NO: 7560472 - DNA, 22 bp, Homo sapiens
cagttcaaaattttgaagaagg

SEQ ID NO: 7560473 - DNA, 22 bp, Homo sapiens
cagttcaaaattttgaagaagg

SEQ ID NO: 7560474 - DNA, 22 bp, Homo sapiens
cagttcaaaattttgaagaagg

SEQ ID NO: 7560475 - DNA, 22 bp, Homo sapiens
cagttatttcaacagagaggat

SEQ ID NO: 7560476 - DNA, 22 bp, Homo sapiens
cagttattttgaggattaaatg

SEQ ID NO: 7560477 - DNA, 22 bp, Homo sapiens
cagttattttgaggattaaatg

SEQ ID NO: 7560478 - DNA, 22 bp, Homo sapiens
cagttattttgaggattaaatg

SEQ ID NO: 7560479 - DNA, 22 bp, Homo sapiens
catcacttttaaaggtgatcga

SEQ ID NO: 7560480 - DNA, 22 bp, Homo sapiens
catcagaaaccttgaggaaact

SEQ ID NO: 7560481 - DNA, 22 bp, Homo sapiens
catcactgtcctcagcattcca

SEQ ID NO: 7560482 - DNA, 20 bp, Homo sapiens
catcagaaatcctgacccac

SEQ ID NO: 7560483 - DNA, 22 bp, Homo sapiens
catcactgtcaccatctttcct

SEQ ID NO: 7560484 - DNA, 22 bp, Homo sapiens
catcactgtcaccatctttcct

SEQ ID NO: 7560485 - DNA, 22 bp, Homo sapiens
catcactggctgctgacagatg

SEQ ID NO: 7560486 - DNA, 22 bp, Homo sapiens
catcactggctgctgacagatg

SEQ ID NO: 7560487 - DNA, 22 bp, Homo sapiens
catcactggcatcatgggaggg

SEQ ID NO: 7560488 - DNA, 22 bp, Homo sapiens
catcagaagatggctctggaaa

SEQ ID NO: 7560489 - DNA, 22 bp, Homo sapiens
catcagaagatggctctggaaa

SEQ ID NO: 7560490 - DNA, 22 bp, Homo sapiens
catcagaaggccagagggtagc

SEQ ID NO: 7560491 - DNA, 22 bp, Homo sapiens
catcagaaggccagagggtagc

SEQ ID NO: 7560492 - DNA, 22 bp, Homo sapiens
catcagaaggaaggacgattat

SEQ ID NO: 7560493 - DNA, 22 bp, Homo sapiens
catcagaaggaaggacgattat

SEQ ID NO: 7560494 - DNA, 22 bp, Homo sapiens
catcagaatctgagtctctgcc

SEQ ID NO: 7560495 - DNA, 22 bp, Homo sapiens
catcagaagatggctctggaaa

SEQ ID NO: 7560496 - DNA, 22 bp, Homo sapiens
catcagaagatggctctggaaa

SEQ ID NO: 7560497 - DNA, 22 bp, Homo sapiens
catcagaagaaagacaaatgat

SEQ ID NO: 7560498 - DNA, 22 bp, Homo sapiens
catcagaagaaagacaaatgat

SEQ ID NO: 7560499 - DNA, 22 bp, Homo sapiens
catcagaacgtgagctccttgt

SEQ ID NO: 7560500 - DNA, 22 bp, Homo sapiens
catcagaagaaagacaaatgat

SEQ ID NO: 7560501 - DNA, 22 bp, Homo sapiens
catcagaagaaagacaaatgat

SEQ ID NO: 7560502 - DNA, 22 bp, Homo sapiens
catcagaagaaagacaaatgat

SEQ ID NO: 7560503 - DNA, 22 bp, Homo sapiens
catcagaacgtgagctccttgt

SEQ ID NO: 7560504 - DNA, 22 bp, Homo sapiens
catcagaaccagtggggacatt

SEQ ID NO: 7560505 - DNA, 22 bp, Homo sapiens
catcagaacgtgagctccttgt

SEQ ID NO: 7560506 - DNA, 22 bp, Homo sapiens
aggaggctggttcaggccatat

SEQ ID NO: 7560507 - DNA, 22 bp, Homo sapiens
aggaggctgggcacagtggcct

SEQ ID NO: 7560508 - DNA, 22 bp, Homo sapiens
aggaggctgggcacagtggcct

SEQ ID NO: 7560509 - DNA, 22 bp, Homo sapiens
aggaggctgggcacagtggcct

SEQ ID NO: 7560510 - DNA, 22 bp, Homo sapiens
aggaggctgggcacagtggcct

SEQ ID NO: 7560511 - DNA, 22 bp, Homo sapiens
aggaggctgggcacagtggcct

SEQ ID NO: 7560512 - DNA, 22 bp, Homo sapiens
aggaggctgcaaccctgaggcc

SEQ ID NO: 7560513 - DNA, 22 bp, Homo sapiens
aggaggctgcaaccctgaggcc

SEQ ID NO: 7560514 - DNA, 22 bp, Homo sapiens
aggaggctgggcacagtggcct

SEQ ID NO: 7560515 - DNA, 22 bp, Homo sapiens
aggaggctgggcacagtggcct

SEQ ID NO: 7560516 - DNA, 22 bp, Homo sapiens
aggaggctgggcacagtggcct

SEQ ID NO: 7560517 - DNA, 22 bp, Homo sapiens
aggaggctgggcacagtggcct

SEQ ID NO: 7560518 - DNA, 22 bp, Homo sapiens
aggaggctgggcacagtggcct

SEQ ID NO: 7560519 - DNA, 22 bp, Homo sapiens
aggaggctgggcacagtggcct

SEQ ID NO: 7560520 - DNA, 22 bp, Homo sapiens
aggaggctgggcacagtggcct

SEQ ID NO: 7560521 - DNA, 22 bp, Homo sapiens
aggaggctgcaaccctgaggcc

SEQ ID NO: 7560522 - DNA, 22 bp, Homo sapiens
aggaggctgcaaccctgaggcc

SEQ ID NO: 7560523 - DNA, 22 bp, Homo sapiens
catcagagtcagagctctttct

SEQ ID NO: 7560524 - DNA, 22 bp, Homo sapiens
aggaggctgcaaccctgaggcc

SEQ ID NO: 7560525 - DNA, 22 bp, Homo sapiens
aggaggctgcaaccctgaggcc

SEQ ID NO: 7560526 - DNA, 22 bp, Homo sapiens
aggaggctgcaaccctgaggcc

SEQ ID NO: 7560527 - DNA, 22 bp, Homo sapiens
aggaggctgcaaccctgaggcc

SEQ ID NO: 7560528 - DNA, 23 bp, Homo sapiens
catcagaggttgccactccctgg

SEQ ID NO: 7560529 - DNA, 23 bp, Homo sapiens
catcagaggttgccactccctgg

SEQ ID NO: 7560530 - DNA, 22 bp, Homo sapiens
catcagaggtacttaatgaatg

SEQ ID NO: 7560531 - DNA, 19 bp, Homo sapiens
catcagagggcataggatg

SEQ ID NO: 7560532 - DNA, 19 bp, Homo sapiens
catcagagggcataggatg

SEQ ID NO: 7560533 - DNA, 22 bp, Homo sapiens
catcagacctgccagactaggt

SEQ ID NO: 7560534 - DNA, 22 bp, Homo sapiens
catcagacctgccagactaggt

SEQ ID NO: 7560535 - DNA, 19 bp, Homo sapiens
catcagagggcataggatg

SEQ ID NO: 7560536 - DNA, 19 bp, Homo sapiens
catcagagggcataggatg

SEQ ID NO: 7560537 - DNA, 22 bp, Homo sapiens
catcagaatgttagagaaggga

SEQ ID NO: 7560538 - DNA, 22 bp, Homo sapiens
catcagaatgttagagaaggga

SEQ ID NO: 7560539 - DNA, 22 bp, Homo sapiens
agctcttttatcatgaggagag

SEQ ID NO: 7560540 - DNA, 22 bp, Homo sapiens
agctcttttatcatgaggagag

SEQ ID NO: 7560541 - DNA, 22 bp, Homo sapiens
agctcttttgattctccctgtc

SEQ ID NO: 7560542 - DNA, 22 bp, Homo sapiens
agctcttttgctctccaagttt

SEQ ID NO: 7560543 - DNA, 22 bp, Homo sapiens
agctcttttgctctccaagttt

SEQ ID NO: 7560544 - DNA, 22 bp, Homo sapiens
agctcttttgtgagcatttggc

SEQ ID NO: 7560545 - DNA, 20 bp, Homo sapiens
agctctttttagctaaggta

SEQ ID NO: 7560546 - DNA, 20 bp, Homo sapiens
agctctttttagctaaggta

SEQ ID NO: 7560547 - DNA, 21 bp, Homo sapiens
agctgaaaagttgtttacaag

SEQ ID NO: 7560548 - DNA, 22 bp, Homo sapiens
agctgaaaattagtgatagttt

SEQ ID NO: 7560549 - DNA, 22 bp, Homo sapiens
agctgaaacttcccattaattg

SEQ ID NO: 7560550 - DNA, 22 bp, Homo sapiens
agctgaaagcttgactggggct

SEQ ID NO: 7560551 - DNA, 22 bp, Homo sapiens
agctgaaaattagtgatagttt

SEQ ID NO: 7560552 - DNA, 22 bp, Homo sapiens
agctgaaacccaggcctcagct

SEQ ID NO: 7560553 - DNA, 22 bp, Homo sapiens
agctgaaacccaggcctcagct

SEQ ID NO: 7560554 - DNA, 22 bp, Homo sapiens
agctgaaattttactgagtata

SEQ ID NO: 7560555 - DNA, 22 bp, Homo sapiens
agctgaaattttactgagtata

SEQ ID NO: 7560556 - DNA, 22 bp, Homo sapiens
agctgaaattttactgagtata

SEQ ID NO: 7560557 - DNA, 17 bp, Homo sapiens
agctgaaattgctgaag

SEQ ID NO: 7560558 - DNA, 17 bp, Homo sapiens
agctgaaattgctgaag

SEQ ID NO: 7560559 - DNA, 22 bp, Homo sapiens
agctgaagaaatgggaagcatt

SEQ ID NO: 7560560 - DNA, 22 bp, Homo sapiens
agctgaaattttactgagtata

SEQ ID NO: 7560561 - DNA, 22 bp, Homo sapiens
agctgaaccttagtctggagtg

SEQ ID NO: 7560562 - DNA, 22 bp, Homo sapiens
agctgaagaaatgggaagcatt

SEQ ID NO: 7560563 - DNA, 22 bp, Homo sapiens
agctgaacgtgcttctgcagca

SEQ ID NO: 7560564 - DNA, 22 bp, Homo sapiens
agctgaacgtgcttctgcagca

SEQ ID NO: 7560565 - DNA, 23 bp, Homo sapiens
agctgaaagcttgcaacgaggca

SEQ ID NO: 7560566 - DNA, 22 bp, Homo sapiens
agctgaaagggtgttggagtgt

SEQ ID NO: 7560567 - DNA, 22 bp, Homo sapiens
agctgaaagggtgttggagtgt

SEQ ID NO: 7560568 - DNA, 22 bp, Homo sapiens
agctgaaagggtgttggagtgt

SEQ ID NO: 7560569 - DNA, 22 bp, Homo sapiens
agctgaaagggtgttggagtgt

SEQ ID NO: 7560570 - DNA, 22 bp, Homo sapiens
agctgaaagtgctttgaggact

SEQ ID NO: 7560571 - DNA, 22 bp, Homo sapiens
agctgaaattcacaaggatcca

SEQ ID NO: 7560572 - DNA, 22 bp, Homo sapiens
agctgaaattcacaaggatcca

SEQ ID NO: 7560573 - DNA, 22 bp, Homo sapiens
agctgaaattctttgtcctcag

SEQ ID NO: 7560574 - DNA, 22 bp, Homo sapiens
agctgaaattctttgtcctcag

SEQ ID NO: 7560575 - DNA, 22 bp, Homo sapiens
agctgaaattctttgtcctcag

SEQ ID NO: 7560576 - DNA, 17 bp, Homo sapiens
caggaaaatatgagtga

SEQ ID NO: 7560577 - DNA, 17 bp, Homo sapiens
caggaaaatatgagtga

SEQ ID NO: 7560578 - DNA, 17 bp, Homo sapiens
caggaaaatatgagtga

SEQ ID NO: 7560579 - DNA, 17 bp, Homo sapiens
caggaaaatatgagtga

SEQ ID NO: 7560580 - DNA, 22 bp, Homo sapiens
agctgaagaaatgggaagcatt

SEQ ID NO: 7560581 - DNA, 22 bp, Homo sapiens
caggaaaatctgcccacacaag

SEQ ID NO: 7560582 - DNA, 22 bp, Homo sapiens
caggaaaatctgcccacacaag

SEQ ID NO: 7560583 - DNA, 22 bp, Homo sapiens
caggaaatagttcagtcaaact

SEQ ID NO: 7560584 - DNA, 22 bp, Homo sapiens
caggaaatataggaaaaggaac

SEQ ID NO: 7560585 - DNA, 22 bp, Homo sapiens
caggaaatataggaaaaggaac

SEQ ID NO: 7560586 - DNA, 22 bp, Homo sapiens
caggaaatataggaaaaggaac

SEQ ID NO: 7560587 - DNA, 22 bp, Homo sapiens
caggaaatataggaaaaggaac

SEQ ID NO: 7560588 - DNA, 22 bp, Homo sapiens
caggaaatatctcaacacttta

SEQ ID NO: 7560589 - DNA, 22 bp, Homo sapiens
caggaaatatctcaacacttta

SEQ ID NO: 7560590 - DNA, 22 bp, Homo sapiens
caggaaatatctcaacacttta

SEQ ID NO: 7560591 - DNA, 22 bp, Homo sapiens
caggaaatatctcaacacttta

SEQ ID NO: 7560592 - DNA, 22 bp, Homo sapiens
caggaaatatctcaacacttta

SEQ ID NO: 7560593 - DNA, 22 bp, Homo sapiens
caggaaatatctcaacacttta

SEQ ID NO: 7560594 - DNA, 22 bp, Homo sapiens
caggaaatataggaaaaggaac

SEQ ID NO: 7560595 - DNA, 22 bp, Homo sapiens
caggaaatcactctgattttgg

SEQ ID NO: 7560596 - DNA, 22 bp, Homo sapiens
caggaaatcactctgattttgg

SEQ ID NO: 7560597 - DNA, 22 bp, Homo sapiens
caggaaatcagaactcaagtgg

SEQ ID NO: 7560598 - DNA, 22 bp, Homo sapiens
caggaaatcagaactcaagtgg

SEQ ID NO: 7560599 - DNA, 22 bp, Homo sapiens
caggaaatcagaactcaagtgg

SEQ ID NO: 7560600 - DNA, 22 bp, Homo sapiens
caggaaatcagaactcaagtgg

SEQ ID NO: 7560601 - DNA, 22 bp, Homo sapiens
caggaaatcactctgattttgg

SEQ ID NO: 7560602 - DNA, 22 bp, Homo sapiens
caggaaatcactctgattttgg

SEQ ID NO: 7560603 - DNA, 22 bp, Homo sapiens
caggaaatcagaactcaagtgg

SEQ ID NO: 7560604 - DNA, 22 bp, Homo sapiens
caggaaatcagaactcaagtgg

SEQ ID NO: 7560605 - DNA, 21 bp, Homo sapiens
caggaaatcagtgtgaattag

SEQ ID NO: 7560606 - DNA, 21 bp, Homo sapiens
caggaaatcagtgtgaattag

SEQ ID NO: 7560607 - DNA, 21 bp, Homo sapiens
caggaaatcagtgtgaattag

SEQ ID NO: 7560608 - DNA, 21 bp, Homo sapiens
caggaaatcagtgtgaattag

SEQ ID NO: 7560609 - DNA, 23 bp, Homo sapiens
caggaaatcaattcttccagcat

SEQ ID NO: 7560610 - DNA, 23 bp, Homo sapiens
caggaaatcaattcttccagcat

SEQ ID NO: 7560611 - DNA, 23 bp, Homo sapiens
caggaaatcaattcttccagcat

SEQ ID NO: 7560612 - DNA, 23 bp, Homo sapiens
caggaaatcaattcttccagcat

SEQ ID NO: 7560613 - DNA, 23 bp, Homo sapiens
caggaaatcaattcttccagcat

SEQ ID NO: 7560614 - DNA, 23 bp, Homo sapiens
caggaaatcaattcttccagcat

SEQ ID NO: 7560615 - DNA, 22 bp, Homo sapiens
caggaaatcactctgattttgg

SEQ ID NO: 7560616 - DNA, 22 bp, Homo sapiens
caggaaatatctcctggcagag

SEQ ID NO: 7560617 - DNA, 22 bp, Homo sapiens
caggaaatatctcctggcagag

SEQ ID NO: 7560618 - DNA, 22 bp, Homo sapiens
caggaaatatctcaacacttta

SEQ ID NO: 7560619 - DNA, 22 bp, Homo sapiens
caggaaatatctcctggcagag

SEQ ID NO: 7560620 - DNA, 22 bp, Homo sapiens
caggaaatatctcctggcagag

SEQ ID NO: 7560621 - DNA, 22 bp, Homo sapiens
caggaaatatctcctggcagag

SEQ ID NO: 7560622 - DNA, 22 bp, Homo sapiens
caggaaatatctcctggcagag

SEQ ID NO: 7560623 - DNA, 23 bp, Homo sapiens
caggaaatgcttggaggggctgg

SEQ ID NO: 7560624 - DNA, 23 bp, Homo sapiens
caggaaatgcttggaggggctgg

SEQ ID NO: 7560625 - DNA, 22 bp, Homo sapiens
caggaaatggctgaataaattc

SEQ ID NO: 7560626 - DNA, 20 bp, Homo sapiens
caggaaccaaagaggactcc

SEQ ID NO: 7560627 - DNA, 20 bp, Homo sapiens
caggaaccaaagaggactcc

SEQ ID NO: 7560628 - DNA, 23 bp, Homo sapiens
caggaaatgcttggaggggctgg

SEQ ID NO: 7560629 - DNA, 22 bp, Homo sapiens
caggaaatgctatcatagctga

SEQ ID NO: 7560630 - DNA, 23 bp, Homo sapiens
caggaaatgcttggaggggctgg

SEQ ID NO: 7560631 - DNA, 22 bp, Homo sapiens
caggaaccattttctctttata

SEQ ID NO: 7560632 - DNA, 22 bp, Homo sapiens
caggaaccatgaagacatatac

SEQ ID NO: 7560633 - DNA, 22 bp, Homo sapiens
caggaaatgctatcatagctga

SEQ ID NO: 7560634 - DNA, 22 bp, Homo sapiens
caggaaccaggagagtccctga

SEQ ID NO: 7560635 - DNA, 22 bp, Homo sapiens
caggaaccaggagagtccctga

SEQ ID NO: 7560636 - DNA, 22 bp, Homo sapiens
caggaaccaggagagtccctga

SEQ ID NO: 7560637 - DNA, 22 bp, Homo sapiens
caggaacccaatgggccaggcc

SEQ ID NO: 7560638 - DNA, 22 bp, Homo sapiens
caggaacccaatgggccaggcc

SEQ ID NO: 7560639 - DNA, 22 bp, Homo sapiens
caggaaccattttctctttata

SEQ ID NO: 7560640 - DNA, 22 bp, Homo sapiens
caggaacccccactctcagctc

SEQ ID NO: 7560641 - DNA, 22 bp, Homo sapiens
caggaacctaaagagacattac

SEQ ID NO: 7560642 - DNA, 18 bp, Homo sapiens
caggaacctctccttttt

SEQ ID NO: 7560643 - DNA, 22 bp, Homo sapiens
caggaacctacatctgtttggg

SEQ ID NO: 7560644 - DNA, 22 bp, Homo sapiens
caggaacctaatgaaggctcac

SEQ ID NO: 7560645 - DNA, 22 bp, Homo sapiens
caggaacctaaagagacattac

SEQ ID NO: 7560646 - DNA, 22 bp, Homo sapiens
caggaaatgctatcatagctga

SEQ ID NO: 7560647 - DNA, 22 bp, Homo sapiens
caggaaatgcgtagttgaactt

SEQ ID NO: 7560648 - DNA, 22 bp, Homo sapiens
caggaaatgctatcatagctga

SEQ ID NO: 7560649 - DNA, 22 bp, Homo sapiens
caggaaatgcgtagttgaactt

SEQ ID NO: 7560650 - DNA, 15 bp, Homo sapiens
caggaaatgaatctg

SEQ ID NO: 7560651 - DNA, 15 bp, Homo sapiens
caggaaatgaatctg

SEQ ID NO: 7560652 - DNA, 22 bp, Homo sapiens
caggaaatgaggctgaagggtg

SEQ ID NO: 7560653 - DNA, 22 bp, Homo sapiens
caggaaatgaggctgaagggtg

SEQ ID NO: 7560654 - DNA, 22 bp, Homo sapiens
caggaaatgaggctgaagggtg

SEQ ID NO: 7560655 - DNA, 22 bp, Homo sapiens
caggaaatgaggctgaagggtg

SEQ ID NO: 7560656 - DNA, 22 bp, Homo sapiens
caggaaatgaggctgaagggtg

SEQ ID NO: 7560657 - DNA, 22 bp, Homo sapiens
caggaaatgaacaggaatgaac

SEQ ID NO: 7560658 - DNA, 22 bp, Homo sapiens
caggaaatgcgtagttgaactt

SEQ ID NO: 7560659 - DNA, 22 bp, Homo sapiens
caggaaatgcgtagttgaactt

SEQ ID NO: 7560660 - DNA, 22 bp, Homo sapiens
caggaaatgcgtagttgaactt

SEQ ID NO: 7560661 - DNA, 22 bp, Homo sapiens
caggaaatgaacaggaatgaac

SEQ ID NO: 7560662 - DNA, 23 bp, Homo sapiens
caggaaatgaatccaggaggatg

SEQ ID NO: 7560663 - DNA, 23 bp, Homo sapiens
caggaaatgaatccaggaggatg

SEQ ID NO: 7560664 - DNA, 23 bp, Homo sapiens
caggaaatgaatccaggaggatg

SEQ ID NO: 7560665 - DNA, 23 bp, Homo sapiens
caggaaatgaatccaggaggatg

SEQ ID NO: 7560666 - DNA, 23 bp, Homo sapiens
caggaaatgaatccaggaggatg

SEQ ID NO: 7560667 - DNA, 23 bp, Homo sapiens
caggaaatgaatccaggaggatg

SEQ ID NO: 7560668 - DNA, 21 bp, Homo sapiens
caggaaatcagtgtgaattag

SEQ ID NO: 7560669 - DNA, 22 bp, Homo sapiens
caggaaatgaaagctagctaat

SEQ ID NO: 7560670 - DNA, 22 bp, Homo sapiens
caggaaatgaaagctagctaat

SEQ ID NO: 7560671 - DNA, 22 bp, Homo sapiens
caggaaatgaaagctagctaat

SEQ ID NO: 7560672 - DNA, 22 bp, Homo sapiens
caggaaatgaacaggaatgaac

SEQ ID NO: 7560673 - DNA, 22 bp, Homo sapiens
caggaaatgaacaggaatgaac

SEQ ID NO: 7560674 - DNA, 22 bp, Homo sapiens
caggaaatgaacaggaatgaac

SEQ ID NO: 7560675 - DNA, 22 bp, Homo sapiens
caggaaatgaaagctagctaat

SEQ ID NO: 7560676 - DNA, 22 bp, Homo sapiens
caggaacctgctccaagaggca

SEQ ID NO: 7560677 - DNA, 22 bp, Homo sapiens
caggaacctgtgcgtagggatg

SEQ ID NO: 7560678 - DNA, 22 bp, Homo sapiens
caggaacctgtgcgtagggatg

SEQ ID NO: 7560679 - DNA, 22 bp, Homo sapiens
caggaacccccactctcagctc

SEQ ID NO: 7560680 - DNA, 22 bp, Homo sapiens
caggaaccttgtctgtgttgtt

SEQ ID NO: 7560681 - DNA, 22 bp, Homo sapiens
caggaactggaaccctggccga

SEQ ID NO: 7560682 - DNA, 22 bp, Homo sapiens
caggaagaaagaggtgaggtgt

SEQ ID NO: 7560683 - DNA, 22 bp, Homo sapiens
caggaagaaagaggtgaggtgt

SEQ ID NO: 7560684 - DNA, 22 bp, Homo sapiens
caggaactcaaggtttgtaaca

SEQ ID NO: 7560685 - DNA, 22 bp, Homo sapiens
caggaacgcctggtgttggcct

SEQ ID NO: 7560686 - DNA, 22 bp, Homo sapiens
caggaactggaaccctggccga

SEQ ID NO: 7560687 - DNA, 22 bp, Homo sapiens
caggaagaaagaggtgaggtgt

SEQ ID NO: 7560688 - DNA, 22 bp, Homo sapiens
caggaagaaagaggtgaggtgt

SEQ ID NO: 7560689 - DNA, 22 bp, Homo sapiens
caggaagaagggtggtgagtcc

SEQ ID NO: 7560690 - DNA, 22 bp, Homo sapiens
caggaagaaagaggtgaggtgt

SEQ ID NO: 7560691 - DNA, 22 bp, Homo sapiens
caggaagaaagaggtgaggtgt

SEQ ID NO: 7560692 - DNA, 22 bp, Homo sapiens
caggaagaaagaggtgaggtgt

SEQ ID NO: 7560693 - DNA, 22 bp, Homo sapiens
caggaagaaagaggtgaggtgt

SEQ ID NO: 7560694 - DNA, 22 bp, Homo sapiens
caggaagaaagaggtgaggtgt

SEQ ID NO: 7560695 - DNA, 22 bp, Homo sapiens
caggaagaaagaggtgaggtgt

SEQ ID NO: 7560696 - DNA, 22 bp, Homo sapiens
caggaagaaagaggtgaggtgt

SEQ ID NO: 7560697 - DNA, 22 bp, Homo sapiens
caggaagaagggtggtgagtcc

SEQ ID NO: 7560698 - DNA, 22 bp, Homo sapiens
caggaagaccagggctgtggct

SEQ ID NO: 7560699 - DNA, 22 bp, Homo sapiens
caggaagaagggtggtgagtcc

SEQ ID NO: 7560700 - DNA, 22 bp, Homo sapiens
caggaagaagggtggtgagtcc

SEQ ID NO: 7560701 - DNA, 22 bp, Homo sapiens
caggaagaagggtggtgagtcc

SEQ ID NO: 7560702 - DNA, 22 bp, Homo sapiens
caggaagaagggtggtgagtcc

SEQ ID NO: 7560703 - DNA, 22 bp, Homo sapiens
caggaagaagggtggtgagtcc

SEQ ID NO: 7560704 - DNA, 22 bp, Homo sapiens
caggaagaagggtggtgagtcc

SEQ ID NO: 7560705 - DNA, 22 bp, Homo sapiens
caggaagaaagaggtgaggtgt

SEQ ID NO: 7560706 - DNA, 22 bp, Homo sapiens
caggaagaagggtggtgagtcc

SEQ ID NO: 7560707 - DNA, 22 bp, Homo sapiens
caggaagaagggtggtgagtcc

SEQ ID NO: 7560708 - DNA, 22 bp, Homo sapiens
caggaagaagggtggtgagtcc

SEQ ID NO: 7560709 - DNA, 22 bp, Homo sapiens
caggaagaagggtggtgagtcc

SEQ ID NO: 7560710 - DNA, 22 bp, Homo sapiens
caggaagaagggtggtgagtcc

SEQ ID NO: 7560711 - DNA, 22 bp, Homo sapiens
caggaagaccagggctgtggct

SEQ ID NO: 7560712 - DNA, 22 bp, Homo sapiens
caggaagaagggtggtgagtcc

SEQ ID NO: 7560713 - DNA, 22 bp, Homo sapiens
caggaagaccagggctgtggct

SEQ ID NO: 7560714 - DNA, 22 bp, Homo sapiens
caggaagaccagggctgtggct

SEQ ID NO: 7560715 - DNA, 22 bp, Homo sapiens
caggaagaccagggctgtggct

SEQ ID NO: 7560716 - DNA, 22 bp, Homo sapiens
caggaagaccagggctgtggct

SEQ ID NO: 7560717 - DNA, 22 bp, Homo sapiens
caggaagaccagggctgtggct

SEQ ID NO: 7560718 - DNA, 22 bp, Homo sapiens
caggaagaccagggctgtggct

SEQ ID NO: 7560719 - DNA, 22 bp, Homo sapiens
caggaagaccagggctgtggct

SEQ ID NO: 7560720 - DNA, 22 bp, Homo sapiens
caggaagaccagggctgtggct

SEQ ID NO: 7560721 - DNA, 22 bp, Homo sapiens
caggaagaccagggctgtggct

SEQ ID NO: 7560722 - DNA, 22 bp, Homo sapiens
agctgccactgagggtgcacag

SEQ ID NO: 7560723 - DNA, 22 bp, Homo sapiens
agctgccagatgacagtgctat

SEQ ID NO: 7560724 - DNA, 22 bp, Homo sapiens
agctgccagatgacagtgctat

SEQ ID NO: 7560725 - DNA, 22 bp, Homo sapiens
agctgccactgagggtgcacag

SEQ ID NO: 7560726 - DNA, 22 bp, Homo sapiens
agctgccagatgacagtgctat

SEQ ID NO: 7560727 - DNA, 22 bp, Homo sapiens
agctgccagatgacagtgctat

SEQ ID NO: 7560728 - DNA, 22 bp, Homo sapiens
agctgccagatgacagtgctat

SEQ ID NO: 7560729 - DNA, 22 bp, Homo sapiens
caggaagaccagggctgtggct

SEQ ID NO: 7560730 - DNA, 22 bp, Homo sapiens
caggaagaccagggctgtggct

SEQ ID NO: 7560731 - DNA, 14 bp, Homo sapiens
caggaagactcagc

SEQ ID NO: 7560732 - DNA, 14 bp, Homo sapiens
caggaagactcagc

SEQ ID NO: 7560733 - DNA, 22 bp, Homo sapiens
agctgccccgaggcggcgggaa

SEQ ID NO: 7560734 - DNA, 22 bp, Homo sapiens
agctgccccgaggcggcgggaa

SEQ ID NO: 7560735 - DNA, 22 bp, Homo sapiens
agctgcccctcattttcaccac

SEQ ID NO: 7560736 - DNA, 22 bp, Homo sapiens
agctgcccctcattttcaccac

SEQ ID NO: 7560737 - DNA, 22 bp, Homo sapiens
agctgcccctcattttcaccac

SEQ ID NO: 7560738 - DNA, 22 bp, Homo sapiens
agctgcccccagggctgtgctt

SEQ ID NO: 7560739 - DNA, 22 bp, Homo sapiens
agctgcccccagggctgtgctt

SEQ ID NO: 7560740 - DNA, 22 bp, Homo sapiens
agctgccccgaggcggcgggaa

SEQ ID NO: 7560741 - DNA, 22 bp, Homo sapiens
agctgccccgaggcggcgggaa

SEQ ID NO: 7560742 - DNA, 18 bp, Homo sapiens
agctgccctgggctggag

SEQ ID NO: 7560743 - DNA, 22 bp, Homo sapiens
agctgccctgggctggagatgg

SEQ ID NO: 7560744 - DNA, 18 bp, Homo sapiens
agctgccctgggctggag

SEQ ID NO: 7560745 - DNA, 22 bp, Homo sapiens
agctgccctgggtcttgctgct

SEQ ID NO: 7560746 - DNA, 22 bp, Homo sapiens
agctgccctgggtcttgctgct

SEQ ID NO: 7560747 - DNA, 22 bp, Homo sapiens
agctgccctgggctggagatgg

SEQ ID NO: 7560748 - DNA, 22 bp, Homo sapiens
agctgccctgggctggagatgg

SEQ ID NO: 7560749 - DNA, 18 bp, Homo sapiens
agctgccctgggctggag

SEQ ID NO: 7560750 - DNA, 18 bp, Homo sapiens
agctgccctgggctggag

SEQ ID NO: 7560751 - DNA, 18 bp, Homo sapiens
agctgccctgggctggag

SEQ ID NO: 7560752 - DNA, 22 bp, Homo sapiens
agctgccctggcggagctgctc

SEQ ID NO: 7560753 - DNA, 22 bp, Homo sapiens
agctgccctggcggagctgctc

SEQ ID NO: 7560754 - DNA, 22 bp, Homo sapiens
agctgccctggcggagctgctc

SEQ ID NO: 7560755 - DNA, 20 bp, Homo sapiens
agctgcccctgggcactgcc

SEQ ID NO: 7560756 - DNA, 20 bp, Homo sapiens
agctgcccctgggcactgcc

SEQ ID NO: 7560757 - DNA, 20 bp, Homo sapiens
agctgcccctgggcactgcc

SEQ ID NO: 7560758 - DNA, 20 bp, Homo sapiens
agctgcccctgggcactgcc

SEQ ID NO: 7560759 - DNA, 20 bp, Homo sapiens
agctgcccctgggcactgcc

SEQ ID NO: 7560760 - DNA, 20 bp, Homo sapiens
agctgcccctgggcactgcc

SEQ ID NO: 7560761 - DNA, 22 bp, Homo sapiens
agctgccctcgctggggccaga

SEQ ID NO: 7560762 - DNA, 22 bp, Homo sapiens
agctgccctcgctggggccaga

SEQ ID NO: 7560763 - DNA, 22 bp, Homo sapiens
agctgccctcgctggggccaga

SEQ ID NO: 7560764 - DNA, 22 bp, Homo sapiens
agctgccctggcggagctgctc

SEQ ID NO: 7560765 - DNA, 22 bp, Homo sapiens
agctgccctcgctggggccaga

SEQ ID NO: 7560766 - DNA, 22 bp, Homo sapiens
agctgccctggcggagctgctc

SEQ ID NO: 7560767 - DNA, 22 bp, Homo sapiens
agctgccctggcggagctgctc

SEQ ID NO: 7560768 - DNA, 22 bp, Homo sapiens
agctgccctggcggagctgctc

SEQ ID NO: 7560769 - DNA, 22 bp, Homo sapiens
agctgcctagtagattgattgg

SEQ ID NO: 7560770 - DNA, 22 bp, Homo sapiens
agctgcctcagcaacacagacc

SEQ ID NO: 7560771 - DNA, 20 bp, Homo sapiens
agctgcccttttcacatgtt

SEQ ID NO: 7560772 - DNA, 20 bp, Homo sapiens
agctgcccttttcacatgtt

SEQ ID NO: 7560773 - DNA, 20 bp, Homo sapiens
agctgcccttttcacatgtt

SEQ ID NO: 7560774 - DNA, 22 bp, Homo sapiens
agctgccgatgcccagctgcat

SEQ ID NO: 7560775 - DNA, 22 bp, Homo sapiens
agctgccgatgcccagctgcat

SEQ ID NO: 7560776 - DNA, 20 bp, Homo sapiens
agctgcccttttcacatgtt

SEQ ID NO: 7560777 - DNA, 22 bp, Homo sapiens
agctgcctcagcaacacagacc

SEQ ID NO: 7560778 - DNA, 22 bp, Homo sapiens
agctgcctcagcaacacagacc

SEQ ID NO: 7560779 - DNA, 22 bp, Homo sapiens
agctgcctcagtcactcatggc

SEQ ID NO: 7560780 - DNA, 22 bp, Homo sapiens
agctgcctcagtcactcatggc

SEQ ID NO: 7560781 - DNA, 22 bp, Homo sapiens
agctgcctcagtcactcatggc

SEQ ID NO: 7560782 - DNA, 22 bp, Homo sapiens
agctgcctcagtcactcatggc

SEQ ID NO: 7560783 - DNA, 21 bp, Homo sapiens
agctgcctccacttctgaggc

SEQ ID NO: 7560784 - DNA, 21 bp, Homo sapiens
agctgcctccacttctgaggc

SEQ ID NO: 7560785 - DNA, 21 bp, Homo sapiens
agctgcctccacttctgaggc

SEQ ID NO: 7560786 - DNA, 22 bp, Homo sapiens
agctgccctgtggggagggttg

SEQ ID NO: 7560787 - DNA, 22 bp, Homo sapiens
agctgccctgtggggagggttg

SEQ ID NO: 7560788 - DNA, 22 bp, Homo sapiens
agctgccctgtggggagggttg

SEQ ID NO: 7560789 - DNA, 22 bp, Homo sapiens
agctgcccttaataggcattca

SEQ ID NO: 7560790 - DNA, 22 bp, Homo sapiens
agctgccctgtggggagggttg

SEQ ID NO: 7560791 - DNA, 22 bp, Homo sapiens
agctgccctggtaagattgatg

SEQ ID NO: 7560792 - DNA, 22 bp, Homo sapiens
agctgccctggtaagattgatg

SEQ ID NO: 7560793 - DNA, 22 bp, Homo sapiens
agctgccctgggtcttgctgct

SEQ ID NO: 7560794 - DNA, 22 bp, Homo sapiens
agctgccctgggtcttgctgct

SEQ ID NO: 7560795 - DNA, 22 bp, Homo sapiens
agctgccctgggtcttgctgct

SEQ ID NO: 7560796 - DNA, 22 bp, Homo sapiens
agctgccctttatgatgctgaa

SEQ ID NO: 7560797 - DNA, 22 bp, Homo sapiens
agctgccctttatgatgctgaa

SEQ ID NO: 7560798 - DNA, 22 bp, Homo sapiens
agctgccctttatgatgctgaa

SEQ ID NO: 7560799 - DNA, 22 bp, Homo sapiens
agctgccctttatgatgctgaa

SEQ ID NO: 7560800 - DNA, 22 bp, Homo sapiens
agctgccctttatgatgctgaa

SEQ ID NO: 7560801 - DNA, 22 bp, Homo sapiens
agctgcccttaataggcattca

SEQ ID NO: 7560802 - DNA, 22 bp, Homo sapiens
agctgcccttaataggcattca

SEQ ID NO: 7560803 - DNA, 22 bp, Homo sapiens
agctgcccttaataggcattca

SEQ ID NO: 7560804 - DNA, 22 bp, Homo sapiens
agctgcccttaataggcattca

SEQ ID NO: 7560805 - DNA, 22 bp, Homo sapiens
agctgcccttctcttgcccttg

SEQ ID NO: 7560806 - DNA, 22 bp, Homo sapiens
agctgcccttctcttgcccttg

SEQ ID NO: 7560807 - DNA, 22 bp, Homo sapiens
agctgcccttaataggcattca

SEQ ID NO: 7560808 - DNA, 22 bp, Homo sapiens
agctgcctccatggtcaaagat

SEQ ID NO: 7560809 - DNA, 22 bp, Homo sapiens
agctgcctccctgtgcttgtcc

SEQ ID NO: 7560810 - DNA, 22 bp, Homo sapiens
agctgcctccctgtgcttgtcc

SEQ ID NO: 7560811 - DNA, 22 bp, Homo sapiens
agctgcctccctgtgcttgtcc

SEQ ID NO: 7560812 - DNA, 22 bp, Homo sapiens
agctgcctccctgtgcttgtcc

SEQ ID NO: 7560813 - DNA, 22 bp, Homo sapiens
agctgcctcctggtgccccatc

SEQ ID NO: 7560814 - DNA, 22 bp, Homo sapiens
agctgcctcctggtgccccatc

SEQ ID NO: 7560815 - DNA, 22 bp, Homo sapiens
agctgcctcctggtgccccatc

SEQ ID NO: 7560816 - DNA, 22 bp, Homo sapiens
agctgcctctcttgaggttacg

SEQ ID NO: 7560817 - DNA, 22 bp, Homo sapiens
agctgcctctcttgaggttacg

SEQ ID NO: 7560818 - DNA, 17 bp, Homo sapiens
agctgcctctcccacca

SEQ ID NO: 7560819 - DNA, 17 bp, Homo sapiens
agctgcctctcccacca

SEQ ID NO: 7560820 - DNA, 22 bp, Homo sapiens
agctgcctcctggtgccccatc

SEQ ID NO: 7560821 - DNA, 22 bp, Homo sapiens
agctgcctcctggtgccccatc

SEQ ID NO: 7560822 - DNA, 22 bp, Homo sapiens
agctgcctcctggtgccccatc

SEQ ID NO: 7560823 - DNA, 17 bp, Homo sapiens
agctgcctctcccacca

SEQ ID NO: 7560824 - DNA, 17 bp, Homo sapiens
agctgcctctcccacca

SEQ ID NO: 7560825 - DNA, 17 bp, Homo sapiens
agctgcctctcccacca

SEQ ID NO: 7560826 - DNA, 17 bp, Homo sapiens
agctgcctctcccacca

SEQ ID NO: 7560827 - DNA, 22 bp, Homo sapiens
agctgcctctgctggtttagaa

SEQ ID NO: 7560828 - DNA, 22 bp, Homo sapiens
agctgcctctgctggtttagaa

SEQ ID NO: 7560829 - DNA, 22 bp, Homo sapiens
agctgcctctgaactttaattc

SEQ ID NO: 7560830 - DNA, 22 bp, Homo sapiens
agctgcctctcttgaggttacg

SEQ ID NO: 7560831 - DNA, 22 bp, Homo sapiens
agctgcctgcatttatatcctg

SEQ ID NO: 7560832 - DNA, 22 bp, Homo sapiens
agctgcctgccatgccgctggt

SEQ ID NO: 7560833 - DNA, 22 bp, Homo sapiens
agctgcctgcatttatatcctg

SEQ ID NO: 7560834 - DNA, 22 bp, Homo sapiens
agctgcctgccatgccgctggt

SEQ ID NO: 7560835 - DNA, 22 bp, Homo sapiens
agctgcctgccatgccgctggt

SEQ ID NO: 7560836 - DNA, 22 bp, Homo sapiens
agctgcctgccatgccgctggt

SEQ ID NO: 7560837 - DNA, 22 bp, Homo sapiens
agctgcctgccatgccgctggt

SEQ ID NO: 7560838 - DNA, 22 bp, Homo sapiens
agctgcctgctgcactcggtgc

SEQ ID NO: 7560839 - DNA, 21 bp, Homo sapiens
agctgcctgctctggacctgg

SEQ ID NO: 7560840 - DNA, 22 bp, Homo sapiens
agctgcctgcttatgagctcca

SEQ ID NO: 7560841 - DNA, 22 bp, Homo sapiens
agctgcctgccatgccgctggt

SEQ ID NO: 7560842 - DNA, 22 bp, Homo sapiens
agctgcctgccatgccgctggt

SEQ ID NO: 7560843 - DNA, 21 bp, Homo sapiens
agctgcctgctctggacctgg

SEQ ID NO: 7560844 - DNA, 21 bp, Homo sapiens
agctgcctgctctggacctgg

SEQ ID NO: 7560845 - DNA, 21 bp, Homo sapiens
agctgcctgctctggacctgg

SEQ ID NO: 7560846 - DNA, 22 bp, Homo sapiens
agctgcctgcttatgagctcca

SEQ ID NO: 7560847 - DNA, 22 bp, Homo sapiens
agctgcctgcttatgagctcca

SEQ ID NO: 7560848 - DNA, 22 bp, Homo sapiens
agctgcctggagccagagttga

SEQ ID NO: 7560849 - DNA, 22 bp, Homo sapiens
agctgcctggagccagagttga

SEQ ID NO: 7560850 - DNA, 22 bp, Homo sapiens
agctgcctggagccagagttga

SEQ ID NO: 7560851 - DNA, 22 bp, Homo sapiens
agctgctgggagaagtgagcca

SEQ ID NO: 7560852 - DNA, 22 bp, Homo sapiens
agctgctgggaccccagatcca

SEQ ID NO: 7560853 - DNA, 22 bp, Homo sapiens
agctgcttttagggccgggctc

SEQ ID NO: 7560854 - DNA, 22 bp, Homo sapiens
agctgctttgctgggcaggccc

SEQ ID NO: 7560855 - DNA, 22 bp, Homo sapiens
agctgctttgccaatgcgttcc

SEQ ID NO: 7560856 - DNA, 22 bp, Homo sapiens
agctgctgggagaagtgagcca

SEQ ID NO: 7560857 - DNA, 22 bp, Homo sapiens
agctgctgggagaagtgagcca

SEQ ID NO: 7560858 - DNA, 22 bp, Homo sapiens
agctgctgggagaagtgagcca

SEQ ID NO: 7560859 - DNA, 22 bp, Homo sapiens
agctgctgggatacagtagtga

SEQ ID NO: 7560860 - DNA, 22 bp, Homo sapiens
agctgctgggatacagtagtga

SEQ ID NO: 7560861 - DNA, 22 bp, Homo sapiens
agctgctgggatacagtagtga

SEQ ID NO: 7560862 - DNA, 22 bp, Homo sapiens
agctggaacccgggtgggcagc

SEQ ID NO: 7560863 - DNA, 22 bp, Homo sapiens
agctggaacccgggtgggcagc

SEQ ID NO: 7560864 - DNA, 22 bp, Homo sapiens
agctggaacccgggtgggcagc

SEQ ID NO: 7560865 - DNA, 22 bp, Homo sapiens
agctggaaagaaggtggcagcc

SEQ ID NO: 7560866 - DNA, 22 bp, Homo sapiens
agctggaaagaaggtggcagcc

SEQ ID NO: 7560867 - DNA, 23 bp, Homo sapiens
agctggaaatggccgagctctgc

SEQ ID NO: 7560868 - DNA, 23 bp, Homo sapiens
agctggaaatggccgagctctgc

SEQ ID NO: 7560869 - DNA, 22 bp, Homo sapiens
agctggaaagaaggtggcagcc

SEQ ID NO: 7560870 - DNA, 22 bp, Homo sapiens
agctggaaaatccaagaccttg

SEQ ID NO: 7560871 - DNA, 22 bp, Homo sapiens
agctggaaaatccaagaccttg

SEQ ID NO: 7560872 - DNA, 22 bp, Homo sapiens
agctggaaaatccaagaccttg

SEQ ID NO: 7560873 - DNA, 18 bp, Homo sapiens
agctgcttttggcttaaa

SEQ ID NO: 7560874 - DNA, 22 bp, Homo sapiens
agctggaagctgatgagcacag

SEQ ID NO: 7560875 - DNA, 22 bp, Homo sapiens
agctggaagctgatgagcacag

SEQ ID NO: 7560876 - DNA, 22 bp, Homo sapiens
agctggaacgtcacaggagcag

SEQ ID NO: 7560877 - DNA, 22 bp, Homo sapiens
agctggaacgtcacaggagcag

SEQ ID NO: 7560878 - DNA, 22 bp, Homo sapiens
agctggaactgggtttgttgga

SEQ ID NO: 7560879 - DNA, 22 bp, Homo sapiens
agctggaagctgatgagcacag

SEQ ID NO: 7560880 - DNA, 22 bp, Homo sapiens
agctggaagctgatgagcacag

SEQ ID NO: 7560881 - DNA, 22 bp, Homo sapiens
agctggaagtgcatttctcact

SEQ ID NO: 7560882 - DNA, 22 bp, Homo sapiens
agctggaatcctacttctaaca

SEQ ID NO: 7560883 - DNA, 21 bp, Homo sapiens
agctggaatctggctgtgctt

SEQ ID NO: 7560884 - DNA, 21 bp, Homo sapiens
agctgggtgggctgagtgaca

SEQ ID NO: 7560885 - DNA, 21 bp, Homo sapiens
agctgggtgggctgagtgaca

SEQ ID NO: 7560886 - DNA, 23 bp, Homo sapiens
agctgggtggcctgcgtgaagct

SEQ ID NO: 7560887 - DNA, 23 bp, Homo sapiens
agctgggtggcctgcgtgaagct

SEQ ID NO: 7560888 - DNA, 22 bp, Homo sapiens
agctgggtggtgctgagccttg

SEQ ID NO: 7560889 - DNA, 21 bp, Homo sapiens
agctgggtgggctgagtgaca

SEQ ID NO: 7560890 - DNA, 21 bp, Homo sapiens
agctgggtgggctgagtgaca

SEQ ID NO: 7560891 - DNA, 22 bp, Homo sapiens
agctgggtgtgtatcagataaa

SEQ ID NO: 7560892 - DNA, 22 bp, Homo sapiens
agctgggtgtagggctggacaa

SEQ ID NO: 7560893 - DNA, 22 bp, Homo sapiens
agctgggtggtgctgagccttg

SEQ ID NO: 7560894 - DNA, 22 bp, Homo sapiens
agctgggtggtgctgagccttg

SEQ ID NO: 7560895 - DNA, 22 bp, Homo sapiens
agctgggtgtagggctggacaa

SEQ ID NO: 7560896 - DNA, 22 bp, Homo sapiens
agctgggtggagggcccacggt

SEQ ID NO: 7560897 - DNA, 21 bp, Homo sapiens
agctgggtgctaatgacaact

SEQ ID NO: 7560898 - DNA, 22 bp, Homo sapiens
agctgggtggagggcccacggt

SEQ ID NO: 7560899 - DNA, 22 bp, Homo sapiens
agctgggtggagggcccacggt

SEQ ID NO: 7560900 - DNA, 21 bp, Homo sapiens
agctgggtgctaatgacaact

SEQ ID NO: 7560901 - DNA, 21 bp, Homo sapiens
agctgggtgctaatgacaact

SEQ ID NO: 7560902 - DNA, 22 bp, Homo sapiens
caggcagagtgaggtggtctaa

SEQ ID NO: 7560903 - DNA, 22 bp, Homo sapiens
agctgggtgcggtggctcatgc

SEQ ID NO: 7560904 - DNA, 23 bp, Homo sapiens
agctgggtggcctgcgtgaagct

SEQ ID NO: 7560905 - DNA, 22 bp, Homo sapiens
agctgggtggcctctcctcggg

SEQ ID NO: 7560906 - DNA, 22 bp, Homo sapiens
agctgggtggcctctcctcggg

SEQ ID NO: 7560907 - DNA, 22 bp, Homo sapiens
agctgggtggcctctcctcggg

SEQ ID NO: 7560908 - DNA, 22 bp, Homo sapiens
agctgggtggcctctcctcggg

SEQ ID NO: 7560909 - DNA, 22 bp, Homo sapiens
caggcagagtgaggtggtctaa

SEQ ID NO: 7560910 - DNA, 22 bp, Homo sapiens
caggcagagtgaggtggtctaa

SEQ ID NO: 7560911 - DNA, 22 bp, Homo sapiens
caggcagagtgaggtggtctaa

SEQ ID NO: 7560912 - DNA, 22 bp, Homo sapiens
caggcagagtgaggtggtctaa

SEQ ID NO: 7560913 - DNA, 19 bp, Homo sapiens
agctggggcggtgtgtgtt

SEQ ID NO: 7560914 - DNA, 19 bp, Homo sapiens
agctggggcggtgtgtgtt

SEQ ID NO: 7560915 - DNA, 22 bp, Homo sapiens
caggcagagtgagaagcccttg

SEQ ID NO: 7560916 - DNA, 22 bp, Homo sapiens
caggcagagtgagaagcccttg

SEQ ID NO: 7560917 - DNA, 22 bp, Homo sapiens
agctgggtgcccgaagccacgt

SEQ ID NO: 7560918 - DNA, 22 bp, Homo sapiens
agctgggtgcccgaagccacgt

SEQ ID NO: 7560919 - DNA, 22 bp, Homo sapiens
agctgggtgcggtggctcatgc

SEQ ID NO: 7560920 - DNA, 22 bp, Homo sapiens
agctgggtgcggtggctcatgc

SEQ ID NO: 7560921 - DNA, 19 bp, Homo sapiens
agctggggcggtgtgtgtt

SEQ ID NO: 7560922 - DNA, 20 bp, Homo sapiens
caggcagaggatgctgacca

SEQ ID NO: 7560923 - DNA, 20 bp, Homo sapiens
caggcagaggatgctgacca

SEQ ID NO: 7560924 - DNA, 22 bp, Homo sapiens
caggcagaggcttttcatggct

SEQ ID NO: 7560925 - DNA, 22 bp, Homo sapiens
caggcagaggcttttcatggct

SEQ ID NO: 7560926 - DNA, 22 bp, Homo sapiens
caggcagaggcttttcatggct

SEQ ID NO: 7560927 - DNA, 22 bp, Homo sapiens
caggcagaggcttttcatggct

SEQ ID NO: 7560928 - DNA, 22 bp, Homo sapiens
caggcagaggtaccaagattga

SEQ ID NO: 7560929 - DNA, 22 bp, Homo sapiens
caggcagaggtaccaagattga

SEQ ID NO: 7560930 - DNA, 22 bp, Homo sapiens
caggcagaggcttttcatggct

SEQ ID NO: 7560931 - DNA, 22 bp, Homo sapiens
caggcagaggtaccaagattga

SEQ ID NO: 7560932 - DNA, 22 bp, Homo sapiens
caggcagaggaggccttctcct

SEQ ID NO: 7560933 - DNA, 22 bp, Homo sapiens
caggcagaggcttttcatggct

SEQ ID NO: 7560934 - DNA, 22 bp, Homo sapiens
caggcagaggcttttcatggct

SEQ ID NO: 7560935 - DNA, 22 bp, Homo sapiens
caggcagagtgagaagcccttg

SEQ ID NO: 7560936 - DNA, 22 bp, Homo sapiens
caggcagagtgagaagcccttg

SEQ ID NO: 7560937 - DNA, 22 bp, Homo sapiens
caggcagagtgagaagcccttg

SEQ ID NO: 7560938 - DNA, 22 bp, Homo sapiens
caggcagagtcagattagactt

SEQ ID NO: 7560939 - DNA, 22 bp, Homo sapiens
caggcagagtcagattagactt

SEQ ID NO: 7560940 - DNA, 22 bp, Homo sapiens
caggcagaggtaccaagattga

SEQ ID NO: 7560941 - DNA, 22 bp, Homo sapiens
caggcagagtcagattagactt

SEQ ID NO: 7560942 - DNA, 22 bp, Homo sapiens
caggcagagtcagattagactt

SEQ ID NO: 7560943 - DNA, 22 bp, Homo sapiens
caggcagagtcagattagactt

SEQ ID NO: 7560944 - DNA, 22 bp, Homo sapiens
caggcagaggaggccttctcct

SEQ ID NO: 7560945 - DNA, 22 bp, Homo sapiens
caggcagaggaggccttctcct

SEQ ID NO: 7560946 - DNA, 22 bp, Homo sapiens
caggcagaggaagtctgggtct

SEQ ID NO: 7560947 - DNA, 20 bp, Homo sapiens
caggcagaggatgctgacca

SEQ ID NO: 7560948 - DNA, 20 bp, Homo sapiens
caggcagaggatgctgacca

SEQ ID NO: 7560949 - DNA, 20 bp, Homo sapiens
caggcagaggatgctgacca

SEQ ID NO: 7560950 - DNA, 22 bp, Homo sapiens
caggcagaggaggccttctcct

SEQ ID NO: 7560951 - DNA, 20 bp, Homo sapiens
caggcagaggatgctgacca

SEQ ID NO: 7560952 - DNA, 20 bp, Homo sapiens
caggcagaggatgctgacca

SEQ ID NO: 7560953 - DNA, 20 bp, Homo sapiens
caggcagaggatgctgacca

SEQ ID NO: 7560954 - DNA, 20 bp, Homo sapiens
caggcagaggatgctgacca

SEQ ID NO: 7560955 - DNA, 22 bp, Homo sapiens
caggcagaggaagtctgggtct

SEQ ID NO: 7560956 - DNA, 22 bp, Homo sapiens
caggcagaggaagtctgggtct

SEQ ID NO: 7560957 - DNA, 22 bp, Homo sapiens
caggcagaggaagtctgggtct

SEQ ID NO: 7560958 - DNA, 22 bp, Homo sapiens
caggcagaggaagtctgggtct

SEQ ID NO: 7560959 - DNA, 22 bp, Homo sapiens
caggcagaggaagtctgggtct

SEQ ID NO: 7560960 - DNA, 22 bp, Homo sapiens
caggcagaggaagtctgggtct

SEQ ID NO: 7560961 - DNA, 22 bp, Homo sapiens
caggcagaggaagtctgggtct

SEQ ID NO: 7560962 - DNA, 22 bp, Homo sapiens
caggcagaggaggccttctcct

SEQ ID NO: 7560963 - DNA, 22 bp, Homo sapiens
caggcagaggaagtctgggtct

SEQ ID NO: 7560964 - DNA, 22 bp, Homo sapiens
caggcagaggaagtctgggtct

SEQ ID NO: 7560965 - DNA, 22 bp, Homo sapiens
agctggtgaacctgaggcacag

SEQ ID NO: 7560966 - DNA, 22 bp, Homo sapiens
agctggtgaacctgaggcacag

SEQ ID NO: 7560967 - DNA, 22 bp, Homo sapiens
agctggtgaacctgaggcacag

SEQ ID NO: 7560968 - DNA, 22 bp, Homo sapiens
agctggtgaacctgaggcacag

SEQ ID NO: 7560969 - DNA, 18 bp, Homo sapiens
agctggtgaaatccagta

SEQ ID NO: 7560970 - DNA, 18 bp, Homo sapiens
agctggtgaaatccagta

SEQ ID NO: 7560971 - DNA, 22 bp, Homo sapiens
agctggtgaacctgaggcacag

SEQ ID NO: 7560972 - DNA, 20 bp, Homo sapiens
agctggtgaattaaagactg

SEQ ID NO: 7560973 - DNA, 20 bp, Homo sapiens
agctggtgaattaaagactg

SEQ ID NO: 7560974 - DNA, 22 bp, Homo sapiens
agctggtcttaaatgtgtccag

SEQ ID NO: 7560975 - DNA, 22 bp, Homo sapiens
agctggtctgctgcatggagtg

SEQ ID NO: 7560976 - DNA, 22 bp, Homo sapiens
agctggtctgctgcatggagtg

SEQ ID NO: 7560977 - DNA, 22 bp, Homo sapiens
agctggtccttccctgccctgt

SEQ ID NO: 7560978 - DNA, 22 bp, Homo sapiens
agctggtccttcaatctagcat

SEQ ID NO: 7560979 - DNA, 22 bp, Homo sapiens
agctggtccttggcagttctca

SEQ ID NO: 7560980 - DNA, 22 bp, Homo sapiens
agctggtccttggcagttctca

SEQ ID NO: 7560981 - DNA, 22 bp, Homo sapiens
agctggtgatggcctaagaagg

SEQ ID NO: 7560982 - DNA, 22 bp, Homo sapiens
agctggtgagggttgaggggta

SEQ ID NO: 7560983 - DNA, 22 bp, Homo sapiens
agctggtgatgtggtccctcac

SEQ ID NO: 7560984 - DNA, 22 bp, Homo sapiens
agctggtgatggcctaagaagg

SEQ ID NO: 7560985 - DNA, 22 bp, Homo sapiens
agctggtgagggttgaggggta

SEQ ID NO: 7560986 - DNA, 22 bp, Homo sapiens
agctggtgagggttgaggggta

SEQ ID NO: 7560987 - DNA, 22 bp, Homo sapiens
agctggtgagggttgaggggta

SEQ ID NO: 7560988 - DNA, 22 bp, Homo sapiens
agctggtgagggttgaggggta

SEQ ID NO: 7560989 - DNA, 22 bp, Homo sapiens
agctggtgagggttgaggggta

SEQ ID NO: 7560990 - DNA, 20 bp, Homo sapiens
agctggtgaattaaagactg

SEQ ID NO: 7560991 - DNA, 20 bp, Homo sapiens
agctggtgaattaaagactg

SEQ ID NO: 7560992 - DNA, 22 bp, Homo sapiens
agctggtgcctgcttttgtgtg

SEQ ID NO: 7560993 - DNA, 22 bp, Homo sapiens
agctggtgcctgcttttgtgtg

SEQ ID NO: 7560994 - DNA, 22 bp, Homo sapiens
agctggtgctcaggggcatgga

SEQ ID NO: 7560995 - DNA, 22 bp, Homo sapiens
agctggtgctcaggggcatgga

SEQ ID NO: 7560996 - DNA, 22 bp, Homo sapiens
agctggtgctcaggggcatgga

SEQ ID NO: 7560997 - DNA, 22 bp, Homo sapiens
agctggtgctcaggggcatgga

SEQ ID NO: 7560998 - DNA, 22 bp, Homo sapiens
agctggtgctcaggggcatgga

SEQ ID NO: 7560999 - DNA, 22 bp, Homo sapiens
agctggtgctcaggggcatgga

SEQ ID NO: 7561000 - DNA, 22 bp, Homo sapiens
agctggtgctcaggggcatgga

SEQ ID NO: 7561001 - DNA, 22 bp, Homo sapiens
agctgggttcagaggcacatgg

SEQ ID NO: 7561002 - DNA, 22 bp, Homo sapiens
agctgggtgttcttgggcctaa

SEQ ID NO: 7561003 - DNA, 22 bp, Homo sapiens
agctgggttcagaggcacatgg

SEQ ID NO: 7561004 - DNA, 22 bp, Homo sapiens
agctgggtgttcttgggcctaa

SEQ ID NO: 7561005 - DNA, 22 bp, Homo sapiens
agctgggtgttcttgggcctaa

SEQ ID NO: 7561006 - DNA, 19 bp, Homo sapiens
agctgggtgttagtggaga

SEQ ID NO: 7561007 - DNA, 22 bp, Homo sapiens
agctgggtgtgtatcagataaa

SEQ ID NO: 7561008 - DNA, 19 bp, Homo sapiens
agctgggtgttagtggaga

SEQ ID NO: 7561009 - DNA, 19 bp, Homo sapiens
agctgggtgttagtggaga

SEQ ID NO: 7561010 - DNA, 22 bp, Homo sapiens
agctgggtgtagggctggacaa

SEQ ID NO: 7561011 - DNA, 22 bp, Homo sapiens
agctgggttgacaagatggaaa

SEQ ID NO: 7561012 - DNA, 22 bp, Homo sapiens
agctgggttgacaagatggaaa

SEQ ID NO: 7561013 - DNA, 17 bp, Homo sapiens
agctgggttctcaggaa

SEQ ID NO: 7561014 - DNA, 22 bp, Homo sapiens
agctgggttgacaagatggaaa

SEQ ID NO: 7561015 - DNA, 22 bp, Homo sapiens
agctgggttgacaagatggaaa

SEQ ID NO: 7561016 - DNA, 17 bp, Homo sapiens
agctgggttctcaggaa

SEQ ID NO: 7561017 - DNA, 17 bp, Homo sapiens
agctgggttctcaggaa

SEQ ID NO: 7561018 - DNA, 22 bp, Homo sapiens
agctgggttcagaggcacatgg

SEQ ID NO: 7561019 - DNA, 17 bp, Homo sapiens
agctgggttctcaggaa

SEQ ID NO: 7561020 - DNA, 17 bp, Homo sapiens
agctgggttctcaggaa

SEQ ID NO: 7561021 - DNA, 22 bp, Homo sapiens
agctggtatttgttagggagtt

SEQ ID NO: 7561022 - DNA, 22 bp, Homo sapiens
agctggtatttctgaaggaaag

SEQ ID NO: 7561023 - DNA, 22 bp, Homo sapiens
agctggtatttctgaaggaaag

SEQ ID NO: 7561024 - DNA, 22 bp, Homo sapiens
agctggtatgaacaggatagga

SEQ ID NO: 7561025 - DNA, 22 bp, Homo sapiens
agctggtaagtggcagagattc

SEQ ID NO: 7561026 - DNA, 22 bp, Homo sapiens
agctggtatgaacaggatagga

SEQ ID NO: 7561027 - DNA, 22 bp, Homo sapiens
agctggtcctaattgagccatt

SEQ ID NO: 7561028 - DNA, 22 bp, Homo sapiens
agctggtcagagtggggataga

SEQ ID NO: 7561029 - DNA, 22 bp, Homo sapiens
agctggtaagtggcagagattc

SEQ ID NO: 7561030 - DNA, 22 bp, Homo sapiens
agctggtaagtggcagagattc

SEQ ID NO: 7561031 - DNA, 22 bp, Homo sapiens
agctggtaaaggggaaagcaga

SEQ ID NO: 7561032 - DNA, 22 bp, Homo sapiens
agctggtaacattagtcagtat

SEQ ID NO: 7561033 - DNA, 22 bp, Homo sapiens
agctggtaacattagtcagtat

SEQ ID NO: 7561034 - DNA, 22 bp, Homo sapiens
agctgggtttctggcaggctta

SEQ ID NO: 7561035 - DNA, 22 bp, Homo sapiens
agctgggtttctggcaggctta

SEQ ID NO: 7561036 - DNA, 22 bp, Homo sapiens
agctgggttgacaagatggaaa

SEQ ID NO: 7561037 - DNA, 22 bp, Homo sapiens
agctgggtttctggcaggctta

SEQ ID NO: 7561038 - DNA, 22 bp, Homo sapiens
agctgggtttctggcaggctta

SEQ ID NO: 7561039 - DNA, 22 bp, Homo sapiens
agctggtaaaggggaaagcaga

SEQ ID NO: 7561040 - DNA, 22 bp, Homo sapiens
agctggaggagtttctcctagc

SEQ ID NO: 7561041 - DNA, 22 bp, Homo sapiens
agctggaggagtttctcctagc

SEQ ID NO: 7561042 - DNA, 22 bp, Homo sapiens
agctggaggagtttctcctagc

SEQ ID NO: 7561043 - DNA, 22 bp, Homo sapiens
agctggaggagtttctcctagc

SEQ ID NO: 7561044 - DNA, 22 bp, Homo sapiens
agctggaggataactcacttct

SEQ ID NO: 7561045 - DNA, 22 bp, Homo sapiens
agctgggactcaactgtctggg

SEQ ID NO: 7561046 - DNA, 22 bp, Homo sapiens
agctggaggataactcacttct

SEQ ID NO: 7561047 - DNA, 22 bp, Homo sapiens
agctgggactcaactgtctggg

SEQ ID NO: 7561048 - DNA, 22 bp, Homo sapiens
agctgggactcaactgtctggg

SEQ ID NO: 7561049 - DNA, 22 bp, Homo sapiens
agctgggcaccccgctgcgtct

SEQ ID NO: 7561050 - DNA, 22 bp, Homo sapiens
agctgggactcaactgtctggg

SEQ ID NO: 7561051 - DNA, 22 bp, Homo sapiens
agctgggcaccccgctgcgtct

SEQ ID NO: 7561052 - DNA, 22 bp, Homo sapiens
agctgggcaccccgctgcgtct

SEQ ID NO: 7561053 - DNA, 22 bp, Homo sapiens
agctgggcaccccgctgcgtct

SEQ ID NO: 7561054 - DNA, 22 bp, Homo sapiens
agctgggcaccccgctgcgtct

SEQ ID NO: 7561055 - DNA, 22 bp, Homo sapiens
agctgggcagactgcagtggtt

SEQ ID NO: 7561056 - DNA, 22 bp, Homo sapiens
agctgggcagtgcttggattca

SEQ ID NO: 7561057 - DNA, 22 bp, Homo sapiens
agctgggcagactgcagtggtt

SEQ ID NO: 7561058 - DNA, 22 bp, Homo sapiens
agctgggcagtgcttggattca

SEQ ID NO: 7561059 - DNA, 22 bp, Homo sapiens
agctgggcagtgcttggattca

SEQ ID NO: 7561060 - DNA, 23 bp, Homo sapiens
agctgggccaggtggtcagacct

SEQ ID NO: 7561061 - DNA, 22 bp, Homo sapiens
agctgggcagtgcttggattca

SEQ ID NO: 7561062 - DNA, 22 bp, Homo sapiens
agctgggcagactgcagtggtt

SEQ ID NO: 7561063 - DNA, 22 bp, Homo sapiens
agctgggcagactgcagtggtt

SEQ ID NO: 7561064 - DNA, 22 bp, Homo sapiens
agctgggcagactgcagtggtt

SEQ ID NO: 7561065 - DNA, 22 bp, Homo sapiens
agctgggcagactgcagtggtt

SEQ ID NO: 7561066 - DNA, 23 bp, Homo sapiens
agctgggccaggtggtcagacct

SEQ ID NO: 7561067 - DNA, 23 bp, Homo sapiens
agctgggccaggtggtcagacct

SEQ ID NO: 7561068 - DNA, 23 bp, Homo sapiens
agctgggccaggtggtcagacct

SEQ ID NO: 7561069 - DNA, 21 bp, Homo sapiens
agctgggcctcagcctgcagt

SEQ ID NO: 7561070 - DNA, 21 bp, Homo sapiens
agctgggcctcagcctgcagt

SEQ ID NO: 7561071 - DNA, 21 bp, Homo sapiens
agctgggcctcagcctgcagt

SEQ ID NO: 7561072 - DNA, 21 bp, Homo sapiens
agctgggcctcagcctgcagt

SEQ ID NO: 7561073 - DNA, 21 bp, Homo sapiens
agctgggcctcagcctgcagt

SEQ ID NO: 7561074 - DNA, 21 bp, Homo sapiens
agctgggcctcagcctgcagt

SEQ ID NO: 7561075 - DNA, 22 bp, Homo sapiens
agctgggcctgatttgcagggg

SEQ ID NO: 7561076 - DNA, 22 bp, Homo sapiens
agctgggcctgatttgcagggg

SEQ ID NO: 7561077 - DNA, 22 bp, Homo sapiens
agctgggcctgatttgcagggg

SEQ ID NO: 7561078 - DNA, 22 bp, Homo sapiens
agctgggcgcagtggctggtga

SEQ ID NO: 7561079 - DNA, 22 bp, Homo sapiens
agctgggcctgatttgcagggg

SEQ ID NO: 7561080 - DNA, 22 bp, Homo sapiens
agctgggcctgatttgcagggg

SEQ ID NO: 7561081 - DNA, 22 bp, Homo sapiens
agctgggcctgagctggaagct

SEQ ID NO: 7561082 - DNA, 22 bp, Homo sapiens
agctgggcctgagctggaagct

SEQ ID NO: 7561083 - DNA, 22 bp, Homo sapiens
agctgggcctgatttgcagggg

SEQ ID NO: 7561084 - DNA, 22 bp, Homo sapiens
agctgggcctgagctggaagct

SEQ ID NO: 7561085 - DNA, 22 bp, Homo sapiens
agctgggcctgagctggaagct

SEQ ID NO: 7561086 - DNA, 22 bp, Homo sapiens
agctgggcctgagctggaagct

SEQ ID NO: 7561087 - DNA, 22 bp, Homo sapiens
agctgggcctgagctggaagct

SEQ ID NO: 7561088 - DNA, 21 bp, Homo sapiens
agctgggcctcagcctgcagt

SEQ ID NO: 7561089 - DNA, 21 bp, Homo sapiens
agctgggcctcagcctgcagt

SEQ ID NO: 7561090 - DNA, 22 bp, Homo sapiens
agctgggctgatgactcatgtt

SEQ ID NO: 7561091 - DNA, 22 bp, Homo sapiens
agctgggctggagctccaagcg

SEQ ID NO: 7561092 - DNA, 22 bp, Homo sapiens
caggcagagctgaagatagatg

SEQ ID NO: 7561093 - DNA, 22 bp, Homo sapiens
agctgggctgatgactcatgtt

SEQ ID NO: 7561094 - DNA, 22 bp, Homo sapiens
agctgggctgatgactcatgtt

SEQ ID NO: 7561095 - DNA, 22 bp, Homo sapiens
agctgggctgatgactcatgtt

SEQ ID NO: 7561096 - DNA, 22 bp, Homo sapiens
agctgggctgatgactcatgtt

SEQ ID NO: 7561097 - DNA, 22 bp, Homo sapiens
agctgggctgatgactcatgtt

SEQ ID NO: 7561098 - DNA, 22 bp, Homo sapiens
agctgggctgatgactcatgtt

SEQ ID NO: 7561099 - DNA, 22 bp, Homo sapiens
agctgggctccaagagggatct

SEQ ID NO: 7561100 - DNA, 22 bp, Homo sapiens
agctgggctccaagagggatct

SEQ ID NO: 7561101 - DNA, 22 bp, Homo sapiens
agctgggctccaagagggatct

SEQ ID NO: 7561102 - DNA, 22 bp, Homo sapiens
agctgggcgcagtggctggtga

SEQ ID NO: 7561103 - DNA, 22 bp, Homo sapiens
agctgggcgcagtggctggtga

SEQ ID NO: 7561104 - DNA, 22 bp, Homo sapiens
agctgggcgcagtggctggtga

SEQ ID NO: 7561105 - DNA, 22 bp, Homo sapiens
agctgggcgcagtggctggtga

SEQ ID NO: 7561106 - DNA, 22 bp, Homo sapiens
agctgggcgcagtggctggtga

SEQ ID NO: 7561107 - DNA, 22 bp, Homo sapiens
agctgggcgcagtggctggtga

SEQ ID NO: 7561108 - DNA, 22 bp, Homo sapiens
agctggagatcatgctgatact

SEQ ID NO: 7561109 - DNA, 22 bp, Homo sapiens
agctggagatcatgctgatact

SEQ ID NO: 7561110 - DNA, 22 bp, Homo sapiens
agctggagagtttccaggaagg

SEQ ID NO: 7561111 - DNA, 22 bp, Homo sapiens
agctggagagtttccaggaagg

SEQ ID NO: 7561112 - DNA, 22 bp, Homo sapiens
agctggagagtttccaggaagg

SEQ ID NO: 7561113 - DNA, 22 bp, Homo sapiens
agctggagagtttccaggaagg

SEQ ID NO: 7561114 - DNA, 22 bp, Homo sapiens
agctggagagtttccaggaagg

SEQ ID NO: 7561115 - DNA, 22 bp, Homo sapiens
agctggagagtttccaggaagg

SEQ ID NO: 7561116 - DNA, 22 bp, Homo sapiens
agctggagatcatgctgatact

SEQ ID NO: 7561117 - DNA, 22 bp, Homo sapiens
agctggagatcatgctgatact

SEQ ID NO: 7561118 - DNA, 22 bp, Homo sapiens
agctggagatgagtgacgtgcc

SEQ ID NO: 7561119 - DNA, 22 bp, Homo sapiens
agctggagatgcccagcaccgg

SEQ ID NO: 7561120 - DNA, 22 bp, Homo sapiens
agctggagatgcccagcaccgg

SEQ ID NO: 7561121 - DNA, 22 bp, Homo sapiens
agctggagatgcccagcaccgg

SEQ ID NO: 7561122 - DNA, 22 bp, Homo sapiens
agctggagatgcccagcaccgg

SEQ ID NO: 7561123 - DNA, 22 bp, Homo sapiens
agctggagatgagtgacgtgcc

SEQ ID NO: 7561124 - DNA, 22 bp, Homo sapiens
agctggagatgcccagcaccgg

SEQ ID NO: 7561125 - DNA, 22 bp, Homo sapiens
agctggagaaacctgggagggt

SEQ ID NO: 7561126 - DNA, 22 bp, Homo sapiens
agctggagaaacctgggagggt

SEQ ID NO: 7561127 - DNA, 22 bp, Homo sapiens
agctggaattacaggcacgcac

SEQ ID NO: 7561128 - DNA, 21 bp, Homo sapiens
agctggaatctggctgtgctt

SEQ ID NO: 7561129 - DNA, 21 bp, Homo sapiens
agctggaatctggctgtgctt

SEQ ID NO: 7561130 - DNA, 22 bp, Homo sapiens
agctggagaaacctgggagggt

SEQ ID NO: 7561131 - DNA, 22 bp, Homo sapiens
agctggagaaacctgggagggt

SEQ ID NO: 7561132 - DNA, 22 bp, Homo sapiens
agctggagaaacctgggagggt

SEQ ID NO: 7561133 - DNA, 22 bp, Homo sapiens
agctggagaaacctgggagggt

SEQ ID NO: 7561134 - DNA, 22 bp, Homo sapiens
agctggagaaacctgggagggt

SEQ ID NO: 7561135 - DNA, 22 bp, Homo sapiens
agctggagaatgtggatgatcc

SEQ ID NO: 7561136 - DNA, 22 bp, Homo sapiens
agctggagaatgtggatgatcc

SEQ ID NO: 7561137 - DNA, 20 bp, Homo sapiens
agctggagaagggcccttcc

SEQ ID NO: 7561138 - DNA, 22 bp, Homo sapiens
agctggagaaacctgggagggt

SEQ ID NO: 7561139 - DNA, 22 bp, Homo sapiens
agctggagaaacctgggagggt

SEQ ID NO: 7561140 - DNA, 20 bp, Homo sapiens
agctggagaagggcccttcc

SEQ ID NO: 7561141 - DNA, 22 bp, Homo sapiens
agctggagcttcaagcaggtaa

SEQ ID NO: 7561142 - DNA, 22 bp, Homo sapiens
agctggagcttcaagcaggtaa

SEQ ID NO: 7561143 - DNA, 22 bp, Homo sapiens
agctggagcttcaagcaggtaa

SEQ ID NO: 7561144 - DNA, 22 bp, Homo sapiens
agctggagcttcaagcaggtaa

SEQ ID NO: 7561145 - DNA, 22 bp, Homo sapiens
agctggagcttcaagcaggtaa

SEQ ID NO: 7561146 - DNA, 22 bp, Homo sapiens
agctggagcttcaagcaggtaa

SEQ ID NO: 7561147 - DNA, 22 bp, Homo sapiens
agctggagcttcaagcaggtaa

SEQ ID NO: 7561148 - DNA, 22 bp, Homo sapiens
agctggagcttcaagcaggtaa

SEQ ID NO: 7561149 - DNA, 22 bp, Homo sapiens
agctggagcttcaagcaggtaa

SEQ ID NO: 7561150 - DNA, 22 bp, Homo sapiens
agctggagccagtgtgaggctt

SEQ ID NO: 7561151 - DNA, 22 bp, Homo sapiens
agctggagccagtgtgaggctt

SEQ ID NO: 7561152 - DNA, 22 bp, Homo sapiens
agctggagccagtgtgaggctt

SEQ ID NO: 7561153 - DNA, 22 bp, Homo sapiens
agctggagccagtgtgaggctt

SEQ ID NO: 7561154 - DNA, 22 bp, Homo sapiens
agctggagccagtgtgaggctt

SEQ ID NO: 7561155 - DNA, 22 bp, Homo sapiens
agctggagccagtgtgaggctt

SEQ ID NO: 7561156 - DNA, 22 bp, Homo sapiens
agctggagcttcaagcaggtaa

SEQ ID NO: 7561157 - DNA, 22 bp, Homo sapiens
agctggagccagtgtgaggctt

SEQ ID NO: 7561158 - DNA, 22 bp, Homo sapiens
agctggagattctggggacagt

SEQ ID NO: 7561159 - DNA, 22 bp, Homo sapiens
agctggagattctggggacagt

SEQ ID NO: 7561160 - DNA, 22 bp, Homo sapiens
agctggagattctggggacagt

SEQ ID NO: 7561161 - DNA, 19 bp, Homo sapiens
agctggagattggagggca

SEQ ID NO: 7561162 - DNA, 19 bp, Homo sapiens
agctggagattggagggca

SEQ ID NO: 7561163 - DNA, 22 bp, Homo sapiens
agctggagattctggggacagt

SEQ ID NO: 7561164 - DNA, 22 bp, Homo sapiens
agctggagattctggggacagt

SEQ ID NO: 7561165 - DNA, 22 bp, Homo sapiens
agctggagattctggggacagt

SEQ ID NO: 7561166 - DNA, 19 bp, Homo sapiens
agctggagattggagggca

SEQ ID NO: 7561167 - DNA, 19 bp, Homo sapiens
agctggagattggagggca

SEQ ID NO: 7561168 - DNA, 19 bp, Homo sapiens
agctggagattggagggca

SEQ ID NO: 7561169 - DNA, 19 bp, Homo sapiens
agctggagattggagggca

SEQ ID NO: 7561170 - DNA, 19 bp, Homo sapiens
agctggagattggagggca

SEQ ID NO: 7561171 - DNA, 22 bp, Homo sapiens
agctggagccagtgtgaggctt

SEQ ID NO: 7561172 - DNA, 22 bp, Homo sapiens
agctggagccagtgtgaggctt

SEQ ID NO: 7561173 - DNA, 19 bp, Homo sapiens
agctggagattggagggca

SEQ ID NO: 7561174 - DNA, 22 bp, Homo sapiens
agctttcacgatttggaacagg

SEQ ID NO: 7561175 - DNA, 22 bp, Homo sapiens
agctttatttgtcattcacggc

SEQ ID NO: 7561176 - DNA, 22 bp, Homo sapiens
agctttcagtctctgaaggaac

SEQ ID NO: 7561177 - DNA, 22 bp, Homo sapiens
agctttcaggataatgaaaaag

SEQ ID NO: 7561178 - DNA, 22 bp, Homo sapiens
agctttcaggataatgaaaaag

SEQ ID NO: 7561179 - DNA, 22 bp, Homo sapiens
agctttcactgatatgctttga

SEQ ID NO: 7561180 - DNA, 22 bp, Homo sapiens
agctttcactgatatgctttga

SEQ ID NO: 7561181 - DNA, 22 bp, Homo sapiens
agctttcactgatatgctttga

SEQ ID NO: 7561182 - DNA, 22 bp, Homo sapiens
agctttcagttactaatgaagg

SEQ ID NO: 7561183 - DNA, 22 bp, Homo sapiens
agctttcagtctctgaaggaac

SEQ ID NO: 7561184 - DNA, 22 bp, Homo sapiens
agctttcagttactaatgaagg

SEQ ID NO: 7561185 - DNA, 22 bp, Homo sapiens
agctttcagttactaatgaagg

SEQ ID NO: 7561186 - DNA, 22 bp, Homo sapiens
agctttcagttactaatgaagg

SEQ ID NO: 7561187 - DNA, 22 bp, Homo sapiens
agctttccactatcttaggggt

SEQ ID NO: 7561188 - DNA, 22 bp, Homo sapiens
agctttcagttactaatgaagg

SEQ ID NO: 7561189 - DNA, 22 bp, Homo sapiens
agctttcgttccttagacacat

SEQ ID NO: 7561190 - DNA, 22 bp, Homo sapiens
agctttctaccaggtcctgtct

SEQ ID NO: 7561191 - DNA, 22 bp, Homo sapiens
agctttctagactctgtggtca

SEQ ID NO: 7561192 - DNA, 22 bp, Homo sapiens
agctttctagactctgtggtca

SEQ ID NO: 7561193 - DNA, 22 bp, Homo sapiens
agctttctagatttggaattgt

SEQ ID NO: 7561194 - DNA, 22 bp, Homo sapiens
agcttctgttcatcttccaggc

SEQ ID NO: 7561195 - DNA, 22 bp, Homo sapiens
agctttatatttaatgaattct

SEQ ID NO: 7561196 - DNA, 22 bp, Homo sapiens
agctttatatttaatgaattct

SEQ ID NO: 7561197 - DNA, 22 bp, Homo sapiens
agcttctgttcatcttccaggc

SEQ ID NO: 7561198 - DNA, 22 bp, Homo sapiens
agcttctgttcatcttccaggc

SEQ ID NO: 7561199 - DNA, 22 bp, Homo sapiens
agctttattaactctccaggtg

SEQ ID NO: 7561200 - DNA, 22 bp, Homo sapiens
agctttatatttaatgaattct

SEQ ID NO: 7561201 - DNA, 22 bp, Homo sapiens
agctttattcatgatttcaggg

SEQ ID NO: 7561202 - DNA, 22 bp, Homo sapiens
agctttatttgtcattcacggc

SEQ ID NO: 7561203 - DNA, 22 bp, Homo sapiens
agctttattcatgatttcaggg

SEQ ID NO: 7561204 - DNA, 22 bp, Homo sapiens
agcttctggaagcctggcagca

SEQ ID NO: 7561205 - DNA, 22 bp, Homo sapiens
agcttctggaagcctggcagca

SEQ ID NO: 7561206 - DNA, 22 bp, Homo sapiens
agcttctggaagcctggcagca

SEQ ID NO: 7561207 - DNA, 22 bp, Homo sapiens
agcttctggaaggcaaggcttg

SEQ ID NO: 7561208 - DNA, 22 bp, Homo sapiens
agcttctggaaggcaaggcttg

SEQ ID NO: 7561209 - DNA, 22 bp, Homo sapiens
agcttctggaaggcaaggcttg

SEQ ID NO: 7561210 - DNA, 22 bp, Homo sapiens
agcttctggaagcctggcagca

SEQ ID NO: 7561211 - DNA, 22 bp, Homo sapiens
agcttctggaagcctggcagca

SEQ ID NO: 7561212 - DNA, 22 bp, Homo sapiens
agcttctggaaggcaaggcttg

SEQ ID NO: 7561213 - DNA, 22 bp, Homo sapiens
agcttctggaaggcaaggcttg

SEQ ID NO: 7561214 - DNA, 23 bp, Homo sapiens
agcttctggttcaggtcaagcag

SEQ ID NO: 7561215 - DNA, 22 bp, Homo sapiens
agcttctgttcatcttccaggc

SEQ ID NO: 7561216 - DNA, 22 bp, Homo sapiens
agcttctgttcatcttccaggc

SEQ ID NO: 7561217 - DNA, 22 bp, Homo sapiens
agcttctgttcatcttccaggc

SEQ ID NO: 7561218 - DNA, 22 bp, Homo sapiens
agcttctctctttgcactcaca

SEQ ID NO: 7561219 - DNA, 22 bp, Homo sapiens
agcttctctcagggtatctttc

SEQ ID NO: 7561220 - DNA, 22 bp, Homo sapiens
agcttctctctttgcactcaca

SEQ ID NO: 7561221 - DNA, 22 bp, Homo sapiens
agcttctcctggtacagaactg

SEQ ID NO: 7561222 - DNA, 22 bp, Homo sapiens
agcttctgcatcttttcttccc

SEQ ID NO: 7561223 - DNA, 22 bp, Homo sapiens
agcttctgcatcttttcttccc

SEQ ID NO: 7561224 - DNA, 22 bp, Homo sapiens
agcttctgcccgtgtttgctct

SEQ ID NO: 7561225 - DNA, 22 bp, Homo sapiens
agcttctgcccgtgtttgctct

SEQ ID NO: 7561226 - DNA, 22 bp, Homo sapiens
agcttctgaaagtctgttttcc

SEQ ID NO: 7561227 - DNA, 22 bp, Homo sapiens
agcttctctggtcttctgccaa

SEQ ID NO: 7561228 - DNA, 22 bp, Homo sapiens
agcttctctctttgcactcaca

SEQ ID NO: 7561229 - DNA, 22 bp, Homo sapiens
agcttctgagaatagtaaatgc

SEQ ID NO: 7561230 - DNA, 22 bp, Homo sapiens
agcttctgagaatagtaaatgc

SEQ ID NO: 7561231 - DNA, 22 bp, Homo sapiens
agcttctgcatcttttcttccc

SEQ ID NO: 7561232 - DNA, 22 bp, Homo sapiens
agcttctgcatcttttcttccc

SEQ ID NO: 7561233 - DNA, 22 bp, Homo sapiens
agctggtgctgaagctcttgag

SEQ ID NO: 7561234 - DNA, 22 bp, Homo sapiens
agctggtgctgaagctcttgag

SEQ ID NO: 7561235 - DNA, 22 bp, Homo sapiens
agctggtgctgaagctcttgag

SEQ ID NO: 7561236 - DNA, 22 bp, Homo sapiens
agctggtgctgaagctcttgag

SEQ ID NO: 7561237 - DNA, 22 bp, Homo sapiens
agctggtgctgaagctcttgag

SEQ ID NO: 7561238 - DNA, 22 bp, Homo sapiens
agctggtgctcggggagctggc

SEQ ID NO: 7561239 - DNA, 22 bp, Homo sapiens
agctggtgctcggggagctggc

SEQ ID NO: 7561240 - DNA, 22 bp, Homo sapiens
agctggtgctcggggagctggc

SEQ ID NO: 7561241 - DNA, 22 bp, Homo sapiens
agctggtgctcggggagctggc

SEQ ID NO: 7561242 - DNA, 22 bp, Homo sapiens
agctggtgctcggggagctggc

SEQ ID NO: 7561243 - DNA, 22 bp, Homo sapiens
agctggtgctcggggagctggc

SEQ ID NO: 7561244 - DNA, 22 bp, Homo sapiens
agctggtgctcggggagctggc

SEQ ID NO: 7561245 - DNA, 22 bp, Homo sapiens
agctggtgctcggggagctggc

SEQ ID NO: 7561246 - DNA, 22 bp, Homo sapiens
caggctgtgaaactgagatgcg

SEQ ID NO: 7561247 - DNA, 22 bp, Homo sapiens
caggctgtctgctgaggaaagg

SEQ ID NO: 7561248 - DNA, 22 bp, Homo sapiens
caggctgtctgctgaggaaagg

SEQ ID NO: 7561249 - DNA, 22 bp, Homo sapiens
caggctggagttcagtggtgtg

SEQ ID NO: 7561250 - DNA, 22 bp, Homo sapiens
caggctggagttcagtggtgtg

SEQ ID NO: 7561251 - DNA, 22 bp, Homo sapiens
caggctggagttacctttaggg

SEQ ID NO: 7561252 - DNA, 22 bp, Homo sapiens
agctggtgctgaagctcttgag

SEQ ID NO: 7561253 - DNA, 22 bp, Homo sapiens
caggcttcagcatccacttagt

SEQ ID NO: 7561254 - DNA, 22 bp, Homo sapiens
caggcttaggagtcagcctgct

SEQ ID NO: 7561255 - DNA, 22 bp, Homo sapiens
caggctgtgttcctggaacccc

SEQ ID NO: 7561256 - DNA, 22 bp, Homo sapiens
caggcttaggagtcagcctgct

SEQ ID NO: 7561257 - DNA, 22 bp, Homo sapiens
caggcttaggagtcagcctgct

SEQ ID NO: 7561258 - DNA, 22 bp, Homo sapiens
caggctgtgttcctggaacccc

SEQ ID NO: 7561259 - DNA, 22 bp, Homo sapiens
caggctgtgttcctggaacccc

SEQ ID NO: 7561260 - DNA, 22 bp, Homo sapiens
caggctgtgggagtcaggaccc

SEQ ID NO: 7561261 - DNA, 22 bp, Homo sapiens
caggctgtggatcaggagcctt

SEQ ID NO: 7561262 - DNA, 22 bp, Homo sapiens
caggctgtgggagtcaggaccc

SEQ ID NO: 7561263 - DNA, 22 bp, Homo sapiens
caggctgtgggagtcaggaccc

SEQ ID NO: 7561264 - DNA, 22 bp, Homo sapiens
caggctgtggatcaggagcctt

SEQ ID NO: 7561265 - DNA, 22 bp, Homo sapiens
caggctgtggatcaggagcctt

SEQ ID NO: 7561266 - DNA, 22 bp, Homo sapiens
caggctgtgaaactgagatgcg

SEQ ID NO: 7561267 - DNA, 22 bp, Homo sapiens
caggctgtggatcaggagcctt

SEQ ID NO: 7561268 - DNA, 22 bp, Homo sapiens
caggctgtggatcaggagcctt

SEQ ID NO: 7561269 - DNA, 22 bp, Homo sapiens
caggctgtggatcaggagcctt

SEQ ID NO: 7561270 - DNA, 22 bp, Homo sapiens
caggctgtgaaactgagatgcg

SEQ ID NO: 7561271 - DNA, 22 bp, Homo sapiens
caggctgtgaaactgagatgcg

SEQ ID NO: 7561272 - DNA, 22 bp, Homo sapiens
caggctgtgaaactgagatgcg

SEQ ID NO: 7561273 - DNA, 22 bp, Homo sapiens
caggctgtgaaactgagatgcg

SEQ ID NO: 7561274 - DNA, 22 bp, Homo sapiens
caggcttgagggcaggcccagt

SEQ ID NO: 7561275 - DNA, 22 bp, Homo sapiens
caggcttgagggcaggcccagt

SEQ ID NO: 7561276 - DNA, 22 bp, Homo sapiens
caggcttgattattcagacaat

SEQ ID NO: 7561277 - DNA, 22 bp, Homo sapiens
caggcttgattattcagacaat

SEQ ID NO: 7561278 - DNA, 22 bp, Homo sapiens
caggcttgatgtgtctatactt

SEQ ID NO: 7561279 - DNA, 22 bp, Homo sapiens
caggcttgctagaggagccaaa

SEQ ID NO: 7561280 - DNA, 22 bp, Homo sapiens
caggcttgctagaggagccaaa

SEQ ID NO: 7561281 - DNA, 22 bp, Homo sapiens
caggcttgctagaggagccaaa

SEQ ID NO: 7561282 - DNA, 22 bp, Homo sapiens
caggcttgctagaggagccaaa

SEQ ID NO: 7561283 - DNA, 22 bp, Homo sapiens
agcttctccatctgcccagaga

SEQ ID NO: 7561284 - DNA, 22 bp, Homo sapiens
agcttctccatctgcccagaga

SEQ ID NO: 7561285 - DNA, 22 bp, Homo sapiens
caggcttgctgctagagcactt

SEQ ID NO: 7561286 - DNA, 22 bp, Homo sapiens
caggcttgctgctagagcactt

SEQ ID NO: 7561287 - DNA, 22 bp, Homo sapiens
caggcttgctgctagagcactt

SEQ ID NO: 7561288 - DNA, 22 bp, Homo sapiens
caggcttgctgctagagcactt

SEQ ID NO: 7561289 - DNA, 22 bp, Homo sapiens
caggcttgagggcaggcccagt

SEQ ID NO: 7561290 - DNA, 22 bp, Homo sapiens
caggcttgagggcaggcccagt

SEQ ID NO: 7561291 - DNA, 22 bp, Homo sapiens
caggcttgagggcaggcccagt

SEQ ID NO: 7561292 - DNA, 21 bp, Homo sapiens
caggcttgaggaatgtgcctg

SEQ ID NO: 7561293 - DNA, 21 bp, Homo sapiens
caggcttgaggaatgtgcctg

SEQ ID NO: 7561294 - DNA, 22 bp, Homo sapiens
caggcttgaagcttcagagtat

SEQ ID NO: 7561295 - DNA, 22 bp, Homo sapiens
caggcttgaagcttcagagtat

SEQ ID NO: 7561296 - DNA, 22 bp, Homo sapiens
caggcttcttttctttccagac

SEQ ID NO: 7561297 - DNA, 22 bp, Homo sapiens
caggcttcttttctttccagac

SEQ ID NO: 7561298 - DNA, 22 bp, Homo sapiens
caggcttgacagttttcatctt

SEQ ID NO: 7561299 - DNA, 22 bp, Homo sapiens
caggcttgacagttttcatctt

SEQ ID NO: 7561300 - DNA, 21 bp, Homo sapiens
caggcttgaccctagtgggaa

SEQ ID NO: 7561301 - DNA, 21 bp, Homo sapiens
caggcttgaccctagtgggaa

SEQ ID NO: 7561302 - DNA, 21 bp, Homo sapiens
caggcttgaccctagtgggaa

SEQ ID NO: 7561303 - DNA, 22 bp, Homo sapiens
caggcttcgctctgtgggcagg

SEQ ID NO: 7561304 - DNA, 22 bp, Homo sapiens
caggcttcttttctttccagac

SEQ ID NO: 7561305 - DNA, 22 bp, Homo sapiens
caggcttcttttctttccagac

SEQ ID NO: 7561306 - DNA, 22 bp, Homo sapiens
caggcttcgctctgtgggcagg

SEQ ID NO: 7561307 - DNA, 22 bp, Homo sapiens
caggcttcatgaattatgcacc

SEQ ID NO: 7561308 - DNA, 22 bp, Homo sapiens
aggaaaagtgtgaagtatggag

SEQ ID NO: 7561309 - DNA, 22 bp, Homo sapiens
aggaaaagtgtgaagtatggag

SEQ ID NO: 7561310 - DNA, 22 bp, Homo sapiens
aggaaaagtgtgaagtatggag

SEQ ID NO: 7561311 - DNA, 22 bp, Homo sapiens
aggaaaatcaatgtctttttaa

SEQ ID NO: 7561312 - DNA, 22 bp, Homo sapiens
aggaaaagtgtgaagtatggag

SEQ ID NO: 7561313 - DNA, 22 bp, Homo sapiens
aggaaaatcgagtctggaggca

SEQ ID NO: 7561314 - DNA, 22 bp, Homo sapiens
aggaaaagtgtgaagtatggag

SEQ ID NO: 7561315 - DNA, 22 bp, Homo sapiens
aggaaaatcgagtctggaggca

SEQ ID NO: 7561316 - DNA, 22 bp, Homo sapiens
aggaaaatcgagtctggaggca

SEQ ID NO: 7561317 - DNA, 22 bp, Homo sapiens
aggaaaatcgagtctggaggca

SEQ ID NO: 7561318 - DNA, 22 bp, Homo sapiens
aggaaaatgaaacagcaactgt

SEQ ID NO: 7561319 - DNA, 22 bp, Homo sapiens
aggaaaatgaaacagcaactgt

SEQ ID NO: 7561320 - DNA, 22 bp, Homo sapiens
aggaaaatgaaacagcaactgt

SEQ ID NO: 7561321 - DNA, 22 bp, Homo sapiens
aggaaaatgaaacagcaactgt

SEQ ID NO: 7561322 - DNA, 22 bp, Homo sapiens
aggaaaatgaaacagcaactgt

SEQ ID NO: 7561323 - DNA, 22 bp, Homo sapiens
aggaaaatgaaacagcaactgt

SEQ ID NO: 7561324 - DNA, 22 bp, Homo sapiens
aggaaaatggaccagagttgtt

SEQ ID NO: 7561325 - DNA, 22 bp, Homo sapiens
aggaaaatggaccagagttgtt

SEQ ID NO: 7561326 - DNA, 22 bp, Homo sapiens
aggaaacaacttggcatgagcc

SEQ ID NO: 7561327 - DNA, 22 bp, Homo sapiens
aggaaacaacttggcatgagcc

SEQ ID NO: 7561328 - DNA, 22 bp, Homo sapiens
aggaaacaacttggcatgagcc

SEQ ID NO: 7561329 - DNA, 22 bp, Homo sapiens
aggaaacagaggtgccacaata

SEQ ID NO: 7561330 - DNA, 21 bp, Homo sapiens
aggaaaattgagggttgttgt

SEQ ID NO: 7561331 - DNA, 22 bp, Homo sapiens
aggaaaattatcatgagagcca

SEQ ID NO: 7561332 - DNA, 22 bp, Homo sapiens
aggaaaattatcatgagagcca

SEQ ID NO: 7561333 - DNA, 22 bp, Homo sapiens
aggaaaatggaccagagttgtt

SEQ ID NO: 7561334 - DNA, 22 bp, Homo sapiens
aggaaaatggaccagagttgtt

SEQ ID NO: 7561335 - DNA, 22 bp, Homo sapiens
aggaaaatggaccagagttgtt

SEQ ID NO: 7561336 - DNA, 22 bp, Homo sapiens
aggaaaatggaccagagttgtt

SEQ ID NO: 7561337 - DNA, 22 bp, Homo sapiens
aggaaaatggaccagagttgtt

SEQ ID NO: 7561338 - DNA, 22 bp, Homo sapiens
aggaaaatggaccagagttgtt

SEQ ID NO: 7561339 - DNA, 22 bp, Homo sapiens
aggaaaatggaccagagttgtt

SEQ ID NO: 7561340 - DNA, 22 bp, Homo sapiens
aggaaaacagaccaaggagctc

SEQ ID NO: 7561341 - DNA, 20 bp, Homo sapiens
aggaaaagggtggtggtaga

SEQ ID NO: 7561342 - DNA, 22 bp, Homo sapiens
aggaaaacagaccaaggagctc

SEQ ID NO: 7561343 - DNA, 22 bp, Homo sapiens
aggaaaacagaccaaggagctc

SEQ ID NO: 7561344 - DNA, 22 bp, Homo sapiens
aggaaaacacagtattgatgga

SEQ ID NO: 7561345 - DNA, 22 bp, Homo sapiens
aggaaaacacagtattgatgga

SEQ ID NO: 7561346 - DNA, 22 bp, Homo sapiens
aggaaaacacagtattgatgga

SEQ ID NO: 7561347 - DNA, 20 bp, Homo sapiens
aggaaaagggtggtggtaga

SEQ ID NO: 7561348 - DNA, 20 bp, Homo sapiens
aggaaaagggtggtggtaga

SEQ ID NO: 7561349 - DNA, 20 bp, Homo sapiens
aggaaaagggtggtggtaga

SEQ ID NO: 7561350 - DNA, 20 bp, Homo sapiens
aggaaaagggtggtggtaga

SEQ ID NO: 7561351 - DNA, 20 bp, Homo sapiens
aggaaaagggtggtggtaga

SEQ ID NO: 7561352 - DNA, 22 bp, Homo sapiens
aggaaaacagaccaaggagctc

SEQ ID NO: 7561353 - DNA, 22 bp, Homo sapiens
aggaaaagtgtgaagtatggag

SEQ ID NO: 7561354 - DNA, 22 bp, Homo sapiens
aggaaaagtgtgaagtatggag

SEQ ID NO: 7561355 - DNA, 22 bp, Homo sapiens
aggaaaagtgtgaagtatggag

SEQ ID NO: 7561356 - DNA, 22 bp, Homo sapiens
aggaaaagtgtgaagtatggag

SEQ ID NO: 7561357 - DNA, 20 bp, Homo sapiens
aggaaaagggtggtggtaga

SEQ ID NO: 7561358 - DNA, 20 bp, Homo sapiens
aggaaaagggtggtggtaga

SEQ ID NO: 7561359 - DNA, 20 bp, Homo sapiens
aggaaaagggtggtggtaga

SEQ ID NO: 7561360 - DNA, 20 bp, Homo sapiens
aggaaaaatggaaactggag

SEQ ID NO: 7561361 - DNA, 20 bp, Homo sapiens
aggaaaaatggaaactggag

SEQ ID NO: 7561362 - DNA, 20 bp, Homo sapiens
aggaaaaatggaaactggag

SEQ ID NO: 7561363 - DNA, 22 bp, Homo sapiens
aggaaaaataaggcagcagggc

SEQ ID NO: 7561364 - DNA, 20 bp, Homo sapiens
aggaaaaatggaaactggag

SEQ ID NO: 7561365 - DNA, 20 bp, Homo sapiens
aggaaaaatggaaactggag

SEQ ID NO: 7561366 - DNA, 20 bp, Homo sapiens
aggaaaaatggaaactggag

SEQ ID NO: 7561367 - DNA, 20 bp, Homo sapiens
aggaaaaatggaaactggag

SEQ ID NO: 7561368 - DNA, 22 bp, Homo sapiens
agctttggtgctgtcacacaaa

SEQ ID NO: 7561369 - DNA, 22 bp, Homo sapiens
agctttggtgctgtcacacaaa

SEQ ID NO: 7561370 - DNA, 23 bp, Homo sapiens
agctttggtgatgtgacagataa

SEQ ID NO: 7561371 - DNA, 22 bp, Homo sapiens
aggaaaaataaggcagcagggc

SEQ ID NO: 7561372 - DNA, 22 bp, Homo sapiens
aggaaaaataaggcagcagggc

SEQ ID NO: 7561373 - DNA, 22 bp, Homo sapiens
aggaaaaataaggcagcagggc

SEQ ID NO: 7561374 - DNA, 22 bp, Homo sapiens
aggaaaaataaggcagcagggc

SEQ ID NO: 7561375 - DNA, 22 bp, Homo sapiens
aggaaaaataaggcagcagggc

SEQ ID NO: 7561376 - DNA, 22 bp, Homo sapiens
aggaaaaataaggcagcagggc

SEQ ID NO: 7561377 - DNA, 22 bp, Homo sapiens
aggaaaaataaggcagcagggc

SEQ ID NO: 7561378 - DNA, 22 bp, Homo sapiens
aggaaaaataaggcagcagggc

SEQ ID NO: 7561379 - DNA, 22 bp, Homo sapiens
aggaaaaataaggcagcagggc

SEQ ID NO: 7561380 - DNA, 22 bp, Homo sapiens
aggaaaaataaggcagcagggc

SEQ ID NO: 7561381 - DNA, 22 bp, Homo sapiens
cagggacatttccaagagaatt

SEQ ID NO: 7561382 - DNA, 22 bp, Homo sapiens
cagggacatttccaagagaatt

SEQ ID NO: 7561383 - DNA, 22 bp, Homo sapiens
cagggacatttccaagagaatt

SEQ ID NO: 7561384 - DNA, 22 bp, Homo sapiens
cagggacatttccaagagaatt

SEQ ID NO: 7561385 - DNA, 22 bp, Homo sapiens
cagggacattggtggccaggtt

SEQ ID NO: 7561386 - DNA, 22 bp, Homo sapiens
cagggacatttccaagagaatt

SEQ ID NO: 7561387 - DNA, 22 bp, Homo sapiens
cagggacccgcacaggtagcat

SEQ ID NO: 7561388 - DNA, 22 bp, Homo sapiens
cagggacccgcacaggtagcat

SEQ ID NO: 7561389 - DNA, 22 bp, Homo sapiens
cagggacatgactggtctctgt

SEQ ID NO: 7561390 - DNA, 22 bp, Homo sapiens
cagggacatgactggtctctgt

SEQ ID NO: 7561391 - DNA, 22 bp, Homo sapiens
cagggacattggtggccaggtt

SEQ ID NO: 7561392 - DNA, 22 bp, Homo sapiens
cagggacattggtggccaggtt

SEQ ID NO: 7561393 - DNA, 22 bp, Homo sapiens
cagggacattggtggccaggtt

SEQ ID NO: 7561394 - DNA, 22 bp, Homo sapiens
cagggacattggtggccaggtt

SEQ ID NO: 7561395 - DNA, 22 bp, Homo sapiens
cagggacattggtggccaggtt

SEQ ID NO: 7561396 - DNA, 22 bp, Homo sapiens
cagggacattggtggccaggtt

SEQ ID NO: 7561397 - DNA, 22 bp, Homo sapiens
cagggacattggtggccaggtt

SEQ ID NO: 7561398 - DNA, 22 bp, Homo sapiens
cagggacattggtggccaggtt

SEQ ID NO: 7561399 - DNA, 22 bp, Homo sapiens
cagggactcccagggtagctcc

SEQ ID NO: 7561400 - DNA, 22 bp, Homo sapiens
cagggactcccagggtagctcc

SEQ ID NO: 7561401 - DNA, 22 bp, Homo sapiens
cagggactcccagggtagctcc

SEQ ID NO: 7561402 - DNA, 22 bp, Homo sapiens
cagggactcgctggacataccg

SEQ ID NO: 7561403 - DNA, 22 bp, Homo sapiens
cagggactcgctggacataccg

SEQ ID NO: 7561404 - DNA, 22 bp, Homo sapiens
cagggactcccagggtagctcc

SEQ ID NO: 7561405 - DNA, 22 bp, Homo sapiens
cagggaccctactagctcacac

SEQ ID NO: 7561406 - DNA, 22 bp, Homo sapiens
cagggactacagccagccctcc

SEQ ID NO: 7561407 - DNA, 22 bp, Homo sapiens
cagggaccctactagctcacac

SEQ ID NO: 7561408 - DNA, 22 bp, Homo sapiens
cagggactgagatccagactgt

SEQ ID NO: 7561409 - DNA, 22 bp, Homo sapiens
cagggagaaatctccaggaggt

SEQ ID NO: 7561410 - DNA, 22 bp, Homo sapiens
agctttggggacagccaaggtt

SEQ ID NO: 7561411 - DNA, 22 bp, Homo sapiens
agctttgggccactggctggat

SEQ ID NO: 7561412 - DNA, 22 bp, Homo sapiens
agctttgggccactggctggat

SEQ ID NO: 7561413 - DNA, 22 bp, Homo sapiens
agctttggggacagccaaggtt

SEQ ID NO: 7561414 - DNA, 22 bp, Homo sapiens
agctttgggggaggtagtctgt

SEQ ID NO: 7561415 - DNA, 22 bp, Homo sapiens
agctttgggggaggtagtctgt

SEQ ID NO: 7561416 - DNA, 22 bp, Homo sapiens
agctttgggggtaggtatagag

SEQ ID NO: 7561417 - DNA, 22 bp, Homo sapiens
cagggacagggatcatttgctt

SEQ ID NO: 7561418 - DNA, 22 bp, Homo sapiens
cagggacagcgggactctgaca

SEQ ID NO: 7561419 - DNA, 22 bp, Homo sapiens
cagggacagcgggactctgaca

SEQ ID NO: 7561420 - DNA, 22 bp, Homo sapiens
cagggacagcgggactctgaca

SEQ ID NO: 7561421 - DNA, 22 bp, Homo sapiens
cagggacaggggagaaaagatg

SEQ ID NO: 7561422 - DNA, 22 bp, Homo sapiens
cagggacagggatcatttgctt

SEQ ID NO: 7561423 - DNA, 22 bp, Homo sapiens
cagggacaggggagaaaagatg

SEQ ID NO: 7561424 - DNA, 22 bp, Homo sapiens
cagggacagggatcatttgctt

SEQ ID NO: 7561425 - DNA, 22 bp, Homo sapiens
cagggacaggggagaaaagatg

SEQ ID NO: 7561426 - DNA, 22 bp, Homo sapiens
cagggacaggggagaaaagatg

SEQ ID NO: 7561427 - DNA, 22 bp, Homo sapiens
cagggacaggggagaaaagatg

SEQ ID NO: 7561428 - DNA, 20 bp, Homo sapiens
cagggacagtggcagattca

SEQ ID NO: 7561429 - DNA, 20 bp, Homo sapiens
cagggacagtggcagattca

SEQ ID NO: 7561430 - DNA, 20 bp, Homo sapiens
cagggacagtggcagattca

SEQ ID NO: 7561431 - DNA, 22 bp, Homo sapiens
cagggacataagaggaacatgg

SEQ ID NO: 7561432 - DNA, 22 bp, Homo sapiens
cagggacataagaggaacatgg

SEQ ID NO: 7561433 - DNA, 22 bp, Homo sapiens
cagggacataagaggaacatgg

SEQ ID NO: 7561434 - DNA, 22 bp, Homo sapiens
cagggacataagaggaacatgg

SEQ ID NO: 7561435 - DNA, 22 bp, Homo sapiens
cagggacataagaggaacatgg

SEQ ID NO: 7561436 - DNA, 22 bp, Homo sapiens
cagggacataagaggaacatgg

SEQ ID NO: 7561437 - DNA, 22 bp, Homo sapiens
cagggacatgactggtctctgt

SEQ ID NO: 7561438 - DNA, 22 bp, Homo sapiens
cagggacatgactggtctctgt

SEQ ID NO: 7561439 - DNA, 22 bp, Homo sapiens
agctttctcttctttagaaagt

SEQ ID NO: 7561440 - DNA, 22 bp, Homo sapiens
agctttctctcagccaggctgc

SEQ ID NO: 7561441 - DNA, 22 bp, Homo sapiens
agctttctcttctttagaaagt

SEQ ID NO: 7561442 - DNA, 22 bp, Homo sapiens
agctttctggttacagtcttca

SEQ ID NO: 7561443 - DNA, 20 bp, Homo sapiens
agctttctccttggagctcc

SEQ ID NO: 7561444 - DNA, 20 bp, Homo sapiens
agctttctccttggagctcc

SEQ ID NO: 7561445 - DNA, 22 bp, Homo sapiens
agctttctatatatgagttgct

SEQ ID NO: 7561446 - DNA, 22 bp, Homo sapiens
agctttctccctgacgctttgg

SEQ ID NO: 7561447 - DNA, 22 bp, Homo sapiens
agctttctagatttggaattgt

SEQ ID NO: 7561448 - DNA, 22 bp, Homo sapiens
agctttctagtttagccatctt

SEQ ID NO: 7561449 - DNA, 22 bp, Homo sapiens
aggaaggtaatgaactgaggag

SEQ ID NO: 7561450 - DNA, 22 bp, Homo sapiens
aggaaggtgcagtagggtgtgc

SEQ ID NO: 7561451 - DNA, 22 bp, Homo sapiens
aggaaggtgcagtagggtgtgc

SEQ ID NO: 7561452 - DNA, 20 bp, Homo sapiens
aggaagtattgtcatgaagg

SEQ ID NO: 7561453 - DNA, 20 bp, Homo sapiens
aggaagtattgtcatgaagg

SEQ ID NO: 7561454 - DNA, 20 bp, Homo sapiens
aggaagtattgtcatgaagg

SEQ ID NO: 7561455 - DNA, 22 bp, Homo sapiens
aggaagtgaaagggaaggagtt

SEQ ID NO: 7561456 - DNA, 22 bp, Homo sapiens
aggaagtgaaagggaaggagtt

SEQ ID NO: 7561457 - DNA, 22 bp, Homo sapiens
aggaagtgaaagggaaggagtt

SEQ ID NO: 7561458 - DNA, 22 bp, Homo sapiens
aggaagtcagaatgctggggag

SEQ ID NO: 7561459 - DNA, 22 bp, Homo sapiens
aggaagtcagctgccatgctgt

SEQ ID NO: 7561460 - DNA, 22 bp, Homo sapiens
aggaagggttctttgtgaaaga

SEQ ID NO: 7561461 - DNA, 22 bp, Homo sapiens
aggaaggtaatgaactgaggag

SEQ ID NO: 7561462 - DNA, 22 bp, Homo sapiens
aggaaggtaatgaactgaggag

SEQ ID NO: 7561463 - DNA, 22 bp, Homo sapiens
aggaaggtaatgaactgaggag

SEQ ID NO: 7561464 - DNA, 22 bp, Homo sapiens
aggaaggtaatgaactgaggag

SEQ ID NO: 7561465 - DNA, 22 bp, Homo sapiens
aggaagggttctttgtgaaaga

SEQ ID NO: 7561466 - DNA, 22 bp, Homo sapiens
aggaagggttctttgtgaaaga

SEQ ID NO: 7561467 - DNA, 22 bp, Homo sapiens
aggaagggttctttgtgaaaga

SEQ ID NO: 7561468 - DNA, 22 bp, Homo sapiens
aggaagggttctttgtgaaaga

SEQ ID NO: 7561469 - DNA, 22 bp, Homo sapiens
aggaagggttctttgtgaaaga

SEQ ID NO: 7561470 - DNA, 22 bp, Homo sapiens
caggtcccgccccgggctgacc

SEQ ID NO: 7561471 - DNA, 22 bp, Homo sapiens
caggtcccgttccccagagatt

SEQ ID NO: 7561472 - DNA, 22 bp, Homo sapiens
aggaagtgaaagggaaggagtt

SEQ ID NO: 7561473 - DNA, 22 bp, Homo sapiens
caggtcccgttccccagagatt

SEQ ID NO: 7561474 - DNA, 22 bp, Homo sapiens
caggtcccgttccccagagatt

SEQ ID NO: 7561475 - DNA, 22 bp, Homo sapiens
caggtcccgccccgggctgacc

SEQ ID NO: 7561476 - DNA, 22 bp, Homo sapiens
caggtcccgccccgggctgacc

SEQ ID NO: 7561477 - DNA, 22 bp, Homo sapiens
caggtccccagggtacctacct

SEQ ID NO: 7561478 - DNA, 17 bp, Homo sapiens
caggtcccagggtctct

SEQ ID NO: 7561479 - DNA, 22 bp, Homo sapiens
caggtccccagggtacctacct

SEQ ID NO: 7561480 - DNA, 22 bp, Homo sapiens
caggtcccctcccctaccaggc

SEQ ID NO: 7561481 - DNA, 22 bp, Homo sapiens
caggtcccctcccctaccaggc

SEQ ID NO: 7561482 - DNA, 22 bp, Homo sapiens
caggtcccctcccctaccaggc

SEQ ID NO: 7561483 - DNA, 22 bp, Homo sapiens
caggtccagtcactggtctgca

SEQ ID NO: 7561484 - DNA, 22 bp, Homo sapiens
caggtccagtaaaaagagtcct

SEQ ID NO: 7561485 - DNA, 22 bp, Homo sapiens
caggtccagtaaaaagagtcct

SEQ ID NO: 7561486 - DNA, 22 bp, Homo sapiens
caggtccagtcactggtctgca

SEQ ID NO: 7561487 - DNA, 17 bp, Homo sapiens
caggtcccagggtctct

SEQ ID NO: 7561488 - DNA, 17 bp, Homo sapiens
caggtcccagggtctct

SEQ ID NO: 7561489 - DNA, 17 bp, Homo sapiens
caggtcccagggtctct

SEQ ID NO: 7561490 - DNA, 22 bp, Homo sapiens
caggtccagtaaaaagagtcct

SEQ ID NO: 7561491 - DNA, 20 bp, Homo sapiens
caggtccagcacgtgcacgg

SEQ ID NO: 7561492 - DNA, 20 bp, Homo sapiens
caggtccagcacgtgcacgg

SEQ ID NO: 7561493 - DNA, 22 bp, Homo sapiens
aggaagtgaaagggaaggagtt

SEQ ID NO: 7561494 - DNA, 22 bp, Homo sapiens
aggaaggggagaagttaaagct

SEQ ID NO: 7561495 - DNA, 22 bp, Homo sapiens
aggaaggggagaagttaaagct

SEQ ID NO: 7561496 - DNA, 22 bp, Homo sapiens
aggaagggtggatagtaacgtg

SEQ ID NO: 7561497 - DNA, 22 bp, Homo sapiens
aggaagggtggatagtaacgtg

SEQ ID NO: 7561498 - DNA, 22 bp, Homo sapiens
aggaagggtggatagtaacgtg

SEQ ID NO: 7561499 - DNA, 22 bp, Homo sapiens
aggaagggtggatagtaacgtg

SEQ ID NO: 7561500 - DNA, 22 bp, Homo sapiens
aggaagggtggatagtaacgtg

SEQ ID NO: 7561501 - DNA, 22 bp, Homo sapiens
aggaagggtggatagtaacgtg

SEQ ID NO: 7561502 - DNA, 22 bp, Homo sapiens
aggaagggtggatagtaacgtg

SEQ ID NO: 7561503 - DNA, 22 bp, Homo sapiens
aggaagggtggatagtaacgtg

SEQ ID NO: 7561504 - DNA, 22 bp, Homo sapiens
aggaagggctgtttctccaaga

SEQ ID NO: 7561505 - DNA, 20 bp, Homo sapiens
aggaaggagaatctgagcaa

SEQ ID NO: 7561506 - DNA, 20 bp, Homo sapiens
aggaaggagaatctgagcaa

SEQ ID NO: 7561507 - DNA, 20 bp, Homo sapiens
aggaaggagaatctgagcaa

SEQ ID NO: 7561508 - DNA, 22 bp, Homo sapiens
aggaaggggagaagttaaagct

SEQ ID NO: 7561509 - DNA, 22 bp, Homo sapiens
aggaaggggagaagttaaagct

SEQ ID NO: 7561510 - DNA, 22 bp, Homo sapiens
aggaaggggagaagttaaagct

SEQ ID NO: 7561511 - DNA, 22 bp, Homo sapiens
aggaaggggagaagttaaagct

SEQ ID NO: 7561512 - DNA, 22 bp, Homo sapiens
aggaaggggagaagttaaagct

SEQ ID NO: 7561513 - DNA, 22 bp, Homo sapiens
aggaaggggagaagttaaagct

SEQ ID NO: 7561514 - DNA, 22 bp, Homo sapiens
aggaaggggagaagttaaagct

SEQ ID NO: 7561515 - DNA, 22 bp, Homo sapiens
aggaagggtgtcatgagccctt

SEQ ID NO: 7561516 - DNA, 22 bp, Homo sapiens
aggaagggttctttctgtttat

SEQ ID NO: 7561517 - DNA, 22 bp, Homo sapiens
aggaagggttctttctgtttat

SEQ ID NO: 7561518 - DNA, 22 bp, Homo sapiens
aggaagggttctttctgtttat

SEQ ID NO: 7561519 - DNA, 22 bp, Homo sapiens
aggaagggttctttctgtttat

SEQ ID NO: 7561520 - DNA, 22 bp, Homo sapiens
aggaagggttctttctgtttat

SEQ ID NO: 7561521 - DNA, 22 bp, Homo sapiens
aggaagggttctttctgtttat

SEQ ID NO: 7561522 - DNA, 22 bp, Homo sapiens
aggaagggttctttgtgaaaga

SEQ ID NO: 7561523 - DNA, 22 bp, Homo sapiens
aggaagggttctttgtgaaaga

SEQ ID NO: 7561524 - DNA, 22 bp, Homo sapiens
aggaagggttctttgtgaaaga

SEQ ID NO: 7561525 - DNA, 22 bp, Homo sapiens
aggaagggttctttgtgaaaga

SEQ ID NO: 7561526 - DNA, 22 bp, Homo sapiens
aggaagggttctttgtgaaaga

SEQ ID NO: 7561527 - DNA, 22 bp, Homo sapiens
aggaagggttctttgtgaaaga

SEQ ID NO: 7561528 - DNA, 22 bp, Homo sapiens
aggaagggttctttgtgaaaga

SEQ ID NO: 7561529 - DNA, 22 bp, Homo sapiens
aggaagggtggatagtaacgtg

SEQ ID NO: 7561530 - DNA, 22 bp, Homo sapiens
aggaagggtgtcatgagccctt

SEQ ID NO: 7561531 - DNA, 22 bp, Homo sapiens
aggaagggtgtcatgagccctt

SEQ ID NO: 7561532 - DNA, 22 bp, Homo sapiens
aggaagggtgtcatgagccctt

SEQ ID NO: 7561533 - DNA, 22 bp, Homo sapiens
aggaagggtgtcatgagccctt

SEQ ID NO: 7561534 - DNA, 22 bp, Homo sapiens
aggaagggtggatagtaacgtg

SEQ ID NO: 7561535 - DNA, 22 bp, Homo sapiens
aggaagggtgtcatgagccctt

SEQ ID NO: 7561536 - DNA, 22 bp, Homo sapiens
aggaagggtgtcatgagccctt

SEQ ID NO: 7561537 - DNA, 22 bp, Homo sapiens
aggaagggtgtcatgagccctt

SEQ ID NO: 7561538 - DNA, 22 bp, Homo sapiens
aggaagggtgtcatgagccctt

SEQ ID NO: 7561539 - DNA, 22 bp, Homo sapiens
aggaagggtgtcatgagccctt

SEQ ID NO: 7561540 - DNA, 22 bp, Homo sapiens
aggaagggtgtcatgagccctt

SEQ ID NO: 7561541 - DNA, 22 bp, Homo sapiens
aggaagggtgtcatgagccctt

SEQ ID NO: 7561542 - DNA, 22 bp, Homo sapiens
caggtcctggcagctgactcag

SEQ ID NO: 7561543 - DNA, 22 bp, Homo sapiens
caggtcctggcagctgactcag

SEQ ID NO: 7561544 - DNA, 22 bp, Homo sapiens
caggtcctgcagggagagtaaa

SEQ ID NO: 7561545 - DNA, 22 bp, Homo sapiens
caggtcctgccttggttaccct

SEQ ID NO: 7561546 - DNA, 22 bp, Homo sapiens
caggtcctctgagatgggaggt

SEQ ID NO: 7561547 - DNA, 22 bp, Homo sapiens
caggtcctctgagatgggaggt

SEQ ID NO: 7561548 - DNA, 22 bp, Homo sapiens
caggtcctctgagatgggaggt

SEQ ID NO: 7561549 - DNA, 22 bp, Homo sapiens
caggtcctcgggggaggccggc

SEQ ID NO: 7561550 - DNA, 22 bp, Homo sapiens
caggtcctctgagatgggaggt

SEQ ID NO: 7561551 - DNA, 22 bp, Homo sapiens
caggtcctgcagggagagtaaa

SEQ ID NO: 7561552 - DNA, 22 bp, Homo sapiens
caggtcctgcagggagagtaaa

SEQ ID NO: 7561553 - DNA, 22 bp, Homo sapiens
caggtcctgcagggagagtaaa

SEQ ID NO: 7561554 - DNA, 22 bp, Homo sapiens
caggtcctcgggggaggccggc

SEQ ID NO: 7561555 - DNA, 22 bp, Homo sapiens
caggtcctcacgcctcaccctt

SEQ ID NO: 7561556 - DNA, 22 bp, Homo sapiens
caggtcctcgggggaggccggc

SEQ ID NO: 7561557 - DNA, 22 bp, Homo sapiens
caggtcctcgggggaggccggc

SEQ ID NO: 7561558 - DNA, 22 bp, Homo sapiens
caggtcctcgggggaggccggc

SEQ ID NO: 7561559 - DNA, 22 bp, Homo sapiens
caggtcccgttccccagagatt

SEQ ID NO: 7561560 - DNA, 22 bp, Homo sapiens
caggtcctcacgcctcaccctt

SEQ ID NO: 7561561 - DNA, 22 bp, Homo sapiens
caggtccctgcgccccggcctc

SEQ ID NO: 7561562 - DNA, 22 bp, Homo sapiens
caggtccctgcgccccggcctc

SEQ ID NO: 7561563 - DNA, 22 bp, Homo sapiens
caggtccctgcgccccggcctc

SEQ ID NO: 7561564 - DNA, 22 bp, Homo sapiens
aggaatgtcgtcataaacatga

SEQ ID NO: 7561565 - DNA, 14 bp, Homo sapiens
aggaatgtcctagg

SEQ ID NO: 7561566 - DNA, 22 bp, Homo sapiens
aggaatgacaggcctcccgcag

SEQ ID NO: 7561567 - DNA, 22 bp, Homo sapiens
aggaatgacagatgtccgcacc

SEQ ID NO: 7561568 - DNA, 22 bp, Homo sapiens
aggaatgacagatgtccgcacc

SEQ ID NO: 7561569 - DNA, 22 bp, Homo sapiens
aggaatgacagatgtccgcacc

SEQ ID NO: 7561570 - DNA, 22 bp, Homo sapiens
aggaatgaactcgagtgatctg

SEQ ID NO: 7561571 - DNA, 22 bp, Homo sapiens
caggtcctggcatcaggcaggt

SEQ ID NO: 7561572 - DNA, 22 bp, Homo sapiens
aggaatgaactcgagtgatctg

SEQ ID NO: 7561573 - DNA, 22 bp, Homo sapiens
caggtcctggcatcaggcaggt

SEQ ID NO: 7561574 - DNA, 22 bp, Homo sapiens
caggtcctggcatcaggcaggt

SEQ ID NO: 7561575 - DNA, 22 bp, Homo sapiens
caggtcctggcatcaggcaggt

SEQ ID NO: 7561576 - DNA, 22 bp, Homo sapiens
caggtcctggcatcaggcaggt

SEQ ID NO: 7561577 - DNA, 22 bp, Homo sapiens
caggtcctggcatcaggcaggt

SEQ ID NO: 7561578 - DNA, 22 bp, Homo sapiens
caggtcctggcatcaggcaggt

SEQ ID NO: 7561579 - DNA, 22 bp, Homo sapiens
caggtcctggcatcaggcaggt

SEQ ID NO: 7561580 - DNA, 22 bp, Homo sapiens
caggtcctggcatcaggcaggt

SEQ ID NO: 7561581 - DNA, 22 bp, Homo sapiens
caggtcctggcatcaggcaggt

SEQ ID NO: 7561582 - DNA, 22 bp, Homo sapiens
caggtcctggcatcaggcaggt

SEQ ID NO: 7561583 - DNA, 22 bp, Homo sapiens
caggtcctggcagctgactcag

SEQ ID NO: 7561584 - DNA, 22 bp, Homo sapiens
caggtcctggcagctgactcag

SEQ ID NO: 7561585 - DNA, 22 bp, Homo sapiens
aggaatgtttagaatgtcagaa

SEQ ID NO: 7561586 - DNA, 22 bp, Homo sapiens
aggaatgtttagaatgtcagaa

SEQ ID NO: 7561587 - DNA, 22 bp, Homo sapiens
aggaatgtttagaatgtcagaa

SEQ ID NO: 7561588 - DNA, 22 bp, Homo sapiens
aggaatgtttacacgacagaaa

SEQ ID NO: 7561589 - DNA, 22 bp, Homo sapiens
aggaatgttaagaaggtctacc

SEQ ID NO: 7561590 - DNA, 22 bp, Homo sapiens
aggaatgttaggagatgagtct

SEQ ID NO: 7561591 - DNA, 22 bp, Homo sapiens
aggaatgttagttctgtataca

SEQ ID NO: 7561592 - DNA, 22 bp, Homo sapiens
aggaatgttaaagattaagagc

SEQ ID NO: 7561593 - DNA, 22 bp, Homo sapiens
aggaatgtgtttctaggctgtt

SEQ ID NO: 7561594 - DNA, 22 bp, Homo sapiens
aggaatgtgtttctaggctgtt

SEQ ID NO: 7561595 - DNA, 16 bp, Homo sapiens
aggaatgtggcggaac

SEQ ID NO: 7561596 - DNA, 21 bp, Homo sapiens
aggaatgtgtatatatacaat

SEQ ID NO: 7561597 - DNA, 22 bp, Homo sapiens
aggaatgtgtgtccaccgggga

SEQ ID NO: 7561598 - DNA, 22 bp, Homo sapiens
aggaatgtctgagaaagaggca

SEQ ID NO: 7561599 - DNA, 22 bp, Homo sapiens
aggaatgtctgagaaagaggca

SEQ ID NO: 7561600 - DNA, 22 bp, Homo sapiens
aggaatgtgaaacaggtggctg

SEQ ID NO: 7561601 - DNA, 22 bp, Homo sapiens
aggaatgtgaaacaggtggctg

SEQ ID NO: 7561602 - DNA, 22 bp, Homo sapiens
aggaatgtgaggcaagttgtga

SEQ ID NO: 7561603 - DNA, 22 bp, Homo sapiens
aggaatgtgaggcaagttgtga

SEQ ID NO: 7561604 - DNA, 22 bp, Homo sapiens
aggaatgtgaccactagactct

SEQ ID NO: 7561605 - DNA, 22 bp, Homo sapiens
aggaatgtgactattttttcag

SEQ ID NO: 7561606 - DNA, 22 bp, Homo sapiens
aggaatgtggcaatcttcaagt

SEQ ID NO: 7561607 - DNA, 22 bp, Homo sapiens
aggaatgtggcctagggaggag

SEQ ID NO: 7561608 - DNA, 22 bp, Homo sapiens
aggaatgtggaaggtggcggcg

SEQ ID NO: 7561609 - DNA, 22 bp, Homo sapiens
aggaatgtgcctagcctccctg

SEQ ID NO: 7561610 - DNA, 23 bp, Homo sapiens
aggaatgtgcccacccatctcct

SEQ ID NO: 7561611 - DNA, 22 bp, Homo sapiens
aggaaacatgaatctgccttga

SEQ ID NO: 7561612 - DNA, 22 bp, Homo sapiens
aggaaacatgaatctgccttga

SEQ ID NO: 7561613 - DNA, 22 bp, Homo sapiens
aggaaacatgaatctgccttga

SEQ ID NO: 7561614 - DNA, 22 bp, Homo sapiens
aggaaacatgaatctgccttga

SEQ ID NO: 7561615 - DNA, 22 bp, Homo sapiens
aggaaacatgaatctgccttga

SEQ ID NO: 7561616 - DNA, 22 bp, Homo sapiens
aggaaacatccttatctattct

SEQ ID NO: 7561617 - DNA, 22 bp, Homo sapiens
aggaaacatgaatctgccttga

SEQ ID NO: 7561618 - DNA, 17 bp, Homo sapiens
aggaaacattttctttc

SEQ ID NO: 7561619 - DNA, 17 bp, Homo sapiens
aggaaacattttctttc

SEQ ID NO: 7561620 - DNA, 17 bp, Homo sapiens
aggaaacattttctttc

SEQ ID NO: 7561621 - DNA, 17 bp, Homo sapiens
aggaaacattttctttc

SEQ ID NO: 7561622 - DNA, 17 bp, Homo sapiens
aggaaacattttctttc

SEQ ID NO: 7561623 - DNA, 17 bp, Homo sapiens
aggaaacattttctttc

SEQ ID NO: 7561624 - DNA, 22 bp, Homo sapiens
aggaaacattgatattgggaaa

SEQ ID NO: 7561625 - DNA, 22 bp, Homo sapiens
aggaaacattgatattgggaaa

SEQ ID NO: 7561626 - DNA, 22 bp, Homo sapiens
aggaaacatgaatctgccttga

SEQ ID NO: 7561627 - DNA, 22 bp, Homo sapiens
aggaaacattgatattgggaaa

SEQ ID NO: 7561628 - DNA, 22 bp, Homo sapiens
aggaaacaggcagcctttgaac

SEQ ID NO: 7561629 - DNA, 22 bp, Homo sapiens
aggaaacaggcagcctttgaac

SEQ ID NO: 7561630 - DNA, 22 bp, Homo sapiens
aggaaacagagtgaagcttggg

SEQ ID NO: 7561631 - DNA, 22 bp, Homo sapiens
aggaaacagagtgaagcttggg

SEQ ID NO: 7561632 - DNA, 22 bp, Homo sapiens
aggaaacagagtgaagcttggg

SEQ ID NO: 7561633 - DNA, 22 bp, Homo sapiens
aggaaacagtgaacttggcagg

SEQ ID NO: 7561634 - DNA, 22 bp, Homo sapiens
aggaaacagtgaacttggcagg

SEQ ID NO: 7561635 - DNA, 22 bp, Homo sapiens
aggaaacatccttatctattct

SEQ ID NO: 7561636 - DNA, 22 bp, Homo sapiens
aggaaacatccttatctattct

SEQ ID NO: 7561637 - DNA, 22 bp, Homo sapiens
aggaaacatccttatctattct

SEQ ID NO: 7561638 - DNA, 22 bp, Homo sapiens
aggaaacatccttatctattct

SEQ ID NO: 7561639 - DNA, 22 bp, Homo sapiens
aggaaacatccttatctattct

SEQ ID NO: 7561640 - DNA, 22 bp, Homo sapiens
aggaaacagttggtaatgcata

SEQ ID NO: 7561641 - DNA, 22 bp, Homo sapiens
aggaaacagttggtaatgcata

SEQ ID NO: 7561642 - DNA, 22 bp, Homo sapiens
aggaaacagttggtaatgcata

SEQ ID NO: 7561643 - DNA, 22 bp, Homo sapiens
aggaaacagttggtaatgcata

SEQ ID NO: 7561644 - DNA, 22 bp, Homo sapiens
cagggtggtaccagcatctagt

SEQ ID NO: 7561645 - DNA, 22 bp, Homo sapiens
cagggtggggctggctatcaaa

SEQ ID NO: 7561646 - DNA, 22 bp, Homo sapiens
cagggtggtaccagcatctagt

SEQ ID NO: 7561647 - DNA, 22 bp, Homo sapiens
cagggtggtaccagcatctagt

SEQ ID NO: 7561648 - DNA, 22 bp, Homo sapiens
cagggtggtaccagcatctagt

SEQ ID NO: 7561649 - DNA, 22 bp, Homo sapiens
cagggtggtaccagcatctagt

SEQ ID NO: 7561650 - DNA, 22 bp, Homo sapiens
cagggtggtaccagcatctagt

SEQ ID NO: 7561651 - DNA, 22 bp, Homo sapiens
cagggtggtaccagcatctagt

SEQ ID NO: 7561652 - DNA, 22 bp, Homo sapiens
cagggtgctgcaccatccctca

SEQ ID NO: 7561653 - DNA, 22 bp, Homo sapiens
cagggtgcttagaaatggacct

SEQ ID NO: 7561654 - DNA, 22 bp, Homo sapiens
cagggtgctgcaccatccctca

SEQ ID NO: 7561655 - DNA, 22 bp, Homo sapiens
cagggtggggctggctatcaaa

SEQ ID NO: 7561656 - DNA, 22 bp, Homo sapiens
cagggtggggctggctatcaaa

SEQ ID NO: 7561657 - DNA, 22 bp, Homo sapiens
cagggtggggctggctatcaaa

SEQ ID NO: 7561658 - DNA, 22 bp, Homo sapiens
cagggtgtggtctgcattcgga

SEQ ID NO: 7561659 - DNA, 22 bp, Homo sapiens
cagggttcagtgggccctcttg

SEQ ID NO: 7561660 - DNA, 22 bp, Homo sapiens
cagggttctggaatataatgtg

SEQ ID NO: 7561661 - DNA, 22 bp, Homo sapiens
cagggttctggaatataatgtg

SEQ ID NO: 7561662 - DNA, 22 bp, Homo sapiens
cagggttgatgaattgtctgta

SEQ ID NO: 7561663 - DNA, 22 bp, Homo sapiens
cagggttgattccttctgaggg

SEQ ID NO: 7561664 - DNA, 22 bp, Homo sapiens
cagggttagagaaaatccttaa

SEQ ID NO: 7561665 - DNA, 22 bp, Homo sapiens
cagggttatacagctgaacaaa

SEQ ID NO: 7561666 - DNA, 22 bp, Homo sapiens
cagggttatacagctgaacaaa

SEQ ID NO: 7561667 - DNA, 22 bp, Homo sapiens
cagggttcagtgggccctcttg

SEQ ID NO: 7561668 - DNA, 22 bp, Homo sapiens
cagggtggtgaatagctatagt

SEQ ID NO: 7561669 - DNA, 22 bp, Homo sapiens
cagggtggtaccagcatctagt

SEQ ID NO: 7561670 - DNA, 22 bp, Homo sapiens
cagggtggtaccagcatctagt

SEQ ID NO: 7561671 - DNA, 22 bp, Homo sapiens
cagggtggtaccagcatctagt

SEQ ID NO: 7561672 - DNA, 22 bp, Homo sapiens
cagggtggtaccagcatctagt

SEQ ID NO: 7561673 - DNA, 22 bp, Homo sapiens
cagggtggtgaatagctatagt

SEQ ID NO: 7561674 - DNA, 22 bp, Homo sapiens
cagggtggtgaatagctatagt

SEQ ID NO: 7561675 - DNA, 22 bp, Homo sapiens
cagggtggtgaatagctatagt

SEQ ID NO: 7561676 - DNA, 22 bp, Homo sapiens
aggaagaggtgtgcaatggtgt

SEQ ID NO: 7561677 - DNA, 22 bp, Homo sapiens
aggaagaggtgtgcaatggtgt

SEQ ID NO: 7561678 - DNA, 22 bp, Homo sapiens
aggaagagtgttacctatgggt

SEQ ID NO: 7561679 - DNA, 22 bp, Homo sapiens
aggaagagtgttacctatgggt

SEQ ID NO: 7561680 - DNA, 22 bp, Homo sapiens
aggaagagtgttacctatgggt

SEQ ID NO: 7561681 - DNA, 22 bp, Homo sapiens
aggaagaggtgtgcaatggtgt

SEQ ID NO: 7561682 - DNA, 22 bp, Homo sapiens
aggaagaggtgtgcaatggtgt

SEQ ID NO: 7561683 - DNA, 22 bp, Homo sapiens
aggaagaggtgtgcaatggtgt

SEQ ID NO: 7561684 - DNA, 22 bp, Homo sapiens
aggaagaggtgtgcaatggtgt

SEQ ID NO: 7561685 - DNA, 22 bp, Homo sapiens
aggaagaggtgtgcaatggtgt

SEQ ID NO: 7561686 - DNA, 22 bp, Homo sapiens
aggaagaggtgtgcaatggtgt

SEQ ID NO: 7561687 - DNA, 22 bp, Homo sapiens
aggaagaggtgtgcaatggtgt

SEQ ID NO: 7561688 - DNA, 22 bp, Homo sapiens
aggaagaggtgtgcaatggtgt

SEQ ID NO: 7561689 - DNA, 22 bp, Homo sapiens
aggaagagtgttacctatgggt

SEQ ID NO: 7561690 - DNA, 20 bp, Homo sapiens
aggaagatcctttcttttaa

SEQ ID NO: 7561691 - DNA, 21 bp, Homo sapiens
aggaagatctggaggtcggcg

SEQ ID NO: 7561692 - DNA, 22 bp, Homo sapiens
aggaagagtgttacctatgggt

SEQ ID NO: 7561693 - DNA, 22 bp, Homo sapiens
aggaagagtgttacctatgggt

SEQ ID NO: 7561694 - DNA, 22 bp, Homo sapiens
aggaagagtgttacctatgggt

SEQ ID NO: 7561695 - DNA, 22 bp, Homo sapiens
aggaagagtgttacctatgggt

SEQ ID NO: 7561696 - DNA, 20 bp, Homo sapiens
aggaaggagaatctgagcaa

SEQ ID NO: 7561697 - DNA, 22 bp, Homo sapiens
aggaagcactggaaggggttgg

SEQ ID NO: 7561698 - DNA, 22 bp, Homo sapiens
aggaagcaccggaatgatgact

SEQ ID NO: 7561699 - DNA, 22 bp, Homo sapiens
aggaagcaccggaatgatgact

SEQ ID NO: 7561700 - DNA, 22 bp, Homo sapiens
aggaagcaccggaatgatgact

SEQ ID NO: 7561701 - DNA, 22 bp, Homo sapiens
aggaagcactggaaggggttgg

SEQ ID NO: 7561702 - DNA, 22 bp, Homo sapiens
aggaagatgtgcaaagttggaa

SEQ ID NO: 7561703 - DNA, 22 bp, Homo sapiens
aggaagatgggagagctctgga

SEQ ID NO: 7561704 - DNA, 22 bp, Homo sapiens
aggaagatgggagagctctgga

SEQ ID NO: 7561705 - DNA, 22 bp, Homo sapiens
aggaagatgggagagctctgga

SEQ ID NO: 7561706 - DNA, 22 bp, Homo sapiens
aggaagatgtgtttagcaggtt

SEQ ID NO: 7561707 - DNA, 22 bp, Homo sapiens
aggaagatgtgcaaagttggaa

SEQ ID NO: 7561708 - DNA, 22 bp, Homo sapiens
aggaagatgtgtttagcaggtt

SEQ ID NO: 7561709 - DNA, 22 bp, Homo sapiens
aggaagcaaaaggcagggtcta

SEQ ID NO: 7561710 - DNA, 22 bp, Homo sapiens
aggaagcaaaaggcagggtcta

SEQ ID NO: 7561711 - DNA, 22 bp, Homo sapiens
aggaagcaaaaggcagggtcta

SEQ ID NO: 7561712 - DNA, 22 bp, Homo sapiens
aggaagcaaaaggcagggtcta

SEQ ID NO: 7561713 - DNA, 22 bp, Homo sapiens
aggaagcaaaaggcagggtcta

SEQ ID NO: 7561714 - DNA, 22 bp, Homo sapiens
aggaagcaaaaggcagggtcta

SEQ ID NO: 7561715 - DNA, 22 bp, Homo sapiens
aggaagaggtagctgtcaaggg

SEQ ID NO: 7561716 - DNA, 22 bp, Homo sapiens
aggaagaggtagctgtcaaggg

SEQ ID NO: 7561717 - DNA, 22 bp, Homo sapiens
aggaagaggtagctgtcaaggg

SEQ ID NO: 7561718 - DNA, 22 bp, Homo sapiens
aggaagaggtagctgtcaaggg

SEQ ID NO: 7561719 - DNA, 22 bp, Homo sapiens
aggaagaggtagctgtcaaggg

SEQ ID NO: 7561720 - DNA, 22 bp, Homo sapiens
aggaagaggtagctgtcaaggg

SEQ ID NO: 7561721 - DNA, 22 bp, Homo sapiens
aggaagaggtagctgtcaaggg

SEQ ID NO: 7561722 - DNA, 22 bp, Homo sapiens
aggaagaggtagctgtcaaggg

SEQ ID NO: 7561723 - DNA, 22 bp, Homo sapiens
aggaagaggtagctgtcaaggg

SEQ ID NO: 7561724 - DNA, 22 bp, Homo sapiens
aggaagaggtagctgtcaaggg

SEQ ID NO: 7561725 - DNA, 22 bp, Homo sapiens
aggaagagggtggcagataatc

SEQ ID NO: 7561726 - DNA, 22 bp, Homo sapiens
aggaagagggtggcagataatc

SEQ ID NO: 7561727 - DNA, 22 bp, Homo sapiens
aggaagagggtggcagataatc

SEQ ID NO: 7561728 - DNA, 22 bp, Homo sapiens
aggaagagggtggcagataatc

SEQ ID NO: 7561729 - DNA, 22 bp, Homo sapiens
aggaagagggtggcagataatc

SEQ ID NO: 7561730 - DNA, 22 bp, Homo sapiens
aggaagaggtagctgtcaaggg

SEQ ID NO: 7561731 - DNA, 22 bp, Homo sapiens
aggaagaggtagctgtcaaggg

SEQ ID NO: 7561732 - DNA, 22 bp, Homo sapiens
aggaagaggtagctgtcaaggg

SEQ ID NO: 7561733 - DNA, 22 bp, Homo sapiens
aggaagagggtggcagataatc

SEQ ID NO: 7561734 - DNA, 22 bp, Homo sapiens
aggaagagggtggcagataatc

SEQ ID NO: 7561735 - DNA, 22 bp, Homo sapiens
aggaagagggtggcagataatc

SEQ ID NO: 7561736 - DNA, 22 bp, Homo sapiens
aggaagagggtggcagataatc

SEQ ID NO: 7561737 - DNA, 22 bp, Homo sapiens
cagggtttcaccatgttagcag

SEQ ID NO: 7561738 - DNA, 22 bp, Homo sapiens
cagggttggggtagataagaaa

SEQ ID NO: 7561739 - DNA, 22 bp, Homo sapiens
cagggttgtcagtgtttcaggt

SEQ ID NO: 7561740 - DNA, 22 bp, Homo sapiens
cagggttggtttctcctcaggc

SEQ ID NO: 7561741 - DNA, 22 bp, Homo sapiens
cagggttggtttctcctcaggc

SEQ ID NO: 7561742 - DNA, 22 bp, Homo sapiens
cagggttgcatgcatctgtggg

SEQ ID NO: 7561743 - DNA, 22 bp, Homo sapiens
cagggttgggctccaaggatgg

SEQ ID NO: 7561744 - DNA, 22 bp, Homo sapiens
cagggttgattccttctgaggg

SEQ ID NO: 7561745 - DNA, 22 bp, Homo sapiens
cagggttgcatgcatctgtggg

SEQ ID NO: 7561746 - DNA, 22 bp, Homo sapiens
cagggtttcaccatgttagcag

SEQ ID NO: 7561747 - DNA, 22 bp, Homo sapiens
cagggtttcaccatgttagcag

SEQ ID NO: 7561748 - DNA, 22 bp, Homo sapiens
cagggtttcaccatgttagcag

SEQ ID NO: 7561749 - DNA, 22 bp, Homo sapiens
cagggtttcaccatgttagcag

SEQ ID NO: 7561750 - DNA, 22 bp, Homo sapiens
cagggtttcaccatgttagcag

SEQ ID NO: 7561751 - DNA, 22 bp, Homo sapiens
cagggtttcaccatgttagcag

SEQ ID NO: 7561752 - DNA, 22 bp, Homo sapiens
cagggtttcaccatgttagcag

SEQ ID NO: 7561753 - DNA, 22 bp, Homo sapiens
cagggtttcaccatgttagcag

SEQ ID NO: 7561754 - DNA, 22 bp, Homo sapiens
cagggtttcaccatgttagcag

SEQ ID NO: 7561755 - DNA, 22 bp, Homo sapiens
cagggtttcaccatgttagcag

SEQ ID NO: 7561756 - DNA, 22 bp, Homo sapiens
aggggagcaacatagtcactct

SEQ ID NO: 7561757 - DNA, 22 bp, Homo sapiens
aggggaggagcttttcttgcct

SEQ ID NO: 7561758 - DNA, 22 bp, Homo sapiens
aggggaggagcttttcttgcct

SEQ ID NO: 7561759 - DNA, 22 bp, Homo sapiens
aggggaggagcttttcttgcct

SEQ ID NO: 7561760 - DNA, 22 bp, Homo sapiens
aggggaggagcttttcttgcct

SEQ ID NO: 7561761 - DNA, 22 bp, Homo sapiens
aggggaggcagcgataaacctg

SEQ ID NO: 7561762 - DNA, 22 bp, Homo sapiens
aggggaggcagcgataaacctg

SEQ ID NO: 7561763 - DNA, 22 bp, Homo sapiens
aggggaggcagcgataaacctg

SEQ ID NO: 7561764 - DNA, 22 bp, Homo sapiens
aggggaggcagcgataaacctg

SEQ ID NO: 7561765 - DNA, 22 bp, Homo sapiens
aggggaggcagcgataaacctg

SEQ ID NO: 7561766 - DNA, 22 bp, Homo sapiens
aggggaggcagcgataaacctg

SEQ ID NO: 7561767 - DNA, 22 bp, Homo sapiens
aggggaggcagcgataaacctg

SEQ ID NO: 7561768 - DNA, 22 bp, Homo sapiens
aggggaggcagcgataaacctg

SEQ ID NO: 7561769 - DNA, 22 bp, Homo sapiens
aggggaggcagcgataaacctg

SEQ ID NO: 7561770 - DNA, 22 bp, Homo sapiens
aggggaggcagcgataaacctg

SEQ ID NO: 7561771 - DNA, 22 bp, Homo sapiens
aggggaggcagcgataaacctg

SEQ ID NO: 7561772 - DNA, 22 bp, Homo sapiens
aggggaggtgtccccaaatctc

SEQ ID NO: 7561773 - DNA, 22 bp, Homo sapiens
aggggaggtgtccccaaatctc

SEQ ID NO: 7561774 - DNA, 22 bp, Homo sapiens
aggggaggtgtccccaaatctc

SEQ ID NO: 7561775 - DNA, 22 bp, Homo sapiens
aggggaggtgtccccaaatctc

SEQ ID NO: 7561776 - DNA, 22 bp, Homo sapiens
aggggaggtgtccccaaatctc

SEQ ID NO: 7561777 - DNA, 22 bp, Homo sapiens
aggggaggtgtccccaaatctc

SEQ ID NO: 7561778 - DNA, 22 bp, Homo sapiens
aggggaggtgtccccaaatctc

SEQ ID NO: 7561779 - DNA, 22 bp, Homo sapiens
aggggaggtgtccccaaatctc

SEQ ID NO: 7561780 - DNA, 22 bp, Homo sapiens
aggggaggtgtccccaaatctc

SEQ ID NO: 7561781 - DNA, 22 bp, Homo sapiens
aggggaggtgtccccaaatctc

SEQ ID NO: 7561782 - DNA, 22 bp, Homo sapiens
aggggatgcctagtggagtctc

SEQ ID NO: 7561783 - DNA, 22 bp, Homo sapiens
aggggatgcctagtggagtctc

SEQ ID NO: 7561784 - DNA, 22 bp, Homo sapiens
aggggatgcctagtggagtctc

SEQ ID NO: 7561785 - DNA, 22 bp, Homo sapiens
aggggatgcctagtggagtctc

SEQ ID NO: 7561786 - DNA, 22 bp, Homo sapiens
aggggatgcctagtggagtctc

SEQ ID NO: 7561787 - DNA, 22 bp, Homo sapiens
aggggatgcctagtggagtctc

SEQ ID NO: 7561788 - DNA, 22 bp, Homo sapiens
aggggatgatcctcccgcagcg

SEQ ID NO: 7561789 - DNA, 22 bp, Homo sapiens
aggggatgatcctcccgcagcg

SEQ ID NO: 7561790 - DNA, 22 bp, Homo sapiens
aggggatgatcctcccgcagcg

SEQ ID NO: 7561791 - DNA, 22 bp, Homo sapiens
aggggatgatcctcccgcagcg

SEQ ID NO: 7561792 - DNA, 22 bp, Homo sapiens
agggctggcatctctaatgctg

SEQ ID NO: 7561793 - DNA, 22 bp, Homo sapiens
agggctggcatctctaatgctg

SEQ ID NO: 7561794 - DNA, 22 bp, Homo sapiens
agggctggccacatgatttggt

SEQ ID NO: 7561795 - DNA, 22 bp, Homo sapiens
agggctggccacatgatttggt

SEQ ID NO: 7561796 - DNA, 22 bp, Homo sapiens
agggctggcatctctaatgctg

SEQ ID NO: 7561797 - DNA, 22 bp, Homo sapiens
agggctggcatctctaatgctg

SEQ ID NO: 7561798 - DNA, 22 bp, Homo sapiens
agggctggccacatgatttggt

SEQ ID NO: 7561799 - DNA, 22 bp, Homo sapiens
agggctggctaggtgcgttccc

SEQ ID NO: 7561800 - DNA, 22 bp, Homo sapiens
agggctggctaggtgcgttccc

SEQ ID NO: 7561801 - DNA, 22 bp, Homo sapiens
agggctggctaggtgcgttccc

SEQ ID NO: 7561802 - DNA, 22 bp, Homo sapiens
agggctggctaggtgcgttccc

SEQ ID NO: 7561803 - DNA, 22 bp, Homo sapiens
agggctggctaggtgcgttccc

SEQ ID NO: 7561804 - DNA, 22 bp, Homo sapiens
agggctggccacatgatttggt

SEQ ID NO: 7561805 - DNA, 22 bp, Homo sapiens
agggctggccacatgatttggt

SEQ ID NO: 7561806 - DNA, 22 bp, Homo sapiens
agggctggccacatgatttggt

SEQ ID NO: 7561807 - DNA, 22 bp, Homo sapiens
agggctggccacatgatttggt

SEQ ID NO: 7561808 - DNA, 22 bp, Homo sapiens
agggctggccacatgatttggt

SEQ ID NO: 7561809 - DNA, 22 bp, Homo sapiens
agggctggctaggtgcgttccc

SEQ ID NO: 7561810 - DNA, 22 bp, Homo sapiens
agggctggctccgttaccttga

SEQ ID NO: 7561811 - DNA, 22 bp, Homo sapiens
agggctggctccgttaccttga

SEQ ID NO: 7561812 - DNA, 22 bp, Homo sapiens
agggctggctccgttaccttga

SEQ ID NO: 7561813 - DNA, 22 bp, Homo sapiens
agggctggctccgttaccttga

SEQ ID NO: 7561814 - DNA, 22 bp, Homo sapiens
agggctggctccgttaccttga

SEQ ID NO: 7561815 - DNA, 22 bp, Homo sapiens
agggctggctccgttaccttga

SEQ ID NO: 7561816 - DNA, 22 bp, Homo sapiens
agggctggctaggtgcgttccc

SEQ ID NO: 7561817 - DNA, 22 bp, Homo sapiens
agggctggctaggtgcgttccc

SEQ ID NO: 7561818 - DNA, 22 bp, Homo sapiens
agggctggctaggtgcgttccc

SEQ ID NO: 7561819 - DNA, 22 bp, Homo sapiens
agggctggctaggtgcgttccc

SEQ ID NO: 7561820 - DNA, 22 bp, Homo sapiens
aggggagagttaatgtgaatgt

SEQ ID NO: 7561821 - DNA, 22 bp, Homo sapiens
agggctggctccgttaccttga

SEQ ID NO: 7561822 - DNA, 22 bp, Homo sapiens
agggctggctccgttaccttga

SEQ ID NO: 7561823 - DNA, 22 bp, Homo sapiens
aggggagagttaatgtgaatgt

SEQ ID NO: 7561824 - DNA, 22 bp, Homo sapiens
aggggagcaacatagtcactct

SEQ ID NO: 7561825 - DNA, 22 bp, Homo sapiens
aggggagcaacatagtcactct

SEQ ID NO: 7561826 - DNA, 22 bp, Homo sapiens
aggggagcaacatagtcactct

SEQ ID NO: 7561827 - DNA, 23 bp, Homo sapiens
aggggcagcaagttttggtgtta

SEQ ID NO: 7561828 - DNA, 23 bp, Homo sapiens
aggggcagcaagttttggtgtta

SEQ ID NO: 7561829 - DNA, 23 bp, Homo sapiens
aggggcagcaagttttggtgtta

SEQ ID NO: 7561830 - DNA, 23 bp, Homo sapiens
aggggcagcaagttttggtgtta

SEQ ID NO: 7561831 - DNA, 23 bp, Homo sapiens
aggggcagcaagttttggtgtta

SEQ ID NO: 7561832 - DNA, 22 bp, Homo sapiens
aggggcagcctcacaatcctct

SEQ ID NO: 7561833 - DNA, 22 bp, Homo sapiens
aggggcagcctcacaatcctct

SEQ ID NO: 7561834 - DNA, 22 bp, Homo sapiens
aggggcagcctcacaatcctct

SEQ ID NO: 7561835 - DNA, 22 bp, Homo sapiens
aggggcacttctcaggctgtgg

SEQ ID NO: 7561836 - DNA, 22 bp, Homo sapiens
aggggcacttctcaggctgtgg

SEQ ID NO: 7561837 - DNA, 22 bp, Homo sapiens
aggggcacttctcaggctgtgg

SEQ ID NO: 7561838 - DNA, 19 bp, Homo sapiens
aggggcactgtctctagag

SEQ ID NO: 7561839 - DNA, 19 bp, Homo sapiens
aggggcactgtctctagag

SEQ ID NO: 7561840 - DNA, 23 bp, Homo sapiens
aggggcagcaagttttggtgtta

SEQ ID NO: 7561841 - DNA, 23 bp, Homo sapiens
aggggcagcaagttttggtgtta

SEQ ID NO: 7561842 - DNA, 22 bp, Homo sapiens
aggggcacttctcaggctgtgg

SEQ ID NO: 7561843 - DNA, 22 bp, Homo sapiens
aggggcacttctcaggctgtgg

SEQ ID NO: 7561844 - DNA, 23 bp, Homo sapiens
aggggcagcaagttttggtgtta

SEQ ID NO: 7561845 - DNA, 23 bp, Homo sapiens
aggggcagcaagttttggtgtta

SEQ ID NO: 7561846 - DNA, 22 bp, Homo sapiens
cctgaaacagtccttgccctca

SEQ ID NO: 7561847 - DNA, 22 bp, Homo sapiens
cctcttccactgggccccatcc

SEQ ID NO: 7561848 - DNA, 22 bp, Homo sapiens
cctcttccactgggccccatcc

SEQ ID NO: 7561849 - DNA, 22 bp, Homo sapiens
cctcttcatcctggaagctgct

SEQ ID NO: 7561850 - DNA, 22 bp, Homo sapiens
aggggcagcctcacaatcctct

SEQ ID NO: 7561851 - DNA, 22 bp, Homo sapiens
aggggcagcctcacaatcctct

SEQ ID NO: 7561852 - DNA, 22 bp, Homo sapiens
aggggcagcctcacaatcctct

SEQ ID NO: 7561853 - DNA, 18 bp, Homo sapiens
aggggcagcttgtgtgga

SEQ ID NO: 7561854 - DNA, 18 bp, Homo sapiens
aggggcagcttgtgtgga

SEQ ID NO: 7561855 - DNA, 18 bp, Homo sapiens
aggggcagcttgtgtgga

SEQ ID NO: 7561856 - DNA, 18 bp, Homo sapiens
aggggcagcttgtgtgga

SEQ ID NO: 7561857 - DNA, 18 bp, Homo sapiens
aggggcagcttgtgtgga

SEQ ID NO: 7561858 - DNA, 18 bp, Homo sapiens
aggggcagcttgtgtgga

SEQ ID NO: 7561859 - DNA, 22 bp, Homo sapiens
cctcttcaggcactcgaaggcc

SEQ ID NO: 7561860 - DNA, 22 bp, Homo sapiens
aggggcaaatgtgagcctggaa

SEQ ID NO: 7561861 - DNA, 22 bp, Homo sapiens
aggggcaaatgtgagcctggaa

SEQ ID NO: 7561862 - DNA, 22 bp, Homo sapiens
aggggatggagctggaaggcag

SEQ ID NO: 7561863 - DNA, 20 bp, Homo sapiens
aggggcacctgcgacggggc

SEQ ID NO: 7561864 - DNA, 20 bp, Homo sapiens
aggggcacctgcgacggggc

SEQ ID NO: 7561865 - DNA, 20 bp, Homo sapiens
aggggcacctgcgacggggc

SEQ ID NO: 7561866 - DNA, 22 bp, Homo sapiens
aggggatggagctggaaggcag

SEQ ID NO: 7561867 - DNA, 22 bp, Homo sapiens
aggggatggagctggaaggcag

SEQ ID NO: 7561868 - DNA, 22 bp, Homo sapiens
aggggcacgagtagagctctag

SEQ ID NO: 7561869 - DNA, 22 bp, Homo sapiens
aggggcacgagtagagctctag

SEQ ID NO: 7561870 - DNA, 22 bp, Homo sapiens
aggggcacgagtagagctctag

SEQ ID NO: 7561871 - DNA, 22 bp, Homo sapiens
aggggcacggatgacctgttag

SEQ ID NO: 7561872 - DNA, 22 bp, Homo sapiens
aggggcacggatgacctgttag

SEQ ID NO: 7561873 - DNA, 22 bp, Homo sapiens
aggggcactagaatgggagact

SEQ ID NO: 7561874 - DNA, 22 bp, Homo sapiens
aggggcactagaatgggagact

SEQ ID NO: 7561875 - DNA, 22 bp, Homo sapiens
aggggcactagaatgggagact

SEQ ID NO: 7561876 - DNA, 22 bp, Homo sapiens
aggggcacgagtagagctctag

SEQ ID NO: 7561877 - DNA, 22 bp, Homo sapiens
aggggcacgagtagagctctag

SEQ ID NO: 7561878 - DNA, 22 bp, Homo sapiens
aggggcactagaatgggagact

SEQ ID NO: 7561879 - DNA, 22 bp, Homo sapiens
aggggcactagaatgggagact

SEQ ID NO: 7561880 - DNA, 22 bp, Homo sapiens
aggggcactagaatgggagact

SEQ ID NO: 7561881 - DNA, 19 bp, Homo sapiens
aggggcactgtctctagag

SEQ ID NO: 7561882 - DNA, 19 bp, Homo sapiens
aggggcactgtctctagag

SEQ ID NO: 7561883 - DNA, 19 bp, Homo sapiens
aggggcactgtctctagag

SEQ ID NO: 7561884 - DNA, 22 bp, Homo sapiens
aggggatgcctgaggatctgta

SEQ ID NO: 7561885 - DNA, 22 bp, Homo sapiens
aggggatggagctggaaggcag

SEQ ID NO: 7561886 - DNA, 22 bp, Homo sapiens
aggggatggagctggaaggcag

SEQ ID NO: 7561887 - DNA, 22 bp, Homo sapiens
aggggatggagctggaaggcag

SEQ ID NO: 7561888 - DNA, 22 bp, Homo sapiens
aggggatggagctggaaggcag

SEQ ID NO: 7561889 - DNA, 22 bp, Homo sapiens
aggggatggagctggaaggcag

SEQ ID NO: 7561890 - DNA, 22 bp, Homo sapiens
aggggatggagctggaaggcag

SEQ ID NO: 7561891 - DNA, 22 bp, Homo sapiens
aggggatggagctggaaggcag

SEQ ID NO: 7561892 - DNA, 22 bp, Homo sapiens
aggggatggagctggaaggcag

SEQ ID NO: 7561893 - DNA, 22 bp, Homo sapiens
aggggatggagctggaaggcag

SEQ ID NO: 7561894 - DNA, 22 bp, Homo sapiens
aggggatggagctggaaggcag

SEQ ID NO: 7561895 - DNA, 22 bp, Homo sapiens
aggggatggagctggaaggcag

SEQ ID NO: 7561896 - DNA, 22 bp, Homo sapiens
aggggatggagctggaaggcag

SEQ ID NO: 7561897 - DNA, 22 bp, Homo sapiens
aggggatgcctgaggatctgta

SEQ ID NO: 7561898 - DNA, 22 bp, Homo sapiens
aggggatgcctgaggatctgta

SEQ ID NO: 7561899 - DNA, 22 bp, Homo sapiens
aggggatgcctgaggatctgta

SEQ ID NO: 7561900 - DNA, 22 bp, Homo sapiens
aggggatgcctgaggatctgta

SEQ ID NO: 7561901 - DNA, 22 bp, Homo sapiens
aggggatgcctgaggatctgta

SEQ ID NO: 7561902 - DNA, 22 bp, Homo sapiens
aggggatgcctagtggagtctc

SEQ ID NO: 7561903 - DNA, 22 bp, Homo sapiens
aggggatgcctgaggatctgta

SEQ ID NO: 7561904 - DNA, 22 bp, Homo sapiens
aggggatggagctggaaggcag

SEQ ID NO: 7561905 - DNA, 22 bp, Homo sapiens
aggggatgcctgaggatctgta

SEQ ID NO: 7561906 - DNA, 22 bp, Homo sapiens
aggggatgcctgaggatctgta

SEQ ID NO: 7561907 - DNA, 22 bp, Homo sapiens
aggggatgcctgaggatctgta

SEQ ID NO: 7561908 - DNA, 22 bp, Homo sapiens
aggggatgcctgaggatctgta

SEQ ID NO: 7561909 - DNA, 22 bp, Homo sapiens
cctgaagatccattatagacac

SEQ ID NO: 7561910 - DNA, 22 bp, Homo sapiens
cctgaagcaagggtaggcaggt

SEQ ID NO: 7561911 - DNA, 22 bp, Homo sapiens
cctgaagatgctgtggcctggt

SEQ ID NO: 7561912 - DNA, 22 bp, Homo sapiens
cctgagagagtgagccctgaca

SEQ ID NO: 7561913 - DNA, 22 bp, Homo sapiens
cctgagagagtgagccctgaca

SEQ ID NO: 7561914 - DNA, 22 bp, Homo sapiens
cctgaagcaagggtaggcaggt

SEQ ID NO: 7561915 - DNA, 22 bp, Homo sapiens
cctgagagcattccacactgaa

SEQ ID NO: 7561916 - DNA, 22 bp, Homo sapiens
cctgagagcagcttcctgctta

SEQ ID NO: 7561917 - DNA, 22 bp, Homo sapiens
cctgagagcagcttcctgctta

SEQ ID NO: 7561918 - DNA, 22 bp, Homo sapiens
cctgagagagtgagccctgaca

SEQ ID NO: 7561919 - DNA, 22 bp, Homo sapiens
cctgagagccagtgcctgccca

SEQ ID NO: 7561920 - DNA, 22 bp, Homo sapiens
cctgagagccagtgcctgccca

SEQ ID NO: 7561921 - DNA, 22 bp, Homo sapiens
cctgagagccctagccaggcgc

SEQ ID NO: 7561922 - DNA, 22 bp, Homo sapiens
cctgagagccctagccaggcgc

SEQ ID NO: 7561923 - DNA, 22 bp, Homo sapiens
cctgagagccagtgcctgccca

SEQ ID NO: 7561924 - DNA, 22 bp, Homo sapiens
cctgagagccagtgcctgccca

SEQ ID NO: 7561925 - DNA, 22 bp, Homo sapiens
cctgagagcattccacactgaa

SEQ ID NO: 7561926 - DNA, 22 bp, Homo sapiens
cctgagagcattccacactgaa

SEQ ID NO: 7561927 - DNA, 22 bp, Homo sapiens
cctgagaggccctctcactgtc

SEQ ID NO: 7561928 - DNA, 22 bp, Homo sapiens
cctgagaggccctctcactgtc

SEQ ID NO: 7561929 - DNA, 22 bp, Homo sapiens
cctgagaggccctctcactgtc

SEQ ID NO: 7561930 - DNA, 22 bp, Homo sapiens
cctgagagcgagtggcctcatg

SEQ ID NO: 7561931 - DNA, 22 bp, Homo sapiens
cctgagagcgagtggcctcatg

SEQ ID NO: 7561932 - DNA, 22 bp, Homo sapiens
cctgagagcgagtggcctcatg

SEQ ID NO: 7561933 - DNA, 22 bp, Homo sapiens
cctgagagcgagtggcctcatg

SEQ ID NO: 7561934 - DNA, 22 bp, Homo sapiens
cctgagagcgagtggcctcatg

SEQ ID NO: 7561935 - DNA, 22 bp, Homo sapiens
cctgagagccctagccaggcgc

SEQ ID NO: 7561936 - DNA, 22 bp, Homo sapiens
cctgagagccctagccaggcgc

SEQ ID NO: 7561937 - DNA, 22 bp, Homo sapiens
cctgagaggttggcctgtccag

SEQ ID NO: 7561938 - DNA, 22 bp, Homo sapiens
cctgagagggggccctagaaat

SEQ ID NO: 7561939 - DNA, 22 bp, Homo sapiens
cctgagagtaggtgtctcttta

SEQ ID NO: 7561940 - DNA, 22 bp, Homo sapiens
cctgagagggggccctagaaat

SEQ ID NO: 7561941 - DNA, 22 bp, Homo sapiens
cctgagagggggccctagaaat

SEQ ID NO: 7561942 - DNA, 22 bp, Homo sapiens
cctgagagggggccctagaaat

SEQ ID NO: 7561943 - DNA, 22 bp, Homo sapiens
cctgagaggccctctcactgtc

SEQ ID NO: 7561944 - DNA, 22 bp, Homo sapiens
cctgagaggccctctcactgtc

SEQ ID NO: 7561945 - DNA, 22 bp, Homo sapiens
cctgagaggccctctcactgtc

SEQ ID NO: 7561946 - DNA, 22 bp, Homo sapiens
cctgaagacaacttttatcacc

SEQ ID NO: 7561947 - DNA, 22 bp, Homo sapiens
cctgaagacaacttttatcacc

SEQ ID NO: 7561948 - DNA, 22 bp, Homo sapiens
cctgaagagcactctagagttg

SEQ ID NO: 7561949 - DNA, 22 bp, Homo sapiens
cctgaagaattcaaatccagat

SEQ ID NO: 7561950 - DNA, 22 bp, Homo sapiens
cctgaagaattcaaatccagat

SEQ ID NO: 7561951 - DNA, 22 bp, Homo sapiens
cctgaagaattcaaatccagat

SEQ ID NO: 7561952 - DNA, 22 bp, Homo sapiens
cctgaagagcactctagagttg

SEQ ID NO: 7561953 - DNA, 22 bp, Homo sapiens
cctgaagagcactctagagttg

SEQ ID NO: 7561954 - DNA, 22 bp, Homo sapiens
cctgaagagcactctagagttg

SEQ ID NO: 7561955 - DNA, 22 bp, Homo sapiens
cctgaagagtgaatgtggcagt

SEQ ID NO: 7561956 - DNA, 22 bp, Homo sapiens
cctgaagagcactctagagttg

SEQ ID NO: 7561957 - DNA, 22 bp, Homo sapiens
cctgaagagcactctagagttg

SEQ ID NO: 7561958 - DNA, 22 bp, Homo sapiens
cctgaagatgctgtggcctggt

SEQ ID NO: 7561959 - DNA, 22 bp, Homo sapiens
cctgaagatgagggacagctaa

SEQ ID NO: 7561960 - DNA, 22 bp, Homo sapiens
cctgaagatgctgtggcctggt

SEQ ID NO: 7561961 - DNA, 22 bp, Homo sapiens
cctgaagatgagggacagctaa

SEQ ID NO: 7561962 - DNA, 22 bp, Homo sapiens
cctgaagatccattatagacac

SEQ ID NO: 7561963 - DNA, 22 bp, Homo sapiens
cctgaagatccattatagacac

SEQ ID NO: 7561964 - DNA, 22 bp, Homo sapiens
cctgaagagtgaatgtggcagt

SEQ ID NO: 7561965 - DNA, 20 bp, Homo sapiens
cctgaagagtttctctttct

SEQ ID NO: 7561966 - DNA, 20 bp, Homo sapiens
cctgaagagtttctctttct

SEQ ID NO: 7561967 - DNA, 22 bp, Homo sapiens
cctgaagatccattatagacac

SEQ ID NO: 7561968 - DNA, 20 bp, Homo sapiens
cctgaagagtttctctttct

SEQ ID NO: 7561969 - DNA, 22 bp, Homo sapiens
cctgaagaaaattccacgagaa

SEQ ID NO: 7561970 - DNA, 22 bp, Homo sapiens
cctgaagaagttgttatggtct

SEQ ID NO: 7561971 - DNA, 22 bp, Homo sapiens
cctgaagaagttgttatggtct

SEQ ID NO: 7561972 - DNA, 22 bp, Homo sapiens
cctgaagaacctcacgggcact

SEQ ID NO: 7561973 - DNA, 21 bp, Homo sapiens
cctgaaattctcactagctta

SEQ ID NO: 7561974 - DNA, 22 bp, Homo sapiens
cctgaaatttgaagacctgaat

SEQ ID NO: 7561975 - DNA, 22 bp, Homo sapiens
cctgaaatttgaagacctgaat

SEQ ID NO: 7561976 - DNA, 22 bp, Homo sapiens
cctgaacaaatggcatagccaa

SEQ ID NO: 7561977 - DNA, 22 bp, Homo sapiens
cctgaaatgactccagctgagt

SEQ ID NO: 7561978 - DNA, 22 bp, Homo sapiens
cctgaaatgagttctgctcact

SEQ ID NO: 7561979 - DNA, 22 bp, Homo sapiens
cctgaaatgactccagctgagt

SEQ ID NO: 7561980 - DNA, 21 bp, Homo sapiens
cctgaaattctcactagctta

SEQ ID NO: 7561981 - DNA, 22 bp, Homo sapiens
cctgaaatccatagtttacact

SEQ ID NO: 7561982 - DNA, 22 bp, Homo sapiens
cctgaaatgactccagctgagt

SEQ ID NO: 7561983 - DNA, 22 bp, Homo sapiens
cctgaaatccatagtttacact

SEQ ID NO: 7561984 - DNA, 22 bp, Homo sapiens
agggtaggaactgagtggaagg

SEQ ID NO: 7561985 - DNA, 22 bp, Homo sapiens
agggtaggaactgagtggaagg

SEQ ID NO: 7561986 - DNA, 22 bp, Homo sapiens
aggggtgaaggcccgataggag

SEQ ID NO: 7561987 - DNA, 22 bp, Homo sapiens
aggggtgaaggcccgataggag

SEQ ID NO: 7561988 - DNA, 22 bp, Homo sapiens
aggggtgacacatatcagtgca

SEQ ID NO: 7561989 - DNA, 22 bp, Homo sapiens
aggggtgaaggcccgataggag

SEQ ID NO: 7561990 - DNA, 22 bp, Homo sapiens
cctgagagtgagtgcctcctta

SEQ ID NO: 7561991 - DNA, 22 bp, Homo sapiens
cctgagagtgagtgccacctta

SEQ ID NO: 7561992 - DNA, 22 bp, Homo sapiens
cctgagagtgagtgcctcctta

SEQ ID NO: 7561993 - DNA, 22 bp, Homo sapiens
cctgagagtgagtgcctcctta

SEQ ID NO: 7561994 - DNA, 22 bp, Homo sapiens
cctgagaggttggcctgtccag

SEQ ID NO: 7561995 - DNA, 22 bp, Homo sapiens
cctgagagtgagggcctcctta

SEQ ID NO: 7561996 - DNA, 22 bp, Homo sapiens
cctgagagtgagggcctcctta

SEQ ID NO: 7561997 - DNA, 22 bp, Homo sapiens
cctgagagtgagggcctcctta

SEQ ID NO: 7561998 - DNA, 22 bp, Homo sapiens
cctgagagtaggtgtctcttta

SEQ ID NO: 7561999 - DNA, 22 bp, Homo sapiens
cctgagagtgagtgccacctta

SEQ ID NO: 7562000 - DNA, 22 bp, Homo sapiens
cctgagagtgagtgccacctta

SEQ ID NO: 7562001 - DNA, 22 bp, Homo sapiens
agggtagggcccggagacagac

SEQ ID NO: 7562002 - DNA, 22 bp, Homo sapiens
agggtagggcccggagacagac

SEQ ID NO: 7562003 - DNA, 22 bp, Homo sapiens
agggtagggcccggagacagac

SEQ ID NO: 7562004 - DNA, 22 bp, Homo sapiens
agggtagggccgtagggccatg

SEQ ID NO: 7562005 - DNA, 22 bp, Homo sapiens
agggtagggcccggagacagac

SEQ ID NO: 7562006 - DNA, 22 bp, Homo sapiens
agggtagggcccggagacagac

SEQ ID NO: 7562007 - DNA, 22 bp, Homo sapiens
agggtagggccgtagggccatg

SEQ ID NO: 7562008 - DNA, 22 bp, Homo sapiens
agggtagggcccggagacagac

SEQ ID NO: 7562009 - DNA, 22 bp, Homo sapiens
agggtagggcccggagacagac

SEQ ID NO: 7562010 - DNA, 22 bp, Homo sapiens
agggtagggcccggagacagac

SEQ ID NO: 7562011 - DNA, 22 bp, Homo sapiens
agggtagggcccggagacagac

SEQ ID NO: 7562012 - DNA, 22 bp, Homo sapiens
agggtagggcccggagacagac

SEQ ID NO: 7562013 - DNA, 22 bp, Homo sapiens
agggtaggaactgagtggaagg

SEQ ID NO: 7562014 - DNA, 22 bp, Homo sapiens
agggtagggcccggagacagac

SEQ ID NO: 7562015 - DNA, 22 bp, Homo sapiens
agggtaggaactgagtggaagg

SEQ ID NO: 7562016 - DNA, 22 bp, Homo sapiens
agggtaggaactgagtggaagg

SEQ ID NO: 7562017 - DNA, 22 bp, Homo sapiens
agggtaggaactgagtggaagg

SEQ ID NO: 7562018 - DNA, 22 bp, Homo sapiens
agggtaggaactgagtggaagg

SEQ ID NO: 7562019 - DNA, 22 bp, Homo sapiens
agggtaggaactgagtggaagg

SEQ ID NO: 7562020 - DNA, 22 bp, Homo sapiens
agggtagggccgtagggccatg

SEQ ID NO: 7562021 - DNA, 22 bp, Homo sapiens
agggtagggtaaatgatgcatc

SEQ ID NO: 7562022 - DNA, 22 bp, Homo sapiens
agggtagggtaaatgatgcatc

SEQ ID NO: 7562023 - DNA, 22 bp, Homo sapiens
agggtagggtaaatgatgcatc

SEQ ID NO: 7562024 - DNA, 22 bp, Homo sapiens
agggtagggccgtagggccatg

SEQ ID NO: 7562025 - DNA, 22 bp, Homo sapiens
agggtagggccgtagggccatg

SEQ ID NO: 7562026 - DNA, 22 bp, Homo sapiens
agggtagggccgtagggccatg

SEQ ID NO: 7562027 - DNA, 22 bp, Homo sapiens
agggtagggccgtagggccatg

SEQ ID NO: 7562028 - DNA, 22 bp, Homo sapiens
agggtagggccgtagggccatg

SEQ ID NO: 7562029 - DNA, 22 bp, Homo sapiens
agggtaggtgtaagatagccct

SEQ ID NO: 7562030 - DNA, 22 bp, Homo sapiens
agggtaggtgtaagatagccct

SEQ ID NO: 7562031 - DNA, 22 bp, Homo sapiens
agggtatgttttaggctgagtt

SEQ ID NO: 7562032 - DNA, 22 bp, Homo sapiens
agggtaggtgtaagatagccct

SEQ ID NO: 7562033 - DNA, 22 bp, Homo sapiens
agggtagggtaaatgatgcatc

SEQ ID NO: 7562034 - DNA, 22 bp, Homo sapiens
agggtagggtaaatgatgcatc

SEQ ID NO: 7562035 - DNA, 22 bp, Homo sapiens
agggtagggtaaatgatgcatc

SEQ ID NO: 7562036 - DNA, 22 bp, Homo sapiens
agggtagggtaaatgatgcatc

SEQ ID NO: 7562037 - DNA, 22 bp, Homo sapiens
agggtagggtaaatgatgcatc

SEQ ID NO: 7562038 - DNA, 22 bp, Homo sapiens
cctgaggtggctgcagcactgc

SEQ ID NO: 7562039 - DNA, 22 bp, Homo sapiens
cctgaggtctagagtcagggtg

SEQ ID NO: 7562040 - DNA, 22 bp, Homo sapiens
agggtcaccagttcataggcac

SEQ ID NO: 7562041 - DNA, 22 bp, Homo sapiens
agggtcacctgcttgccagggc

SEQ ID NO: 7562042 - DNA, 22 bp, Homo sapiens
cctgaggtctagagtcagggtg

SEQ ID NO: 7562043 - DNA, 22 bp, Homo sapiens
agggtcaagaggcagagttctt

SEQ ID NO: 7562044 - DNA, 22 bp, Homo sapiens
agggtcacaatgtgtgaattgg

SEQ ID NO: 7562045 - DNA, 22 bp, Homo sapiens
agggtcacaatgtgtgaattgg

SEQ ID NO: 7562046 - DNA, 22 bp, Homo sapiens
agggtcaccagttcataggcac

SEQ ID NO: 7562047 - DNA, 22 bp, Homo sapiens
agggtcaccagttcataggcac

SEQ ID NO: 7562048 - DNA, 22 bp, Homo sapiens
agggtcaccagttcataggcac

SEQ ID NO: 7562049 - DNA, 22 bp, Homo sapiens
agggtcacctgcttgccagggc

SEQ ID NO: 7562050 - DNA, 22 bp, Homo sapiens
agggtcaaatgggcaggaagag

SEQ ID NO: 7562051 - DNA, 22 bp, Homo sapiens
agggtatgttttaggctgagtt

SEQ ID NO: 7562052 - DNA, 22 bp, Homo sapiens
agggtcaacaggagtcaagatg

SEQ ID NO: 7562053 - DNA, 22 bp, Homo sapiens
agggtcaaaggaaaggcccaca

SEQ ID NO: 7562054 - DNA, 22 bp, Homo sapiens
agggtcaaatgggcaggaagag

SEQ ID NO: 7562055 - DNA, 22 bp, Homo sapiens
agggccttgctgtctgaagctg

SEQ ID NO: 7562056 - DNA, 22 bp, Homo sapiens
agggcgacaatggagagcgttt

SEQ ID NO: 7562057 - DNA, 22 bp, Homo sapiens
agggcgacaatggagagcgttt

SEQ ID NO: 7562058 - DNA, 22 bp, Homo sapiens
agggcgacaatggagagcgttt

SEQ ID NO: 7562059 - DNA, 22 bp, Homo sapiens
agggcgacaatggagagcgttt

SEQ ID NO: 7562060 - DNA, 22 bp, Homo sapiens
agggcgaggagacggaggcaca

SEQ ID NO: 7562061 - DNA, 22 bp, Homo sapiens
agggcgcctgctgtggccaccg

SEQ ID NO: 7562062 - DNA, 22 bp, Homo sapiens
agggcgcatctctggggtgaat

SEQ ID NO: 7562063 - DNA, 22 bp, Homo sapiens
agggcgcctgctgtggccaccg

SEQ ID NO: 7562064 - DNA, 22 bp, Homo sapiens
agggcgcatctctggggtgaat

SEQ ID NO: 7562065 - DNA, 22 bp, Homo sapiens
agggcgctgaaatactaacatg

SEQ ID NO: 7562066 - DNA, 22 bp, Homo sapiens
agggcgctgaaatactaacatg

SEQ ID NO: 7562067 - DNA, 22 bp, Homo sapiens
agggcgaggagacggaggcaca

SEQ ID NO: 7562068 - DNA, 22 bp, Homo sapiens
agggcgaggagacggaggcaca

SEQ ID NO: 7562069 - DNA, 22 bp, Homo sapiens
agggcgaggagacggaggcaca

SEQ ID NO: 7562070 - DNA, 22 bp, Homo sapiens
agggcgaggagacggaggcaca

SEQ ID NO: 7562071 - DNA, 22 bp, Homo sapiens
agggcgaggagacggaggcaca

SEQ ID NO: 7562072 - DNA, 22 bp, Homo sapiens
agggcgaggagacggaggcaca

SEQ ID NO: 7562073 - DNA, 22 bp, Homo sapiens
agggcgaggagacggaggcaca

SEQ ID NO: 7562074 - DNA, 19 bp, Homo sapiens
agggcgtggtggcacatgt

SEQ ID NO: 7562075 - DNA, 19 bp, Homo sapiens
agggcgtggtggcacatgt

SEQ ID NO: 7562076 - DNA, 19 bp, Homo sapiens
agggcggggcccaggcaca

SEQ ID NO: 7562077 - DNA, 22 bp, Homo sapiens
agggcgtggtggtgctggagca

SEQ ID NO: 7562078 - DNA, 19 bp, Homo sapiens
agggcgtggtggcacatgt

SEQ ID NO: 7562079 - DNA, 19 bp, Homo sapiens
agggcgtggtggcacatgt

SEQ ID NO: 7562080 - DNA, 22 bp, Homo sapiens
agggcgtggtggtgctggagca

SEQ ID NO: 7562081 - DNA, 22 bp, Homo sapiens
agggcgtggtggtgctggagca

SEQ ID NO: 7562082 - DNA, 22 bp, Homo sapiens
agggcgtggtggtgctggagca

SEQ ID NO: 7562083 - DNA, 22 bp, Homo sapiens
agggcgtggtggtgctggagca

SEQ ID NO: 7562084 - DNA, 22 bp, Homo sapiens
agggcgtggtggtgctggagca

SEQ ID NO: 7562085 - DNA, 22 bp, Homo sapiens
agggcgtggtggtgctggagca

SEQ ID NO: 7562086 - DNA, 22 bp, Homo sapiens
agggcgggctcatcacatgctc

SEQ ID NO: 7562087 - DNA, 22 bp, Homo sapiens
agggcgggctcatcacatgctc

SEQ ID NO: 7562088 - DNA, 22 bp, Homo sapiens
agggcgggctcatcacatgctc

SEQ ID NO: 7562089 - DNA, 22 bp, Homo sapiens
agggcgggctcatcacatgctc

SEQ ID NO: 7562090 - DNA, 19 bp, Homo sapiens
agggcggggcccaggcaca

SEQ ID NO: 7562091 - DNA, 19 bp, Homo sapiens
agggcggggcccaggcaca

SEQ ID NO: 7562092 - DNA, 22 bp, Homo sapiens
agggcgggctcatcacatgctc

SEQ ID NO: 7562093 - DNA, 22 bp, Homo sapiens
agggcgctgaaatactaacatg

SEQ ID NO: 7562094 - DNA, 22 bp, Homo sapiens
agggcgctgaaatactaacatg

SEQ ID NO: 7562095 - DNA, 22 bp, Homo sapiens
agggcgctgtctggccagcggt

SEQ ID NO: 7562096 - DNA, 22 bp, Homo sapiens
cctcaggcaggaaactgtcccg

SEQ ID NO: 7562097 - DNA, 22 bp, Homo sapiens
cctcaggcaggaaactgtcccg

SEQ ID NO: 7562098 - DNA, 22 bp, Homo sapiens
cctcaggcaggaaactgtcccg

SEQ ID NO: 7562099 - DNA, 22 bp, Homo sapiens
cctcaggcaggaaactgtcccg

SEQ ID NO: 7562100 - DNA, 22 bp, Homo sapiens
cctcaggcaggaaactgtcccg

SEQ ID NO: 7562101 - DNA, 22 bp, Homo sapiens
cctcaggcaggaaactgtcccg

SEQ ID NO: 7562102 - DNA, 22 bp, Homo sapiens
cctcaggcaagtcacttaacat

SEQ ID NO: 7562103 - DNA, 22 bp, Homo sapiens
cctcaggcaagtcacttaacat

SEQ ID NO: 7562104 - DNA, 20 bp, Homo sapiens
cctcaggatgagggtgagca

SEQ ID NO: 7562105 - DNA, 20 bp, Homo sapiens
cctcaggatgagggtgagca

SEQ ID NO: 7562106 - DNA, 22 bp, Homo sapiens
cctcaggatccgcaggtgcagt

SEQ ID NO: 7562107 - DNA, 22 bp, Homo sapiens
cctcaggatccgcaggtgcagt

SEQ ID NO: 7562108 - DNA, 22 bp, Homo sapiens
cctcaggatccgcaggtgcagt

SEQ ID NO: 7562109 - DNA, 22 bp, Homo sapiens
cctcaggatacaggagccacag

SEQ ID NO: 7562110 - DNA, 22 bp, Homo sapiens
cctcaggatacaggagccacag

SEQ ID NO: 7562111 - DNA, 22 bp, Homo sapiens
cctcaggatacaggagccacag

SEQ ID NO: 7562112 - DNA, 22 bp, Homo sapiens
cctcaggatacaggagccacag

SEQ ID NO: 7562113 - DNA, 22 bp, Homo sapiens
cctcaggatacaggagccacag

SEQ ID NO: 7562114 - DNA, 22 bp, Homo sapiens
cctcaggccctgtccctgcgcc

SEQ ID NO: 7562115 - DNA, 22 bp, Homo sapiens
cctcaggccctgtccctgcgcc

SEQ ID NO: 7562116 - DNA, 22 bp, Homo sapiens
cctcaggccctgtccctgcgcc

SEQ ID NO: 7562117 - DNA, 20 bp, Homo sapiens
cctcaggccagttttaaagt

SEQ ID NO: 7562118 - DNA, 22 bp, Homo sapiens
cctcaggccctgtccctgcgcc

SEQ ID NO: 7562119 - DNA, 22 bp, Homo sapiens
cctcaggccctgtccctgcgcc

SEQ ID NO: 7562120 - DNA, 22 bp, Homo sapiens
cctcaggcctctgcctcattgg

SEQ ID NO: 7562121 - DNA, 22 bp, Homo sapiens
cctcaggcctctgcctcattgg

SEQ ID NO: 7562122 - DNA, 22 bp, Homo sapiens
cctcaggccctgtccctgcgcc

SEQ ID NO: 7562123 - DNA, 22 bp, Homo sapiens
cctcaggccagggggcggccag

SEQ ID NO: 7562124 - DNA, 22 bp, Homo sapiens
cctcaggccagggggcggccag

SEQ ID NO: 7562125 - DNA, 22 bp, Homo sapiens
cctcaggccagggggcggccag

SEQ ID NO: 7562126 - DNA, 22 bp, Homo sapiens
cctcaggcaggaaactgtcccg

SEQ ID NO: 7562127 - DNA, 22 bp, Homo sapiens
cctcaggcagtggtatggatgg

SEQ ID NO: 7562128 - DNA, 20 bp, Homo sapiens
cctcaggccagttttaaagt

SEQ ID NO: 7562129 - DNA, 22 bp, Homo sapiens
cctcaggccagggggcggccag

SEQ ID NO: 7562130 - DNA, 22 bp, Homo sapiens
cctcaggccagggggcggccag

SEQ ID NO: 7562131 - DNA, 22 bp, Homo sapiens
cctcaggccagggggcggccag

SEQ ID NO: 7562132 - DNA, 22 bp, Homo sapiens
agggctggagccacagctggga

SEQ ID NO: 7562133 - DNA, 22 bp, Homo sapiens
agggctggagccacagctggga

SEQ ID NO: 7562134 - DNA, 22 bp, Homo sapiens
agggctggagccacagctggga

SEQ ID NO: 7562135 - DNA, 22 bp, Homo sapiens
agggctggagccacagctggga

SEQ ID NO: 7562136 - DNA, 22 bp, Homo sapiens
agggctggagccacagctggga

SEQ ID NO: 7562137 - DNA, 22 bp, Homo sapiens
agggctggagccacagctggga

SEQ ID NO: 7562138 - DNA, 22 bp, Homo sapiens
agggctggagccacagctggga

SEQ ID NO: 7562139 - DNA, 22 bp, Homo sapiens
agggctggagccacagctggga

SEQ ID NO: 7562140 - DNA, 22 bp, Homo sapiens
agggctggagccacagctggga

SEQ ID NO: 7562141 - DNA, 22 bp, Homo sapiens
agggctggagccacagctggga

SEQ ID NO: 7562142 - DNA, 22 bp, Homo sapiens
agggctggagccacagctggga

SEQ ID NO: 7562143 - DNA, 22 bp, Homo sapiens
agggctggagccacagctggga

SEQ ID NO: 7562144 - DNA, 22 bp, Homo sapiens
agggctgctttgctaaatatgg

SEQ ID NO: 7562145 - DNA, 22 bp, Homo sapiens
agggctggagccacagctggga

SEQ ID NO: 7562146 - DNA, 22 bp, Homo sapiens
agggctggagccacagctggga

SEQ ID NO: 7562147 - DNA, 22 bp, Homo sapiens
agggctggagccacagctggga

SEQ ID NO: 7562148 - DNA, 22 bp, Homo sapiens
agggctgcttacctggaatggc

SEQ ID NO: 7562149 - DNA, 22 bp, Homo sapiens
agggctgctttgctaaatatgg

SEQ ID NO: 7562150 - DNA, 22 bp, Homo sapiens
agggctgcttacctggaatggc

SEQ ID NO: 7562151 - DNA, 22 bp, Homo sapiens
agggctgcttacctggaatggc

SEQ ID NO: 7562152 - DNA, 22 bp, Homo sapiens
agggctgctgctccgggcccag

SEQ ID NO: 7562153 - DNA, 22 bp, Homo sapiens
agggctgccatttctggcccaa

SEQ ID NO: 7562154 - DNA, 22 bp, Homo sapiens
agggctgctgaggaagccttgc

SEQ ID NO: 7562155 - DNA, 22 bp, Homo sapiens
agggctgcatctgcctggtgaa

SEQ ID NO: 7562156 - DNA, 22 bp, Homo sapiens
agggctgcatctgcctggtgaa

SEQ ID NO: 7562157 - DNA, 22 bp, Homo sapiens
agggctgcatctgcctggtgaa

SEQ ID NO: 7562158 - DNA, 22 bp, Homo sapiens
agggctgcatctgcctggtgaa

SEQ ID NO: 7562159 - DNA, 22 bp, Homo sapiens
agggctaccaccaagctgcaca

SEQ ID NO: 7562160 - DNA, 22 bp, Homo sapiens
agggctagagttgagatgggga

SEQ ID NO: 7562161 - DNA, 22 bp, Homo sapiens
agggctagagttgagatgggga

SEQ ID NO: 7562162 - DNA, 23 bp, Homo sapiens
agggctagcattgagtacccact

SEQ ID NO: 7562163 - DNA, 23 bp, Homo sapiens
agggctagcattgagtacccact

SEQ ID NO: 7562164 - DNA, 22 bp, Homo sapiens
agggctaggaatggaactggag

SEQ ID NO: 7562165 - DNA, 22 bp, Homo sapiens
agggctggagggtactagttta

SEQ ID NO: 7562166 - DNA, 22 bp, Homo sapiens
agggctggagggtactagttta

SEQ ID NO: 7562167 - DNA, 22 bp, Homo sapiens
agggctggagggtactagttta

SEQ ID NO: 7562168 - DNA, 22 bp, Homo sapiens
agggctggagccacagctggga

SEQ ID NO: 7562169 - DNA, 22 bp, Homo sapiens
agggctggagccacagctggga

SEQ ID NO: 7562170 - DNA, 22 bp, Homo sapiens
agggctggagccacagctggga

SEQ ID NO: 7562171 - DNA, 22 bp, Homo sapiens
agggctggagccacagctggga

SEQ ID NO: 7562172 - DNA, 22 bp, Homo sapiens
agggctggagccacagctggga

SEQ ID NO: 7562173 - DNA, 22 bp, Homo sapiens
agggctggagccacagctggga

SEQ ID NO: 7562174 - DNA, 22 bp, Homo sapiens
agggctggagccacagctggga

SEQ ID NO: 7562175 - DNA, 22 bp, Homo sapiens
agggctggagccacagctggga

SEQ ID NO: 7562176 - DNA, 22 bp, Homo sapiens
agggctggagccacagctggga

SEQ ID NO: 7562177 - DNA, 22 bp, Homo sapiens
agggctggagccacagctggga

SEQ ID NO: 7562178 - DNA, 22 bp, Homo sapiens
agggctggcaagggattgaaat

SEQ ID NO: 7562179 - DNA, 22 bp, Homo sapiens
agggctggcaagggattgaaat

SEQ ID NO: 7562180 - DNA, 22 bp, Homo sapiens
agggctggcaagggattgaaat

SEQ ID NO: 7562181 - DNA, 22 bp, Homo sapiens
agggctggcaagggattgaaat

SEQ ID NO: 7562182 - DNA, 22 bp, Homo sapiens
agggctggcaagggattgaaat

SEQ ID NO: 7562183 - DNA, 22 bp, Homo sapiens
agggctggcaagggattgaaat

SEQ ID NO: 7562184 - DNA, 22 bp, Homo sapiens
agggctggagggtactagttta

SEQ ID NO: 7562185 - DNA, 22 bp, Homo sapiens
agggctggagggtactagttta

SEQ ID NO: 7562186 - DNA, 22 bp, Homo sapiens
agggctggagggtactagttta

SEQ ID NO: 7562187 - DNA, 22 bp, Homo sapiens
agggctggcatctctaatgctg

SEQ ID NO: 7562188 - DNA, 22 bp, Homo sapiens
agggctggcaagggattgaaat

SEQ ID NO: 7562189 - DNA, 22 bp, Homo sapiens
agggctggcatctctaatgctg

SEQ ID NO: 7562190 - DNA, 22 bp, Homo sapiens
agggctggcatctctaatgctg

SEQ ID NO: 7562191 - DNA, 22 bp, Homo sapiens
agggctggcatctctaatgctg

SEQ ID NO: 7562192 - DNA, 22 bp, Homo sapiens
agggctggcatctctaatgctg

SEQ ID NO: 7562193 - DNA, 22 bp, Homo sapiens
agggctggcatctctaatgctg

SEQ ID NO: 7562194 - DNA, 22 bp, Homo sapiens
agggctggcaagggattgaaat

SEQ ID NO: 7562195 - DNA, 22 bp, Homo sapiens
agggctggcaagggattgaaat

SEQ ID NO: 7562196 - DNA, 22 bp, Homo sapiens
agggctggcaagggattgaaat

SEQ ID NO: 7562197 - DNA, 22 bp, Homo sapiens
agggctggcaagggattgaaat

SEQ ID NO: 7562198 - DNA, 22 bp, Homo sapiens
agggctggcaagggattgaaat

SEQ ID NO: 7562199 - DNA, 22 bp, Homo sapiens
agggctggcatctctaatgctg

SEQ ID NO: 7562200 - DNA, 22 bp, Homo sapiens
agggcctgctctatcactctca

SEQ ID NO: 7562201 - DNA, 22 bp, Homo sapiens
agggcctgctctatcactctca

SEQ ID NO: 7562202 - DNA, 22 bp, Homo sapiens
agggcctgctctatcactctca

SEQ ID NO: 7562203 - DNA, 22 bp, Homo sapiens
agggcctgctctatcactctca

SEQ ID NO: 7562204 - DNA, 20 bp, Homo sapiens
agggcctgctctgtggtgtc

SEQ ID NO: 7562205 - DNA, 20 bp, Homo sapiens
agggcctgctctgtggtgtc

SEQ ID NO: 7562206 - DNA, 20 bp, Homo sapiens
agggcctgctctgtggtgtc

SEQ ID NO: 7562207 - DNA, 20 bp, Homo sapiens
agggcctgctctgtggtgtc

SEQ ID NO: 7562208 - DNA, 20 bp, Homo sapiens
agggcctgctctgtggtgtc

SEQ ID NO: 7562209 - DNA, 20 bp, Homo sapiens
agggcctgctctgtggtgtc

SEQ ID NO: 7562210 - DNA, 20 bp, Homo sapiens
agggcctgctctgtggtgtc

SEQ ID NO: 7562211 - DNA, 20 bp, Homo sapiens
agggcctgctctgtggtgtc

SEQ ID NO: 7562212 - DNA, 20 bp, Homo sapiens
agggcctgctctgtggtgtc

SEQ ID NO: 7562213 - DNA, 22 bp, Homo sapiens
agggcctggaactggagaccac

SEQ ID NO: 7562214 - DNA, 22 bp, Homo sapiens
agggcctggaactggagaccac

SEQ ID NO: 7562215 - DNA, 22 bp, Homo sapiens
agggcctggaactggagaccac

SEQ ID NO: 7562216 - DNA, 22 bp, Homo sapiens
agggcctggaactggagaccac

SEQ ID NO: 7562217 - DNA, 20 bp, Homo sapiens
agggcctgctctgtggtgtc

SEQ ID NO: 7562218 - DNA, 22 bp, Homo sapiens
agggcctggaactggagaccac

SEQ ID NO: 7562219 - DNA, 22 bp, Homo sapiens
agggcctggaactggagaccac

SEQ ID NO: 7562220 - DNA, 22 bp, Homo sapiens
agggcctggaactggagaccac

SEQ ID NO: 7562221 - DNA, 22 bp, Homo sapiens
agggcctggaactgtgggcagg

SEQ ID NO: 7562222 - DNA, 22 bp, Homo sapiens
agggcctggaactgtgggcagg

SEQ ID NO: 7562223 - DNA, 22 bp, Homo sapiens
agggcctggaactgtgggcagg

SEQ ID NO: 7562224 - DNA, 22 bp, Homo sapiens
agggcctggactaattggatcc

SEQ ID NO: 7562225 - DNA, 22 bp, Homo sapiens
agggcctggaactgtgggcagg

SEQ ID NO: 7562226 - DNA, 22 bp, Homo sapiens
agggcctggaactgtgggcagg

SEQ ID NO: 7562227 - DNA, 22 bp, Homo sapiens
agggcctggaactgtgggcagg

SEQ ID NO: 7562228 - DNA, 22 bp, Homo sapiens
agggcctggaactgtgggcagg

SEQ ID NO: 7562229 - DNA, 22 bp, Homo sapiens
agggcctggaactgtgggcagg

SEQ ID NO: 7562230 - DNA, 22 bp, Homo sapiens
agggcctggaactgtgggcagg

SEQ ID NO: 7562231 - DNA, 22 bp, Homo sapiens
agggcctggaactgtgggcagg

SEQ ID NO: 7562232 - DNA, 22 bp, Homo sapiens
cctcagagcgcgtggcattatt

SEQ ID NO: 7562233 - DNA, 22 bp, Homo sapiens
cctcagagcgcgtggcattatt

SEQ ID NO: 7562234 - DNA, 22 bp, Homo sapiens
agggcctggcttcactttctca

SEQ ID NO: 7562235 - DNA, 23 bp, Homo sapiens
agggcctggcgtggagtgtgtgc

SEQ ID NO: 7562236 - DNA, 23 bp, Homo sapiens
agggcctggcgtggagtgtgtgc

SEQ ID NO: 7562237 - DNA, 19 bp, Homo sapiens
cctcagagctagtgaacat

SEQ ID NO: 7562238 - DNA, 19 bp, Homo sapiens
cctcagagctagtgaacat

SEQ ID NO: 7562239 - DNA, 22 bp, Homo sapiens
cctcagagcgcgtggcattatt

SEQ ID NO: 7562240 - DNA, 19 bp, Homo sapiens
cctcagagctagtgaacat

SEQ ID NO: 7562241 - DNA, 18 bp, Homo sapiens
cctcagaggcaaattgtt

SEQ ID NO: 7562242 - DNA, 22 bp, Homo sapiens
cctcagcttgatttctgcagag

SEQ ID NO: 7562243 - DNA, 22 bp, Homo sapiens
cctcagcttgatttctgcagag

SEQ ID NO: 7562244 - DNA, 22 bp, Homo sapiens
cctcagcttgatttctgcagag

SEQ ID NO: 7562245 - DNA, 22 bp, Homo sapiens
cctcaggaaatgaataaatggc

SEQ ID NO: 7562246 - DNA, 22 bp, Homo sapiens
cctcagcttgatttctgcagag

SEQ ID NO: 7562247 - DNA, 22 bp, Homo sapiens
cctcaggaaccacattgctgct

SEQ ID NO: 7562248 - DNA, 23 bp, Homo sapiens
agggcctggcgtggagtgtgtgc

SEQ ID NO: 7562249 - DNA, 23 bp, Homo sapiens
agggcctggcgtggagtgtgtgc

SEQ ID NO: 7562250 - DNA, 23 bp, Homo sapiens
agggcctggcgtggagtgtgtgc

SEQ ID NO: 7562251 - DNA, 23 bp, Homo sapiens
agggcctggcgtggagtgtgtgc

SEQ ID NO: 7562252 - DNA, 22 bp, Homo sapiens
agggcctggcgcgtggccgccg

SEQ ID NO: 7562253 - DNA, 20 bp, Homo sapiens
agggcctggagtacagcagg

SEQ ID NO: 7562254 - DNA, 22 bp, Homo sapiens
agggcctggcgcgtggccgccg

SEQ ID NO: 7562255 - DNA, 22 bp, Homo sapiens
agggcctggcgcgtggccgccg

SEQ ID NO: 7562256 - DNA, 22 bp, Homo sapiens
agggcctggcgcgtggccgccg

SEQ ID NO: 7562257 - DNA, 20 bp, Homo sapiens
agggcctggagtacagcagg

SEQ ID NO: 7562258 - DNA, 20 bp, Homo sapiens
agggcctggagtacagcagg

SEQ ID NO: 7562259 - DNA, 20 bp, Homo sapiens
agggcctggagtacagcagg

SEQ ID NO: 7562260 - DNA, 20 bp, Homo sapiens
agggcctggagtacagcagg

SEQ ID NO: 7562261 - DNA, 20 bp, Homo sapiens
agggcctggagtacagcagg

SEQ ID NO: 7562262 - DNA, 22 bp, Homo sapiens
ccctggaactcctaggcaagca

SEQ ID NO: 7562263 - DNA, 22 bp, Homo sapiens
ccctggaactcctaggcaagca

SEQ ID NO: 7562264 - DNA, 22 bp, Homo sapiens
ccctggaacccatggccagtgt

SEQ ID NO: 7562265 - DNA, 22 bp, Homo sapiens
ccctggaactgccaagcctcag

SEQ ID NO: 7562266 - DNA, 22 bp, Homo sapiens
ccctggaactgccaagcctcag

SEQ ID NO: 7562267 - DNA, 22 bp, Homo sapiens
ccctggaactcctaggcaagca

SEQ ID NO: 7562268 - DNA, 22 bp, Homo sapiens
agggcctcagtgttctcatctg

SEQ ID NO: 7562269 - DNA, 22 bp, Homo sapiens
ccctggaaggagatgggacatg

SEQ ID NO: 7562270 - DNA, 22 bp, Homo sapiens
ccctggaagagcctgggcatgg

SEQ ID NO: 7562271 - DNA, 22 bp, Homo sapiens
ccctggaagagcctgggcatgg

SEQ ID NO: 7562272 - DNA, 23 bp, Homo sapiens
ccctggaacttcactcatgcaca

SEQ ID NO: 7562273 - DNA, 23 bp, Homo sapiens
ccctggaacttcactcatgcaca

SEQ ID NO: 7562274 - DNA, 22 bp, Homo sapiens
agggcctccagggcagcagtgg

SEQ ID NO: 7562275 - DNA, 22 bp, Homo sapiens
agggcctcagtgttctcatctg

SEQ ID NO: 7562276 - DNA, 22 bp, Homo sapiens
agggcctccagggcagcagtgg

SEQ ID NO: 7562277 - DNA, 22 bp, Homo sapiens
agggcctccagggcagcagtgg

SEQ ID NO: 7562278 - DNA, 22 bp, Homo sapiens
agggcctcctaatttcctcata

SEQ ID NO: 7562279 - DNA, 22 bp, Homo sapiens
agggcctcctaatttcctcata

SEQ ID NO: 7562280 - DNA, 18 bp, Homo sapiens
agggcctccatcccctcc

SEQ ID NO: 7562281 - DNA, 22 bp, Homo sapiens
agggcctgagctctcctccagt

SEQ ID NO: 7562282 - DNA, 22 bp, Homo sapiens
agggcctgagctggctgacctc

SEQ ID NO: 7562283 - DNA, 22 bp, Homo sapiens
ccctgctttgcacccaggctgg

SEQ ID NO: 7562284 - DNA, 22 bp, Homo sapiens
ccctgctttcaaccttctagct

SEQ ID NO: 7562285 - DNA, 22 bp, Homo sapiens
ccctgctttcaaccttctagct

SEQ ID NO: 7562286 - DNA, 22 bp, Homo sapiens
ccctgcttgtcacccctgggtc

SEQ ID NO: 7562287 - DNA, 22 bp, Homo sapiens
ccctgctttcaaccttctagct

SEQ ID NO: 7562288 - DNA, 22 bp, Homo sapiens
ccctgcttccgctgttttctca

SEQ ID NO: 7562289 - DNA, 22 bp, Homo sapiens
ccctgcttccgctgttttctca

SEQ ID NO: 7562290 - DNA, 22 bp, Homo sapiens
ccctgcttgtcacccctgggtc

SEQ ID NO: 7562291 - DNA, 22 bp, Homo sapiens
ccctgcttgtcacccctgggtc

SEQ ID NO: 7562292 - DNA, 22 bp, Homo sapiens
ccctgcttccctgggagaggcg

SEQ ID NO: 7562293 - DNA, 22 bp, Homo sapiens
ccctgcttccctgggagaggcg

SEQ ID NO: 7562294 - DNA, 22 bp, Homo sapiens
ccctgcttccctgggagaggcg

SEQ ID NO: 7562295 - DNA, 22 bp, Homo sapiens
ccctgcttagcacccttgcacc

SEQ ID NO: 7562296 - DNA, 22 bp, Homo sapiens
ccctgcttagcacccttgcacc

SEQ ID NO: 7562297 - DNA, 22 bp, Homo sapiens
ccctgcttagcacccttgcacc

SEQ ID NO: 7562298 - DNA, 22 bp, Homo sapiens
ccctgctttgcacccaggctgg

SEQ ID NO: 7562299 - DNA, 22 bp, Homo sapiens
ccctggaaatgaggcatgtgcg

SEQ ID NO: 7562300 - DNA, 22 bp, Homo sapiens
ccctggaaatgaggcatgtgcg

SEQ ID NO: 7562301 - DNA, 22 bp, Homo sapiens
ccctgctttgcacccaggctgg

SEQ ID NO: 7562302 - DNA, 22 bp, Homo sapiens
ccctgctttgcacccaggctgg

SEQ ID NO: 7562303 - DNA, 22 bp, Homo sapiens
ccctggaacccatggccagtgt

SEQ ID NO: 7562304 - DNA, 22 bp, Homo sapiens
ccctggaacccatggccagtgt

SEQ ID NO: 7562305 - DNA, 22 bp, Homo sapiens
ccctggaaatgaggcatgtgcg

SEQ ID NO: 7562306 - DNA, 22 bp, Homo sapiens
ccctggaaatgaggcatgtgcg

SEQ ID NO: 7562307 - DNA, 22 bp, Homo sapiens
ccctggaaatgaggcatgtgcg

SEQ ID NO: 7562308 - DNA, 22 bp, Homo sapiens
ccctggaaatgaggcatgtgcg

SEQ ID NO: 7562309 - DNA, 22 bp, Homo sapiens
agggcctgcatcaggagcttgg

SEQ ID NO: 7562310 - DNA, 22 bp, Homo sapiens
agggcctgcatcaggagcttgg

SEQ ID NO: 7562311 - DNA, 22 bp, Homo sapiens
agggcctgcatcaggagcttgg

SEQ ID NO: 7562312 - DNA, 22 bp, Homo sapiens
agggcctgcatcaggagcttgg

SEQ ID NO: 7562313 - DNA, 22 bp, Homo sapiens
agggcctgcatcaggagcttgg

SEQ ID NO: 7562314 - DNA, 22 bp, Homo sapiens
agggcctgcatcaggagcttgg

SEQ ID NO: 7562315 - DNA, 22 bp, Homo sapiens
agggcctgcatcaggagcttgg

SEQ ID NO: 7562316 - DNA, 22 bp, Homo sapiens
agggcctgcatcaggagcttgg

SEQ ID NO: 7562317 - DNA, 19 bp, Homo sapiens
agggcctgcagctcaagct

SEQ ID NO: 7562318 - DNA, 19 bp, Homo sapiens
agggcctgcagctcaagct

SEQ ID NO: 7562319 - DNA, 19 bp, Homo sapiens
agggcctgcagctcaagct

SEQ ID NO: 7562320 - DNA, 19 bp, Homo sapiens
agggcctgcagctcaagct

SEQ ID NO: 7562321 - DNA, 19 bp, Homo sapiens
agggcctgcagctcaagct

SEQ ID NO: 7562322 - DNA, 19 bp, Homo sapiens
agggcctgcagctcaagct

SEQ ID NO: 7562323 - DNA, 22 bp, Homo sapiens
agggcctgagctggctgacctc

SEQ ID NO: 7562324 - DNA, 22 bp, Homo sapiens
agggcctgagctggctgacctc

SEQ ID NO: 7562325 - DNA, 22 bp, Homo sapiens
agggcctgagctggctgacctc

SEQ ID NO: 7562326 - DNA, 22 bp, Homo sapiens
agggcctgaggctgacggggag

SEQ ID NO: 7562327 - DNA, 22 bp, Homo sapiens
agggcctgaggctgacggggag

SEQ ID NO: 7562328 - DNA, 22 bp, Homo sapiens
agggcctgaggctgacggggag

SEQ ID NO: 7562329 - DNA, 23 bp, Homo sapiens
agggcctgatggctcccgctggc

SEQ ID NO: 7562330 - DNA, 19 bp, Homo sapiens
agggcctgcagctcaagct

SEQ ID NO: 7562331 - DNA, 23 bp, Homo sapiens
agggcctgatggctcccgctggc

SEQ ID NO: 7562332 - DNA, 23 bp, Homo sapiens
agggcctgatggctcccgctggc

SEQ ID NO: 7562333 - DNA, 22 bp, Homo sapiens
agggcctgaggctgacggggag

SEQ ID NO: 7562334 - DNA, 22 bp, Homo sapiens
agggcctgaggctgacggggag

SEQ ID NO: 7562335 - DNA, 22 bp, Homo sapiens
agggcctgaggctgacggggag

SEQ ID NO: 7562336 - DNA, 22 bp, Homo sapiens
cccaggaggtcgaagctgcagt

SEQ ID NO: 7562337 - DNA, 22 bp, Homo sapiens
cccaggaggtcgaagctgcagt

SEQ ID NO: 7562338 - DNA, 22 bp, Homo sapiens
cccaggaggtcgaagctgcagt

SEQ ID NO: 7562339 - DNA, 22 bp, Homo sapiens
cccaggaggtcgaagctgcagt

SEQ ID NO: 7562340 - DNA, 22 bp, Homo sapiens
cccaggaggtcgaagctgcagt

SEQ ID NO: 7562341 - DNA, 22 bp, Homo sapiens
cccaggaggtcgaagctgcagt

SEQ ID NO: 7562342 - DNA, 22 bp, Homo sapiens
cccaggaggtcgaagctgcagt

SEQ ID NO: 7562343 - DNA, 22 bp, Homo sapiens
cccaggaggtcgaagctgcagt

SEQ ID NO: 7562344 - DNA, 22 bp, Homo sapiens
cccaggaggtcaaggctgcagt

SEQ ID NO: 7562345 - DNA, 22 bp, Homo sapiens
cccaggaggtcaaggctgcagt

SEQ ID NO: 7562346 - DNA, 22 bp, Homo sapiens
cccaggaggtcaaggctgcagt

SEQ ID NO: 7562347 - DNA, 22 bp, Homo sapiens
cccaggaggtcaaggctgcagt

SEQ ID NO: 7562348 - DNA, 22 bp, Homo sapiens
cccaggaggtcaaggctgcagt

SEQ ID NO: 7562349 - DNA, 22 bp, Homo sapiens
cccaggaggtcaaggctgcagt

SEQ ID NO: 7562350 - DNA, 22 bp, Homo sapiens
cccaggaggtcaaggctgcagt

SEQ ID NO: 7562351 - DNA, 22 bp, Homo sapiens
cccaggaggtcaaggctgcagt

SEQ ID NO: 7562352 - DNA, 23 bp, Homo sapiens
cccaggctacaaattatgctctg

SEQ ID NO: 7562353 - DNA, 22 bp, Homo sapiens
cccaggctgagttagaggtgtc

SEQ ID NO: 7562354 - DNA, 22 bp, Homo sapiens
cccaggctgagttagaggtgtc

SEQ ID NO: 7562355 - DNA, 23 bp, Homo sapiens
cccaggctacaaattatgctctg

SEQ ID NO: 7562356 - DNA, 22 bp, Homo sapiens
cccaggaggtggagcttgcagt

SEQ ID NO: 7562357 - DNA, 23 bp, Homo sapiens
cccaggctacaaattatgctctg

SEQ ID NO: 7562358 - DNA, 23 bp, Homo sapiens
cccaggctacaaattatgctctg

SEQ ID NO: 7562359 - DNA, 22 bp, Homo sapiens
cccaggaggtggagcttgcagt

SEQ ID NO: 7562360 - DNA, 22 bp, Homo sapiens
cccaggaggtggagcttgcagt

SEQ ID NO: 7562361 - DNA, 22 bp, Homo sapiens
cccaggaggtggagcttgcagt

SEQ ID NO: 7562362 - DNA, 22 bp, Homo sapiens
cccaggaggtggagcttgcagt

SEQ ID NO: 7562363 - DNA, 22 bp, Homo sapiens
cccaggaggtggagcttgcagt

SEQ ID NO: 7562364 - DNA, 22 bp, Homo sapiens
cccaggaggtcgaagctgcagt

SEQ ID NO: 7562365 - DNA, 22 bp, Homo sapiens
cccaggaggtcgaagctgcagt

SEQ ID NO: 7562366 - DNA, 22 bp, Homo sapiens
cccaggaggtcgaagctgcagt

SEQ ID NO: 7562367 - DNA, 22 bp, Homo sapiens
cccaggaggtcgaagctgcagt

SEQ ID NO: 7562368 - DNA, 22 bp, Homo sapiens
cccaggaggtcgaagctgcagt

SEQ ID NO: 7562369 - DNA, 22 bp, Homo sapiens
cccaggaggtcgaagctgcagt

SEQ ID NO: 7562370 - DNA, 22 bp, Homo sapiens
cccaggctgatgggatgggcca

SEQ ID NO: 7562371 - DNA, 22 bp, Homo sapiens
cccaggctgatgggatgggcca

SEQ ID NO: 7562372 - DNA, 22 bp, Homo sapiens
cccaggctgatgggatgggcca

SEQ ID NO: 7562373 - DNA, 22 bp, Homo sapiens
cccaggctgatgggatgggcca

SEQ ID NO: 7562374 - DNA, 22 bp, Homo sapiens
cccaggctgatgggatgggcca

SEQ ID NO: 7562375 - DNA, 22 bp, Homo sapiens
cccaggctgatgggatgggcca

SEQ ID NO: 7562376 - DNA, 22 bp, Homo sapiens
cccaggctgatgggatgggcca

SEQ ID NO: 7562377 - DNA, 22 bp, Homo sapiens
cccaggctgatgggatgggcca

SEQ ID NO: 7562378 - DNA, 22 bp, Homo sapiens
cccaggctgatgggatgggcca

SEQ ID NO: 7562379 - DNA, 22 bp, Homo sapiens
cccaggctgatgggatgggcca

SEQ ID NO: 7562380 - DNA, 22 bp, Homo sapiens
cccaggctgatgggatgggcca

SEQ ID NO: 7562381 - DNA, 22 bp, Homo sapiens
cccaggctgatgggatgggcca

SEQ ID NO: 7562382 - DNA, 22 bp, Homo sapiens
cccaggctgatgggatgggcca

SEQ ID NO: 7562383 - DNA, 22 bp, Homo sapiens
cccaggctgatgttcagcgggt

SEQ ID NO: 7562384 - DNA, 22 bp, Homo sapiens
cccaggctgatgttcagcgggt

SEQ ID NO: 7562385 - DNA, 22 bp, Homo sapiens
cccaggctgatgttcagcgggt

SEQ ID NO: 7562386 - DNA, 22 bp, Homo sapiens
cccaggctgatgttcagcgggt

SEQ ID NO: 7562387 - DNA, 22 bp, Homo sapiens
cccaggctgatgttcagcgggt

SEQ ID NO: 7562388 - DNA, 22 bp, Homo sapiens
cccaggctgatgttcagcgggt

SEQ ID NO: 7562389 - DNA, 22 bp, Homo sapiens
cccaggctgatgttcagcgggt

SEQ ID NO: 7562390 - DNA, 22 bp, Homo sapiens
cccaggctgatgttcagcgggt

SEQ ID NO: 7562391 - DNA, 22 bp, Homo sapiens
cccaggctgatgttcagcgggt

SEQ ID NO: 7562392 - DNA, 22 bp, Homo sapiens
cccaggctgatgttcagcgggt

SEQ ID NO: 7562393 - DNA, 22 bp, Homo sapiens
cccaggctgcatgagtccatgg

SEQ ID NO: 7562394 - DNA, 22 bp, Homo sapiens
cccaggctgatgttcagcgggt

SEQ ID NO: 7562395 - DNA, 22 bp, Homo sapiens
cccaggctgatgttcagcgggt

SEQ ID NO: 7562396 - DNA, 22 bp, Homo sapiens
cccaggctgatgttcagcgggt

SEQ ID NO: 7562397 - DNA, 22 bp, Homo sapiens
cccaggctgcatgagtccatgg

SEQ ID NO: 7562398 - DNA, 22 bp, Homo sapiens
cccaggctgcatgagtccatgg

SEQ ID NO: 7562399 - DNA, 22 bp, Homo sapiens
cccaggctgcatgagtccatgg

SEQ ID NO: 7562400 - DNA, 22 bp, Homo sapiens
cccaggctgcatgagtccatgg

SEQ ID NO: 7562401 - DNA, 22 bp, Homo sapiens
cccaggctgccacgattactgc

SEQ ID NO: 7562402 - DNA, 22 bp, Homo sapiens
cccaggctgcatgagtccatgg

SEQ ID NO: 7562403 - DNA, 22 bp, Homo sapiens
cccaggctgccacgattactgc

SEQ ID NO: 7562404 - DNA, 22 bp, Homo sapiens
cccaggctgccacgattactgc

SEQ ID NO: 7562405 - DNA, 22 bp, Homo sapiens
cccaggctgccacgattactgc

SEQ ID NO: 7562406 - DNA, 22 bp, Homo sapiens
cccaggctgccacgattactgc

SEQ ID NO: 7562407 - DNA, 22 bp, Homo sapiens
cccaggctgcgtatccacaata

SEQ ID NO: 7562408 - DNA, 22 bp, Homo sapiens
cccaggctgccacgattactgc

SEQ ID NO: 7562409 - DNA, 22 bp, Homo sapiens
cccaggctgcgtatccacaata

SEQ ID NO: 7562410 - DNA, 22 bp, Homo sapiens
cccaggctgcgtatccacaata

SEQ ID NO: 7562411 - DNA, 22 bp, Homo sapiens
cccaggctgtctgtcctttgct

SEQ ID NO: 7562412 - DNA, 22 bp, Homo sapiens
cccaggctggtcctgaactcct

SEQ ID NO: 7562413 - DNA, 22 bp, Homo sapiens
cccaggctggtcctgaactcct

SEQ ID NO: 7562414 - DNA, 22 bp, Homo sapiens
cccaggctgtctgtcctttgct

SEQ ID NO: 7562415 - DNA, 22 bp, Homo sapiens
cccaggctgtctgtcctttgct

SEQ ID NO: 7562416 - DNA, 22 bp, Homo sapiens
cccaggctgtctgtcctttgct

SEQ ID NO: 7562417 - DNA, 22 bp, Homo sapiens
cccaggctgtctgtcctttgct

SEQ ID NO: 7562418 - DNA, 22 bp, Homo sapiens
cccaggctgtctgtcctttgct

SEQ ID NO: 7562419 - DNA, 22 bp, Homo sapiens
cccaggctgtgcaaacttcaaa

SEQ ID NO: 7562420 - DNA, 22 bp, Homo sapiens
cccaggctgtgcaaacttcaaa

SEQ ID NO: 7562421 - DNA, 22 bp, Homo sapiens
cccaggctgtctgtcctttgct

SEQ ID NO: 7562422 - DNA, 22 bp, Homo sapiens
cccaggctgcgtatccacaata

SEQ ID NO: 7562423 - DNA, 22 bp, Homo sapiens
cccaggctgcgtatccacaata

SEQ ID NO: 7562424 - DNA, 22 bp, Homo sapiens
cccaggctggaattccaggcct

SEQ ID NO: 7562425 - DNA, 22 bp, Homo sapiens
cccaggctgcgtatccacaata

SEQ ID NO: 7562426 - DNA, 22 bp, Homo sapiens
cccaggctggaattccaggcct

SEQ ID NO: 7562427 - DNA, 22 bp, Homo sapiens
cccaggctggaattccaggcct

SEQ ID NO: 7562428 - DNA, 22 bp, Homo sapiens
cccaggctgcgtatccacaata

SEQ ID NO: 7562429 - DNA, 22 bp, Homo sapiens
cccaggctggaattccaggcct

SEQ ID NO: 7562430 - DNA, 22 bp, Homo sapiens
cccaggctggaattccaggcct

SEQ ID NO: 7562431 - DNA, 22 bp, Homo sapiens
cccaggctggaattccaggcct

SEQ ID NO: 7562432 - DNA, 22 bp, Homo sapiens
cccaggctggaattccaggcct

SEQ ID NO: 7562433 - DNA, 18 bp, Homo sapiens
cccaggctttgtgggtct

SEQ ID NO: 7562434 - DNA, 22 bp, Homo sapiens
cccaggcttcccaatcagaagg

SEQ ID NO: 7562435 - DNA, 22 bp, Homo sapiens
cccaggcttcccaatcagaagg

SEQ ID NO: 7562436 - DNA, 22 bp, Homo sapiens
cccaggcttcccaatcagaagg

SEQ ID NO: 7562437 - DNA, 22 bp, Homo sapiens
cccaggcttcccaatcagaagg

SEQ ID NO: 7562438 - DNA, 22 bp, Homo sapiens
cccaggctgtgcaaacttcaaa

SEQ ID NO: 7562439 - DNA, 18 bp, Homo sapiens
cccaggctttgtgggtct

SEQ ID NO: 7562440 - DNA, 22 bp, Homo sapiens
cccaggcttttaagttagacag

SEQ ID NO: 7562441 - DNA, 22 bp, Homo sapiens
cccaggcttttaagttagacag

SEQ ID NO: 7562442 - DNA, 22 bp, Homo sapiens
cccaggcttttaagttagacag

SEQ ID NO: 7562443 - DNA, 18 bp, Homo sapiens
cccaggctttgtgggtct

SEQ ID NO: 7562444 - DNA, 18 bp, Homo sapiens
cccaggctttgtgggtct

SEQ ID NO: 7562445 - DNA, 18 bp, Homo sapiens
cccaggctttgtgggtct

SEQ ID NO: 7562446 - DNA, 18 bp, Homo sapiens
cccaggctttgtgggtct

SEQ ID NO: 7562447 - DNA, 22 bp, Homo sapiens
cccagtccaaaagtaggttcta

SEQ ID NO: 7562448 - DNA, 22 bp, Homo sapiens
cccagtccaaaagtaggttcta

SEQ ID NO: 7562449 - DNA, 22 bp, Homo sapiens
cccagtttcaactttccagtgg

SEQ ID NO: 7562450 - DNA, 22 bp, Homo sapiens
cccagttttctgattgaagagc

SEQ ID NO: 7562451 - DNA, 22 bp, Homo sapiens
cccatcaggaacccaggagccc

SEQ ID NO: 7562452 - DNA, 22 bp, Homo sapiens
cccatcaggaacccaggagccc

SEQ ID NO: 7562453 - DNA, 22 bp, Homo sapiens
cccatcaggaacccaggagccc

SEQ ID NO: 7562454 - DNA, 22 bp, Homo sapiens
cccatcatattctattattggg

SEQ ID NO: 7562455 - DNA, 22 bp, Homo sapiens
cccatcatattctattattggg

SEQ ID NO: 7562456 - DNA, 22 bp, Homo sapiens
cccatccctgattttcactcgt

SEQ ID NO: 7562457 - DNA, 22 bp, Homo sapiens
cccatcaggaacccaggagccc

SEQ ID NO: 7562458 - DNA, 22 bp, Homo sapiens
cccatccctgattttcactcgt

SEQ ID NO: 7562459 - DNA, 22 bp, Homo sapiens
cccatccctgattttcactcgt

SEQ ID NO: 7562460 - DNA, 22 bp, Homo sapiens
cccatccctgattttcactcgt

SEQ ID NO: 7562461 - DNA, 22 bp, Homo sapiens
cccatcggcaaggtaggtgatt

SEQ ID NO: 7562462 - DNA, 22 bp, Homo sapiens
cccatctcagtcgtgctaaggg

SEQ ID NO: 7562463 - DNA, 22 bp, Homo sapiens
cccatctcagtcgtgctaaggg

SEQ ID NO: 7562464 - DNA, 22 bp, Homo sapiens
cccagtcatcctgcaggtgaaa

SEQ ID NO: 7562465 - DNA, 22 bp, Homo sapiens
cccagtacctctgttccctgct

SEQ ID NO: 7562466 - DNA, 22 bp, Homo sapiens
cccagtattgagctacaggcct

SEQ ID NO: 7562467 - DNA, 22 bp, Homo sapiens
cccagtcatcctgcaggtgaaa

SEQ ID NO: 7562468 - DNA, 22 bp, Homo sapiens
cccagtattgagctacaggcct

SEQ ID NO: 7562469 - DNA, 22 bp, Homo sapiens
cccagtacctctgttccctgct

SEQ ID NO: 7562470 - DNA, 22 bp, Homo sapiens
cccaggcttttctcttgcccca

SEQ ID NO: 7562471 - DNA, 22 bp, Homo sapiens
cccaggcttttctcttgcccca

SEQ ID NO: 7562472 - DNA, 22 bp, Homo sapiens
cccaggcttttctcttgcccca

SEQ ID NO: 7562473 - DNA, 22 bp, Homo sapiens
cccaggcttttctcttgcccca

SEQ ID NO: 7562474 - DNA, 22 bp, Homo sapiens
cccaggcttttaagttagacag

SEQ ID NO: 7562475 - DNA, 22 bp, Homo sapiens
cccaggcttttctcttgcccca

SEQ ID NO: 7562476 - DNA, 22 bp, Homo sapiens
cccaggcttttaagttagacag

SEQ ID NO: 7562477 - DNA, 22 bp, Homo sapiens
cccaggcttttctcttgcccca

SEQ ID NO: 7562478 - DNA, 22 bp, Homo sapiens
cccaggcttttaagttagacag

SEQ ID NO: 7562479 - DNA, 22 bp, Homo sapiens
cccaggcttttctcttgcccca

SEQ ID NO: 7562480 - DNA, 22 bp, Homo sapiens
cccaggcttttctcttgcccca

SEQ ID NO: 7562481 - DNA, 22 bp, Homo sapiens
cccaggaggtagaggttgcagt

SEQ ID NO: 7562482 - DNA, 22 bp, Homo sapiens
cccaggagggtggcctctgccc

SEQ ID NO: 7562483 - DNA, 22 bp, Homo sapiens
cccaggaggtagaggttgcagt

SEQ ID NO: 7562484 - DNA, 22 bp, Homo sapiens
cccaggaggtagaggttgcagt

SEQ ID NO: 7562485 - DNA, 22 bp, Homo sapiens
cccaggaggtagaggttgcagt

SEQ ID NO: 7562486 - DNA, 22 bp, Homo sapiens
cccaggaggtagaggttgcagt

SEQ ID NO: 7562487 - DNA, 22 bp, Homo sapiens
cccaggagcttctctctgcctc

SEQ ID NO: 7562488 - DNA, 22 bp, Homo sapiens
cccaggagggtggcctctgccc

SEQ ID NO: 7562489 - DNA, 22 bp, Homo sapiens
cccaggagcttctctctgcctc

SEQ ID NO: 7562490 - DNA, 22 bp, Homo sapiens
cccaggaggtcaaggctgcagt

SEQ ID NO: 7562491 - DNA, 22 bp, Homo sapiens
cccaggaggtcaaggctgcagt

SEQ ID NO: 7562492 - DNA, 22 bp, Homo sapiens
cccaggaggtcaaggctgcagt

SEQ ID NO: 7562493 - DNA, 22 bp, Homo sapiens
cccaggaggtcaaggctgcagt

SEQ ID NO: 7562494 - DNA, 22 bp, Homo sapiens
cccaggaggtcaaggctgcagt

SEQ ID NO: 7562495 - DNA, 22 bp, Homo sapiens
cccaggaggtcaaggctgcagt

SEQ ID NO: 7562496 - DNA, 22 bp, Homo sapiens
cccaggaggtcaaggctgcagt

SEQ ID NO: 7562497 - DNA, 22 bp, Homo sapiens
cccaggaggtagaggttgcagt

SEQ ID NO: 7562498 - DNA, 22 bp, Homo sapiens
cccaggaggtagaggttgcagt

SEQ ID NO: 7562499 - DNA, 22 bp, Homo sapiens
cccaggaggtagaggttgcagt

SEQ ID NO: 7562500 - DNA, 23 bp, Homo sapiens
cccaggagcctgagtcctctctg

SEQ ID NO: 7562501 - DNA, 20 bp, Homo sapiens
cccaggagctgtgccccatc

SEQ ID NO: 7562502 - DNA, 23 bp, Homo sapiens
cccaggagcctgagtcctctctg

SEQ ID NO: 7562503 - DNA, 20 bp, Homo sapiens
cccaggagctgtgccccatc

SEQ ID NO: 7562504 - DNA, 20 bp, Homo sapiens
cccaggagctgtgccccatc

SEQ ID NO: 7562505 - DNA, 20 bp, Homo sapiens
cccaggagctgtgccccatc

SEQ ID NO: 7562506 - DNA, 20 bp, Homo sapiens
cccaggagctgtgccccatc

SEQ ID NO: 7562507 - DNA, 22 bp, Homo sapiens
cccaggagcttctctctgcctc

SEQ ID NO: 7562508 - DNA, 20 bp, Homo sapiens
cccaggagctgtgccccatc

SEQ ID NO: 7562509 - DNA, 20 bp, Homo sapiens
cccaggagctgtgccccatc

SEQ ID NO: 7562510 - DNA, 22 bp, Homo sapiens
cccaggagcttctctctgcctc

SEQ ID NO: 7562511 - DNA, 22 bp, Homo sapiens
cccaggagcttctctctgcctc

SEQ ID NO: 7562512 - DNA, 22 bp, Homo sapiens
cccaggagcttctctctgcctc

SEQ ID NO: 7562513 - DNA, 22 bp, Homo sapiens
cccaggagatgcactccattgg

SEQ ID NO: 7562514 - DNA, 22 bp, Homo sapiens
cccaggagatgcactccattgg

SEQ ID NO: 7562515 - DNA, 22 bp, Homo sapiens
cccaggagatgcactccattgg

SEQ ID NO: 7562516 - DNA, 22 bp, Homo sapiens
cccaggagatgcactccattgg

SEQ ID NO: 7562517 - DNA, 22 bp, Homo sapiens
cccaggagatggaggttgcagt

SEQ ID NO: 7562518 - DNA, 22 bp, Homo sapiens
cccaggagatggaggttgcagt

SEQ ID NO: 7562519 - DNA, 22 bp, Homo sapiens
cccaggagatggaggttgcagt

SEQ ID NO: 7562520 - DNA, 22 bp, Homo sapiens
cccaggagatggaggttgcagt

SEQ ID NO: 7562521 - DNA, 22 bp, Homo sapiens
cccaggagatggaggttgcagt

SEQ ID NO: 7562522 - DNA, 22 bp, Homo sapiens
cccaggagatggaggttgcagt

SEQ ID NO: 7562523 - DNA, 22 bp, Homo sapiens
cccaggagatgcactccattgg

SEQ ID NO: 7562524 - DNA, 22 bp, Homo sapiens
cccaggagatctggatctcgtc

SEQ ID NO: 7562525 - DNA, 22 bp, Homo sapiens
cccaggagatctggatctcgtc

SEQ ID NO: 7562526 - DNA, 22 bp, Homo sapiens
cccaggagatgcactccattgg

SEQ ID NO: 7562527 - DNA, 22 bp, Homo sapiens
cccaggagatctggatctcgtc

SEQ ID NO: 7562528 - DNA, 22 bp, Homo sapiens
cccaggaattcagggctcaagg

SEQ ID NO: 7562529 - DNA, 22 bp, Homo sapiens
cccaggaattcagggctcaagg

SEQ ID NO: 7562530 - DNA, 22 bp, Homo sapiens
cccaggaatgggaaggaggaat

SEQ ID NO: 7562531 - DNA, 22 bp, Homo sapiens
cccaggaatgggaaggaggaat

SEQ ID NO: 7562532 - DNA, 23 bp, Homo sapiens
cccaggagcctgagtcctctctg

SEQ ID NO: 7562533 - DNA, 23 bp, Homo sapiens
cccaggagcctgagtcctctctg

SEQ ID NO: 7562534 - DNA, 23 bp, Homo sapiens
cccaggagcctgagtcctctctg

SEQ ID NO: 7562535 - DNA, 22 bp, Homo sapiens
cccaggagccatctgtcttggc

SEQ ID NO: 7562536 - DNA, 22 bp, Homo sapiens
cccaggagccatctgtcttggc

SEQ ID NO: 7562537 - DNA, 23 bp, Homo sapiens
cccaggagcctgagtcctctctg

SEQ ID NO: 7562538 - DNA, 22 bp, Homo sapiens
cccaggagccatctgtcttggc

SEQ ID NO: 7562539 - DNA, 22 bp, Homo sapiens
cccaggagccatctgtcttggc

SEQ ID NO: 7562540 - DNA, 22 bp, Homo sapiens
cccaggagccatctgtcttggc

SEQ ID NO: 7562541 - DNA, 19 bp, Homo sapiens
cccaggagcagtattgatg

SEQ ID NO: 7562542 - DNA, 19 bp, Homo sapiens
cccaggagcagtattgatg

SEQ ID NO: 7562543 - DNA, 19 bp, Homo sapiens
cccaggagcagtattgatg

SEQ ID NO: 7562544 - DNA, 19 bp, Homo sapiens
cccaggagcagtattgatg

SEQ ID NO: 7562545 - DNA, 19 bp, Homo sapiens
cccaggagcagtattgatg

SEQ ID NO: 7562546 - DNA, 19 bp, Homo sapiens
cccaggagcagtattgatg

SEQ ID NO: 7562547 - DNA, 22 bp, Homo sapiens
cccaggagatggtgcgtggtct

SEQ ID NO: 7562548 - DNA, 19 bp, Homo sapiens
cccaggagcagtattgatg

SEQ ID NO: 7562549 - DNA, 22 bp, Homo sapiens
cccaggagatggtgcgtggtct

SEQ ID NO: 7562550 - DNA, 22 bp, Homo sapiens
cccaggagatggtgcgtggtct

SEQ ID NO: 7562551 - DNA, 22 bp, Homo sapiens
cccaggagatggtgcgtggtct

SEQ ID NO: 7562552 - DNA, 22 bp, Homo sapiens
cccaggagatggtgcgtggtct

SEQ ID NO: 7562553 - DNA, 22 bp, Homo sapiens
cccaggagatggtgcgtggtct

SEQ ID NO: 7562554 - DNA, 22 bp, Homo sapiens
cccaggagatggtgcgtggtct

SEQ ID NO: 7562555 - DNA, 22 bp, Homo sapiens
cccaggagatggaggttgcagt

SEQ ID NO: 7562556 - DNA, 22 bp, Homo sapiens
cccaggagatggaggttgcagt

SEQ ID NO: 7562557 - DNA, 22 bp, Homo sapiens
aggctggtagtatttagtcaca

SEQ ID NO: 7562558 - DNA, 22 bp, Homo sapiens
aggctgggtacctgtcatatgc

SEQ ID NO: 7562559 - DNA, 22 bp, Homo sapiens
aggctggtagtatttagtcaca

SEQ ID NO: 7562560 - DNA, 22 bp, Homo sapiens
aggctggtagtatttagtcaca

SEQ ID NO: 7562561 - DNA, 22 bp, Homo sapiens
aggctggtcccagggagggaat

SEQ ID NO: 7562562 - DNA, 22 bp, Homo sapiens
aggctggtcccagggagggaat

SEQ ID NO: 7562563 - DNA, 22 bp, Homo sapiens
aggctggtgcctgcagtgaatc

SEQ ID NO: 7562564 - DNA, 22 bp, Homo sapiens
aggctggtgcctgcagtgaatc

SEQ ID NO: 7562565 - DNA, 22 bp, Homo sapiens
aggctggtgcctgcagtgaatc

SEQ ID NO: 7562566 - DNA, 22 bp, Homo sapiens
aggctggtgattagaagcagcc

SEQ ID NO: 7562567 - DNA, 22 bp, Homo sapiens
aggctggtgattagaagcagcc

SEQ ID NO: 7562568 - DNA, 22 bp, Homo sapiens
aggctggtgattagaagcagcc

SEQ ID NO: 7562569 - DNA, 22 bp, Homo sapiens
aggctggtgattagaagcagcc

SEQ ID NO: 7562570 - DNA, 22 bp, Homo sapiens
aggctggtctgttggcattttt

SEQ ID NO: 7562571 - DNA, 22 bp, Homo sapiens
aggctggtctgttggcattttt

SEQ ID NO: 7562572 - DNA, 22 bp, Homo sapiens
aggctggtgcttcctagggcag

SEQ ID NO: 7562573 - DNA, 22 bp, Homo sapiens
aggctggtgcctgcagtgaatc

SEQ ID NO: 7562574 - DNA, 22 bp, Homo sapiens
aggctggtgcttcctagggcag

SEQ ID NO: 7562575 - DNA, 22 bp, Homo sapiens
aggctggtgcttcctagggcag

SEQ ID NO: 7562576 - DNA, 22 bp, Homo sapiens
aggctggtgcttcctagggcag

SEQ ID NO: 7562577 - DNA, 22 bp, Homo sapiens
aggctggtgtctctgtcctgtc

SEQ ID NO: 7562578 - DNA, 22 bp, Homo sapiens
aggctggtgtctctgtcctgtc

SEQ ID NO: 7562579 - DNA, 22 bp, Homo sapiens
aggctgtagtgcatgtgctatg

SEQ ID NO: 7562580 - DNA, 22 bp, Homo sapiens
aggctgtcatctttgcaggcag

SEQ ID NO: 7562581 - DNA, 22 bp, Homo sapiens
aggctgtcatctttgcaggcag

SEQ ID NO: 7562582 - DNA, 22 bp, Homo sapiens
aggctgtcatctttgcaggcag

SEQ ID NO: 7562583 - DNA, 22 bp, Homo sapiens
aggctgtcatggctataggccc

SEQ ID NO: 7562584 - DNA, 22 bp, Homo sapiens
aggctggtgtgtcctgaagcct

SEQ ID NO: 7562585 - DNA, 20 bp, Homo sapiens
aggctgtcatttctggcagg

SEQ ID NO: 7562586 - DNA, 22 bp, Homo sapiens
aggctgtcatggctataggccc

SEQ ID NO: 7562587 - DNA, 22 bp, Homo sapiens
aggctgtccaaggtggcgaagt

SEQ ID NO: 7562588 - DNA, 22 bp, Homo sapiens
aggctgtcctctcttgctcagt

SEQ ID NO: 7562589 - DNA, 21 bp, Homo sapiens
aggctgtcctttgccagccct

SEQ ID NO: 7562590 - DNA, 21 bp, Homo sapiens
aggctgtcctttgccagccct

SEQ ID NO: 7562591 - DNA, 22 bp, Homo sapiens
aggctgtcttcctccctcttgg

SEQ ID NO: 7562592 - DNA, 21 bp, Homo sapiens
aggctgtcctttgccagccct

SEQ ID NO: 7562593 - DNA, 22 bp, Homo sapiens
aggctgtctgaccccagagccc

SEQ ID NO: 7562594 - DNA, 22 bp, Homo sapiens
aggctgtctcagcctgcttgca

SEQ ID NO: 7562595 - DNA, 22 bp, Homo sapiens
aggctgtctcagcctgcttgca

SEQ ID NO: 7562596 - DNA, 22 bp, Homo sapiens
aggctgtctcagcctgcttgca

SEQ ID NO: 7562597 - DNA, 22 bp, Homo sapiens
aggctgtctcacctcaggaggg

SEQ ID NO: 7562598 - DNA, 22 bp, Homo sapiens
aggctgtctcacctcaggaggg

SEQ ID NO: 7562599 - DNA, 22 bp, Homo sapiens
aggctgtgaaggttaaagacga

SEQ ID NO: 7562600 - DNA, 22 bp, Homo sapiens
aggctgtgacagggtcatggag

SEQ ID NO: 7562601 - DNA, 22 bp, Homo sapiens
aggctgtgacagggtcatggag

SEQ ID NO: 7562602 - DNA, 22 bp, Homo sapiens
aggctgtgacagggtcatggag

SEQ ID NO: 7562603 - DNA, 22 bp, Homo sapiens
cccaggaatgaggggcggaggc

SEQ ID NO: 7562604 - DNA, 22 bp, Homo sapiens
cccaggaatgaggggcggaggc

SEQ ID NO: 7562605 - DNA, 22 bp, Homo sapiens
cccaggaatgagcaggcagggg

SEQ ID NO: 7562606 - DNA, 22 bp, Homo sapiens
cccaggaatgaggggcggaggc

SEQ ID NO: 7562607 - DNA, 22 bp, Homo sapiens
aggctgtgaactctatgctgaa

SEQ ID NO: 7562608 - DNA, 22 bp, Homo sapiens
aggctgtgaaggttaaagacga

SEQ ID NO: 7562609 - DNA, 22 bp, Homo sapiens
aggctgtgaaatgtggcaagga

SEQ ID NO: 7562610 - DNA, 22 bp, Homo sapiens
aggctgtgaactctatgctgaa

SEQ ID NO: 7562611 - DNA, 22 bp, Homo sapiens
aggctgtgaactctatgctgaa

SEQ ID NO: 7562612 - DNA, 22 bp, Homo sapiens
aggctgtgaaatgtggcaagga

SEQ ID NO: 7562613 - DNA, 22 bp, Homo sapiens
aggctgtgaaatgtggcaagga

SEQ ID NO: 7562614 - DNA, 22 bp, Homo sapiens
aggctgtgaaatgtggcaagga

SEQ ID NO: 7562615 - DNA, 22 bp, Homo sapiens
aggctgtcttcctccctcttgg

SEQ ID NO: 7562616 - DNA, 22 bp, Homo sapiens
aggctgtgaaatgtggcaagga

SEQ ID NO: 7562617 - DNA, 22 bp, Homo sapiens
ccctgccagggtcctgacagac

SEQ ID NO: 7562618 - DNA, 22 bp, Homo sapiens
ccctgccagggtcctgacagac

SEQ ID NO: 7562619 - DNA, 18 bp, Homo sapiens
ccctgccagctcccagca

SEQ ID NO: 7562620 - DNA, 22 bp, Homo sapiens
ccctgccagggtcctgacagac

SEQ ID NO: 7562621 - DNA, 22 bp, Homo sapiens
ccctgcccaccacatgctggga

SEQ ID NO: 7562622 - DNA, 22 bp, Homo sapiens
ccctgcccaccacatgctggga

SEQ ID NO: 7562623 - DNA, 22 bp, Homo sapiens
ccctgcccaccacatgctggga

SEQ ID NO: 7562624 - DNA, 22 bp, Homo sapiens
ccctgcccaccacatgctggga

SEQ ID NO: 7562625 - DNA, 22 bp, Homo sapiens
ccctgcccaccacatgctggga

SEQ ID NO: 7562626 - DNA, 22 bp, Homo sapiens
ccctgcccatcggggcggcctg

SEQ ID NO: 7562627 - DNA, 22 bp, Homo sapiens
ccctgcccatcggggcggcctg

SEQ ID NO: 7562628 - DNA, 22 bp, Homo sapiens
ccctgcccatcggggcggcctg

SEQ ID NO: 7562629 - DNA, 22 bp, Homo sapiens
ccctgcccaccacatgctggga

SEQ ID NO: 7562630 - DNA, 22 bp, Homo sapiens
ccctgcccaccacatgctggga

SEQ ID NO: 7562631 - DNA, 22 bp, Homo sapiens
ccctgcccaccacatgctggga

SEQ ID NO: 7562632 - DNA, 22 bp, Homo sapiens
ccctgcccatcggggcggcctg

SEQ ID NO: 7562633 - DNA, 22 bp, Homo sapiens
ccctgcccatcggggcggcctg

SEQ ID NO: 7562634 - DNA, 22 bp, Homo sapiens
ccctgcccatcggggcggcctg

SEQ ID NO: 7562635 - DNA, 22 bp, Homo sapiens
ccctgccccaggcggcttcact

SEQ ID NO: 7562636 - DNA, 22 bp, Homo sapiens
ccctgccccaggcggcttcact

SEQ ID NO: 7562637 - DNA, 22 bp, Homo sapiens
ccctgccccaggcggcttcact

SEQ ID NO: 7562638 - DNA, 23 bp, Homo sapiens
ccctgcccattgagcaggacgtc

SEQ ID NO: 7562639 - DNA, 22 bp, Homo sapiens
ccctgccccaggcggcttcact

SEQ ID NO: 7562640 - DNA, 22 bp, Homo sapiens
ccctgccccaggcggcttcact

SEQ ID NO: 7562641 - DNA, 23 bp, Homo sapiens
ccctgcccattgagcaggacgtc

SEQ ID NO: 7562642 - DNA, 23 bp, Homo sapiens
ccctgcccattgagcaggacgtc

SEQ ID NO: 7562643 - DNA, 23 bp, Homo sapiens
ccctgcccattgagcaggacgtc

SEQ ID NO: 7562644 - DNA, 23 bp, Homo sapiens
ccctgcccattgagcaggacgtc

SEQ ID NO: 7562645 - DNA, 23 bp, Homo sapiens
ccctgcccattgagcaggacgtc

SEQ ID NO: 7562646 - DNA, 23 bp, Homo sapiens
ccctgcccattgagcaggacgtc

SEQ ID NO: 7562647 - DNA, 23 bp, Homo sapiens
ccctgcccattgagcaggacgtc

SEQ ID NO: 7562648 - DNA, 22 bp, Homo sapiens
ccctgccccaggcggcttcact

SEQ ID NO: 7562649 - DNA, 22 bp, Homo sapiens
ccctgccagggtcctgacagac

SEQ ID NO: 7562650 - DNA, 21 bp, Homo sapiens
ccctgccctcaaggacagtgc

SEQ ID NO: 7562651 - DNA, 21 bp, Homo sapiens
ccctgccctcaaggacagtgc

SEQ ID NO: 7562652 - DNA, 21 bp, Homo sapiens
ccctgccctcaaggacagtgc

SEQ ID NO: 7562653 - DNA, 22 bp, Homo sapiens
ccctgccccaggcggcttcact

SEQ ID NO: 7562654 - DNA, 22 bp, Homo sapiens
ccctgccccaggcggcttcact

SEQ ID NO: 7562655 - DNA, 21 bp, Homo sapiens
ccctgccctcaaggacagtgc

SEQ ID NO: 7562656 - DNA, 21 bp, Homo sapiens
ccctgccctcaaggacagtgc

SEQ ID NO: 7562657 - DNA, 22 bp, Homo sapiens
ccctgccctggagacacttaaa

SEQ ID NO: 7562658 - DNA, 22 bp, Homo sapiens
ccctgccctggagacacttaaa

SEQ ID NO: 7562659 - DNA, 22 bp, Homo sapiens
ccctgccctggagacacttaaa

SEQ ID NO: 7562660 - DNA, 22 bp, Homo sapiens
ccctgctgtcaggtgctgggag

SEQ ID NO: 7562661 - DNA, 22 bp, Homo sapiens
ccctgctgtcaggtgctgggag

SEQ ID NO: 7562662 - DNA, 22 bp, Homo sapiens
ccctgctgtcaggtgctgggag

SEQ ID NO: 7562663 - DNA, 22 bp, Homo sapiens
ccctgctgccttcacccaggac

SEQ ID NO: 7562664 - DNA, 22 bp, Homo sapiens
ccctgctgtcaggtgctgggag

SEQ ID NO: 7562665 - DNA, 22 bp, Homo sapiens
ccctgctgtcaggtgctgggag

SEQ ID NO: 7562666 - DNA, 22 bp, Homo sapiens
ccctgctgccttcacccaggac

SEQ ID NO: 7562667 - DNA, 22 bp, Homo sapiens
ccctgctgccttcacccaggac

SEQ ID NO: 7562668 - DNA, 22 bp, Homo sapiens
ccctgctgccttcacccaggac

SEQ ID NO: 7562669 - DNA, 22 bp, Homo sapiens
ccctgctgccttcacccaggac

SEQ ID NO: 7562670 - DNA, 22 bp, Homo sapiens
ccctgctgccttcacccaggac

SEQ ID NO: 7562671 - DNA, 22 bp, Homo sapiens
ccctgctgcatggcctccacga

SEQ ID NO: 7562672 - DNA, 22 bp, Homo sapiens
ccctgctgcaggcttcaggagg

SEQ ID NO: 7562673 - DNA, 22 bp, Homo sapiens
ccctgctgcatggcctccacga

SEQ ID NO: 7562674 - DNA, 19 bp, Homo sapiens
ccctgccctggtgactggg

SEQ ID NO: 7562675 - DNA, 19 bp, Homo sapiens
ccctgccctggtgactggg

SEQ ID NO: 7562676 - DNA, 19 bp, Homo sapiens
ccctgccctggtgactggg

SEQ ID NO: 7562677 - DNA, 22 bp, Homo sapiens
ccctgctgcaggcttcaggagg

SEQ ID NO: 7562678 - DNA, 22 bp, Homo sapiens
ccctgctgcaggcttcaggagg

SEQ ID NO: 7562679 - DNA, 22 bp, Homo sapiens
ccctgccctgggcagaagtggg

SEQ ID NO: 7562680 - DNA, 22 bp, Homo sapiens
ccctgccctggagacacttaaa

SEQ ID NO: 7562681 - DNA, 22 bp, Homo sapiens
ccctgccctggagacacttaaa

SEQ ID NO: 7562682 - DNA, 22 bp, Homo sapiens
ccctgccctgggcagaagtggg

SEQ ID NO: 7562683 - DNA, 22 bp, Homo sapiens
ccctgccctgggcagaagtggg

SEQ ID NO: 7562684 - DNA, 22 bp, Homo sapiens
ccctgccctgggcagaagtggg

SEQ ID NO: 7562685 - DNA, 22 bp, Homo sapiens
ccctgccctgggcagaagtggg

SEQ ID NO: 7562686 - DNA, 22 bp, Homo sapiens
ccctgccctgggcagaagtggg

SEQ ID NO: 7562687 - DNA, 22 bp, Homo sapiens
ccctgctgtgcctgactgccat

SEQ ID NO: 7562688 - DNA, 22 bp, Homo sapiens
ccctgctgtgtagcggaggaac

SEQ ID NO: 7562689 - DNA, 22 bp, Homo sapiens
ccctgctgtgtagcggaggaac

SEQ ID NO: 7562690 - DNA, 22 bp, Homo sapiens
ccctgctgtgcctgactgccat

SEQ ID NO: 7562691 - DNA, 22 bp, Homo sapiens
ccctgctgtgcctgactgccat

SEQ ID NO: 7562692 - DNA, 22 bp, Homo sapiens
ccctgctgtgcctgactgccat

SEQ ID NO: 7562693 - DNA, 22 bp, Homo sapiens
ccctgctgtgtcccacctggaa

SEQ ID NO: 7562694 - DNA, 22 bp, Homo sapiens
ccctgctgtgtcccacctggaa

SEQ ID NO: 7562695 - DNA, 22 bp, Homo sapiens
ccctgctgtgtcccacctggaa

SEQ ID NO: 7562696 - DNA, 22 bp, Homo sapiens
ccctgctgtgtcccacctggaa

SEQ ID NO: 7562697 - DNA, 22 bp, Homo sapiens
ccctgctgtgtcccacctggaa

SEQ ID NO: 7562698 - DNA, 22 bp, Homo sapiens
ccctgctgtccctcagtcctgc

SEQ ID NO: 7562699 - DNA, 22 bp, Homo sapiens
ccctgctgtgcctgactgccat

SEQ ID NO: 7562700 - DNA, 22 bp, Homo sapiens
ccctgctgtccctcagtcctgc

SEQ ID NO: 7562701 - DNA, 22 bp, Homo sapiens
ccctgctgtccctcagtcctgc

SEQ ID NO: 7562702 - DNA, 22 bp, Homo sapiens
ccctgctgtccctcagtcctgc

SEQ ID NO: 7562703 - DNA, 22 bp, Homo sapiens
ccctgctgtccctcagtcctgc

SEQ ID NO: 7562704 - DNA, 22 bp, Homo sapiens
ccctcccaggagtggccagaga

SEQ ID NO: 7562705 - DNA, 22 bp, Homo sapiens
ccctcccagatgggcttgaggt

SEQ ID NO: 7562706 - DNA, 22 bp, Homo sapiens
ccctcccaggagtggccagaga

SEQ ID NO: 7562707 - DNA, 22 bp, Homo sapiens
ccctcccaggagtggccagaga

SEQ ID NO: 7562708 - DNA, 22 bp, Homo sapiens
ccctcccaggagtggccagaga

SEQ ID NO: 7562709 - DNA, 22 bp, Homo sapiens
ccctcccagatgggcttgaggt

SEQ ID NO: 7562710 - DNA, 22 bp, Homo sapiens
ccctcccagatgggcttgaggt

SEQ ID NO: 7562711 - DNA, 22 bp, Homo sapiens
ccctcccagatgggcttgaggt

SEQ ID NO: 7562712 - DNA, 22 bp, Homo sapiens
ccctcccagatgggcttgaggt

SEQ ID NO: 7562713 - DNA, 22 bp, Homo sapiens
ccctgcacagcctggctctctt

SEQ ID NO: 7562714 - DNA, 22 bp, Homo sapiens
ccctgcacagcctggctctctt

SEQ ID NO: 7562715 - DNA, 22 bp, Homo sapiens
ccctgcacactcgtgtcttgac

SEQ ID NO: 7562716 - DNA, 20 bp, Homo sapiens
ccctgcaatgggaagctggt

SEQ ID NO: 7562717 - DNA, 22 bp, Homo sapiens
ccctgatgttttctctgccttt

SEQ ID NO: 7562718 - DNA, 22 bp, Homo sapiens
ccctgatgttttctctgccttt

SEQ ID NO: 7562719 - DNA, 22 bp, Homo sapiens
ccctgatggcctatctggcagt

SEQ ID NO: 7562720 - DNA, 22 bp, Homo sapiens
ccctgatgttttctctgccttt

SEQ ID NO: 7562721 - DNA, 22 bp, Homo sapiens
ccctgatgttttctctgccttt

SEQ ID NO: 7562722 - DNA, 22 bp, Homo sapiens
ccctcccaggagtggccagaga

SEQ ID NO: 7562723 - DNA, 22 bp, Homo sapiens
ccctcccaggagtggccagaga

SEQ ID NO: 7562724 - DNA, 22 bp, Homo sapiens
ccctgatggcacagtggcaggc

SEQ ID NO: 7562725 - DNA, 22 bp, Homo sapiens
ccctgatggcctatctggcagt

SEQ ID NO: 7562726 - DNA, 22 bp, Homo sapiens
ccctcccaggagtggccagaga

SEQ ID NO: 7562727 - DNA, 22 bp, Homo sapiens
ccctgcacagcctggctctctt

SEQ ID NO: 7562728 - DNA, 23 bp, Homo sapiens
ccctgcatctgtccctcaccagt

SEQ ID NO: 7562729 - DNA, 22 bp, Homo sapiens
ccctgcatccaaaggcctcctc

SEQ ID NO: 7562730 - DNA, 23 bp, Homo sapiens
ccctgcatctgtccctcaccagt

SEQ ID NO: 7562731 - DNA, 22 bp, Homo sapiens
ccctgccaatcccgtctctctg

SEQ ID NO: 7562732 - DNA, 17 bp, Homo sapiens
ccctgccaccaggaagc

SEQ ID NO: 7562733 - DNA, 17 bp, Homo sapiens
ccctgccaccaggaagc

SEQ ID NO: 7562734 - DNA, 22 bp, Homo sapiens
ccctgccaatcccgtctctctg

SEQ ID NO: 7562735 - DNA, 22 bp, Homo sapiens
ccctgccaatcccgtctctctg

SEQ ID NO: 7562736 - DNA, 22 bp, Homo sapiens
ccctgccaatcccgtctctctg

SEQ ID NO: 7562737 - DNA, 23 bp, Homo sapiens
ccctgcatctgtccctcaccagt

SEQ ID NO: 7562738 - DNA, 22 bp, Homo sapiens
ccctgccagatgtgcttcagtt

SEQ ID NO: 7562739 - DNA, 22 bp, Homo sapiens
ccctgccagatgtgcttcagtt

SEQ ID NO: 7562740 - DNA, 22 bp, Homo sapiens
ccctgccaatcccgtctctctg

SEQ ID NO: 7562741 - DNA, 22 bp, Homo sapiens
ccctgccagatgtgcttcagtt

SEQ ID NO: 7562742 - DNA, 22 bp, Homo sapiens
ccctgccagatgtgcttcagtt

SEQ ID NO: 7562743 - DNA, 18 bp, Homo sapiens
ccctgccagctcccagca

SEQ ID NO: 7562744 - DNA, 18 bp, Homo sapiens
ccctgccagctcccagca

SEQ ID NO: 7562745 - DNA, 18 bp, Homo sapiens
ccctgccagctcccagca

SEQ ID NO: 7562746 - DNA, 22 bp, Homo sapiens
ccctgccagatgtgcttcagtt

SEQ ID NO: 7562747 - DNA, 20 bp, Homo sapiens
ccctcccagatgcttcccaa

SEQ ID NO: 7562748 - DNA, 20 bp, Homo sapiens
ccctcccagatgcttcccaa

SEQ ID NO: 7562749 - DNA, 20 bp, Homo sapiens
ccctcccagatgcttcccaa

SEQ ID NO: 7562750 - DNA, 20 bp, Homo sapiens
ccctcccagatgcttcccaa

SEQ ID NO: 7562751 - DNA, 20 bp, Homo sapiens
ccctcccagatgcttcccaa

SEQ ID NO: 7562752 - DNA, 22 bp, Homo sapiens
ccctcccagatgggcttgaggt

SEQ ID NO: 7562753 - DNA, 22 bp, Homo sapiens
ccctcccagatgggcttgaggt

SEQ ID NO: 7562754 - DNA, 20 bp, Homo sapiens
ccctcccagatgcttcccaa

SEQ ID NO: 7562755 - DNA, 20 bp, Homo sapiens
ccctcccagatgcttcccaa

SEQ ID NO: 7562756 - DNA, 20 bp, Homo sapiens
ccctcccagatgcttcccaa

SEQ ID NO: 7562757 - DNA, 22 bp, Homo sapiens
ccctcccaagcactctgacata

SEQ ID NO: 7562758 - DNA, 22 bp, Homo sapiens
ccctcccaagcactctgacata

SEQ ID NO: 7562759 - DNA, 22 bp, Homo sapiens
ccctcccaagcactctgacata

SEQ ID NO: 7562760 - DNA, 22 bp, Homo sapiens
ccctcccaagcactctgacata

SEQ ID NO: 7562761 - DNA, 22 bp, Homo sapiens
ccctcccaagcactctgacata

SEQ ID NO: 7562762 - DNA, 22 bp, Homo sapiens
ccctcccaagcactctgacata

SEQ ID NO: 7562763 - DNA, 22 bp, Homo sapiens
ccctcccaagcactctgacata

SEQ ID NO: 7562764 - DNA, 22 bp, Homo sapiens
ccctcccaagcactctgacata

SEQ ID NO: 7562765 - DNA, 22 bp, Homo sapiens
ccctcccaagcactctgacata

SEQ ID NO: 7562766 - DNA, 22 bp, Homo sapiens
ccctccatgagtgtgctgctgg

SEQ ID NO: 7562767 - DNA, 22 bp, Homo sapiens
ccctccatgagtgtgctgctgg

SEQ ID NO: 7562768 - DNA, 22 bp, Homo sapiens
ccctccattaaaacagacctat

SEQ ID NO: 7562769 - DNA, 22 bp, Homo sapiens
ccctccattaaaacagacctat

SEQ ID NO: 7562770 - DNA, 22 bp, Homo sapiens
ccctccattaaaacagacctat

SEQ ID NO: 7562771 - DNA, 22 bp, Homo sapiens
ccctcagctccaccctcagcag

SEQ ID NO: 7562772 - DNA, 22 bp, Homo sapiens
ccctccatgagtgtgctgctgg

SEQ ID NO: 7562773 - DNA, 22 bp, Homo sapiens
ccctccatgagtgtgctgctgg

SEQ ID NO: 7562774 - DNA, 22 bp, Homo sapiens
ccctcagagcctgaagcaagca

SEQ ID NO: 7562775 - DNA, 22 bp, Homo sapiens
ccctcagctcaagcccctgtgc

SEQ ID NO: 7562776 - DNA, 22 bp, Homo sapiens
ccctcagctcaagcccctgtgc

SEQ ID NO: 7562777 - DNA, 22 bp, Homo sapiens
ccctcagctccaccctcagcag

SEQ ID NO: 7562778 - DNA, 22 bp, Homo sapiens
ccctcagctccaccctcagcag

SEQ ID NO: 7562779 - DNA, 22 bp, Homo sapiens
ccctcagctccaccctcagcag

SEQ ID NO: 7562780 - DNA, 22 bp, Homo sapiens
ccctcagctccaccctcagcag

SEQ ID NO: 7562781 - DNA, 22 bp, Homo sapiens
ccctagggtttggccagagccc

SEQ ID NO: 7562782 - DNA, 22 bp, Homo sapiens
ccctagggtttggccagagccc

SEQ ID NO: 7562783 - DNA, 23 bp, Homo sapiens
ccctaggtgggcccgctctaggg

SEQ ID NO: 7562784 - DNA, 22 bp, Homo sapiens
ccctagtccacaggttcctgga

SEQ ID NO: 7562785 - DNA, 22 bp, Homo sapiens
ccctattagtgaccacatcata

SEQ ID NO: 7562786 - DNA, 22 bp, Homo sapiens
ccctatcctgcaggcctgggct

SEQ ID NO: 7562787 - DNA, 22 bp, Homo sapiens
ccctatcctgcaggcctgggct

SEQ ID NO: 7562788 - DNA, 22 bp, Homo sapiens
ccctagggtttggccagagccc

SEQ ID NO: 7562789 - DNA, 22 bp, Homo sapiens
ccctagggtttggccagagccc

SEQ ID NO: 7562790 - DNA, 22 bp, Homo sapiens
ccctagggtttggccagagccc

SEQ ID NO: 7562791 - DNA, 22 bp, Homo sapiens
ccctagggtttggccagagccc

SEQ ID NO: 7562792 - DNA, 22 bp, Homo sapiens
ccctagggtttggccagagccc

SEQ ID NO: 7562793 - DNA, 22 bp, Homo sapiens
ccctagggctaagcaggactgc

SEQ ID NO: 7562794 - DNA, 22 bp, Homo sapiens
ccctagggctaagcaggactgc

SEQ ID NO: 7562795 - DNA, 22 bp, Homo sapiens
ccctagggctaagcaggactgc

SEQ ID NO: 7562796 - DNA, 22 bp, Homo sapiens
ccctaggggcaatgatggtgct

SEQ ID NO: 7562797 - DNA, 22 bp, Homo sapiens
ccctaggggcaatgatggtgct

SEQ ID NO: 7562798 - DNA, 22 bp, Homo sapiens
ccctaggggcaatgatggtgct

SEQ ID NO: 7562799 - DNA, 22 bp, Homo sapiens
ccctaggggcaatgatggtgct

SEQ ID NO: 7562800 - DNA, 22 bp, Homo sapiens
ccctaggggcaatgatggtgct

SEQ ID NO: 7562801 - DNA, 22 bp, Homo sapiens
ccctaggggcaatgatggtgct

SEQ ID NO: 7562802 - DNA, 19 bp, Homo sapiens
ccctaggggctcctgaggg

SEQ ID NO: 7562803 - DNA, 19 bp, Homo sapiens
ccctaggggctcctgaggg

SEQ ID NO: 7562804 - DNA, 19 bp, Homo sapiens
ccctaggggctcctgaggg

SEQ ID NO: 7562805 - DNA, 22 bp, Homo sapiens
ccctcaccaggctccaggcatg

SEQ ID NO: 7562806 - DNA, 22 bp, Homo sapiens
ccctcaccaggctccaggcatg

SEQ ID NO: 7562807 - DNA, 22 bp, Homo sapiens
ccctcaccaggctccaggcatg

SEQ ID NO: 7562808 - DNA, 22 bp, Homo sapiens
ccctcaatgtctacagcagtcc

SEQ ID NO: 7562809 - DNA, 22 bp, Homo sapiens
ccctcacagtctaggagcagct

SEQ ID NO: 7562810 - DNA, 22 bp, Homo sapiens
ccctcaccaggctccaggcatg

SEQ ID NO: 7562811 - DNA, 22 bp, Homo sapiens
ccctcaccaggctccaggcatg

SEQ ID NO: 7562812 - DNA, 22 bp, Homo sapiens
ccctatgctttgggaggatcac

SEQ ID NO: 7562813 - DNA, 22 bp, Homo sapiens
ccctcaccaggctccaggcatg

SEQ ID NO: 7562814 - DNA, 22 bp, Homo sapiens
ccctcaccaggctccaggcatg

SEQ ID NO: 7562815 - DNA, 22 bp, Homo sapiens
ccctcaccaggctccaggcatg

SEQ ID NO: 7562816 - DNA, 17 bp, Homo sapiens
ccctcactcctgccggg

SEQ ID NO: 7562817 - DNA, 22 bp, Homo sapiens
ccctcactctgcctcctggggt

SEQ ID NO: 7562818 - DNA, 22 bp, Homo sapiens
ccctcactctgcctcctggggt

SEQ ID NO: 7562819 - DNA, 22 bp, Homo sapiens
ccctcactgtccttgggccctt

SEQ ID NO: 7562820 - DNA, 22 bp, Homo sapiens
ccctcactgtccttgggccctt

SEQ ID NO: 7562821 - DNA, 22 bp, Homo sapiens
ccctcacttcacgctctgcaga

SEQ ID NO: 7562822 - DNA, 22 bp, Homo sapiens
ccctcacttcacgctctgcaga

SEQ ID NO: 7562823 - DNA, 22 bp, Homo sapiens
ccctcacttcacgctctgcaga

SEQ ID NO: 7562824 - DNA, 22 bp, Homo sapiens
ccctcacttcacgctctgcaga

SEQ ID NO: 7562825 - DNA, 22 bp, Homo sapiens
ccccttccacagtgcttcctaa

SEQ ID NO: 7562826 - DNA, 22 bp, Homo sapiens
ccccttccacagtgcttcctaa

SEQ ID NO: 7562827 - DNA, 22 bp, Homo sapiens
ccccttccacagtgcttcctaa

SEQ ID NO: 7562828 - DNA, 22 bp, Homo sapiens
ccccttccacagtgcttcctaa

SEQ ID NO: 7562829 - DNA, 22 bp, Homo sapiens
ccccttccacagtgcttcctaa

SEQ ID NO: 7562830 - DNA, 22 bp, Homo sapiens
ccccttccacagtgcttcctaa

SEQ ID NO: 7562831 - DNA, 22 bp, Homo sapiens
ccccagcacttggagtggggag

SEQ ID NO: 7562832 - DNA, 22 bp, Homo sapiens
ccccagcactctgactcttacc

SEQ ID NO: 7562833 - DNA, 22 bp, Homo sapiens
ccccagcacttggagtggggag

SEQ ID NO: 7562834 - DNA, 22 bp, Homo sapiens
ccccttccaggaagcagaatcg

SEQ ID NO: 7562835 - DNA, 22 bp, Homo sapiens
ccccttccaggaagcagaatcg

SEQ ID NO: 7562836 - DNA, 22 bp, Homo sapiens
ccccttccaggaagcagaatcg

SEQ ID NO: 7562837 - DNA, 22 bp, Homo sapiens
ccctaggctgaggccagggtgc

SEQ ID NO: 7562838 - DNA, 22 bp, Homo sapiens
ccctaggctgaggccagggtgc

SEQ ID NO: 7562839 - DNA, 22 bp, Homo sapiens
ccctaggctgaggccagggtgc

SEQ ID NO: 7562840 - DNA, 22 bp, Homo sapiens
ccctaggctgaggccagggtgc

SEQ ID NO: 7562841 - DNA, 22 bp, Homo sapiens
ccctaggctgggctcttggctt

SEQ ID NO: 7562842 - DNA, 22 bp, Homo sapiens
ccctaggctgaggccagggtgc

SEQ ID NO: 7562843 - DNA, 22 bp, Homo sapiens
ccctaggctgaggccagggtgc

SEQ ID NO: 7562844 - DNA, 22 bp, Homo sapiens
ccctaggctgggctcttggctt

SEQ ID NO: 7562845 - DNA, 22 bp, Homo sapiens
ccctagggctaagcaggactgc

SEQ ID NO: 7562846 - DNA, 22 bp, Homo sapiens
ccctagggctaagcaggactgc

SEQ ID NO: 7562847 - DNA, 22 bp, Homo sapiens
ccccagcactaccagaagccag

SEQ ID NO: 7562848 - DNA, 22 bp, Homo sapiens
ccccagcactaccagaagccag

SEQ ID NO: 7562849 - DNA, 22 bp, Homo sapiens
ccccagcactaccagaagccag

SEQ ID NO: 7562850 - DNA, 21 bp, Homo sapiens
ccccagcaccttgccagcctg

SEQ ID NO: 7562851 - DNA, 22 bp, Homo sapiens
ccccagcactaccagaagccag

SEQ ID NO: 7562852 - DNA, 22 bp, Homo sapiens
ccccagcactaccagaagccag

SEQ ID NO: 7562853 - DNA, 22 bp, Homo sapiens
ccccagcactaccagaagccag

SEQ ID NO: 7562854 - DNA, 22 bp, Homo sapiens
ccccagcacaggctcctcagat

SEQ ID NO: 7562855 - DNA, 21 bp, Homo sapiens
ccccagcaccttgccagcctg

SEQ ID NO: 7562856 - DNA, 21 bp, Homo sapiens
ccccagcaccttgccagcctg

SEQ ID NO: 7562857 - DNA, 21 bp, Homo sapiens
ccccagcaccttgccagcctg

SEQ ID NO: 7562858 - DNA, 21 bp, Homo sapiens
ccccagcaccttgccagcctg

SEQ ID NO: 7562859 - DNA, 21 bp, Homo sapiens
ccccagcaccttgccagcctg

SEQ ID NO: 7562860 - DNA, 22 bp, Homo sapiens
ccccagcacaggctcctcagat

SEQ ID NO: 7562861 - DNA, 22 bp, Homo sapiens
ccccagcacaggctcctcagat

SEQ ID NO: 7562862 - DNA, 22 bp, Homo sapiens
ccccagcacaggctcctcagat

SEQ ID NO: 7562863 - DNA, 22 bp, Homo sapiens
ccccagagagcaccatgaagcc

SEQ ID NO: 7562864 - DNA, 22 bp, Homo sapiens
ccccagataggttcatgcccta

SEQ ID NO: 7562865 - DNA, 22 bp, Homo sapiens
ccccagataggttcatgcccta

SEQ ID NO: 7562866 - DNA, 22 bp, Homo sapiens
ccccagcacaggctcctcagat

SEQ ID NO: 7562867 - DNA, 22 bp, Homo sapiens
ccccagcacaggctcctcagat

SEQ ID NO: 7562868 - DNA, 22 bp, Homo sapiens
ccccagcacaggctcctcagat

SEQ ID NO: 7562869 - DNA, 22 bp, Homo sapiens
cccatgggttttcctccctgcc

SEQ ID NO: 7562870 - DNA, 22 bp, Homo sapiens
cccatgggttttcctccctgcc

SEQ ID NO: 7562871 - DNA, 22 bp, Homo sapiens
cccatggggacaccatgaagga

SEQ ID NO: 7562872 - DNA, 22 bp, Homo sapiens
cccatggggacaccatgaagga

SEQ ID NO: 7562873 - DNA, 22 bp, Homo sapiens
cccatggggacaccatgaagga

SEQ ID NO: 7562874 - DNA, 22 bp, Homo sapiens
cccatggcagtcagagataaga

SEQ ID NO: 7562875 - DNA, 22 bp, Homo sapiens
cccatggcttaggagggagtgt

SEQ ID NO: 7562876 - DNA, 22 bp, Homo sapiens
cccatggcaataaggtcacagg

SEQ ID NO: 7562877 - DNA, 22 bp, Homo sapiens
cccatggcaataaggtcacagg

SEQ ID NO: 7562878 - DNA, 22 bp, Homo sapiens
cccatgctgtgcctagagagca

SEQ ID NO: 7562879 - DNA, 22 bp, Homo sapiens
cccatggagtgcctgagggcca

SEQ ID NO: 7562880 - DNA, 22 bp, Homo sapiens
cccatggcagtcagagataaga

SEQ ID NO: 7562881 - DNA, 22 bp, Homo sapiens
cccatggcaataaggtcacagg

SEQ ID NO: 7562882 - DNA, 22 bp, Homo sapiens
cccatgctgagtggcctgagat

SEQ ID NO: 7562883 - DNA, 22 bp, Homo sapiens
cccatgctgagtggcctgagat

SEQ ID NO: 7562884 - DNA, 22 bp, Homo sapiens
cccatgctgagtggcctgagat

SEQ ID NO: 7562885 - DNA, 22 bp, Homo sapiens
cccatgctgagtggcctgagat

SEQ ID NO: 7562886 - DNA, 22 bp, Homo sapiens
cccatgccttctgactcacagg

SEQ ID NO: 7562887 - DNA, 22 bp, Homo sapiens
cccatgccttctgactcacagg

SEQ ID NO: 7562888 - DNA, 22 bp, Homo sapiens
cccatggagtgcctgagggcca

SEQ ID NO: 7562889 - DNA, 22 bp, Homo sapiens
cccatgctgtgcctagagagca

SEQ ID NO: 7562890 - DNA, 22 bp, Homo sapiens
cccatgctgagtggcctgagat

SEQ ID NO: 7562891 - DNA, 22 bp, Homo sapiens
cccatgcaccctctaagaagga

SEQ ID NO: 7562892 - DNA, 20 bp, Homo sapiens
cccatgcatcttcacaacct

SEQ ID NO: 7562893 - DNA, 20 bp, Homo sapiens
cccatgcatcttcacaacct

SEQ ID NO: 7562894 - DNA, 22 bp, Homo sapiens
cccatgcatccctctcctgggc

SEQ ID NO: 7562895 - DNA, 22 bp, Homo sapiens
cccatgcatccctctcctgggc

SEQ ID NO: 7562896 - DNA, 22 bp, Homo sapiens
cccatgcaccctctaagaagga

SEQ ID NO: 7562897 - DNA, 22 bp, Homo sapiens
cccatgcaccctctaagaagga

SEQ ID NO: 7562898 - DNA, 22 bp, Homo sapiens
cccatgcaccctctaagaagga

SEQ ID NO: 7562899 - DNA, 22 bp, Homo sapiens
cccatgagtgctgctcagaggc

SEQ ID NO: 7562900 - DNA, 22 bp, Homo sapiens
cccatgcaccctctaagaagga

SEQ ID NO: 7562901 - DNA, 22 bp, Homo sapiens
cccatgcaccctctaagaagga

SEQ ID NO: 7562902 - DNA, 22 bp, Homo sapiens
cccatgcaccctctaagaagga

SEQ ID NO: 7562903 - DNA, 22 bp, Homo sapiens
cccatgagacctggtttaaggc

SEQ ID NO: 7562904 - DNA, 22 bp, Homo sapiens
cccatgagattctgaatttggc

SEQ ID NO: 7562905 - DNA, 22 bp, Homo sapiens
cccatgagattctgaatttggc

SEQ ID NO: 7562906 - DNA, 17 bp, Homo sapiens
cccatgagcccactccc

SEQ ID NO: 7562907 - DNA, 22 bp, Homo sapiens
cccatgaggtggaggttgcagt

SEQ ID NO: 7562908 - DNA, 22 bp, Homo sapiens
cccatgagtgctgctcagaggc

SEQ ID NO: 7562909 - DNA, 22 bp, Homo sapiens
cccatgagtgctgctcagaggc

SEQ ID NO: 7562910 - DNA, 22 bp, Homo sapiens
cccattcatcctcgcttccttc

SEQ ID NO: 7562911 - DNA, 22 bp, Homo sapiens
ccccacttgctcagcatgtcca

SEQ ID NO: 7562912 - DNA, 22 bp, Homo sapiens
ccccactttgagtagcacttga

SEQ ID NO: 7562913 - DNA, 22 bp, Homo sapiens
ccccacttgctcagcatgtcca

SEQ ID NO: 7562914 - DNA, 22 bp, Homo sapiens
cccatgtgtgacagtccatttg

SEQ ID NO: 7562915 - DNA, 16 bp, Homo sapiens
cccatgtgtagatgag

SEQ ID NO: 7562916 - DNA, 18 bp, Homo sapiens
cccatgttgccagtcagc

SEQ ID NO: 7562917 - DNA, 22 bp, Homo sapiens
cccatgtggtaccttctgtgga

SEQ ID NO: 7562918 - DNA, 22 bp, Homo sapiens
cccattcatcctcgcttccttc

SEQ ID NO: 7562919 - DNA, 22 bp, Homo sapiens
cccattcatcctcgcttccttc

SEQ ID NO: 7562920 - DNA, 22 bp, Homo sapiens
ccccagaaagcctggcactagg

SEQ ID NO: 7562921 - DNA, 22 bp, Homo sapiens
ccccacttgctcagcatgtcca

SEQ ID NO: 7562922 - DNA, 22 bp, Homo sapiens
ccccagaaagcctggcactagg

SEQ ID NO: 7562923 - DNA, 22 bp, Homo sapiens
ccccactttgagtagcacttga

SEQ ID NO: 7562924 - DNA, 22 bp, Homo sapiens
ccccagaaagcctggcactagg

SEQ ID NO: 7562925 - DNA, 22 bp, Homo sapiens
ccccagaaagcctggcactagg

SEQ ID NO: 7562926 - DNA, 22 bp, Homo sapiens
ccccagaaggggacagagggta

SEQ ID NO: 7562927 - DNA, 22 bp, Homo sapiens
ccccagaagtttgcacaagaga

SEQ ID NO: 7562928 - DNA, 22 bp, Homo sapiens
ccccagaagtttgcacaagaga

SEQ ID NO: 7562929 - DNA, 22 bp, Homo sapiens
ccccagaaagcctggcactagg

SEQ ID NO: 7562930 - DNA, 22 bp, Homo sapiens
ccccagaaggggacagagggta

SEQ ID NO: 7562931 - DNA, 22 bp, Homo sapiens
ccccagaaggggacagagggta

SEQ ID NO: 7562932 - DNA, 22 bp, Homo sapiens
ccccagaaggggacagagggta

SEQ ID NO: 7562933 - DNA, 22 bp, Homo sapiens
ccccagaaggggacagagggta

SEQ ID NO: 7562934 - DNA, 22 bp, Homo sapiens
ccccagaaggggacagagggta

SEQ ID NO: 7562935 - DNA, 22 bp, Homo sapiens
ccccagagaaagtcagcagcat

SEQ ID NO: 7562936 - DNA, 22 bp, Homo sapiens
ccccagagaaagtcagcagcat

SEQ ID NO: 7562937 - DNA, 22 bp, Homo sapiens
ccccagaagtttgcacaagaga

SEQ ID NO: 7562938 - DNA, 22 bp, Homo sapiens
ccccagaagtttgcacaagaga

SEQ ID NO: 7562939 - DNA, 22 bp, Homo sapiens
ccccagaagtttgcacaagaga

SEQ ID NO: 7562940 - DNA, 22 bp, Homo sapiens
ccccagagaaagtcagcagcat

SEQ ID NO: 7562941 - DNA, 22 bp, Homo sapiens
ccccagagaaagtcagcagcat

SEQ ID NO: 7562942 - DNA, 22 bp, Homo sapiens
ccccagagaaagtcagcagcat

SEQ ID NO: 7562943 - DNA, 22 bp, Homo sapiens
ccccagagaaagtcagcagcat

SEQ ID NO: 7562944 - DNA, 22 bp, Homo sapiens
ccccagagaaagtcagcagcat

SEQ ID NO: 7562945 - DNA, 22 bp, Homo sapiens
ccccagagagcaccatgaagcc

SEQ ID NO: 7562946 - DNA, 22 bp, Homo sapiens
ccccagagtgagggattgagtg

SEQ ID NO: 7562947 - DNA, 22 bp, Homo sapiens
ccccagagagcaccatgaagcc

SEQ ID NO: 7562948 - DNA, 22 bp, Homo sapiens
ccccagagagcaccatgaagcc

SEQ ID NO: 7562949 - DNA, 22 bp, Homo sapiens
ccccagagtgagggattgagtg

SEQ ID NO: 7562950 - DNA, 22 bp, Homo sapiens
ccccagagtgagggattgagtg

SEQ ID NO: 7562951 - DNA, 22 bp, Homo sapiens
ccccagagtgagggattgagtg

SEQ ID NO: 7562952 - DNA, 22 bp, Homo sapiens
ccccagagaaagtcagcagcat

SEQ ID NO: 7562953 - DNA, 22 bp, Homo sapiens
ccccagagagcaccatgaagcc

SEQ ID NO: 7562954 - DNA, 22 bp, Homo sapiens
ccccagagagcaccatgaagcc

SEQ ID NO: 7562955 - DNA, 22 bp, Homo sapiens
ccccagagagcaccatgaagcc

SEQ ID NO: 7562956 - DNA, 22 bp, Homo sapiens
ccccagagagcaccatgaagcc

SEQ ID NO: 7562957 - DNA, 22 bp, Homo sapiens
ccccagagagcaccatgaagcc

SEQ ID NO: 7562958 - DNA, 22 bp, Homo sapiens
ccccagagagcaccatgaagcc

SEQ ID NO: 7562959 - DNA, 22 bp, Homo sapiens
ccaggaaggcaggcctccccgc

SEQ ID NO: 7562960 - DNA, 22 bp, Homo sapiens
ccaggaaggcaggcctccccgc

SEQ ID NO: 7562961 - DNA, 22 bp, Homo sapiens
ccaggaaggcaggcctccccgc

SEQ ID NO: 7562962 - DNA, 22 bp, Homo sapiens
ccaggaaggcaggcctccccgc

SEQ ID NO: 7562963 - DNA, 22 bp, Homo sapiens
aggcctgggacgggagccgtga

SEQ ID NO: 7562964 - DNA, 22 bp, Homo sapiens
ccaggaaggatcgtttgggagt

SEQ ID NO: 7562965 - DNA, 22 bp, Homo sapiens
ccaggaaggatcgtttgggagt

SEQ ID NO: 7562966 - DNA, 22 bp, Homo sapiens
aggcctgggacgggagccgtga

SEQ ID NO: 7562967 - DNA, 22 bp, Homo sapiens
aggcctgggacgggagccgtga

SEQ ID NO: 7562968 - DNA, 22 bp, Homo sapiens
aggcctgggacgggagccgtga

SEQ ID NO: 7562969 - DNA, 18 bp, Homo sapiens
aggcctgggaagctgagg

SEQ ID NO: 7562970 - DNA, 18 bp, Homo sapiens
aggcctgggaagctgagg

SEQ ID NO: 7562971 - DNA, 18 bp, Homo sapiens
aggcctgggaagctgagg

SEQ ID NO: 7562972 - DNA, 18 bp, Homo sapiens
aggcctgggaagctgagg

SEQ ID NO: 7562973 - DNA, 18 bp, Homo sapiens
aggcctgggaagctgagg

SEQ ID NO: 7562974 - DNA, 18 bp, Homo sapiens
aggcctgggaagctgagg

SEQ ID NO: 7562975 - DNA, 22 bp, Homo sapiens
ccaggaaggcaggcctccccgc

SEQ ID NO: 7562976 - DNA, 22 bp, Homo sapiens
ccaggaaggcctggatgccccc

SEQ ID NO: 7562977 - DNA, 22 bp, Homo sapiens
ccaggaaggcctggatgccccc

SEQ ID NO: 7562978 - DNA, 22 bp, Homo sapiens
ccaggaaggcctggatgccccc

SEQ ID NO: 7562979 - DNA, 22 bp, Homo sapiens
ccaggaaggcctggatgccccc

SEQ ID NO: 7562980 - DNA, 22 bp, Homo sapiens
ccaggaaggcaggcctccccgc

SEQ ID NO: 7562981 - DNA, 22 bp, Homo sapiens
ccaggaaggcctggatgccccc

SEQ ID NO: 7562982 - DNA, 22 bp, Homo sapiens
ccaggaaggcctggatgccccc

SEQ ID NO: 7562983 - DNA, 22 bp, Homo sapiens
ccaggaaggcgttgttcctctc

SEQ ID NO: 7562984 - DNA, 22 bp, Homo sapiens
ccaggaaggcgttgttcctctc

SEQ ID NO: 7562985 - DNA, 22 bp, Homo sapiens
ccaggaaggcctggatgccccc

SEQ ID NO: 7562986 - DNA, 22 bp, Homo sapiens
ccaggaaggcgttgttcctctc

SEQ ID NO: 7562987 - DNA, 22 bp, Homo sapiens
ccaggaaggtatgggaagaaaa

SEQ ID NO: 7562988 - DNA, 22 bp, Homo sapiens
ccaggaaggtatgggaagaaaa

SEQ ID NO: 7562989 - DNA, 22 bp, Homo sapiens
ccaggaaggtatgggaagaaaa

SEQ ID NO: 7562990 - DNA, 22 bp, Homo sapiens
ccaggaaggtatgggaagaaaa

SEQ ID NO: 7562991 - DNA, 22 bp, Homo sapiens
ccaggaaggtatgggaagaaaa

SEQ ID NO: 7562992 - DNA, 22 bp, Homo sapiens
ccaggaagggctctttaaagac

SEQ ID NO: 7562993 - DNA, 22 bp, Homo sapiens
ccaggaagggctctttaaagac

SEQ ID NO: 7562994 - DNA, 22 bp, Homo sapiens
ccaggaaggcgttgttcctctc

SEQ ID NO: 7562995 - DNA, 22 bp, Homo sapiens
ccaggaaggcgttgttcctctc

SEQ ID NO: 7562996 - DNA, 22 bp, Homo sapiens
ccaggaagggctctttaaagac

SEQ ID NO: 7562997 - DNA, 22 bp, Homo sapiens
aggcctggcatgagacctgaga

SEQ ID NO: 7562998 - DNA, 22 bp, Homo sapiens
aggcctggcatgagacctgaga

SEQ ID NO: 7562999 - DNA, 22 bp, Homo sapiens
aggcctggcatgagacctgaga

SEQ ID NO: 7563000 - DNA, 22 bp, Homo sapiens
aggcctggcatgagacctgaga

SEQ ID NO: 7563001 - DNA, 22 bp, Homo sapiens
aggcctgctgtgtagcctgttg

SEQ ID NO: 7563002 - DNA, 22 bp, Homo sapiens
aggcctgctgtgtagcctgttg

SEQ ID NO: 7563003 - DNA, 22 bp, Homo sapiens
aggcctgctgtcttgaggccaa

SEQ ID NO: 7563004 - DNA, 22 bp, Homo sapiens
aggcctgctgtgtagcctgttg

SEQ ID NO: 7563005 - DNA, 22 bp, Homo sapiens
aggcctgctgtgtagcctgttg

SEQ ID NO: 7563006 - DNA, 22 bp, Homo sapiens
aggcctgcttacaatgttatcc

SEQ ID NO: 7563007 - DNA, 22 bp, Homo sapiens
aggcctggccccagttgctagg

SEQ ID NO: 7563008 - DNA, 22 bp, Homo sapiens
aggcctggccccagttgctagg

SEQ ID NO: 7563009 - DNA, 22 bp, Homo sapiens
aggcctggccccagttgctagg

SEQ ID NO: 7563010 - DNA, 22 bp, Homo sapiens
aggcctggcctttatgttcaag

SEQ ID NO: 7563011 - DNA, 22 bp, Homo sapiens
aggcctggcctttatgttcaag

SEQ ID NO: 7563012 - DNA, 22 bp, Homo sapiens
aggcctggcctgggcggcattg

SEQ ID NO: 7563013 - DNA, 22 bp, Homo sapiens
aggcctggcctgggcggcattg

SEQ ID NO: 7563014 - DNA, 22 bp, Homo sapiens
aggcctggcctgggcggcattg

SEQ ID NO: 7563015 - DNA, 22 bp, Homo sapiens
aggcctggcctgggcggcattg

SEQ ID NO: 7563016 - DNA, 22 bp, Homo sapiens
aggcctggcctgggcggcattg

SEQ ID NO: 7563017 - DNA, 22 bp, Homo sapiens
aggcctggctttggtttgctga

SEQ ID NO: 7563018 - DNA, 22 bp, Homo sapiens
aggcctggctttggtttgctga

SEQ ID NO: 7563019 - DNA, 22 bp, Homo sapiens
aggcctggctttggtttgctga

SEQ ID NO: 7563020 - DNA, 22 bp, Homo sapiens
aggcctggctttggtttgctga

SEQ ID NO: 7563021 - DNA, 22 bp, Homo sapiens
aggcctggcctttatgttcaag

SEQ ID NO: 7563022 - DNA, 22 bp, Homo sapiens
aggcctggcctttatgttcaag

SEQ ID NO: 7563023 - DNA, 22 bp, Homo sapiens
aggcctggcctttatgttcaag

SEQ ID NO: 7563024 - DNA, 22 bp, Homo sapiens
aggcctggcctttatgttcaag

SEQ ID NO: 7563025 - DNA, 22 bp, Homo sapiens
ccaggaaggtatgggaagaaaa

SEQ ID NO: 7563026 - DNA, 22 bp, Homo sapiens
ccaggaaggtatgggaagaaaa

SEQ ID NO: 7563027 - DNA, 22 bp, Homo sapiens
ccaggaaggtgtttaactagag

SEQ ID NO: 7563028 - DNA, 22 bp, Homo sapiens
ccaggaaggtgtttaactagag

SEQ ID NO: 7563029 - DNA, 22 bp, Homo sapiens
ccaggaaggtgtttaactagag

SEQ ID NO: 7563030 - DNA, 22 bp, Homo sapiens
ccaggaaggtgtttaactagag

SEQ ID NO: 7563031 - DNA, 22 bp, Homo sapiens
ccaggaaggtgtttaactagag

SEQ ID NO: 7563032 - DNA, 22 bp, Homo sapiens
ccaggaaggtgtttaactagag

SEQ ID NO: 7563033 - DNA, 22 bp, Homo sapiens
ccaggacaagccagagggacag

SEQ ID NO: 7563034 - DNA, 22 bp, Homo sapiens
ccaggacaagccagagggacag

SEQ ID NO: 7563035 - DNA, 22 bp, Homo sapiens
ccaggaatgcacactctgagaa

SEQ ID NO: 7563036 - DNA, 22 bp, Homo sapiens
ccaggaatgcacactctgagaa

SEQ ID NO: 7563037 - DNA, 22 bp, Homo sapiens
ccaggaagtatgacccaacaga

SEQ ID NO: 7563038 - DNA, 22 bp, Homo sapiens
ccaggaagtatgacccaacaga

SEQ ID NO: 7563039 - DNA, 22 bp, Homo sapiens
ccaggaagtatgacccaacaga

SEQ ID NO: 7563040 - DNA, 22 bp, Homo sapiens
ccaggaagtatgacccaacaga

SEQ ID NO: 7563041 - DNA, 22 bp, Homo sapiens
ccaggaagtatgacccaacaga

SEQ ID NO: 7563042 - DNA, 22 bp, Homo sapiens
aggcctgtctggggctcagcca

SEQ ID NO: 7563043 - DNA, 22 bp, Homo sapiens
aggcctgtctggggctcagcca

SEQ ID NO: 7563044 - DNA, 22 bp, Homo sapiens
aggcgctgcatgtgaaggagtt

SEQ ID NO: 7563045 - DNA, 22 bp, Homo sapiens
aggcgctgcatgtgaaggagtt

SEQ ID NO: 7563046 - DNA, 22 bp, Homo sapiens
aggcctgtcccagctgaggacg

SEQ ID NO: 7563047 - DNA, 22 bp, Homo sapiens
aggcctgtagttcctctttcca

SEQ ID NO: 7563048 - DNA, 22 bp, Homo sapiens
aggcctgtcccagctgaggacg

SEQ ID NO: 7563049 - DNA, 22 bp, Homo sapiens
aggcctgtaatcccagcacttt

SEQ ID NO: 7563050 - DNA, 22 bp, Homo sapiens
aggcctgtaattttcctctttt

SEQ ID NO: 7563051 - DNA, 22 bp, Homo sapiens
ccaggacaagtgtggccatggc

SEQ ID NO: 7563052 - DNA, 22 bp, Homo sapiens
ccaggacaagccagagggacag

SEQ ID NO: 7563053 - DNA, 22 bp, Homo sapiens
ccaggacaagccagagggacag

SEQ ID NO: 7563054 - DNA, 22 bp, Homo sapiens
ccaggacaagccagagggacag

SEQ ID NO: 7563055 - DNA, 22 bp, Homo sapiens
ccaggacaagccagagggacag

SEQ ID NO: 7563056 - DNA, 22 bp, Homo sapiens
ccaggacaagccagagggacag

SEQ ID NO: 7563057 - DNA, 22 bp, Homo sapiens
aggcgtgggaggatctgaggcc

SEQ ID NO: 7563058 - DNA, 22 bp, Homo sapiens
aggcgtgggaggatctgaggcc

SEQ ID NO: 7563059 - DNA, 22 bp, Homo sapiens
aggcgtgggaggatctgaggcc

SEQ ID NO: 7563060 - DNA, 22 bp, Homo sapiens
aggcggtggccaaggagcggga

SEQ ID NO: 7563061 - DNA, 22 bp, Homo sapiens
aggcggtggccaaggagcggga

SEQ ID NO: 7563062 - DNA, 22 bp, Homo sapiens
aggcggtgtgctttgcagagca

SEQ ID NO: 7563063 - DNA, 22 bp, Homo sapiens
aggcggcttctgaggaggctgc

SEQ ID NO: 7563064 - DNA, 22 bp, Homo sapiens
aggcggggaggcgctgctgtag

SEQ ID NO: 7563065 - DNA, 22 bp, Homo sapiens
aggcggggaggcgctgctgtag

SEQ ID NO: 7563066 - DNA, 22 bp, Homo sapiens
aggcggcttctgaggaggctgc

SEQ ID NO: 7563067 - DNA, 22 bp, Homo sapiens
aggcggcttctgaggaggctgc

SEQ ID NO: 7563068 - DNA, 22 bp, Homo sapiens
aggcggcttctgaggaggctgc

SEQ ID NO: 7563069 - DNA, 22 bp, Homo sapiens
aggcggggaggcgctgctgtag

SEQ ID NO: 7563070 - DNA, 22 bp, Homo sapiens
aggcgggtaccctggctcgaaa

SEQ ID NO: 7563071 - DNA, 22 bp, Homo sapiens
aggcggctccgggagtgtgggc

SEQ ID NO: 7563072 - DNA, 22 bp, Homo sapiens
aggcggctccgggagtgtgggc

SEQ ID NO: 7563073 - DNA, 22 bp, Homo sapiens
aggcggctccgggagtgtgggc

SEQ ID NO: 7563074 - DNA, 22 bp, Homo sapiens
aggcggctggtgtcctgcaggt

SEQ ID NO: 7563075 - DNA, 22 bp, Homo sapiens
aggcgctgtgcttggggctgga

SEQ ID NO: 7563076 - DNA, 22 bp, Homo sapiens
aggcggaagatggccccataga

SEQ ID NO: 7563077 - DNA, 22 bp, Homo sapiens
aggcggagctcagtgtgtccaa

SEQ ID NO: 7563078 - DNA, 22 bp, Homo sapiens
aggcggagctcagtgtgtccaa

SEQ ID NO: 7563079 - DNA, 22 bp, Homo sapiens
aggcggagctcagtgtgtccaa

SEQ ID NO: 7563080 - DNA, 22 bp, Homo sapiens
aggcgctgtctggggtcgcggc

SEQ ID NO: 7563081 - DNA, 22 bp, Homo sapiens
aggcgctgtgcttggggctgga

SEQ ID NO: 7563082 - DNA, 22 bp, Homo sapiens
aggcgctgtgcttggggctgga

SEQ ID NO: 7563083 - DNA, 22 bp, Homo sapiens
aggcgctgcgctggggccagaa

SEQ ID NO: 7563084 - DNA, 22 bp, Homo sapiens
aggcgctgcgctggggccagaa

SEQ ID NO: 7563085 - DNA, 22 bp, Homo sapiens
aggcgctgcgctggggccagaa

SEQ ID NO: 7563086 - DNA, 22 bp, Homo sapiens
aggcgctgcgctggggccagaa

SEQ ID NO: 7563087 - DNA, 22 bp, Homo sapiens
aggcgctgcgctggggccagaa

SEQ ID NO: 7563088 - DNA, 22 bp, Homo sapiens
ccagctcttttggctgagtgag

SEQ ID NO: 7563089 - DNA, 22 bp, Homo sapiens
ccagctcttttggctgagtgag

SEQ ID NO: 7563090 - DNA, 22 bp, Homo sapiens
ccagctcttttggctgagtgag

SEQ ID NO: 7563091 - DNA, 22 bp, Homo sapiens
ccagctcttttggctgagtgag

SEQ ID NO: 7563092 - DNA, 22 bp, Homo sapiens
ccagctcttttggctgagtgag

SEQ ID NO: 7563093 - DNA, 22 bp, Homo sapiens
ccagctcttttggctgagtgag

SEQ ID NO: 7563094 - DNA, 22 bp, Homo sapiens
ccagctcttggtgcacttacat

SEQ ID NO: 7563095 - DNA, 22 bp, Homo sapiens
ccagctcttggtgcacttacat

SEQ ID NO: 7563096 - DNA, 22 bp, Homo sapiens
ccagctctgtaagctgtgaaat

SEQ ID NO: 7563097 - DNA, 22 bp, Homo sapiens
ccagctctggcttcttgctggg

SEQ ID NO: 7563098 - DNA, 20 bp, Homo sapiens
ccagctctgtggttagatac

SEQ ID NO: 7563099 - DNA, 22 bp, Homo sapiens
ccagctcttggtgcacttacat

SEQ ID NO: 7563100 - DNA, 22 bp, Homo sapiens
ccagctcttggtgcacttacat

SEQ ID NO: 7563101 - DNA, 22 bp, Homo sapiens
ccagctctgtaagctgtgaaat

SEQ ID NO: 7563102 - DNA, 22 bp, Homo sapiens
ccagctctgtaagctgtgaaat

SEQ ID NO: 7563103 - DNA, 22 bp, Homo sapiens
ccagctctggcttcttgctggg

SEQ ID NO: 7563104 - DNA, 22 bp, Homo sapiens
ccagctctgcttgcccagtcag

SEQ ID NO: 7563105 - DNA, 22 bp, Homo sapiens
ccagctctgcttgcccagtcag

SEQ ID NO: 7563106 - DNA, 22 bp, Homo sapiens
ccagctctgcttgcccagtcag

SEQ ID NO: 7563107 - DNA, 22 bp, Homo sapiens
ccagctctggcttcttgctggg

SEQ ID NO: 7563108 - DNA, 22 bp, Homo sapiens
ccagctctggcttcttgctggg

SEQ ID NO: 7563109 - DNA, 22 bp, Homo sapiens
ccagctctggcttcttgctggg

SEQ ID NO: 7563110 - DNA, 21 bp, Homo sapiens
ccagctctgcctccagttggt

SEQ ID NO: 7563111 - DNA, 21 bp, Homo sapiens
ccagctctgcctccagttggt

SEQ ID NO: 7563112 - DNA, 22 bp, Homo sapiens
ccagctctgcttgcccagtcag

SEQ ID NO: 7563113 - DNA, 22 bp, Homo sapiens
ccagctctgcttgcccagtcag

SEQ ID NO: 7563114 - DNA, 22 bp, Homo sapiens
ccagctctgcttgcccagtcag

SEQ ID NO: 7563115 - DNA, 22 bp, Homo sapiens
ccagctctgcttgcccagtcag

SEQ ID NO: 7563116 - DNA, 22 bp, Homo sapiens
ccagctctgcttgcccagtcag

SEQ ID NO: 7563117 - DNA, 22 bp, Homo sapiens
ccagctctgcttgcccagtcag

SEQ ID NO: 7563118 - DNA, 22 bp, Homo sapiens
ccagctccggtgtgcttatttc

SEQ ID NO: 7563119 - DNA, 22 bp, Homo sapiens
ccagcaggagactagcaacata

SEQ ID NO: 7563120 - DNA, 22 bp, Homo sapiens
ccagcaggagactagcaacata

SEQ ID NO: 7563121 - DNA, 22 bp, Homo sapiens
ccagcaggagactagcaacata

SEQ ID NO: 7563122 - DNA, 22 bp, Homo sapiens
ccagcaggagactagcaacata

SEQ ID NO: 7563123 - DNA, 22 bp, Homo sapiens
ccagcaggagactagcaacata

SEQ ID NO: 7563124 - DNA, 22 bp, Homo sapiens
ccagcaggagactagcaacata

SEQ ID NO: 7563125 - DNA, 22 bp, Homo sapiens
ccagcaggagagaacatttccc

SEQ ID NO: 7563126 - DNA, 22 bp, Homo sapiens
ccagcaggagagaacatttccc

SEQ ID NO: 7563127 - DNA, 22 bp, Homo sapiens
ccagcaggagatgcctgtgtct

SEQ ID NO: 7563128 - DNA, 22 bp, Homo sapiens
ccagcaggagatgcctgtgtct

SEQ ID NO: 7563129 - DNA, 22 bp, Homo sapiens
ccagcaggagagaacatttccc

SEQ ID NO: 7563130 - DNA, 22 bp, Homo sapiens
ccagcaggagatgcctgtgtct

SEQ ID NO: 7563131 - DNA, 22 bp, Homo sapiens
ccagcaggagatgcctgtgtct

SEQ ID NO: 7563132 - DNA, 22 bp, Homo sapiens
ccagcaggagatgcctgtgtct

SEQ ID NO: 7563133 - DNA, 22 bp, Homo sapiens
ccagcaggcagtcatatccttt

SEQ ID NO: 7563134 - DNA, 22 bp, Homo sapiens
ccagcaggcagtcatatccttt

SEQ ID NO: 7563135 - DNA, 22 bp, Homo sapiens
ccagctccggtgtgcttatttc

SEQ ID NO: 7563136 - DNA, 22 bp, Homo sapiens
ccagcaggcagtcatatccttt

SEQ ID NO: 7563137 - DNA, 22 bp, Homo sapiens
ccagctccggtgtgcttatttc

SEQ ID NO: 7563138 - DNA, 22 bp, Homo sapiens
ccagctccggtgtgcttatttc

SEQ ID NO: 7563139 - DNA, 23 bp, Homo sapiens
ccagctccgtgagcctcgggctc

SEQ ID NO: 7563140 - DNA, 23 bp, Homo sapiens
ccagctccgtgagcctcgggctc

SEQ ID NO: 7563141 - DNA, 23 bp, Homo sapiens
ccagctccgtgagcctcgggctc

SEQ ID NO: 7563142 - DNA, 23 bp, Homo sapiens
ccagctccgtgagcctcgggctc

SEQ ID NO: 7563143 - DNA, 23 bp, Homo sapiens
ccagctccgtgagcctcgggctc

SEQ ID NO: 7563144 - DNA, 21 bp, Homo sapiens
ccagctctgcctccagttggt

SEQ ID NO: 7563145 - DNA, 22 bp, Homo sapiens
ccagctctgccaagcgtcagct

SEQ ID NO: 7563146 - DNA, 21 bp, Homo sapiens
ccagctctgcctccagttggt

SEQ ID NO: 7563147 - DNA, 21 bp, Homo sapiens
ccagctctgcctccagttggt

SEQ ID NO: 7563148 - DNA, 21 bp, Homo sapiens
ccagctctgcctccagttggt

SEQ ID NO: 7563149 - DNA, 21 bp, Homo sapiens
ccagctctgcctccagttggt

SEQ ID NO: 7563150 - DNA, 22 bp, Homo sapiens
ccagctgacgatgcctggtctc

SEQ ID NO: 7563151 - DNA, 22 bp, Homo sapiens
ccagctgacgatgcctggtctc

SEQ ID NO: 7563152 - DNA, 22 bp, Homo sapiens
ccagctgacgatgcctggtctc

SEQ ID NO: 7563153 - DNA, 22 bp, Homo sapiens
ccagctgacgatgcctggtctc

SEQ ID NO: 7563154 - DNA, 22 bp, Homo sapiens
ccagctcttttggctgagtgag

SEQ ID NO: 7563155 - DNA, 22 bp, Homo sapiens
ccagctcttttggctgagtgag

SEQ ID NO: 7563156 - DNA, 22 bp, Homo sapiens
ccagctcttttggctgagtgag

SEQ ID NO: 7563157 - DNA, 22 bp, Homo sapiens
ccagctggaacggcagcccagc

SEQ ID NO: 7563158 - DNA, 22 bp, Homo sapiens
ccagctggaacggcagcccagc

SEQ ID NO: 7563159 - DNA, 22 bp, Homo sapiens
ccagctggaacggcagcccagc

SEQ ID NO: 7563160 - DNA, 22 bp, Homo sapiens
ccagctggaacggcagcccagc

SEQ ID NO: 7563161 - DNA, 22 bp, Homo sapiens
ccagctggaacggcagcccagc

SEQ ID NO: 7563162 - DNA, 22 bp, Homo sapiens
ccagctggaacggcagcccagc

SEQ ID NO: 7563163 - DNA, 22 bp, Homo sapiens
ccagctggaaacaaatagagtg

SEQ ID NO: 7563164 - DNA, 22 bp, Homo sapiens
ccagctggaaacaaatagagtg

SEQ ID NO: 7563165 - DNA, 22 bp, Homo sapiens
ccagctgagaagtgtaaagtga

SEQ ID NO: 7563166 - DNA, 22 bp, Homo sapiens
ccagctgagaagtgtaaagtga

SEQ ID NO: 7563167 - DNA, 22 bp, Homo sapiens
ccagctgagaagtgtaaagtga

SEQ ID NO: 7563168 - DNA, 22 bp, Homo sapiens
ccagctggagccaaggtggact

SEQ ID NO: 7563169 - DNA, 22 bp, Homo sapiens
ccagctggagccaaggtggact

SEQ ID NO: 7563170 - DNA, 22 bp, Homo sapiens
ccagctggagccaaggtggact

SEQ ID NO: 7563171 - DNA, 22 bp, Homo sapiens
ccagctggagccaaggtggact

SEQ ID NO: 7563172 - DNA, 22 bp, Homo sapiens
ccagctggaagagtgcagaact

SEQ ID NO: 7563173 - DNA, 22 bp, Homo sapiens
ccagctggaagagtgcagaact

SEQ ID NO: 7563174 - DNA, 22 bp, Homo sapiens
ccagctggaagagtgcagaact

SEQ ID NO: 7563175 - DNA, 22 bp, Homo sapiens
ccagctggaagagtgcagaact

SEQ ID NO: 7563176 - DNA, 22 bp, Homo sapiens
ccagctggaagagtgcagaact

SEQ ID NO: 7563177 - DNA, 22 bp, Homo sapiens
ccagctggaagagtgcagaact

SEQ ID NO: 7563178 - DNA, 22 bp, Homo sapiens
ccagctggagccaaggtggact

SEQ ID NO: 7563179 - DNA, 22 bp, Homo sapiens
ccagctggagccaaggtggact

SEQ ID NO: 7563180 - DNA, 22 bp, Homo sapiens
ccagctggagccaaggtggact

SEQ ID NO: 7563181 - DNA, 22 bp, Homo sapiens
ccagctggagccaaggtggact

SEQ ID NO: 7563182 - DNA, 22 bp, Homo sapiens
ccagctggagctcgcagatagg

SEQ ID NO: 7563183 - DNA, 22 bp, Homo sapiens
ccagctggcaggagagtcaggg

SEQ ID NO: 7563184 - DNA, 22 bp, Homo sapiens
ccagctggcaggagagtcaggg

SEQ ID NO: 7563185 - DNA, 22 bp, Homo sapiens
ccagctggcaggagagtcaggg

SEQ ID NO: 7563186 - DNA, 22 bp, Homo sapiens
ccagctggcaggagagtcaggg

SEQ ID NO: 7563187 - DNA, 22 bp, Homo sapiens
ccagctggcaggagagtcaggg

SEQ ID NO: 7563188 - DNA, 22 bp, Homo sapiens
ccagctggcaggagagtcaggg

SEQ ID NO: 7563189 - DNA, 22 bp, Homo sapiens
ccagctggcaggagagtcaggg

SEQ ID NO: 7563190 - DNA, 22 bp, Homo sapiens
ccagctggcaggagagtcaggg

SEQ ID NO: 7563191 - DNA, 22 bp, Homo sapiens
ccagctggcactgtggctgccc

SEQ ID NO: 7563192 - DNA, 22 bp, Homo sapiens
ccagctggcactgtggctgccc

SEQ ID NO: 7563193 - DNA, 22 bp, Homo sapiens
ccagctggagctcgcagatagg

SEQ ID NO: 7563194 - DNA, 22 bp, Homo sapiens
ccagctggcactgtggctgccc

SEQ ID NO: 7563195 - DNA, 22 bp, Homo sapiens
ccagctggcactgtggctgccc

SEQ ID NO: 7563196 - DNA, 22 bp, Homo sapiens
ccagctggcactgtggctgccc

SEQ ID NO: 7563197 - DNA, 22 bp, Homo sapiens
ccagctggcactgtggctgccc

SEQ ID NO: 7563198 - DNA, 22 bp, Homo sapiens
ccagctggcccagctgtgctcc

SEQ ID NO: 7563199 - DNA, 22 bp, Homo sapiens
ccagctggcccagctgtgctcc

SEQ ID NO: 7563200 - DNA, 22 bp, Homo sapiens
ccagctggcccagctgtgctcc

SEQ ID NO: 7563201 - DNA, 22 bp, Homo sapiens
ccagctggcccagctgtgctcc

SEQ ID NO: 7563202 - DNA, 22 bp, Homo sapiens
ccagctggcccagctgtgctcc

SEQ ID NO: 7563203 - DNA, 22 bp, Homo sapiens
aggcctctggaggtggcagtgt

SEQ ID NO: 7563204 - DNA, 22 bp, Homo sapiens
aggcctctggaggtggcagtgt

SEQ ID NO: 7563205 - DNA, 22 bp, Homo sapiens
aggcctctgctggaaagagttg

SEQ ID NO: 7563206 - DNA, 22 bp, Homo sapiens
aggcctctggaggtggcagtgt

SEQ ID NO: 7563207 - DNA, 17 bp, Homo sapiens
aggcctctgccggtgcc

SEQ ID NO: 7563208 - DNA, 17 bp, Homo sapiens
aggcctctgccggtgcc

SEQ ID NO: 7563209 - DNA, 17 bp, Homo sapiens
aggcctctgccggtgcc

SEQ ID NO: 7563210 - DNA, 22 bp, Homo sapiens
aggcctctgctggaaagagttg

SEQ ID NO: 7563211 - DNA, 22 bp, Homo sapiens
aggcctgccttgagcaaccagc

SEQ ID NO: 7563212 - DNA, 22 bp, Homo sapiens
aggcctctgggcctgcgggttt

SEQ ID NO: 7563213 - DNA, 22 bp, Homo sapiens
aggcctctgggcctgcgggttt

SEQ ID NO: 7563214 - DNA, 22 bp, Homo sapiens
aggcctgctgtcttgaggccaa

SEQ ID NO: 7563215 - DNA, 22 bp, Homo sapiens
aggcctgccttgagcaaccagc

SEQ ID NO: 7563216 - DNA, 22 bp, Homo sapiens
aggcctgctgtcttgaggccaa

SEQ ID NO: 7563217 - DNA, 22 bp, Homo sapiens
aggcctgctgtcttgaggccaa

SEQ ID NO: 7563218 - DNA, 22 bp, Homo sapiens
aggcctgctgtcttgaggccaa

SEQ ID NO: 7563219 - DNA, 22 bp, Homo sapiens
aggcctgctgtcttgaggccaa

SEQ ID NO: 7563220 - DNA, 22 bp, Homo sapiens
aggcctgctgtcttgaggccaa

SEQ ID NO: 7563221 - DNA, 22 bp, Homo sapiens
aggccacatagcttgcatgtag

SEQ ID NO: 7563222 - DNA, 22 bp, Homo sapiens
aggccacattgtgattcccgca

SEQ ID NO: 7563223 - DNA, 22 bp, Homo sapiens
aggccacattgtgattcccgca

SEQ ID NO: 7563224 - DNA, 22 bp, Homo sapiens
aggccacattgtgattcccgca

SEQ ID NO: 7563225 - DNA, 22 bp, Homo sapiens
aggccaccaccctatctcctgg

SEQ ID NO: 7563226 - DNA, 22 bp, Homo sapiens
aggccaccaccctatctcctgg

SEQ ID NO: 7563227 - DNA, 22 bp, Homo sapiens
aggccagaaaaagacagctcca

SEQ ID NO: 7563228 - DNA, 22 bp, Homo sapiens
aggccagaaaaagacagctcca

SEQ ID NO: 7563229 - DNA, 22 bp, Homo sapiens
aggccagaaaaagacagctcca

SEQ ID NO: 7563230 - DNA, 22 bp, Homo sapiens
aggccagaaaaagacagctcca

SEQ ID NO: 7563231 - DNA, 22 bp, Homo sapiens
aggccagaaaaagacagctcca

SEQ ID NO: 7563232 - DNA, 22 bp, Homo sapiens
aggccactcagggggccaagat

SEQ ID NO: 7563233 - DNA, 20 bp, Homo sapiens
aggccactgaatgccaatca

SEQ ID NO: 7563234 - DNA, 22 bp, Homo sapiens
aggccaccaccctatctcctgg

SEQ ID NO: 7563235 - DNA, 22 bp, Homo sapiens
aggccacgctaatggggccaag

SEQ ID NO: 7563236 - DNA, 22 bp, Homo sapiens
aggccacatagcttgcatgtag

SEQ ID NO: 7563237 - DNA, 22 bp, Homo sapiens
aggccacatagcttgcatgtag

SEQ ID NO: 7563238 - DNA, 22 bp, Homo sapiens
aggccacatagcttgcatgtag

SEQ ID NO: 7563239 - DNA, 22 bp, Homo sapiens
aggccacagttgaggccagcaa

SEQ ID NO: 7563240 - DNA, 22 bp, Homo sapiens
aggccacagttgaggccagcaa

SEQ ID NO: 7563241 - DNA, 22 bp, Homo sapiens
aggccacagttgaggccagcaa

SEQ ID NO: 7563242 - DNA, 22 bp, Homo sapiens
aggccacatagcttgcatgtag

SEQ ID NO: 7563243 - DNA, 22 bp, Homo sapiens
aggccacatagcttgcatgtag

SEQ ID NO: 7563244 - DNA, 21 bp, Homo sapiens
ccagagcctgctgagccccct

SEQ ID NO: 7563245 - DNA, 21 bp, Homo sapiens
ccagagcctgctgagccccct

SEQ ID NO: 7563246 - DNA, 22 bp, Homo sapiens
ccagagcctggcatctgcataa

SEQ ID NO: 7563247 - DNA, 22 bp, Homo sapiens
ccagagcctggcatctgcataa

SEQ ID NO: 7563248 - DNA, 22 bp, Homo sapiens
aggccagaaatgtcagggagtg

SEQ ID NO: 7563249 - DNA, 22 bp, Homo sapiens
aggccagaaatgtcagggagtg

SEQ ID NO: 7563250 - DNA, 22 bp, Homo sapiens
aggccagaaatgtcagggagtg

SEQ ID NO: 7563251 - DNA, 22 bp, Homo sapiens
aggccagaaatgtcagggagtg

SEQ ID NO: 7563252 - DNA, 22 bp, Homo sapiens
aggccagaaaaagacagctcca

SEQ ID NO: 7563253 - DNA, 22 bp, Homo sapiens
aggccagaaatgtcagggagtg

SEQ ID NO: 7563254 - DNA, 22 bp, Homo sapiens
aggccagaaatgtcagggagtg

SEQ ID NO: 7563255 - DNA, 22 bp, Homo sapiens
aggccagaaatgtcagggagtg

SEQ ID NO: 7563256 - DNA, 22 bp, Homo sapiens
aggccagaaatgtcagggagtg

SEQ ID NO: 7563257 - DNA, 22 bp, Homo sapiens
ccagagctgaggagatgggctt

SEQ ID NO: 7563258 - DNA, 22 bp, Homo sapiens
ccagagctgaggagatgggctt

SEQ ID NO: 7563259 - DNA, 22 bp, Homo sapiens
ccagagctgaggagatgggctt

SEQ ID NO: 7563260 - DNA, 23 bp, Homo sapiens
ccagagctctttcatgcttccat

SEQ ID NO: 7563261 - DNA, 22 bp, Homo sapiens
ccagagctccagggctacagaa

SEQ ID NO: 7563262 - DNA, 23 bp, Homo sapiens
ccagagctctttcatgcttccat

SEQ ID NO: 7563263 - DNA, 22 bp, Homo sapiens
ccagagctccagggctacagaa

SEQ ID NO: 7563264 - DNA, 22 bp, Homo sapiens
ccagagctccagggctacagaa

SEQ ID NO: 7563265 - DNA, 22 bp, Homo sapiens
ccagagctccagggctacagaa

SEQ ID NO: 7563266 - DNA, 22 bp, Homo sapiens
ccagagctgagggagcctgagc

SEQ ID NO: 7563267 - DNA, 22 bp, Homo sapiens
ccagagctgagggagcctgagc

SEQ ID NO: 7563268 - DNA, 22 bp, Homo sapiens
ccagagctgaggagatgggctt

SEQ ID NO: 7563269 - DNA, 22 bp, Homo sapiens
ccagagctgaggagatgggctt

SEQ ID NO: 7563270 - DNA, 22 bp, Homo sapiens
ccagagctgaggagatgggctt

SEQ ID NO: 7563271 - DNA, 22 bp, Homo sapiens
ccagagctgaggagatgggctt

SEQ ID NO: 7563272 - DNA, 20 bp, Homo sapiens
ccagagctgatggctgcccg

SEQ ID NO: 7563273 - DNA, 20 bp, Homo sapiens
ccagagctgatggctgcccg

SEQ ID NO: 7563274 - DNA, 20 bp, Homo sapiens
ccagagctgatggctgcccg

SEQ ID NO: 7563275 - DNA, 22 bp, Homo sapiens
ccagagctgagggagcctgagc

SEQ ID NO: 7563276 - DNA, 22 bp, Homo sapiens
ccagagctgagggagcctgagc

SEQ ID NO: 7563277 - DNA, 22 bp, Homo sapiens
ccagagctgagggagcctgagc

SEQ ID NO: 7563278 - DNA, 22 bp, Homo sapiens
ccagagctgagggagcctgagc

SEQ ID NO: 7563279 - DNA, 17 bp, Homo sapiens
ccagagctactgagact

SEQ ID NO: 7563280 - DNA, 17 bp, Homo sapiens
ccagagctactgagact

SEQ ID NO: 7563281 - DNA, 17 bp, Homo sapiens
ccagagctactgagact

SEQ ID NO: 7563282 - DNA, 22 bp, Homo sapiens
ccagagctaaacacacaggctg

SEQ ID NO: 7563283 - DNA, 22 bp, Homo sapiens
ccagagctaaacacacaggctg

SEQ ID NO: 7563284 - DNA, 22 bp, Homo sapiens
ccagagcctggcatctgcataa

SEQ ID NO: 7563285 - DNA, 22 bp, Homo sapiens
ccagagctaaacacacaggctg

SEQ ID NO: 7563286 - DNA, 22 bp, Homo sapiens
ccagagctaaacacacaggctg

SEQ ID NO: 7563287 - DNA, 22 bp, Homo sapiens
ccagagctaaacacacaggctg

SEQ ID NO: 7563288 - DNA, 22 bp, Homo sapiens
ccagagctaaacacacaggctg

SEQ ID NO: 7563289 - DNA, 22 bp, Homo sapiens
ccagagctccagggctacagaa

SEQ ID NO: 7563290 - DNA, 17 bp, Homo sapiens
ccagagctactgagact

SEQ ID NO: 7563291 - DNA, 22 bp, Homo sapiens
ccagagctccagggctacagaa

SEQ ID NO: 7563292 - DNA, 22 bp, Homo sapiens
ccagagctccagggctacagaa

SEQ ID NO: 7563293 - DNA, 17 bp, Homo sapiens
ccagagctactgagact

SEQ ID NO: 7563294 - DNA, 17 bp, Homo sapiens
ccagagctactgagact

SEQ ID NO: 7563295 - DNA, 17 bp, Homo sapiens
ccagagctactgagact

SEQ ID NO: 7563296 - DNA, 22 bp, Homo sapiens
ccagagctccagggctacagaa

SEQ ID NO: 7563297 - DNA, 22 bp, Homo sapiens
ccagagctccagggctacagaa

SEQ ID NO: 7563298 - DNA, 22 bp, Homo sapiens
ccagagctccagggctacagaa

SEQ ID NO: 7563299 - DNA, 22 bp, Homo sapiens
aggcccagactcagcggggcgg

SEQ ID NO: 7563300 - DNA, 22 bp, Homo sapiens
aggcccagactcagcggggcgg

SEQ ID NO: 7563301 - DNA, 22 bp, Homo sapiens
aggcccagactcagcggggcgg

SEQ ID NO: 7563302 - DNA, 23 bp, Homo sapiens
aggcccaactctgtgagggctgc

SEQ ID NO: 7563303 - DNA, 23 bp, Homo sapiens
aggcccaactctgtgagggctgc

SEQ ID NO: 7563304 - DNA, 22 bp, Homo sapiens
aggcccaatggctattgggtga

SEQ ID NO: 7563305 - DNA, 22 bp, Homo sapiens
aggcccagagagccagttagtg

SEQ ID NO: 7563306 - DNA, 19 bp, Homo sapiens
ccagcagctttgattctct

SEQ ID NO: 7563307 - DNA, 19 bp, Homo sapiens
ccagcagctttgattctct

SEQ ID NO: 7563308 - DNA, 22 bp, Homo sapiens
aggcccagactcagcggggcgg

SEQ ID NO: 7563309 - DNA, 22 bp, Homo sapiens
aggcccagactcagcggggcgg

SEQ ID NO: 7563310 - DNA, 22 bp, Homo sapiens
aggccatgaggtcatgggagat

SEQ ID NO: 7563311 - DNA, 22 bp, Homo sapiens
aggccatgaggtcatgggagat

SEQ ID NO: 7563312 - DNA, 22 bp, Homo sapiens
aggccatgtggccccagagtct

SEQ ID NO: 7563313 - DNA, 22 bp, Homo sapiens
aggccatgtggccccagagtct

SEQ ID NO: 7563314 - DNA, 22 bp, Homo sapiens
aggccatgccaggcccaggaag

SEQ ID NO: 7563315 - DNA, 22 bp, Homo sapiens
aggccatgggatttccaattgg

SEQ ID NO: 7563316 - DNA, 23 bp, Homo sapiens
aggcccaactctgtgagggctgc

SEQ ID NO: 7563317 - DNA, 23 bp, Homo sapiens
aggcccaactctgtgagggctgc

SEQ ID NO: 7563318 - DNA, 22 bp, Homo sapiens
aggcccaaaagaaaccactggg

SEQ ID NO: 7563319 - DNA, 22 bp, Homo sapiens
aggcccaaaagaaaccactggg

SEQ ID NO: 7563320 - DNA, 22 bp, Homo sapiens
aggcccaaaagaaaccactggg

SEQ ID NO: 7563321 - DNA, 22 bp, Homo sapiens
aggcccaaaagaaaccactggg

SEQ ID NO: 7563322 - DNA, 22 bp, Homo sapiens
ccagcaggagactagcaacata

SEQ ID NO: 7563323 - DNA, 22 bp, Homo sapiens
ccagcaggactttggaaatatg

SEQ ID NO: 7563324 - DNA, 22 bp, Homo sapiens
ccagcaggactttggaaatatg

SEQ ID NO: 7563325 - DNA, 22 bp, Homo sapiens
ccagcaggactttggaaatatg

SEQ ID NO: 7563326 - DNA, 22 bp, Homo sapiens
ccagcaggaaagtgacgtttga

SEQ ID NO: 7563327 - DNA, 22 bp, Homo sapiens
ccagcaggaaagtgacgtttga

SEQ ID NO: 7563328 - DNA, 22 bp, Homo sapiens
ccagcaggaaagtgacgtttga

SEQ ID NO: 7563329 - DNA, 22 bp, Homo sapiens
ccagcagctttgcatacactaa

SEQ ID NO: 7563330 - DNA, 22 bp, Homo sapiens
ccagcagctttgcatacactaa

SEQ ID NO: 7563331 - DNA, 19 bp, Homo sapiens
ccagcagctttgattctct

SEQ ID NO: 7563332 - DNA, 19 bp, Homo sapiens
ccagcagctttgattctct

SEQ ID NO: 7563333 - DNA, 22 bp, Homo sapiens
ccagcagctttgcatacactaa

SEQ ID NO: 7563334 - DNA, 19 bp, Homo sapiens
ccagcagctttgattctct

SEQ ID NO: 7563335 - DNA, 22 bp, Homo sapiens
aggccagtgcagctggaacaga

SEQ ID NO: 7563336 - DNA, 22 bp, Homo sapiens
aggccagtgcagctggaacaga

SEQ ID NO: 7563337 - DNA, 22 bp, Homo sapiens
aggccagtgcagctggaacaga

SEQ ID NO: 7563338 - DNA, 22 bp, Homo sapiens
aggccagtgcagctggaacaga

SEQ ID NO: 7563339 - DNA, 22 bp, Homo sapiens
aggccaggttcctcaatcttga

SEQ ID NO: 7563340 - DNA, 22 bp, Homo sapiens
aggccagtgcagctggaacaga

SEQ ID NO: 7563341 - DNA, 22 bp, Homo sapiens
aggccagtgcagctggaacaga

SEQ ID NO: 7563342 - DNA, 22 bp, Homo sapiens
aggccagtgcctttccagggct

SEQ ID NO: 7563343 - DNA, 22 bp, Homo sapiens
aggccagtgcctttccagggct

SEQ ID NO: 7563344 - DNA, 22 bp, Homo sapiens
aggccagtgccatcagggtttt

SEQ ID NO: 7563345 - DNA, 22 bp, Homo sapiens
aggccagtgccatcagggtttt

SEQ ID NO: 7563346 - DNA, 22 bp, Homo sapiens
aggccagtgtggctggagcaca

SEQ ID NO: 7563347 - DNA, 22 bp, Homo sapiens
aggccagtgtggctggagcaca

SEQ ID NO: 7563348 - DNA, 22 bp, Homo sapiens
aggccagtggttctctgtgtcc

SEQ ID NO: 7563349 - DNA, 22 bp, Homo sapiens
aggccagtgtggctggagcaca

SEQ ID NO: 7563350 - DNA, 22 bp, Homo sapiens
aggccagtgtggctggagcaca

SEQ ID NO: 7563351 - DNA, 22 bp, Homo sapiens
aggccatattaattacacagga

SEQ ID NO: 7563352 - DNA, 22 bp, Homo sapiens
aggccatcaaatcatgtagtgc

SEQ ID NO: 7563353 - DNA, 22 bp, Homo sapiens
aggccatcaaatcatgtagtgc

SEQ ID NO: 7563354 - DNA, 20 bp, Homo sapiens
ccagagctgatggctgcccg

SEQ ID NO: 7563355 - DNA, 22 bp, Homo sapiens
aggccaggatagcatggatcag

SEQ ID NO: 7563356 - DNA, 22 bp, Homo sapiens
aggccaggcaacattctgaagt

SEQ ID NO: 7563357 - DNA, 22 bp, Homo sapiens
aggccaggcaacattctgaagt

SEQ ID NO: 7563358 - DNA, 22 bp, Homo sapiens
aggccaggcaacattctgaagt

SEQ ID NO: 7563359 - DNA, 22 bp, Homo sapiens
aggccaggcaacattctgaagt

SEQ ID NO: 7563360 - DNA, 22 bp, Homo sapiens
aggccaggtggtcatgcttgct

SEQ ID NO: 7563361 - DNA, 22 bp, Homo sapiens
aggccaggttcctcaatcttga

SEQ ID NO: 7563362 - DNA, 22 bp, Homo sapiens
aggccaggttcctcaatcttga

SEQ ID NO: 7563363 - DNA, 22 bp, Homo sapiens
aggccaggttcctcaatcttga

SEQ ID NO: 7563364 - DNA, 22 bp, Homo sapiens
aggccaggtggtcatgcttgct

SEQ ID NO: 7563365 - DNA, 22 bp, Homo sapiens
aggccaggttcctcaatcttga

SEQ ID NO: 7563366 - DNA, 22 bp, Homo sapiens
aggccaggtggtcatgcttgct

SEQ ID NO: 7563367 - DNA, 22 bp, Homo sapiens
aggccacagttgaggccagcaa

SEQ ID NO: 7563368 - DNA, 22 bp, Homo sapiens
aggccacagttgaggccagcaa

SEQ ID NO: 7563369 - DNA, 22 bp, Homo sapiens
aggccacagttgaggccagcaa

SEQ ID NO: 7563370 - DNA, 22 bp, Homo sapiens
aggccacagttgaggccagcaa

SEQ ID NO: 7563371 - DNA, 22 bp, Homo sapiens
aggccacagtcagtgggtgctg

SEQ ID NO: 7563372 - DNA, 22 bp, Homo sapiens
aggccacagttgaggccagcaa

SEQ ID NO: 7563373 - DNA, 22 bp, Homo sapiens
aggccacagtcagtgggtgctg

SEQ ID NO: 7563374 - DNA, 22 bp, Homo sapiens
aggccacagtcagtgggtgctg

SEQ ID NO: 7563375 - DNA, 22 bp, Homo sapiens
aggccacagtcagtgggtgctg

SEQ ID NO: 7563376 - DNA, 22 bp, Homo sapiens
aggccacagtactttgcagacc

SEQ ID NO: 7563377 - DNA, 22 bp, Homo sapiens
aggccacagtcagtgggtgctg

SEQ ID NO: 7563378 - DNA, 22 bp, Homo sapiens
aggccacagtcagtgggtgctg

SEQ ID NO: 7563379 - DNA, 22 bp, Homo sapiens
aggccacagtcagtgggtgctg

SEQ ID NO: 7563380 - DNA, 22 bp, Homo sapiens
aggccacagtcagtgggtgctg

SEQ ID NO: 7563381 - DNA, 22 bp, Homo sapiens
aggccacaagaactaccccatc

SEQ ID NO: 7563382 - DNA, 22 bp, Homo sapiens
aggccacaagaactaccccatc

SEQ ID NO: 7563383 - DNA, 22 bp, Homo sapiens
aggccacaagaactaccccatc

SEQ ID NO: 7563384 - DNA, 22 bp, Homo sapiens
aggccacagtactttgcagacc

SEQ ID NO: 7563385 - DNA, 22 bp, Homo sapiens
aggccacagtactttgcagacc

SEQ ID NO: 7563386 - DNA, 22 bp, Homo sapiens
aggccacaagaaaatgcttcat

SEQ ID NO: 7563387 - DNA, 22 bp, Homo sapiens
ccagagaaagctcacaggcagt

SEQ ID NO: 7563388 - DNA, 22 bp, Homo sapiens
ccagagaaagctcacaggcagt

SEQ ID NO: 7563389 - DNA, 22 bp, Homo sapiens
ccagagaaagctcacaggcagt

SEQ ID NO: 7563390 - DNA, 22 bp, Homo sapiens
ccagagaaaagaggccaaggat

SEQ ID NO: 7563391 - DNA, 22 bp, Homo sapiens
ccagagaaagctcacaggcagt

SEQ ID NO: 7563392 - DNA, 22 bp, Homo sapiens
ccagagaaagctcacaggcagt

SEQ ID NO: 7563393 - DNA, 22 bp, Homo sapiens
ccagagaaaagaggccaaggat

SEQ ID NO: 7563394 - DNA, 22 bp, Homo sapiens
ccagagaaaagaggccaaggat

SEQ ID NO: 7563395 - DNA, 22 bp, Homo sapiens
ccagagaaaagaggccaaggat

SEQ ID NO: 7563396 - DNA, 22 bp, Homo sapiens
ccagagaaaagaggccaaggat

SEQ ID NO: 7563397 - DNA, 22 bp, Homo sapiens
ccagagaaaaatgtgtccctgt

SEQ ID NO: 7563398 - DNA, 22 bp, Homo sapiens
ccagagaaaaatgtgtccctgt

SEQ ID NO: 7563399 - DNA, 22 bp, Homo sapiens
ccagagaaaaatgtgtccctgt

SEQ ID NO: 7563400 - DNA, 22 bp, Homo sapiens
ccagagaaaaatgtgtccctgt

SEQ ID NO: 7563401 - DNA, 22 bp, Homo sapiens
ccagagaaaaatgtgtccctgt

SEQ ID NO: 7563402 - DNA, 22 bp, Homo sapiens
ccagactggggctccttgaggg

SEQ ID NO: 7563403 - DNA, 22 bp, Homo sapiens
ccagactggggctccttgaggg

SEQ ID NO: 7563404 - DNA, 22 bp, Homo sapiens
ccagactgtcagcaacttcaag

SEQ ID NO: 7563405 - DNA, 22 bp, Homo sapiens
ccagactgtggagttcctggtg

SEQ ID NO: 7563406 - DNA, 22 bp, Homo sapiens
ccagactgtggagttcctggtg

SEQ ID NO: 7563407 - DNA, 22 bp, Homo sapiens
ccagactgtggagttcctggtg

SEQ ID NO: 7563408 - DNA, 22 bp, Homo sapiens
ccagaccctttcttggcatgtg

SEQ ID NO: 7563409 - DNA, 22 bp, Homo sapiens
ccagacctaaccagcttttgta

SEQ ID NO: 7563410 - DNA, 22 bp, Homo sapiens
ccagacctaaccagcttttgta

SEQ ID NO: 7563411 - DNA, 22 bp, Homo sapiens
ccagacctgcaaggctgagagg

SEQ ID NO: 7563412 - DNA, 22 bp, Homo sapiens
ccagacctgcaaggctgagagg

SEQ ID NO: 7563413 - DNA, 22 bp, Homo sapiens
ccagacctaagcatcagtgcat

SEQ ID NO: 7563414 - DNA, 22 bp, Homo sapiens
ccagaccctttcttggcatgtg

SEQ ID NO: 7563415 - DNA, 22 bp, Homo sapiens
ccagaccctgctctggggctct

SEQ ID NO: 7563416 - DNA, 22 bp, Homo sapiens
ccagaccctttcttggcatgtg

SEQ ID NO: 7563417 - DNA, 22 bp, Homo sapiens
ccagaccctttcttggcatgtg

SEQ ID NO: 7563418 - DNA, 22 bp, Homo sapiens
ccagaccctttcttggcatgtg

SEQ ID NO: 7563419 - DNA, 21 bp, Homo sapiens
ccagactggcctatgtggtag

SEQ ID NO: 7563420 - DNA, 22 bp, Homo sapiens
ccagactggggctccttgaggg

SEQ ID NO: 7563421 - DNA, 22 bp, Homo sapiens
ccagactggggctccttgaggg

SEQ ID NO: 7563422 - DNA, 22 bp, Homo sapiens
ccagactgcttgcttcccagcc

SEQ ID NO: 7563423 - DNA, 22 bp, Homo sapiens
ccagactgagggtccctgagct

SEQ ID NO: 7563424 - DNA, 22 bp, Homo sapiens
ccagactgagggtccctgagct

SEQ ID NO: 7563425 - DNA, 22 bp, Homo sapiens
ccagactgagggtccctgagct

SEQ ID NO: 7563426 - DNA, 22 bp, Homo sapiens
ccagactgagggtccctgagct

SEQ ID NO: 7563427 - DNA, 22 bp, Homo sapiens
ccagactgcttgcttcccagcc

SEQ ID NO: 7563428 - DNA, 22 bp, Homo sapiens
ccagactattgtgtgtcttggg

SEQ ID NO: 7563429 - DNA, 22 bp, Homo sapiens
ccagaccaccctggccatgcac

SEQ ID NO: 7563430 - DNA, 22 bp, Homo sapiens
ccagacatgtgcccttgaggaa

SEQ ID NO: 7563431 - DNA, 22 bp, Homo sapiens
ccagacagttccttgaggttca

SEQ ID NO: 7563432 - DNA, 22 bp, Homo sapiens
ccagacagttccttgaggttca

SEQ ID NO: 7563433 - DNA, 22 bp, Homo sapiens
ccagacagttccttgaggttca

SEQ ID NO: 7563434 - DNA, 22 bp, Homo sapiens
ccagaagaccggggagtcaggg

SEQ ID NO: 7563435 - DNA, 22 bp, Homo sapiens
ccagaagaccggggagtcaggg

SEQ ID NO: 7563436 - DNA, 22 bp, Homo sapiens
ccagaagaccggggagtcaggg

SEQ ID NO: 7563437 - DNA, 22 bp, Homo sapiens
ccagaccaccctggccatgcac

SEQ ID NO: 7563438 - DNA, 22 bp, Homo sapiens
ccagaccagactgacttgagcc

SEQ ID NO: 7563439 - DNA, 22 bp, Homo sapiens
ccagaccaccctggccatgcac

SEQ ID NO: 7563440 - DNA, 22 bp, Homo sapiens
ccagaccctgctctggggctct

SEQ ID NO: 7563441 - DNA, 22 bp, Homo sapiens
ccagaccctgctctggggctct

SEQ ID NO: 7563442 - DNA, 22 bp, Homo sapiens
ccagaccagactgacttgagcc

SEQ ID NO: 7563443 - DNA, 22 bp, Homo sapiens
ccagaacacagtggaagaatat

SEQ ID NO: 7563444 - DNA, 22 bp, Homo sapiens
ccagaacacagtggaagaatat

SEQ ID NO: 7563445 - DNA, 22 bp, Homo sapiens
ccagaacacagtggaagaatat

SEQ ID NO: 7563446 - DNA, 22 bp, Homo sapiens
ccagaaatggccctcaggtgac

SEQ ID NO: 7563447 - DNA, 22 bp, Homo sapiens
ccagaaatggccctcaggtgac

SEQ ID NO: 7563448 - DNA, 22 bp, Homo sapiens
ccagaaatggccctcaggtgac

SEQ ID NO: 7563449 - DNA, 22 bp, Homo sapiens
ccagaaatggccctagtcagag

SEQ ID NO: 7563450 - DNA, 22 bp, Homo sapiens
ccagaacacagtggaagaatat

SEQ ID NO: 7563451 - DNA, 22 bp, Homo sapiens
ccagaacagacctgcctgacct

SEQ ID NO: 7563452 - DNA, 22 bp, Homo sapiens
ccagaaagttcagctgtgaatg

SEQ ID NO: 7563453 - DNA, 22 bp, Homo sapiens
ccagaaagttcagctgtgaatg

SEQ ID NO: 7563454 - DNA, 22 bp, Homo sapiens
ccagaaagttcagctgtgaatg

SEQ ID NO: 7563455 - DNA, 22 bp, Homo sapiens
ccagaaagttcagctgtgaatg

SEQ ID NO: 7563456 - DNA, 22 bp, Homo sapiens
ccagaaaggtaaacactggatt

SEQ ID NO: 7563457 - DNA, 22 bp, Homo sapiens
ccagaaaggtaaacactggatt

SEQ ID NO: 7563458 - DNA, 22 bp, Homo sapiens
ccagaaaggtaaacactggatt

SEQ ID NO: 7563459 - DNA, 22 bp, Homo sapiens
ccagaaaggtaaacactggatt

SEQ ID NO: 7563460 - DNA, 22 bp, Homo sapiens
ccagaaaggtaaacactggatt

SEQ ID NO: 7563461 - DNA, 22 bp, Homo sapiens
ccagaaatcctctctttcttgc

SEQ ID NO: 7563462 - DNA, 22 bp, Homo sapiens
ccagaaatgagtagaggatgct

SEQ ID NO: 7563463 - DNA, 22 bp, Homo sapiens
ccagaaatgagtagaggatgct

SEQ ID NO: 7563464 - DNA, 22 bp, Homo sapiens
ccagaaatgagtagaggatgct

SEQ ID NO: 7563465 - DNA, 22 bp, Homo sapiens
ccagaaatgagtagaggatgct

SEQ ID NO: 7563466 - DNA, 22 bp, Homo sapiens
ccagaaatcctctctttcttgc

SEQ ID NO: 7563467 - DNA, 22 bp, Homo sapiens
ccagaagacaagaatgttctta

SEQ ID NO: 7563468 - DNA, 22 bp, Homo sapiens
ccagaagaccggggagtcaggg

SEQ ID NO: 7563469 - DNA, 22 bp, Homo sapiens
ccagaagaccggggagtcaggg

SEQ ID NO: 7563470 - DNA, 22 bp, Homo sapiens
ccagaagaacttaattcaaaac

SEQ ID NO: 7563471 - DNA, 22 bp, Homo sapiens
ccagaagaacttaattcaaaac

SEQ ID NO: 7563472 - DNA, 22 bp, Homo sapiens
ccagaagaacttaattcaaaac

SEQ ID NO: 7563473 - DNA, 22 bp, Homo sapiens
ccagaagacaagaatgttctta

SEQ ID NO: 7563474 - DNA, 22 bp, Homo sapiens
ccagaagacaagaatgttctta

SEQ ID NO: 7563475 - DNA, 22 bp, Homo sapiens
ccagaacgtttgtgcgaggcag

SEQ ID NO: 7563476 - DNA, 22 bp, Homo sapiens
ccagaactgagaaaataaattt

SEQ ID NO: 7563477 - DNA, 22 bp, Homo sapiens
ccagaaccaaaagcatggagta

SEQ ID NO: 7563478 - DNA, 22 bp, Homo sapiens
ccagaaccaaaagcatggagta

SEQ ID NO: 7563479 - DNA, 22 bp, Homo sapiens
ccagaaccaaaagcatggagta

SEQ ID NO: 7563480 - DNA, 22 bp, Homo sapiens
ccagaacagacctgcctgacct

SEQ ID NO: 7563481 - DNA, 22 bp, Homo sapiens
ccagaactgggcaacagaaagt

SEQ ID NO: 7563482 - DNA, 22 bp, Homo sapiens
ccagaactgggcaacagaaagt

SEQ ID NO: 7563483 - DNA, 22 bp, Homo sapiens
ccagaactgagaaaataaattt

SEQ ID NO: 7563484 - DNA, 22 bp, Homo sapiens
ccagaactgagaaaataaattt

SEQ ID NO: 7563485 - DNA, 22 bp, Homo sapiens
ccagaagaaaaagctggtatta

SEQ ID NO: 7563486 - DNA, 22 bp, Homo sapiens
ccagaagaaaaagctggtatta

SEQ ID NO: 7563487 - DNA, 22 bp, Homo sapiens
ccagaagaaaaagctggtatta

SEQ ID NO: 7563488 - DNA, 22 bp, Homo sapiens
ccagaaaatatggctaaggtga

SEQ ID NO: 7563489 - DNA, 22 bp, Homo sapiens
ccagaaaatatggctaaggtga

SEQ ID NO: 7563490 - DNA, 22 bp, Homo sapiens
ccagaaaatgcagaacatagaa

SEQ ID NO: 7563491 - DNA, 22 bp, Homo sapiens
ccagaaaatgcagaacatagaa

SEQ ID NO: 7563492 - DNA, 22 bp, Homo sapiens
ccagaaaatatggctaaggtga

SEQ ID NO: 7563493 - DNA, 22 bp, Homo sapiens
ccagaaaatatggctaaggtga

SEQ ID NO: 7563494 - DNA, 22 bp, Homo sapiens
ccagaaaatgcagaacatagaa

SEQ ID NO: 7563495 - DNA, 22 bp, Homo sapiens
ccagaaaatgcagaacatagaa

SEQ ID NO: 7563496 - DNA, 22 bp, Homo sapiens
ccagaaacagatgacaagccct

SEQ ID NO: 7563497 - DNA, 22 bp, Homo sapiens
ccagaaaatgcagaacatagaa

SEQ ID NO: 7563498 - DNA, 22 bp, Homo sapiens
ccagaaaatgcagaacatagaa

SEQ ID NO: 7563499 - DNA, 22 bp, Homo sapiens
ccagaaagaatgaactgaaccc

SEQ ID NO: 7563500 - DNA, 22 bp, Homo sapiens
ccagaaagaatgaactgaaccc

SEQ ID NO: 7563501 - DNA, 22 bp, Homo sapiens
ccagaaagaatgaactgaaccc

SEQ ID NO: 7563502 - DNA, 22 bp, Homo sapiens
ccagaaagaatgaactgaaccc

SEQ ID NO: 7563503 - DNA, 22 bp, Homo sapiens
ccagaaagactttttaggtacg

SEQ ID NO: 7563504 - DNA, 22 bp, Homo sapiens
ccagaaagactttttaggtacg

SEQ ID NO: 7563505 - DNA, 22 bp, Homo sapiens
ccagaaagactttttaggtacg

SEQ ID NO: 7563506 - DNA, 22 bp, Homo sapiens
ccagaaagataggaaatcaagt

SEQ ID NO: 7563507 - DNA, 22 bp, Homo sapiens
ccagaaagataggaaatcaagt

SEQ ID NO: 7563508 - DNA, 22 bp, Homo sapiens
ccagaaagactttttaggtacg

SEQ ID NO: 7563509 - DNA, 22 bp, Homo sapiens
ccagaaagataggaaatcaagt

SEQ ID NO: 7563510 - DNA, 22 bp, Homo sapiens
ccagaaagataggaaatcaagt

SEQ ID NO: 7563511 - DNA, 22 bp, Homo sapiens
ccagaaagataggaaatcaagt

SEQ ID NO: 7563512 - DNA, 22 bp, Homo sapiens
ccagaaaatatggctaaggtga

SEQ ID NO: 7563513 - DNA, 22 bp, Homo sapiens
ccactgggggctgctcccaggt

SEQ ID NO: 7563514 - DNA, 22 bp, Homo sapiens
ccagaaaaggagctgcaggatg

SEQ ID NO: 7563515 - DNA, 22 bp, Homo sapiens
ccagaaaaggagctgcaggatg

SEQ ID NO: 7563516 - DNA, 22 bp, Homo sapiens
ccactgggggctgcaggcactc

SEQ ID NO: 7563517 - DNA, 22 bp, Homo sapiens
ccactgggggctgctcccaggt

SEQ ID NO: 7563518 - DNA, 22 bp, Homo sapiens
ccactgggggctgctcccaggt

SEQ ID NO: 7563519 - DNA, 22 bp, Homo sapiens
ccactgggggctgcaggcactc

SEQ ID NO: 7563520 - DNA, 22 bp, Homo sapiens
ccactgggggctgcaggcactc

SEQ ID NO: 7563521 - DNA, 22 bp, Homo sapiens
ccactgggggctgcaggcactc

SEQ ID NO: 7563522 - DNA, 22 bp, Homo sapiens
ccactgggggctgcaggcactc

SEQ ID NO: 7563523 - DNA, 18 bp, Homo sapiens
aggcaggctggagtgact

SEQ ID NO: 7563524 - DNA, 18 bp, Homo sapiens
aggcaggctggagtgact

SEQ ID NO: 7563525 - DNA, 22 bp, Homo sapiens
aggcaggctgctatggagtaga

SEQ ID NO: 7563526 - DNA, 18 bp, Homo sapiens
aggcaggctggagtgact

SEQ ID NO: 7563527 - DNA, 18 bp, Homo sapiens
aggcaggctggagtgact

SEQ ID NO: 7563528 - DNA, 18 bp, Homo sapiens
aggcaggctggagtgact

SEQ ID NO: 7563529 - DNA, 18 bp, Homo sapiens
aggcaggctggagtgact

SEQ ID NO: 7563530 - DNA, 22 bp, Homo sapiens
ccactgggggctgcaggcactc

SEQ ID NO: 7563531 - DNA, 22 bp, Homo sapiens
ccactgggggctgcaggcactc

SEQ ID NO: 7563532 - DNA, 22 bp, Homo sapiens
aggcaggctgctatggagtaga

SEQ ID NO: 7563533 - DNA, 22 bp, Homo sapiens
aggcaggctgctatggagtaga

SEQ ID NO: 7563534 - DNA, 18 bp, Homo sapiens
aggcaggctggagtgact

SEQ ID NO: 7563535 - DNA, 22 bp, Homo sapiens
aggcaggctgctatggagtaga

SEQ ID NO: 7563536 - DNA, 22 bp, Homo sapiens
aggctacagcctcaagagtgca

SEQ ID NO: 7563537 - DNA, 22 bp, Homo sapiens
aggctacagcctcaagagtgca

SEQ ID NO: 7563538 - DNA, 22 bp, Homo sapiens
aggctacagatacagaggctac

SEQ ID NO: 7563539 - DNA, 22 bp, Homo sapiens
aggctacagatacagaggctac

SEQ ID NO: 7563540 - DNA, 22 bp, Homo sapiens
aggctacagatacagaggctac

SEQ ID NO: 7563541 - DNA, 22 bp, Homo sapiens
aggctacaataattcccatgca

SEQ ID NO: 7563542 - DNA, 22 bp, Homo sapiens
aggctacactgttttgatgtct

SEQ ID NO: 7563543 - DNA, 22 bp, Homo sapiens
aggctacactgttttgatgtct

SEQ ID NO: 7563544 - DNA, 22 bp, Homo sapiens
aggctacagatacagaggctac

SEQ ID NO: 7563545 - DNA, 22 bp, Homo sapiens
aggctacatgttggggtggaag

SEQ ID NO: 7563546 - DNA, 22 bp, Homo sapiens
aggctacatgttggggtggaag

SEQ ID NO: 7563547 - DNA, 22 bp, Homo sapiens
aggctacaggagacgccaggag

SEQ ID NO: 7563548 - DNA, 22 bp, Homo sapiens
aggctacttctagagggacaat

SEQ ID NO: 7563549 - DNA, 22 bp, Homo sapiens
aggctacatgttggggtggaag

SEQ ID NO: 7563550 - DNA, 22 bp, Homo sapiens
aggctagactttggcgaagcac

SEQ ID NO: 7563551 - DNA, 22 bp, Homo sapiens
aggctacttctagagggacaat

SEQ ID NO: 7563552 - DNA, 22 bp, Homo sapiens
aggctagactttggcgaagcac

SEQ ID NO: 7563553 - DNA, 22 bp, Homo sapiens
aggctagaggcttctggcttca

SEQ ID NO: 7563554 - DNA, 22 bp, Homo sapiens
aggctagaggcttctggcttca

SEQ ID NO: 7563555 - DNA, 22 bp, Homo sapiens
ccaggctgctgttggtgtccgc

SEQ ID NO: 7563556 - DNA, 22 bp, Homo sapiens
ccaggctgcttagccttatctt

SEQ ID NO: 7563557 - DNA, 22 bp, Homo sapiens
ccaggctgctgttggtgtccgc

SEQ ID NO: 7563558 - DNA, 22 bp, Homo sapiens
ccaggctgcttagccttatctt

SEQ ID NO: 7563559 - DNA, 22 bp, Homo sapiens
ccaggctgctgttggtgtccgc

SEQ ID NO: 7563560 - DNA, 22 bp, Homo sapiens
ccaggctgctgttggtgtccgc

SEQ ID NO: 7563561 - DNA, 22 bp, Homo sapiens
ccaggctgctgttggtgtccgc

SEQ ID NO: 7563562 - DNA, 22 bp, Homo sapiens
ccaggctgctgttggtgtccgc

SEQ ID NO: 7563563 - DNA, 22 bp, Homo sapiens
aggctagaggcttctggcttca

SEQ ID NO: 7563564 - DNA, 22 bp, Homo sapiens
aggctagaggcttctggcttca

SEQ ID NO: 7563565 - DNA, 22 bp, Homo sapiens
aggctagaggcttctggcttca

SEQ ID NO: 7563566 - DNA, 22 bp, Homo sapiens
ccaggctctgcgctggacatgg

SEQ ID NO: 7563567 - DNA, 22 bp, Homo sapiens
aggctaaggtgggaggatcgct

SEQ ID NO: 7563568 - DNA, 22 bp, Homo sapiens
aggctaagggatgactggagtg

SEQ ID NO: 7563569 - DNA, 22 bp, Homo sapiens
aggctaaggagtgtgatgctca

SEQ ID NO: 7563570 - DNA, 22 bp, Homo sapiens
aggctaaggaccaggagggcca

SEQ ID NO: 7563571 - DNA, 22 bp, Homo sapiens
aggctaagatgtggtctgagca

SEQ ID NO: 7563572 - DNA, 22 bp, Homo sapiens
aggctaagttgattaaattgtt

SEQ ID NO: 7563573 - DNA, 22 bp, Homo sapiens
aggctaatatggcacatgaaca

SEQ ID NO: 7563574 - DNA, 22 bp, Homo sapiens
aggctaagtgggtgtcagggcc

SEQ ID NO: 7563575 - DNA, 22 bp, Homo sapiens
aggctacaaataagcatgtaat

SEQ ID NO: 7563576 - DNA, 22 bp, Homo sapiens
aggctacaaataagcatgtaat

SEQ ID NO: 7563577 - DNA, 22 bp, Homo sapiens
aggctaatatggcacatgaaca

SEQ ID NO: 7563578 - DNA, 22 bp, Homo sapiens
aggcgtggttgaggcgagcata

SEQ ID NO: 7563579 - DNA, 22 bp, Homo sapiens
aggcgtggttgaggcgagcata

SEQ ID NO: 7563580 - DNA, 22 bp, Homo sapiens
aggcgtggttgaggcgagcata

SEQ ID NO: 7563581 - DNA, 22 bp, Homo sapiens
aggctaaaagagaatcatttag

SEQ ID NO: 7563582 - DNA, 22 bp, Homo sapiens
aggcgtggttgaggcgagcata

SEQ ID NO: 7563583 - DNA, 22 bp, Homo sapiens
aggcgtggttgaggcgagcata

SEQ ID NO: 7563584 - DNA, 22 bp, Homo sapiens
aggctaagatgtggtctgagca

SEQ ID NO: 7563585 - DNA, 22 bp, Homo sapiens
aggctaagaggccttcagatac

SEQ ID NO: 7563586 - DNA, 19 bp, Homo sapiens
aggctaaagagtcttgcgt

SEQ ID NO: 7563587 - DNA, 19 bp, Homo sapiens
aggctaaagagtcttgcgt

SEQ ID NO: 7563588 - DNA, 19 bp, Homo sapiens
aggctaaagagtcttgcgt

SEQ ID NO: 7563589 - DNA, 22 bp, Homo sapiens
aggctaaaagagaatcatttag

SEQ ID NO: 7563590 - DNA, 19 bp, Homo sapiens
aggctaaagagtcttgcgt

SEQ ID NO: 7563591 - DNA, 22 bp, Homo sapiens
aggctaaaagagaatcatttag

SEQ ID NO: 7563592 - DNA, 22 bp, Homo sapiens
ccaggctggagtgcaatggcat

SEQ ID NO: 7563593 - DNA, 22 bp, Homo sapiens
ccaggctggagtgcaatggcat

SEQ ID NO: 7563594 - DNA, 22 bp, Homo sapiens
ccaggctggagtgcaatggcat

SEQ ID NO: 7563595 - DNA, 22 bp, Homo sapiens
ccaggctggagtgcaatggcat

SEQ ID NO: 7563596 - DNA, 22 bp, Homo sapiens
ccaggctggagtgcaatggcat

SEQ ID NO: 7563597 - DNA, 22 bp, Homo sapiens
ccaggctggagtatagtggcgc

SEQ ID NO: 7563598 - DNA, 22 bp, Homo sapiens
ccaggctggagtgcaatggcat

SEQ ID NO: 7563599 - DNA, 22 bp, Homo sapiens
ccaggctggagtatagtggcgc

SEQ ID NO: 7563600 - DNA, 22 bp, Homo sapiens
ccaggctggagtatagtggcgc

SEQ ID NO: 7563601 - DNA, 22 bp, Homo sapiens
ccaggctggagtatagtggcgc

SEQ ID NO: 7563602 - DNA, 22 bp, Homo sapiens
ccaggctggagtatagtggcgc

SEQ ID NO: 7563603 - DNA, 22 bp, Homo sapiens
ccaggctggagtatagtggcgc

SEQ ID NO: 7563604 - DNA, 22 bp, Homo sapiens
ccaggctggagtatagtggcgc

SEQ ID NO: 7563605 - DNA, 22 bp, Homo sapiens
ccaggctggagtatagtggcgc

SEQ ID NO: 7563606 - DNA, 22 bp, Homo sapiens
ccaggctggagtatagtggcgc

SEQ ID NO: 7563607 - DNA, 22 bp, Homo sapiens
ccaggctggagtatagtggcgc

SEQ ID NO: 7563608 - DNA, 22 bp, Homo sapiens
ccaggctggaatcaatattctg

SEQ ID NO: 7563609 - DNA, 22 bp, Homo sapiens
ccaggctggagtatagtggcgc

SEQ ID NO: 7563610 - DNA, 22 bp, Homo sapiens
ccaggctggagtatagtggcgc

SEQ ID NO: 7563611 - DNA, 22 bp, Homo sapiens
ccaggctggagtatagtggcgc

SEQ ID NO: 7563612 - DNA, 22 bp, Homo sapiens
ccaggctggagtatagtggcgc

SEQ ID NO: 7563613 - DNA, 22 bp, Homo sapiens
ccaggctggaatcaatattctg

SEQ ID NO: 7563614 - DNA, 22 bp, Homo sapiens
ccaggctggaatcaatattctg

SEQ ID NO: 7563615 - DNA, 22 bp, Homo sapiens
ccaggctgctttattactctgt

SEQ ID NO: 7563616 - DNA, 22 bp, Homo sapiens
ccaggctggaatcaatattctg

SEQ ID NO: 7563617 - DNA, 22 bp, Homo sapiens
ccaggctggaatcaatattctg

SEQ ID NO: 7563618 - DNA, 22 bp, Homo sapiens
ccaggctgctttattactctgt

SEQ ID NO: 7563619 - DNA, 22 bp, Homo sapiens
ccaggctgctttattactctgt

SEQ ID NO: 7563620 - DNA, 22 bp, Homo sapiens
ccaggctgctttattactctgt

SEQ ID NO: 7563621 - DNA, 22 bp, Homo sapiens
ccaggctgctttattactctgt

SEQ ID NO: 7563622 - DNA, 22 bp, Homo sapiens
ccaggctgcttagccttatctt

SEQ ID NO: 7563623 - DNA, 22 bp, Homo sapiens
ccaggctgcttagccttatctt

SEQ ID NO: 7563624 - DNA, 22 bp, Homo sapiens
ccaggctgcttagccttatctt

SEQ ID NO: 7563625 - DNA, 22 bp, Homo sapiens
ccaggctgcttagccttatctt

SEQ ID NO: 7563626 - DNA, 22 bp, Homo sapiens
ccaggctgcttagccttatctt

SEQ ID NO: 7563627 - DNA, 22 bp, Homo sapiens
ccaggctgggctacaagttgag

SEQ ID NO: 7563628 - DNA, 22 bp, Homo sapiens
ccaggctgggctacaagttgag

SEQ ID NO: 7563629 - DNA, 22 bp, Homo sapiens
ccaggctgggctacaagttgag

SEQ ID NO: 7563630 - DNA, 22 bp, Homo sapiens
ccaggctgggctacaagttgag

SEQ ID NO: 7563631 - DNA, 22 bp, Homo sapiens
ccaggctgggcggggaacctgg

SEQ ID NO: 7563632 - DNA, 22 bp, Homo sapiens
ccaggctgggcggggaacctgg

SEQ ID NO: 7563633 - DNA, 22 bp, Homo sapiens
ccaggctggagtgcaatggcat

SEQ ID NO: 7563634 - DNA, 21 bp, Homo sapiens
ccaggctgggagggcagttcc

SEQ ID NO: 7563635 - DNA, 21 bp, Homo sapiens
ccaggctgggagggcagttcc

SEQ ID NO: 7563636 - DNA, 22 bp, Homo sapiens
ccaggctgggcggggaacctgg

SEQ ID NO: 7563637 - DNA, 22 bp, Homo sapiens
ccaggctgggcggggaacctgg

SEQ ID NO: 7563638 - DNA, 22 bp, Homo sapiens
ccaggctgggcggggaacctgg

SEQ ID NO: 7563639 - DNA, 22 bp, Homo sapiens
ccaggctgggcggggaacctgg

SEQ ID NO: 7563640 - DNA, 22 bp, Homo sapiens
ccaggctgggcggggaacctgg

SEQ ID NO: 7563641 - DNA, 22 bp, Homo sapiens
ccaggctgggcggggaacctgg

SEQ ID NO: 7563642 - DNA, 22 bp, Homo sapiens
ccaggctggtctgaatttctag

SEQ ID NO: 7563643 - DNA, 22 bp, Homo sapiens
ccaggctggtctgaatttctag

SEQ ID NO: 7563644 - DNA, 15 bp, Homo sapiens
ccaggctgggtgagc

SEQ ID NO: 7563645 - DNA, 22 bp, Homo sapiens
ccaggctggtctgaatttctag

SEQ ID NO: 7563646 - DNA, 22 bp, Homo sapiens
ccaggctggtctgaatttctag

SEQ ID NO: 7563647 - DNA, 22 bp, Homo sapiens
ccaggctggtctgaatttctag

SEQ ID NO: 7563648 - DNA, 15 bp, Homo sapiens
ccaggctgggtgagc

SEQ ID NO: 7563649 - DNA, 15 bp, Homo sapiens
ccaggctgggtgagc

SEQ ID NO: 7563650 - DNA, 15 bp, Homo sapiens
ccaggctgggtgagc

SEQ ID NO: 7563651 - DNA, 22 bp, Homo sapiens
ccaggctgggctacaagttgag

SEQ ID NO: 7563652 - DNA, 22 bp, Homo sapiens
ccaggctgggctacaagttgag

SEQ ID NO: 7563653 - DNA, 22 bp, Homo sapiens
ccaggctgggctacaagttgag

SEQ ID NO: 7563654 - DNA, 22 bp, Homo sapiens
ccaggctgggctacaagttgag

SEQ ID NO: 7563655 - DNA, 22 bp, Homo sapiens
ccaggctgggctacaagttgag

SEQ ID NO: 7563656 - DNA, 22 bp, Homo sapiens
ccagggcctgccacttagcaag

SEQ ID NO: 7563657 - DNA, 22 bp, Homo sapiens
ccagggcctgccacttagcaag

SEQ ID NO: 7563658 - DNA, 22 bp, Homo sapiens
ccagggcctgccacttagcaag

SEQ ID NO: 7563659 - DNA, 22 bp, Homo sapiens
ccagggcctgccacttagcaag

SEQ ID NO: 7563660 - DNA, 22 bp, Homo sapiens
ccagggcctgccacttagcaag

SEQ ID NO: 7563661 - DNA, 22 bp, Homo sapiens
ccagggcctgagggcgacgccc

SEQ ID NO: 7563662 - DNA, 22 bp, Homo sapiens
ccagggcctgagggcgacgccc

SEQ ID NO: 7563663 - DNA, 22 bp, Homo sapiens
ccagggcctgagggcgacgccc

SEQ ID NO: 7563664 - DNA, 22 bp, Homo sapiens
ccagggcctgagggcgacgccc

SEQ ID NO: 7563665 - DNA, 22 bp, Homo sapiens
ccagggcctgccacttagcaag

SEQ ID NO: 7563666 - DNA, 22 bp, Homo sapiens
ccagggcctgccacttagcaag

SEQ ID NO: 7563667 - DNA, 22 bp, Homo sapiens
ccagggcctgccacttagcaag

SEQ ID NO: 7563668 - DNA, 22 bp, Homo sapiens
ccagggcctgccacttagcaag

SEQ ID NO: 7563669 - DNA, 23 bp, Homo sapiens
ccagggctacgggcaccgtcctg

SEQ ID NO: 7563670 - DNA, 23 bp, Homo sapiens
ccagggctacgggcaccgtcctg

SEQ ID NO: 7563671 - DNA, 23 bp, Homo sapiens
ccagggctacgggcaccgtcctg

SEQ ID NO: 7563672 - DNA, 22 bp, Homo sapiens
ccaggctgtaaacaccttcaaa

SEQ ID NO: 7563673 - DNA, 22 bp, Homo sapiens
ccaggctgtaaacaccttcaaa

SEQ ID NO: 7563674 - DNA, 22 bp, Homo sapiens
ccaggctgtaaacaccttcaaa

SEQ ID NO: 7563675 - DNA, 22 bp, Homo sapiens
ccaggctgtaaacaccttcaaa

SEQ ID NO: 7563676 - DNA, 22 bp, Homo sapiens
ccaggctgtaaacaccttcaaa

SEQ ID NO: 7563677 - DNA, 22 bp, Homo sapiens
ccaggctgtaaacaccttcaaa

SEQ ID NO: 7563678 - DNA, 22 bp, Homo sapiens
ccaggctgtaaacaccttcaaa

SEQ ID NO: 7563679 - DNA, 22 bp, Homo sapiens
ccagggcagcgcccctccacgc

SEQ ID NO: 7563680 - DNA, 22 bp, Homo sapiens
ccagggcagcgcccctccacgc

SEQ ID NO: 7563681 - DNA, 22 bp, Homo sapiens
ccagggcagcgcccctccacgc

SEQ ID NO: 7563682 - DNA, 22 bp, Homo sapiens
ccagggcctgagggcgacgccc

SEQ ID NO: 7563683 - DNA, 22 bp, Homo sapiens
ccagggcctcgtgttctgagtg

SEQ ID NO: 7563684 - DNA, 22 bp, Homo sapiens
ccagggcaggagaaagactcac

SEQ ID NO: 7563685 - DNA, 22 bp, Homo sapiens
ccagggcaggagaaagactcac

SEQ ID NO: 7563686 - DNA, 22 bp, Homo sapiens
ccagggcctcgtgttctgagtg

SEQ ID NO: 7563687 - DNA, 22 bp, Homo sapiens
ccagggcctcgtgttctgagtg

SEQ ID NO: 7563688 - DNA, 22 bp, Homo sapiens
ccagggctcaggctcccagtgg

SEQ ID NO: 7563689 - DNA, 22 bp, Homo sapiens
ccagggctcaggctcccagtgg

SEQ ID NO: 7563690 - DNA, 22 bp, Homo sapiens
ccagggctcaggctcccagtgg

SEQ ID NO: 7563691 - DNA, 22 bp, Homo sapiens
ccagggctcaggctcccagtgg

SEQ ID NO: 7563692 - DNA, 22 bp, Homo sapiens
ccagggctcaggctcccagtgg

SEQ ID NO: 7563693 - DNA, 22 bp, Homo sapiens
ccagggctcaggctcccagtgg

SEQ ID NO: 7563694 - DNA, 19 bp, Homo sapiens
ccagggctccaagctgagt

SEQ ID NO: 7563695 - DNA, 19 bp, Homo sapiens
ccagggctccaagctgagt

SEQ ID NO: 7563696 - DNA, 19 bp, Homo sapiens
ccagggctccaagctgagt

SEQ ID NO: 7563697 - DNA, 19 bp, Homo sapiens
ccagggctccaagctgagt

SEQ ID NO: 7563698 - DNA, 19 bp, Homo sapiens
ccagggctccaagctgagt

SEQ ID NO: 7563699 - DNA, 22 bp, Homo sapiens
ccagggctccattgctcatcct

SEQ ID NO: 7563700 - DNA, 22 bp, Homo sapiens
ccagggctccattgctcatcct

SEQ ID NO: 7563701 - DNA, 22 bp, Homo sapiens
ccagggctccattgctcatcct

SEQ ID NO: 7563702 - DNA, 22 bp, Homo sapiens
ccagggctccattgctcatcct

SEQ ID NO: 7563703 - DNA, 22 bp, Homo sapiens
ccagggctccattgctcatcct

SEQ ID NO: 7563704 - DNA, 22 bp, Homo sapiens
ccagggctccattgctcatcct

SEQ ID NO: 7563705 - DNA, 22 bp, Homo sapiens
ccagggctccattgctcatcct

SEQ ID NO: 7563706 - DNA, 23 bp, Homo sapiens
ccagggctacgggcaccgtcctg

SEQ ID NO: 7563707 - DNA, 22 bp, Homo sapiens
ccagggctggaccagtgcttgg

SEQ ID NO: 7563708 - DNA, 20 bp, Homo sapiens
ccagggctggctcctgggat

SEQ ID NO: 7563709 - DNA, 20 bp, Homo sapiens
ccagggctggctcctgggat

SEQ ID NO: 7563710 - DNA, 22 bp, Homo sapiens
ccagggctggaccagtgcttgg

SEQ ID NO: 7563711 - DNA, 22 bp, Homo sapiens
ccagggctggaccagtgcttgg

SEQ ID NO: 7563712 - DNA, 20 bp, Homo sapiens
ccagggctggctcctgggat

SEQ ID NO: 7563713 - DNA, 20 bp, Homo sapiens
ccagggctggctcctgggat

SEQ ID NO: 7563714 - DNA, 20 bp, Homo sapiens
ccagggctggctcctgggat

SEQ ID NO: 7563715 - DNA, 20 bp, Homo sapiens
ccagggctggctcctgggat

SEQ ID NO: 7563716 - DNA, 20 bp, Homo sapiens
ccagggctggctcctgggat

SEQ ID NO: 7563717 - DNA, 20 bp, Homo sapiens
ccagggctggctcctgggat

SEQ ID NO: 7563718 - DNA, 20 bp, Homo sapiens
ccagggctggctcctgggat

SEQ ID NO: 7563719 - DNA, 22 bp, Homo sapiens
aggctgaggcaggtggatcacc

SEQ ID NO: 7563720 - DNA, 22 bp, Homo sapiens
aggctgaggcaggtggatcacc

SEQ ID NO: 7563721 - DNA, 22 bp, Homo sapiens
aggctgaggcaggtggatcacc

SEQ ID NO: 7563722 - DNA, 22 bp, Homo sapiens
aggctgaggcaggtggatcacc

SEQ ID NO: 7563723 - DNA, 22 bp, Homo sapiens
aggctgaggcaggtggatcacc

SEQ ID NO: 7563724 - DNA, 22 bp, Homo sapiens
aggctgaggcaggtggatcacc

SEQ ID NO: 7563725 - DNA, 22 bp, Homo sapiens
aggctgaggcaggtggatcacc

SEQ ID NO: 7563726 - DNA, 22 bp, Homo sapiens
aggctgaggcaggtggatcacc

SEQ ID NO: 7563727 - DNA, 22 bp, Homo sapiens
aggctgaggcaggtggatcacc

SEQ ID NO: 7563728 - DNA, 22 bp, Homo sapiens
ccaggtctggaaccaccagggc

SEQ ID NO: 7563729 - DNA, 22 bp, Homo sapiens
ccaggtctgcgggcggcaggca

SEQ ID NO: 7563730 - DNA, 22 bp, Homo sapiens
ccaggtctggaaccaccagggc

SEQ ID NO: 7563731 - DNA, 22 bp, Homo sapiens
aggctgaggcaagaggatcact

SEQ ID NO: 7563732 - DNA, 22 bp, Homo sapiens
aggctgaggcaagaggatcact

SEQ ID NO: 7563733 - DNA, 22 bp, Homo sapiens
aggctgaggcaagaggatcact

SEQ ID NO: 7563734 - DNA, 22 bp, Homo sapiens
aggctgaggcaagaggatcact

SEQ ID NO: 7563735 - DNA, 22 bp, Homo sapiens
aggctgaggcaagaggatcact

SEQ ID NO: 7563736 - DNA, 22 bp, Homo sapiens
aggctgaggcaagaggatcact

SEQ ID NO: 7563737 - DNA, 22 bp, Homo sapiens
aggctgaggcaagaggatcact

SEQ ID NO: 7563738 - DNA, 22 bp, Homo sapiens
aggctgaggatcgtactttcca

SEQ ID NO: 7563739 - DNA, 22 bp, Homo sapiens
aggctgaggcaagaggatcact

SEQ ID NO: 7563740 - DNA, 22 bp, Homo sapiens
aggctgaggatcgtactttcca

SEQ ID NO: 7563741 - DNA, 22 bp, Homo sapiens
aggctgaggatcgtactttcca

SEQ ID NO: 7563742 - DNA, 22 bp, Homo sapiens
aggctgaggcaagaggatcact

SEQ ID NO: 7563743 - DNA, 22 bp, Homo sapiens
aggctgaggcaagaggatcact

SEQ ID NO: 7563744 - DNA, 22 bp, Homo sapiens
aggctgaggcaggtggatcacc

SEQ ID NO: 7563745 - DNA, 22 bp, Homo sapiens
aggctgaggcaagaggatcact

SEQ ID NO: 7563746 - DNA, 22 bp, Homo sapiens
aggctgaggcaagaggatcact

SEQ ID NO: 7563747 - DNA, 22 bp, Homo sapiens
aggctgaggcaagaggatcact

SEQ ID NO: 7563748 - DNA, 22 bp, Homo sapiens
aggctgaggcaagaggatcact

SEQ ID NO: 7563749 - DNA, 22 bp, Homo sapiens
aggctgagctgacctggtttgg

SEQ ID NO: 7563750 - DNA, 22 bp, Homo sapiens
ccagggctggtgggagatgctg

SEQ ID NO: 7563751 - DNA, 22 bp, Homo sapiens
aggctgagctgacctggtttgg

SEQ ID NO: 7563752 - DNA, 22 bp, Homo sapiens
aggctgagctgacctggtttgg

SEQ ID NO: 7563753 - DNA, 22 bp, Homo sapiens
ccagggctggtgggagatgctg

SEQ ID NO: 7563754 - DNA, 22 bp, Homo sapiens
ccagggctggtgggagatgctg

SEQ ID NO: 7563755 - DNA, 22 bp, Homo sapiens
ccagggctggtgggagatgctg

SEQ ID NO: 7563756 - DNA, 22 bp, Homo sapiens
ccagggctggtgggagatgctg

SEQ ID NO: 7563757 - DNA, 22 bp, Homo sapiens
ccagggctggtgggagatgctg

SEQ ID NO: 7563758 - DNA, 22 bp, Homo sapiens
aggctgaggatccctgtgttct

SEQ ID NO: 7563759 - DNA, 22 bp, Homo sapiens
aggctgaggatcgtactttcca

SEQ ID NO: 7563760 - DNA, 22 bp, Homo sapiens
aggctgaggatcgtactttcca

SEQ ID NO: 7563761 - DNA, 22 bp, Homo sapiens
aggctgaggatcgtactttcca

SEQ ID NO: 7563762 - DNA, 22 bp, Homo sapiens
aggctgagctgacctggtttgg

SEQ ID NO: 7563763 - DNA, 22 bp, Homo sapiens
aggctgaggatccctgtgttct

SEQ ID NO: 7563764 - DNA, 22 bp, Homo sapiens
aggctgaggatccctgtgttct

SEQ ID NO: 7563765 - DNA, 22 bp, Homo sapiens
ccagggctggtgggagatgctg

SEQ ID NO: 7563766 - DNA, 22 bp, Homo sapiens
ccagggctggtgggagatgctg

SEQ ID NO: 7563767 - DNA, 22 bp, Homo sapiens
ccagggctggtgggagatgctg

SEQ ID NO: 7563768 - DNA, 22 bp, Homo sapiens
ccagggctggtggctgcagagg

SEQ ID NO: 7563769 - DNA, 22 bp, Homo sapiens
ccagggctggtggctgcagagg

SEQ ID NO: 7563770 - DNA, 22 bp, Homo sapiens
ccagggctggtggctgcagagg

SEQ ID NO: 7563771 - DNA, 22 bp, Homo sapiens
ccagggctggtggctgcagagg

SEQ ID NO: 7563772 - DNA, 22 bp, Homo sapiens
ccagggctgggtttgtcggtgt

SEQ ID NO: 7563773 - DNA, 22 bp, Homo sapiens
ccagggctgggtttgtcggtgt

SEQ ID NO: 7563774 - DNA, 22 bp, Homo sapiens
ccagggctgggtttgtcggtgt

SEQ ID NO: 7563775 - DNA, 22 bp, Homo sapiens
ccagggctggtggctgcagagg

SEQ ID NO: 7563776 - DNA, 22 bp, Homo sapiens
ccagggctggtggctgcagagg

SEQ ID NO: 7563777 - DNA, 22 bp, Homo sapiens
ccagggctggtggctgcagagg

SEQ ID NO: 7563778 - DNA, 22 bp, Homo sapiens
aggctgctttttatttacaggt

SEQ ID NO: 7563779 - DNA, 22 bp, Homo sapiens
aggctggaaagggaccagagtg

SEQ ID NO: 7563780 - DNA, 22 bp, Homo sapiens
aggctgctttcatggccgcccc

SEQ ID NO: 7563781 - DNA, 22 bp, Homo sapiens
aggctggaaagggaccagagtg

SEQ ID NO: 7563782 - DNA, 22 bp, Homo sapiens
aggctggaaagggaccagagtg

SEQ ID NO: 7563783 - DNA, 22 bp, Homo sapiens
aggctggaaagggaccagagtg

SEQ ID NO: 7563784 - DNA, 22 bp, Homo sapiens
aggctggaaatcactagattcc

SEQ ID NO: 7563785 - DNA, 22 bp, Homo sapiens
aggctggaaatcactagattcc

SEQ ID NO: 7563786 - DNA, 22 bp, Homo sapiens
aggctggaaagggaccagagtg

SEQ ID NO: 7563787 - DNA, 22 bp, Homo sapiens
aggctggaaagggaccagagtg

SEQ ID NO: 7563788 - DNA, 22 bp, Homo sapiens
aggctggaaagggaccagagtg

SEQ ID NO: 7563789 - DNA, 22 bp, Homo sapiens
aggctggaaagggaccagagtg

SEQ ID NO: 7563790 - DNA, 19 bp, Homo sapiens
aggctggagacaccaggcc

SEQ ID NO: 7563791 - DNA, 19 bp, Homo sapiens
aggctggagacaccaggcc

SEQ ID NO: 7563792 - DNA, 19 bp, Homo sapiens
aggctggagacaccaggcc

SEQ ID NO: 7563793 - DNA, 19 bp, Homo sapiens
aggctggagacaccaggcc

SEQ ID NO: 7563794 - DNA, 19 bp, Homo sapiens
aggctggagacaccaggcc

SEQ ID NO: 7563795 - DNA, 22 bp, Homo sapiens
aggctggaaatcactagattcc

SEQ ID NO: 7563796 - DNA, 22 bp, Homo sapiens
aggctggacccgacacctgccc

SEQ ID NO: 7563797 - DNA, 22 bp, Homo sapiens
aggctggacccgacacctgccc

SEQ ID NO: 7563798 - DNA, 22 bp, Homo sapiens
aggctggacccgacacctgccc

SEQ ID NO: 7563799 - DNA, 22 bp, Homo sapiens
aggctggacccgacacctgccc

SEQ ID NO: 7563800 - DNA, 19 bp, Homo sapiens
aggctggagacaccaggcc

SEQ ID NO: 7563801 - DNA, 22 bp, Homo sapiens
aggctgcttcttgtccttggca

SEQ ID NO: 7563802 - DNA, 22 bp, Homo sapiens
aggctgcttcttgtccttggca

SEQ ID NO: 7563803 - DNA, 22 bp, Homo sapiens
aggctgcttcttgtccttggca

SEQ ID NO: 7563804 - DNA, 22 bp, Homo sapiens
aggctgcttcttgtccttggca

SEQ ID NO: 7563805 - DNA, 22 bp, Homo sapiens
aggctgctttcatggccgcccc

SEQ ID NO: 7563806 - DNA, 22 bp, Homo sapiens
aggctgctttcatggccgcccc

SEQ ID NO: 7563807 - DNA, 22 bp, Homo sapiens
aggctgctttttatttacaggt

SEQ ID NO: 7563808 - DNA, 22 bp, Homo sapiens
aggctgctttattcacaatagc

SEQ ID NO: 7563809 - DNA, 22 bp, Homo sapiens
aggctgctttattcacaatagc

SEQ ID NO: 7563810 - DNA, 22 bp, Homo sapiens
aggctgctctgcgaagtcagct

SEQ ID NO: 7563811 - DNA, 22 bp, Homo sapiens
aggctgctctgcgaagtcagct

SEQ ID NO: 7563812 - DNA, 22 bp, Homo sapiens
aggctgctcagtagatggagct

SEQ ID NO: 7563813 - DNA, 22 bp, Homo sapiens
aggctgcttcagctgcagggag

SEQ ID NO: 7563814 - DNA, 22 bp, Homo sapiens
aggctgcttcagctgcagggag

SEQ ID NO: 7563815 - DNA, 22 bp, Homo sapiens
aggctgcttccttacgtggctg

SEQ ID NO: 7563816 - DNA, 22 bp, Homo sapiens
aggctgcttccttacgtggctg

SEQ ID NO: 7563817 - DNA, 22 bp, Homo sapiens
ccaggtgaggtaggtatggtag

SEQ ID NO: 7563818 - DNA, 22 bp, Homo sapiens
ccaggtgcaaactcccagcagg

SEQ ID NO: 7563819 - DNA, 22 bp, Homo sapiens
ccaggtgcaaactcccagcagg

SEQ ID NO: 7563820 - DNA, 22 bp, Homo sapiens
aggctgctcagtagatggagct

SEQ ID NO: 7563821 - DNA, 22 bp, Homo sapiens
aggctgctcagtagatggagct

SEQ ID NO: 7563822 - DNA, 22 bp, Homo sapiens
ccaggtgcaaactcccagcagg

SEQ ID NO: 7563823 - DNA, 22 bp, Homo sapiens
ccaggtgactgtcagaggtttt

SEQ ID NO: 7563824 - DNA, 22 bp, Homo sapiens
ccaggtgaaatcttcatggttc

SEQ ID NO: 7563825 - DNA, 22 bp, Homo sapiens
ccaggtctttggccttggcact

SEQ ID NO: 7563826 - DNA, 22 bp, Homo sapiens
ccaggtctttggccttggcact

SEQ ID NO: 7563827 - DNA, 22 bp, Homo sapiens
ccaggtctttgactaatatgct

SEQ ID NO: 7563828 - DNA, 22 bp, Homo sapiens
ccaggtcttgtttgacatcaat

SEQ ID NO: 7563829 - DNA, 21 bp, Homo sapiens
ccaggtcttggtccttggact

SEQ ID NO: 7563830 - DNA, 21 bp, Homo sapiens
ccaggtcttggtccttggact

SEQ ID NO: 7563831 - DNA, 22 bp, Homo sapiens
ccaggtcttggcccccggacct

SEQ ID NO: 7563832 - DNA, 22 bp, Homo sapiens
ccaggtcttcactttactgaag

SEQ ID NO: 7563833 - DNA, 22 bp, Homo sapiens
ccaggtcttcactttactgaag

SEQ ID NO: 7563834 - DNA, 19 bp, Homo sapiens
ccaggtctggggccagatt

SEQ ID NO: 7563835 - DNA, 22 bp, Homo sapiens
ccaggtctgtcttcttagctca

SEQ ID NO: 7563836 - DNA, 22 bp, Homo sapiens
ccaggtctgtcttcttagctca

SEQ ID NO: 7563837 - DNA, 22 bp, Homo sapiens
ccaggtctggcactggccagtc

SEQ ID NO: 7563838 - DNA, 22 bp, Homo sapiens
ccaggtctggaaccaccagggc

SEQ ID NO: 7563839 - DNA, 22 bp, Homo sapiens
ccaggtctggcactggccagtc

SEQ ID NO: 7563840 - DNA, 22 bp, Homo sapiens
ccaggtctggcactggccagtc

SEQ ID NO: 7563841 - DNA, 19 bp, Homo sapiens
ccaggtctggggccagatt

SEQ ID NO: 7563842 - DNA, 22 bp, Homo sapiens
aggctggagtgcagttgcatga

SEQ ID NO: 7563843 - DNA, 22 bp, Homo sapiens
aggctggagtgctggagtgctg

SEQ ID NO: 7563844 - DNA, 22 bp, Homo sapiens
aggctggagtgctggagtgctg

SEQ ID NO: 7563845 - DNA, 22 bp, Homo sapiens
aggctggagtgctggagtgctg

SEQ ID NO: 7563846 - DNA, 22 bp, Homo sapiens
aggctggagtgtagcagtgcag

SEQ ID NO: 7563847 - DNA, 22 bp, Homo sapiens
aggctggagtgctggagtgctg

SEQ ID NO: 7563848 - DNA, 22 bp, Homo sapiens
aggctggagtgctggagtgctg

SEQ ID NO: 7563849 - DNA, 22 bp, Homo sapiens
aggctggagtgcaatggcgtga

SEQ ID NO: 7563850 - DNA, 22 bp, Homo sapiens
aggctggagtacagtggctatt

SEQ ID NO: 7563851 - DNA, 22 bp, Homo sapiens
aggctggagtacagtggctatt

SEQ ID NO: 7563852 - DNA, 22 bp, Homo sapiens
aggctggagtacagtggctatt

SEQ ID NO: 7563853 - DNA, 22 bp, Homo sapiens
aggctggagtgcagtggtgtga

SEQ ID NO: 7563854 - DNA, 22 bp, Homo sapiens
aggctggagtgcaatggcgtga

SEQ ID NO: 7563855 - DNA, 22 bp, Homo sapiens
aggctggagtgcaatggcgtga

SEQ ID NO: 7563856 - DNA, 22 bp, Homo sapiens
aggctggagtgcagtggcgtga

SEQ ID NO: 7563857 - DNA, 22 bp, Homo sapiens
aggctggccagtgctgcagtgg

SEQ ID NO: 7563858 - DNA, 22 bp, Homo sapiens
aggctggccagtgctgcagtgg

SEQ ID NO: 7563859 - DNA, 22 bp, Homo sapiens
aggctggcccacctcttgtctt

SEQ ID NO: 7563860 - DNA, 22 bp, Homo sapiens
aggctggcccacctcttgtctt

SEQ ID NO: 7563861 - DNA, 22 bp, Homo sapiens
aggctggcccacctcttgtctt

SEQ ID NO: 7563862 - DNA, 22 bp, Homo sapiens
aggctggcccacctcttgtctt

SEQ ID NO: 7563863 - DNA, 22 bp, Homo sapiens
aggctggcccacctcttgtctt

SEQ ID NO: 7563864 - DNA, 22 bp, Homo sapiens
aggctggagtgtagcagtgcag

SEQ ID NO: 7563865 - DNA, 22 bp, Homo sapiens
aggctggagtgtagcagtgcag

SEQ ID NO: 7563866 - DNA, 22 bp, Homo sapiens
aggctggagtgtagcagtgcag

SEQ ID NO: 7563867 - DNA, 22 bp, Homo sapiens
aggctggagtgtagcagtgcag

SEQ ID NO: 7563868 - DNA, 22 bp, Homo sapiens
aggctggagtgtgcagtggcgc

SEQ ID NO: 7563869 - DNA, 22 bp, Homo sapiens
aggctggagtgtagcagtgcag

SEQ ID NO: 7563870 - DNA, 22 bp, Homo sapiens
aggctggagtgtagcagtgcag

SEQ ID NO: 7563871 - DNA, 22 bp, Homo sapiens
aggctggagtgtagcagtgcag

SEQ ID NO: 7563872 - DNA, 22 bp, Homo sapiens
aggctggagtacagtggctatt

SEQ ID NO: 7563873 - DNA, 22 bp, Homo sapiens
aggctggagtacagtggctatt

SEQ ID NO: 7563874 - DNA, 22 bp, Homo sapiens
aggctggagtacagtggctatt

SEQ ID NO: 7563875 - DNA, 22 bp, Homo sapiens
aggctggagtacagtggctatt

SEQ ID NO: 7563876 - DNA, 22 bp, Homo sapiens
aggctggagggcaatggcaaga

SEQ ID NO: 7563877 - DNA, 22 bp, Homo sapiens
aggctggagggcaatggcaaga

SEQ ID NO: 7563878 - DNA, 22 bp, Homo sapiens
aggctggaggtttgttgcggct

SEQ ID NO: 7563879 - DNA, 22 bp, Homo sapiens
aggctggaggtttgttgcggct

SEQ ID NO: 7563880 - DNA, 22 bp, Homo sapiens
aggctggagcaagggggcatat

SEQ ID NO: 7563881 - DNA, 22 bp, Homo sapiens
aggctggagcaagggggcatat

SEQ ID NO: 7563882 - DNA, 22 bp, Homo sapiens
aggctggagcaagggggcatat

SEQ ID NO: 7563883 - DNA, 22 bp, Homo sapiens
aggctggagagtgcagtggcgt

SEQ ID NO: 7563884 - DNA, 22 bp, Homo sapiens
aggctggagagtgcagtggcgt

SEQ ID NO: 7563885 - DNA, 22 bp, Homo sapiens
aggctggagagtgcagtggcgt

SEQ ID NO: 7563886 - DNA, 22 bp, Homo sapiens
aggctggagcaagggggcatat

SEQ ID NO: 7563887 - DNA, 22 bp, Homo sapiens
aggctggagcaagggggcatat

SEQ ID NO: 7563888 - DNA, 22 bp, Homo sapiens
aggctggagcaagggggcatat

SEQ ID NO: 7563889 - DNA, 22 bp, Homo sapiens
aggctggagcaagggggcatat

SEQ ID NO: 7563890 - DNA, 19 bp, Homo sapiens
aggctggagacaccaggcc

SEQ ID NO: 7563891 - DNA, 19 bp, Homo sapiens
aggctggagacaccaggcc

SEQ ID NO: 7563892 - DNA, 22 bp, Homo sapiens
aggctggagacccgccaagaaa

SEQ ID NO: 7563893 - DNA, 22 bp, Homo sapiens
aggctggagacccgccaagaaa

SEQ ID NO: 7563894 - DNA, 22 bp, Homo sapiens
aggctggagacccgccaagaaa

SEQ ID NO: 7563895 - DNA, 22 bp, Homo sapiens
aggctggagacccgccaagaaa

SEQ ID NO: 7563896 - DNA, 22 bp, Homo sapiens
aggctggagacccgccaagaaa

SEQ ID NO: 7563897 - DNA, 22 bp, Homo sapiens
aggctggagacccgccaagaaa

SEQ ID NO: 7563898 - DNA, 22 bp, Homo sapiens
aggctggagacccgccaagaaa

SEQ ID NO: 7563899 - DNA, 22 bp, Homo sapiens
aggctggagagtgcagtggcgt

SEQ ID NO: 7563900 - DNA, 22 bp, Homo sapiens
aggctggagagtgcagtggcgt

SEQ ID NO: 7563901 - DNA, 22 bp, Homo sapiens
aggctggagagtgcagtggcgt

SEQ ID NO: 7563902 - DNA, 22 bp, Homo sapiens
aggctggagagtgcagtggcgt

SEQ ID NO: 7563903 - DNA, 22 bp, Homo sapiens
aggctggagagtgcagtggcgt

SEQ ID NO: 7563904 - DNA, 22 bp, Homo sapiens
aggctggagagtgcagtggcgt

SEQ ID NO: 7563905 - DNA, 22 bp, Homo sapiens
aggctggagagtgcagtggcgt

SEQ ID NO: 7563906 - DNA, 22 bp, Homo sapiens
aggctggagagtgcagtggcgt

SEQ ID NO: 7563907 - DNA, 22 bp, Homo sapiens
aggctggagagtgcagtggcgt

SEQ ID NO: 7563908 - DNA, 22 bp, Homo sapiens
ccatttatagatgtatttggct

SEQ ID NO: 7563909 - DNA, 22 bp, Homo sapiens
ccatttaacacagagttttcca

SEQ ID NO: 7563910 - DNA, 22 bp, Homo sapiens
ccatttacattgtactctgtga

SEQ ID NO: 7563911 - DNA, 22 bp, Homo sapiens
ccatttagtaaggaagaacagc

SEQ ID NO: 7563912 - DNA, 22 bp, Homo sapiens
ccatttacattgtactctgtga

SEQ ID NO: 7563913 - DNA, 22 bp, Homo sapiens
ccatttactagggagatctaga

SEQ ID NO: 7563914 - DNA, 22 bp, Homo sapiens
aggctggcggtgactgctctga

SEQ ID NO: 7563915 - DNA, 22 bp, Homo sapiens
aggctggcgtcaggggctgtac

SEQ ID NO: 7563916 - DNA, 22 bp, Homo sapiens
aggctggcgtcaggggctgtac

SEQ ID NO: 7563917 - DNA, 22 bp, Homo sapiens
aggctggcgtcaggggctgtac

SEQ ID NO: 7563918 - DNA, 22 bp, Homo sapiens
ccatttggtatagtgaaaagga

SEQ ID NO: 7563919 - DNA, 22 bp, Homo sapiens
ccatttgggaatcttccatgga

SEQ ID NO: 7563920 - DNA, 22 bp, Homo sapiens
ccatttggtatagtgaaaagga

SEQ ID NO: 7563921 - DNA, 22 bp, Homo sapiens
ccatttggtatagtgaaaagga

SEQ ID NO: 7563922 - DNA, 22 bp, Homo sapiens
ccatttggcaagaaagagtcat

SEQ ID NO: 7563923 - DNA, 22 bp, Homo sapiens
ccatttggcaagaaagagtcat

SEQ ID NO: 7563924 - DNA, 22 bp, Homo sapiens
ccatttggctcttaaactgagc

SEQ ID NO: 7563925 - DNA, 22 bp, Homo sapiens
ccatttggctcttaaactgagc

SEQ ID NO: 7563926 - DNA, 22 bp, Homo sapiens
ccatttggcaagaaagagtcat

SEQ ID NO: 7563927 - DNA, 22 bp, Homo sapiens
ccatttggcaaacattttacag

SEQ ID NO: 7563928 - DNA, 22 bp, Homo sapiens
ccatttggcaaacattttacag

SEQ ID NO: 7563929 - DNA, 22 bp, Homo sapiens
ccatttggaggtcattaggaca

SEQ ID NO: 7563930 - DNA, 22 bp, Homo sapiens
ccatttggatacttttggttac

SEQ ID NO: 7563931 - DNA, 22 bp, Homo sapiens
ccatttgcccaaggattgtctt

SEQ ID NO: 7563932 - DNA, 18 bp, Homo sapiens
ccatttggatagtgaagc

SEQ ID NO: 7563933 - DNA, 22 bp, Homo sapiens
ccatttgaaatgaatgttttta

SEQ ID NO: 7563934 - DNA, 22 bp, Homo sapiens
ccatttggaggtcattaggaca

SEQ ID NO: 7563935 - DNA, 22 bp, Homo sapiens
ccatttcattgcctgtaaagtg

SEQ ID NO: 7563936 - DNA, 22 bp, Homo sapiens
ccatttaacacagagttttcca

SEQ ID NO: 7563937 - DNA, 18 bp, Homo sapiens
ccatttcatgattattac

SEQ ID NO: 7563938 - DNA, 22 bp, Homo sapiens
aggctggcgacatctggcgggc

SEQ ID NO: 7563939 - DNA, 22 bp, Homo sapiens
aggctggcgacatctggcgggc

SEQ ID NO: 7563940 - DNA, 22 bp, Homo sapiens
aggctggcgacatctggcgggc

SEQ ID NO: 7563941 - DNA, 22 bp, Homo sapiens
aggctggcgacatctggcgggc

SEQ ID NO: 7563942 - DNA, 17 bp, Homo sapiens
aggctggccttcacagt

SEQ ID NO: 7563943 - DNA, 22 bp, Homo sapiens
aggctggcgacatctggcgggc

SEQ ID NO: 7563944 - DNA, 22 bp, Homo sapiens
aggctggcgacatctggcgggc

SEQ ID NO: 7563945 - DNA, 22 bp, Homo sapiens
aggctggcgacatctggcgggc

SEQ ID NO: 7563946 - DNA, 22 bp, Homo sapiens
aggctggcgacatctggcgggc

SEQ ID NO: 7563947 - DNA, 22 bp, Homo sapiens
aggctggcgacatctggcgggc

SEQ ID NO: 7563948 - DNA, 22 bp, Homo sapiens
aggctggcggtgactgctctga

SEQ ID NO: 7563949 - DNA, 22 bp, Homo sapiens
aggctggcggtgactgctctga

SEQ ID NO: 7563950 - DNA, 22 bp, Homo sapiens
aggctggcggtgactgctctga

SEQ ID NO: 7563951 - DNA, 22 bp, Homo sapiens
aggctggcggtgactgctctga

SEQ ID NO: 7563952 - DNA, 22 bp, Homo sapiens
aggctggcgacatctggcgggc

SEQ ID NO: 7563953 - DNA, 22 bp, Homo sapiens
aggctggcgacatctggcgggc

SEQ ID NO: 7563954 - DNA, 22 bp, Homo sapiens
aggctggccctactggctgcct

SEQ ID NO: 7563955 - DNA, 22 bp, Homo sapiens
aggctggccctactggctgcct

SEQ ID NO: 7563956 - DNA, 22 bp, Homo sapiens
aggctggcctatttctttatcg

SEQ ID NO: 7563957 - DNA, 17 bp, Homo sapiens
aggctggccttcacagt

SEQ ID NO: 7563958 - DNA, 17 bp, Homo sapiens
aggctggccttcacagt

SEQ ID NO: 7563959 - DNA, 17 bp, Homo sapiens
aggctggccttcacagt

SEQ ID NO: 7563960 - DNA, 17 bp, Homo sapiens
aggctggccttcacagt

SEQ ID NO: 7563961 - DNA, 17 bp, Homo sapiens
aggctggccttcacagt

SEQ ID NO: 7563962 - DNA, 22 bp, Homo sapiens
aggctggccctactggctgcct

SEQ ID NO: 7563963 - DNA, 22 bp, Homo sapiens
aggctggccctactggctgcct

SEQ ID NO: 7563964 - DNA, 22 bp, Homo sapiens
aggctggccctactggctgcct

SEQ ID NO: 7563965 - DNA, 22 bp, Homo sapiens
aggctggccctactggctgcct

SEQ ID NO: 7563966 - DNA, 22 bp, Homo sapiens
aggctggccctactggctgcct

SEQ ID NO: 7563967 - DNA, 22 bp, Homo sapiens
aggctggccctactggctgcct

SEQ ID NO: 7563968 - DNA, 22 bp, Homo sapiens
aggctggccctactggctgcct

SEQ ID NO: 7563969 - DNA, 22 bp, Homo sapiens
aggctggccctactggctgcct

SEQ ID NO: 7563970 - DNA, 22 bp, Homo sapiens
aggctggccctactggctgcct

SEQ ID NO: 7563971 - DNA, 22 bp, Homo sapiens
aggctgggctccgcccaactcc

SEQ ID NO: 7563972 - DNA, 22 bp, Homo sapiens
aggctgggctccgcccaactcc

SEQ ID NO: 7563973 - DNA, 22 bp, Homo sapiens
aggctgggctccgcccaactcc

SEQ ID NO: 7563974 - DNA, 22 bp, Homo sapiens
aggctggggaattgaatttgct

SEQ ID NO: 7563975 - DNA, 22 bp, Homo sapiens
aggctggggaattgaatttgct

SEQ ID NO: 7563976 - DNA, 22 bp, Homo sapiens
aggctggggaattgaatttgct

SEQ ID NO: 7563977 - DNA, 22 bp, Homo sapiens
aggctggggaattgaatttgct

SEQ ID NO: 7563978 - DNA, 22 bp, Homo sapiens
aggctgggctccgcccaactcc

SEQ ID NO: 7563979 - DNA, 22 bp, Homo sapiens
aggctgggctccgcccaactcc

SEQ ID NO: 7563980 - DNA, 22 bp, Homo sapiens
aggctgggctccgcccaactcc

SEQ ID NO: 7563981 - DNA, 22 bp, Homo sapiens
aggctgggctccgcccaactcc

SEQ ID NO: 7563982 - DNA, 22 bp, Homo sapiens
aggctgggcaccgttttgatcc

SEQ ID NO: 7563983 - DNA, 22 bp, Homo sapiens
aggctgggcaccgttttgatcc

SEQ ID NO: 7563984 - DNA, 22 bp, Homo sapiens
aggctgggcaccgttttgatcc

SEQ ID NO: 7563985 - DNA, 22 bp, Homo sapiens
aggctgggcaccgttttgatcc

SEQ ID NO: 7563986 - DNA, 22 bp, Homo sapiens
aggctgggaaggtaaagttgta

SEQ ID NO: 7563987 - DNA, 22 bp, Homo sapiens
aggctgggaaggtaaagttgta

SEQ ID NO: 7563988 - DNA, 22 bp, Homo sapiens
aggctgggtacctgtcatatgc

SEQ ID NO: 7563989 - DNA, 22 bp, Homo sapiens
aggctgggtacctgtcatatgc

SEQ ID NO: 7563990 - DNA, 22 bp, Homo sapiens
aggctgggtacctgtcatatgc

SEQ ID NO: 7563991 - DNA, 20 bp, Homo sapiens
aggctggggtgttttgccca

SEQ ID NO: 7563992 - DNA, 22 bp, Homo sapiens
aggctgggtacctgtcatatgc

SEQ ID NO: 7563993 - DNA, 20 bp, Homo sapiens
aggctggggtgttttgccca

SEQ ID NO: 7563994 - DNA, 20 bp, Homo sapiens
aggctggggtgttttgccca

SEQ ID NO: 7563995 - DNA, 20 bp, Homo sapiens
aggctggggtgttttgccca

SEQ ID NO: 7563996 - DNA, 22 bp, Homo sapiens
aggctggggaattgaatttgct

SEQ ID NO: 7563997 - DNA, 22 bp, Homo sapiens
aggctggggaattgaatttgct

SEQ ID NO: 7563998 - DNA, 20 bp, Homo sapiens
aggctggggtgttttgccca

SEQ ID NO: 7563999 - DNA, 20 bp, Homo sapiens
aggctggggtgttttgccca

SEQ ID NO: 7564000 - DNA, 22 bp, Homo sapiens
aggctggggaattgaatttgct

SEQ ID NO: 7564001 - DNA, 22 bp, Homo sapiens
aggctggggaattgaatttgct

SEQ ID NO: 7564002 - DNA, 22 bp, Homo sapiens
ccatttgtaaccttagagcaat

SEQ ID NO: 7564003 - DNA, 22 bp, Homo sapiens
ccatttgtaccatttctttgta

SEQ ID NO: 7564004 - DNA, 22 bp, Homo sapiens
ccatttgtaccatttctttgta

SEQ ID NO: 7564005 - DNA, 22 bp, Homo sapiens
ccatttggttatgtatcgaaac

SEQ ID NO: 7564006 - DNA, 22 bp, Homo sapiens
ccatttgtaaccttagagcaat

SEQ ID NO: 7564007 - DNA, 22 bp, Homo sapiens
ccatttgtattactgccccagg

SEQ ID NO: 7564008 - DNA, 22 bp, Homo sapiens
ccatttgtcacctctgcactcc

SEQ ID NO: 7564009 - DNA, 22 bp, Homo sapiens
ccatttgtgatgtggcagcatc

SEQ ID NO: 7564010 - DNA, 22 bp, Homo sapiens
ccatttgtgatgtggcagcatc

SEQ ID NO: 7564011 - DNA, 22 bp, Homo sapiens
ccatttgtgcttcttcaaagca

SEQ ID NO: 7564012 - DNA, 22 bp, Homo sapiens
ccatttgtgatgtggcagcatc

SEQ ID NO: 7564013 - DNA, 22 bp, Homo sapiens
ccatttgtcacctctgcactcc

SEQ ID NO: 7564014 - DNA, 22 bp, Homo sapiens
ccatttgtgatgtggcagcatc

SEQ ID NO: 7564015 - DNA, 22 bp, Homo sapiens
ccatttgtggtttatttgctct

SEQ ID NO: 7564016 - DNA, 22 bp, Homo sapiens
ccatttgtggtttatttgctct

SEQ ID NO: 7564017 - DNA, 22 bp, Homo sapiens
ccatttgtggtttatttgctct

SEQ ID NO: 7564018 - DNA, 22 bp, Homo sapiens
ccatttgttgtgtattaatatt

SEQ ID NO: 7564019 - DNA, 22 bp, Homo sapiens
ccatttgttgtgtattaatatt

SEQ ID NO: 7564020 - DNA, 22 bp, Homo sapiens
ccatttgttgtgtattaatatt

SEQ ID NO: 7564021 - DNA, 22 bp, Homo sapiens
ccatttgttttcgctaccatgg

SEQ ID NO: 7564022 - DNA, 22 bp, Homo sapiens
ccattttattagtgacatttag

SEQ ID NO: 7564023 - DNA, 22 bp, Homo sapiens
ccattttattagtgacatttag

SEQ ID NO: 7564024 - DNA, 22 bp, Homo sapiens
ccattttattagtgacatttag

SEQ ID NO: 7564025 - DNA, 22 bp, Homo sapiens
ccattttattagtgacatttag

SEQ ID NO: 7564026 - DNA, 22 bp, Homo sapiens
aggctggctggggatgcgtctt

SEQ ID NO: 7564027 - DNA, 22 bp, Homo sapiens
aggctggctggcaggggacaca

SEQ ID NO: 7564028 - DNA, 22 bp, Homo sapiens
aggctggctggggatgcgtctt

SEQ ID NO: 7564029 - DNA, 22 bp, Homo sapiens
aggctgggaaggtaaagttgta

SEQ ID NO: 7564030 - DNA, 22 bp, Homo sapiens
aggctgggaaggtaaagttgta

SEQ ID NO: 7564031 - DNA, 22 bp, Homo sapiens
aggctgggaaggtaaagttgta

SEQ ID NO: 7564032 - DNA, 22 bp, Homo sapiens
aggctgggaaggtaaagttgta

SEQ ID NO: 7564033 - DNA, 22 bp, Homo sapiens
aggctgggaaggtaaagttgta

SEQ ID NO: 7564034 - DNA, 22 bp, Homo sapiens
atacatcacctatatattcaca

SEQ ID NO: 7564035 - DNA, 22 bp, Homo sapiens
atacatcatgctccatatattt

SEQ ID NO: 7564036 - DNA, 22 bp, Homo sapiens
atacatcatgctccatatattt

SEQ ID NO: 7564037 - DNA, 22 bp, Homo sapiens
atacatcacctatatattcaca

SEQ ID NO: 7564038 - DNA, 22 bp, Homo sapiens
atacatcacctatatattcaca

SEQ ID NO: 7564039 - DNA, 22 bp, Homo sapiens
atacatcacctatatattcaca

SEQ ID NO: 7564040 - DNA, 22 bp, Homo sapiens
atacatcacctatatattcaca

SEQ ID NO: 7564041 - DNA, 22 bp, Homo sapiens
atacatcaatttcttagttatc

SEQ ID NO: 7564042 - DNA, 22 bp, Homo sapiens
atacatcacctatatattcaca

SEQ ID NO: 7564043 - DNA, 22 bp, Homo sapiens
atacatcacctatatattcaca

SEQ ID NO: 7564044 - DNA, 22 bp, Homo sapiens
atacatcacctatatattcaca

SEQ ID NO: 7564045 - DNA, 22 bp, Homo sapiens
atacatcacctatatattcaca

SEQ ID NO: 7564046 - DNA, 22 bp, Homo sapiens
atacatcaatttcttagttatc

SEQ ID NO: 7564047 - DNA, 22 bp, Homo sapiens
atacatcaatttcttagttatc

SEQ ID NO: 7564048 - DNA, 22 bp, Homo sapiens
atacatcaaggatgatggtgta

SEQ ID NO: 7564049 - DNA, 22 bp, Homo sapiens
atacatcaaggatgatggtgta

SEQ ID NO: 7564050 - DNA, 22 bp, Homo sapiens
atacatcaaggatgatggtgta

SEQ ID NO: 7564051 - DNA, 22 bp, Homo sapiens
atacatcaatttcttagttatc

SEQ ID NO: 7564052 - DNA, 22 bp, Homo sapiens
atacatcaatttcttagttatc

SEQ ID NO: 7564053 - DNA, 22 bp, Homo sapiens
atacatcaaggatgatggtgta

SEQ ID NO: 7564054 - DNA, 22 bp, Homo sapiens
atacatatgaatgatttggctc

SEQ ID NO: 7564055 - DNA, 22 bp, Homo sapiens
atacatatgaatgatttggctc

SEQ ID NO: 7564056 - DNA, 22 bp, Homo sapiens
atacatatgaatgatttggctc

SEQ ID NO: 7564057 - DNA, 22 bp, Homo sapiens
atacatatccacaggagataaa

SEQ ID NO: 7564058 - DNA, 22 bp, Homo sapiens
atacatatccacaggagataaa

SEQ ID NO: 7564059 - DNA, 22 bp, Homo sapiens
atacatatccacaggagataaa

SEQ ID NO: 7564060 - DNA, 20 bp, Homo sapiens
actttacagagaagactgac

SEQ ID NO: 7564061 - DNA, 20 bp, Homo sapiens
actttacagagaagactgac

SEQ ID NO: 7564062 - DNA, 20 bp, Homo sapiens
actttacagagaagactgac

SEQ ID NO: 7564063 - DNA, 20 bp, Homo sapiens
actttacagagaagactgac

SEQ ID NO: 7564064 - DNA, 20 bp, Homo sapiens
actttacagagaagactgac

SEQ ID NO: 7564065 - DNA, 21 bp, Homo sapiens
actttacaatttacatagtga

SEQ ID NO: 7564066 - DNA, 21 bp, Homo sapiens
actttacaatttacatagtga

SEQ ID NO: 7564067 - DNA, 22 bp, Homo sapiens
actttacacatcttttctcatt

SEQ ID NO: 7564068 - DNA, 22 bp, Homo sapiens
actttacacatcttttctcatt

SEQ ID NO: 7564069 - DNA, 21 bp, Homo sapiens
actttacaatttacatagtga

SEQ ID NO: 7564070 - DNA, 22 bp, Homo sapiens
actttaattaatgaactgtggc

SEQ ID NO: 7564071 - DNA, 22 bp, Homo sapiens
actttaattaatgaactgtggc

SEQ ID NO: 7564072 - DNA, 21 bp, Homo sapiens
actttaatatacatgaggagg

SEQ ID NO: 7564073 - DNA, 22 bp, Homo sapiens
actttaaggaggcactcatctc

SEQ ID NO: 7564074 - DNA, 22 bp, Homo sapiens
actttaaggaggcactcatctc

SEQ ID NO: 7564075 - DNA, 22 bp, Homo sapiens
actttaaagcagaatggctatg

SEQ ID NO: 7564076 - DNA, 22 bp, Homo sapiens
actttaactgttattactcacc

SEQ ID NO: 7564077 - DNA, 23 bp, Homo sapiens
actttaagagtatatgacttccc

SEQ ID NO: 7564078 - DNA, 22 bp, Homo sapiens
actttaaagcagaatggctatg

SEQ ID NO: 7564079 - DNA, 22 bp, Homo sapiens
actttaaagcagaatggctatg

SEQ ID NO: 7564080 - DNA, 22 bp, Homo sapiens
actttaaagcagaatggctatg

SEQ ID NO: 7564081 - DNA, 22 bp, Homo sapiens
actttaaagcagaatggctatg

SEQ ID NO: 7564082 - DNA, 22 bp, Homo sapiens
actttaaagcagaatggctatg

SEQ ID NO: 7564083 - DNA, 22 bp, Homo sapiens
actttaaagcagaatggctatg

SEQ ID NO: 7564084 - DNA, 22 bp, Homo sapiens
actttaaagcagaatggctatg

SEQ ID NO: 7564085 - DNA, 22 bp, Homo sapiens
actttaaagcagaatggctatg

SEQ ID NO: 7564086 - DNA, 22 bp, Homo sapiens
actttaaagcagaatggctatg

SEQ ID NO: 7564087 - DNA, 22 bp, Homo sapiens
actttaaagcagaatggctatg

SEQ ID NO: 7564088 - DNA, 22 bp, Homo sapiens
actttaaagcagaatggctatg

SEQ ID NO: 7564089 - DNA, 22 bp, Homo sapiens
actttaaagcagaatggctatg

SEQ ID NO: 7564090 - DNA, 22 bp, Homo sapiens
actttaaagcagaatggctatg

SEQ ID NO: 7564091 - DNA, 22 bp, Homo sapiens
actttaaagcagaatggctatg

SEQ ID NO: 7564092 - DNA, 22 bp, Homo sapiens
actttacaaactcctcactgtt

SEQ ID NO: 7564093 - DNA, 22 bp, Homo sapiens
actttacaaactcctcactgtt

SEQ ID NO: 7564094 - DNA, 22 bp, Homo sapiens
actttaattaatgaactgtggc

SEQ ID NO: 7564095 - DNA, 22 bp, Homo sapiens
actttacaaactcctcactgtt

SEQ ID NO: 7564096 - DNA, 22 bp, Homo sapiens
actttacaagcttatagcctag

SEQ ID NO: 7564097 - DNA, 22 bp, Homo sapiens
actttacaagcttatagcctag

SEQ ID NO: 7564098 - DNA, 22 bp, Homo sapiens
actttacaatatcctgtgactt

SEQ ID NO: 7564099 - DNA, 22 bp, Homo sapiens
actttacaagcttatagcctag

SEQ ID NO: 7564100 - DNA, 22 bp, Homo sapiens
actttacaatatcctgtgactt

SEQ ID NO: 7564101 - DNA, 21 bp, Homo sapiens
actttacaatttacatagtga

SEQ ID NO: 7564102 - DNA, 21 bp, Homo sapiens
actttacaatttacatagtga

SEQ ID NO: 7564103 - DNA, 21 bp, Homo sapiens
actttacaatttacatagtga

SEQ ID NO: 7564104 - DNA, 21 bp, Homo sapiens
actttacaatttacatagtga

SEQ ID NO: 7564105 - DNA, 21 bp, Homo sapiens
actttacaatttacatagtga

SEQ ID NO: 7564106 - DNA, 21 bp, Homo sapiens
actttacaatttacatagtga

SEQ ID NO: 7564107 - DNA, 21 bp, Homo sapiens
actttacaatttacatagtga

SEQ ID NO: 7564108 - DNA, 21 bp, Homo sapiens
actttacaatttacatagtga

SEQ ID NO: 7564109 - DNA, 22 bp, Homo sapiens
acttggttggtctcaccctgtt

SEQ ID NO: 7564110 - DNA, 22 bp, Homo sapiens
atacaaagacaaatctcaatct

SEQ ID NO: 7564111 - DNA, 22 bp, Homo sapiens
actttaaagcagaatggctatg

SEQ ID NO: 7564112 - DNA, 22 bp, Homo sapiens
actttaaagcagaatggctatg

SEQ ID NO: 7564113 - DNA, 22 bp, Homo sapiens
actttaaagcagaatggctatg

SEQ ID NO: 7564114 - DNA, 22 bp, Homo sapiens
actttaaaactgatcatcagag

SEQ ID NO: 7564115 - DNA, 22 bp, Homo sapiens
actttaaaactgatcatcagag

SEQ ID NO: 7564116 - DNA, 22 bp, Homo sapiens
actttaaaactgatcatcagag

SEQ ID NO: 7564117 - DNA, 22 bp, Homo sapiens
actttaaaactgatcatcagag

SEQ ID NO: 7564118 - DNA, 22 bp, Homo sapiens
actttaaaactgatcatcagag

SEQ ID NO: 7564119 - DNA, 22 bp, Homo sapiens
actttaaaactgatcatcagag

SEQ ID NO: 7564120 - DNA, 23 bp, Homo sapiens
atacaaaccttgcaggacatgtt

SEQ ID NO: 7564121 - DNA, 23 bp, Homo sapiens
atacaaaccttgcaggacatgtt

SEQ ID NO: 7564122 - DNA, 22 bp, Homo sapiens
atacaaaatatatactggagac

SEQ ID NO: 7564123 - DNA, 22 bp, Homo sapiens
atacaaagacaaatctcaatct

SEQ ID NO: 7564124 - DNA, 22 bp, Homo sapiens
atacaaagacaaatctcaatct

SEQ ID NO: 7564125 - DNA, 22 bp, Homo sapiens
acttggttgcaaatgaattatt

SEQ ID NO: 7564126 - DNA, 22 bp, Homo sapiens
atacaaaatatatactggagac

SEQ ID NO: 7564127 - DNA, 22 bp, Homo sapiens
atacaaaatatatactggagac

SEQ ID NO: 7564128 - DNA, 22 bp, Homo sapiens
atacaaaatatatactggagac

SEQ ID NO: 7564129 - DNA, 22 bp, Homo sapiens
atacaaaatatatactggagac

SEQ ID NO: 7564130 - DNA, 22 bp, Homo sapiens
atacaaaatatatactggagac

SEQ ID NO: 7564131 - DNA, 22 bp, Homo sapiens
atacaaaatatatactggagac

SEQ ID NO: 7564132 - DNA, 22 bp, Homo sapiens
atacaaaatatatactggagac

SEQ ID NO: 7564133 - DNA, 22 bp, Homo sapiens
atacaaaatatatactggagac

SEQ ID NO: 7564134 - DNA, 22 bp, Homo sapiens
atacaaaatatatactggagac

SEQ ID NO: 7564135 - DNA, 22 bp, Homo sapiens
atacaaaatatatactggagac

SEQ ID NO: 7564136 - DNA, 22 bp, Homo sapiens
atacaaaatatatactggagac

SEQ ID NO: 7564137 - DNA, 22 bp, Homo sapiens
atacaaaatatatactggagac

SEQ ID NO: 7564138 - DNA, 22 bp, Homo sapiens
atacaaaatatatactggagac

SEQ ID NO: 7564139 - DNA, 22 bp, Homo sapiens
atacaaaatatatactggagac

SEQ ID NO: 7564140 - DNA, 22 bp, Homo sapiens
atacaaaatatatactggagac

SEQ ID NO: 7564141 - DNA, 22 bp, Homo sapiens
atacaaaatatatactggagac

SEQ ID NO: 7564142 - DNA, 22 bp, Homo sapiens
atacaaaatatatactggagac

SEQ ID NO: 7564143 - DNA, 22 bp, Homo sapiens
atacaaaatatatactggagac

SEQ ID NO: 7564144 - DNA, 22 bp, Homo sapiens
atacaaaaattagccgggagta

SEQ ID NO: 7564145 - DNA, 22 bp, Homo sapiens
atacaaaaattagccgggagta

SEQ ID NO: 7564146 - DNA, 22 bp, Homo sapiens
atacaaaaattagccgggagta

SEQ ID NO: 7564147 - DNA, 22 bp, Homo sapiens
atacaaaaattagccgggagta

SEQ ID NO: 7564148 - DNA, 22 bp, Homo sapiens
atacaaaatatatactggagac

SEQ ID NO: 7564149 - DNA, 22 bp, Homo sapiens
ataatttttgtttgatgtccaa

SEQ ID NO: 7564150 - DNA, 22 bp, Homo sapiens
ataatttttgtttgatgtccaa

SEQ ID NO: 7564151 - DNA, 22 bp, Homo sapiens
atacaaaaattagccgggagta

SEQ ID NO: 7564152 - DNA, 22 bp, Homo sapiens
atacaaaaattagccgggagta

SEQ ID NO: 7564153 - DNA, 22 bp, Homo sapiens
atacaaaaattagccgggagta

SEQ ID NO: 7564154 - DNA, 22 bp, Homo sapiens
atacaaaaattagccgggagta

SEQ ID NO: 7564155 - DNA, 22 bp, Homo sapiens
atacaaaaattagccgggagta

SEQ ID NO: 7564156 - DNA, 22 bp, Homo sapiens
atacaaaaattagccgggagta

SEQ ID NO: 7564157 - DNA, 22 bp, Homo sapiens
atacaaaaattagccgggagta

SEQ ID NO: 7564158 - DNA, 22 bp, Homo sapiens
atacaaaaattagccgggagta

SEQ ID NO: 7564159 - DNA, 22 bp, Homo sapiens
atacaaaaattagccgggagta

SEQ ID NO: 7564160 - DNA, 22 bp, Homo sapiens
ataatttttgtttgatgtccaa

SEQ ID NO: 7564161 - DNA, 22 bp, Homo sapiens
ataatttttgtttgatgtccaa

SEQ ID NO: 7564162 - DNA, 22 bp, Homo sapiens
ataatttttgtttgatgtccaa

SEQ ID NO: 7564163 - DNA, 22 bp, Homo sapiens
acttctcttcataggtggcaat

SEQ ID NO: 7564164 - DNA, 22 bp, Homo sapiens
ataatttttgtttgatgtccaa

SEQ ID NO: 7564165 - DNA, 22 bp, Homo sapiens
acttctcttcataggtggcaat

SEQ ID NO: 7564166 - DNA, 22 bp, Homo sapiens
acttctctgctacctgcaaaga

SEQ ID NO: 7564167 - DNA, 22 bp, Homo sapiens
acttctctgctacctgcaaaga

SEQ ID NO: 7564168 - DNA, 22 bp, Homo sapiens
acttctctgctacctgcaaaga

SEQ ID NO: 7564169 - DNA, 22 bp, Homo sapiens
acttctctgctacctgcaaaga

SEQ ID NO: 7564170 - DNA, 22 bp, Homo sapiens
acttctctcattcagacatagc

SEQ ID NO: 7564171 - DNA, 22 bp, Homo sapiens
acttctctccacccaagtccct

SEQ ID NO: 7564172 - DNA, 22 bp, Homo sapiens
acttctctcattcagacatagc

SEQ ID NO: 7564173 - DNA, 22 bp, Homo sapiens
actttgccctacagcagctctg

SEQ ID NO: 7564174 - DNA, 22 bp, Homo sapiens
actttgccctacagcagctctg

SEQ ID NO: 7564175 - DNA, 22 bp, Homo sapiens
actttgccttcttactgtgttg

SEQ ID NO: 7564176 - DNA, 22 bp, Homo sapiens
actttgccttcttactgtgttg

SEQ ID NO: 7564177 - DNA, 22 bp, Homo sapiens
actttgctcatattgagtttct

SEQ ID NO: 7564178 - DNA, 22 bp, Homo sapiens
actttgctcatattgagtttct

SEQ ID NO: 7564179 - DNA, 22 bp, Homo sapiens
actttggacaatttattactgt

SEQ ID NO: 7564180 - DNA, 22 bp, Homo sapiens
actttggacaatttattactgt

SEQ ID NO: 7564181 - DNA, 22 bp, Homo sapiens
actttggaataagctatataac

SEQ ID NO: 7564182 - DNA, 22 bp, Homo sapiens
actttggaagatggctgtattt

SEQ ID NO: 7564183 - DNA, 22 bp, Homo sapiens
actttggaagatggctgtattt

SEQ ID NO: 7564184 - DNA, 22 bp, Homo sapiens
actttggaataagctatataac

SEQ ID NO: 7564185 - DNA, 22 bp, Homo sapiens
actttggaaattgtctataaga

SEQ ID NO: 7564186 - DNA, 22 bp, Homo sapiens
actttgctgcaggtttaaagag

SEQ ID NO: 7564187 - DNA, 22 bp, Homo sapiens
actttgctgcaggtttaaagag

SEQ ID NO: 7564188 - DNA, 22 bp, Homo sapiens
actttggaaattgtctataaga

SEQ ID NO: 7564189 - DNA, 23 bp, Homo sapiens
actttgcatacccaaattgtttt

SEQ ID NO: 7564190 - DNA, 19 bp, Homo sapiens
actttgcatgtgtgtctaa

SEQ ID NO: 7564191 - DNA, 19 bp, Homo sapiens
actttgcatgtgtgtctaa

SEQ ID NO: 7564192 - DNA, 22 bp, Homo sapiens
actttgcagggcttgatatcca

SEQ ID NO: 7564193 - DNA, 22 bp, Homo sapiens
actttgcaggtacatgagcatc

SEQ ID NO: 7564194 - DNA, 22 bp, Homo sapiens
actttgcaggtacatgagcatc

SEQ ID NO: 7564195 - DNA, 22 bp, Homo sapiens
actttgcaggtacatgagcatc

SEQ ID NO: 7564196 - DNA, 22 bp, Homo sapiens
actttgcagagccagaagagaa

SEQ ID NO: 7564197 - DNA, 18 bp, Homo sapiens
actttgcaggctcccatt

SEQ ID NO: 7564198 - DNA, 22 bp, Homo sapiens
atacatcatttatggaataagg

SEQ ID NO: 7564199 - DNA, 22 bp, Homo sapiens
atacatcatttatggaataagg

SEQ ID NO: 7564200 - DNA, 22 bp, Homo sapiens
atacatcatttcccatcaatcg

SEQ ID NO: 7564201 - DNA, 22 bp, Homo sapiens
atacatcatttcccatcaatcg

SEQ ID NO: 7564202 - DNA, 22 bp, Homo sapiens
atacatcatttcccatcaatcg

SEQ ID NO: 7564203 - DNA, 22 bp, Homo sapiens
atacatcatttcccatcaatcg

SEQ ID NO: 7564204 - DNA, 22 bp, Homo sapiens
atacatcatttcccatcaatcg

SEQ ID NO: 7564205 - DNA, 22 bp, Homo sapiens
atacatcatttcccatcaatcg

SEQ ID NO: 7564206 - DNA, 22 bp, Homo sapiens
atacatcatttcccatcaatcg

SEQ ID NO: 7564207 - DNA, 22 bp, Homo sapiens
atacatcatgctccatatattt

SEQ ID NO: 7564208 - DNA, 22 bp, Homo sapiens
atacatcatgctccatatattt

SEQ ID NO: 7564209 - DNA, 22 bp, Homo sapiens
atacatcatttatgatgtgtgt

SEQ ID NO: 7564210 - DNA, 22 bp, Homo sapiens
atacatcatttatgatgtgtgt

SEQ ID NO: 7564211 - DNA, 22 bp, Homo sapiens
atacatcatgctccatatattt

SEQ ID NO: 7564212 - DNA, 22 bp, Homo sapiens
atacatcatgctccatatattt

SEQ ID NO: 7564213 - DNA, 22 bp, Homo sapiens
atacatcatgctccatatattt

SEQ ID NO: 7564214 - DNA, 22 bp, Homo sapiens
atacatctagagtcataaaaac

SEQ ID NO: 7564215 - DNA, 22 bp, Homo sapiens
atacatctagagtcataaaaac

SEQ ID NO: 7564216 - DNA, 22 bp, Homo sapiens
atacatctagagtcataaaaac

SEQ ID NO: 7564217 - DNA, 22 bp, Homo sapiens
atacatctagagtcataaaaac

SEQ ID NO: 7564218 - DNA, 20 bp, Homo sapiens
actttctcggtttctcacct

SEQ ID NO: 7564219 - DNA, 22 bp, Homo sapiens
actttctgcagtgttggaaatg

SEQ ID NO: 7564220 - DNA, 22 bp, Homo sapiens
actttctgtcatctagacaagt

SEQ ID NO: 7564221 - DNA, 22 bp, Homo sapiens
actttctgtcatctagacaagt

SEQ ID NO: 7564222 - DNA, 22 bp, Homo sapiens
actttctgtcatctagacaagt

SEQ ID NO: 7564223 - DNA, 22 bp, Homo sapiens
actttctgtcatctagacaagt

SEQ ID NO: 7564224 - DNA, 22 bp, Homo sapiens
actttctgccttacaggagtcc

SEQ ID NO: 7564225 - DNA, 22 bp, Homo sapiens
actttctgccttacaggagtcc

SEQ ID NO: 7564226 - DNA, 22 bp, Homo sapiens
actttctgccttacaggagtcc

SEQ ID NO: 7564227 - DNA, 22 bp, Homo sapiens
actttgcaaataaactctctaa

SEQ ID NO: 7564228 - DNA, 22 bp, Homo sapiens
actttgcaatacttaatacaaa

SEQ ID NO: 7564229 - DNA, 22 bp, Homo sapiens
actttgcaatacttaatacaaa

SEQ ID NO: 7564230 - DNA, 22 bp, Homo sapiens
actttgcaatacttaatacaaa

SEQ ID NO: 7564231 - DNA, 22 bp, Homo sapiens
actttgcacttcaatataactt

SEQ ID NO: 7564232 - DNA, 22 bp, Homo sapiens
actttgcactaagttactcatt

SEQ ID NO: 7564233 - DNA, 22 bp, Homo sapiens
actttgcacttcaatataactt

SEQ ID NO: 7564234 - DNA, 22 bp, Homo sapiens
actttgcaatgggcagaaccca

SEQ ID NO: 7564235 - DNA, 22 bp, Homo sapiens
actttgcaatgggcagaaccca

SEQ ID NO: 7564236 - DNA, 22 bp, Homo sapiens
actttgcactaagttactcatt

SEQ ID NO: 7564237 - DNA, 22 bp, Homo sapiens
atagagttgagttcaaatatgt

SEQ ID NO: 7564238 - DNA, 22 bp, Homo sapiens
atagagtgatgtaaggtatgtg

SEQ ID NO: 7564239 - DNA, 22 bp, Homo sapiens
atagagttttattttccaataa

SEQ ID NO: 7564240 - DNA, 22 bp, Homo sapiens
atagatacattgttatatttgt

SEQ ID NO: 7564241 - DNA, 22 bp, Homo sapiens
atagatacattaggtaacttgt

SEQ ID NO: 7564242 - DNA, 22 bp, Homo sapiens
atagatacattgttatatttgt

SEQ ID NO: 7564243 - DNA, 22 bp, Homo sapiens
atagatacattgttatatttgt

SEQ ID NO: 7564244 - DNA, 22 bp, Homo sapiens
atagagtgatgtaaggtatgtg

SEQ ID NO: 7564245 - DNA, 22 bp, Homo sapiens
atagagtgatgtaaggtatgtg

SEQ ID NO: 7564246 - DNA, 22 bp, Homo sapiens
atagagtgatgtaaggtatgtg

SEQ ID NO: 7564247 - DNA, 21 bp, Homo sapiens
actttgggaggtgtgaggggc

SEQ ID NO: 7564248 - DNA, 22 bp, Homo sapiens
atagaggcagtgaagctagttg

SEQ ID NO: 7564249 - DNA, 21 bp, Homo sapiens
actttgggaggtgtgaggggc

SEQ ID NO: 7564250 - DNA, 19 bp, Homo sapiens
atagagtagagtatctgtt

SEQ ID NO: 7564251 - DNA, 22 bp, Homo sapiens
atagagtacagtctttgattat

SEQ ID NO: 7564252 - DNA, 22 bp, Homo sapiens
actttggattgggtccctccca

SEQ ID NO: 7564253 - DNA, 22 bp, Homo sapiens
actttggcacagaacttccatt

SEQ ID NO: 7564254 - DNA, 22 bp, Homo sapiens
actttgggacccagccaaccct

SEQ ID NO: 7564255 - DNA, 22 bp, Homo sapiens
actttgggaagctgcaattgcc

SEQ ID NO: 7564256 - DNA, 22 bp, Homo sapiens
actttggcacagaacttccatt

SEQ ID NO: 7564257 - DNA, 22 bp, Homo sapiens
actttgggaagctgcaattgcc

SEQ ID NO: 7564258 - DNA, 22 bp, Homo sapiens
actttggatctgatgtaatcag

SEQ ID NO: 7564259 - DNA, 22 bp, Homo sapiens
actttggatctgatgtaatcag

SEQ ID NO: 7564260 - DNA, 22 bp, Homo sapiens
actttggatctgatgtaatcag

SEQ ID NO: 7564261 - DNA, 22 bp, Homo sapiens
actttggagggtgttgtagatg

SEQ ID NO: 7564262 - DNA, 22 bp, Homo sapiens
actttggacaatttattactgt

SEQ ID NO: 7564263 - DNA, 22 bp, Homo sapiens
actttggacaatttattactgt

SEQ ID NO: 7564264 - DNA, 22 bp, Homo sapiens
actttggacgccatgctgtttg

SEQ ID NO: 7564265 - DNA, 22 bp, Homo sapiens
actttggacgccatgctgtttg

SEQ ID NO: 7564266 - DNA, 17 bp, Homo sapiens
actttggaggcagctgt

SEQ ID NO: 7564267 - DNA, 17 bp, Homo sapiens
actttggaggcagctgt

SEQ ID NO: 7564268 - DNA, 17 bp, Homo sapiens
actttggaggcagctgt

SEQ ID NO: 7564269 - DNA, 22 bp, Homo sapiens
actttggacgccatgctgtttg

SEQ ID NO: 7564270 - DNA, 22 bp, Homo sapiens
actttggacgccatgctgtttg

SEQ ID NO: 7564271 - DNA, 22 bp, Homo sapiens
actttggacgccatgctgtttg

SEQ ID NO: 7564272 - DNA, 22 bp, Homo sapiens
atagatatttgagttgtttcca

SEQ ID NO: 7564273 - DNA, 22 bp, Homo sapiens
atagatatttgagttgtttcca

SEQ ID NO: 7564274 - DNA, 22 bp, Homo sapiens
atagatattagcaaaattttat

SEQ ID NO: 7564275 - DNA, 22 bp, Homo sapiens
atagatattagcaaaattttat

SEQ ID NO: 7564276 - DNA, 22 bp, Homo sapiens
atagatattagcaaaattttat

SEQ ID NO: 7564277 - DNA, 20 bp, Homo sapiens
atagatatcatctttagaag

SEQ ID NO: 7564278 - DNA, 20 bp, Homo sapiens
atagatatcatctttagaag

SEQ ID NO: 7564279 - DNA, 20 bp, Homo sapiens
atagatatcatctttagaag

SEQ ID NO: 7564280 - DNA, 22 bp, Homo sapiens
atagatattagcaaaattttat

SEQ ID NO: 7564281 - DNA, 20 bp, Homo sapiens
atagatatcatctttagaag

SEQ ID NO: 7564282 - DNA, 23 bp, Homo sapiens
acttttcaattagctatgcttaa

SEQ ID NO: 7564283 - DNA, 23 bp, Homo sapiens
acttttcaattagctatgcttaa

SEQ ID NO: 7564284 - DNA, 22 bp, Homo sapiens
actttgttcctttcacaaagaa

SEQ ID NO: 7564285 - DNA, 22 bp, Homo sapiens
actttgttcctttcacaaagaa

SEQ ID NO: 7564286 - DNA, 22 bp, Homo sapiens
acttttcaaatgggaaactcag

SEQ ID NO: 7564287 - DNA, 22 bp, Homo sapiens
actttgttcctttcacaaagaa

SEQ ID NO: 7564288 - DNA, 22 bp, Homo sapiens
actttgttcctttcacaaagaa

SEQ ID NO: 7564289 - DNA, 22 bp, Homo sapiens
actttgtgcccaacagaaagaa

SEQ ID NO: 7564290 - DNA, 22 bp, Homo sapiens
actttgtgcccaacagaaagaa

SEQ ID NO: 7564291 - DNA, 22 bp, Homo sapiens
atagatcaatgagcaatttaat

SEQ ID NO: 7564292 - DNA, 22 bp, Homo sapiens
atagatcaatgagcaatttaat

SEQ ID NO: 7564293 - DNA, 22 bp, Homo sapiens
atagatcaattctgcttccaca

SEQ ID NO: 7564294 - DNA, 20 bp, Homo sapiens
atagatcagtgagactaaag

SEQ ID NO: 7564295 - DNA, 22 bp, Homo sapiens
agttttatggctcaacctaata

SEQ ID NO: 7564296 - DNA, 22 bp, Homo sapiens
agttttatggctcaacctaata

SEQ ID NO: 7564297 - DNA, 22 bp, Homo sapiens
agttttatgcagtgttctgata

SEQ ID NO: 7564298 - DNA, 22 bp, Homo sapiens
agttttatggctcaacctaata

SEQ ID NO: 7564299 - DNA, 22 bp, Homo sapiens
agttttatggctcaacctaata

SEQ ID NO: 7564300 - DNA, 22 bp, Homo sapiens
agttttatggctcaacctaata

SEQ ID NO: 7564301 - DNA, 22 bp, Homo sapiens
agttttatgcagtgttctgata

SEQ ID NO: 7564302 - DNA, 22 bp, Homo sapiens
agttttatgcagtgttctgata

SEQ ID NO: 7564303 - DNA, 22 bp, Homo sapiens
agttttatctgtaagctgttca

SEQ ID NO: 7564304 - DNA, 22 bp, Homo sapiens
agttttatgcagtgttctgata

SEQ ID NO: 7564305 - DNA, 22 bp, Homo sapiens
agttttatctgtaagctgttca

SEQ ID NO: 7564306 - DNA, 22 bp, Homo sapiens
agttttatctgtaagctgttca

SEQ ID NO: 7564307 - DNA, 21 bp, Homo sapiens
agttttatattataagctaaa

SEQ ID NO: 7564308 - DNA, 21 bp, Homo sapiens
agttttatattataagctaaa

SEQ ID NO: 7564309 - DNA, 21 bp, Homo sapiens
agttttatattataagctaaa

SEQ ID NO: 7564310 - DNA, 22 bp, Homo sapiens
agttttatctgtaagctgttca

SEQ ID NO: 7564311 - DNA, 22 bp, Homo sapiens
agttttatctgtaagctgttca

SEQ ID NO: 7564312 - DNA, 22 bp, Homo sapiens
agttttatgcagtgttctgata

SEQ ID NO: 7564313 - DNA, 22 bp, Homo sapiens
agttttatgcagtgttctgata

SEQ ID NO: 7564314 - DNA, 22 bp, Homo sapiens
agttttatgcagtgttctgata

SEQ ID NO: 7564315 - DNA, 22 bp, Homo sapiens
agttttatgcagtgttctgata

SEQ ID NO: 7564316 - DNA, 21 bp, Homo sapiens
agttttatattataagctaaa

SEQ ID NO: 7564317 - DNA, 21 bp, Homo sapiens
agttttatattataagctaaa

SEQ ID NO: 7564318 - DNA, 22 bp, Homo sapiens
agttttagagtaagaattactg

SEQ ID NO: 7564319 - DNA, 21 bp, Homo sapiens
agttttatattataagctaaa

SEQ ID NO: 7564320 - DNA, 21 bp, Homo sapiens
agttttatattataagctaaa

SEQ ID NO: 7564321 - DNA, 21 bp, Homo sapiens
agttttatattataagctaaa

SEQ ID NO: 7564322 - DNA, 21 bp, Homo sapiens
agttttatattataagctaaa

SEQ ID NO: 7564323 - DNA, 21 bp, Homo sapiens
agttttatattataagctaaa

SEQ ID NO: 7564324 - DNA, 21 bp, Homo sapiens
agttttatattataagctaaa

SEQ ID NO: 7564325 - DNA, 22 bp, Homo sapiens
agttttatatcttccattggtt

SEQ ID NO: 7564326 - DNA, 22 bp, Homo sapiens
agttttatatcttccattggtt

SEQ ID NO: 7564327 - DNA, 22 bp, Homo sapiens
agttttatatcttccattggtt

SEQ ID NO: 7564328 - DNA, 22 bp, Homo sapiens
agttttatatcttccattggtt

SEQ ID NO: 7564329 - DNA, 22 bp, Homo sapiens
agttttatatcttccattggtt

SEQ ID NO: 7564330 - DNA, 22 bp, Homo sapiens
agttttataaaggcacctcagt

SEQ ID NO: 7564331 - DNA, 22 bp, Homo sapiens
agttttataaaggcacctcagt

SEQ ID NO: 7564332 - DNA, 22 bp, Homo sapiens
agttttataaaggcacctcagt

SEQ ID NO: 7564333 - DNA, 22 bp, Homo sapiens
agttttataaaggcacctcagt

SEQ ID NO: 7564334 - DNA, 22 bp, Homo sapiens
agttttataaaggcacctcagt

SEQ ID NO: 7564335 - DNA, 22 bp, Homo sapiens
agttttatatcttccattggtt

SEQ ID NO: 7564336 - DNA, 22 bp, Homo sapiens
agtttctagcaaggattgttga

SEQ ID NO: 7564337 - DNA, 22 bp, Homo sapiens
agttttaaatgatggtggtggt

SEQ ID NO: 7564338 - DNA, 22 bp, Homo sapiens
agttttaaatgatggtggtggt

SEQ ID NO: 7564339 - DNA, 22 bp, Homo sapiens
agttttaagatgcgcttctgtt

SEQ ID NO: 7564340 - DNA, 22 bp, Homo sapiens
agttttaagatgcgcttctgtt

SEQ ID NO: 7564341 - DNA, 22 bp, Homo sapiens
agttttaagatgcgcttctgtt

SEQ ID NO: 7564342 - DNA, 22 bp, Homo sapiens
agttttaagatgcgcttctgtt

SEQ ID NO: 7564343 - DNA, 22 bp, Homo sapiens
agtttctaccggtacattcagg

SEQ ID NO: 7564344 - DNA, 22 bp, Homo sapiens
agtttctagcaaggattgttga

SEQ ID NO: 7564345 - DNA, 22 bp, Homo sapiens
agtttctaccggtacattcagg

SEQ ID NO: 7564346 - DNA, 22 bp, Homo sapiens
agtttctagcaaggattgttga

SEQ ID NO: 7564347 - DNA, 22 bp, Homo sapiens
actgggctccagatgtgatacg

SEQ ID NO: 7564348 - DNA, 22 bp, Homo sapiens
agtttctaccggtacattcagg

SEQ ID NO: 7564349 - DNA, 22 bp, Homo sapiens
actgggctccagatgtgatacg

SEQ ID NO: 7564350 - DNA, 21 bp, Homo sapiens
actgggctagcctgacttctg

SEQ ID NO: 7564351 - DNA, 22 bp, Homo sapiens
actgggctcataatgtcataga

SEQ ID NO: 7564352 - DNA, 22 bp, Homo sapiens
actgggctcataatgtcataga

SEQ ID NO: 7564353 - DNA, 22 bp, Homo sapiens
actgggctcataatgtcataga

SEQ ID NO: 7564354 - DNA, 22 bp, Homo sapiens
actgggctccaaggacctggag

SEQ ID NO: 7564355 - DNA, 22 bp, Homo sapiens
actgggctccaaggacctggag

SEQ ID NO: 7564356 - DNA, 22 bp, Homo sapiens
actgggctaccccaccattacc

SEQ ID NO: 7564357 - DNA, 22 bp, Homo sapiens
actgggccttgtgtgtctcatc

SEQ ID NO: 7564358 - DNA, 22 bp, Homo sapiens
actgggccttgtgtgtctcatc

SEQ ID NO: 7564359 - DNA, 22 bp, Homo sapiens
actgggccttgtgtgtctcatc

SEQ ID NO: 7564360 - DNA, 22 bp, Homo sapiens
actgggccttgtgtgtctcatc

SEQ ID NO: 7564361 - DNA, 22 bp, Homo sapiens
actgggccttgtgtgtctcatc

SEQ ID NO: 7564362 - DNA, 22 bp, Homo sapiens
actgggccttgccatggcagcc

SEQ ID NO: 7564363 - DNA, 21 bp, Homo sapiens
actgggctagcctgacttctg

SEQ ID NO: 7564364 - DNA, 22 bp, Homo sapiens
actgggctagagtggaagctgg

SEQ ID NO: 7564365 - DNA, 22 bp, Homo sapiens
actgggctagagtggaagctgg

SEQ ID NO: 7564366 - DNA, 18 bp, Homo sapiens
agtttttaggaagaaatg

SEQ ID NO: 7564367 - DNA, 18 bp, Homo sapiens
agtttttaggaagaaatg

SEQ ID NO: 7564368 - DNA, 18 bp, Homo sapiens
agtttttaggaagaaatg

SEQ ID NO: 7564369 - DNA, 18 bp, Homo sapiens
agtttttaggaagaaatg

SEQ ID NO: 7564370 - DNA, 21 bp, Homo sapiens
agtttttactcttaactgtgg

SEQ ID NO: 7564371 - DNA, 21 bp, Homo sapiens
agtttttactcttaactgtgg

SEQ ID NO: 7564372 - DNA, 21 bp, Homo sapiens
agtttttactcttaactgtgg

SEQ ID NO: 7564373 - DNA, 22 bp, Homo sapiens
agtttttccgtggctacgataa

SEQ ID NO: 7564374 - DNA, 18 bp, Homo sapiens
agtttttaggaagaaatg

SEQ ID NO: 7564375 - DNA, 22 bp, Homo sapiens
agtttttccgtggctacgataa

SEQ ID NO: 7564376 - DNA, 22 bp, Homo sapiens
agtttttccgtggctacgataa

SEQ ID NO: 7564377 - DNA, 22 bp, Homo sapiens
agtttttcctgattttacagaa

SEQ ID NO: 7564378 - DNA, 22 bp, Homo sapiens
agtttttcctgattttacagaa

SEQ ID NO: 7564379 - DNA, 22 bp, Homo sapiens
agtttttcctgattttacagaa

SEQ ID NO: 7564380 - DNA, 18 bp, Homo sapiens
agtttttaggaagaaatg

SEQ ID NO: 7564381 - DNA, 18 bp, Homo sapiens
agtttttaggaagaaatg

SEQ ID NO: 7564382 - DNA, 18 bp, Homo sapiens
agtttttaggaagaaatg

SEQ ID NO: 7564383 - DNA, 22 bp, Homo sapiens
agttttatgtagacaattcatt

SEQ ID NO: 7564384 - DNA, 22 bp, Homo sapiens
agttttatgtagacaattcatt

SEQ ID NO: 7564385 - DNA, 22 bp, Homo sapiens
agttttatggctcaacctaata

SEQ ID NO: 7564386 - DNA, 22 bp, Homo sapiens
agttttatggctcaacctaata

SEQ ID NO: 7564387 - DNA, 22 bp, Homo sapiens
agttttatggctcaacctaata

SEQ ID NO: 7564388 - DNA, 22 bp, Homo sapiens
agttttatggctcaacctaata

SEQ ID NO: 7564389 - DNA, 22 bp, Homo sapiens
agttttatggctcaacctaata

SEQ ID NO: 7564390 - DNA, 22 bp, Homo sapiens
agttttatgtagacaattcatt

SEQ ID NO: 7564391 - DNA, 22 bp, Homo sapiens
agttttatgttcacagaaggat

SEQ ID NO: 7564392 - DNA, 22 bp, Homo sapiens
agttttatgtagacaattcatt

SEQ ID NO: 7564393 - DNA, 22 bp, Homo sapiens
agttttatgtagacaattcatt

SEQ ID NO: 7564394 - DNA, 22 bp, Homo sapiens
agttttatgtagacaattcatt

SEQ ID NO: 7564395 - DNA, 22 bp, Homo sapiens
agttttatgtagacaattcatt

SEQ ID NO: 7564396 - DNA, 22 bp, Homo sapiens
agttttatgtagacaattcatt

SEQ ID NO: 7564397 - DNA, 23 bp, Homo sapiens
agtttttaatggtcatagctgag

SEQ ID NO: 7564398 - DNA, 21 bp, Homo sapiens
agtttttactcttaactgtgg

SEQ ID NO: 7564399 - DNA, 21 bp, Homo sapiens
agtttttactcttaactgtgg

SEQ ID NO: 7564400 - DNA, 21 bp, Homo sapiens
agtttttactcttaactgtgg

SEQ ID NO: 7564401 - DNA, 21 bp, Homo sapiens
agtttttactcttaactgtgg

SEQ ID NO: 7564402 - DNA, 23 bp, Homo sapiens
agtttttaatggtcatagctgag

SEQ ID NO: 7564403 - DNA, 23 bp, Homo sapiens
agtttttaatggtcatagctgag

SEQ ID NO: 7564404 - DNA, 23 bp, Homo sapiens
agtttttaatggtcatagctgag

SEQ ID NO: 7564405 - DNA, 23 bp, Homo sapiens
agtttttaatggtcatagctgag

SEQ ID NO: 7564406 - DNA, 23 bp, Homo sapiens
agtttttaatggtcatagctgag

SEQ ID NO: 7564407 - DNA, 22 bp, Homo sapiens
ataaaaactgacccatcctttg

SEQ ID NO: 7564408 - DNA, 22 bp, Homo sapiens
ataaaaactgacccatcctttg

SEQ ID NO: 7564409 - DNA, 22 bp, Homo sapiens
ataaaaactgacccatcctttg

SEQ ID NO: 7564410 - DNA, 21 bp, Homo sapiens
actgttattcccattttcacc

SEQ ID NO: 7564411 - DNA, 22 bp, Homo sapiens
ataaaaactgacccatcctttg

SEQ ID NO: 7564412 - DNA, 22 bp, Homo sapiens
actgttattgtgaacgggcaat

SEQ ID NO: 7564413 - DNA, 22 bp, Homo sapiens
actgttatttgtaatccattat

SEQ ID NO: 7564414 - DNA, 22 bp, Homo sapiens
actgttatttcaccactactga

SEQ ID NO: 7564415 - DNA, 22 bp, Homo sapiens
actgtttagtaaattgaaatgg

SEQ ID NO: 7564416 - DNA, 22 bp, Homo sapiens
actgtttaggaggcttatatgc

SEQ ID NO: 7564417 - DNA, 22 bp, Homo sapiens
actgtttaaaggcttcctttct

SEQ ID NO: 7564418 - DNA, 22 bp, Homo sapiens
actgtttaaatatttgggctgg

SEQ ID NO: 7564419 - DNA, 22 bp, Homo sapiens
actgtttaggaggcttatatgc

SEQ ID NO: 7564420 - DNA, 22 bp, Homo sapiens
actgtttaggaggcttatatgc

SEQ ID NO: 7564421 - DNA, 22 bp, Homo sapiens
actgttcaagcaaatgacattg

SEQ ID NO: 7564422 - DNA, 22 bp, Homo sapiens
actgtttaaaggcttcctttct

SEQ ID NO: 7564423 - DNA, 22 bp, Homo sapiens
actgttgtcaggctgctttgga

SEQ ID NO: 7564424 - DNA, 22 bp, Homo sapiens
actgttcaagcaaatgacattg

SEQ ID NO: 7564425 - DNA, 22 bp, Homo sapiens
ataaaaactgacccatcctttg

SEQ ID NO: 7564426 - DNA, 22 bp, Homo sapiens
ataaaaactgacccatcctttg

SEQ ID NO: 7564427 - DNA, 22 bp, Homo sapiens
ataaaaactgacccatcctttg

SEQ ID NO: 7564428 - DNA, 17 bp, Homo sapiens
agtttttggacctgtgt

SEQ ID NO: 7564429 - DNA, 19 bp, Homo sapiens
agtttttggaaatcctgct

SEQ ID NO: 7564430 - DNA, 17 bp, Homo sapiens
agtttttggacctgtgt

SEQ ID NO: 7564431 - DNA, 22 bp, Homo sapiens
agtttttgagaatttactatgt

SEQ ID NO: 7564432 - DNA, 22 bp, Homo sapiens
agtttttgagaatttactatgt

SEQ ID NO: 7564433 - DNA, 22 bp, Homo sapiens
agtttttgagaatttactatgt

SEQ ID NO: 7564434 - DNA, 22 bp, Homo sapiens
agtttttgagaatttactatgt

SEQ ID NO: 7564435 - DNA, 22 bp, Homo sapiens
agtttttctgctggtctcacta

SEQ ID NO: 7564436 - DNA, 22 bp, Homo sapiens
agtttttctgggaggcactgct

SEQ ID NO: 7564437 - DNA, 22 bp, Homo sapiens
agtttttgacaaactgtagttg

SEQ ID NO: 7564438 - DNA, 22 bp, Homo sapiens
agtttttctgctggtctcacta

SEQ ID NO: 7564439 - DNA, 23 bp, Homo sapiens
agtttttctgcatggttctgtat

SEQ ID NO: 7564440 - DNA, 23 bp, Homo sapiens
agtttttctgcatggttctgtat

SEQ ID NO: 7564441 - DNA, 23 bp, Homo sapiens
agtttttctgcatggttctgtat

SEQ ID NO: 7564442 - DNA, 22 bp, Homo sapiens
agtttttcctgattttacagaa

SEQ ID NO: 7564443 - DNA, 22 bp, Homo sapiens
agtttttctcccctggcttcat

SEQ ID NO: 7564444 - DNA, 22 bp, Homo sapiens
agtttttcctgattttacagaa

SEQ ID NO: 7564445 - DNA, 22 bp, Homo sapiens
agtttttctcccctggcttcat

SEQ ID NO: 7564446 - DNA, 22 bp, Homo sapiens
agtttttctcccctggcttcat

SEQ ID NO: 7564447 - DNA, 22 bp, Homo sapiens
acttccttccaaacattcattt

SEQ ID NO: 7564448 - DNA, 22 bp, Homo sapiens
acttcctgttatgtgtgcctct

SEQ ID NO: 7564449 - DNA, 22 bp, Homo sapiens
acttcctgttatgtgtgcctct

SEQ ID NO: 7564450 - DNA, 22 bp, Homo sapiens
acttcctgtatttatccatagc

SEQ ID NO: 7564451 - DNA, 22 bp, Homo sapiens
acttcctgtaaatagaattcca

SEQ ID NO: 7564452 - DNA, 22 bp, Homo sapiens
acttcctgtaaatagaattcca

SEQ ID NO: 7564453 - DNA, 22 bp, Homo sapiens
acttccttttcaaccatacagc

SEQ ID NO: 7564454 - DNA, 22 bp, Homo sapiens
acttccttttgggaaactgttt

SEQ ID NO: 7564455 - DNA, 22 bp, Homo sapiens
acttccttttgggaaactgttt

SEQ ID NO: 7564456 - DNA, 22 bp, Homo sapiens
acttctaatcagaaggtctggt

SEQ ID NO: 7564457 - DNA, 22 bp, Homo sapiens
acttctaagctcaaattggtat

SEQ ID NO: 7564458 - DNA, 22 bp, Homo sapiens
acttctatgcacagagcttgga

SEQ ID NO: 7564459 - DNA, 22 bp, Homo sapiens
acttctaatcagaaggtctggt

SEQ ID NO: 7564460 - DNA, 22 bp, Homo sapiens
acttctaatcagaaggtctggt

SEQ ID NO: 7564461 - DNA, 18 bp, Homo sapiens
acttctcatttctctgca

SEQ ID NO: 7564462 - DNA, 18 bp, Homo sapiens
acttctcatttctctgca

SEQ ID NO: 7564463 - DNA, 22 bp, Homo sapiens
acttctattggtcatgataaaa

SEQ ID NO: 7564464 - DNA, 22 bp, Homo sapiens
acttctatgccttcctctgttt

SEQ ID NO: 7564465 - DNA, 22 bp, Homo sapiens
acttctattggtcatgataaaa

SEQ ID NO: 7564466 - DNA, 21 bp, Homo sapiens
ataaagttttacaggaatgca

SEQ ID NO: 7564467 - DNA, 22 bp, Homo sapiens
ataaagtttaaaagtcaatagt

SEQ ID NO: 7564468 - DNA, 21 bp, Homo sapiens
ataaagttttacaggaatgca

SEQ ID NO: 7564469 - DNA, 21 bp, Homo sapiens
ataaagttttacaggaatgca

SEQ ID NO: 7564470 - DNA, 21 bp, Homo sapiens
ataaagttttacaggaatgca

SEQ ID NO: 7564471 - DNA, 21 bp, Homo sapiens
ataaagttttacaggaatgca

SEQ ID NO: 7564472 - DNA, 19 bp, Homo sapiens
ataaataaaaagtgggaga

SEQ ID NO: 7564473 - DNA, 19 bp, Homo sapiens
ataaataaaaagtgggaga

SEQ ID NO: 7564474 - DNA, 19 bp, Homo sapiens
ataaataaaaagtgggaga

SEQ ID NO: 7564475 - DNA, 19 bp, Homo sapiens
ataaataaaaagtgggaga

SEQ ID NO: 7564476 - DNA, 19 bp, Homo sapiens
ataaataaaaagtgggaga

SEQ ID NO: 7564477 - DNA, 19 bp, Homo sapiens
ataaataaaaagtgggaga

SEQ ID NO: 7564478 - DNA, 22 bp, Homo sapiens
ataaagtttaaaagtcaatagt

SEQ ID NO: 7564479 - DNA, 22 bp, Homo sapiens
ataaagtttaaaagtcaatagt

SEQ ID NO: 7564480 - DNA, 22 bp, Homo sapiens
ataaagtttaaaagtcaatagt

SEQ ID NO: 7564481 - DNA, 22 bp, Homo sapiens
ataaagtttaaaagtcaatagt

SEQ ID NO: 7564482 - DNA, 22 bp, Homo sapiens
ataaagtttaaaagtcaatagt

SEQ ID NO: 7564483 - DNA, 22 bp, Homo sapiens
ataaagtttaaaagtcaatagt

SEQ ID NO: 7564484 - DNA, 22 bp, Homo sapiens
ataaagtttaaaagtcaatagt

SEQ ID NO: 7564485 - DNA, 22 bp, Homo sapiens
ataaagtggaggtagtattcat

SEQ ID NO: 7564486 - DNA, 22 bp, Homo sapiens
ataaagtggaggtagtattcat

SEQ ID NO: 7564487 - DNA, 22 bp, Homo sapiens
ataaagtggaggtagtattcat

SEQ ID NO: 7564488 - DNA, 22 bp, Homo sapiens
ataaagtggaagtgttaaaggg

SEQ ID NO: 7564489 - DNA, 22 bp, Homo sapiens
ataaagttctgctggcatatat

SEQ ID NO: 7564490 - DNA, 22 bp, Homo sapiens
ataaagttctgctggcatatat

SEQ ID NO: 7564491 - DNA, 22 bp, Homo sapiens
ataaagttctgctggcatatat

SEQ ID NO: 7564492 - DNA, 19 bp, Homo sapiens
ataaataaaaagtgggaga

SEQ ID NO: 7564493 - DNA, 19 bp, Homo sapiens
ataaataaaaagtgggaga

SEQ ID NO: 7564494 - DNA, 22 bp, Homo sapiens
acttccagcaacttggtgctat

SEQ ID NO: 7564495 - DNA, 22 bp, Homo sapiens
acttccagcaacttggtgctat

SEQ ID NO: 7564496 - DNA, 22 bp, Homo sapiens
acttccagcacctcaagcggaa

SEQ ID NO: 7564497 - DNA, 22 bp, Homo sapiens
acttccagcaacttggtgctat

SEQ ID NO: 7564498 - DNA, 22 bp, Homo sapiens
acttccagcaacttggtgctat

SEQ ID NO: 7564499 - DNA, 19 bp, Homo sapiens
ataaataaaaagtgggaga

SEQ ID NO: 7564500 - DNA, 19 bp, Homo sapiens
ataaataaaaagtgggaga

SEQ ID NO: 7564501 - DNA, 22 bp, Homo sapiens
acttccagctaggttctgctaa

SEQ ID NO: 7564502 - DNA, 22 bp, Homo sapiens
acttccagctaggttctgctaa

SEQ ID NO: 7564503 - DNA, 22 bp, Homo sapiens
acttccagctaggttctgctaa

SEQ ID NO: 7564504 - DNA, 22 bp, Homo sapiens
acttccagcccctgtcagcaaa

SEQ ID NO: 7564505 - DNA, 22 bp, Homo sapiens
acttccagcccctgtcagcaaa

SEQ ID NO: 7564506 - DNA, 22 bp, Homo sapiens
acttccagcccctgtcagcaaa

SEQ ID NO: 7564507 - DNA, 22 bp, Homo sapiens
acttccagcacctcaagcggaa

SEQ ID NO: 7564508 - DNA, 22 bp, Homo sapiens
acttccagctaggttctgctaa

SEQ ID NO: 7564509 - DNA, 22 bp, Homo sapiens
acttcctggctgggtgacctgg

SEQ ID NO: 7564510 - DNA, 22 bp, Homo sapiens
actgtttcagtttctgaagttt

SEQ ID NO: 7564511 - DNA, 22 bp, Homo sapiens
actgtttctcaaattatgtggt

SEQ ID NO: 7564512 - DNA, 22 bp, Homo sapiens
actgtttctgccacaatagccc

SEQ ID NO: 7564513 - DNA, 22 bp, Homo sapiens
actgtttctcaaattatgtggt

SEQ ID NO: 7564514 - DNA, 22 bp, Homo sapiens
actgtttatagttttgagctga

SEQ ID NO: 7564515 - DNA, 22 bp, Homo sapiens
actgtttagtaaattgaaatgg

SEQ ID NO: 7564516 - DNA, 22 bp, Homo sapiens
actgtttcaggcaaggcaggcc

SEQ ID NO: 7564517 - DNA, 22 bp, Homo sapiens
actgtttcaggcaaggcaggcc

SEQ ID NO: 7564518 - DNA, 22 bp, Homo sapiens
actgtttatagttttgagctga

SEQ ID NO: 7564519 - DNA, 22 bp, Homo sapiens
actgtttagtaaattgaaatgg

SEQ ID NO: 7564520 - DNA, 22 bp, Homo sapiens
actgtttagtaaattgaaatgg

SEQ ID NO: 7564521 - DNA, 22 bp, Homo sapiens
actgtttagtaaattgaaatgg

SEQ ID NO: 7564522 - DNA, 22 bp, Homo sapiens
actgtttctgccacaatagccc

SEQ ID NO: 7564523 - DNA, 22 bp, Homo sapiens
actgtttgctgatagatattta

SEQ ID NO: 7564524 - DNA, 22 bp, Homo sapiens
actgtttgctgatagatattta

SEQ ID NO: 7564525 - DNA, 22 bp, Homo sapiens
actgttttcctaatgagcaaga

SEQ ID NO: 7564526 - DNA, 22 bp, Homo sapiens
actgttttcctaatgagcaaga

SEQ ID NO: 7564527 - DNA, 22 bp, Homo sapiens
actgttttcctaatgagcaaga

SEQ ID NO: 7564528 - DNA, 22 bp, Homo sapiens
actgttttctgtaaagggccag

SEQ ID NO: 7564529 - DNA, 22 bp, Homo sapiens
actgttttctgtaaagggccag

SEQ ID NO: 7564530 - DNA, 22 bp, Homo sapiens
actgttttctgtaaagggccag

SEQ ID NO: 7564531 - DNA, 22 bp, Homo sapiens
actgttttctgtaaagggccag

SEQ ID NO: 7564532 - DNA, 22 bp, Homo sapiens
actgttttctgtaaagggccag

SEQ ID NO: 7564533 - DNA, 22 bp, Homo sapiens
acttaaaaagaatcttttcacg

SEQ ID NO: 7564534 - DNA, 22 bp, Homo sapiens
acttaaaaagaatcttttcacg

SEQ ID NO: 7564535 - DNA, 22 bp, Homo sapiens
acttaaaaagaatcttttcacg

SEQ ID NO: 7564536 - DNA, 22 bp, Homo sapiens
acttaaaaagaatcttttcacg

SEQ ID NO: 7564537 - DNA, 22 bp, Homo sapiens
acttaaaaagaatcttttcacg

SEQ ID NO: 7564538 - DNA, 22 bp, Homo sapiens
acttaaaaagaatcttttcacg

SEQ ID NO: 7564539 - DNA, 22 bp, Homo sapiens
acttaaaaacagatccagcagg

SEQ ID NO: 7564540 - DNA, 22 bp, Homo sapiens
acttaaaaacagatccagcagg

SEQ ID NO: 7564541 - DNA, 22 bp, Homo sapiens
acttaaaaacagatccagcagg

SEQ ID NO: 7564542 - DNA, 22 bp, Homo sapiens
acttaaaaacagatccagcagg

SEQ ID NO: 7564543 - DNA, 22 bp, Homo sapiens
acttaaaaacagatccagcagg

SEQ ID NO: 7564544 - DNA, 22 bp, Homo sapiens
actgttttgtgccttagtttcc

SEQ ID NO: 7564545 - DNA, 22 bp, Homo sapiens
acttaaaaacagatccagcagg

SEQ ID NO: 7564546 - DNA, 22 bp, Homo sapiens
actgttttgtgccttagtttcc

SEQ ID NO: 7564547 - DNA, 22 bp, Homo sapiens
acttaaaaacagatccagcagg

SEQ ID NO: 7564548 - DNA, 22 bp, Homo sapiens
actgttttctgtaaagggccag

SEQ ID NO: 7564549 - DNA, 22 bp, Homo sapiens
actgttttcttagctccctgct

SEQ ID NO: 7564550 - DNA, 22 bp, Homo sapiens
actgttttctgtaaagggccag

SEQ ID NO: 7564551 - DNA, 18 bp, Homo sapiens
ataaagtgctaataatgg

SEQ ID NO: 7564552 - DNA, 18 bp, Homo sapiens
ataaagtgctaataatgg

SEQ ID NO: 7564553 - DNA, 22 bp, Homo sapiens
ataaagtctgggccaggcatgg

SEQ ID NO: 7564554 - DNA, 18 bp, Homo sapiens
ataaagtgctaataatgg

SEQ ID NO: 7564555 - DNA, 18 bp, Homo sapiens
ataaagtgctaataatgg

SEQ ID NO: 7564556 - DNA, 18 bp, Homo sapiens
ataaagtgctaataatgg

SEQ ID NO: 7564557 - DNA, 18 bp, Homo sapiens
ataaagtgctaataatgg

SEQ ID NO: 7564558 - DNA, 22 bp, Homo sapiens
ataaagtcaaggcattttatga

SEQ ID NO: 7564559 - DNA, 22 bp, Homo sapiens
ataaagtcaaggcattttatga

SEQ ID NO: 7564560 - DNA, 22 bp, Homo sapiens
ataaagtcaaggcattttatga

SEQ ID NO: 7564561 - DNA, 22 bp, Homo sapiens
ataaagtcatggcagctagaat

SEQ ID NO: 7564562 - DNA, 22 bp, Homo sapiens
ataaagtcatggcagctagaat

SEQ ID NO: 7564563 - DNA, 22 bp, Homo sapiens
ataaagtcattatgaagatcta

SEQ ID NO: 7564564 - DNA, 22 bp, Homo sapiens
ataaagtctaccgtattaaaga

SEQ ID NO: 7564565 - DNA, 22 bp, Homo sapiens
acttaaaaagaatcttttcacg

SEQ ID NO: 7564566 - DNA, 22 bp, Homo sapiens
acttaaaaagaatcttttcacg

SEQ ID NO: 7564567 - DNA, 22 bp, Homo sapiens
acttaaaaagaatcttttcacg

SEQ ID NO: 7564568 - DNA, 22 bp, Homo sapiens
acttaaaaccagacagcgtcat

SEQ ID NO: 7564569 - DNA, 22 bp, Homo sapiens
acttaaaaccagacagcgtcat

SEQ ID NO: 7564570 - DNA, 22 bp, Homo sapiens
acttaaaaccagacagcgtcat

SEQ ID NO: 7564571 - DNA, 22 bp, Homo sapiens
ataaagtagctttcagtgccaa

SEQ ID NO: 7564572 - DNA, 22 bp, Homo sapiens
ataaagtcaaggcattttatga

SEQ ID NO: 7564573 - DNA, 22 bp, Homo sapiens
ataaagtagctttcagtgccaa

SEQ ID NO: 7564574 - DNA, 19 bp, Homo sapiens
acttaaacctagaaaatgc

SEQ ID NO: 7564575 - DNA, 22 bp, Homo sapiens
acttaaagaggctacttttggt

SEQ ID NO: 7564576 - DNA, 22 bp, Homo sapiens
acttaaaggttagctattctac

SEQ ID NO: 7564577 - DNA, 22 bp, Homo sapiens
acttaaaggttagctattctac

SEQ ID NO: 7564578 - DNA, 22 bp, Homo sapiens
acttaaagtagttttactgtgg

SEQ ID NO: 7564579 - DNA, 22 bp, Homo sapiens
acttaaagtagttttactgtgg

SEQ ID NO: 7564580 - DNA, 22 bp, Homo sapiens
agaacatagatacctaagacag

SEQ ID NO: 7564581 - DNA, 22 bp, Homo sapiens
agaacatagatacctaagacag

SEQ ID NO: 7564582 - DNA, 22 bp, Homo sapiens
agaacatatctgttttctaact

SEQ ID NO: 7564583 - DNA, 22 bp, Homo sapiens
agaacatagtggactttggcaa

SEQ ID NO: 7564584 - DNA, 22 bp, Homo sapiens
agaacatatctgttttctaact

SEQ ID NO: 7564585 - DNA, 22 bp, Homo sapiens
agaacatatctgttttctaact

SEQ ID NO: 7564586 - DNA, 22 bp, Homo sapiens
agaacatatctgttttctaact

SEQ ID NO: 7564587 - DNA, 22 bp, Homo sapiens
agaacatatctgttttctaact

SEQ ID NO: 7564588 - DNA, 22 bp, Homo sapiens
agaacatatctgttttctaact

SEQ ID NO: 7564589 - DNA, 22 bp, Homo sapiens
agaacatatctgttttctaact

SEQ ID NO: 7564590 - DNA, 22 bp, Homo sapiens
agaacatatctgttttctaact

SEQ ID NO: 7564591 - DNA, 22 bp, Homo sapiens
agaacataattatcataaactg

SEQ ID NO: 7564592 - DNA, 22 bp, Homo sapiens
agaacataattatcataaactg

SEQ ID NO: 7564593 - DNA, 22 bp, Homo sapiens
agaacataattatcataaactg

SEQ ID NO: 7564594 - DNA, 22 bp, Homo sapiens
agaacataattatcataaactg

SEQ ID NO: 7564595 - DNA, 22 bp, Homo sapiens
agaacataattatcataaactg

SEQ ID NO: 7564596 - DNA, 22 bp, Homo sapiens
agaacatagatacctaagacag

SEQ ID NO: 7564597 - DNA, 22 bp, Homo sapiens
agaacatagatacctaagacag

SEQ ID NO: 7564598 - DNA, 22 bp, Homo sapiens
agaacagtcgtggtgagagaaa

SEQ ID NO: 7564599 - DNA, 23 bp, Homo sapiens
agaacagtgactaatatagagag

SEQ ID NO: 7564600 - DNA, 22 bp, Homo sapiens
agaacagtgctgataaatcata

SEQ ID NO: 7564601 - DNA, 22 bp, Homo sapiens
agaacagtgctgataaatcata

SEQ ID NO: 7564602 - DNA, 22 bp, Homo sapiens
agaacagtttgttggagactgt

SEQ ID NO: 7564603 - DNA, 22 bp, Homo sapiens
agaacagtttgttggagactgt

SEQ ID NO: 7564604 - DNA, 22 bp, Homo sapiens
atcccattcccataagtggaaa

SEQ ID NO: 7564605 - DNA, 22 bp, Homo sapiens
atcccatttcctagtacatcat

SEQ ID NO: 7564606 - DNA, 22 bp, Homo sapiens
atcccatttcctgttttgtcaa

SEQ ID NO: 7564607 - DNA, 22 bp, Homo sapiens
atccccaagccaaggcctgagg

SEQ ID NO: 7564608 - DNA, 22 bp, Homo sapiens
atccccacgatatagccaaagc

SEQ ID NO: 7564609 - DNA, 22 bp, Homo sapiens
atccccagaaaataggtgccta

SEQ ID NO: 7564610 - DNA, 22 bp, Homo sapiens
atccccactgctgctggtgtag

SEQ ID NO: 7564611 - DNA, 22 bp, Homo sapiens
atccccactgctgctggtgtag

SEQ ID NO: 7564612 - DNA, 22 bp, Homo sapiens
atccccagaaaataggtgccta

SEQ ID NO: 7564613 - DNA, 22 bp, Homo sapiens
atccccagaaaataggtgccta

SEQ ID NO: 7564614 - DNA, 22 bp, Homo sapiens
agaacagtcgtggtgagagaaa

SEQ ID NO: 7564615 - DNA, 22 bp, Homo sapiens
agaacagtcgtggtgagagaaa

SEQ ID NO: 7564616 - DNA, 22 bp, Homo sapiens
atccccagaaaataggtgccta

SEQ ID NO: 7564617 - DNA, 22 bp, Homo sapiens
atccccagaaagaccgatgtac

SEQ ID NO: 7564618 - DNA, 22 bp, Homo sapiens
agaacagggactggaggcttca

SEQ ID NO: 7564619 - DNA, 22 bp, Homo sapiens
atctcaggccctagtgacctca

SEQ ID NO: 7564620 - DNA, 22 bp, Homo sapiens
atctcaggaggttcctctgtcc

SEQ ID NO: 7564621 - DNA, 22 bp, Homo sapiens
atctcaggaggttcctctgtcc

SEQ ID NO: 7564622 - DNA, 22 bp, Homo sapiens
agaacctcaattatttttgcac

SEQ ID NO: 7564623 - DNA, 22 bp, Homo sapiens
agaacctcaattatttttgcac

SEQ ID NO: 7564624 - DNA, 20 bp, Homo sapiens
agaacctaagttaaaacaca

SEQ ID NO: 7564625 - DNA, 22 bp, Homo sapiens
agaaccctatctttctgaggtt

SEQ ID NO: 7564626 - DNA, 20 bp, Homo sapiens
agaacctaagttaaaacaca

SEQ ID NO: 7564627 - DNA, 22 bp, Homo sapiens
atctcagggctggagccctgga

SEQ ID NO: 7564628 - DNA, 22 bp, Homo sapiens
atctcaggccctagtgacctca

SEQ ID NO: 7564629 - DNA, 22 bp, Homo sapiens
atctcagggctggagccctgga

SEQ ID NO: 7564630 - DNA, 22 bp, Homo sapiens
atctcaggggttccttctagag

SEQ ID NO: 7564631 - DNA, 22 bp, Homo sapiens
atctcaggggttccttctagag

SEQ ID NO: 7564632 - DNA, 22 bp, Homo sapiens
atctctggcaatgcagcatcgt

SEQ ID NO: 7564633 - DNA, 22 bp, Homo sapiens
atctctggcaatgcagcatcgt

SEQ ID NO: 7564634 - DNA, 22 bp, Homo sapiens
atctctggcccctggggtccga

SEQ ID NO: 7564635 - DNA, 22 bp, Homo sapiens
agaacatttgtcaaaaagccaa

SEQ ID NO: 7564636 - DNA, 22 bp, Homo sapiens
agaacattaatgcgaggtatta

SEQ ID NO: 7564637 - DNA, 22 bp, Homo sapiens
agaacatttgtcgatcaatttg

SEQ ID NO: 7564638 - DNA, 22 bp, Homo sapiens
agaacatttgtcgatcaatttg

SEQ ID NO: 7564639 - DNA, 22 bp, Homo sapiens
agaacattaatgcgaggtatta

SEQ ID NO: 7564640 - DNA, 22 bp, Homo sapiens
agaacatggattgtcaaaggta

SEQ ID NO: 7564641 - DNA, 22 bp, Homo sapiens
agaacatctgaagatacaaagt

SEQ ID NO: 7564642 - DNA, 22 bp, Homo sapiens
agaacatctgaagatacaaagt

SEQ ID NO: 7564643 - DNA, 22 bp, Homo sapiens
agaacatggattgtcaaaggta

SEQ ID NO: 7564644 - DNA, 21 bp, Homo sapiens
agaacccagcagcactgttct

SEQ ID NO: 7564645 - DNA, 22 bp, Homo sapiens
agaaccattttgacagatatac

SEQ ID NO: 7564646 - DNA, 19 bp, Homo sapiens
agaaccactgctctcttca

SEQ ID NO: 7564647 - DNA, 22 bp, Homo sapiens
agaaccagctagtcttgctttt

SEQ ID NO: 7564648 - DNA, 22 bp, Homo sapiens
agaaccagtttaagatttgggt

SEQ ID NO: 7564649 - DNA, 22 bp, Homo sapiens
agaacatttgtcgatcaatttg

SEQ ID NO: 7564650 - DNA, 19 bp, Homo sapiens
agaaccactgctctcttca

SEQ ID NO: 7564651 - DNA, 22 bp, Homo sapiens
atcccagagaataatgatcagg

SEQ ID NO: 7564652 - DNA, 22 bp, Homo sapiens
atcccagagaataatgatcagg

SEQ ID NO: 7564653 - DNA, 16 bp, Homo sapiens
atcccagaggctagag

SEQ ID NO: 7564654 - DNA, 22 bp, Homo sapiens
atcccagatagtgaccctcagg

SEQ ID NO: 7564655 - DNA, 23 bp, Homo sapiens
atcccacttcccttatagtttct

SEQ ID NO: 7564656 - DNA, 23 bp, Homo sapiens
atcccacttcccttatagtttct

SEQ ID NO: 7564657 - DNA, 22 bp, Homo sapiens
atcccagagaataatgatcagg

SEQ ID NO: 7564658 - DNA, 22 bp, Homo sapiens
atcccacacccctacaacatat

SEQ ID NO: 7564659 - DNA, 22 bp, Homo sapiens
atcccacacccctacaacatat

SEQ ID NO: 7564660 - DNA, 22 bp, Homo sapiens
atcccacacccctacaacatat

SEQ ID NO: 7564661 - DNA, 22 bp, Homo sapiens
atcccacctcaatctgaagctc

SEQ ID NO: 7564662 - DNA, 22 bp, Homo sapiens
atccatttttgcaaagttgttc

SEQ ID NO: 7564663 - DNA, 22 bp, Homo sapiens
atccatttttgcaaagttgttc

SEQ ID NO: 7564664 - DNA, 22 bp, Homo sapiens
atccattttttcagaatgctct

SEQ ID NO: 7564665 - DNA, 22 bp, Homo sapiens
atccattttttcagaatgctct

SEQ ID NO: 7564666 - DNA, 19 bp, Homo sapiens
atcccaaggagctgggact

SEQ ID NO: 7564667 - DNA, 22 bp, Homo sapiens
atcccaagtagcaatcctggta

SEQ ID NO: 7564668 - DNA, 22 bp, Homo sapiens
atcccaagtagcaatcctggta

SEQ ID NO: 7564669 - DNA, 22 bp, Homo sapiens
atcccacacccctacaacatat

SEQ ID NO: 7564670 - DNA, 22 bp, Homo sapiens
atcccaagctctacaagtgatt

SEQ ID NO: 7564671 - DNA, 22 bp, Homo sapiens
atcccatttcctagtacatcat

SEQ ID NO: 7564672 - DNA, 22 bp, Homo sapiens
atcccattcccataagtggaaa

SEQ ID NO: 7564673 - DNA, 22 bp, Homo sapiens
atcccatagggttatcataggg

SEQ ID NO: 7564674 - DNA, 22 bp, Homo sapiens
atcccaggggttgtatcttccc

SEQ ID NO: 7564675 - DNA, 22 bp, Homo sapiens
atcccaggcggcacaggttgca

SEQ ID NO: 7564676 - DNA, 22 bp, Homo sapiens
atcccaggcggcacaggttgca

SEQ ID NO: 7564677 - DNA, 22 bp, Homo sapiens
atcccaggggttgtatcttccc

SEQ ID NO: 7564678 - DNA, 22 bp, Homo sapiens
atcccaggaggctgcgcagtta

SEQ ID NO: 7564679 - DNA, 22 bp, Homo sapiens
atcccaggaggctgcgcagtta

SEQ ID NO: 7564680 - DNA, 21 bp, Homo sapiens
atcccagcacccaggagtgca

SEQ ID NO: 7564681 - DNA, 21 bp, Homo sapiens
atcccagcacccaggagtgca

SEQ ID NO: 7564682 - DNA, 21 bp, Homo sapiens
atcccagcacccaggagtgca

SEQ ID NO: 7564683 - DNA, 22 bp, Homo sapiens
atcccagatggaggctggtcac

SEQ ID NO: 7564684 - DNA, 22 bp, Homo sapiens
atcccagatagtgaccctcagg

SEQ ID NO: 7564685 - DNA, 22 bp, Homo sapiens
atcccagatggaggctggtcac

SEQ ID NO: 7564686 - DNA, 19 bp, Homo sapiens
agaaatctcgagatttgtt

SEQ ID NO: 7564687 - DNA, 22 bp, Homo sapiens
agaaatcttatcaagaaatgcc

SEQ ID NO: 7564688 - DNA, 22 bp, Homo sapiens
atccaggaaggatggcattgag

SEQ ID NO: 7564689 - DNA, 22 bp, Homo sapiens
agaaatctgactgctgtgcaca

SEQ ID NO: 7564690 - DNA, 22 bp, Homo sapiens
agaaatcttatcaagaaatgcc

SEQ ID NO: 7564691 - DNA, 22 bp, Homo sapiens
agaaatctgactgctgtgcaca

SEQ ID NO: 7564692 - DNA, 22 bp, Homo sapiens
agaaatcttatcaagaaatgcc

SEQ ID NO: 7564693 - DNA, 22 bp, Homo sapiens
agaaatcttatcaagaaatgcc

SEQ ID NO: 7564694 - DNA, 22 bp, Homo sapiens
atccaggagtcgtggcgctcag

SEQ ID NO: 7564695 - DNA, 22 bp, Homo sapiens
atccaggagtcgtggcgctcag

SEQ ID NO: 7564696 - DNA, 22 bp, Homo sapiens
atccaggagggctgactcctta

SEQ ID NO: 7564697 - DNA, 20 bp, Homo sapiens
atccaggatgttgatttgaa

SEQ ID NO: 7564698 - DNA, 20 bp, Homo sapiens
atccaggatgttgatttgaa

SEQ ID NO: 7564699 - DNA, 22 bp, Homo sapiens
atccattttccttggcagcagg

SEQ ID NO: 7564700 - DNA, 22 bp, Homo sapiens
atccattttaactgttagtgca

SEQ ID NO: 7564701 - DNA, 22 bp, Homo sapiens
atccattttaactgttagtgca

SEQ ID NO: 7564702 - DNA, 22 bp, Homo sapiens
agaaatctattatttcagagtt

SEQ ID NO: 7564703 - DNA, 22 bp, Homo sapiens
agaaatctattatttcagagtt

SEQ ID NO: 7564704 - DNA, 22 bp, Homo sapiens
agaaatctattatttcagagtt

SEQ ID NO: 7564705 - DNA, 22 bp, Homo sapiens
agaaatctattatttcagagtt

SEQ ID NO: 7564706 - DNA, 22 bp, Homo sapiens
agaaatctcagtatctcaggga

SEQ ID NO: 7564707 - DNA, 19 bp, Homo sapiens
agaaatctcgagatttgtt

SEQ ID NO: 7564708 - DNA, 19 bp, Homo sapiens
agaaatctcgagatttgtt

SEQ ID NO: 7564709 - DNA, 22 bp, Homo sapiens
agaaatctctagcacatcgaat

SEQ ID NO: 7564710 - DNA, 22 bp, Homo sapiens
agaaatctctagcacatcgaat

SEQ ID NO: 7564711 - DNA, 22 bp, Homo sapiens
agaaatctctagcacatcgaat

SEQ ID NO: 7564712 - DNA, 22 bp, Homo sapiens
agaaatctgactgctgtgcaca

SEQ ID NO: 7564713 - DNA, 22 bp, Homo sapiens
agaaatctgactgctgtgcaca

SEQ ID NO: 7564714 - DNA, 22 bp, Homo sapiens
agaaatctgactgctgtgcaca

SEQ ID NO: 7564715 - DNA, 22 bp, Homo sapiens
agaaatctaagatgctcaagga

SEQ ID NO: 7564716 - DNA, 22 bp, Homo sapiens
agaaatctaagatgctcaagga

SEQ ID NO: 7564717 - DNA, 22 bp, Homo sapiens
agaaatctatgttttggttaga

SEQ ID NO: 7564718 - DNA, 22 bp, Homo sapiens
agaaatctatgttttggttaga

SEQ ID NO: 7564719 - DNA, 22 bp, Homo sapiens
agaaatctatgttttggttaga

SEQ ID NO: 7564720 - DNA, 22 bp, Homo sapiens
agaaatcattgaattatttgct

SEQ ID NO: 7564721 - DNA, 22 bp, Homo sapiens
agaaatcccaaggcatcaacca

SEQ ID NO: 7564722 - DNA, 22 bp, Homo sapiens
agaaatcattttaggcttgatg

SEQ ID NO: 7564723 - DNA, 22 bp, Homo sapiens
agaagccaacagggcaggagag

SEQ ID NO: 7564724 - DNA, 22 bp, Homo sapiens
atctctttgatggctcctgtga

SEQ ID NO: 7564725 - DNA, 22 bp, Homo sapiens
atctctttgatggctcctgtga

SEQ ID NO: 7564726 - DNA, 22 bp, Homo sapiens
agaagccaacagggcaggagag

SEQ ID NO: 7564727 - DNA, 22 bp, Homo sapiens
agaagccaacagggcaggagag

SEQ ID NO: 7564728 - DNA, 22 bp, Homo sapiens
agaagccaagaacagacagtgc

SEQ ID NO: 7564729 - DNA, 20 bp, Homo sapiens
agaagccaagtgacatgttt

SEQ ID NO: 7564730 - DNA, 20 bp, Homo sapiens
agaagccaagtgacatgttt

SEQ ID NO: 7564731 - DNA, 22 bp, Homo sapiens
agaagccaatcagctctctgct

SEQ ID NO: 7564732 - DNA, 22 bp, Homo sapiens
agaagccaatcagctctctgct

SEQ ID NO: 7564733 - DNA, 22 bp, Homo sapiens
agaagccaatcagctctctgct

SEQ ID NO: 7564734 - DNA, 20 bp, Homo sapiens
agaagccaagtgacatgttt

SEQ ID NO: 7564735 - DNA, 22 bp, Homo sapiens
agaagccaatcagctctctgct

SEQ ID NO: 7564736 - DNA, 22 bp, Homo sapiens
agaagccacaggcctcgtctgg

SEQ ID NO: 7564737 - DNA, 22 bp, Homo sapiens
agaagccacaggaaagcagctt

SEQ ID NO: 7564738 - DNA, 22 bp, Homo sapiens
agaagccacaggaaagcagctt

SEQ ID NO: 7564739 - DNA, 22 bp, Homo sapiens
agaagccaattctgtgtgagtc

SEQ ID NO: 7564740 - DNA, 22 bp, Homo sapiens
agaagccacaggaaagcagctt

SEQ ID NO: 7564741 - DNA, 22 bp, Homo sapiens
agaagccaattctgtgtgagtc

SEQ ID NO: 7564742 - DNA, 22 bp, Homo sapiens
agaagccaattctgtgtgagtc

SEQ ID NO: 7564743 - DNA, 22 bp, Homo sapiens
agaagccaatccttgtctctct

SEQ ID NO: 7564744 - DNA, 22 bp, Homo sapiens
agaagccaatccttgtctctct

SEQ ID NO: 7564745 - DNA, 22 bp, Homo sapiens
agaagccaatccttgtctctct

SEQ ID NO: 7564746 - DNA, 22 bp, Homo sapiens
agaagccaatccttgtctctct

SEQ ID NO: 7564747 - DNA, 22 bp, Homo sapiens
agaagccaatcagctctctgct

SEQ ID NO: 7564748 - DNA, 22 bp, Homo sapiens
agaagccaatccttgtctctct

SEQ ID NO: 7564749 - DNA, 22 bp, Homo sapiens
agaagccaatccttgtctctct

SEQ ID NO: 7564750 - DNA, 22 bp, Homo sapiens
agaagccaattctgtgtgagtc

SEQ ID NO: 7564751 - DNA, 22 bp, Homo sapiens
agaagccaatccttgtctctct

SEQ ID NO: 7564752 - DNA, 22 bp, Homo sapiens
atctcttctagctctgaaatta

SEQ ID NO: 7564753 - DNA, 21 bp, Homo sapiens
atctcttcaaggctgatttac

SEQ ID NO: 7564754 - DNA, 22 bp, Homo sapiens
atctcttcccaactccacattc

SEQ ID NO: 7564755 - DNA, 22 bp, Homo sapiens
atctcttcccaactccacattc

SEQ ID NO: 7564756 - DNA, 21 bp, Homo sapiens
atctcttcaaggctgatttac

SEQ ID NO: 7564757 - DNA, 22 bp, Homo sapiens
atctctttgatggctcctgtga

SEQ ID NO: 7564758 - DNA, 22 bp, Homo sapiens
atctcttctcccaacacctggc

SEQ ID NO: 7564759 - DNA, 22 bp, Homo sapiens
atctctgtaaaccataaattga

SEQ ID NO: 7564760 - DNA, 22 bp, Homo sapiens
atctctggttgttttgctccca

SEQ ID NO: 7564761 - DNA, 22 bp, Homo sapiens
atctctgtaaaccataaattga

SEQ ID NO: 7564762 - DNA, 22 bp, Homo sapiens
atctctgtaattacatgatatt

SEQ ID NO: 7564763 - DNA, 22 bp, Homo sapiens
atctctgttttaggagatagtg

SEQ ID NO: 7564764 - DNA, 22 bp, Homo sapiens
atctctgtgccatcattgcccc

SEQ ID NO: 7564765 - DNA, 22 bp, Homo sapiens
atctctgtaattacatgatatt

SEQ ID NO: 7564766 - DNA, 22 bp, Homo sapiens
atctctggcccctggggtccga

SEQ ID NO: 7564767 - DNA, 22 bp, Homo sapiens
atctcagggctggagccctgga

SEQ ID NO: 7564768 - DNA, 22 bp, Homo sapiens
atctctggccttccttttccaa

SEQ ID NO: 7564769 - DNA, 22 bp, Homo sapiens
atctctggccttccttttccaa

SEQ ID NO: 7564770 - DNA, 22 bp, Homo sapiens
atctctgggctttgagtttgtt

SEQ ID NO: 7564771 - DNA, 22 bp, Homo sapiens
atctctgggtccatagaagaga

SEQ ID NO: 7564772 - DNA, 22 bp, Homo sapiens
atctctggtccaaatgttacct

SEQ ID NO: 7564773 - DNA, 22 bp, Homo sapiens
atctctgggtccatagaagaga

SEQ ID NO: 7564774 - DNA, 22 bp, Homo sapiens
atctctggttgttttgctccca

SEQ ID NO: 7564775 - DNA, 22 bp, Homo sapiens
agaaggagtgtacaggtcatgc

SEQ ID NO: 7564776 - DNA, 22 bp, Homo sapiens
agaaggagtgtacaggtcatgc

SEQ ID NO: 7564777 - DNA, 22 bp, Homo sapiens
agaagctgtggtatgaaatgtg

SEQ ID NO: 7564778 - DNA, 22 bp, Homo sapiens
agaagctgtggtatgaaatgtg

SEQ ID NO: 7564779 - DNA, 22 bp, Homo sapiens
agaaggagtgtacaggtcatgc

SEQ ID NO: 7564780 - DNA, 22 bp, Homo sapiens
agaagccacaggcctcgtctgg

SEQ ID NO: 7564781 - DNA, 22 bp, Homo sapiens
agaagccacaggcctcgtctgg

SEQ ID NO: 7564782 - DNA, 22 bp, Homo sapiens
agaagccacaggcctcgtctgg

SEQ ID NO: 7564783 - DNA, 22 bp, Homo sapiens
agaagccacaggcctcgtctgg

SEQ ID NO: 7564784 - DNA, 22 bp, Homo sapiens
agaagccacaggaaagcagctt

SEQ ID NO: 7564785 - DNA, 23 bp, Homo sapiens
agaagctgggagcctggggatgg

SEQ ID NO: 7564786 - DNA, 22 bp, Homo sapiens
agaagctgtggtatgaaatgtg

SEQ ID NO: 7564787 - DNA, 19 bp, Homo sapiens
agaagctgtgaaatgaagg

SEQ ID NO: 7564788 - DNA, 23 bp, Homo sapiens
agaagctgggagcctggggatgg

SEQ ID NO: 7564789 - DNA, 19 bp, Homo sapiens
agaagctgtgaaatgaagg

SEQ ID NO: 7564790 - DNA, 19 bp, Homo sapiens
agaagctgtgaaatgaagg

SEQ ID NO: 7564791 - DNA, 22 bp, Homo sapiens
agaaggcaccgtggccaatatt

SEQ ID NO: 7564792 - DNA, 22 bp, Homo sapiens
agaaggcaccgtggccaatatt

SEQ ID NO: 7564793 - DNA, 22 bp, Homo sapiens
agaaggcaccgtggccaatatt

SEQ ID NO: 7564794 - DNA, 22 bp, Homo sapiens
agaaggcaccgtggccaatatt

SEQ ID NO: 7564795 - DNA, 22 bp, Homo sapiens
agaaggcaccgtggccaatatt

SEQ ID NO: 7564796 - DNA, 22 bp, Homo sapiens
agaaggcaccgtggccaatatt

SEQ ID NO: 7564797 - DNA, 21 bp, Homo sapiens
agaaggcaccagcaaggactg

SEQ ID NO: 7564798 - DNA, 21 bp, Homo sapiens
agaaggcaccagcaaggactg

SEQ ID NO: 7564799 - DNA, 21 bp, Homo sapiens
agaaggcaccagcaaggactg

SEQ ID NO: 7564800 - DNA, 21 bp, Homo sapiens
agaaggcaaaagcagacatct

SEQ ID NO: 7564801 - DNA, 22 bp, Homo sapiens
agaaggcacagtgctgctaaga

SEQ ID NO: 7564802 - DNA, 22 bp, Homo sapiens
agaaggcacagtgctgctaaga

SEQ ID NO: 7564803 - DNA, 22 bp, Homo sapiens
agaaggcacagtgctgctaaga

SEQ ID NO: 7564804 - DNA, 22 bp, Homo sapiens
agaaggcacagtgctgctaaga

SEQ ID NO: 7564805 - DNA, 21 bp, Homo sapiens
agaaggcaaaagcagacatct

SEQ ID NO: 7564806 - DNA, 21 bp, Homo sapiens
agaaggcaaaagcagacatct

SEQ ID NO: 7564807 - DNA, 21 bp, Homo sapiens
agaaggcaaaagcagacatct

SEQ ID NO: 7564808 - DNA, 21 bp, Homo sapiens
agaaggcaaaagcagacatct

SEQ ID NO: 7564809 - DNA, 22 bp, Homo sapiens
agaaggagtgtacaggtcatgc

SEQ ID NO: 7564810 - DNA, 22 bp, Homo sapiens
atctgccaatgccatgagaaga

SEQ ID NO: 7564811 - DNA, 22 bp, Homo sapiens
atctgcatttgaacaagctcct

SEQ ID NO: 7564812 - DNA, 22 bp, Homo sapiens
atctgccaatgccatgagaaga

SEQ ID NO: 7564813 - DNA, 22 bp, Homo sapiens
atctgccaagagaacgtgggtc

SEQ ID NO: 7564814 - DNA, 22 bp, Homo sapiens
agaaggcatcagaagtgtgtag

SEQ ID NO: 7564815 - DNA, 22 bp, Homo sapiens
atctgcccatctgtcctgcttc

SEQ ID NO: 7564816 - DNA, 22 bp, Homo sapiens
atctgccaatgccatgagaaga

SEQ ID NO: 7564817 - DNA, 22 bp, Homo sapiens
atctgccaatgccatgagaaga

SEQ ID NO: 7564818 - DNA, 22 bp, Homo sapiens
atctgccccagtgatgggccat

SEQ ID NO: 7564819 - DNA, 22 bp, Homo sapiens
atctgcccttgattgccctagg

SEQ ID NO: 7564820 - DNA, 22 bp, Homo sapiens
agaaggcatcagaagtgtgtag

SEQ ID NO: 7564821 - DNA, 22 bp, Homo sapiens
agaaggcatcagaagtgtgtag

SEQ ID NO: 7564822 - DNA, 22 bp, Homo sapiens
agaaggcatcagaagtgtgtag

SEQ ID NO: 7564823 - DNA, 22 bp, Homo sapiens
agaaggcatagaccggattatg

SEQ ID NO: 7564824 - DNA, 22 bp, Homo sapiens
agaaggcaggttttaaaatgtc

SEQ ID NO: 7564825 - DNA, 22 bp, Homo sapiens
agaaggcaggttttaaaatgtc

SEQ ID NO: 7564826 - DNA, 22 bp, Homo sapiens
agaaggcaggttttaaaatgtc

SEQ ID NO: 7564827 - DNA, 22 bp, Homo sapiens
agaaggcaggttttaaaatgtc

SEQ ID NO: 7564828 - DNA, 20 bp, Homo sapiens
agaaggcaggagacaaaagg

SEQ ID NO: 7564829 - DNA, 20 bp, Homo sapiens
agaaggcaggagacaaaagg

SEQ ID NO: 7564830 - DNA, 20 bp, Homo sapiens
agaaggcaggagacaaaagg

SEQ ID NO: 7564831 - DNA, 22 bp, Homo sapiens
agaaggcagaaagtccaggtat

SEQ ID NO: 7564832 - DNA, 22 bp, Homo sapiens
agaaggcagaaagtccaggtat

SEQ ID NO: 7564833 - DNA, 22 bp, Homo sapiens
agaaggcactcacactggcacg

SEQ ID NO: 7564834 - DNA, 22 bp, Homo sapiens
agaaggcactcacactggcacg

SEQ ID NO: 7564835 - DNA, 22 bp, Homo sapiens
agaaggcactcacactggcacg

SEQ ID NO: 7564836 - DNA, 22 bp, Homo sapiens
agaaggcactcacactggcacg

SEQ ID NO: 7564837 - DNA, 22 bp, Homo sapiens
agaaggcagatgggacggagca

SEQ ID NO: 7564838 - DNA, 22 bp, Homo sapiens
agaaggcagatgggacggagca

SEQ ID NO: 7564839 - DNA, 22 bp, Homo sapiens
agaaggcagatgggacggagca

SEQ ID NO: 7564840 - DNA, 22 bp, Homo sapiens
agaaggcagatgggacggagca

SEQ ID NO: 7564841 - DNA, 22 bp, Homo sapiens
agaaggcagatgggacggagca

SEQ ID NO: 7564842 - DNA, 22 bp, Homo sapiens
agaaggcagatgggacggagca

SEQ ID NO: 7564843 - DNA, 22 bp, Homo sapiens
agaaggcagatgggacggagca

SEQ ID NO: 7564844 - DNA, 22 bp, Homo sapiens
agaaggcagatgggacggagca

SEQ ID NO: 7564845 - DNA, 21 bp, Homo sapiens
agaaaaaccagcatgttttca

SEQ ID NO: 7564846 - DNA, 21 bp, Homo sapiens
agaaaaaccagcatgttttca

SEQ ID NO: 7564847 - DNA, 21 bp, Homo sapiens
agaaaaaccagcatgttttca

SEQ ID NO: 7564848 - DNA, 23 bp, Homo sapiens
agaaaaacaggattgtgttccta

SEQ ID NO: 7564849 - DNA, 21 bp, Homo sapiens
agaaaaacacgatataagccc

SEQ ID NO: 7564850 - DNA, 21 bp, Homo sapiens
agaaaaacacgatataagccc

SEQ ID NO: 7564851 - DNA, 23 bp, Homo sapiens
agaaaaacaggattgtgttccta

SEQ ID NO: 7564852 - DNA, 21 bp, Homo sapiens
agaaaaacacgatataagccc

SEQ ID NO: 7564853 - DNA, 21 bp, Homo sapiens
agaaaaacacgatataagccc

SEQ ID NO: 7564854 - DNA, 21 bp, Homo sapiens
agaaaaacacgatataagccc

SEQ ID NO: 7564855 - DNA, 21 bp, Homo sapiens
agaaaaacacgatataagccc

SEQ ID NO: 7564856 - DNA, 21 bp, Homo sapiens
agaaaaacacgatataagccc

SEQ ID NO: 7564857 - DNA, 21 bp, Homo sapiens
agaaaaacacgatataagccc

SEQ ID NO: 7564858 - DNA, 21 bp, Homo sapiens
agaaaaacacgatataagccc

SEQ ID NO: 7564859 - DNA, 21 bp, Homo sapiens
agaaaaacacgatataagccc

SEQ ID NO: 7564860 - DNA, 21 bp, Homo sapiens
agaaaaacacgatataagccc

SEQ ID NO: 7564861 - DNA, 21 bp, Homo sapiens
agaaaaacacgatataagccc

SEQ ID NO: 7564862 - DNA, 22 bp, Homo sapiens
actttttgcatagtaagtgtct

SEQ ID NO: 7564863 - DNA, 22 bp, Homo sapiens
actttttctcagaaggattggt

SEQ ID NO: 7564864 - DNA, 22 bp, Homo sapiens
actttttgcatagtaagtgtct

SEQ ID NO: 7564865 - DNA, 22 bp, Homo sapiens
actttttctcagaaggattggt

SEQ ID NO: 7564866 - DNA, 22 bp, Homo sapiens
actttttagtttcctcaaacat

SEQ ID NO: 7564867 - DNA, 22 bp, Homo sapiens
actttttagtttcctcaaacat

SEQ ID NO: 7564868 - DNA, 22 bp, Homo sapiens
actttttagtttcctcaaacat

SEQ ID NO: 7564869 - DNA, 22 bp, Homo sapiens
actttttagtttcctcaaacat

SEQ ID NO: 7564870 - DNA, 22 bp, Homo sapiens
actttttagtttcctcaaacat

SEQ ID NO: 7564871 - DNA, 22 bp, Homo sapiens
actttttacagggtgtatacca

SEQ ID NO: 7564872 - DNA, 22 bp, Homo sapiens
actttttacagggtgtatacca

SEQ ID NO: 7564873 - DNA, 22 bp, Homo sapiens
acttttttataaggaagaagat

SEQ ID NO: 7564874 - DNA, 22 bp, Homo sapiens
acttttttataaggaagaagat

SEQ ID NO: 7564875 - DNA, 22 bp, Homo sapiens
acttttttataaggaagaagat

SEQ ID NO: 7564876 - DNA, 22 bp, Homo sapiens
acttttttataaggaagaagat

SEQ ID NO: 7564877 - DNA, 22 bp, Homo sapiens
actttttgctggtctcttccat

SEQ ID NO: 7564878 - DNA, 22 bp, Homo sapiens
acttttttataaggaagaagat

SEQ ID NO: 7564879 - DNA, 22 bp, Homo sapiens
acttttttataaggaagaagat

SEQ ID NO: 7564880 - DNA, 22 bp, Homo sapiens
agaaaaacacaatcgggcctcc

SEQ ID NO: 7564881 - DNA, 22 bp, Homo sapiens
acttttttataaggaagaagat

SEQ ID NO: 7564882 - DNA, 22 bp, Homo sapiens
acttttttataaggaagaagat

SEQ ID NO: 7564883 - DNA, 22 bp, Homo sapiens
acttttcccttggtagagttgc

SEQ ID NO: 7564884 - DNA, 22 bp, Homo sapiens
acttttcccttggtagagttgc

SEQ ID NO: 7564885 - DNA, 22 bp, Homo sapiens
acttttcccttggtagagttgc

SEQ ID NO: 7564886 - DNA, 22 bp, Homo sapiens
acttttcccttggtagagttgc

SEQ ID NO: 7564887 - DNA, 16 bp, Homo sapiens
acttttccaccttttt

SEQ ID NO: 7564888 - DNA, 16 bp, Homo sapiens
acttttccaccttttt

SEQ ID NO: 7564889 - DNA, 16 bp, Homo sapiens
acttttccaccttttt

SEQ ID NO: 7564890 - DNA, 23 bp, Homo sapiens
acttttcaattagctatgcttaa

SEQ ID NO: 7564891 - DNA, 23 bp, Homo sapiens
acttttcaattagctatgcttaa

SEQ ID NO: 7564892 - DNA, 22 bp, Homo sapiens
acttttctccctcctgccttca

SEQ ID NO: 7564893 - DNA, 22 bp, Homo sapiens
acttttctaagcaatggtcttg

SEQ ID NO: 7564894 - DNA, 22 bp, Homo sapiens
acttttctccctcctgccttca

SEQ ID NO: 7564895 - DNA, 22 bp, Homo sapiens
acttttctaagcaatggtcttg

SEQ ID NO: 7564896 - DNA, 22 bp, Homo sapiens
acttttctaagcaatggtcttg

SEQ ID NO: 7564897 - DNA, 22 bp, Homo sapiens
acttttctaagcaatggtcttg

SEQ ID NO: 7564898 - DNA, 22 bp, Homo sapiens
acttttctaagcaatggtcttg

SEQ ID NO: 7564899 - DNA, 22 bp, Homo sapiens
acttttctccctcctgccttca

SEQ ID NO: 7564900 - DNA, 22 bp, Homo sapiens
acttttctccctcctgccttca

SEQ ID NO: 7564901 - DNA, 22 bp, Homo sapiens
acttttctccctcctgccttca

SEQ ID NO: 7564902 - DNA, 22 bp, Homo sapiens
acttttctccctcctgccttca

SEQ ID NO: 7564903 - DNA, 22 bp, Homo sapiens
acttttctgcagatgatctctt

SEQ ID NO: 7564904 - DNA, 22 bp, Homo sapiens
actttttacagggtgtatacca

SEQ ID NO: 7564905 - DNA, 22 bp, Homo sapiens
actttttacagggtgtatacca

SEQ ID NO: 7564906 - DNA, 22 bp, Homo sapiens
actttttacagggtgtatacca

SEQ ID NO: 7564907 - DNA, 22 bp, Homo sapiens
actttttacagggtgtatacca

SEQ ID NO: 7564908 - DNA, 22 bp, Homo sapiens
actttttacagggtgtatacca

SEQ ID NO: 7564909 - DNA, 22 bp, Homo sapiens
actttttacagggtgtatacca

SEQ ID NO: 7564910 - DNA, 22 bp, Homo sapiens
actttttacagggtgtatacca

SEQ ID NO: 7564911 - DNA, 22 bp, Homo sapiens
actttttacagggtgtatacca

SEQ ID NO: 7564912 - DNA, 22 bp, Homo sapiens
actttttacagggtgtatacca

SEQ ID NO: 7564913 - DNA, 22 bp, Homo sapiens
acttttgtgcaggtctctccca

SEQ ID NO: 7564914 - DNA, 22 bp, Homo sapiens
acttttggttctgtaactgtga

SEQ ID NO: 7564915 - DNA, 22 bp, Homo sapiens
acttttgaggactttattgtat

SEQ ID NO: 7564916 - DNA, 22 bp, Homo sapiens
acttttgaggactttattgtat

SEQ ID NO: 7564917 - DNA, 22 bp, Homo sapiens
acttttgaagaattatgcaaaa

SEQ ID NO: 7564918 - DNA, 22 bp, Homo sapiens
acttttgaagaattatgcaaaa

SEQ ID NO: 7564919 - DNA, 22 bp, Homo sapiens
acttttgaacaaactcctctgt

SEQ ID NO: 7564920 - DNA, 22 bp, Homo sapiens
acttttctgcagatgatctctt

SEQ ID NO: 7564921 - DNA, 22 bp, Homo sapiens
acttttctgcagatgatctctt

SEQ ID NO: 7564922 - DNA, 22 bp, Homo sapiens
acttttctgcagatgatctctt

SEQ ID NO: 7564923 - DNA, 22 bp, Homo sapiens
acttttctgcagatgatctctt

SEQ ID NO: 7564924 - DNA, 22 bp, Homo sapiens
acttttcttatcagaaaggcca

SEQ ID NO: 7564925 - DNA, 22 bp, Homo sapiens
acttttcttatcagaaaggcca

SEQ ID NO: 7564926 - DNA, 22 bp, Homo sapiens
atattttggggtgatgtgcatc

SEQ ID NO: 7564927 - DNA, 22 bp, Homo sapiens
atattttggggtgatgtgcatc

SEQ ID NO: 7564928 - DNA, 22 bp, Homo sapiens
atattttggggtgatgtgcatc

SEQ ID NO: 7564929 - DNA, 22 bp, Homo sapiens
atattttggtagctctcaatga

SEQ ID NO: 7564930 - DNA, 22 bp, Homo sapiens
atattttggtagctctcaatga

SEQ ID NO: 7564931 - DNA, 22 bp, Homo sapiens
atattttggtagctctcaatga

SEQ ID NO: 7564932 - DNA, 22 bp, Homo sapiens
atattttggggtgatgtgcatc

SEQ ID NO: 7564933 - DNA, 22 bp, Homo sapiens
atatttctccaaatgttttcaa

SEQ ID NO: 7564934 - DNA, 22 bp, Homo sapiens
atatttctccaaatgttttcaa

SEQ ID NO: 7564935 - DNA, 22 bp, Homo sapiens
atatttctccaaatgttttcaa

SEQ ID NO: 7564936 - DNA, 22 bp, Homo sapiens
atatttctccaaatgttttcaa

SEQ ID NO: 7564937 - DNA, 22 bp, Homo sapiens
agaaaaagtcaaggaattggac

SEQ ID NO: 7564938 - DNA, 19 bp, Homo sapiens
agaaaaactggtactgctg

SEQ ID NO: 7564939 - DNA, 22 bp, Homo sapiens
agaaaaagtcaaggaattggac

SEQ ID NO: 7564940 - DNA, 22 bp, Homo sapiens
agaaaaagtcaaggaattggac

SEQ ID NO: 7564941 - DNA, 22 bp, Homo sapiens
agaaaaagtcaaggaattggac

SEQ ID NO: 7564942 - DNA, 22 bp, Homo sapiens
agaaaaagtcaaggaattggac

SEQ ID NO: 7564943 - DNA, 22 bp, Homo sapiens
agaaaaagtcaaggaattggac

SEQ ID NO: 7564944 - DNA, 22 bp, Homo sapiens
agaaaaagtcaaggaattggac

SEQ ID NO: 7564945 - DNA, 22 bp, Homo sapiens
atatttctccaaatgttttcaa

SEQ ID NO: 7564946 - DNA, 21 bp, Homo sapiens
atatttctcataaggttatgg

SEQ ID NO: 7564947 - DNA, 22 bp, Homo sapiens
agaaaaagtcaaggaattggac

SEQ ID NO: 7564948 - DNA, 22 bp, Homo sapiens
agaaaaagtcaaggaattggac

SEQ ID NO: 7564949 - DNA, 21 bp, Homo sapiens
atatttctcataaggttatgg

SEQ ID NO: 7564950 - DNA, 22 bp, Homo sapiens
agaaaaagtcaaggaattggac

SEQ ID NO: 7564951 - DNA, 22 bp, Homo sapiens
agaaaaagtcaaggaattggac

SEQ ID NO: 7564952 - DNA, 22 bp, Homo sapiens
agaaaaagaaagtggatttgtc

SEQ ID NO: 7564953 - DNA, 22 bp, Homo sapiens
agaaaaagaaagtggatttgtc

SEQ ID NO: 7564954 - DNA, 22 bp, Homo sapiens
agaaaaagaaagtggatttgtc

SEQ ID NO: 7564955 - DNA, 22 bp, Homo sapiens
agaaaaagaaagtggatttgtc

SEQ ID NO: 7564956 - DNA, 19 bp, Homo sapiens
agaaaaactggtactgctg

SEQ ID NO: 7564957 - DNA, 19 bp, Homo sapiens
agaaaaactggtactgctg

SEQ ID NO: 7564958 - DNA, 19 bp, Homo sapiens
agaaaaactggtactgctg

SEQ ID NO: 7564959 - DNA, 22 bp, Homo sapiens
agaaaaactaagagtgggtggt

SEQ ID NO: 7564960 - DNA, 21 bp, Homo sapiens
agaaaaaccagcatgttttca

SEQ ID NO: 7564961 - DNA, 21 bp, Homo sapiens
agaaaaaccagcatgttttca

SEQ ID NO: 7564962 - DNA, 21 bp, Homo sapiens
agaaaaaccagcatgttttca

SEQ ID NO: 7564963 - DNA, 21 bp, Homo sapiens
agaaaaaccagcatgttttca

SEQ ID NO: 7564964 - DNA, 22 bp, Homo sapiens
agaaaaactaagagtgggtggt

SEQ ID NO: 7564965 - DNA, 21 bp, Homo sapiens
atatttttgtttggactgtca

SEQ ID NO: 7564966 - DNA, 22 bp, Homo sapiens
atcaaaaccacctggagggctc

SEQ ID NO: 7564967 - DNA, 21 bp, Homo sapiens
atatttttgtttggactgtca

SEQ ID NO: 7564968 - DNA, 21 bp, Homo sapiens
atatttttgtttggactgtca

SEQ ID NO: 7564969 - DNA, 22 bp, Homo sapiens
atcaaaaccttgacttttaatg

SEQ ID NO: 7564970 - DNA, 22 bp, Homo sapiens
atcaaaaccttgacttttaatg

SEQ ID NO: 7564971 - DNA, 22 bp, Homo sapiens
atcaaaaccttgacttttaatg

SEQ ID NO: 7564972 - DNA, 22 bp, Homo sapiens
atcaaaaccttgacttttaatg

SEQ ID NO: 7564973 - DNA, 22 bp, Homo sapiens
atcaaaaccttgacttttaatg

SEQ ID NO: 7564974 - DNA, 21 bp, Homo sapiens
atatttttgtttggactgtca

SEQ ID NO: 7564975 - DNA, 21 bp, Homo sapiens
atatttttgtttggactgtca

SEQ ID NO: 7564976 - DNA, 21 bp, Homo sapiens
atatttttgtttggactgtca

SEQ ID NO: 7564977 - DNA, 21 bp, Homo sapiens
atatttttgtttggactgtca

SEQ ID NO: 7564978 - DNA, 22 bp, Homo sapiens
atatttttccatgtgggactct

SEQ ID NO: 7564979 - DNA, 22 bp, Homo sapiens
atatttttccatgtgggactct

SEQ ID NO: 7564980 - DNA, 22 bp, Homo sapiens
atatttttccatgtgggactct

SEQ ID NO: 7564981 - DNA, 21 bp, Homo sapiens
atatttttgtttggactgtca

SEQ ID NO: 7564982 - DNA, 21 bp, Homo sapiens
atatttttgtttggactgtca

SEQ ID NO: 7564983 - DNA, 21 bp, Homo sapiens
atatttttgtttggactgtca

SEQ ID NO: 7564984 - DNA, 21 bp, Homo sapiens
atatttttgtttggactgtca

SEQ ID NO: 7564985 - DNA, 22 bp, Homo sapiens
atatttttccatgtgggactct

SEQ ID NO: 7564986 - DNA, 22 bp, Homo sapiens
atatttttccatgtgggactct

SEQ ID NO: 7564987 - DNA, 22 bp, Homo sapiens
atatttttccatgtgggactct

SEQ ID NO: 7564988 - DNA, 22 bp, Homo sapiens
atatttttccatgtgggactct

SEQ ID NO: 7564989 - DNA, 22 bp, Homo sapiens
atatttttccatgtgggactct

SEQ ID NO: 7564990 - DNA, 22 bp, Homo sapiens
atatttttccatgtgggactct

SEQ ID NO: 7564991 - DNA, 22 bp, Homo sapiens
atatttttccatgtgggactct

SEQ ID NO: 7564992 - DNA, 22 bp, Homo sapiens
atattttgtaacttggaatagg

SEQ ID NO: 7564993 - DNA, 22 bp, Homo sapiens
atattttgtaacttggaatagg

SEQ ID NO: 7564994 - DNA, 22 bp, Homo sapiens
atattttgtaacttggaatagg

SEQ ID NO: 7564995 - DNA, 22 bp, Homo sapiens
atattttgtaacttggaatagg

SEQ ID NO: 7564996 - DNA, 22 bp, Homo sapiens
atattttgtaacttggaatagg

SEQ ID NO: 7564997 - DNA, 22 bp, Homo sapiens
atattttgtaacttggaatagg

SEQ ID NO: 7564998 - DNA, 22 bp, Homo sapiens
atattttgtaacttggaatagg

SEQ ID NO: 7564999 - DNA, 22 bp, Homo sapiens
atattttggtagctctcaatga

SEQ ID NO: 7565000 - DNA, 22 bp, Homo sapiens
atattttggtagctctcaatga

SEQ ID NO: 7565001 - DNA, 22 bp, Homo sapiens
atattttggtagctctcaatga

SEQ ID NO: 7565002 - DNA, 22 bp, Homo sapiens
atattttggtagctctcaatga

SEQ ID NO: 7565003 - DNA, 21 bp, Homo sapiens
atcagtaaggttggaggaaga

SEQ ID NO: 7565004 - DNA, 17 bp, Homo sapiens
atcagtagcatatcaga

SEQ ID NO: 7565005 - DNA, 22 bp, Homo sapiens
atcagtaaatattcattgtgca

SEQ ID NO: 7565006 - DNA, 17 bp, Homo sapiens
atcagtagcatatcaga

SEQ ID NO: 7565007 - DNA, 22 bp, Homo sapiens
atcagtagtgtgaaaacagact

SEQ ID NO: 7565008 - DNA, 22 bp, Homo sapiens
atcagtatacaggggacattca

SEQ ID NO: 7565009 - DNA, 22 bp, Homo sapiens
atcagtcatatccaaattagca

SEQ ID NO: 7565010 - DNA, 22 bp, Homo sapiens
atcagtatcctgcagtttctat

SEQ ID NO: 7565011 - DNA, 22 bp, Homo sapiens
atcagtatcctgcagtttctat

SEQ ID NO: 7565012 - DNA, 22 bp, Homo sapiens
atcagtctgttggaatatcgct

SEQ ID NO: 7565013 - DNA, 22 bp, Homo sapiens
atcagtcttttaatgatacctt

SEQ ID NO: 7565014 - DNA, 22 bp, Homo sapiens
atcagtcatatccaaattagca

SEQ ID NO: 7565015 - DNA, 22 bp, Homo sapiens
atcagtccaccatactcatctt

SEQ ID NO: 7565016 - DNA, 22 bp, Homo sapiens
atcagtctgtgttagaaaagag

SEQ ID NO: 7565017 - DNA, 22 bp, Homo sapiens
atcagtctgtgttagaaaagag

SEQ ID NO: 7565018 - DNA, 22 bp, Homo sapiens
atcagtgttgttgattggatag

SEQ ID NO: 7565019 - DNA, 22 bp, Homo sapiens
atcagtgttgttgattggatag

SEQ ID NO: 7565020 - DNA, 22 bp, Homo sapiens
atcagtgttccttgagactgcc

SEQ ID NO: 7565021 - DNA, 22 bp, Homo sapiens
atcagtgttccttgagactgcc

SEQ ID NO: 7565022 - DNA, 22 bp, Homo sapiens
atcagtgtgtcaaaagcacaaa

SEQ ID NO: 7565023 - DNA, 22 bp, Homo sapiens
atcagtgtattcatagggaata

SEQ ID NO: 7565024 - DNA, 22 bp, Homo sapiens
atcagtgtattcatagggaata

SEQ ID NO: 7565025 - DNA, 22 bp, Homo sapiens
atcagtgtaccttatggatttt

SEQ ID NO: 7565026 - DNA, 22 bp, Homo sapiens
atcagtgtaccttatggatttt

SEQ ID NO: 7565027 - DNA, 22 bp, Homo sapiens
atcagtgggagatgctggtttt

SEQ ID NO: 7565028 - DNA, 22 bp, Homo sapiens
atcagtggggacgagaagttta

SEQ ID NO: 7565029 - DNA, 22 bp, Homo sapiens
atcagtgcttcatagccctggt

SEQ ID NO: 7565030 - DNA, 22 bp, Homo sapiens
atcagtgctgggagatgtcaga

SEQ ID NO: 7565031 - DNA, 22 bp, Homo sapiens
atcagtgctaaagcaaatgccc

SEQ ID NO: 7565032 - DNA, 22 bp, Homo sapiens
atcagtgctaaagcaaatgccc

SEQ ID NO: 7565033 - DNA, 19 bp, Homo sapiens
atcagtgcatgagtgctgt

SEQ ID NO: 7565034 - DNA, 19 bp, Homo sapiens
atcagtgcatgagtgctgt

SEQ ID NO: 7565035 - DNA, 22 bp, Homo sapiens
atcagtgatcttgtttgccaga

SEQ ID NO: 7565036 - DNA, 22 bp, Homo sapiens
atcagtgacctgaaatgttttt

SEQ ID NO: 7565037 - DNA, 22 bp, Homo sapiens
atcagtgacctgaaatgttttt

SEQ ID NO: 7565038 - DNA, 23 bp, Homo sapiens
agaaatcatctccaccccatgtc

SEQ ID NO: 7565039 - DNA, 22 bp, Homo sapiens
atcagtttaactgtcaagagcc

SEQ ID NO: 7565040 - DNA, 22 bp, Homo sapiens
atcagtttaactgtcaagagcc

SEQ ID NO: 7565041 - DNA, 22 bp, Homo sapiens
agaaatcaggaacagtaaggag

SEQ ID NO: 7565042 - DNA, 22 bp, Homo sapiens
agaaatcaggaacagtaaggag

SEQ ID NO: 7565043 - DNA, 22 bp, Homo sapiens
agaaatcaggaacagtaaggag

SEQ ID NO: 7565044 - DNA, 22 bp, Homo sapiens
atcagtgtttgcatgggagctt

SEQ ID NO: 7565045 - DNA, 22 bp, Homo sapiens
atcagtgtttgcatgggagctt

SEQ ID NO: 7565046 - DNA, 22 bp, Homo sapiens
atcagtgtttcaaatgtaatct

SEQ ID NO: 7565047 - DNA, 22 bp, Homo sapiens
atcagttatttttaagctataa

SEQ ID NO: 7565048 - DNA, 22 bp, Homo sapiens
atcagtgtttgcatgggagctt

SEQ ID NO: 7565049 - DNA, 22 bp, Homo sapiens
atcagtgtttgcatgggagctt

SEQ ID NO: 7565050 - DNA, 22 bp, Homo sapiens
atcagttagttactgctaagat

SEQ ID NO: 7565051 - DNA, 22 bp, Homo sapiens
atcagtttaaatgggctgttgg

SEQ ID NO: 7565052 - DNA, 22 bp, Homo sapiens
atcagtttaaatgggctgttgg

SEQ ID NO: 7565053 - DNA, 22 bp, Homo sapiens
atcagttatttttaagctataa

SEQ ID NO: 7565054 - DNA, 22 bp, Homo sapiens
atcagttatttttaagctataa

SEQ ID NO: 7565055 - DNA, 22 bp, Homo sapiens
atcagttatttttaagctataa

SEQ ID NO: 7565056 - DNA, 22 bp, Homo sapiens
agaaatcatgtcttatttctat

SEQ ID NO: 7565057 - DNA, 22 bp, Homo sapiens
agaaatcatgtcttatttctat

SEQ ID NO: 7565058 - DNA, 22 bp, Homo sapiens
agaaatcatgtcttatttctat

SEQ ID NO: 7565059 - DNA, 22 bp, Homo sapiens
agaaatcatgtcttatttctat

SEQ ID NO: 7565060 - DNA, 22 bp, Homo sapiens
agaaatcatgactaagagcagt

SEQ ID NO: 7565061 - DNA, 22 bp, Homo sapiens
agaaatcatgactaagagcagt

SEQ ID NO: 7565062 - DNA, 22 bp, Homo sapiens
agaaatcatgactaagagcagt

SEQ ID NO: 7565063 - DNA, 22 bp, Homo sapiens
agaaatcatgactaagagcagt

SEQ ID NO: 7565064 - DNA, 22 bp, Homo sapiens
agaaatcatgactaagagcagt

SEQ ID NO: 7565065 - DNA, 22 bp, Homo sapiens
agaaatcatgactaagagcagt

SEQ ID NO: 7565066 - DNA, 22 bp, Homo sapiens
agaaatcatgactaagagcagt

SEQ ID NO: 7565067 - DNA, 22 bp, Homo sapiens
agaaatcatgactaagagcagt

SEQ ID NO: 7565068 - DNA, 22 bp, Homo sapiens
agaaatcattcccaaacccata

SEQ ID NO: 7565069 - DNA, 22 bp, Homo sapiens
agaaatcattcccaaacccata

SEQ ID NO: 7565070 - DNA, 22 bp, Homo sapiens
agaaatcatgtcttatttctat

SEQ ID NO: 7565071 - DNA, 22 bp, Homo sapiens
agaaatcatgtcttatttctat

SEQ ID NO: 7565072 - DNA, 22 bp, Homo sapiens
agaaatcatgtcttatttctat

SEQ ID NO: 7565073 - DNA, 22 bp, Homo sapiens
agaaatcatgtcttatttctat

SEQ ID NO: 7565074 - DNA, 22 bp, Homo sapiens
agaaatcatgtcttatttctat

SEQ ID NO: 7565075 - DNA, 22 bp, Homo sapiens
agaaagcacagcgggtccattt

SEQ ID NO: 7565076 - DNA, 22 bp, Homo sapiens
agaaagcacagcgggtccattt

SEQ ID NO: 7565077 - DNA, 22 bp, Homo sapiens
agaaagcacagcgggtccattt

SEQ ID NO: 7565078 - DNA, 22 bp, Homo sapiens
agaaagcacagcgggtccattt

SEQ ID NO: 7565079 - DNA, 22 bp, Homo sapiens
agaaagcacagcgggtccattt

SEQ ID NO: 7565080 - DNA, 22 bp, Homo sapiens
agaaagcaccctgcactttctg

SEQ ID NO: 7565081 - DNA, 22 bp, Homo sapiens
agaaagcaccctgcactttctg

SEQ ID NO: 7565082 - DNA, 22 bp, Homo sapiens
agaaagcaccctgcactttctg

SEQ ID NO: 7565083 - DNA, 22 bp, Homo sapiens
agaaagcacagcgggtccattt

SEQ ID NO: 7565084 - DNA, 22 bp, Homo sapiens
agaaagcacagcgggtccattt

SEQ ID NO: 7565085 - DNA, 22 bp, Homo sapiens
agaaagcaccctgcactttctg

SEQ ID NO: 7565086 - DNA, 22 bp, Homo sapiens
agaaagcactctgtcttttacc

SEQ ID NO: 7565087 - DNA, 22 bp, Homo sapiens
agaaagcactctgtcttttacc

SEQ ID NO: 7565088 - DNA, 22 bp, Homo sapiens
agaaagcactctgtcttttacc

SEQ ID NO: 7565089 - DNA, 22 bp, Homo sapiens
agaaagcactctgtcttttacc

SEQ ID NO: 7565090 - DNA, 22 bp, Homo sapiens
agaaagcactctgtcttttacc

SEQ ID NO: 7565091 - DNA, 22 bp, Homo sapiens
agaaagcacgggccccaggctc

SEQ ID NO: 7565092 - DNA, 22 bp, Homo sapiens
agaaagcacgggccccaggctc

SEQ ID NO: 7565093 - DNA, 22 bp, Homo sapiens
agaaagcaccctgcactttctg

SEQ ID NO: 7565094 - DNA, 22 bp, Homo sapiens
agaaagcacgggccccaggctc

SEQ ID NO: 7565095 - DNA, 20 bp, Homo sapiens
atcaaaatcctattgaggtt

SEQ ID NO: 7565096 - DNA, 22 bp, Homo sapiens
atcaaaacttctttagagttta

SEQ ID NO: 7565097 - DNA, 22 bp, Homo sapiens
atcaaaacttctttagagttta

SEQ ID NO: 7565098 - DNA, 22 bp, Homo sapiens
atcaaaacttctttagagttta

SEQ ID NO: 7565099 - DNA, 22 bp, Homo sapiens
atcaaaacttctttagagttta

SEQ ID NO: 7565100 - DNA, 20 bp, Homo sapiens
atcaaaatcctattgaggtt

SEQ ID NO: 7565101 - DNA, 22 bp, Homo sapiens
atcaaaatgctccagtgatggt

SEQ ID NO: 7565102 - DNA, 22 bp, Homo sapiens
atcaaaatgctccagtgatggt

SEQ ID NO: 7565103 - DNA, 22 bp, Homo sapiens
atcaaaatgctccagtgatggt

SEQ ID NO: 7565104 - DNA, 22 bp, Homo sapiens
atcaaaatgctccagtgatggt

SEQ ID NO: 7565105 - DNA, 20 bp, Homo sapiens
atcaaaatcctattgaggtt

SEQ ID NO: 7565106 - DNA, 22 bp, Homo sapiens
agaaagattttcaacaggaggt

SEQ ID NO: 7565107 - DNA, 22 bp, Homo sapiens
agaaagatccttctggctgcct

SEQ ID NO: 7565108 - DNA, 22 bp, Homo sapiens
agaaagatccttctggctgcct

SEQ ID NO: 7565109 - DNA, 22 bp, Homo sapiens
atcaaaatgctccagtgatggt

SEQ ID NO: 7565110 - DNA, 22 bp, Homo sapiens
agaaagcagcatttatgatctc

SEQ ID NO: 7565111 - DNA, 22 bp, Homo sapiens
agaaagcactctgtcttttacc

SEQ ID NO: 7565112 - DNA, 22 bp, Homo sapiens
agaaagcagcatttatgatctc

SEQ ID NO: 7565113 - DNA, 22 bp, Homo sapiens
agaaagcagcatttatgatctc

SEQ ID NO: 7565114 - DNA, 22 bp, Homo sapiens
agaaagcagcatttatgatctc

SEQ ID NO: 7565115 - DNA, 22 bp, Homo sapiens
agaaagcagcatttatgatctc

SEQ ID NO: 7565116 - DNA, 22 bp, Homo sapiens
agaaagcagcatttatgatctc

SEQ ID NO: 7565117 - DNA, 22 bp, Homo sapiens
agaaagcagcatttatgatctc

SEQ ID NO: 7565118 - DNA, 22 bp, Homo sapiens
agaaagcagtcccttccgaccg

SEQ ID NO: 7565119 - DNA, 22 bp, Homo sapiens
agaaagcagcatttatgatctc

SEQ ID NO: 7565120 - DNA, 22 bp, Homo sapiens
agaaagcatctccattgtaggt

SEQ ID NO: 7565121 - DNA, 22 bp, Homo sapiens
agaaagcatctccattgtaggt

SEQ ID NO: 7565122 - DNA, 22 bp, Homo sapiens
agaaagcatctccattgtaggt

SEQ ID NO: 7565123 - DNA, 22 bp, Homo sapiens
agaaagcatctccattgtaggt

SEQ ID NO: 7565124 - DNA, 22 bp, Homo sapiens
agaaagcatctccattgtaggt

SEQ ID NO: 7565125 - DNA, 22 bp, Homo sapiens
agaaagcatctccattgtaggt

SEQ ID NO: 7565126 - DNA, 22 bp, Homo sapiens
agaaagcccacccagaagatgt

SEQ ID NO: 7565127 - DNA, 22 bp, Homo sapiens
agaaagcatctccattgtaggt

SEQ ID NO: 7565128 - DNA, 22 bp, Homo sapiens
atcagcaatctcgtgtattagg

SEQ ID NO: 7565129 - DNA, 22 bp, Homo sapiens
atcagcaatcaaattgcagagt

SEQ ID NO: 7565130 - DNA, 22 bp, Homo sapiens
atcagcaatctcgtgtattagg

SEQ ID NO: 7565131 - DNA, 22 bp, Homo sapiens
agaaagctccccatgagatgat

SEQ ID NO: 7565132 - DNA, 22 bp, Homo sapiens
atcagcaatcaaattgcagagt

SEQ ID NO: 7565133 - DNA, 22 bp, Homo sapiens
atcagcaatctcgtgtattagg

SEQ ID NO: 7565134 - DNA, 22 bp, Homo sapiens
atcaggtgggttttgaagaaac

SEQ ID NO: 7565135 - DNA, 22 bp, Homo sapiens
atcaggtgggttttgaagaaac

SEQ ID NO: 7565136 - DNA, 22 bp, Homo sapiens
agaaagcctgagcagacggagc

SEQ ID NO: 7565137 - DNA, 22 bp, Homo sapiens
agaaagccttatgtacagaggc

SEQ ID NO: 7565138 - DNA, 22 bp, Homo sapiens
agaaagccttatgtacagaggc

SEQ ID NO: 7565139 - DNA, 22 bp, Homo sapiens
agaaagcctgagcagacggagc

SEQ ID NO: 7565140 - DNA, 22 bp, Homo sapiens
agaaagcctcaatcttcaggcc

SEQ ID NO: 7565141 - DNA, 22 bp, Homo sapiens
agaaagccttatgtacagaggc

SEQ ID NO: 7565142 - DNA, 22 bp, Homo sapiens
agaaagccttatgtacagaggc

SEQ ID NO: 7565143 - DNA, 22 bp, Homo sapiens
agaaagcccaggagaacagatt

SEQ ID NO: 7565144 - DNA, 22 bp, Homo sapiens
agaaagcccaggagaacagatt

SEQ ID NO: 7565145 - DNA, 22 bp, Homo sapiens
agaaagcccacccagaagatgt

SEQ ID NO: 7565146 - DNA, 22 bp, Homo sapiens
agaaagccaatctgtaaagtct

SEQ ID NO: 7565147 - DNA, 22 bp, Homo sapiens
agaaagcctcaatcttcaggcc

SEQ ID NO: 7565148 - DNA, 22 bp, Homo sapiens
actgccagaggaggtatctgaa

SEQ ID NO: 7565149 - DNA, 22 bp, Homo sapiens
actgccagaggaggtatctgaa

SEQ ID NO: 7565150 - DNA, 22 bp, Homo sapiens
actgccagaggaggtatctgaa

SEQ ID NO: 7565151 - DNA, 22 bp, Homo sapiens
actgccagatattaaacatatt

SEQ ID NO: 7565152 - DNA, 22 bp, Homo sapiens
actgccagatataaaaactgtg

SEQ ID NO: 7565153 - DNA, 23 bp, Homo sapiens
actgccagagcaggctttgcctg

SEQ ID NO: 7565154 - DNA, 22 bp, Homo sapiens
actgccagaatcattcaaggaa

SEQ ID NO: 7565155 - DNA, 22 bp, Homo sapiens
actgccagagacaaggatgagt

SEQ ID NO: 7565156 - DNA, 23 bp, Homo sapiens
actgccagattgaaggtttctta

SEQ ID NO: 7565157 - DNA, 23 bp, Homo sapiens
actgccagattgaaggtttctta

SEQ ID NO: 7565158 - DNA, 22 bp, Homo sapiens
actgccagcaatgtgaaagaaa

SEQ ID NO: 7565159 - DNA, 23 bp, Homo sapiens
actgccagattgaaggtttctta

SEQ ID NO: 7565160 - DNA, 22 bp, Homo sapiens
actgccagcctcagtgaaggca

SEQ ID NO: 7565161 - DNA, 20 bp, Homo sapiens
actgccagccttgtctactg

SEQ ID NO: 7565162 - DNA, 22 bp, Homo sapiens
actgccagaatcattcaaggaa

SEQ ID NO: 7565163 - DNA, 22 bp, Homo sapiens
actgccacctggtggtcctgga

SEQ ID NO: 7565164 - DNA, 22 bp, Homo sapiens
actgccagaagacagcttttca

SEQ ID NO: 7565165 - DNA, 22 bp, Homo sapiens
actgccaatggtagtttgatgg

SEQ ID NO: 7565166 - DNA, 22 bp, Homo sapiens
actgccaatggtagtttgatgg

SEQ ID NO: 7565167 - DNA, 22 bp, Homo sapiens
actgccaatggtagtttgatgg

SEQ ID NO: 7565168 - DNA, 22 bp, Homo sapiens
actgccaggtaagtgctcctgc

SEQ ID NO: 7565169 - DNA, 22 bp, Homo sapiens
actgccaggccttgttagttga

SEQ ID NO: 7565170 - DNA, 22 bp, Homo sapiens
actgccaggtaagtgctcctgc

SEQ ID NO: 7565171 - DNA, 22 bp, Homo sapiens
actgccaggtaagtgctcctgc

SEQ ID NO: 7565172 - DNA, 22 bp, Homo sapiens
actgccaggtgctccatctgaa

SEQ ID NO: 7565173 - DNA, 21 bp, Homo sapiens
actgccaggagagtaggggga

SEQ ID NO: 7565174 - DNA, 22 bp, Homo sapiens
actgccaggatggcactagagg

SEQ ID NO: 7565175 - DNA, 22 bp, Homo sapiens
actgccaggccagtagaacata

SEQ ID NO: 7565176 - DNA, 22 bp, Homo sapiens
actgccaggatggcactagagg

SEQ ID NO: 7565177 - DNA, 22 bp, Homo sapiens
actgccagtattcacgttcctg

SEQ ID NO: 7565178 - DNA, 22 bp, Homo sapiens
actgccagtattcacgttcctg

SEQ ID NO: 7565179 - DNA, 22 bp, Homo sapiens
actgccagttgttttgtccagt

SEQ ID NO: 7565180 - DNA, 22 bp, Homo sapiens
actgccagtcattccacaattt

SEQ ID NO: 7565181 - DNA, 23 bp, Homo sapiens
actgccagttttaccacagacgg

SEQ ID NO: 7565182 - DNA, 23 bp, Homo sapiens
actgccagttttaccacagacgg

SEQ ID NO: 7565183 - DNA, 22 bp, Homo sapiens
actgcccacagtgaatggttgg

SEQ ID NO: 7565184 - DNA, 21 bp, Homo sapiens
actgcccaccagttaacgctg

SEQ ID NO: 7565185 - DNA, 22 bp, Homo sapiens
actgcccacagtgaatggttgg

SEQ ID NO: 7565186 - DNA, 22 bp, Homo sapiens
actgcccacatctctttccgct

SEQ ID NO: 7565187 - DNA, 21 bp, Homo sapiens
actgcccaccagttaacgctg

SEQ ID NO: 7565188 - DNA, 22 bp, Homo sapiens
actgcccacatctctttccgct

SEQ ID NO: 7565189 - DNA, 22 bp, Homo sapiens
actgccctccagcctgggtgac

SEQ ID NO: 7565190 - DNA, 22 bp, Homo sapiens
actgccctccagcctgggtgac

SEQ ID NO: 7565191 - DNA, 22 bp, Homo sapiens
actgccctccagcctgggtgac

SEQ ID NO: 7565192 - DNA, 22 bp, Homo sapiens
actgcccattatggtagtcact

SEQ ID NO: 7565193 - DNA, 22 bp, Homo sapiens
actgcccattatggtagtcact

SEQ ID NO: 7565194 - DNA, 22 bp, Homo sapiens
actgcccattatggtagtcact

SEQ ID NO: 7565195 - DNA, 22 bp, Homo sapiens
actgcccattaaaggtgctttg

SEQ ID NO: 7565196 - DNA, 22 bp, Homo sapiens
actgcccattaaaggtgctttg

SEQ ID NO: 7565197 - DNA, 22 bp, Homo sapiens
actgccctggagacagcagagt

SEQ ID NO: 7565198 - DNA, 22 bp, Homo sapiens
actgccctcccatctattgcaa

SEQ ID NO: 7565199 - DNA, 22 bp, Homo sapiens
actgccctggagacagcagagt

SEQ ID NO: 7565200 - DNA, 22 bp, Homo sapiens
actgccctggagacagcagagt

SEQ ID NO: 7565201 - DNA, 22 bp, Homo sapiens
actgccctggagacagcagagt

SEQ ID NO: 7565202 - DNA, 22 bp, Homo sapiens
actgccctcccatctattgcaa

SEQ ID NO: 7565203 - DNA, 22 bp, Homo sapiens
actgccctcccatctattgcaa

SEQ ID NO: 7565204 - DNA, 22 bp, Homo sapiens
actgccctccagcctgggtgac

SEQ ID NO: 7565205 - DNA, 22 bp, Homo sapiens
actgcccatgtgcatcaagtag

SEQ ID NO: 7565206 - DNA, 22 bp, Homo sapiens
actgcccattaaaggtgctttg

SEQ ID NO: 7565207 - DNA, 22 bp, Homo sapiens
actgcccatgtgcatcaagtag

SEQ ID NO: 7565208 - DNA, 22 bp, Homo sapiens
actgcccagtgattggtggtta

SEQ ID NO: 7565209 - DNA, 22 bp, Homo sapiens
actgcccagtgattggtggtta

SEQ ID NO: 7565210 - DNA, 22 bp, Homo sapiens
actgcccatgtgcatcaagtag

SEQ ID NO: 7565211 - DNA, 22 bp, Homo sapiens
actgcccaggaatctcaaagaa

SEQ ID NO: 7565212 - DNA, 22 bp, Homo sapiens
actgcccagaagagatgaaagt

SEQ ID NO: 7565213 - DNA, 22 bp, Homo sapiens
actgcccaggaatctcaaagaa

SEQ ID NO: 7565214 - DNA, 22 bp, Homo sapiens
actgcccaggaatctcaaagaa

SEQ ID NO: 7565215 - DNA, 22 bp, Homo sapiens
actgcccaggaatctcaaagaa

SEQ ID NO: 7565216 - DNA, 22 bp, Homo sapiens
actgcccagaagagatgaaagt

SEQ ID NO: 7565217 - DNA, 22 bp, Homo sapiens
actgcccagaagagatgaaagt

SEQ ID NO: 7565218 - DNA, 22 bp, Homo sapiens
actgcccagaagagatgaaagt

SEQ ID NO: 7565219 - DNA, 22 bp, Homo sapiens
actgcctgagctattggaaaag

SEQ ID NO: 7565220 - DNA, 22 bp, Homo sapiens
actgcctgagctattggaaaag

SEQ ID NO: 7565221 - DNA, 22 bp, Homo sapiens
actgcctgagctattggaaaag

SEQ ID NO: 7565222 - DNA, 22 bp, Homo sapiens
actgcctcttggtgctgagaga

SEQ ID NO: 7565223 - DNA, 19 bp, Homo sapiens
actgcctgaggctcacagg

SEQ ID NO: 7565224 - DNA, 19 bp, Homo sapiens
actgcctgaggctcacagg

SEQ ID NO: 7565225 - DNA, 22 bp, Homo sapiens
actgcctgagctattggaaaag

SEQ ID NO: 7565226 - DNA, 22 bp, Homo sapiens
actgcctcttggtgctgagaga

SEQ ID NO: 7565227 - DNA, 22 bp, Homo sapiens
actgcctcttggtgctgagaga

SEQ ID NO: 7565228 - DNA, 22 bp, Homo sapiens
actgcctcttggtgctgagaga

SEQ ID NO: 7565229 - DNA, 22 bp, Homo sapiens
actgccctgtaactgccaggta

SEQ ID NO: 7565230 - DNA, 22 bp, Homo sapiens
actgccctgtaactgccaggta

SEQ ID NO: 7565231 - DNA, 22 bp, Homo sapiens
actgccctgtaactgccaggta

SEQ ID NO: 7565232 - DNA, 22 bp, Homo sapiens
actgcccattatggtagtcact

SEQ ID NO: 7565233 - DNA, 22 bp, Homo sapiens
actgccctggcaccacacatgc

SEQ ID NO: 7565234 - DNA, 22 bp, Homo sapiens
actgccctggcaccacacatgc

SEQ ID NO: 7565235 - DNA, 22 bp, Homo sapiens
actgccctggcaccacacatgc

SEQ ID NO: 7565236 - DNA, 22 bp, Homo sapiens
actgccctggagacagcagagt

SEQ ID NO: 7565237 - DNA, 22 bp, Homo sapiens
actgcccttgtcctggcacacc

SEQ ID NO: 7565238 - DNA, 22 bp, Homo sapiens
actgcccttgtcctggcacacc

SEQ ID NO: 7565239 - DNA, 22 bp, Homo sapiens
actgcccttgtcctggcacacc

SEQ ID NO: 7565240 - DNA, 22 bp, Homo sapiens
actgcccttgtcctggcacacc

SEQ ID NO: 7565241 - DNA, 22 bp, Homo sapiens
actgccctgtaactgccaggta

SEQ ID NO: 7565242 - DNA, 22 bp, Homo sapiens
actggctgcgttcctgtgagac

SEQ ID NO: 7565243 - DNA, 22 bp, Homo sapiens
actggctgcgttcctgtgagac

SEQ ID NO: 7565244 - DNA, 22 bp, Homo sapiens
actggctgcgttcctgtgagac

SEQ ID NO: 7565245 - DNA, 22 bp, Homo sapiens
actggctgcgttcctgtgagac

SEQ ID NO: 7565246 - DNA, 22 bp, Homo sapiens
actggctgcgttcctgtgagac

SEQ ID NO: 7565247 - DNA, 22 bp, Homo sapiens
actggctgcggggtggaagaag

SEQ ID NO: 7565248 - DNA, 22 bp, Homo sapiens
actggctgcggggtggaagaag

SEQ ID NO: 7565249 - DNA, 22 bp, Homo sapiens
actggctgcggggtggaagaag

SEQ ID NO: 7565250 - DNA, 22 bp, Homo sapiens
actggctgcgatcttggcgctt

SEQ ID NO: 7565251 - DNA, 20 bp, Homo sapiens
actggctgcctggaatgcgc

SEQ ID NO: 7565252 - DNA, 20 bp, Homo sapiens
actggctgcctggaatgcgc

SEQ ID NO: 7565253 - DNA, 20 bp, Homo sapiens
actggctgcctggaatgcgc

SEQ ID NO: 7565254 - DNA, 20 bp, Homo sapiens
actggctgcctggaatgcgc

SEQ ID NO: 7565255 - DNA, 22 bp, Homo sapiens
actggctgcggggtggaagaag

SEQ ID NO: 7565256 - DNA, 22 bp, Homo sapiens
actggctgcgatcttggcgctt

SEQ ID NO: 7565257 - DNA, 22 bp, Homo sapiens
actggctggactctgacctctt

SEQ ID NO: 7565258 - DNA, 22 bp, Homo sapiens
actggctgcgttcctgtgagac

SEQ ID NO: 7565259 - DNA, 22 bp, Homo sapiens
actggctgcgttcctgtgagac

SEQ ID NO: 7565260 - DNA, 22 bp, Homo sapiens
actggctgcgttcctgtgagac

SEQ ID NO: 7565261 - DNA, 22 bp, Homo sapiens
actggctggactctgacctctt

SEQ ID NO: 7565262 - DNA, 22 bp, Homo sapiens
actggctggactctgacctctt

SEQ ID NO: 7565263 - DNA, 22 bp, Homo sapiens
actggctggactctgacctctt

SEQ ID NO: 7565264 - DNA, 22 bp, Homo sapiens
actggctggagttgccaaggct

SEQ ID NO: 7565265 - DNA, 22 bp, Homo sapiens
actggctggagttgccaaggct

SEQ ID NO: 7565266 - DNA, 22 bp, Homo sapiens
actggctggagttgccaaggct

SEQ ID NO: 7565267 - DNA, 22 bp, Homo sapiens
actggctggagttgccaaggct

SEQ ID NO: 7565268 - DNA, 22 bp, Homo sapiens
actggctggactctgacctctt

SEQ ID NO: 7565269 - DNA, 22 bp, Homo sapiens
actggctggactctgacctctt

SEQ ID NO: 7565270 - DNA, 21 bp, Homo sapiens
actggctgccatgatccaggg

SEQ ID NO: 7565271 - DNA, 21 bp, Homo sapiens
actggctgccatgatccaggg

SEQ ID NO: 7565272 - DNA, 21 bp, Homo sapiens
actggctgccatgatccaggg

SEQ ID NO: 7565273 - DNA, 22 bp, Homo sapiens
actggctgatcacctgcctcag

SEQ ID NO: 7565274 - DNA, 22 bp, Homo sapiens
actggctgatcacctgcctcag

SEQ ID NO: 7565275 - DNA, 22 bp, Homo sapiens
actggctgatcacctgcctcag

SEQ ID NO: 7565276 - DNA, 22 bp, Homo sapiens
actggctgatatggctaggaag

SEQ ID NO: 7565277 - DNA, 22 bp, Homo sapiens
actggctgatcacctgcctcag

SEQ ID NO: 7565278 - DNA, 22 bp, Homo sapiens
actggctgcctccaaagtgtgc

SEQ ID NO: 7565279 - DNA, 21 bp, Homo sapiens
actggctgccatgatccaggg

SEQ ID NO: 7565280 - DNA, 21 bp, Homo sapiens
actggctgccatgatccaggg

SEQ ID NO: 7565281 - DNA, 22 bp, Homo sapiens
actggctgcctccaaagtgtgc

SEQ ID NO: 7565282 - DNA, 22 bp, Homo sapiens
actggctgcctccaaagtgtgc

SEQ ID NO: 7565283 - DNA, 22 bp, Homo sapiens
actggctgatcacctgcctcag

SEQ ID NO: 7565284 - DNA, 22 bp, Homo sapiens
actggctgatcacctgcctcag

SEQ ID NO: 7565285 - DNA, 22 bp, Homo sapiens
actggctgatcacctgcctcag

SEQ ID NO: 7565286 - DNA, 22 bp, Homo sapiens
actggctgatatggctaggaag

SEQ ID NO: 7565287 - DNA, 21 bp, Homo sapiens
actggccaccactggcagggg

SEQ ID NO: 7565288 - DNA, 21 bp, Homo sapiens
actggccaccactggcagggg

SEQ ID NO: 7565289 - DNA, 21 bp, Homo sapiens
actggccaccactggcagggg

SEQ ID NO: 7565290 - DNA, 21 bp, Homo sapiens
actggccaccactggcagggg

SEQ ID NO: 7565291 - DNA, 22 bp, Homo sapiens
actgcctgtagctcttcatctc

SEQ ID NO: 7565292 - DNA, 22 bp, Homo sapiens
actgcctgtagctcttcatctc

SEQ ID NO: 7565293 - DNA, 22 bp, Homo sapiens
actgcctgtagctcttcatctc

SEQ ID NO: 7565294 - DNA, 22 bp, Homo sapiens
actggcatcccactggtacagg

SEQ ID NO: 7565295 - DNA, 22 bp, Homo sapiens
actggcatcccactggtacagg

SEQ ID NO: 7565296 - DNA, 22 bp, Homo sapiens
actggcatctgtgggtagaggc

SEQ ID NO: 7565297 - DNA, 22 bp, Homo sapiens
actggcattccagcactataat

SEQ ID NO: 7565298 - DNA, 22 bp, Homo sapiens
actgcctgtagccctgagatgt

SEQ ID NO: 7565299 - DNA, 22 bp, Homo sapiens
actgcctgtagccctgagatgt

SEQ ID NO: 7565300 - DNA, 21 bp, Homo sapiens
actgcctggggtgctggccaa

SEQ ID NO: 7565301 - DNA, 21 bp, Homo sapiens
actgcctggggtgctggccaa

SEQ ID NO: 7565302 - DNA, 21 bp, Homo sapiens
actgcctggggtgctggccaa

SEQ ID NO: 7565303 - DNA, 21 bp, Homo sapiens
actgcctggggtgctggccaa

SEQ ID NO: 7565304 - DNA, 21 bp, Homo sapiens
actgcctggggtgctggccaa

SEQ ID NO: 7565305 - DNA, 18 bp, Homo sapiens
actgcctggcgaagatag

SEQ ID NO: 7565306 - DNA, 22 bp, Homo sapiens
actgcctggcctggcctcactg

SEQ ID NO: 7565307 - DNA, 22 bp, Homo sapiens
actgcctggcctggcctcactg

SEQ ID NO: 7565308 - DNA, 22 bp, Homo sapiens
actgcctggcctggcctcactg

SEQ ID NO: 7565309 - DNA, 22 bp, Homo sapiens
actgcctggcagaggtttgcaa

SEQ ID NO: 7565310 - DNA, 22 bp, Homo sapiens
actgcctggcctggcctcactg

SEQ ID NO: 7565311 - DNA, 22 bp, Homo sapiens
actgcctggcctggcctcactg

SEQ ID NO: 7565312 - DNA, 22 bp, Homo sapiens
actgcctgctcctggctccaca

SEQ ID NO: 7565313 - DNA, 22 bp, Homo sapiens
actgcctggcagaggtttgcaa

SEQ ID NO: 7565314 - DNA, 22 bp, Homo sapiens
actgcctgctcctggctccaca

SEQ ID NO: 7565315 - DNA, 23 bp, Homo sapiens
actgcctgctactatgcccacgg

SEQ ID NO: 7565316 - DNA, 22 bp, Homo sapiens
actgcctgctcctggctccaca

SEQ ID NO: 7565317 - DNA, 22 bp, Homo sapiens
actgcctgctcataacattgct

SEQ ID NO: 7565318 - DNA, 22 bp, Homo sapiens
actgcctgctcataacattgct

SEQ ID NO: 7565319 - DNA, 19 bp, Homo sapiens
actgcctgcaggtgttggg

SEQ ID NO: 7565320 - DNA, 19 bp, Homo sapiens
actgcctgcaggtgttggg

SEQ ID NO: 7565321 - DNA, 22 bp, Homo sapiens
actgcctgcatccttagggtag

SEQ ID NO: 7565322 - DNA, 22 bp, Homo sapiens
actgcctgcatccttagggtag

SEQ ID NO: 7565323 - DNA, 22 bp, Homo sapiens
actgcctgatgtggttctaaat

SEQ ID NO: 7565324 - DNA, 22 bp, Homo sapiens
actgcctgatgtggttctaaat

SEQ ID NO: 7565325 - DNA, 22 bp, Homo sapiens
actgcctgatgtggttctaaat

SEQ ID NO: 7565326 - DNA, 19 bp, Homo sapiens
actgcctgaggctcacagg

SEQ ID NO: 7565327 - DNA, 19 bp, Homo sapiens
actgcctgaggctcacagg

SEQ ID NO: 7565328 - DNA, 19 bp, Homo sapiens
actgcctgaggctcacagg

SEQ ID NO: 7565329 - DNA, 23 bp, Homo sapiens
actgcctgctactatgcccacgg

SEQ ID NO: 7565330 - DNA, 22 bp, Homo sapiens
actgcctgccttccaggtactg

SEQ ID NO: 7565331 - DNA, 23 bp, Homo sapiens
actgcctgctactatgcccacgg

SEQ ID NO: 7565332 - DNA, 23 bp, Homo sapiens
actgcctgctactatgcccacgg

SEQ ID NO: 7565333 - DNA, 22 bp, Homo sapiens
actgcctgcctctgattctgca

SEQ ID NO: 7565334 - DNA, 22 bp, Homo sapiens
actgcctgcctctgattctgca

SEQ ID NO: 7565335 - DNA, 22 bp, Homo sapiens
actgcctgcctctgattctgca

SEQ ID NO: 7565336 - DNA, 22 bp, Homo sapiens
actgcctgcctctgattctgca

SEQ ID NO: 7565337 - DNA, 22 bp, Homo sapiens
actgcctgccttccaggtactg

SEQ ID NO: 7565338 - DNA, 22 bp, Homo sapiens
agtgtccttgattcctgttgtt

SEQ ID NO: 7565339 - DNA, 22 bp, Homo sapiens
agtgtccttgattcctgttgtt

SEQ ID NO: 7565340 - DNA, 22 bp, Homo sapiens
agtgtccttgaggttcctagga

SEQ ID NO: 7565341 - DNA, 22 bp, Homo sapiens
agtgtccttgttattactgctc

SEQ ID NO: 7565342 - DNA, 22 bp, Homo sapiens
agtgtcctttctgttccagcca

SEQ ID NO: 7565343 - DNA, 22 bp, Homo sapiens
agtgtccttgaggttcctagga

SEQ ID NO: 7565344 - DNA, 22 bp, Homo sapiens
agtgtccttgaggttcctagga

SEQ ID NO: 7565345 - DNA, 22 bp, Homo sapiens
agtgtcctgtgtcccagactgt

SEQ ID NO: 7565346 - DNA, 22 bp, Homo sapiens
agtgtccttagttagctttggg

SEQ ID NO: 7565347 - DNA, 22 bp, Homo sapiens
agtgtcctgtgtcccagactgt

SEQ ID NO: 7565348 - DNA, 22 bp, Homo sapiens
agtgtcctgtgtcccagactgt

SEQ ID NO: 7565349 - DNA, 22 bp, Homo sapiens
actgggaggcaaagagcaagga

SEQ ID NO: 7565350 - DNA, 22 bp, Homo sapiens
actgggaggcaaagagcaagga

SEQ ID NO: 7565351 - DNA, 22 bp, Homo sapiens
actgggaggcaaagagcaagga

SEQ ID NO: 7565352 - DNA, 21 bp, Homo sapiens
agtgtctctggaagcacgtgt

SEQ ID NO: 7565353 - DNA, 21 bp, Homo sapiens
agtgtctctggaagcacgtgt

SEQ ID NO: 7565354 - DNA, 21 bp, Homo sapiens
agtgtccttttactgtgaata

SEQ ID NO: 7565355 - DNA, 22 bp, Homo sapiens
agtgtctcagccccaactagag

SEQ ID NO: 7565356 - DNA, 22 bp, Homo sapiens
actgggcagggaaggagaccga

SEQ ID NO: 7565357 - DNA, 20 bp, Homo sapiens
actgggcatacctgtcctgt

SEQ ID NO: 7565358 - DNA, 22 bp, Homo sapiens
actgggcagggaaggagaccga

SEQ ID NO: 7565359 - DNA, 22 bp, Homo sapiens
actgggcagggaaggagaccga

SEQ ID NO: 7565360 - DNA, 22 bp, Homo sapiens
actgggaggcaaagagcaagga

SEQ ID NO: 7565361 - DNA, 22 bp, Homo sapiens
actgggcaccatcatgagatgg

SEQ ID NO: 7565362 - DNA, 22 bp, Homo sapiens
actgggaggcaaagagcaagga

SEQ ID NO: 7565363 - DNA, 22 bp, Homo sapiens
actgggcagcagctcgagccgc

SEQ ID NO: 7565364 - DNA, 22 bp, Homo sapiens
actgggcagggaaggagaccga

SEQ ID NO: 7565365 - DNA, 21 bp, Homo sapiens
actggctggtggctaagaatc

SEQ ID NO: 7565366 - DNA, 21 bp, Homo sapiens
actggctggtggctaagaatc

SEQ ID NO: 7565367 - DNA, 22 bp, Homo sapiens
actggctggccgcgctcttcgc

SEQ ID NO: 7565368 - DNA, 21 bp, Homo sapiens
actggctggctgagtttcctg

SEQ ID NO: 7565369 - DNA, 21 bp, Homo sapiens
actggctggctgagtttcctg

SEQ ID NO: 7565370 - DNA, 21 bp, Homo sapiens
actggctggctgagtttcctg

SEQ ID NO: 7565371 - DNA, 21 bp, Homo sapiens
actggctggctgagtttcctg

SEQ ID NO: 7565372 - DNA, 21 bp, Homo sapiens
actggctggctgagtttcctg

SEQ ID NO: 7565373 - DNA, 22 bp, Homo sapiens
actggctggccacaccctggta

SEQ ID NO: 7565374 - DNA, 22 bp, Homo sapiens
actggctggccacaccctggta

SEQ ID NO: 7565375 - DNA, 22 bp, Homo sapiens
actggctggccacaccctggta

SEQ ID NO: 7565376 - DNA, 22 bp, Homo sapiens
actggctggccacaccctggta

SEQ ID NO: 7565377 - DNA, 22 bp, Homo sapiens
actggctggccacaccctggta

SEQ ID NO: 7565378 - DNA, 22 bp, Homo sapiens
actggctggccgcgctcttcgc

SEQ ID NO: 7565379 - DNA, 22 bp, Homo sapiens
actggctggccgcgctcttcgc

SEQ ID NO: 7565380 - DNA, 22 bp, Homo sapiens
actggctggccgcgctcttcgc

SEQ ID NO: 7565381 - DNA, 22 bp, Homo sapiens
actggctggccgcgctcttcgc

SEQ ID NO: 7565382 - DNA, 22 bp, Homo sapiens
actggctgtgcagagggcagta

SEQ ID NO: 7565383 - DNA, 22 bp, Homo sapiens
actggctgtgcagagggcagta

SEQ ID NO: 7565384 - DNA, 22 bp, Homo sapiens
actggctgtgcagagggcagta

SEQ ID NO: 7565385 - DNA, 21 bp, Homo sapiens
actggctgtcttcctactggt

SEQ ID NO: 7565386 - DNA, 22 bp, Homo sapiens
actggctgtgcccatagagctc

SEQ ID NO: 7565387 - DNA, 22 bp, Homo sapiens
actggctgtgcagagggcagta

SEQ ID NO: 7565388 - DNA, 22 bp, Homo sapiens
actggctgtgcagagggcagta

SEQ ID NO: 7565389 - DNA, 22 bp, Homo sapiens
actggctgtgcagagggcagta

SEQ ID NO: 7565390 - DNA, 21 bp, Homo sapiens
actggctgtcttcctactggt

SEQ ID NO: 7565391 - DNA, 21 bp, Homo sapiens
actggctgtcttcctactggt

SEQ ID NO: 7565392 - DNA, 21 bp, Homo sapiens
actggctgtcttcctactggt

SEQ ID NO: 7565393 - DNA, 21 bp, Homo sapiens
actggctgtcttcctactggt

SEQ ID NO: 7565394 - DNA, 21 bp, Homo sapiens
actggctggtggctaagaatc

SEQ ID NO: 7565395 - DNA, 21 bp, Homo sapiens
actggctggtggctaagaatc

SEQ ID NO: 7565396 - DNA, 22 bp, Homo sapiens
actggctgtggccacggctgct

SEQ ID NO: 7565397 - DNA, 22 bp, Homo sapiens
actggctgtggccacggctgct

SEQ ID NO: 7565398 - DNA, 22 bp, Homo sapiens
actggctgtggccacggctgct

SEQ ID NO: 7565399 - DNA, 22 bp, Homo sapiens
actggctgtggccacggctgct

SEQ ID NO: 7565400 - DNA, 22 bp, Homo sapiens
actggctgtgcccatagagctc

SEQ ID NO: 7565401 - DNA, 22 bp, Homo sapiens
actggctgtgcccatagagctc

SEQ ID NO: 7565402 - DNA, 22 bp, Homo sapiens
actggctgtgcccatagagctc

SEQ ID NO: 7565403 - DNA, 22 bp, Homo sapiens
actggctgtgtaacctcaggca

SEQ ID NO: 7565404 - DNA, 22 bp, Homo sapiens
actggctgtgtaacctcaggca

SEQ ID NO: 7565405 - DNA, 22 bp, Homo sapiens
actggctgtgtaacctcaggca

SEQ ID NO: 7565406 - DNA, 22 bp, Homo sapiens
actggcttcagggggaaagtcc

SEQ ID NO: 7565407 - DNA, 22 bp, Homo sapiens
actggctgtgtaacctcaggca

SEQ ID NO: 7565408 - DNA, 22 bp, Homo sapiens
actggcttcaaaccgtttcacc

SEQ ID NO: 7565409 - DNA, 22 bp, Homo sapiens
actggcttcaaaccgtttcacc

SEQ ID NO: 7565410 - DNA, 22 bp, Homo sapiens
actggcttggcaggaggaagat

SEQ ID NO: 7565411 - DNA, 22 bp, Homo sapiens
actggcttcagggggaaagtcc

SEQ ID NO: 7565412 - DNA, 22 bp, Homo sapiens
actggcttggcaggaggaagat

SEQ ID NO: 7565413 - DNA, 22 bp, Homo sapiens
agtgtcctggcaagggtttcag

SEQ ID NO: 7565414 - DNA, 22 bp, Homo sapiens
actgggccaggtgtgggtgagt

SEQ ID NO: 7565415 - DNA, 22 bp, Homo sapiens
actgggccaggggctttggagc

SEQ ID NO: 7565416 - DNA, 22 bp, Homo sapiens
actgggccaggggctttggagc

SEQ ID NO: 7565417 - DNA, 22 bp, Homo sapiens
actgggccaggggctttggagc

SEQ ID NO: 7565418 - DNA, 23 bp, Homo sapiens
actgggccagctacttagcactg

SEQ ID NO: 7565419 - DNA, 22 bp, Homo sapiens
actgggccaggggctttggagc

SEQ ID NO: 7565420 - DNA, 22 bp, Homo sapiens
actgggccaggggctttggagc

SEQ ID NO: 7565421 - DNA, 22 bp, Homo sapiens
actgggccaggggctttggagc

SEQ ID NO: 7565422 - DNA, 22 bp, Homo sapiens
actgggcccagtggtgtggctg

SEQ ID NO: 7565423 - DNA, 22 bp, Homo sapiens
actgggcccagtggtgtggctg

SEQ ID NO: 7565424 - DNA, 22 bp, Homo sapiens
actgggcccagtggtgtggctg

SEQ ID NO: 7565425 - DNA, 22 bp, Homo sapiens
actgggcccagtggtgtggctg

SEQ ID NO: 7565426 - DNA, 22 bp, Homo sapiens
actgggccaggtgtgggtgagt

SEQ ID NO: 7565427 - DNA, 22 bp, Homo sapiens
actgggccaggtgtgggtgagt

SEQ ID NO: 7565428 - DNA, 22 bp, Homo sapiens
actgggccaggtgtgggtgagt

SEQ ID NO: 7565429 - DNA, 22 bp, Homo sapiens
actgggccagatcagagcaact

SEQ ID NO: 7565430 - DNA, 22 bp, Homo sapiens
actgggccagacactgattccc

SEQ ID NO: 7565431 - DNA, 22 bp, Homo sapiens
actgggccagatcagagcaact

SEQ ID NO: 7565432 - DNA, 22 bp, Homo sapiens
actgggccagatcagagcaact

SEQ ID NO: 7565433 - DNA, 18 bp, Homo sapiens
actgggccagcaggcagg

SEQ ID NO: 7565434 - DNA, 23 bp, Homo sapiens
actgggccagctacttagcactg

SEQ ID NO: 7565435 - DNA, 23 bp, Homo sapiens
actgggccagctacttagcactg

SEQ ID NO: 7565436 - DNA, 23 bp, Homo sapiens
actgggccagctacttagcactg

SEQ ID NO: 7565437 - DNA, 18 bp, Homo sapiens
actgggccagcaggcagg

SEQ ID NO: 7565438 - DNA, 18 bp, Homo sapiens
actgggccagcaggcagg

SEQ ID NO: 7565439 - DNA, 18 bp, Homo sapiens
actgggccagcaggcagg

SEQ ID NO: 7565440 - DNA, 22 bp, Homo sapiens
actgggcatgatgagtcaccta

SEQ ID NO: 7565441 - DNA, 22 bp, Homo sapiens
actgggcattttgaacgttctt

SEQ ID NO: 7565442 - DNA, 22 bp, Homo sapiens
actgggcatcccatggcagagc

SEQ ID NO: 7565443 - DNA, 20 bp, Homo sapiens
actgggcatacctgtcctgt

SEQ ID NO: 7565444 - DNA, 22 bp, Homo sapiens
actgggccagacactgattccc

SEQ ID NO: 7565445 - DNA, 22 bp, Homo sapiens
actgggccagacactgattccc

SEQ ID NO: 7565446 - DNA, 22 bp, Homo sapiens
actgggccagacactgattccc

SEQ ID NO: 7565447 - DNA, 22 bp, Homo sapiens
actgggccagatcagagcaact

SEQ ID NO: 7565448 - DNA, 22 bp, Homo sapiens
actgggccaactatttgttcta

SEQ ID NO: 7565449 - DNA, 22 bp, Homo sapiens
actgggccaactatttgttcta

SEQ ID NO: 7565450 - DNA, 22 bp, Homo sapiens
actgggccaactatttgttcta

SEQ ID NO: 7565451 - DNA, 22 bp, Homo sapiens
actgggccaactatttgttcta

SEQ ID NO: 7565452 - DNA, 22 bp, Homo sapiens
actgggccacatagacctgctg

SEQ ID NO: 7565453 - DNA, 22 bp, Homo sapiens
actgggccacatagacctgctg

SEQ ID NO: 7565454 - DNA, 22 bp, Homo sapiens
actgggccacatagacctgctg

SEQ ID NO: 7565455 - DNA, 22 bp, Homo sapiens
actgggccacatagacctgctg

SEQ ID NO: 7565456 - DNA, 22 bp, Homo sapiens
actgggccacatagacctgctg

SEQ ID NO: 7565457 - DNA, 22 bp, Homo sapiens
actgggcctacccagattggca

SEQ ID NO: 7565458 - DNA, 22 bp, Homo sapiens
actgggcctacccagattggca

SEQ ID NO: 7565459 - DNA, 22 bp, Homo sapiens
actgggcctacccagattggca

SEQ ID NO: 7565460 - DNA, 22 bp, Homo sapiens
actgggcctacccagattggca

SEQ ID NO: 7565461 - DNA, 22 bp, Homo sapiens
actgggccggtgcagagtagtt

SEQ ID NO: 7565462 - DNA, 22 bp, Homo sapiens
actgggccggtgcagagtagtt

SEQ ID NO: 7565463 - DNA, 22 bp, Homo sapiens
actgggccggtgcagagtagtt

SEQ ID NO: 7565464 - DNA, 22 bp, Homo sapiens
actgggccgcgctgcagagggc

SEQ ID NO: 7565465 - DNA, 22 bp, Homo sapiens
actgggccgcgctgcagagggc

SEQ ID NO: 7565466 - DNA, 22 bp, Homo sapiens
actgggccggtgcagagtagtt

SEQ ID NO: 7565467 - DNA, 22 bp, Homo sapiens
actgggccgaaatggacagaat

SEQ ID NO: 7565468 - DNA, 22 bp, Homo sapiens
actgggccgaaatggacagaat

SEQ ID NO: 7565469 - DNA, 22 bp, Homo sapiens
actgggccgaaatggacagaat

SEQ ID NO: 7565470 - DNA, 22 bp, Homo sapiens
actgggccgcgctgcagagggc

SEQ ID NO: 7565471 - DNA, 22 bp, Homo sapiens
actgggccgcgctgcagagggc

SEQ ID NO: 7565472 - DNA, 22 bp, Homo sapiens
actgggccgcgctgcagagggc

SEQ ID NO: 7565473 - DNA, 22 bp, Homo sapiens
actgggcccatatactcagtct

SEQ ID NO: 7565474 - DNA, 22 bp, Homo sapiens
actgggcccatatactcagtct

SEQ ID NO: 7565475 - DNA, 22 bp, Homo sapiens
actgggcccagtggtgtggctg

SEQ ID NO: 7565476 - DNA, 22 bp, Homo sapiens
actgggccgaaatggacagaat

SEQ ID NO: 7565477 - DNA, 22 bp, Homo sapiens
actgggcccatatactcagtct

SEQ ID NO: 7565478 - DNA, 22 bp, Homo sapiens
actgggcctggattggcgtgtc

SEQ ID NO: 7565479 - DNA, 22 bp, Homo sapiens
actgggcctgattgggtcggag

SEQ ID NO: 7565480 - DNA, 22 bp, Homo sapiens
actgggcctgattgggtcggag

SEQ ID NO: 7565481 - DNA, 22 bp, Homo sapiens
actgggcctggattggcgtgtc

SEQ ID NO: 7565482 - DNA, 22 bp, Homo sapiens
actgggcctgattgggtcggag

SEQ ID NO: 7565483 - DNA, 22 bp, Homo sapiens
actgggcctgattgggtcggag

SEQ ID NO: 7565484 - DNA, 20 bp, Homo sapiens
actgggcctaggggaggcat

SEQ ID NO: 7565485 - DNA, 20 bp, Homo sapiens
actgggcctaggggaggcat

SEQ ID NO: 7565486 - DNA, 20 bp, Homo sapiens
actgggcctaggggaggcat

SEQ ID NO: 7565487 - DNA, 22 bp, Homo sapiens
actgggcctgtacagagaaaac

SEQ ID NO: 7565488 - DNA, 22 bp, Homo sapiens
actgggcctgtacagagaaaac

SEQ ID NO: 7565489 - DNA, 22 bp, Homo sapiens
actgggcctgtacagagaaaac

SEQ ID NO: 7565490 - DNA, 22 bp, Homo sapiens
actgggcctggattggcgtgtc

SEQ ID NO: 7565491 - DNA, 22 bp, Homo sapiens
actgggcctggattggcgtgtc

SEQ ID NO: 7565492 - DNA, 22 bp, Homo sapiens
actgggccttgccatggcagcc

SEQ ID NO: 7565493 - DNA, 22 bp, Homo sapiens
actgggccttgccatggcagcc

SEQ ID NO: 7565494 - DNA, 22 bp, Homo sapiens
actgggccttgccatggcagcc

SEQ ID NO: 7565495 - DNA, 22 bp, Homo sapiens
actgggcctgtacagagaaaac

SEQ ID NO: 7565496 - DNA, 22 bp, Homo sapiens
actctgagaactgagattccct

SEQ ID NO: 7565497 - DNA, 22 bp, Homo sapiens
actctgagaactgagattccct

SEQ ID NO: 7565498 - DNA, 22 bp, Homo sapiens
actctgagaatccctggacttt

SEQ ID NO: 7565499 - DNA, 22 bp, Homo sapiens
actctgagaatccctggacttt

SEQ ID NO: 7565500 - DNA, 22 bp, Homo sapiens
actctgagaatccctggacttt

SEQ ID NO: 7565501 - DNA, 22 bp, Homo sapiens
actctgagaaaacactatgctg

SEQ ID NO: 7565502 - DNA, 22 bp, Homo sapiens
actctgagaaaacactatgctg

SEQ ID NO: 7565503 - DNA, 23 bp, Homo sapiens
actctgacttagttatagctatt

SEQ ID NO: 7565504 - DNA, 23 bp, Homo sapiens
actctgacttagttatagctatt

SEQ ID NO: 7565505 - DNA, 22 bp, Homo sapiens
actctgactggagtgagagagg

SEQ ID NO: 7565506 - DNA, 22 bp, Homo sapiens
actctgacatttaaaaagcaat

SEQ ID NO: 7565507 - DNA, 22 bp, Homo sapiens
actctgagtcatgcactccttg

SEQ ID NO: 7565508 - DNA, 19 bp, Homo sapiens
actctgaggctgagacaag

SEQ ID NO: 7565509 - DNA, 22 bp, Homo sapiens
actctgaggcaggtcagggcag

SEQ ID NO: 7565510 - DNA, 22 bp, Homo sapiens
actctgagccaccagatcccca

SEQ ID NO: 7565511 - DNA, 22 bp, Homo sapiens
actctgagccaccagatcccca

SEQ ID NO: 7565512 - DNA, 19 bp, Homo sapiens
actctgagcttgctctatc

SEQ ID NO: 7565513 - DNA, 22 bp, Homo sapiens
actctgaggagtgactagaggt

SEQ ID NO: 7565514 - DNA, 22 bp, Homo sapiens
actctgaggaatgtacaggacc

SEQ ID NO: 7565515 - DNA, 22 bp, Homo sapiens
actctgaaatagaggctggtgg

SEQ ID NO: 7565516 - DNA, 22 bp, Homo sapiens
actctgaaatagaggctggtgg

SEQ ID NO: 7565517 - DNA, 22 bp, Homo sapiens
actctgaaccagagatcatacc

SEQ ID NO: 7565518 - DNA, 21 bp, Homo sapiens
actctgaaaattaatagttat

SEQ ID NO: 7565519 - DNA, 21 bp, Homo sapiens
actctgaaaattaatagttat

SEQ ID NO: 7565520 - DNA, 22 bp, Homo sapiens
actctgaatgtgcatgtaaatc

SEQ ID NO: 7565521 - DNA, 22 bp, Homo sapiens
actctgaatgtgcatgtaaatc

SEQ ID NO: 7565522 - DNA, 22 bp, Homo sapiens
actctgaactccaggaggctca

SEQ ID NO: 7565523 - DNA, 22 bp, Homo sapiens
actctgaagaagacttccagac

SEQ ID NO: 7565524 - DNA, 22 bp, Homo sapiens
actctgaagaagacttccagac

SEQ ID NO: 7565525 - DNA, 22 bp, Homo sapiens
actctgaactccaggaggctca

SEQ ID NO: 7565526 - DNA, 22 bp, Homo sapiens
actctgaaccagagatcatacc

SEQ ID NO: 7565527 - DNA, 21 bp, Homo sapiens
actctgccagtctcctgcact

SEQ ID NO: 7565528 - DNA, 21 bp, Homo sapiens
actctgccagtctcctgcact

SEQ ID NO: 7565529 - DNA, 22 bp, Homo sapiens
actctgccatcccaggtgctgt

SEQ ID NO: 7565530 - DNA, 21 bp, Homo sapiens
actctgccagtctcctgcact

SEQ ID NO: 7565531 - DNA, 21 bp, Homo sapiens
actctgccagtctcctgcact

SEQ ID NO: 7565532 - DNA, 22 bp, Homo sapiens
actctgagttcctacttgctcc

SEQ ID NO: 7565533 - DNA, 22 bp, Homo sapiens
actctgagttcctacttgctcc

SEQ ID NO: 7565534 - DNA, 18 bp, Homo sapiens
actctgagtccacttaag

SEQ ID NO: 7565535 - DNA, 22 bp, Homo sapiens
actctgcaatgtggcaagaaca

SEQ ID NO: 7565536 - DNA, 22 bp, Homo sapiens
actctgccctaggcctctgggg

SEQ ID NO: 7565537 - DNA, 22 bp, Homo sapiens
actctgccctaggcctctgggg

SEQ ID NO: 7565538 - DNA, 22 bp, Homo sapiens
actctgccccgagttctgggaa

SEQ ID NO: 7565539 - DNA, 22 bp, Homo sapiens
actctgcctgaacctcctgcaa

SEQ ID NO: 7565540 - DNA, 22 bp, Homo sapiens
actctgccatcccaggtgctgt

SEQ ID NO: 7565541 - DNA, 22 bp, Homo sapiens
actctgccatcccaggtgctgt

SEQ ID NO: 7565542 - DNA, 22 bp, Homo sapiens
actctgccccgagttctgggaa

SEQ ID NO: 7565543 - DNA, 22 bp, Homo sapiens
actctgccccgagttctgggaa

SEQ ID NO: 7565544 - DNA, 22 bp, Homo sapiens
actctgccatcccaggtgctgt

SEQ ID NO: 7565545 - DNA, 22 bp, Homo sapiens
actctgccttagtcctggggct

SEQ ID NO: 7565546 - DNA, 22 bp, Homo sapiens
actctgccttagtcctggggct

SEQ ID NO: 7565547 - DNA, 22 bp, Homo sapiens
actctgcctttcagcagatgaa

SEQ ID NO: 7565548 - DNA, 22 bp, Homo sapiens
actctgcctttcagcagatgaa

SEQ ID NO: 7565549 - DNA, 18 bp, Homo sapiens
actctgcggaggccccag

SEQ ID NO: 7565550 - DNA, 22 bp, Homo sapiens
actctgcctttcagcagatgaa

SEQ ID NO: 7565551 - DNA, 22 bp, Homo sapiens
actctgcctttcagcagatgaa

SEQ ID NO: 7565552 - DNA, 22 bp, Homo sapiens
actctgctaaatgtaagttggt

SEQ ID NO: 7565553 - DNA, 22 bp, Homo sapiens
actctgctaaatgtaagttggt

SEQ ID NO: 7565554 - DNA, 22 bp, Homo sapiens
actctgctaaatgtgtaggctc

SEQ ID NO: 7565555 - DNA, 22 bp, Homo sapiens
actgaatttattagtatagtct

SEQ ID NO: 7565556 - DNA, 22 bp, Homo sapiens
actgaatttattagtatagtct

SEQ ID NO: 7565557 - DNA, 18 bp, Homo sapiens
actctgcggaggccccag

SEQ ID NO: 7565558 - DNA, 18 bp, Homo sapiens
actctgcggaggccccag

SEQ ID NO: 7565559 - DNA, 22 bp, Homo sapiens
actgaattttaattagatctgc

SEQ ID NO: 7565560 - DNA, 22 bp, Homo sapiens
actgaattttaattagatctgc

SEQ ID NO: 7565561 - DNA, 22 bp, Homo sapiens
actgaattttaattagatctgc

SEQ ID NO: 7565562 - DNA, 22 bp, Homo sapiens
actgaatttgtgtagatggtct

SEQ ID NO: 7565563 - DNA, 22 bp, Homo sapiens
actgaattttaattagatctgc

SEQ ID NO: 7565564 - DNA, 22 bp, Homo sapiens
actgaatttgtgtagatggtct

SEQ ID NO: 7565565 - DNA, 22 bp, Homo sapiens
actgaattttaattagatctgc

SEQ ID NO: 7565566 - DNA, 22 bp, Homo sapiens
actgaattttaattagatctgc

SEQ ID NO: 7565567 - DNA, 22 bp, Homo sapiens
actgagagtcaagatagcatgg

SEQ ID NO: 7565568 - DNA, 22 bp, Homo sapiens
actgagagtcaagatagcatgg

SEQ ID NO: 7565569 - DNA, 22 bp, Homo sapiens
actgagagtcttagaaacacat

SEQ ID NO: 7565570 - DNA, 22 bp, Homo sapiens
actgagaggtgatagtgacatt

SEQ ID NO: 7565571 - DNA, 22 bp, Homo sapiens
actgagagggaggctgtccggt

SEQ ID NO: 7565572 - DNA, 22 bp, Homo sapiens
actgagaggtgatagtgacatt

SEQ ID NO: 7565573 - DNA, 22 bp, Homo sapiens
actgagagggaggctgtccggt

SEQ ID NO: 7565574 - DNA, 22 bp, Homo sapiens
actgagaggtgatagtgacatt

SEQ ID NO: 7565575 - DNA, 21 bp, Homo sapiens
actgagagatgttggatcata

SEQ ID NO: 7565576 - DNA, 21 bp, Homo sapiens
actgagagatgttggatcata

SEQ ID NO: 7565577 - DNA, 22 bp, Homo sapiens
actgagagagctgggtatctcc

SEQ ID NO: 7565578 - DNA, 22 bp, Homo sapiens
actgacaaatatagcttcgtct

SEQ ID NO: 7565579 - DNA, 22 bp, Homo sapiens
actgaattttcacttattttag

SEQ ID NO: 7565580 - DNA, 22 bp, Homo sapiens
actgaattttcacttattttag

SEQ ID NO: 7565581 - DNA, 22 bp, Homo sapiens
actgacaaatatagcttcgtct

SEQ ID NO: 7565582 - DNA, 21 bp, Homo sapiens
actgagagatgttggatcata

SEQ ID NO: 7565583 - DNA, 21 bp, Homo sapiens
actgagagatgttggatcata

SEQ ID NO: 7565584 - DNA, 22 bp, Homo sapiens
actgagagcgtgtacaaactta

SEQ ID NO: 7565585 - DNA, 22 bp, Homo sapiens
actgagagcgtgtacaaactta

SEQ ID NO: 7565586 - DNA, 22 bp, Homo sapiens
actgagagcgtgtacaaactta

SEQ ID NO: 7565587 - DNA, 22 bp, Homo sapiens
actgagaggaaattgagactat

SEQ ID NO: 7565588 - DNA, 22 bp, Homo sapiens
actgagagggaggctgtccggt

SEQ ID NO: 7565589 - DNA, 22 bp, Homo sapiens
actgagaggaaattgagactat

SEQ ID NO: 7565590 - DNA, 22 bp, Homo sapiens
actgagaggaaattgagactat

SEQ ID NO: 7565591 - DNA, 22 bp, Homo sapiens
actgagagttgtgcattcatgc

SEQ ID NO: 7565592 - DNA, 22 bp, Homo sapiens
actgagagttgaaaagggagga

SEQ ID NO: 7565593 - DNA, 22 bp, Homo sapiens
actgagagttgaaaagggagga

SEQ ID NO: 7565594 - DNA, 22 bp, Homo sapiens
actgagatttacatgttctagt

SEQ ID NO: 7565595 - DNA, 22 bp, Homo sapiens
actgagatttacatgttctagt

SEQ ID NO: 7565596 - DNA, 22 bp, Homo sapiens
actgagcaagtgctgctcacgt

SEQ ID NO: 7565597 - DNA, 22 bp, Homo sapiens
actgagcaatgcagtgggagcg

SEQ ID NO: 7565598 - DNA, 23 bp, Homo sapiens
actgagcaatgtttacatacttg

SEQ ID NO: 7565599 - DNA, 22 bp, Homo sapiens
actgagcaggagaatcacttta

SEQ ID NO: 7565600 - DNA, 22 bp, Homo sapiens
actgagcagaagagatctgtga

SEQ ID NO: 7565601 - DNA, 22 bp, Homo sapiens
actgagcagtagattttctgtt

SEQ ID NO: 7565602 - DNA, 22 bp, Homo sapiens
actgagcataaatatgtgtcca

SEQ ID NO: 7565603 - DNA, 22 bp, Homo sapiens
actgagcacttggtatatttcc

SEQ ID NO: 7565604 - DNA, 22 bp, Homo sapiens
actgagcagaagagatctgtga

SEQ ID NO: 7565605 - DNA, 22 bp, Homo sapiens
actgagcactcacttttgttat

SEQ ID NO: 7565606 - DNA, 22 bp, Homo sapiens
actgagcactcacttttgttat

SEQ ID NO: 7565607 - DNA, 22 bp, Homo sapiens
actgagcctgtgccctcatcag

SEQ ID NO: 7565608 - DNA, 22 bp, Homo sapiens
actgagcctgtgccctcatcag

SEQ ID NO: 7565609 - DNA, 22 bp, Homo sapiens
actgagccttgaagctagatag

SEQ ID NO: 7565610 - DNA, 22 bp, Homo sapiens
actgagctccctgagggcaggc

SEQ ID NO: 7565611 - DNA, 22 bp, Homo sapiens
actgagctccaagcctggaatc

SEQ ID NO: 7565612 - DNA, 22 bp, Homo sapiens
actgagctctgatgagatttgg

SEQ ID NO: 7565613 - DNA, 22 bp, Homo sapiens
agtgaaatttgtttagataggt

SEQ ID NO: 7565614 - DNA, 22 bp, Homo sapiens
actgagctctaggttttgaacc

SEQ ID NO: 7565615 - DNA, 22 bp, Homo sapiens
agtgaaatttgtttagataggt

SEQ ID NO: 7565616 - DNA, 22 bp, Homo sapiens
actgagcataaatatgtgtcca

SEQ ID NO: 7565617 - DNA, 22 bp, Homo sapiens
actgagcatggctcacagagag

SEQ ID NO: 7565618 - DNA, 23 bp, Homo sapiens
actgagcattagtatttttataa

SEQ ID NO: 7565619 - DNA, 22 bp, Homo sapiens
actgagcctgtgccctcatcag

SEQ ID NO: 7565620 - DNA, 22 bp, Homo sapiens
actgagcctctcttcccacctc

SEQ ID NO: 7565621 - DNA, 23 bp, Homo sapiens
actgagcattagtatttttataa

SEQ ID NO: 7565622 - DNA, 23 bp, Homo sapiens
actgagcattagtatttttataa

SEQ ID NO: 7565623 - DNA, 22 bp, Homo sapiens
agtgaacaagtcgcgatgtttt

SEQ ID NO: 7565624 - DNA, 22 bp, Homo sapiens
agtgaacaagttaagaacacta

SEQ ID NO: 7565625 - DNA, 19 bp, Homo sapiens
agtgaacacaaagagaagg

SEQ ID NO: 7565626 - DNA, 22 bp, Homo sapiens
agtgaacaagttaagaacacta

SEQ ID NO: 7565627 - DNA, 19 bp, Homo sapiens
agtgaacacaaagagaagg

SEQ ID NO: 7565628 - DNA, 19 bp, Homo sapiens
agtgaacacaaagagaagg

SEQ ID NO: 7565629 - DNA, 22 bp, Homo sapiens
agtgaacaaaggtagtgagcat

SEQ ID NO: 7565630 - DNA, 22 bp, Homo sapiens
agtgaacaaggatgccacctct

SEQ ID NO: 7565631 - DNA, 22 bp, Homo sapiens
agtgaacaaggatgccacctct

SEQ ID NO: 7565632 - DNA, 22 bp, Homo sapiens
agtgaacaaaggtagtgagcat

SEQ ID NO: 7565633 - DNA, 22 bp, Homo sapiens
agtgaaatttgtttagataggt

SEQ ID NO: 7565634 - DNA, 22 bp, Homo sapiens
agtgaacaaaggtagtgagcat

SEQ ID NO: 7565635 - DNA, 22 bp, Homo sapiens
agtgaacaaaggtagtgagcat

SEQ ID NO: 7565636 - DNA, 22 bp, Homo sapiens
agtgaacagtttggaacacatg

SEQ ID NO: 7565637 - DNA, 22 bp, Homo sapiens
agtgaacagtttggaacacatg

SEQ ID NO: 7565638 - DNA, 22 bp, Homo sapiens
agtgaacagtttggaacacatg

SEQ ID NO: 7565639 - DNA, 22 bp, Homo sapiens
agtgaacagtttggaacacatg

SEQ ID NO: 7565640 - DNA, 22 bp, Homo sapiens
agtgaacagtttggaacacatg

SEQ ID NO: 7565641 - DNA, 22 bp, Homo sapiens
agtgaacagtttggaacacatg

SEQ ID NO: 7565642 - DNA, 22 bp, Homo sapiens
agtgaacagtttggaacacatg

SEQ ID NO: 7565643 - DNA, 22 bp, Homo sapiens
agtgaactgtggcccgtgaact

SEQ ID NO: 7565644 - DNA, 22 bp, Homo sapiens
agtgaactctcagtaaataaat

SEQ ID NO: 7565645 - DNA, 19 bp, Homo sapiens
agtgaactccatatcaggt

SEQ ID NO: 7565646 - DNA, 22 bp, Homo sapiens
agtgaagaggaagtggggcaca

SEQ ID NO: 7565647 - DNA, 22 bp, Homo sapiens
agtgaagaggaagtggggcaca

SEQ ID NO: 7565648 - DNA, 22 bp, Homo sapiens
actgcactccagcctgggtgat

SEQ ID NO: 7565649 - DNA, 22 bp, Homo sapiens
actgcactccagcctgggtgat

SEQ ID NO: 7565650 - DNA, 22 bp, Homo sapiens
actgcactccagcctgggtgat

SEQ ID NO: 7565651 - DNA, 22 bp, Homo sapiens
actgcactccagcctgggtgat

SEQ ID NO: 7565652 - DNA, 22 bp, Homo sapiens
actgcactccagcctgggtgat

SEQ ID NO: 7565653 - DNA, 22 bp, Homo sapiens
actgcactccagcctgggtgat

SEQ ID NO: 7565654 - DNA, 22 bp, Homo sapiens
actgcactccagcctgggtgat

SEQ ID NO: 7565655 - DNA, 22 bp, Homo sapiens
actgcactccagcctgggtgat

SEQ ID NO: 7565656 - DNA, 22 bp, Homo sapiens
actgcactccagcctgggtgat

SEQ ID NO: 7565657 - DNA, 22 bp, Homo sapiens
actgcactccagcctgggtgat

SEQ ID NO: 7565658 - DNA, 22 bp, Homo sapiens
actgcactccagcctgggtgat

SEQ ID NO: 7565659 - DNA, 22 bp, Homo sapiens
actgcactccagcctgggtgat

SEQ ID NO: 7565660 - DNA, 22 bp, Homo sapiens
actgcactccagcctgggtgat

SEQ ID NO: 7565661 - DNA, 22 bp, Homo sapiens
actgcactccaacctgggcaat

SEQ ID NO: 7565662 - DNA, 22 bp, Homo sapiens
actgcactccagcctgggtgat

SEQ ID NO: 7565663 - DNA, 22 bp, Homo sapiens
actgcactccagcctgggtgat

SEQ ID NO: 7565664 - DNA, 22 bp, Homo sapiens
actgcacttcaccctgggtgac

SEQ ID NO: 7565665 - DNA, 22 bp, Homo sapiens
actgcactcctgcctgggtaac

SEQ ID NO: 7565666 - DNA, 22 bp, Homo sapiens
actgcactgatttatcatccca

SEQ ID NO: 7565667 - DNA, 22 bp, Homo sapiens
actgcacttacatagaggaggc

SEQ ID NO: 7565668 - DNA, 22 bp, Homo sapiens
actgcactcctgcctgggtaac

SEQ ID NO: 7565669 - DNA, 22 bp, Homo sapiens
actgcactcctgcctgggtaac

SEQ ID NO: 7565670 - DNA, 22 bp, Homo sapiens
actgcactcctgcctgggtaac

SEQ ID NO: 7565671 - DNA, 22 bp, Homo sapiens
actgcactcctgcctgggtaac

SEQ ID NO: 7565672 - DNA, 22 bp, Homo sapiens
actgcactcctgcctgggtaac

SEQ ID NO: 7565673 - DNA, 22 bp, Homo sapiens
actgcactcctgcctgggtaac

SEQ ID NO: 7565674 - DNA, 22 bp, Homo sapiens
actgcactcctgcctgggtaac

SEQ ID NO: 7565675 - DNA, 22 bp, Homo sapiens
actgcactcctgcctgggtaac

SEQ ID NO: 7565676 - DNA, 22 bp, Homo sapiens
actgcactcctgcctgggtaac

SEQ ID NO: 7565677 - DNA, 20 bp, Homo sapiens
actgcactccagccttccag

SEQ ID NO: 7565678 - DNA, 22 bp, Homo sapiens
actgcactccatcctgggcaac

SEQ ID NO: 7565679 - DNA, 22 bp, Homo sapiens
actgcactcctgcctgggtaac

SEQ ID NO: 7565680 - DNA, 22 bp, Homo sapiens
agtgaagcggcagatattagaa

SEQ ID NO: 7565681 - DNA, 22 bp, Homo sapiens
agtgaagcctgctgaaagtggc

SEQ ID NO: 7565682 - DNA, 22 bp, Homo sapiens
agtgaagccccgatgcgttttg

SEQ ID NO: 7565683 - DNA, 22 bp, Homo sapiens
agtgaagccccgatgcgttttg

SEQ ID NO: 7565684 - DNA, 22 bp, Homo sapiens
agtgaagcccatttttagctgt

SEQ ID NO: 7565685 - DNA, 22 bp, Homo sapiens
agtgaagatatactgttgtcct

SEQ ID NO: 7565686 - DNA, 22 bp, Homo sapiens
agtgaagcccatttttagctgt

SEQ ID NO: 7565687 - DNA, 22 bp, Homo sapiens
agtgaagatatactgttgtcct

SEQ ID NO: 7565688 - DNA, 21 bp, Homo sapiens
agtgaagagtgaaacacatgg

SEQ ID NO: 7565689 - DNA, 21 bp, Homo sapiens
agtgaagagtgaaacacatgg

SEQ ID NO: 7565690 - DNA, 21 bp, Homo sapiens
agtgaagagtgaaacacatgg

SEQ ID NO: 7565691 - DNA, 22 bp, Homo sapiens
agtgaagatatactgttgtcct

SEQ ID NO: 7565692 - DNA, 22 bp, Homo sapiens
agtgaagaggaagtggggcaca

SEQ ID NO: 7565693 - DNA, 22 bp, Homo sapiens
agtgaagaggaagtggggcaca

SEQ ID NO: 7565694 - DNA, 21 bp, Homo sapiens
agtgaagagtgaaacacatgg

SEQ ID NO: 7565695 - DNA, 22 bp, Homo sapiens
agtgaagctggagaaaggcagt

SEQ ID NO: 7565696 - DNA, 22 bp, Homo sapiens
agtgaagctaacctgctgattt

SEQ ID NO: 7565697 - DNA, 22 bp, Homo sapiens
agtgaagctaacctgctgattt

SEQ ID NO: 7565698 - DNA, 22 bp, Homo sapiens
agtgaagcggcagatattagaa

SEQ ID NO: 7565699 - DNA, 22 bp, Homo sapiens
agtgaagctaacctgctgattt

SEQ ID NO: 7565700 - DNA, 22 bp, Homo sapiens
agtgaaggaaacaattggttga

SEQ ID NO: 7565701 - DNA, 23 bp, Homo sapiens
agtgaagctggttagtgatgacc

SEQ ID NO: 7565702 - DNA, 22 bp, Homo sapiens
agtgaagctggagaaaggcagt

SEQ ID NO: 7565703 - DNA, 23 bp, Homo sapiens
agtgaagctggttagtgatgacc

SEQ ID NO: 7565704 - DNA, 22 bp, Homo sapiens
agtgaaggaagtttgtcttggg

SEQ ID NO: 7565705 - DNA, 22 bp, Homo sapiens
agtgaaggaaacaattggttga

SEQ ID NO: 7565706 - DNA, 22 bp, Homo sapiens
agtgaaggtttacagggcccct

SEQ ID NO: 7565707 - DNA, 22 bp, Homo sapiens
agtgaaggaagtttgtcttggg

SEQ ID NO: 7565708 - DNA, 22 bp, Homo sapiens
agtgaaggtttacagggcccct

SEQ ID NO: 7565709 - DNA, 22 bp, Homo sapiens
agtgaaggtttacagggcccct

SEQ ID NO: 7565710 - DNA, 22 bp, Homo sapiens
actgcacagtcccagaggatgc

SEQ ID NO: 7565711 - DNA, 22 bp, Homo sapiens
actgcacagattaagttagatt

SEQ ID NO: 7565712 - DNA, 22 bp, Homo sapiens
actgcacagatgaagctgtaaa

SEQ ID NO: 7565713 - DNA, 22 bp, Homo sapiens
agtgaatgagaggtgagtattg

SEQ ID NO: 7565714 - DNA, 22 bp, Homo sapiens
actgcacatagtgggctggcct

SEQ ID NO: 7565715 - DNA, 22 bp, Homo sapiens
actgcactccaacctgggtgac

SEQ ID NO: 7565716 - DNA, 22 bp, Homo sapiens
actgcacatagtgggctggcct

SEQ ID NO: 7565717 - DNA, 22 bp, Homo sapiens
actgcacctcagcctgggcgac

SEQ ID NO: 7565718 - DNA, 22 bp, Homo sapiens
agtgaaggtttacagggcccct

SEQ ID NO: 7565719 - DNA, 22 bp, Homo sapiens
agtgaagtaaaagatgtgcatc

SEQ ID NO: 7565720 - DNA, 22 bp, Homo sapiens
agtgaatacatgtcactcagca

SEQ ID NO: 7565721 - DNA, 22 bp, Homo sapiens
agtgaagtgatagtttgcctag

SEQ ID NO: 7565722 - DNA, 20 bp, Homo sapiens
agtgaatagagacattgccc

SEQ ID NO: 7565723 - DNA, 22 bp, Homo sapiens
agtgaatacatgtcactcagca

SEQ ID NO: 7565724 - DNA, 20 bp, Homo sapiens
agtgaatagagacattgccc

SEQ ID NO: 7565725 - DNA, 22 bp, Homo sapiens
agtgaatatgcagcaagaagtt

SEQ ID NO: 7565726 - DNA, 22 bp, Homo sapiens
actgcattctttatcccacaac

SEQ ID NO: 7565727 - DNA, 22 bp, Homo sapiens
actgcagccttgaactctgggc

SEQ ID NO: 7565728 - DNA, 22 bp, Homo sapiens
actgcagccttgaactctgggc

SEQ ID NO: 7565729 - DNA, 22 bp, Homo sapiens
actgcagccttgaactctgggc

SEQ ID NO: 7565730 - DNA, 23 bp, Homo sapiens
actgcagcctccgcctgccgggt

SEQ ID NO: 7565731 - DNA, 22 bp, Homo sapiens
actgcagcctagggaccacagt

SEQ ID NO: 7565732 - DNA, 22 bp, Homo sapiens
actgcagcctagggaccacagt

SEQ ID NO: 7565733 - DNA, 22 bp, Homo sapiens
actgcagcctagggaccacagt

SEQ ID NO: 7565734 - DNA, 22 bp, Homo sapiens
actgcagcctagggaccacagt

SEQ ID NO: 7565735 - DNA, 23 bp, Homo sapiens
actgcagcctccgcctgccgggt

SEQ ID NO: 7565736 - DNA, 23 bp, Homo sapiens
actgcagcctccgcctgccgggt

SEQ ID NO: 7565737 - DNA, 23 bp, Homo sapiens
actgcagcctccgcctgccgggt

SEQ ID NO: 7565738 - DNA, 22 bp, Homo sapiens
actgccaatggtagtttgatgg

SEQ ID NO: 7565739 - DNA, 22 bp, Homo sapiens
actgcagcaggtaagagcattt

SEQ ID NO: 7565740 - DNA, 22 bp, Homo sapiens
actgcagcaggtaagagcattt

SEQ ID NO: 7565741 - DNA, 22 bp, Homo sapiens
actgcagcaggtaagagcattt

SEQ ID NO: 7565742 - DNA, 22 bp, Homo sapiens
actgcagccccctattaggact

SEQ ID NO: 7565743 - DNA, 22 bp, Homo sapiens
agtgctgaacatagaatggaca

SEQ ID NO: 7565744 - DNA, 22 bp, Homo sapiens
agtgctctgtcattggtgggat

SEQ ID NO: 7565745 - DNA, 22 bp, Homo sapiens
agtgctctgatctccttgggtt

SEQ ID NO: 7565746 - DNA, 22 bp, Homo sapiens
agtgctctgtcattggtgggat

SEQ ID NO: 7565747 - DNA, 22 bp, Homo sapiens
agtgctcctgccagctttctgg

SEQ ID NO: 7565748 - DNA, 22 bp, Homo sapiens
agtgctcctgaagcttgaggca

SEQ ID NO: 7565749 - DNA, 22 bp, Homo sapiens
agtgctcctcagaagagttgga

SEQ ID NO: 7565750 - DNA, 22 bp, Homo sapiens
agtgctcctatggatcagttgt

SEQ ID NO: 7565751 - DNA, 22 bp, Homo sapiens
agtgctccctagagttgtgcaa

SEQ ID NO: 7565752 - DNA, 22 bp, Homo sapiens
agtgctctaacagtcaaaaaag

SEQ ID NO: 7565753 - DNA, 22 bp, Homo sapiens
agtgctcctttcattgctgccc

SEQ ID NO: 7565754 - DNA, 22 bp, Homo sapiens
agtgctctgggtccactccaga

SEQ ID NO: 7565755 - DNA, 22 bp, Homo sapiens
agtgctctctccccagtgctac

SEQ ID NO: 7565756 - DNA, 22 bp, Homo sapiens
agtgctctctccccagtgctac

SEQ ID NO: 7565757 - DNA, 22 bp, Homo sapiens
agtgctctcatgctgactatta

SEQ ID NO: 7565758 - DNA, 22 bp, Homo sapiens
actgcacttcaccctgggtgac

SEQ ID NO: 7565759 - DNA, 22 bp, Homo sapiens
actgcacttcaccctgggtgac

SEQ ID NO: 7565760 - DNA, 22 bp, Homo sapiens
actgcacttcaccctgggtgac

SEQ ID NO: 7565761 - DNA, 22 bp, Homo sapiens
actgcacttcaccctgggtgac

SEQ ID NO: 7565762 - DNA, 22 bp, Homo sapiens
actgcacttcaccctgggtgac

SEQ ID NO: 7565763 - DNA, 22 bp, Homo sapiens
actgcacttcaccctgggtgac

SEQ ID NO: 7565764 - DNA, 22 bp, Homo sapiens
actgcacttcaccctgggtgac

SEQ ID NO: 7565765 - DNA, 22 bp, Homo sapiens
actgcacttcaccctgggtgac

SEQ ID NO: 7565766 - DNA, 22 bp, Homo sapiens
actgcacttcaccctgggtgac

SEQ ID NO: 7565767 - DNA, 22 bp, Homo sapiens
actgcacttcaccctgggtgac

SEQ ID NO: 7565768 - DNA, 22 bp, Homo sapiens
actgcacttcagcctgggtgac

SEQ ID NO: 7565769 - DNA, 22 bp, Homo sapiens
actgcacttcagcctgggtgac

SEQ ID NO: 7565770 - DNA, 22 bp, Homo sapiens
actgcacttcagcctgggtgac

SEQ ID NO: 7565771 - DNA, 22 bp, Homo sapiens
actgcacttcaccctgggtgac

SEQ ID NO: 7565772 - DNA, 22 bp, Homo sapiens
actgcacttcaccctgggtgac

SEQ ID NO: 7565773 - DNA, 22 bp, Homo sapiens
actgcacttcaccctgggtgac

SEQ ID NO: 7565774 - DNA, 22 bp, Homo sapiens
actgcacttcaccctgggtgac

SEQ ID NO: 7565775 - DNA, 22 bp, Homo sapiens
actgcacttcagcctgggtgac

SEQ ID NO: 7565776 - DNA, 22 bp, Homo sapiens
agtgctatcgagttctaatgct

SEQ ID NO: 7565777 - DNA, 22 bp, Homo sapiens
agtgctatttttgctcatgaac

SEQ ID NO: 7565778 - DNA, 22 bp, Homo sapiens
agtgctcataaaaatgtgaaac

SEQ ID NO: 7565779 - DNA, 22 bp, Homo sapiens
agtgctcactctccacagtgcc

SEQ ID NO: 7565780 - DNA, 23 bp, Homo sapiens
agtgctcagggcattaggctaga

SEQ ID NO: 7565781 - DNA, 22 bp, Homo sapiens
agtgctcactctccacagtgcc

SEQ ID NO: 7565782 - DNA, 22 bp, Homo sapiens
agtgctcacctgtcaggtcaag

SEQ ID NO: 7565783 - DNA, 22 bp, Homo sapiens
agtgctcactctccacagtgcc

SEQ ID NO: 7565784 - DNA, 23 bp, Homo sapiens
agtgctcccaggacctggggcag

SEQ ID NO: 7565785 - DNA, 22 bp, Homo sapiens
agtgctccaaaggttggtcatt

SEQ ID NO: 7565786 - DNA, 22 bp, Homo sapiens
agtgctccacattgcactattc

SEQ ID NO: 7565787 - DNA, 22 bp, Homo sapiens
agtgctcatgcacatttatagt

SEQ ID NO: 7565788 - DNA, 22 bp, Homo sapiens
agtgctccaaaggttggtcatt

SEQ ID NO: 7565789 - DNA, 22 bp, Homo sapiens
agtgctcatgcacatttatagt

SEQ ID NO: 7565790 - DNA, 22 bp, Homo sapiens
agtgctcataaaaatgtgaaac

SEQ ID NO: 7565791 - DNA, 22 bp, Homo sapiens
actactacaagtgagtacaaag

SEQ ID NO: 7565792 - DNA, 22 bp, Homo sapiens
actactgaatattagttctgaa

SEQ ID NO: 7565793 - DNA, 22 bp, Homo sapiens
actactggaaactgtagataat

SEQ ID NO: 7565794 - DNA, 22 bp, Homo sapiens
actactttgggccatttgttta

SEQ ID NO: 7565795 - DNA, 22 bp, Homo sapiens
actactttgggccatttgttta

SEQ ID NO: 7565796 - DNA, 23 bp, Homo sapiens
actagaaaatgactttctccctg

SEQ ID NO: 7565797 - DNA, 22 bp, Homo sapiens
actacattcatgctcgtgttgg

SEQ ID NO: 7565798 - DNA, 22 bp, Homo sapiens
actacattatgaggaaagagtg

SEQ ID NO: 7565799 - DNA, 22 bp, Homo sapiens
actacagtgtgataagaggggc

SEQ ID NO: 7565800 - DNA, 22 bp, Homo sapiens
actacatttcctgacccctgtg

SEQ ID NO: 7565801 - DNA, 22 bp, Homo sapiens
actacatttctcagtacctgaa

SEQ ID NO: 7565802 - DNA, 22 bp, Homo sapiens
actactacaagtgagtacaaag

SEQ ID NO: 7565803 - DNA, 22 bp, Homo sapiens
actaccttatacaaaatgtagg

SEQ ID NO: 7565804 - DNA, 22 bp, Homo sapiens
aggtgagaaaacgagggttgca

SEQ ID NO: 7565805 - DNA, 22 bp, Homo sapiens
actaaatatttgagaggtgtag

SEQ ID NO: 7565806 - DNA, 22 bp, Homo sapiens
aggtgacttaggctgtggctcg

SEQ ID NO: 7565807 - DNA, 22 bp, Homo sapiens
aggtgagaaaacgagggttgca

SEQ ID NO: 7565808 - DNA, 22 bp, Homo sapiens
aggtgactggtttatctggcag

SEQ ID NO: 7565809 - DNA, 22 bp, Homo sapiens
aggtgactggtttatctggcag

SEQ ID NO: 7565810 - DNA, 22 bp, Homo sapiens
aggtgactggtttatctggcag

SEQ ID NO: 7565811 - DNA, 22 bp, Homo sapiens
actacagtccctcatatgttgg

SEQ ID NO: 7565812 - DNA, 22 bp, Homo sapiens
actacagtactatatctatagg

SEQ ID NO: 7565813 - DNA, 22 bp, Homo sapiens
actacagtactatatctatagg

SEQ ID NO: 7565814 - DNA, 22 bp, Homo sapiens
actacagtactatatctatagg

SEQ ID NO: 7565815 - DNA, 22 bp, Homo sapiens
actacagtaagggaggcagcat

SEQ ID NO: 7565816 - DNA, 23 bp, Homo sapiens
actacagatactcctgctgtttg

SEQ ID NO: 7565817 - DNA, 22 bp, Homo sapiens
actaaatatttgagaggtgtag

SEQ ID NO: 7565818 - DNA, 22 bp, Homo sapiens
actaaatctgcagagtttagtg

SEQ ID NO: 7565819 - DNA, 22 bp, Homo sapiens
aggtgagaaaacgagggttgca

SEQ ID NO: 7565820 - DNA, 22 bp, Homo sapiens
actaaatctgcagagtttagtg

SEQ ID NO: 7565821 - DNA, 21 bp, Homo sapiens
aggtgggcaggtggagtggcc

SEQ ID NO: 7565822 - DNA, 21 bp, Homo sapiens
aggtgggcaggtggagtggcc

SEQ ID NO: 7565823 - DNA, 22 bp, Homo sapiens
aggtgggcactccgctcgaggt

SEQ ID NO: 7565824 - DNA, 22 bp, Homo sapiens
aggtgggcactccgctcgaggt

SEQ ID NO: 7565825 - DNA, 22 bp, Homo sapiens
aggtgggcactccgctcgaggt

SEQ ID NO: 7565826 - DNA, 22 bp, Homo sapiens
aggtgggcactccgctcgaggt

SEQ ID NO: 7565827 - DNA, 22 bp, Homo sapiens
aggtgggcactccgctcgaggt

SEQ ID NO: 7565828 - DNA, 22 bp, Homo sapiens
aggtgggcactccgctcgaggt

SEQ ID NO: 7565829 - DNA, 22 bp, Homo sapiens
aggtgggcactccgctcgaggt

SEQ ID NO: 7565830 - DNA, 22 bp, Homo sapiens
aggtgggcaccaggcttgtggt

SEQ ID NO: 7565831 - DNA, 22 bp, Homo sapiens
aggtgggcaccaggcttgtggt

SEQ ID NO: 7565832 - DNA, 22 bp, Homo sapiens
aggtgggcaccaggcttgtggt

SEQ ID NO: 7565833 - DNA, 22 bp, Homo sapiens
actagaaattactcagaataaa

SEQ ID NO: 7565834 - DNA, 22 bp, Homo sapiens
actagaaattactcagaataaa

SEQ ID NO: 7565835 - DNA, 22 bp, Homo sapiens
actagaaattactcagaataaa

SEQ ID NO: 7565836 - DNA, 22 bp, Homo sapiens
actagaaattactcagaataaa

SEQ ID NO: 7565837 - DNA, 22 bp, Homo sapiens
actagaaagtttccagagttat

SEQ ID NO: 7565838 - DNA, 22 bp, Homo sapiens
actagaaatgtattggtagctg

SEQ ID NO: 7565839 - DNA, 22 bp, Homo sapiens
actagaaagtttccagagttat

SEQ ID NO: 7565840 - DNA, 22 bp, Homo sapiens
actagaaagtttccagagttat

SEQ ID NO: 7565841 - DNA, 22 bp, Homo sapiens
actagaaagtttccagagttat

SEQ ID NO: 7565842 - DNA, 22 bp, Homo sapiens
actagaaagcaaaagccatttc

SEQ ID NO: 7565843 - DNA, 22 bp, Homo sapiens
actagaaagcaaaagccatttc

SEQ ID NO: 7565844 - DNA, 22 bp, Homo sapiens
actagaaagaagttttttgaga

SEQ ID NO: 7565845 - DNA, 22 bp, Homo sapiens
actagaaagcaaaagccatttc

SEQ ID NO: 7565846 - DNA, 22 bp, Homo sapiens
actagaaagtttccagagttat

SEQ ID NO: 7565847 - DNA, 22 bp, Homo sapiens
actagaaagtttccagagttat

SEQ ID NO: 7565848 - DNA, 20 bp, Homo sapiens
actagaaagtcactgggggg

SEQ ID NO: 7565849 - DNA, 22 bp, Homo sapiens
actagaaagcactaagctaggc

SEQ ID NO: 7565850 - DNA, 22 bp, Homo sapiens
actagaaagcactaagctaggc

SEQ ID NO: 7565851 - DNA, 22 bp, Homo sapiens
actagaaagcactaagctaggc

SEQ ID NO: 7565852 - DNA, 22 bp, Homo sapiens
actagaaagcactaagctaggc

SEQ ID NO: 7565853 - DNA, 22 bp, Homo sapiens
actagaaaattcctagaaacta

SEQ ID NO: 7565854 - DNA, 22 bp, Homo sapiens
actagaaaattcctagaaacta

SEQ ID NO: 7565855 - DNA, 22 bp, Homo sapiens
actagaaaattcctagaaacta

SEQ ID NO: 7565856 - DNA, 23 bp, Homo sapiens
actagaaaatgactttctccctg

SEQ ID NO: 7565857 - DNA, 22 bp, Homo sapiens
actagaaactaatggattatta

SEQ ID NO: 7565858 - DNA, 22 bp, Homo sapiens
actagaaactaatggattatta

SEQ ID NO: 7565859 - DNA, 22 bp, Homo sapiens
acgagaggtccttagaatctgt

SEQ ID NO: 7565860 - DNA, 22 bp, Homo sapiens
accttttttcagaactctaaag

SEQ ID NO: 7565861 - DNA, 22 bp, Homo sapiens
accttttttcagaactctaaag

SEQ ID NO: 7565862 - DNA, 22 bp, Homo sapiens
accttttttcagaactctaaag

SEQ ID NO: 7565863 - DNA, 22 bp, Homo sapiens
accttttttcagaactctaaag

SEQ ID NO: 7565864 - DNA, 22 bp, Homo sapiens
acgatgatgaaagagaacattc

SEQ ID NO: 7565865 - DNA, 22 bp, Homo sapiens
aggtctgttggtaccagtgtgg

SEQ ID NO: 7565866 - DNA, 22 bp, Homo sapiens
acgatgagatggggctggaagg

SEQ ID NO: 7565867 - DNA, 22 bp, Homo sapiens
acgatatctgtaatattttatt

SEQ ID NO: 7565868 - DNA, 23 bp, Homo sapiens
acgaggtagggcagggtgtgtct

SEQ ID NO: 7565869 - DNA, 22 bp, Homo sapiens
acgaggagcctgtggcctggta

SEQ ID NO: 7565870 - DNA, 22 bp, Homo sapiens
acgaggaagcgacccttgcccg

SEQ ID NO: 7565871 - DNA, 22 bp, Homo sapiens
acgaggagcctgtggcctggta

SEQ ID NO: 7565872 - DNA, 22 bp, Homo sapiens
acgaggtgcttccaccatttca

SEQ ID NO: 7565873 - DNA, 22 bp, Homo sapiens
accttttcatctgaaactttta

SEQ ID NO: 7565874 - DNA, 22 bp, Homo sapiens
accttttcatctgaaactttta

SEQ ID NO: 7565875 - DNA, 22 bp, Homo sapiens
accttttccagcttctagaggc

SEQ ID NO: 7565876 - DNA, 22 bp, Homo sapiens
accttttccagcttctagaggc

SEQ ID NO: 7565877 - DNA, 22 bp, Homo sapiens
accttttccagcttctagaggc

SEQ ID NO: 7565878 - DNA, 22 bp, Homo sapiens
acctttttccaatgagggaagt

SEQ ID NO: 7565879 - DNA, 22 bp, Homo sapiens
acctttttccaaagcttcttac

SEQ ID NO: 7565880 - DNA, 22 bp, Homo sapiens
acctttttccaaagcttcttac

SEQ ID NO: 7565881 - DNA, 22 bp, Homo sapiens
acctttttgttctgttctcagc

SEQ ID NO: 7565882 - DNA, 22 bp, Homo sapiens
acctttttgttctgttctcagc

SEQ ID NO: 7565883 - DNA, 22 bp, Homo sapiens
acctttttgttctgttctcagc

SEQ ID NO: 7565884 - DNA, 22 bp, Homo sapiens
accttttacggtgtgactagca

SEQ ID NO: 7565885 - DNA, 22 bp, Homo sapiens
accttttacggtgtgactagca

SEQ ID NO: 7565886 - DNA, 22 bp, Homo sapiens
accttttatgtaaatatatgtt

SEQ ID NO: 7565887 - DNA, 22 bp, Homo sapiens
accttttatgtaaatatatgtt

SEQ ID NO: 7565888 - DNA, 21 bp, Homo sapiens
acctttgggtgtttataatag

SEQ ID NO: 7565889 - DNA, 21 bp, Homo sapiens
acctttgggtgtttataatag

SEQ ID NO: 7565890 - DNA, 22 bp, Homo sapiens
acctttggtcatttacttttca

SEQ ID NO: 7565891 - DNA, 22 bp, Homo sapiens
acctttggtaagtttccaaaac

SEQ ID NO: 7565892 - DNA, 22 bp, Homo sapiens
acctttggtaagtttccaaaac

SEQ ID NO: 7565893 - DNA, 22 bp, Homo sapiens
acctttggataatttgagtttg

SEQ ID NO: 7565894 - DNA, 22 bp, Homo sapiens
acctttggataatctttgtgtt

SEQ ID NO: 7565895 - DNA, 22 bp, Homo sapiens
acctttggataatttgagtttg

SEQ ID NO: 7565896 - DNA, 22 bp, Homo sapiens
aggtgacatgaaaaatgttgag

SEQ ID NO: 7565897 - DNA, 19 bp, Homo sapiens
aggtgacatgtgacagcct

SEQ ID NO: 7565898 - DNA, 22 bp, Homo sapiens
aggtgacattcagagaacattt

SEQ ID NO: 7565899 - DNA, 22 bp, Homo sapiens
aggtgacattcagagaacattt

SEQ ID NO: 7565900 - DNA, 22 bp, Homo sapiens
aggtgactactattttaaaata

SEQ ID NO: 7565901 - DNA, 22 bp, Homo sapiens
aggtgactactattttaaaata

SEQ ID NO: 7565902 - DNA, 22 bp, Homo sapiens
aggtgactggtttatctggcag

SEQ ID NO: 7565903 - DNA, 22 bp, Homo sapiens
aggtgactggtttatctggcag

SEQ ID NO: 7565904 - DNA, 19 bp, Homo sapiens
aggtgacaggtgcacttgc

SEQ ID NO: 7565905 - DNA, 19 bp, Homo sapiens
aggtgacaggtgcacttgc

SEQ ID NO: 7565906 - DNA, 19 bp, Homo sapiens
aggtgacaggtgcacttgc

SEQ ID NO: 7565907 - DNA, 22 bp, Homo sapiens
aggtgacatcccggcagcagag

SEQ ID NO: 7565908 - DNA, 22 bp, Homo sapiens
aggtgacatcccggcagcagag

SEQ ID NO: 7565909 - DNA, 22 bp, Homo sapiens
aggtgacatcccggcagcagag

SEQ ID NO: 7565910 - DNA, 22 bp, Homo sapiens
aggtgacatcccggcagcagag

SEQ ID NO: 7565911 - DNA, 22 bp, Homo sapiens
aggtgacaggatgcagataaac

SEQ ID NO: 7565912 - DNA, 22 bp, Homo sapiens
aggtgacaggatgcagataaac

SEQ ID NO: 7565913 - DNA, 22 bp, Homo sapiens
aggtgacaggacaggagctggt

SEQ ID NO: 7565914 - DNA, 22 bp, Homo sapiens
aggtgacaggacaggagctggt

SEQ ID NO: 7565915 - DNA, 22 bp, Homo sapiens
aggtgaatgctcacattctaat

SEQ ID NO: 7565916 - DNA, 22 bp, Homo sapiens
aggtgacaggacaggagctggt

SEQ ID NO: 7565917 - DNA, 22 bp, Homo sapiens
aggtgaatgcctgaggcctctg

SEQ ID NO: 7565918 - DNA, 22 bp, Homo sapiens
aggtgaagttgaggaggcagaa

SEQ ID NO: 7565919 - DNA, 22 bp, Homo sapiens
aggtgaagttgaggaggcagaa

SEQ ID NO: 7565920 - DNA, 22 bp, Homo sapiens
aggtgaagttgaggaggcagaa

SEQ ID NO: 7565921 - DNA, 22 bp, Homo sapiens
aggtgaagttgaggaggcagaa

SEQ ID NO: 7565922 - DNA, 22 bp, Homo sapiens
aggtgaagttgaggaggcagaa

SEQ ID NO: 7565923 - DNA, 22 bp, Homo sapiens
aggtgaagttgaggaggcagaa

SEQ ID NO: 7565924 - DNA, 20 bp, Homo sapiens
aggtcttccaatcagctcct

SEQ ID NO: 7565925 - DNA, 22 bp, Homo sapiens
aggtgaagttgaggaggcagaa

SEQ ID NO: 7565926 - DNA, 22 bp, Homo sapiens
aggtgaagttaaaaaccagtct

SEQ ID NO: 7565927 - DNA, 22 bp, Homo sapiens
aggtgaagttaaaaaccagtct

SEQ ID NO: 7565928 - DNA, 22 bp, Homo sapiens
aggtgaacccaggtgcttcacg

SEQ ID NO: 7565929 - DNA, 22 bp, Homo sapiens
acctttcacggtatcagacatc

SEQ ID NO: 7565930 - DNA, 22 bp, Homo sapiens
acctttccaagtatcaggtggt

SEQ ID NO: 7565931 - DNA, 22 bp, Homo sapiens
acctttcctggctgaccgagga

SEQ ID NO: 7565932 - DNA, 22 bp, Homo sapiens
acctttcattaaagtctgtagt

SEQ ID NO: 7565933 - DNA, 22 bp, Homo sapiens
acctttcattaaagtctgtagt

SEQ ID NO: 7565934 - DNA, 22 bp, Homo sapiens
acctttctgcaagttctgggac

SEQ ID NO: 7565935 - DNA, 22 bp, Homo sapiens
acctttctgcaagttctgggac

SEQ ID NO: 7565936 - DNA, 19 bp, Homo sapiens
acctttcctttctcagatg

SEQ ID NO: 7565937 - DNA, 22 bp, Homo sapiens
acctttgctaggtaggtattgg

SEQ ID NO: 7565938 - DNA, 22 bp, Homo sapiens
acctttgagtgtattgtctttc

SEQ ID NO: 7565939 - DNA, 22 bp, Homo sapiens
acctttggaggactagggtcat

SEQ ID NO: 7565940 - DNA, 22 bp, Homo sapiens
acctttggagcatgcattttct

SEQ ID NO: 7565941 - DNA, 22 bp, Homo sapiens
acctttggaaataaacactctg

SEQ ID NO: 7565942 - DNA, 21 bp, Homo sapiens
acctttggaaagaccctggga

SEQ ID NO: 7565943 - DNA, 22 bp, Homo sapiens
acctttatgtttgattacaatt

SEQ ID NO: 7565944 - DNA, 22 bp, Homo sapiens
acctttcaaagtggctatcact

SEQ ID NO: 7565945 - DNA, 20 bp, Homo sapiens
acctttcaaatgattcagca

SEQ ID NO: 7565946 - DNA, 20 bp, Homo sapiens
acctttcaaatgattcagca

SEQ ID NO: 7565947 - DNA, 22 bp, Homo sapiens
accttcctctaagacatttagc

SEQ ID NO: 7565948 - DNA, 22 bp, Homo sapiens
accttcctctaagacatttagc

SEQ ID NO: 7565949 - DNA, 22 bp, Homo sapiens
accttcgtttcccactttgtaa

SEQ ID NO: 7565950 - DNA, 22 bp, Homo sapiens
accttcctctaagacatttagc

SEQ ID NO: 7565951 - DNA, 21 bp, Homo sapiens
accttctgaattacctaccaa

SEQ ID NO: 7565952 - DNA, 22 bp, Homo sapiens
accttctgaccagttatcttga

SEQ ID NO: 7565953 - DNA, 22 bp, Homo sapiens
aggtccagttgccagaatggcc

SEQ ID NO: 7565954 - DNA, 22 bp, Homo sapiens
aggtccagttgccagaatggcc

SEQ ID NO: 7565955 - DNA, 21 bp, Homo sapiens
aggtccagttctgtcttggac

SEQ ID NO: 7565956 - DNA, 22 bp, Homo sapiens
aggtccagtgctcttggtggtt

SEQ ID NO: 7565957 - DNA, 22 bp, Homo sapiens
aggtccagtgaaactttatttg

SEQ ID NO: 7565958 - DNA, 22 bp, Homo sapiens
aggtccagtgctcttggtggtt

SEQ ID NO: 7565959 - DNA, 22 bp, Homo sapiens
aggtccagtgctcttggtggtt

SEQ ID NO: 7565960 - DNA, 20 bp, Homo sapiens
aggtccactgaggctgcctc

SEQ ID NO: 7565961 - DNA, 22 bp, Homo sapiens
aggtccagaacgtgcctactct

SEQ ID NO: 7565962 - DNA, 22 bp, Homo sapiens
aggtccagaacgtgcctactct

SEQ ID NO: 7565963 - DNA, 20 bp, Homo sapiens
aggtccactgaggctgcctc

SEQ ID NO: 7565964 - DNA, 22 bp, Homo sapiens
aggtccaaggtagggcccagac

SEQ ID NO: 7565965 - DNA, 22 bp, Homo sapiens
aggtccacagttcagctgccca

SEQ ID NO: 7565966 - DNA, 22 bp, Homo sapiens
aggtccacagttcagctgccca

SEQ ID NO: 7565967 - DNA, 22 bp, Homo sapiens
aggtccagactgtgtaccctag

SEQ ID NO: 7565968 - DNA, 22 bp, Homo sapiens
aggtccagactgtgtaccctag

SEQ ID NO: 7565969 - DNA, 22 bp, Homo sapiens
aggtccagactgtgtaccctag

SEQ ID NO: 7565970 - DNA, 22 bp, Homo sapiens
aggtccagagttgagatacaga

SEQ ID NO: 7565971 - DNA, 22 bp, Homo sapiens
aggtccagagttgagatacaga

SEQ ID NO: 7565972 - DNA, 22 bp, Homo sapiens
aggtccagagttgagatacaga

SEQ ID NO: 7565973 - DNA, 22 bp, Homo sapiens
aggtccagaggttgaacggtgg

SEQ ID NO: 7565974 - DNA, 22 bp, Homo sapiens
aggtccagaggttgaacggtgg

SEQ ID NO: 7565975 - DNA, 22 bp, Homo sapiens
aggtccagaggttgaacggtgg

SEQ ID NO: 7565976 - DNA, 22 bp, Homo sapiens
aggtccagcctgccctctctcc

SEQ ID NO: 7565977 - DNA, 22 bp, Homo sapiens
aggtccagctctattgaaaaga

SEQ ID NO: 7565978 - DNA, 22 bp, Homo sapiens
aggtccaggatttgtggggtct

SEQ ID NO: 7565979 - DNA, 22 bp, Homo sapiens
aggtccaggatttgtggggtct

SEQ ID NO: 7565980 - DNA, 22 bp, Homo sapiens
aggtccaggagatttggcaatt

SEQ ID NO: 7565981 - DNA, 22 bp, Homo sapiens
aggtccaggagatttggcaatt

SEQ ID NO: 7565982 - DNA, 22 bp, Homo sapiens
aggtccagctgttgcagcctcc

SEQ ID NO: 7565983 - DNA, 22 bp, Homo sapiens
aggtccagctgttgcagcctcc

SEQ ID NO: 7565984 - DNA, 22 bp, Homo sapiens
aggtccaggttccgtttctgcg

SEQ ID NO: 7565985 - DNA, 22 bp, Homo sapiens
aggtccaggttccgtttctgcg

SEQ ID NO: 7565986 - DNA, 22 bp, Homo sapiens
aggtccaggttccgtttctgcg

SEQ ID NO: 7565987 - DNA, 22 bp, Homo sapiens
aggtccaggcctcatgatggcc

SEQ ID NO: 7565988 - DNA, 22 bp, Homo sapiens
aggtccaggcctcatgatggcc

SEQ ID NO: 7565989 - DNA, 22 bp, Homo sapiens
aggtccaggcctcatgatggcc

SEQ ID NO: 7565990 - DNA, 22 bp, Homo sapiens
aggtccaggcatttgggttggg

SEQ ID NO: 7565991 - DNA, 22 bp, Homo sapiens
aggtccaggcatttgggttggg

SEQ ID NO: 7565992 - DNA, 22 bp, Homo sapiens
aggtccaggatttgtggggtct

SEQ ID NO: 7565993 - DNA, 22 bp, Homo sapiens
aggtccaggcatttgggttggg

SEQ ID NO: 7565994 - DNA, 22 bp, Homo sapiens
aggtccaggcatttgggttggg

SEQ ID NO: 7565995 - DNA, 22 bp, Homo sapiens
aggtatttgttacagcagcacc

SEQ ID NO: 7565996 - DNA, 22 bp, Homo sapiens
aggtatttgttacagcagcacc

SEQ ID NO: 7565997 - DNA, 19 bp, Homo sapiens
aggtatttgggagatatat

SEQ ID NO: 7565998 - DNA, 22 bp, Homo sapiens
aggtatttgtctcagattgggt

SEQ ID NO: 7565999 - DNA, 22 bp, Homo sapiens
aggtattttatagataagtaaa

SEQ ID NO: 7566000 - DNA, 22 bp, Homo sapiens
aggtattttatagataagtaaa

SEQ ID NO: 7566001 - DNA, 22 bp, Homo sapiens
aggtatttcatggagcaagcag

SEQ ID NO: 7566002 - DNA, 22 bp, Homo sapiens
aggtatttcaaagcccacttcc

SEQ ID NO: 7566003 - DNA, 19 bp, Homo sapiens
aggtatttgggagatatat

SEQ ID NO: 7566004 - DNA, 22 bp, Homo sapiens
aggtatttcctttaaagaaact

SEQ ID NO: 7566005 - DNA, 22 bp, Homo sapiens
aggtatttcctttaaagaaact

SEQ ID NO: 7566006 - DNA, 22 bp, Homo sapiens
accctgtcttccctgggcatca

SEQ ID NO: 7566007 - DNA, 22 bp, Homo sapiens
accctgtgcagagaagtgagcg

SEQ ID NO: 7566008 - DNA, 22 bp, Homo sapiens
accctgtgcagagaagtgagcg

SEQ ID NO: 7566009 - DNA, 22 bp, Homo sapiens
accctgtgcagagaagtgagcg

SEQ ID NO: 7566010 - DNA, 22 bp, Homo sapiens
accctgtgtcacagtggcctgt

SEQ ID NO: 7566011 - DNA, 22 bp, Homo sapiens
accctgtgtcacagtggcctgt

SEQ ID NO: 7566012 - DNA, 22 bp, Homo sapiens
accctgtgtcacagtggcctgt

SEQ ID NO: 7566013 - DNA, 22 bp, Homo sapiens
acccttccaaatgagcttatta

SEQ ID NO: 7566014 - DNA, 22 bp, Homo sapiens
acccttccaaatgagcttatta

SEQ ID NO: 7566015 - DNA, 22 bp, Homo sapiens
acccttccaaatgagcttatta

SEQ ID NO: 7566016 - DNA, 22 bp, Homo sapiens
acccttcatagaggagaagctg

SEQ ID NO: 7566017 - DNA, 22 bp, Homo sapiens
acccttctgtgacctgcctgtc

SEQ ID NO: 7566018 - DNA, 22 bp, Homo sapiens
aggtagctggtgctgggctcct

SEQ ID NO: 7566019 - DNA, 19 bp, Homo sapiens
aggtagctcagactcaaag

SEQ ID NO: 7566020 - DNA, 22 bp, Homo sapiens
acccttggttttgcagagctgt

SEQ ID NO: 7566021 - DNA, 22 bp, Homo sapiens
accctttagaaggcatctcagt

SEQ ID NO: 7566022 - DNA, 22 bp, Homo sapiens
aggtagcttggtgctttcattc

SEQ ID NO: 7566023 - DNA, 22 bp, Homo sapiens
aggtagctggtgctgggctcct

SEQ ID NO: 7566024 - DNA, 20 bp, Homo sapiens
aggtagctttgcatttttgt

SEQ ID NO: 7566025 - DNA, 22 bp, Homo sapiens
aggtaggaaagtctccttgtat

SEQ ID NO: 7566026 - DNA, 22 bp, Homo sapiens
aggtaggaaagtctccttgtat

SEQ ID NO: 7566027 - DNA, 22 bp, Homo sapiens
aggtaggagttgatggatgttc

SEQ ID NO: 7566028 - DNA, 22 bp, Homo sapiens
aggtcaaaatcaggcagggaag

SEQ ID NO: 7566029 - DNA, 22 bp, Homo sapiens
aggtcaaaatgcttttcaggtc

SEQ ID NO: 7566030 - DNA, 22 bp, Homo sapiens
aggtcaaaatgcttttcaggtc

SEQ ID NO: 7566031 - DNA, 22 bp, Homo sapiens
aggtattttatagataagtaaa

SEQ ID NO: 7566032 - DNA, 22 bp, Homo sapiens
aggtcaaaatcaggcagggaag

SEQ ID NO: 7566033 - DNA, 21 bp, Homo sapiens
aggtcaaaggcatccatgagg

SEQ ID NO: 7566034 - DNA, 22 bp, Homo sapiens
aggtcaaaccacagctctaggc

SEQ ID NO: 7566035 - DNA, 20 bp, Homo sapiens
aggtcaacacctagtaagtg

SEQ ID NO: 7566036 - DNA, 23 bp, Homo sapiens
aggtcaaccacaagctgacaaac

SEQ ID NO: 7566037 - DNA, 22 bp, Homo sapiens
aggtcaagagtaaatttgggta

SEQ ID NO: 7566038 - DNA, 22 bp, Homo sapiens
aggtcaagagtaaatttgggta

SEQ ID NO: 7566039 - DNA, 22 bp, Homo sapiens
aggtcaagagtaaatttgggta

SEQ ID NO: 7566040 - DNA, 22 bp, Homo sapiens
aggtcaagagtaaatttgggta

SEQ ID NO: 7566041 - DNA, 23 bp, Homo sapiens
aggtcaaccacaagctgacaaac

SEQ ID NO: 7566042 - DNA, 22 bp, Homo sapiens
aggtcaagaattgatgtggttt

SEQ ID NO: 7566043 - DNA, 22 bp, Homo sapiens
aggtcaagaattgatgtggttt

SEQ ID NO: 7566044 - DNA, 22 bp, Homo sapiens
aggtcaaggccaaaagagtggt

SEQ ID NO: 7566045 - DNA, 22 bp, Homo sapiens
aggtcaaggccaaaagagtggt

SEQ ID NO: 7566046 - DNA, 22 bp, Homo sapiens
aggtcaagagtaaatttgggta

SEQ ID NO: 7566047 - DNA, 22 bp, Homo sapiens
aggtcaagagtaaatttgggta

SEQ ID NO: 7566048 - DNA, 22 bp, Homo sapiens
aggtcatttccttagaggcaga

SEQ ID NO: 7566049 - DNA, 22 bp, Homo sapiens
aggtcacacaactgtcagaggc

SEQ ID NO: 7566050 - DNA, 22 bp, Homo sapiens
aggtccacagttcagctgccca

SEQ ID NO: 7566051 - DNA, 22 bp, Homo sapiens
aggtccaaatgttgagactgat

SEQ ID NO: 7566052 - DNA, 22 bp, Homo sapiens
aggtccaaggtagggcccagac

SEQ ID NO: 7566053 - DNA, 22 bp, Homo sapiens
aggtcaagtttagatagagtta

SEQ ID NO: 7566054 - DNA, 22 bp, Homo sapiens
aggtcaagtttagatagagtta

SEQ ID NO: 7566055 - DNA, 22 bp, Homo sapiens
aggtcaagtttagatagagtta

SEQ ID NO: 7566056 - DNA, 22 bp, Homo sapiens
aggtcaaggttcacaggggatc

SEQ ID NO: 7566057 - DNA, 22 bp, Homo sapiens
aggtcaagggcaagagtgaggt

SEQ ID NO: 7566058 - DNA, 22 bp, Homo sapiens
aggtcaaggttcacaggggatc

SEQ ID NO: 7566059 - DNA, 22 bp, Homo sapiens
aggtcaagggagctgagggcca

SEQ ID NO: 7566060 - DNA, 22 bp, Homo sapiens
aggtcaagggcaagagtgaggt

SEQ ID NO: 7566061 - DNA, 22 bp, Homo sapiens
aggtcaagggcaagagtgaggt

SEQ ID NO: 7566062 - DNA, 22 bp, Homo sapiens
aggtcaagggcaagagtgaggt

SEQ ID NO: 7566063 - DNA, 22 bp, Homo sapiens
aggtcaaggctgcagtgagctg

SEQ ID NO: 7566064 - DNA, 22 bp, Homo sapiens
aggtcaagggagctgagggcca

SEQ ID NO: 7566065 - DNA, 22 bp, Homo sapiens
aggtcaagggagctgagggcca

SEQ ID NO: 7566066 - DNA, 22 bp, Homo sapiens
aggtcaaggccaaaagagtggt

SEQ ID NO: 7566067 - DNA, 22 bp, Homo sapiens
aggtcaaggctgcagtgagctg

SEQ ID NO: 7566068 - DNA, 22 bp, Homo sapiens
aggtcaaggctgcagtgagctg

SEQ ID NO: 7566069 - DNA, 20 bp, Homo sapiens
agtaccttttgtatgttacc

SEQ ID NO: 7566070 - DNA, 22 bp, Homo sapiens
agtacctttgcatggatttttt

SEQ ID NO: 7566071 - DNA, 22 bp, Homo sapiens
agtacctgatttcacagaccag

SEQ ID NO: 7566072 - DNA, 22 bp, Homo sapiens
agtactgtcagcagggtgttga

SEQ ID NO: 7566073 - DNA, 22 bp, Homo sapiens
agtacttagaaagttaatataa

SEQ ID NO: 7566074 - DNA, 22 bp, Homo sapiens
agtacttcagaggctgcccagg

SEQ ID NO: 7566075 - DNA, 22 bp, Homo sapiens
agtactttacttcttacagttt

SEQ ID NO: 7566076 - DNA, 22 bp, Homo sapiens
agtactttacttcttacagttt

SEQ ID NO: 7566077 - DNA, 22 bp, Homo sapiens
agtactttgcactttgctcaga

SEQ ID NO: 7566078 - DNA, 22 bp, Homo sapiens
agtactttgcactttgctcaga

SEQ ID NO: 7566079 - DNA, 22 bp, Homo sapiens
agtactttgcactttgctcaga

SEQ ID NO: 7566080 - DNA, 22 bp, Homo sapiens
agtactttttgttcaattgtgc

SEQ ID NO: 7566081 - DNA, 22 bp, Homo sapiens
agtactttagcataaagcagtt

SEQ ID NO: 7566082 - DNA, 22 bp, Homo sapiens
agtactttagcataaagcagtt

SEQ ID NO: 7566083 - DNA, 22 bp, Homo sapiens
agtactttacttcttacagttt

SEQ ID NO: 7566084 - DNA, 22 bp, Homo sapiens
agtacttttttgatatctgagt

SEQ ID NO: 7566085 - DNA, 22 bp, Homo sapiens
agtagaaagaaggcactgggcc

SEQ ID NO: 7566086 - DNA, 22 bp, Homo sapiens
agtagaaagttgcaggaggaat

SEQ ID NO: 7566087 - DNA, 22 bp, Homo sapiens
agtagaaagttgcaggaggaat

SEQ ID NO: 7566088 - DNA, 22 bp, Homo sapiens
agtagaaagttgcaggaggaat

SEQ ID NO: 7566089 - DNA, 22 bp, Homo sapiens
agtagaaagaaggcactgggcc

SEQ ID NO: 7566090 - DNA, 22 bp, Homo sapiens
agtagtcagcagataatatagg

SEQ ID NO: 7566091 - DNA, 22 bp, Homo sapiens
agtagtggcttcctggagtgct

SEQ ID NO: 7566092 - DNA, 22 bp, Homo sapiens
agtagtgaagaatttgttctac

SEQ ID NO: 7566093 - DNA, 22 bp, Homo sapiens
agtagtgaacagccacaggatt

SEQ ID NO: 7566094 - DNA, 18 bp, Homo sapiens
agtagtgggtttagcttc

SEQ ID NO: 7566095 - DNA, 22 bp, Homo sapiens
agtagtgaagaatttgttctac

SEQ ID NO: 7566096 - DNA, 22 bp, Homo sapiens
agtagtgtacatctgttgattt

SEQ ID NO: 7566097 - DNA, 22 bp, Homo sapiens
agtagtggggccagggtttgaa

SEQ ID NO: 7566098 - DNA, 22 bp, Homo sapiens
agtagtggcttcctggagtgct

SEQ ID NO: 7566099 - DNA, 22 bp, Homo sapiens
agtataaagtggttttcagcac

SEQ ID NO: 7566100 - DNA, 22 bp, Homo sapiens
agtataaagtggttttcagcac

SEQ ID NO: 7566101 - DNA, 22 bp, Homo sapiens
agtataaagtggttttcagcac

SEQ ID NO: 7566102 - DNA, 22 bp, Homo sapiens
agtataaagtggttttcagcac

SEQ ID NO: 7566103 - DNA, 22 bp, Homo sapiens
agtataaagtggttttcagcac

SEQ ID NO: 7566104 - DNA, 22 bp, Homo sapiens
agtataaagtggttttcagcac

SEQ ID NO: 7566105 - DNA, 22 bp, Homo sapiens
agtataattagatatcaaaagt

SEQ ID NO: 7566106 - DNA, 22 bp, Homo sapiens
agtataatttacatttggtatt

SEQ ID NO: 7566107 - DNA, 22 bp, Homo sapiens
agtataatttacatttggtatt

SEQ ID NO: 7566108 - DNA, 22 bp, Homo sapiens
agtataattagatatcaaaagt

SEQ ID NO: 7566109 - DNA, 22 bp, Homo sapiens
agtagtttttaagaggtataaa

SEQ ID NO: 7566110 - DNA, 22 bp, Homo sapiens
agtagtttttaagaggtataaa

SEQ ID NO: 7566111 - DNA, 22 bp, Homo sapiens
agtagtttccatttctgagttt

SEQ ID NO: 7566112 - DNA, 21 bp, Homo sapiens
agtagtttagcacagggtttg

SEQ ID NO: 7566113 - DNA, 21 bp, Homo sapiens
agtagtttagcacagggtttg

SEQ ID NO: 7566114 - DNA, 22 bp, Homo sapiens
agtagtttgggcagtgacagat

SEQ ID NO: 7566115 - DNA, 22 bp, Homo sapiens
agtagtgtgacaattaatattt

SEQ ID NO: 7566116 - DNA, 22 bp, Homo sapiens
agtagtgtgacaattaatattt

SEQ ID NO: 7566117 - DNA, 21 bp, Homo sapiens
agtagtttagcacagggtttg

SEQ ID NO: 7566118 - DNA, 21 bp, Homo sapiens
agtagtttagcacagggtttg

SEQ ID NO: 7566119 - DNA, 21 bp, Homo sapiens
agtagtttagcacagggtttg

SEQ ID NO: 7566120 - DNA, 22 bp, Homo sapiens
agtatacagtaatgacatatct

SEQ ID NO: 7566121 - DNA, 22 bp, Homo sapiens
agtatacatatattagccttcg

SEQ ID NO: 7566122 - DNA, 22 bp, Homo sapiens
agtatacagtaatgacatatct

SEQ ID NO: 7566123 - DNA, 22 bp, Homo sapiens
agtatacagtaatgacatatct

SEQ ID NO: 7566124 - DNA, 22 bp, Homo sapiens
agtatacagtaatgacatatct

SEQ ID NO: 7566125 - DNA, 22 bp, Homo sapiens
agtatacagtaatgacatatct

SEQ ID NO: 7566126 - DNA, 22 bp, Homo sapiens
agtatacaaataaatgtgtaat

SEQ ID NO: 7566127 - DNA, 22 bp, Homo sapiens
agtatacaaataaatgtgtaat

SEQ ID NO: 7566128 - DNA, 22 bp, Homo sapiens
agtatacaaataaatgtgtaat

SEQ ID NO: 7566129 - DNA, 22 bp, Homo sapiens
agtatacaaataaatgtgtaat

SEQ ID NO: 7566130 - DNA, 22 bp, Homo sapiens
agtatacaaataaatgtgtaat

SEQ ID NO: 7566131 - DNA, 22 bp, Homo sapiens
agtatacagtaatgacatatct

SEQ ID NO: 7566132 - DNA, 22 bp, Homo sapiens
agtatacagtaatgacatatct

SEQ ID NO: 7566133 - DNA, 22 bp, Homo sapiens
agtatacaaataaatgtgtaat

SEQ ID NO: 7566134 - DNA, 22 bp, Homo sapiens
aggtgggcggattcatgaggtc

SEQ ID NO: 7566135 - DNA, 22 bp, Homo sapiens
aggtgggcttggtgccaacatg

SEQ ID NO: 7566136 - DNA, 22 bp, Homo sapiens
aggtgggcggattcatgaggtc

SEQ ID NO: 7566137 - DNA, 22 bp, Homo sapiens
aggtgggcggattcatgaggtc

SEQ ID NO: 7566138 - DNA, 22 bp, Homo sapiens
aggtggggaaaccagcgatccc

SEQ ID NO: 7566139 - DNA, 22 bp, Homo sapiens
aggtggggaaaccagcgatccc

SEQ ID NO: 7566140 - DNA, 22 bp, Homo sapiens
aggtgggcttggtgccaacatg

SEQ ID NO: 7566141 - DNA, 22 bp, Homo sapiens
aggtgggcggattcatgaggtc

SEQ ID NO: 7566142 - DNA, 22 bp, Homo sapiens
aggtggggaaaccagcgatccc

SEQ ID NO: 7566143 - DNA, 22 bp, Homo sapiens
aggtgggcttggtgccaacatg

SEQ ID NO: 7566144 - DNA, 22 bp, Homo sapiens
aggtggggaaaccagcgatccc

SEQ ID NO: 7566145 - DNA, 22 bp, Homo sapiens
aggtggggaaaccagcgatccc

SEQ ID NO: 7566146 - DNA, 22 bp, Homo sapiens
aggtggggaaaccagcgatccc

SEQ ID NO: 7566147 - DNA, 22 bp, Homo sapiens
aggtggggaaaccagcgatccc

SEQ ID NO: 7566148 - DNA, 22 bp, Homo sapiens
aggtggggaaaccagcgatccc

SEQ ID NO: 7566149 - DNA, 22 bp, Homo sapiens
aggtggggaaaccagcgatccc

SEQ ID NO: 7566150 - DNA, 21 bp, Homo sapiens
aggtgggcaggtggagtggcc

SEQ ID NO: 7566151 - DNA, 21 bp, Homo sapiens
aggtgggcaggtggagtggcc

SEQ ID NO: 7566152 - DNA, 21 bp, Homo sapiens
aggtgggcaggtggagtggcc

SEQ ID NO: 7566153 - DNA, 21 bp, Homo sapiens
aggtgggcaggtggagtggcc

SEQ ID NO: 7566154 - DNA, 22 bp, Homo sapiens
aggtgggcccagtgggctccag

SEQ ID NO: 7566155 - DNA, 22 bp, Homo sapiens
aggtgggcccagtgggctccag

SEQ ID NO: 7566156 - DNA, 22 bp, Homo sapiens
aggtgggcatagctagaatatt

SEQ ID NO: 7566157 - DNA, 22 bp, Homo sapiens
aggtgggcccagtgggctccag

SEQ ID NO: 7566158 - DNA, 22 bp, Homo sapiens
aggtgggcccagtgggctccag

SEQ ID NO: 7566159 - DNA, 22 bp, Homo sapiens
aggtgggcggatcacaaggtca

SEQ ID NO: 7566160 - DNA, 22 bp, Homo sapiens
aggtgggcggatcacaaggtca

SEQ ID NO: 7566161 - DNA, 22 bp, Homo sapiens
aggtgggcggattcatgaggtc

SEQ ID NO: 7566162 - DNA, 22 bp, Homo sapiens
aggtgggcggattcatgaggtc

SEQ ID NO: 7566163 - DNA, 22 bp, Homo sapiens
aggtgggcggattcatgaggtc

SEQ ID NO: 7566164 - DNA, 22 bp, Homo sapiens
aggtgggcggattcatgaggtc

SEQ ID NO: 7566165 - DNA, 22 bp, Homo sapiens
aggtgggcgctgctcccgctgg

SEQ ID NO: 7566166 - DNA, 22 bp, Homo sapiens
aggtgggcgctgctcccgctgg

SEQ ID NO: 7566167 - DNA, 22 bp, Homo sapiens
aggtgggcgctgctcccgctgg

SEQ ID NO: 7566168 - DNA, 22 bp, Homo sapiens
aggtgggcggatcacaaggtca

SEQ ID NO: 7566169 - DNA, 22 bp, Homo sapiens
aggtgggcggatcacaaggtca

SEQ ID NO: 7566170 - DNA, 22 bp, Homo sapiens
agtacatgtggtcctggccaga

SEQ ID NO: 7566171 - DNA, 22 bp, Homo sapiens
agtacatgcagaactaacagat

SEQ ID NO: 7566172 - DNA, 23 bp, Homo sapiens
agtacattcgaaaaattctgtga

SEQ ID NO: 7566173 - DNA, 22 bp, Homo sapiens
agtacatttagtttatgaacat

SEQ ID NO: 7566174 - DNA, 23 bp, Homo sapiens
agtacattcgaaaaattctgtga

SEQ ID NO: 7566175 - DNA, 23 bp, Homo sapiens
agtacattcgaaaaattctgtga

SEQ ID NO: 7566176 - DNA, 22 bp, Homo sapiens
agtacatttagtttatgaacat

SEQ ID NO: 7566177 - DNA, 22 bp, Homo sapiens
agtacatttattaatggtaaaa

SEQ ID NO: 7566178 - DNA, 22 bp, Homo sapiens
agtacatttattaatggtaaaa

SEQ ID NO: 7566179 - DNA, 22 bp, Homo sapiens
agtacatttattaatggtaaaa

SEQ ID NO: 7566180 - DNA, 22 bp, Homo sapiens
agtacatttattaatggtaaaa

SEQ ID NO: 7566181 - DNA, 22 bp, Homo sapiens
agtacatttattaatggtaaaa

SEQ ID NO: 7566182 - DNA, 22 bp, Homo sapiens
agtacatacttcaaatgtactt

SEQ ID NO: 7566183 - DNA, 22 bp, Homo sapiens
agtacatatagtaatttagcca

SEQ ID NO: 7566184 - DNA, 22 bp, Homo sapiens
agtacatatagtaatttagcca

SEQ ID NO: 7566185 - DNA, 21 bp, Homo sapiens
agtacatctcaaatgtaaatc

SEQ ID NO: 7566186 - DNA, 21 bp, Homo sapiens
agtacatctcaaatgtaaatc

SEQ ID NO: 7566187 - DNA, 21 bp, Homo sapiens
agtacatctcaaatgtaaatc

SEQ ID NO: 7566188 - DNA, 22 bp, Homo sapiens
agtaataatagctgtaaagtgc

SEQ ID NO: 7566189 - DNA, 22 bp, Homo sapiens
agtaataatttatattagggag

SEQ ID NO: 7566190 - DNA, 22 bp, Homo sapiens
agtaataatagtagccggcatt

SEQ ID NO: 7566191 - DNA, 22 bp, Homo sapiens
agtaataatagtagccggcatt

SEQ ID NO: 7566192 - DNA, 22 bp, Homo sapiens
agtaataatagctgtaaagtgc

SEQ ID NO: 7566193 - DNA, 22 bp, Homo sapiens
agtaataatagctgtaaagtgc

SEQ ID NO: 7566194 - DNA, 22 bp, Homo sapiens
agtaccatgcttcctgactggt

SEQ ID NO: 7566195 - DNA, 22 bp, Homo sapiens
agtaccatgcttcctgactggt

SEQ ID NO: 7566196 - DNA, 22 bp, Homo sapiens
agtaccatctctgcctctgcct

SEQ ID NO: 7566197 - DNA, 22 bp, Homo sapiens
agtaccatctatgtgccaagca

SEQ ID NO: 7566198 - DNA, 23 bp, Homo sapiens
agtacatttgacccaaataagct

SEQ ID NO: 7566199 - DNA, 23 bp, Homo sapiens
agtacatttgacccaaataagct

SEQ ID NO: 7566200 - DNA, 23 bp, Homo sapiens
agtacatttgacccaaataagct

SEQ ID NO: 7566201 - DNA, 23 bp, Homo sapiens
agtacatttgacccaaataagct

SEQ ID NO: 7566202 - DNA, 23 bp, Homo sapiens
agtacatttgacccaaataagct

SEQ ID NO: 7566203 - DNA, 22 bp, Homo sapiens
agtaccatcatttagatgtgtt

SEQ ID NO: 7566204 - DNA, 23 bp, Homo sapiens
agtacatttgacccaaataagct

SEQ ID NO: 7566205 - DNA, 22 bp, Homo sapiens
agtacccttttcactgtcacaa

SEQ ID NO: 7566206 - DNA, 22 bp, Homo sapiens
agtacccttttcactgtcacaa

SEQ ID NO: 7566207 - DNA, 22 bp, Homo sapiens
agtaccctagggtgggagctca

SEQ ID NO: 7566208 - DNA, 22 bp, Homo sapiens
agtaccattccgttggagctgg

SEQ ID NO: 7566209 - DNA, 22 bp, Homo sapiens
agtaccattatccagtaaagga

SEQ ID NO: 7566210 - DNA, 22 bp, Homo sapiens
agtaccattactcacttatttt

SEQ ID NO: 7566211 - DNA, 22 bp, Homo sapiens
agtaccattactcacttatttt

SEQ ID NO: 7566212 - DNA, 23 bp, Homo sapiens
agtaccatgtgttccttctcgtt

SEQ ID NO: 7566213 - DNA, 22 bp, Homo sapiens
agtaccattatccagtaaagga

SEQ ID NO: 7566214 - DNA, 22 bp, Homo sapiens
agtaccattagattaggatgac

SEQ ID NO: 7566215 - DNA, 22 bp, Homo sapiens
actccctgtacttgcctctctt

SEQ ID NO: 7566216 - DNA, 22 bp, Homo sapiens
actcccttggtggagaatgcaa

SEQ ID NO: 7566217 - DNA, 22 bp, Homo sapiens
actcccttggtggagaatgcaa

SEQ ID NO: 7566218 - DNA, 22 bp, Homo sapiens
actcccttgtgaactcattctt

SEQ ID NO: 7566219 - DNA, 22 bp, Homo sapiens
actccgggagccaggagaggct

SEQ ID NO: 7566220 - DNA, 22 bp, Homo sapiens
actcctgcttcttccctgagga

SEQ ID NO: 7566221 - DNA, 22 bp, Homo sapiens
actcctgcttcttccctgagga

SEQ ID NO: 7566222 - DNA, 22 bp, Homo sapiens
actcctgcttcttccctgagga

SEQ ID NO: 7566223 - DNA, 22 bp, Homo sapiens
actcctgctgtcactgcagttc

SEQ ID NO: 7566224 - DNA, 22 bp, Homo sapiens
actcctgctgtcactgcagttc

SEQ ID NO: 7566225 - DNA, 22 bp, Homo sapiens
actcctgccacacagatgctgt

SEQ ID NO: 7566226 - DNA, 22 bp, Homo sapiens
actcctgccacacagatgctgt

SEQ ID NO: 7566227 - DNA, 22 bp, Homo sapiens
actcctcagttgcttcttagtt

SEQ ID NO: 7566228 - DNA, 22 bp, Homo sapiens
actcctcagtcaaatagttggt

SEQ ID NO: 7566229 - DNA, 22 bp, Homo sapiens
actccagggttttgcacctgga

SEQ ID NO: 7566230 - DNA, 22 bp, Homo sapiens
actccagggtgactctgtctga

SEQ ID NO: 7566231 - DNA, 22 bp, Homo sapiens
actccagggtgactctgtctga

SEQ ID NO: 7566232 - DNA, 22 bp, Homo sapiens
actccagggtgactctgtctga

SEQ ID NO: 7566233 - DNA, 22 bp, Homo sapiens
actccctccaaatctgcacagt

SEQ ID NO: 7566234 - DNA, 22 bp, Homo sapiens
actccctccaaatctgcacagt

SEQ ID NO: 7566235 - DNA, 22 bp, Homo sapiens
actccctccaaatctgcacagt

SEQ ID NO: 7566236 - DNA, 21 bp, Homo sapiens
actccctgcataagtgattta

SEQ ID NO: 7566237 - DNA, 22 bp, Homo sapiens
actccctctctagtccttgcaa

SEQ ID NO: 7566238 - DNA, 22 bp, Homo sapiens
actccctggcaggtctttatct

SEQ ID NO: 7566239 - DNA, 22 bp, Homo sapiens
actccctgtacttgcctctctt

SEQ ID NO: 7566240 - DNA, 22 bp, Homo sapiens
actccctgcaagattttccatg

SEQ ID NO: 7566241 - DNA, 21 bp, Homo sapiens
actccctgcataagtgattta

SEQ ID NO: 7566242 - DNA, 22 bp, Homo sapiens
actccctctctagtccttgcaa

SEQ ID NO: 7566243 - DNA, 22 bp, Homo sapiens
actccctctctagtccttgcaa

SEQ ID NO: 7566244 - DNA, 22 bp, Homo sapiens
actccctctctagtccttgcaa

SEQ ID NO: 7566245 - DNA, 22 bp, Homo sapiens
actcctggggctgccatcacag

SEQ ID NO: 7566246 - DNA, 22 bp, Homo sapiens
actcctgggtgcatttctgatt

SEQ ID NO: 7566247 - DNA, 22 bp, Homo sapiens
actcctgggtgctgaccagcgt

SEQ ID NO: 7566248 - DNA, 22 bp, Homo sapiens
actcctgggtgctgaccagcgt

SEQ ID NO: 7566249 - DNA, 22 bp, Homo sapiens
actcctgggtgctgaccagcgt

SEQ ID NO: 7566250 - DNA, 22 bp, Homo sapiens
actcctgggtgcatttctgatt

SEQ ID NO: 7566251 - DNA, 22 bp, Homo sapiens
actcctggaaaagaacgcaggg

SEQ ID NO: 7566252 - DNA, 22 bp, Homo sapiens
actcctggaaaagaacgcaggg

SEQ ID NO: 7566253 - DNA, 22 bp, Homo sapiens
actcctggggatccattccttt

SEQ ID NO: 7566254 - DNA, 22 bp, Homo sapiens
actcctggggatccattccttt

SEQ ID NO: 7566255 - DNA, 22 bp, Homo sapiens
actcctggggatccattccttt

SEQ ID NO: 7566256 - DNA, 22 bp, Homo sapiens
actcctggaaaagaacgcaggg

SEQ ID NO: 7566257 - DNA, 22 bp, Homo sapiens
actcctgggttccggagattct

SEQ ID NO: 7566258 - DNA, 22 bp, Homo sapiens
actcctgggtgctgaccagcgt

SEQ ID NO: 7566259 - DNA, 22 bp, Homo sapiens
actcctgggtgctgaccagcgt

SEQ ID NO: 7566260 - DNA, 22 bp, Homo sapiens
actcctgggtgctgaccagcgt

SEQ ID NO: 7566261 - DNA, 22 bp, Homo sapiens
agtcaccaggttttagagacct

SEQ ID NO: 7566262 - DNA, 22 bp, Homo sapiens
agtcaccaggttttagagacct

SEQ ID NO: 7566263 - DNA, 22 bp, Homo sapiens
agtcactgaataccttaatgtt

SEQ ID NO: 7566264 - DNA, 22 bp, Homo sapiens
agtcaccttgtttatgcccagg

SEQ ID NO: 7566265 - DNA, 22 bp, Homo sapiens
agtcactctgctacatgacagc

SEQ ID NO: 7566266 - DNA, 22 bp, Homo sapiens
agtcaccctccaactctccact

SEQ ID NO: 7566267 - DNA, 22 bp, Homo sapiens
agtcaccctccaactctccact

SEQ ID NO: 7566268 - DNA, 22 bp, Homo sapiens
agtcaccattttcacctgcctc

SEQ ID NO: 7566269 - DNA, 22 bp, Homo sapiens
agtcaccatctgtggcagcctg

SEQ ID NO: 7566270 - DNA, 22 bp, Homo sapiens
actctctgagctaccaggtgag

SEQ ID NO: 7566271 - DNA, 22 bp, Homo sapiens
actctctgagctaccaggtgag

SEQ ID NO: 7566272 - DNA, 22 bp, Homo sapiens
actctctctgatggaactttag

SEQ ID NO: 7566273 - DNA, 22 bp, Homo sapiens
actctctggtgtagaaagacct

SEQ ID NO: 7566274 - DNA, 22 bp, Homo sapiens
actctctggtgtagaaagacct

SEQ ID NO: 7566275 - DNA, 22 bp, Homo sapiens
actctctggtattggcaagttt

SEQ ID NO: 7566276 - DNA, 22 bp, Homo sapiens
actctctggtattggcaagttt

SEQ ID NO: 7566277 - DNA, 22 bp, Homo sapiens
actctctggtattggcaagttt

SEQ ID NO: 7566278 - DNA, 22 bp, Homo sapiens
actctctgggcatgccccacca

SEQ ID NO: 7566279 - DNA, 22 bp, Homo sapiens
actctctgtctaaatgcagttt

SEQ ID NO: 7566280 - DNA, 22 bp, Homo sapiens
actctctgtgatggaggccagc

SEQ ID NO: 7566281 - DNA, 22 bp, Homo sapiens
actctctgtctaaatgcagttt

SEQ ID NO: 7566282 - DNA, 22 bp, Homo sapiens
actctctgtgatggaggccagc

SEQ ID NO: 7566283 - DNA, 22 bp, Homo sapiens
actctctgtgatggaggccagc

SEQ ID NO: 7566284 - DNA, 22 bp, Homo sapiens
actctctgtgatggaggccagc

SEQ ID NO: 7566285 - DNA, 22 bp, Homo sapiens
actctcttgggggagagcagag

SEQ ID NO: 7566286 - DNA, 22 bp, Homo sapiens
actctctgtggttctactttgc

SEQ ID NO: 7566287 - DNA, 22 bp, Homo sapiens
actctccttttgatcttcagaa

SEQ ID NO: 7566288 - DNA, 22 bp, Homo sapiens
actctcccttggagcctcaggc

SEQ ID NO: 7566289 - DNA, 22 bp, Homo sapiens
actctcccttggagcctcaggc

SEQ ID NO: 7566290 - DNA, 22 bp, Homo sapiens
actctaaatagcctcttaaaca

SEQ ID NO: 7566291 - DNA, 22 bp, Homo sapiens
actctaaatagcctcttaaaca

SEQ ID NO: 7566292 - DNA, 22 bp, Homo sapiens
actctcccttggagcctcaggc

SEQ ID NO: 7566293 - DNA, 22 bp, Homo sapiens
actctctcacagcttggctgat

SEQ ID NO: 7566294 - DNA, 22 bp, Homo sapiens
actctctcacagcttggctgat

SEQ ID NO: 7566295 - DNA, 22 bp, Homo sapiens
actctctcacacacgcctatat

SEQ ID NO: 7566296 - DNA, 22 bp, Homo sapiens
actctctcacacacgcctatat

SEQ ID NO: 7566297 - DNA, 22 bp, Homo sapiens
agtcactgtttaatctagctaa

SEQ ID NO: 7566298 - DNA, 22 bp, Homo sapiens
agtcactgttctgtcatgtcaa

SEQ ID NO: 7566299 - DNA, 22 bp, Homo sapiens
agtcactgttctgtcatgtcaa

SEQ ID NO: 7566300 - DNA, 22 bp, Homo sapiens
agtcactgtcttgcaaaggtca

SEQ ID NO: 7566301 - DNA, 22 bp, Homo sapiens
agtcactgtcaaagccacacac

SEQ ID NO: 7566302 - DNA, 22 bp, Homo sapiens
agtcactggttctgtaattaat

SEQ ID NO: 7566303 - DNA, 22 bp, Homo sapiens
agtcactgtcaaagccacacac

SEQ ID NO: 7566304 - DNA, 22 bp, Homo sapiens
agtcactgagatggtgaggcta

SEQ ID NO: 7566305 - DNA, 22 bp, Homo sapiens
agtcactgagatggtgaggcta

SEQ ID NO: 7566306 - DNA, 22 bp, Homo sapiens
agtcactgaataccttaatgtt

SEQ ID NO: 7566307 - DNA, 22 bp, Homo sapiens
agtcactgagatggtgaggcta

SEQ ID NO: 7566308 - DNA, 22 bp, Homo sapiens
agtcactgaataccttaatgtt

SEQ ID NO: 7566309 - DNA, 22 bp, Homo sapiens
agtcactgagatggtgaggcta

SEQ ID NO: 7566310 - DNA, 22 bp, Homo sapiens
agtcactgctttgtccctgtgt

SEQ ID NO: 7566311 - DNA, 22 bp, Homo sapiens
agtcactggttctgtaattaat

SEQ ID NO: 7566312 - DNA, 22 bp, Homo sapiens
agtcactgggctgcttcctata

SEQ ID NO: 7566313 - DNA, 22 bp, Homo sapiens
agtcactgggctgcttcctata

SEQ ID NO: 7566314 - DNA, 22 bp, Homo sapiens
agtcactgctttgtccctgtgt

SEQ ID NO: 7566315 - DNA, 22 bp, Homo sapiens
agtcactgggctgcttcctata

SEQ ID NO: 7566316 - DNA, 22 bp, Homo sapiens
agtcactgctttgtccctgtgt

SEQ ID NO: 7566317 - DNA, 22 bp, Homo sapiens
actctaaaatgctatgagatct

SEQ ID NO: 7566318 - DNA, 22 bp, Homo sapiens
agtcacttccagacacctgcct

SEQ ID NO: 7566319 - DNA, 22 bp, Homo sapiens
agtcacttccagctgtgtttca

SEQ ID NO: 7566320 - DNA, 22 bp, Homo sapiens
agtcacttccagacacctgcct

SEQ ID NO: 7566321 - DNA, 22 bp, Homo sapiens
agtcacttaatctaagtctcag

SEQ ID NO: 7566322 - DNA, 22 bp, Homo sapiens
agtcacttcatggtttcttgga

SEQ ID NO: 7566323 - DNA, 22 bp, Homo sapiens
agtcacttaatctaagtctcag

SEQ ID NO: 7566324 - DNA, 22 bp, Homo sapiens
agtcacttccagacacctgcct

SEQ ID NO: 7566325 - DNA, 22 bp, Homo sapiens
actctaaatagataaccatgca

SEQ ID NO: 7566326 - DNA, 22 bp, Homo sapiens
agtcactgtttcagaactgagt

SEQ ID NO: 7566327 - DNA, 22 bp, Homo sapiens
agtcacttaataggttcatctg

SEQ ID NO: 7566328 - DNA, 22 bp, Homo sapiens
agtcacttaacatttgctgcag

SEQ ID NO: 7566329 - DNA, 22 bp, Homo sapiens
agtcacttaataggttcatctg

SEQ ID NO: 7566330 - DNA, 22 bp, Homo sapiens
agtcactgtttaatctagctaa

SEQ ID NO: 7566331 - DNA, 22 bp, Homo sapiens
agtcactgtttcagaactgagt

SEQ ID NO: 7566332 - DNA, 22 bp, Homo sapiens
agtcactgtttcagaactgagt

SEQ ID NO: 7566333 - DNA, 22 bp, Homo sapiens
agtcactgtttcagaactgagt

SEQ ID NO: 7566334 - DNA, 22 bp, Homo sapiens
aggaaagaaaggaggtgcattt

SEQ ID NO: 7566335 - DNA, 22 bp, Homo sapiens
aggaaagaaaggaggtgcattt

SEQ ID NO: 7566336 - DNA, 22 bp, Homo sapiens
aggaaagaaaggaggtgcattt

SEQ ID NO: 7566337 - DNA, 22 bp, Homo sapiens
aggaaagaaaggaggtgcattt

SEQ ID NO: 7566338 - DNA, 22 bp, Homo sapiens
aggaaactttcttttgcttcat

SEQ ID NO: 7566339 - DNA, 22 bp, Homo sapiens
aggaaactttcttttgcttcat

SEQ ID NO: 7566340 - DNA, 22 bp, Homo sapiens
aggaaacttcagagttttggtc

SEQ ID NO: 7566341 - DNA, 19 bp, Homo sapiens
aggaaactgtcttttccag

SEQ ID NO: 7566342 - DNA, 19 bp, Homo sapiens
aggaaactgtcttttccag

SEQ ID NO: 7566343 - DNA, 22 bp, Homo sapiens
aggaaactgggtatggttatac

SEQ ID NO: 7566344 - DNA, 22 bp, Homo sapiens
aggaaactgtcccctcatccta

SEQ ID NO: 7566345 - DNA, 22 bp, Homo sapiens
aggaaactgtcccctcatccta

SEQ ID NO: 7566346 - DNA, 19 bp, Homo sapiens
aggaaactgtcttttccag

SEQ ID NO: 7566347 - DNA, 22 bp, Homo sapiens
aggaaactgggcctcaggttag

SEQ ID NO: 7566348 - DNA, 22 bp, Homo sapiens
aggaaactgatgttttttacaa

SEQ ID NO: 7566349 - DNA, 22 bp, Homo sapiens
aggaaactgatgttttttacaa

SEQ ID NO: 7566350 - DNA, 22 bp, Homo sapiens
aggaaactgaagcccagagagg

SEQ ID NO: 7566351 - DNA, 22 bp, Homo sapiens
aggaaactctgagcggaccagc

SEQ ID NO: 7566352 - DNA, 23 bp, Homo sapiens
aggaaactgaaggggccctctat

SEQ ID NO: 7566353 - DNA, 23 bp, Homo sapiens
aggaaactgaaggggccctctat

SEQ ID NO: 7566354 - DNA, 22 bp, Homo sapiens
aggaaactgaggttacgggact

SEQ ID NO: 7566355 - DNA, 22 bp, Homo sapiens
aggaaactcaaagtgtcaggta

SEQ ID NO: 7566356 - DNA, 22 bp, Homo sapiens
aggaaactcccctacatctcaa

SEQ ID NO: 7566357 - DNA, 22 bp, Homo sapiens
aggaaactcccctacatctcaa

SEQ ID NO: 7566358 - DNA, 22 bp, Homo sapiens
aggaaactcccctacatctcaa

SEQ ID NO: 7566359 - DNA, 22 bp, Homo sapiens
aggaaactaaggctcagtgaag

SEQ ID NO: 7566360 - DNA, 22 bp, Homo sapiens
aggaaactaaggctcagtgaag

SEQ ID NO: 7566361 - DNA, 22 bp, Homo sapiens
aggaaactaaggctcagtgaag

SEQ ID NO: 7566362 - DNA, 22 bp, Homo sapiens
aggaaactaattagtagaataa

SEQ ID NO: 7566363 - DNA, 22 bp, Homo sapiens
aggaaactaattagtagaataa

SEQ ID NO: 7566364 - DNA, 22 bp, Homo sapiens
aggaaactaacttatctttata

SEQ ID NO: 7566365 - DNA, 18 bp, Homo sapiens
aggaagcaggaggaaggc

SEQ ID NO: 7566366 - DNA, 18 bp, Homo sapiens
aggaagcaggaggaaggc

SEQ ID NO: 7566367 - DNA, 18 bp, Homo sapiens
aggaagcaggaggaaggc

SEQ ID NO: 7566368 - DNA, 22 bp, Homo sapiens
aggaagcagtttataatgcatt

SEQ ID NO: 7566369 - DNA, 22 bp, Homo sapiens
aggaagcatgttggatccactt

SEQ ID NO: 7566370 - DNA, 22 bp, Homo sapiens
aggaagcatgttggatccactt

SEQ ID NO: 7566371 - DNA, 22 bp, Homo sapiens
aggaagccaagcctgacactca

SEQ ID NO: 7566372 - DNA, 22 bp, Homo sapiens
aggaagccacgagtggcacggg

SEQ ID NO: 7566373 - DNA, 22 bp, Homo sapiens
aggaagccacgagtggcacggg

SEQ ID NO: 7566374 - DNA, 22 bp, Homo sapiens
aggaagccaagcctgacactca

SEQ ID NO: 7566375 - DNA, 22 bp, Homo sapiens
aggaagccacgagtggcacggg

SEQ ID NO: 7566376 - DNA, 22 bp, Homo sapiens
aggaagccaggcccttgggtgg

SEQ ID NO: 7566377 - DNA, 22 bp, Homo sapiens
aggaagccaggcccttgggtgg

SEQ ID NO: 7566378 - DNA, 22 bp, Homo sapiens
aggaagccatggtggacgtcta

SEQ ID NO: 7566379 - DNA, 22 bp, Homo sapiens
aggaagccatggtggacgtcta

SEQ ID NO: 7566380 - DNA, 22 bp, Homo sapiens
aggaagagcattcacatggtag

SEQ ID NO: 7566381 - DNA, 22 bp, Homo sapiens
aggaagagcattcacatggtag

SEQ ID NO: 7566382 - DNA, 22 bp, Homo sapiens
aggaagagcattcacatggtag

SEQ ID NO: 7566383 - DNA, 22 bp, Homo sapiens
aggaagagcattcacatggtag

SEQ ID NO: 7566384 - DNA, 22 bp, Homo sapiens
aggaagagcattcacatggtag

SEQ ID NO: 7566385 - DNA, 22 bp, Homo sapiens
aggaagagcattcacatggtag

SEQ ID NO: 7566386 - DNA, 18 bp, Homo sapiens
aggaaagaaaggcaggtg

SEQ ID NO: 7566387 - DNA, 18 bp, Homo sapiens
aggaaagaaaggcaggtg

SEQ ID NO: 7566388 - DNA, 18 bp, Homo sapiens
aggaaagaaaggcaggtg

SEQ ID NO: 7566389 - DNA, 18 bp, Homo sapiens
aggaaagaaaggcaggtg

SEQ ID NO: 7566390 - DNA, 18 bp, Homo sapiens
aggaaagaaaggcaggtg

SEQ ID NO: 7566391 - DNA, 18 bp, Homo sapiens
aggaaagaaaggcaggtg

SEQ ID NO: 7566392 - DNA, 18 bp, Homo sapiens
aggaaagaaaggcaggtg

SEQ ID NO: 7566393 - DNA, 22 bp, Homo sapiens
aggaaagaaaggaggtgcattt

SEQ ID NO: 7566394 - DNA, 18 bp, Homo sapiens
aggaaagaaaggcaggtg

SEQ ID NO: 7566395 - DNA, 18 bp, Homo sapiens
aggaaagaaaggcaggtg

SEQ ID NO: 7566396 - DNA, 18 bp, Homo sapiens
aggaaagaaaggcaggtg

SEQ ID NO: 7566397 - DNA, 22 bp, Homo sapiens
aggaaagaaaggaggtgcattt

SEQ ID NO: 7566398 - DNA, 22 bp, Homo sapiens
aggaaagaaaggaggtgcattt

SEQ ID NO: 7566399 - DNA, 22 bp, Homo sapiens
aggaaagaaaggaggtgcattt

SEQ ID NO: 7566400 - DNA, 22 bp, Homo sapiens
aggaaagaaaggaggtgcattt

SEQ ID NO: 7566401 - DNA, 22 bp, Homo sapiens
aggaaagaaaggaggtgcattt

SEQ ID NO: 7566402 - DNA, 22 bp, Homo sapiens
aggaaagaaaggaggtgcattt

SEQ ID NO: 7566403 - DNA, 22 bp, Homo sapiens
agcttcaggtggtcttgtttct

SEQ ID NO: 7566404 - DNA, 20 bp, Homo sapiens
agctttggttaagccagtgg

SEQ ID NO: 7566405 - DNA, 20 bp, Homo sapiens
agctttggttaagccagtgg

SEQ ID NO: 7566406 - DNA, 22 bp, Homo sapiens
agctttggtgctgtcacacaaa

SEQ ID NO: 7566407 - DNA, 22 bp, Homo sapiens
agctttggtgctgtcacacaaa

SEQ ID NO: 7566408 - DNA, 22 bp, Homo sapiens
agctttggttgccatgatctga

SEQ ID NO: 7566409 - DNA, 22 bp, Homo sapiens
agctttggttgccatgatctga

SEQ ID NO: 7566410 - DNA, 22 bp, Homo sapiens
agctttggttgaggggagtgtg

SEQ ID NO: 7566411 - DNA, 20 bp, Homo sapiens
agctttggttaagccagtgg

SEQ ID NO: 7566412 - DNA, 22 bp, Homo sapiens
agctttggttgaggggagtgtg

SEQ ID NO: 7566413 - DNA, 22 bp, Homo sapiens
agctttggttgaggggagtgtg

SEQ ID NO: 7566414 - DNA, 22 bp, Homo sapiens
agctttgtgactttgagctagt

SEQ ID NO: 7566415 - DNA, 22 bp, Homo sapiens
agctttgtggctttgcaagact

SEQ ID NO: 7566416 - DNA, 22 bp, Homo sapiens
agctttgtttgctcacccgccg

SEQ ID NO: 7566417 - DNA, 22 bp, Homo sapiens
agctttgtttcacatacacctt

SEQ ID NO: 7566418 - DNA, 22 bp, Homo sapiens
agctttgtttcacatacacctt

SEQ ID NO: 7566419 - DNA, 22 bp, Homo sapiens
agctttgtttcacatacacctt

SEQ ID NO: 7566420 - DNA, 23 bp, Homo sapiens
agctttgtgaaagcagacatggg

SEQ ID NO: 7566421 - DNA, 22 bp, Homo sapiens
agctttgtatttgagcatacga

SEQ ID NO: 7566422 - DNA, 22 bp, Homo sapiens
agctttgtcttctcacatatcc

SEQ ID NO: 7566423 - DNA, 22 bp, Homo sapiens
agcttcataattccttgactca

SEQ ID NO: 7566424 - DNA, 22 bp, Homo sapiens
agcttcatgcctaaagacagcg

SEQ ID NO: 7566425 - DNA, 22 bp, Homo sapiens
agcttcagttttctattgttaa

SEQ ID NO: 7566426 - DNA, 22 bp, Homo sapiens
agcttcagtgtcaggcccgtgg

SEQ ID NO: 7566427 - DNA, 17 bp, Homo sapiens
agcttcagttgcaaaac

SEQ ID NO: 7566428 - DNA, 17 bp, Homo sapiens
agcttcagttgcaaaac

SEQ ID NO: 7566429 - DNA, 22 bp, Homo sapiens
agcttcaggtggtcttgtttct

SEQ ID NO: 7566430 - DNA, 22 bp, Homo sapiens
agcttcaggtggtcttgtttct

SEQ ID NO: 7566431 - DNA, 22 bp, Homo sapiens
agcttccaatttctccaagaga

SEQ ID NO: 7566432 - DNA, 22 bp, Homo sapiens
agctttatggtgcctcacttga

SEQ ID NO: 7566433 - DNA, 22 bp, Homo sapiens
aggaaaaacctgttaatggtag

SEQ ID NO: 7566434 - DNA, 22 bp, Homo sapiens
aggaaaaacctgttaatggtag

SEQ ID NO: 7566435 - DNA, 22 bp, Homo sapiens
aggaaaaacctgttaatggtag

SEQ ID NO: 7566436 - DNA, 22 bp, Homo sapiens
aggaaaaagagttgctgccttc

SEQ ID NO: 7566437 - DNA, 22 bp, Homo sapiens
aggaaaaagagttgctgccttc

SEQ ID NO: 7566438 - DNA, 22 bp, Homo sapiens
aggaaaaagagttgctgccttc

SEQ ID NO: 7566439 - DNA, 22 bp, Homo sapiens
aggaaaaagagttgctgccttc

SEQ ID NO: 7566440 - DNA, 22 bp, Homo sapiens
aggaaaaagagttgctgccttc

SEQ ID NO: 7566441 - DNA, 22 bp, Homo sapiens
aggaaaaagagttgctgccttc

SEQ ID NO: 7566442 - DNA, 22 bp, Homo sapiens
aggaaaaaagtctgtgattata

SEQ ID NO: 7566443 - DNA, 22 bp, Homo sapiens
aggaaaaaagtctgtgattata

SEQ ID NO: 7566444 - DNA, 22 bp, Homo sapiens
aggaaaaaagtctgtgattata

SEQ ID NO: 7566445 - DNA, 22 bp, Homo sapiens
aggaaaaacctgttaatggtag

SEQ ID NO: 7566446 - DNA, 22 bp, Homo sapiens
aggaaaaacctgttaatggtag

SEQ ID NO: 7566447 - DNA, 22 bp, Homo sapiens
aggaaaaacctgttaatggtag

SEQ ID NO: 7566448 - DNA, 22 bp, Homo sapiens
aggaaaaacctgttaatggtag

SEQ ID NO: 7566449 - DNA, 22 bp, Homo sapiens
aggaaaaaagtctgtgattata

SEQ ID NO: 7566450 - DNA, 22 bp, Homo sapiens
aggaaaaaagtctgtgattata

SEQ ID NO: 7566451 - DNA, 19 bp, Homo sapiens
agcttttactaacagcaga

SEQ ID NO: 7566452 - DNA, 22 bp, Homo sapiens
agcttttacataatgatcttga

SEQ ID NO: 7566453 - DNA, 19 bp, Homo sapiens
agcttttactaacagcaga

SEQ ID NO: 7566454 - DNA, 22 bp, Homo sapiens
agcttttacataatgatcttga

SEQ ID NO: 7566455 - DNA, 22 bp, Homo sapiens
agcttttacataatgatcttga

SEQ ID NO: 7566456 - DNA, 22 bp, Homo sapiens
agcttttacataatgatcttga

SEQ ID NO: 7566457 - DNA, 23 bp, Homo sapiens
agcttttaggtggaaatggcact

SEQ ID NO: 7566458 - DNA, 23 bp, Homo sapiens
agcttttaggtggaaatggcact

SEQ ID NO: 7566459 - DNA, 19 bp, Homo sapiens
agcttttactaacagcaga

SEQ ID NO: 7566460 - DNA, 22 bp, Homo sapiens
agcttttagctcctggttgcaa

SEQ ID NO: 7566461 - DNA, 22 bp, Homo sapiens
agcttttagtacgttaaaattg

SEQ ID NO: 7566462 - DNA, 22 bp, Homo sapiens
agcttttagtacgttaaaattg

SEQ ID NO: 7566463 - DNA, 22 bp, Homo sapiens
agcttttagtacgttaaaattg

SEQ ID NO: 7566464 - DNA, 22 bp, Homo sapiens
agcttttagtacgttaaaattg

SEQ ID NO: 7566465 - DNA, 22 bp, Homo sapiens
agcttttattggctgtcatttg

SEQ ID NO: 7566466 - DNA, 22 bp, Homo sapiens
agcttttattggctgtcatttg

SEQ ID NO: 7566467 - DNA, 22 bp, Homo sapiens
agcttttattggctgtcatttg

SEQ ID NO: 7566468 - DNA, 22 bp, Homo sapiens
aggaaaaaagtctgtgattata

SEQ ID NO: 7566469 - DNA, 22 bp, Homo sapiens
aggaaaaaagtctgtgattata

SEQ ID NO: 7566470 - DNA, 22 bp, Homo sapiens
agctttttcactttggatggga

SEQ ID NO: 7566471 - DNA, 22 bp, Homo sapiens
aggaaaaaagtctgtgattata

SEQ ID NO: 7566472 - DNA, 21 bp, Homo sapiens
agcttttctgttttatatcta

SEQ ID NO: 7566473 - DNA, 22 bp, Homo sapiens
agcttataatgtaactaaggac

SEQ ID NO: 7566474 - DNA, 22 bp, Homo sapiens
agcttataatgtaactaaggac

SEQ ID NO: 7566475 - DNA, 22 bp, Homo sapiens
agcttagtggttgtatgagtta

SEQ ID NO: 7566476 - DNA, 22 bp, Homo sapiens
agcttatcttgttagtttcatt

SEQ ID NO: 7566477 - DNA, 22 bp, Homo sapiens
agcttattaatttttctgcatg

SEQ ID NO: 7566478 - DNA, 22 bp, Homo sapiens
agcttattaccactccttgggg

SEQ ID NO: 7566479 - DNA, 22 bp, Homo sapiens
agcttattaccactccttgggg

SEQ ID NO: 7566480 - DNA, 22 bp, Homo sapiens
agcttagtggttgtatgagtta

SEQ ID NO: 7566481 - DNA, 22 bp, Homo sapiens
agcttagtcactcttaaattta

SEQ ID NO: 7566482 - DNA, 22 bp, Homo sapiens
agcttagcacacacaggcaggt

SEQ ID NO: 7566483 - DNA, 22 bp, Homo sapiens
agcttaggaggatgatgaacat

SEQ ID NO: 7566484 - DNA, 22 bp, Homo sapiens
agcttagaatgtgttaggaaag

SEQ ID NO: 7566485 - DNA, 22 bp, Homo sapiens
agctgtgtaggatcataacacg

SEQ ID NO: 7566486 - DNA, 22 bp, Homo sapiens
agctgtgtagggaatcagagaa

SEQ ID NO: 7566487 - DNA, 22 bp, Homo sapiens
agcttcagcttgcagctgtgat

SEQ ID NO: 7566488 - DNA, 22 bp, Homo sapiens
agcttcagcttgcagctgtgat

SEQ ID NO: 7566489 - DNA, 22 bp, Homo sapiens
agcttcaggaacaggcagcctg

SEQ ID NO: 7566490 - DNA, 22 bp, Homo sapiens
agcttcagcttgcagctgtgat

SEQ ID NO: 7566491 - DNA, 22 bp, Homo sapiens
agcttcagcttgcagctgtgat

SEQ ID NO: 7566492 - DNA, 22 bp, Homo sapiens
agcttcagggacttgtggcaga

SEQ ID NO: 7566493 - DNA, 22 bp, Homo sapiens
agcttcagggacttgtggcaga

SEQ ID NO: 7566494 - DNA, 20 bp, Homo sapiens
agcttcaggctcaagagaac

SEQ ID NO: 7566495 - DNA, 22 bp, Homo sapiens
agcttcaggaacaggcagcctg

SEQ ID NO: 7566496 - DNA, 20 bp, Homo sapiens
agcttcaggctcaagagaac

SEQ ID NO: 7566497 - DNA, 20 bp, Homo sapiens
agcttcaggctcaagagaac

SEQ ID NO: 7566498 - DNA, 20 bp, Homo sapiens
agcttcaggctcaagagaac

SEQ ID NO: 7566499 - DNA, 22 bp, Homo sapiens
agcttcaacttactaaaagata

SEQ ID NO: 7566500 - DNA, 22 bp, Homo sapiens
agcttcaaggttcaaggatgct

SEQ ID NO: 7566501 - DNA, 22 bp, Homo sapiens
agcttcaacttactaaaagata

SEQ ID NO: 7566502 - DNA, 22 bp, Homo sapiens
agcttcaaggttcaaggatgct

SEQ ID NO: 7566503 - DNA, 20 bp, Homo sapiens
agcttcagccctaggattgc

SEQ ID NO: 7566504 - DNA, 20 bp, Homo sapiens
agcttcagccctaggattgc

SEQ ID NO: 7566505 - DNA, 22 bp, Homo sapiens
agcttcagatttatctttctgt

SEQ ID NO: 7566506 - DNA, 22 bp, Homo sapiens
agcttcagatttatctttctgt

SEQ ID NO: 7566507 - DNA, 22 bp, Homo sapiens
agcttcaaagctaggaagatct

SEQ ID NO: 7566508 - DNA, 22 bp, Homo sapiens
agcttcaaagctaggaagatct

SEQ ID NO: 7566509 - DNA, 22 bp, Homo sapiens
agcttcaaagctaggaagatct

SEQ ID NO: 7566510 - DNA, 22 bp, Homo sapiens
agcttattcatcttgtgaccta

SEQ ID NO: 7566511 - DNA, 22 bp, Homo sapiens
agcttattaatttttctgcatg

SEQ ID NO: 7566512 - DNA, 22 bp, Homo sapiens
agctgtgtaagtcatgtaggtg

SEQ ID NO: 7566513 - DNA, 21 bp, Homo sapiens
agctgtggttttacatctttt

SEQ ID NO: 7566514 - DNA, 22 bp, Homo sapiens
agctgtggttctgggcagcgac

SEQ ID NO: 7566515 - DNA, 22 bp, Homo sapiens
agctgtggttctgggcagcgac

SEQ ID NO: 7566516 - DNA, 22 bp, Homo sapiens
agctgtggttctgggcagcgac

SEQ ID NO: 7566517 - DNA, 22 bp, Homo sapiens
agctgtggtgttttcaagccct

SEQ ID NO: 7566518 - DNA, 22 bp, Homo sapiens
agctgtggtgttttcaagccct

SEQ ID NO: 7566519 - DNA, 22 bp, Homo sapiens
agctgtggtgttttcaagccct

SEQ ID NO: 7566520 - DNA, 22 bp, Homo sapiens
agctgtggtcttcaagttgcct

SEQ ID NO: 7566521 - DNA, 22 bp, Homo sapiens
agctgtggttagatagagtcct

SEQ ID NO: 7566522 - DNA, 22 bp, Homo sapiens
agctgtggttagatagagtcct

SEQ ID NO: 7566523 - DNA, 22 bp, Homo sapiens
agctgtggttagatagagtcct

SEQ ID NO: 7566524 - DNA, 22 bp, Homo sapiens
agctgtggttagatagagtcct

SEQ ID NO: 7566525 - DNA, 22 bp, Homo sapiens
agctgtggtgttttcaagccct

SEQ ID NO: 7566526 - DNA, 22 bp, Homo sapiens
agctgtggtgttttcaagccct

SEQ ID NO: 7566527 - DNA, 19 bp, Homo sapiens
agctgtggggcctagcacc

SEQ ID NO: 7566528 - DNA, 19 bp, Homo sapiens
agctgtggggcctagcacc

SEQ ID NO: 7566529 - DNA, 22 bp, Homo sapiens
agctgtggggcaggcagcgagg

SEQ ID NO: 7566530 - DNA, 19 bp, Homo sapiens
agctgtggggcctagcacc

SEQ ID NO: 7566531 - DNA, 19 bp, Homo sapiens
agctgtggggcctagcacc

SEQ ID NO: 7566532 - DNA, 19 bp, Homo sapiens
agctgtggggcctagcacc

SEQ ID NO: 7566533 - DNA, 19 bp, Homo sapiens
agctgtggggcctagcacc

SEQ ID NO: 7566534 - DNA, 22 bp, Homo sapiens
agctgtggtacttgattcacaa

SEQ ID NO: 7566535 - DNA, 22 bp, Homo sapiens
agctgtggtacttgattcacaa

SEQ ID NO: 7566536 - DNA, 22 bp, Homo sapiens
agctgtggggcaggcagcgagg

SEQ ID NO: 7566537 - DNA, 22 bp, Homo sapiens
agctgtggggcaggcagcgagg

SEQ ID NO: 7566538 - DNA, 22 bp, Homo sapiens
agctgtggggcaggcagcgagg

SEQ ID NO: 7566539 - DNA, 22 bp, Homo sapiens
agctgtggggaggaggctagca

SEQ ID NO: 7566540 - DNA, 22 bp, Homo sapiens
agctgtggggaggaggctagca

SEQ ID NO: 7566541 - DNA, 22 bp, Homo sapiens
agctgtggggaggaggctagca

SEQ ID NO: 7566542 - DNA, 22 bp, Homo sapiens
agctgtgggcctgggagagctg

SEQ ID NO: 7566543 - DNA, 22 bp, Homo sapiens
agctgtgggcctgggagagctg

SEQ ID NO: 7566544 - DNA, 22 bp, Homo sapiens
agctgggcaaaatgtgaggttg

SEQ ID NO: 7566545 - DNA, 22 bp, Homo sapiens
agctgggcaaaatgtgaggttg

SEQ ID NO: 7566546 - DNA, 22 bp, Homo sapiens
agctgggcaaaatgtgaggttg

SEQ ID NO: 7566547 - DNA, 22 bp, Homo sapiens
agctgggcaaaatgtgaggttg

SEQ ID NO: 7566548 - DNA, 23 bp, Homo sapiens
agctgggcaaggatccgggctcc

SEQ ID NO: 7566549 - DNA, 23 bp, Homo sapiens
agctgggcaaggatccgggctcc

SEQ ID NO: 7566550 - DNA, 22 bp, Homo sapiens
agctggttaagggtggagttaa

SEQ ID NO: 7566551 - DNA, 20 bp, Homo sapiens
agctggttatcttaattctt

SEQ ID NO: 7566552 - DNA, 22 bp, Homo sapiens
agctggttagcaatctaagtga

SEQ ID NO: 7566553 - DNA, 22 bp, Homo sapiens
agctggttcactaagcataata

SEQ ID NO: 7566554 - DNA, 22 bp, Homo sapiens
agctggttcactaagcataata

SEQ ID NO: 7566555 - DNA, 22 bp, Homo sapiens
agctgggatgataacctcagtc

SEQ ID NO: 7566556 - DNA, 22 bp, Homo sapiens
agctgggatgataacctcagtc

SEQ ID NO: 7566557 - DNA, 22 bp, Homo sapiens
agctgggatgaggagcatcctt

SEQ ID NO: 7566558 - DNA, 22 bp, Homo sapiens
agctgggcaaaatgtgaggttg

SEQ ID NO: 7566559 - DNA, 22 bp, Homo sapiens
agctgggatgataacctcagtc

SEQ ID NO: 7566560 - DNA, 22 bp, Homo sapiens
agctgtgggcctgggagagctg

SEQ ID NO: 7566561 - DNA, 22 bp, Homo sapiens
agctgtgggcctgggagagctg

SEQ ID NO: 7566562 - DNA, 22 bp, Homo sapiens
agctgtgggatttgggtgtgcc

SEQ ID NO: 7566563 - DNA, 22 bp, Homo sapiens
agctgtgggatttgggtgtgcc

SEQ ID NO: 7566564 - DNA, 22 bp, Homo sapiens
agctgtgggcctgggagagctg

SEQ ID NO: 7566565 - DNA, 22 bp, Homo sapiens
agctgtgggagaatctctgggt

SEQ ID NO: 7566566 - DNA, 22 bp, Homo sapiens
agctgtgggagaatctctgggt

SEQ ID NO: 7566567 - DNA, 22 bp, Homo sapiens
agctgtgggatttgggtgtgcc

SEQ ID NO: 7566568 - DNA, 22 bp, Homo sapiens
agctgtgggatttgggtgtgcc

SEQ ID NO: 7566569 - DNA, 22 bp, Homo sapiens
agctgtgggagaatctctgggt

SEQ ID NO: 7566570 - DNA, 22 bp, Homo sapiens
agctgtgggagaatctctgggt

SEQ ID NO: 7566571 - DNA, 21 bp, Homo sapiens
agctgtggcgaggggaacatg

SEQ ID NO: 7566572 - DNA, 22 bp, Homo sapiens
agctggttcagtttctgggcct

SEQ ID NO: 7566573 - DNA, 22 bp, Homo sapiens
agctggttcagaaattagatgg

SEQ ID NO: 7566574 - DNA, 22 bp, Homo sapiens
agctggttcactaagcataata

SEQ ID NO: 7566575 - DNA, 22 bp, Homo sapiens
agctgggagctgaaggctgatt

SEQ ID NO: 7566576 - DNA, 22 bp, Homo sapiens
agctgggagctgaaggctgatt

SEQ ID NO: 7566577 - DNA, 22 bp, Homo sapiens
agctgggagctgaaggctgatt

SEQ ID NO: 7566578 - DNA, 22 bp, Homo sapiens
agctgggagctgaaggctgatt

SEQ ID NO: 7566579 - DNA, 22 bp, Homo sapiens
agctgggagctgaaggctgatt

SEQ ID NO: 7566580 - DNA, 22 bp, Homo sapiens
agctgggagctgaaggctgatt

SEQ ID NO: 7566581 - DNA, 22 bp, Homo sapiens
agctgggagctgaaggctgatt

SEQ ID NO: 7566582 - DNA, 22 bp, Homo sapiens
agctgggagctgaaggctgatt

SEQ ID NO: 7566583 - DNA, 22 bp, Homo sapiens
agctgggagctgaaggctgatt

SEQ ID NO: 7566584 - DNA, 22 bp, Homo sapiens
agctgggagcagagccacagcc

SEQ ID NO: 7566585 - DNA, 22 bp, Homo sapiens
agctgggagcagagccacagcc

SEQ ID NO: 7566586 - DNA, 22 bp, Homo sapiens
agctgggagcagagccacagcc

SEQ ID NO: 7566587 - DNA, 22 bp, Homo sapiens
agctgggagcagagccacagcc

SEQ ID NO: 7566588 - DNA, 22 bp, Homo sapiens
agctgggagcagagccacagcc

SEQ ID NO: 7566589 - DNA, 19 bp, Homo sapiens
agctggctcttctttgtct

SEQ ID NO: 7566590 - DNA, 21 bp, Homo sapiens
agctggctctctctggagaga

SEQ ID NO: 7566591 - DNA, 19 bp, Homo sapiens
agctggctcttctttgtct

SEQ ID NO: 7566592 - DNA, 22 bp, Homo sapiens
agctgggaggtgggcagtgaga

SEQ ID NO: 7566593 - DNA, 22 bp, Homo sapiens
agctgggaggtgggcagtgaga

SEQ ID NO: 7566594 - DNA, 22 bp, Homo sapiens
agctgggaggtgggcagtgaga

SEQ ID NO: 7566595 - DNA, 22 bp, Homo sapiens
agctgggaggctcctctgtgac

SEQ ID NO: 7566596 - DNA, 22 bp, Homo sapiens
agctgggaggctcctctgtgac

SEQ ID NO: 7566597 - DNA, 22 bp, Homo sapiens
agctgggaggctcctctgtgac

SEQ ID NO: 7566598 - DNA, 22 bp, Homo sapiens
agctgggaggctcctctgtgac

SEQ ID NO: 7566599 - DNA, 22 bp, Homo sapiens
agctgggaggctcctctgtgac

SEQ ID NO: 7566600 - DNA, 22 bp, Homo sapiens
agctgggaggctcctctgtgac

SEQ ID NO: 7566601 - DNA, 22 bp, Homo sapiens
agctgggatgaggagcatcctt

SEQ ID NO: 7566602 - DNA, 22 bp, Homo sapiens
agctgggaggtgggcagtgaga

SEQ ID NO: 7566603 - DNA, 22 bp, Homo sapiens
agctgggaggtgggcagtgaga

SEQ ID NO: 7566604 - DNA, 22 bp, Homo sapiens
agctgggaggtgggcagtgaga

SEQ ID NO: 7566605 - DNA, 22 bp, Homo sapiens
agctgggaggtgggcagtgaga

SEQ ID NO: 7566606 - DNA, 22 bp, Homo sapiens
agctgggaggtgggcagtgaga

SEQ ID NO: 7566607 - DNA, 22 bp, Homo sapiens
agctgctcattactttctgttg

SEQ ID NO: 7566608 - DNA, 22 bp, Homo sapiens
agctgctgggatacagtagtga

SEQ ID NO: 7566609 - DNA, 22 bp, Homo sapiens
agctgctcattactttctgttg

SEQ ID NO: 7566610 - DNA, 22 bp, Homo sapiens
agctgctcattactttctgttg

SEQ ID NO: 7566611 - DNA, 22 bp, Homo sapiens
agctgctcattactttctgttg

SEQ ID NO: 7566612 - DNA, 22 bp, Homo sapiens
agctgctcaggagagccaggtc

SEQ ID NO: 7566613 - DNA, 22 bp, Homo sapiens
agctgctcagatcccggggaag

SEQ ID NO: 7566614 - DNA, 22 bp, Homo sapiens
agctgcaggcccatgctcagtc

SEQ ID NO: 7566615 - DNA, 22 bp, Homo sapiens
agctgctcaggagagccaggtc

SEQ ID NO: 7566616 - DNA, 22 bp, Homo sapiens
agctgctcaggagagccaggtc

SEQ ID NO: 7566617 - DNA, 22 bp, Homo sapiens
agctgcaggattatggaatgga

SEQ ID NO: 7566618 - DNA, 22 bp, Homo sapiens
agctgcaggagtcgcctaggat

SEQ ID NO: 7566619 - DNA, 22 bp, Homo sapiens
agctgcaggagtcgcctaggat

SEQ ID NO: 7566620 - DNA, 22 bp, Homo sapiens
agctgcaggattatggaatgga

SEQ ID NO: 7566621 - DNA, 22 bp, Homo sapiens
agctgcaggcccatgctcagtc

SEQ ID NO: 7566622 - DNA, 22 bp, Homo sapiens
agctgcaggcccatgctcagtc

SEQ ID NO: 7566623 - DNA, 22 bp, Homo sapiens
agctgcaggattatggaatgga

SEQ ID NO: 7566624 - DNA, 22 bp, Homo sapiens
agctgcaggattatggaatgga

SEQ ID NO: 7566625 - DNA, 22 bp, Homo sapiens
agctgcaggagtcgcctaggat

SEQ ID NO: 7566626 - DNA, 22 bp, Homo sapiens
agctgcaggagtcgcctaggat

SEQ ID NO: 7566627 - DNA, 22 bp, Homo sapiens
agctgcaggaagtagaagcgga

SEQ ID NO: 7566628 - DNA, 22 bp, Homo sapiens
agctgcaggaagtagaagcgga

SEQ ID NO: 7566629 - DNA, 22 bp, Homo sapiens
agctgcagcttcctagtccagc

SEQ ID NO: 7566630 - DNA, 22 bp, Homo sapiens
agctgcaggaagtagaagcgga

SEQ ID NO: 7566631 - DNA, 22 bp, Homo sapiens
agctgcagcttcctagtccagc

SEQ ID NO: 7566632 - DNA, 22 bp, Homo sapiens
agctgcagctacagtgttggtt

SEQ ID NO: 7566633 - DNA, 22 bp, Homo sapiens
agctgcagctacagtgttggtt

SEQ ID NO: 7566634 - DNA, 22 bp, Homo sapiens
agctgcagcgttcatttttcca

SEQ ID NO: 7566635 - DNA, 22 bp, Homo sapiens
agctgcagcgttcatttttcca

SEQ ID NO: 7566636 - DNA, 22 bp, Homo sapiens
agctgcagctgttttctgagtg

SEQ ID NO: 7566637 - DNA, 22 bp, Homo sapiens
agctgcagctgttttctgagtg

SEQ ID NO: 7566638 - DNA, 22 bp, Homo sapiens
agctgcagctgttttctgagtg

SEQ ID NO: 7566639 - DNA, 22 bp, Homo sapiens
agctgcagccctcctgcatggc

SEQ ID NO: 7566640 - DNA, 22 bp, Homo sapiens
agctgcagccctcctgcatggc

SEQ ID NO: 7566641 - DNA, 22 bp, Homo sapiens
agctgcagccctcctgcatggc

SEQ ID NO: 7566642 - DNA, 22 bp, Homo sapiens
acagcccagaaagcctaagggg

SEQ ID NO: 7566643 - DNA, 22 bp, Homo sapiens
acagcccaagtcacctgcagga

SEQ ID NO: 7566644 - DNA, 22 bp, Homo sapiens
acagcccaagtcacctgcagga

SEQ ID NO: 7566645 - DNA, 22 bp, Homo sapiens
agctgcagccctcctgcatggc

SEQ ID NO: 7566646 - DNA, 22 bp, Homo sapiens
agctgcagccctcctgcatggc

SEQ ID NO: 7566647 - DNA, 22 bp, Homo sapiens
agctgcagcctcatgattcggt

SEQ ID NO: 7566648 - DNA, 22 bp, Homo sapiens
agctgcagccgcagctgtggcc

SEQ ID NO: 7566649 - DNA, 22 bp, Homo sapiens
agctgcagccgcagctgtggcc

SEQ ID NO: 7566650 - DNA, 22 bp, Homo sapiens
agctgcagccgcagctgtggcc

SEQ ID NO: 7566651 - DNA, 22 bp, Homo sapiens
agctgcagccgcagctgtggcc

SEQ ID NO: 7566652 - DNA, 22 bp, Homo sapiens
agctgcagccgcagctgtggcc

SEQ ID NO: 7566653 - DNA, 22 bp, Homo sapiens
agctgcagccgcagctgtggcc

SEQ ID NO: 7566654 - DNA, 22 bp, Homo sapiens
acagcccaagtcacctgcagga

SEQ ID NO: 7566655 - DNA, 22 bp, Homo sapiens
acagcccaagtcacctgcagga

SEQ ID NO: 7566656 - DNA, 22 bp, Homo sapiens
acagcccaagtcacctgcagga

SEQ ID NO: 7566657 - DNA, 22 bp, Homo sapiens
acagcccaagtcacctgcagga

SEQ ID NO: 7566658 - DNA, 22 bp, Homo sapiens
acagcccaagtcacctgcagga

SEQ ID NO: 7566659 - DNA, 22 bp, Homo sapiens
acagccatagatgcttatgtaa

SEQ ID NO: 7566660 - DNA, 22 bp, Homo sapiens
acagccatagatgcttatgtaa

SEQ ID NO: 7566661 - DNA, 23 bp, Homo sapiens
acagccagttcacctctccttgg

SEQ ID NO: 7566662 - DNA, 23 bp, Homo sapiens
acagccagttcacctctccttgg

SEQ ID NO: 7566663 - DNA, 23 bp, Homo sapiens
acagccagttcacctctccttgg

SEQ ID NO: 7566664 - DNA, 23 bp, Homo sapiens
acagccagttcacctctccttgg

SEQ ID NO: 7566665 - DNA, 23 bp, Homo sapiens
acagccagttcacctctccttgg

SEQ ID NO: 7566666 - DNA, 23 bp, Homo sapiens
acagccagttcacctctccttgg

SEQ ID NO: 7566667 - DNA, 23 bp, Homo sapiens
acagccagttcacctctccttgg

SEQ ID NO: 7566668 - DNA, 22 bp, Homo sapiens
acagccagtgctccgtgaggac

SEQ ID NO: 7566669 - DNA, 22 bp, Homo sapiens
acagccagtgctccgtgaggac

SEQ ID NO: 7566670 - DNA, 22 bp, Homo sapiens
acagccagtgactggacaagct

SEQ ID NO: 7566671 - DNA, 22 bp, Homo sapiens
acagccagtgctccgtgaggac

SEQ ID NO: 7566672 - DNA, 22 bp, Homo sapiens
acagccagtgctccgtgaggac

SEQ ID NO: 7566673 - DNA, 22 bp, Homo sapiens
acagccagtgctccgtgaggac

SEQ ID NO: 7566674 - DNA, 22 bp, Homo sapiens
acagccagtgactggacaagct

SEQ ID NO: 7566675 - DNA, 22 bp, Homo sapiens
acagccagtgactggacaagct

SEQ ID NO: 7566676 - DNA, 22 bp, Homo sapiens
acagccagtgactgcagaccct

SEQ ID NO: 7566677 - DNA, 22 bp, Homo sapiens
agctccagttacttacctagag

SEQ ID NO: 7566678 - DNA, 22 bp, Homo sapiens
agctccagttacttacctagag

SEQ ID NO: 7566679 - DNA, 22 bp, Homo sapiens
agctccagttacttacctagag

SEQ ID NO: 7566680 - DNA, 22 bp, Homo sapiens
agctccaggtgcaagtcatggt

SEQ ID NO: 7566681 - DNA, 20 bp, Homo sapiens
agctccagtgctgacgcttc

SEQ ID NO: 7566682 - DNA, 20 bp, Homo sapiens
agctccagtgctgacgcttc

SEQ ID NO: 7566683 - DNA, 22 bp, Homo sapiens
agctccaggtgcaagtcatggt

SEQ ID NO: 7566684 - DNA, 20 bp, Homo sapiens
agctccagtgctgacgcttc

SEQ ID NO: 7566685 - DNA, 20 bp, Homo sapiens
agctccagtgctgacgcttc

SEQ ID NO: 7566686 - DNA, 22 bp, Homo sapiens
agctccaggtgcaagtcatggt

SEQ ID NO: 7566687 - DNA, 22 bp, Homo sapiens
agctccaggtgcaagtcatggt

SEQ ID NO: 7566688 - DNA, 22 bp, Homo sapiens
agctccaggtgcaagtcatggt

SEQ ID NO: 7566689 - DNA, 22 bp, Homo sapiens
agctccaggtgcaagtcatggt

SEQ ID NO: 7566690 - DNA, 22 bp, Homo sapiens
agctccaggtgcaagtcatggt

SEQ ID NO: 7566691 - DNA, 22 bp, Homo sapiens
agctccaggtgcaagtcatggt

SEQ ID NO: 7566692 - DNA, 22 bp, Homo sapiens
agctccaggtgcaagtcatggt

SEQ ID NO: 7566693 - DNA, 22 bp, Homo sapiens
agctccaggtgcaagtcatggt

SEQ ID NO: 7566694 - DNA, 22 bp, Homo sapiens
agctccaggtgcaagtcatggt

SEQ ID NO: 7566695 - DNA, 22 bp, Homo sapiens
acagccagaggtggtcctgggt

SEQ ID NO: 7566696 - DNA, 22 bp, Homo sapiens
acagccagaggtggtcctgggt

SEQ ID NO: 7566697 - DNA, 22 bp, Homo sapiens
acagccagaggtggtcctgggt

SEQ ID NO: 7566698 - DNA, 22 bp, Homo sapiens
agctcccagaaggccctgcgcc

SEQ ID NO: 7566699 - DNA, 22 bp, Homo sapiens
agctcccagaaggccctgcgcc

SEQ ID NO: 7566700 - DNA, 22 bp, Homo sapiens
agctcccagaagccagagtcgg

SEQ ID NO: 7566701 - DNA, 22 bp, Homo sapiens
agctcccagaagccagagtcgg

SEQ ID NO: 7566702 - DNA, 22 bp, Homo sapiens
agctcccagaagccagagtcgg

SEQ ID NO: 7566703 - DNA, 22 bp, Homo sapiens
agctcccagaagccagagtcgg

SEQ ID NO: 7566704 - DNA, 22 bp, Homo sapiens
agctccagtttcctgactgagc

SEQ ID NO: 7566705 - DNA, 22 bp, Homo sapiens
agctccagtttcctgactgagc

SEQ ID NO: 7566706 - DNA, 22 bp, Homo sapiens
agctccagtttcctgactgagc

SEQ ID NO: 7566707 - DNA, 22 bp, Homo sapiens
agctccagtttcctgactgagc

SEQ ID NO: 7566708 - DNA, 18 bp, Homo sapiens
agctccatctgtcagcat

SEQ ID NO: 7566709 - DNA, 20 bp, Homo sapiens
agctccatgaagtagtcact

SEQ ID NO: 7566710 - DNA, 20 bp, Homo sapiens
agctccatgaagtagtcact

SEQ ID NO: 7566711 - DNA, 22 bp, Homo sapiens
acagccaggtaaaggcatggca

SEQ ID NO: 7566712 - DNA, 22 bp, Homo sapiens
acagccaggtaaaggcatggca

SEQ ID NO: 7566713 - DNA, 22 bp, Homo sapiens
acagccaggtaaaggcatggca

SEQ ID NO: 7566714 - DNA, 22 bp, Homo sapiens
acagccagggtctcaggaggcg

SEQ ID NO: 7566715 - DNA, 22 bp, Homo sapiens
acagccaggtaaaggcatggca

SEQ ID NO: 7566716 - DNA, 22 bp, Homo sapiens
acagccagtaaggaaagaccca

SEQ ID NO: 7566717 - DNA, 22 bp, Homo sapiens
acagccagtaaggaaagaccca

SEQ ID NO: 7566718 - DNA, 22 bp, Homo sapiens
acagccagtaaggaaagaccca

SEQ ID NO: 7566719 - DNA, 22 bp, Homo sapiens
acagccaggtaaaggcatggca

SEQ ID NO: 7566720 - DNA, 22 bp, Homo sapiens
acagccaggtaaaggcatggca

SEQ ID NO: 7566721 - DNA, 22 bp, Homo sapiens
acagccaggtaaaggcatggca

SEQ ID NO: 7566722 - DNA, 22 bp, Homo sapiens
acagccagaggtggtcctgggt

SEQ ID NO: 7566723 - DNA, 22 bp, Homo sapiens
acagccagaggtggtcctgggt

SEQ ID NO: 7566724 - DNA, 22 bp, Homo sapiens
acagccagaggtggtcctgggt

SEQ ID NO: 7566725 - DNA, 22 bp, Homo sapiens
acagccagggtctcaggaggcg

SEQ ID NO: 7566726 - DNA, 22 bp, Homo sapiens
acagccagggtctcaggaggcg

SEQ ID NO: 7566727 - DNA, 22 bp, Homo sapiens
acagccaggtaaaggcatggca

SEQ ID NO: 7566728 - DNA, 22 bp, Homo sapiens
acagccagtgactgcagaccct

SEQ ID NO: 7566729 - DNA, 22 bp, Homo sapiens
acagccagtgactgcagaccct

SEQ ID NO: 7566730 - DNA, 22 bp, Homo sapiens
acagccagtgactgcagaccct

SEQ ID NO: 7566731 - DNA, 22 bp, Homo sapiens
acagccagtcctcccacagggt

SEQ ID NO: 7566732 - DNA, 22 bp, Homo sapiens
acagccagtcctcccacagggt

SEQ ID NO: 7566733 - DNA, 22 bp, Homo sapiens
acagccagtcctcccacagggt

SEQ ID NO: 7566734 - DNA, 22 bp, Homo sapiens
acagccagtcctcccacagggt

SEQ ID NO: 7566735 - DNA, 22 bp, Homo sapiens
acagccagtcctcccacagggt

SEQ ID NO: 7566736 - DNA, 22 bp, Homo sapiens
acagccagtcctcccacagggt

SEQ ID NO: 7566737 - DNA, 22 bp, Homo sapiens
acagccagtcatctcagcaggg

SEQ ID NO: 7566738 - DNA, 22 bp, Homo sapiens
acagccagtcatctcagcaggg

SEQ ID NO: 7566739 - DNA, 22 bp, Homo sapiens
acagccagtcatctcagcaggg

SEQ ID NO: 7566740 - DNA, 22 bp, Homo sapiens
acagccagtcatctcagcaggg

SEQ ID NO: 7566741 - DNA, 22 bp, Homo sapiens
acagccagtaatctacccctgt

SEQ ID NO: 7566742 - DNA, 22 bp, Homo sapiens
acagccagtaatctacccctgt

SEQ ID NO: 7566743 - DNA, 22 bp, Homo sapiens
acagccagtaaggaaagaccca

SEQ ID NO: 7566744 - DNA, 22 bp, Homo sapiens
acagccagtaatctacccctgt

SEQ ID NO: 7566745 - DNA, 22 bp, Homo sapiens
acagccagtcatctcagcaggg

SEQ ID NO: 7566746 - DNA, 22 bp, Homo sapiens
acagccagtcatctcagcaggg

SEQ ID NO: 7566747 - DNA, 22 bp, Homo sapiens
acagccagtcatctcagcaggg

SEQ ID NO: 7566748 - DNA, 22 bp, Homo sapiens
acagccagtcatctcagcaggg

SEQ ID NO: 7566749 - DNA, 22 bp, Homo sapiens
acagccagtcatctcagcaggg

SEQ ID NO: 7566750 - DNA, 22 bp, Homo sapiens
acagccagtcatctcagcaggg

SEQ ID NO: 7566751 - DNA, 22 bp, Homo sapiens
acagcccagaaagcctaagggg

SEQ ID NO: 7566752 - DNA, 22 bp, Homo sapiens
acagcccagctctttctctgca

SEQ ID NO: 7566753 - DNA, 22 bp, Homo sapiens
acagcccagctctttctctgca

SEQ ID NO: 7566754 - DNA, 22 bp, Homo sapiens
acagcccagaaagcctaagggg

SEQ ID NO: 7566755 - DNA, 22 bp, Homo sapiens
acagcccagctctttctctgca

SEQ ID NO: 7566756 - DNA, 22 bp, Homo sapiens
agctgcttgggaaccatcaatt

SEQ ID NO: 7566757 - DNA, 18 bp, Homo sapiens
agctgcttgcaggccttc

SEQ ID NO: 7566758 - DNA, 22 bp, Homo sapiens
agctgcttgtacatgaccacat

SEQ ID NO: 7566759 - DNA, 21 bp, Homo sapiens
agctgctttcagctcctagag

SEQ ID NO: 7566760 - DNA, 21 bp, Homo sapiens
agctgctttcagctcctagag

SEQ ID NO: 7566761 - DNA, 21 bp, Homo sapiens
agctgctttcagctcctagag

SEQ ID NO: 7566762 - DNA, 22 bp, Homo sapiens
agctgcttattcattgatcgat

SEQ ID NO: 7566763 - DNA, 22 bp, Homo sapiens
agctgcttataagatttgggag

SEQ ID NO: 7566764 - DNA, 22 bp, Homo sapiens
agctgcttagagtcctcaggat

SEQ ID NO: 7566765 - DNA, 22 bp, Homo sapiens
agctgcttagagtctcttctta

SEQ ID NO: 7566766 - DNA, 22 bp, Homo sapiens
agctgcttagagtctcttctta

SEQ ID NO: 7566767 - DNA, 22 bp, Homo sapiens
agctgcttcctctttgatgtca

SEQ ID NO: 7566768 - DNA, 22 bp, Homo sapiens
agctgcttcaaaatgggctcct

SEQ ID NO: 7566769 - DNA, 22 bp, Homo sapiens
agctgcttcaaaatgggctcct

SEQ ID NO: 7566770 - DNA, 22 bp, Homo sapiens
agctgcttcaaaatgggctcct

SEQ ID NO: 7566771 - DNA, 22 bp, Homo sapiens
acagcccgttctctggcacaca

SEQ ID NO: 7566772 - DNA, 22 bp, Homo sapiens
acagcccgtgtcatcagctgct

SEQ ID NO: 7566773 - DNA, 21 bp, Homo sapiens
acagcctccatctcctgggct

SEQ ID NO: 7566774 - DNA, 23 bp, Homo sapiens
acagccccatgcaggtgtgtttg

SEQ ID NO: 7566775 - DNA, 22 bp, Homo sapiens
acagccccccgctcagtttcca

SEQ ID NO: 7566776 - DNA, 22 bp, Homo sapiens
acagccccccgctcagtttcca

SEQ ID NO: 7566777 - DNA, 22 bp, Homo sapiens
acagccccccgctcagtttcca

SEQ ID NO: 7566778 - DNA, 22 bp, Homo sapiens
acagcccaggactccagtgggc

SEQ ID NO: 7566779 - DNA, 22 bp, Homo sapiens
acagccccagcgcggcggggtc

SEQ ID NO: 7566780 - DNA, 22 bp, Homo sapiens
acagccccagcgcggcggggtc

SEQ ID NO: 7566781 - DNA, 23 bp, Homo sapiens
acagccccatgcaggtgtgtttg

SEQ ID NO: 7566782 - DNA, 22 bp, Homo sapiens
acagcccaggactccagtgggc

SEQ ID NO: 7566783 - DNA, 22 bp, Homo sapiens
acagcccagctctttctctgca

SEQ ID NO: 7566784 - DNA, 22 bp, Homo sapiens
acagcccaggactccagtgggc

SEQ ID NO: 7566785 - DNA, 22 bp, Homo sapiens
agctgctgtgtgctcaggcagg

SEQ ID NO: 7566786 - DNA, 22 bp, Homo sapiens
agctgctgtggggctcggcctg

SEQ ID NO: 7566787 - DNA, 22 bp, Homo sapiens
agctgctgtgtgctcaggcagg

SEQ ID NO: 7566788 - DNA, 22 bp, Homo sapiens
agctgctgtgtgctcaggcagg

SEQ ID NO: 7566789 - DNA, 22 bp, Homo sapiens
agctgctgtggggctcggcctg

SEQ ID NO: 7566790 - DNA, 22 bp, Homo sapiens
agctgctgtggggctcggcctg

SEQ ID NO: 7566791 - DNA, 22 bp, Homo sapiens
agctgctgtggggctcggcctg

SEQ ID NO: 7566792 - DNA, 22 bp, Homo sapiens
agctgctgtggccacatctggc

SEQ ID NO: 7566793 - DNA, 21 bp, Homo sapiens
agctgctgtggccagaatcca

SEQ ID NO: 7566794 - DNA, 22 bp, Homo sapiens
agctgctgtttggtgagtcttg

SEQ ID NO: 7566795 - DNA, 22 bp, Homo sapiens
agctgctgtttcttgcacgtat

SEQ ID NO: 7566796 - DNA, 22 bp, Homo sapiens
agctgctgtttggtgagtcttg

SEQ ID NO: 7566797 - DNA, 22 bp, Homo sapiens
agctgctgtttggtgagtcttg

SEQ ID NO: 7566798 - DNA, 22 bp, Homo sapiens
agctgctgtttcttgcacgtat

SEQ ID NO: 7566799 - DNA, 22 bp, Homo sapiens
agctgctgtttcttgcacgtat

SEQ ID NO: 7566800 - DNA, 22 bp, Homo sapiens
agctgctgtttcttgcacgtat

SEQ ID NO: 7566801 - DNA, 22 bp, Homo sapiens
agctgctgtttcttgcacgtat

SEQ ID NO: 7566802 - DNA, 22 bp, Homo sapiens
agctgctggggagggcagacac

SEQ ID NO: 7566803 - DNA, 22 bp, Homo sapiens
agctgctggggagggcagacac

SEQ ID NO: 7566804 - DNA, 22 bp, Homo sapiens
agctgctggggagggcagacac

SEQ ID NO: 7566805 - DNA, 22 bp, Homo sapiens
agctgctggggagggcagacac

SEQ ID NO: 7566806 - DNA, 22 bp, Homo sapiens
agctgctggggagggcagacac

SEQ ID NO: 7566807 - DNA, 23 bp, Homo sapiens
agctgctgggcctgccgtggcct

SEQ ID NO: 7566808 - DNA, 23 bp, Homo sapiens
agctgctgggcctgccgtggcct

SEQ ID NO: 7566809 - DNA, 23 bp, Homo sapiens
agctgctgggcctgccgtggcct

SEQ ID NO: 7566810 - DNA, 22 bp, Homo sapiens
agctgctggtttaagggatggg

SEQ ID NO: 7566811 - DNA, 22 bp, Homo sapiens
agctgctggtttaagggatggg

SEQ ID NO: 7566812 - DNA, 22 bp, Homo sapiens
agctgctggtttaagggatggg

SEQ ID NO: 7566813 - DNA, 22 bp, Homo sapiens
agctgctggtttaagggatggg

SEQ ID NO: 7566814 - DNA, 22 bp, Homo sapiens
agctgctgtcctaggcactgta

SEQ ID NO: 7566815 - DNA, 22 bp, Homo sapiens
agctgctgtcctaggcactgta

SEQ ID NO: 7566816 - DNA, 22 bp, Homo sapiens
agctgctgtcctaggcactgta

SEQ ID NO: 7566817 - DNA, 22 bp, Homo sapiens
agctgctgtggccacatctggc

SEQ ID NO: 7566818 - DNA, 22 bp, Homo sapiens
agctgctgtggccacatctggc

SEQ ID NO: 7566819 - DNA, 22 bp, Homo sapiens
agctgctgtggccacatctggc

SEQ ID NO: 7566820 - DNA, 22 bp, Homo sapiens
agctgctgtcctaggcactgta

SEQ ID NO: 7566821 - DNA, 22 bp, Homo sapiens
agctgctgtcctaggcactgta

SEQ ID NO: 7566822 - DNA, 22 bp, Homo sapiens
agctgctgtcctaggcactgta

SEQ ID NO: 7566823 - DNA, 22 bp, Homo sapiens
acagcctgcagccccaggtcgc

SEQ ID NO: 7566824 - DNA, 22 bp, Homo sapiens
acagcctgatttatggagcagt

SEQ ID NO: 7566825 - DNA, 22 bp, Homo sapiens
acagcctgatttatggagcagt

SEQ ID NO: 7566826 - DNA, 22 bp, Homo sapiens
acagcctgcagccccaggtcgc

SEQ ID NO: 7566827 - DNA, 22 bp, Homo sapiens
acagcctgcagccccaggtcgc

SEQ ID NO: 7566828 - DNA, 22 bp, Homo sapiens
acagcctgcagccccaggtcgc

SEQ ID NO: 7566829 - DNA, 22 bp, Homo sapiens
acagcctgatttatggagcagt

SEQ ID NO: 7566830 - DNA, 22 bp, Homo sapiens
acagcctgagagtggagctggc

SEQ ID NO: 7566831 - DNA, 22 bp, Homo sapiens
acagcctgatttatggagcagt

SEQ ID NO: 7566832 - DNA, 22 bp, Homo sapiens
acagcctgatttatggagcagt

SEQ ID NO: 7566833 - DNA, 21 bp, Homo sapiens
acagcctccatctcctgggct

SEQ ID NO: 7566834 - DNA, 22 bp, Homo sapiens
acagcctgatttatggagcagt

SEQ ID NO: 7566835 - DNA, 22 bp, Homo sapiens
acagcctgacttttgttgtcac

SEQ ID NO: 7566836 - DNA, 22 bp, Homo sapiens
acagcctgacttttgttgtcac

SEQ ID NO: 7566837 - DNA, 22 bp, Homo sapiens
acagcctgacttttgttgtcac

SEQ ID NO: 7566838 - DNA, 22 bp, Homo sapiens
acagcctgacttttgttgtcac

SEQ ID NO: 7566839 - DNA, 22 bp, Homo sapiens
acagcctgacttttgttgtcac

SEQ ID NO: 7566840 - DNA, 22 bp, Homo sapiens
acagcctgagagtggagctggc

SEQ ID NO: 7566841 - DNA, 22 bp, Homo sapiens
acagcctgacttttgttgtcac

SEQ ID NO: 7566842 - DNA, 22 bp, Homo sapiens
acagcctgagagtggagctggc

SEQ ID NO: 7566843 - DNA, 22 bp, Homo sapiens
acagcctgagagtggagctggc

SEQ ID NO: 7566844 - DNA, 22 bp, Homo sapiens
acagcctgcagccccaggtcgc

SEQ ID NO: 7566845 - DNA, 22 bp, Homo sapiens
agctggcagctctcaggggtac

SEQ ID NO: 7566846 - DNA, 22 bp, Homo sapiens
acagcctgcagccccaggtcgc

SEQ ID NO: 7566847 - DNA, 22 bp, Homo sapiens
agctggcaggggttcacactgc

SEQ ID NO: 7566848 - DNA, 19 bp, Homo sapiens
agctggcagcttccacttc

SEQ ID NO: 7566849 - DNA, 19 bp, Homo sapiens
agctggcagcttccacttc

SEQ ID NO: 7566850 - DNA, 19 bp, Homo sapiens
agctggcagcttccacttc

SEQ ID NO: 7566851 - DNA, 20 bp, Homo sapiens
agctggcctgtcctaggcct

SEQ ID NO: 7566852 - DNA, 22 bp, Homo sapiens
agctggcaggggttcacactgc

SEQ ID NO: 7566853 - DNA, 20 bp, Homo sapiens
agctggcctgtcctaggcct

SEQ ID NO: 7566854 - DNA, 20 bp, Homo sapiens
agctggcctgtcctaggcct

SEQ ID NO: 7566855 - DNA, 22 bp, Homo sapiens
agctggcctgttagagctgagt

SEQ ID NO: 7566856 - DNA, 22 bp, Homo sapiens
agctggcctgttagagctgagt

SEQ ID NO: 7566857 - DNA, 22 bp, Homo sapiens
agctggcctgttagagctgagt

SEQ ID NO: 7566858 - DNA, 22 bp, Homo sapiens
agctggctatacttgaaaagtc

SEQ ID NO: 7566859 - DNA, 22 bp, Homo sapiens
agctggctatacttgaaaagtc

SEQ ID NO: 7566860 - DNA, 22 bp, Homo sapiens
agctggctatacttgaaaagtc

SEQ ID NO: 7566861 - DNA, 21 bp, Homo sapiens
agctggctatagttagtgatg

SEQ ID NO: 7566862 - DNA, 22 bp, Homo sapiens
agctggccttagtgagcacctg

SEQ ID NO: 7566863 - DNA, 22 bp, Homo sapiens
agctggcctgttagagctgagt

SEQ ID NO: 7566864 - DNA, 22 bp, Homo sapiens
agctggccttcggtgtcactgg

SEQ ID NO: 7566865 - DNA, 22 bp, Homo sapiens
agctggccttcggtgtcactgg

SEQ ID NO: 7566866 - DNA, 21 bp, Homo sapiens
agctggctctctctggagaga

SEQ ID NO: 7566867 - DNA, 22 bp, Homo sapiens
agctggctcagccgggtggtct

SEQ ID NO: 7566868 - DNA, 21 bp, Homo sapiens
agctggctctctctggagaga

SEQ ID NO: 7566869 - DNA, 21 bp, Homo sapiens
agctggctctctctggagaga

SEQ ID NO: 7566870 - DNA, 21 bp, Homo sapiens
agctggctctctctggagaga

SEQ ID NO: 7566871 - DNA, 22 bp, Homo sapiens
agctggctcagccgggtggtct

SEQ ID NO: 7566872 - DNA, 21 bp, Homo sapiens
agctggctctctctggagaga

SEQ ID NO: 7566873 - DNA, 21 bp, Homo sapiens
agctggctctctctggagaga

SEQ ID NO: 7566874 - DNA, 21 bp, Homo sapiens
agctggctctctctggagaga

SEQ ID NO: 7566875 - DNA, 21 bp, Homo sapiens
agctggctctctctggagaga

SEQ ID NO: 7566876 - DNA, 21 bp, Homo sapiens
agctggctatagttagtgatg

SEQ ID NO: 7566877 - DNA, 22 bp, Homo sapiens
agctggctatgccctgtgaacc

SEQ ID NO: 7566878 - DNA, 22 bp, Homo sapiens
agctggctatgccctgtgaacc

SEQ ID NO: 7566879 - DNA, 21 bp, Homo sapiens
agctggctatagttagtgatg

SEQ ID NO: 7566880 - DNA, 22 bp, Homo sapiens
agctggctatgccctgtgaacc

SEQ ID NO: 7566881 - DNA, 22 bp, Homo sapiens
agctggctatgccctgtgaacc

SEQ ID NO: 7566882 - DNA, 22 bp, Homo sapiens
agctggctcagccgggtggtct

SEQ ID NO: 7566883 - DNA, 22 bp, Homo sapiens
agctggctatgccctgtgaacc

SEQ ID NO: 7566884 - DNA, 22 bp, Homo sapiens
acataacaatcataggacatag

SEQ ID NO: 7566885 - DNA, 22 bp, Homo sapiens
acatacacaagcgtacatgaac

SEQ ID NO: 7566886 - DNA, 22 bp, Homo sapiens
acatacacaagcgtacatgaac

SEQ ID NO: 7566887 - DNA, 22 bp, Homo sapiens
acatacacaagcgtacatgaac

SEQ ID NO: 7566888 - DNA, 22 bp, Homo sapiens
acatacacaagcgtacatgaac

SEQ ID NO: 7566889 - DNA, 22 bp, Homo sapiens
acatacacacatactttctcct

SEQ ID NO: 7566890 - DNA, 22 bp, Homo sapiens
acatacacatgaatatattttt

SEQ ID NO: 7566891 - DNA, 22 bp, Homo sapiens
acatacacatgaatatattttt

SEQ ID NO: 7566892 - DNA, 22 bp, Homo sapiens
acatacacatgaatatattttt

SEQ ID NO: 7566893 - DNA, 22 bp, Homo sapiens
acatacacatgaatatattttt

SEQ ID NO: 7566894 - DNA, 22 bp, Homo sapiens
acatacacatgaatatattttt

SEQ ID NO: 7566895 - DNA, 22 bp, Homo sapiens
acatacacatgaatatattttt

SEQ ID NO: 7566896 - DNA, 22 bp, Homo sapiens
acatacacatgaatatattttt

SEQ ID NO: 7566897 - DNA, 22 bp, Homo sapiens
acatacacacatactttctcct

SEQ ID NO: 7566898 - DNA, 22 bp, Homo sapiens
acatacacacatactttctcct

SEQ ID NO: 7566899 - DNA, 22 bp, Homo sapiens
acatacacaagcgtacatgaac

SEQ ID NO: 7566900 - DNA, 22 bp, Homo sapiens
acatacacacatactttctcct

SEQ ID NO: 7566901 - DNA, 22 bp, Homo sapiens
acatacacacatactttctcct

SEQ ID NO: 7566902 - DNA, 22 bp, Homo sapiens
acatacacaagcgtacatgaac

SEQ ID NO: 7566903 - DNA, 22 bp, Homo sapiens
acatacacgggaaacctctttt

SEQ ID NO: 7566904 - DNA, 22 bp, Homo sapiens
acatacacgggaaacctctttt

SEQ ID NO: 7566905 - DNA, 22 bp, Homo sapiens
acatacacgggaaacctctttt

SEQ ID NO: 7566906 - DNA, 22 bp, Homo sapiens
acatacacgggaaacctctttt

SEQ ID NO: 7566907 - DNA, 22 bp, Homo sapiens
acatacacgggaaacctctttt

SEQ ID NO: 7566908 - DNA, 22 bp, Homo sapiens
acatacacgggaaacctctttt

SEQ ID NO: 7566909 - DNA, 17 bp, Homo sapiens
acatacactggtgaaca

SEQ ID NO: 7566910 - DNA, 17 bp, Homo sapiens
acatacactggtgaaca

SEQ ID NO: 7566911 - DNA, 23 bp, Homo sapiens
acatacataagcaccacattttg

SEQ ID NO: 7566912 - DNA, 23 bp, Homo sapiens
acatacataagcaccacattttg

SEQ ID NO: 7566913 - DNA, 17 bp, Homo sapiens
acatacactggtgaaca

SEQ ID NO: 7566914 - DNA, 23 bp, Homo sapiens
acatacataagcaccacattttg

SEQ ID NO: 7566915 - DNA, 23 bp, Homo sapiens
acatacataagcaccacattttg

SEQ ID NO: 7566916 - DNA, 23 bp, Homo sapiens
acatacataagcaccacattttg

SEQ ID NO: 7566917 - DNA, 23 bp, Homo sapiens
acatacataagcaccacattttg

SEQ ID NO: 7566918 - DNA, 22 bp, Homo sapiens
acatacagacctgcagggcagc

SEQ ID NO: 7566919 - DNA, 23 bp, Homo sapiens
acatacataagcaccacattttg

SEQ ID NO: 7566920 - DNA, 23 bp, Homo sapiens
acatacataagcaccacattttg

SEQ ID NO: 7566921 - DNA, 23 bp, Homo sapiens
acatacataagcaccacattttg

SEQ ID NO: 7566922 - DNA, 23 bp, Homo sapiens
acatacataagcaccacattttg

SEQ ID NO: 7566923 - DNA, 22 bp, Homo sapiens
acatacatcaagtatcacaaga

SEQ ID NO: 7566924 - DNA, 22 bp, Homo sapiens
acatacatcaagtatcacaaga

SEQ ID NO: 7566925 - DNA, 22 bp, Homo sapiens
acatacatcaagtatcacaaga

SEQ ID NO: 7566926 - DNA, 22 bp, Homo sapiens
acatacatcaagtatcacaaga

SEQ ID NO: 7566927 - DNA, 22 bp, Homo sapiens
acatacatcaagtatcacaaga

SEQ ID NO: 7566928 - DNA, 22 bp, Homo sapiens
acatacatcaagtatcacaaga

SEQ ID NO: 7566929 - DNA, 22 bp, Homo sapiens
acatacatcaagtatcacaaga

SEQ ID NO: 7566930 - DNA, 22 bp, Homo sapiens
acatacatcaagtatcacaaga

SEQ ID NO: 7566931 - DNA, 23 bp, Homo sapiens
acatacatggagataaagtgatg

SEQ ID NO: 7566932 - DNA, 23 bp, Homo sapiens
acatacatggagataaagtgatg

SEQ ID NO: 7566933 - DNA, 23 bp, Homo sapiens
acatacatggagataaagtgatg

SEQ ID NO: 7566934 - DNA, 23 bp, Homo sapiens
acatacatggagataaagtgatg

SEQ ID NO: 7566935 - DNA, 23 bp, Homo sapiens
acatacatggagataaagtgatg

SEQ ID NO: 7566936 - DNA, 23 bp, Homo sapiens
acatacatggagataaagtgatg

SEQ ID NO: 7566937 - DNA, 23 bp, Homo sapiens
acatacatggagataaagtgatg

SEQ ID NO: 7566938 - DNA, 23 bp, Homo sapiens
acatacatggagataaagtgatg

SEQ ID NO: 7566939 - DNA, 23 bp, Homo sapiens
acatacatggagataaagtgatg

SEQ ID NO: 7566940 - DNA, 22 bp, Homo sapiens
acatacatatgtttaaatgcat

SEQ ID NO: 7566941 - DNA, 22 bp, Homo sapiens
acatacatatgtttaaatgcat

SEQ ID NO: 7566942 - DNA, 22 bp, Homo sapiens
acatacatatgtttaaatgcat

SEQ ID NO: 7566943 - DNA, 22 bp, Homo sapiens
acatacatatgtttaaatgcat

SEQ ID NO: 7566944 - DNA, 22 bp, Homo sapiens
acatacatatgtttaaatgcat

SEQ ID NO: 7566945 - DNA, 22 bp, Homo sapiens
acatacatcaagtatcacaaga

SEQ ID NO: 7566946 - DNA, 22 bp, Homo sapiens
acatacatcaagtatcacaaga

SEQ ID NO: 7566947 - DNA, 22 bp, Homo sapiens
acatacatcaagtatcacaaga

SEQ ID NO: 7566948 - DNA, 22 bp, Homo sapiens
acatacatcaagtatcacaaga

SEQ ID NO: 7566949 - DNA, 22 bp, Homo sapiens
acatacatcaagtatcacaaga

SEQ ID NO: 7566950 - DNA, 22 bp, Homo sapiens
acatacatcaagtatcacaaga

SEQ ID NO: 7566951 - DNA, 22 bp, Homo sapiens
acatacatatgtttaaatgcat

SEQ ID NO: 7566952 - DNA, 22 bp, Homo sapiens
acatacatatgacaactttcct

SEQ ID NO: 7566953 - DNA, 22 bp, Homo sapiens
acatacatatgacaactttcct

SEQ ID NO: 7566954 - DNA, 22 bp, Homo sapiens
acatacatatgacaactttcct

SEQ ID NO: 7566955 - DNA, 22 bp, Homo sapiens
acatacatatgacaactttcct

SEQ ID NO: 7566956 - DNA, 22 bp, Homo sapiens
acatacatatgacaactttcct

SEQ ID NO: 7566957 - DNA, 22 bp, Homo sapiens
acatacatatgacaactttcct

SEQ ID NO: 7566958 - DNA, 21 bp, Homo sapiens
acatacataccttaccacctt

SEQ ID NO: 7566959 - DNA, 21 bp, Homo sapiens
acatacataccttaccacctt

SEQ ID NO: 7566960 - DNA, 23 bp, Homo sapiens
acatacataagcaccacattttg

SEQ ID NO: 7566961 - DNA, 21 bp, Homo sapiens
acatacataccttaccacctt

SEQ ID NO: 7566962 - DNA, 21 bp, Homo sapiens
acatacataccttaccacctt

SEQ ID NO: 7566963 - DNA, 22 bp, Homo sapiens
aggcaacatgactcacttgcac

SEQ ID NO: 7566964 - DNA, 22 bp, Homo sapiens
aggcaacatgactcacttgcac

SEQ ID NO: 7566965 - DNA, 22 bp, Homo sapiens
aggcaacataacacgaaagtct

SEQ ID NO: 7566966 - DNA, 22 bp, Homo sapiens
aggcaacataacacgaaagtct

SEQ ID NO: 7566967 - DNA, 22 bp, Homo sapiens
aggcaacatgggccaggcagaa

SEQ ID NO: 7566968 - DNA, 22 bp, Homo sapiens
aggcaacatgggccaggcagaa

SEQ ID NO: 7566969 - DNA, 22 bp, Homo sapiens
aggcaacatgggccaggcagaa

SEQ ID NO: 7566970 - DNA, 22 bp, Homo sapiens
aggcaacatgggccaggcagaa

SEQ ID NO: 7566971 - DNA, 22 bp, Homo sapiens
aggcaacaggaaaccacatgat

SEQ ID NO: 7566972 - DNA, 22 bp, Homo sapiens
aggcaacaggaaaccacatgat

SEQ ID NO: 7566973 - DNA, 22 bp, Homo sapiens
aggcaacaagggtagtcagtga

SEQ ID NO: 7566974 - DNA, 22 bp, Homo sapiens
aggcaacaagggtagtcagtga

SEQ ID NO: 7566975 - DNA, 22 bp, Homo sapiens
aggcaaattgtgagaaaatgaa

SEQ ID NO: 7566976 - DNA, 22 bp, Homo sapiens
aggcaaattgtgagaaaatgaa

SEQ ID NO: 7566977 - DNA, 22 bp, Homo sapiens
aggcaaattgtgagaaaatgaa

SEQ ID NO: 7566978 - DNA, 22 bp, Homo sapiens
aggcaacaagggtagtcagtga

SEQ ID NO: 7566979 - DNA, 19 bp, Homo sapiens
aggcaaccaatgaggcaaa

SEQ ID NO: 7566980 - DNA, 19 bp, Homo sapiens
aggcaaccaatgaggcaaa

SEQ ID NO: 7566981 - DNA, 19 bp, Homo sapiens
aggcaaccaatgaggcaaa

SEQ ID NO: 7566982 - DNA, 22 bp, Homo sapiens
aggcaaccctggtgagcagatg

SEQ ID NO: 7566983 - DNA, 22 bp, Homo sapiens
aggcaacctacatttttttgaa

SEQ ID NO: 7566984 - DNA, 22 bp, Homo sapiens
aggcacaaagacagaaaagcac

SEQ ID NO: 7566985 - DNA, 22 bp, Homo sapiens
aggcacaagaaactgctcccca

SEQ ID NO: 7566986 - DNA, 17 bp, Homo sapiens
aggcaacctttggtaca

SEQ ID NO: 7566987 - DNA, 22 bp, Homo sapiens
aggcaaccctggtgagcagatg

SEQ ID NO: 7566988 - DNA, 22 bp, Homo sapiens
aggcaactaggcctctgcctca

SEQ ID NO: 7566989 - DNA, 22 bp, Homo sapiens
aggcacaaagacagaaaagcac

SEQ ID NO: 7566990 - DNA, 22 bp, Homo sapiens
aggcacagaatggcattcagtg

SEQ ID NO: 7566991 - DNA, 22 bp, Homo sapiens
aggcacagaatggcattcagtg

SEQ ID NO: 7566992 - DNA, 22 bp, Homo sapiens
aggcacagaatggcattcagtg

SEQ ID NO: 7566993 - DNA, 22 bp, Homo sapiens
aggcacacagaccccagcaagt

SEQ ID NO: 7566994 - DNA, 22 bp, Homo sapiens
aggcacaagaaactgctcccca

SEQ ID NO: 7566995 - DNA, 19 bp, Homo sapiens
aggcacaattctgagaagc

SEQ ID NO: 7566996 - DNA, 19 bp, Homo sapiens
aggcacaattctgagaagc

SEQ ID NO: 7566997 - DNA, 22 bp, Homo sapiens
aggcacagatttggggaaagca

SEQ ID NO: 7566998 - DNA, 22 bp, Homo sapiens
aggcacagatttggggaaagca

SEQ ID NO: 7566999 - DNA, 22 bp, Homo sapiens
aggcacagatttggggaaagca

SEQ ID NO: 7567000 - DNA, 22 bp, Homo sapiens
aggcacagatttggggaaagca

SEQ ID NO: 7567001 - DNA, 22 bp, Homo sapiens
acataaatttcactgttccgtg

SEQ ID NO: 7567002 - DNA, 22 bp, Homo sapiens
aggcacagatttggggaaagca

SEQ ID NO: 7567003 - DNA, 22 bp, Homo sapiens
aggcacagatttggggaaagca

SEQ ID NO: 7567004 - DNA, 22 bp, Homo sapiens
aggcacagatttggggaaagca

SEQ ID NO: 7567005 - DNA, 18 bp, Homo sapiens
aggcacagagcatacata

SEQ ID NO: 7567006 - DNA, 18 bp, Homo sapiens
aggcacagagcatacata

SEQ ID NO: 7567007 - DNA, 18 bp, Homo sapiens
aggcacagagcatacata

SEQ ID NO: 7567008 - DNA, 22 bp, Homo sapiens
aggcacagatttggggaaagca

SEQ ID NO: 7567009 - DNA, 22 bp, Homo sapiens
aggcacagatttggggaaagca

SEQ ID NO: 7567010 - DNA, 22 bp, Homo sapiens
aggcacagatttggggaaagca

SEQ ID NO: 7567011 - DNA, 22 bp, Homo sapiens
aggcacagatttggggaaagca

SEQ ID NO: 7567012 - DNA, 22 bp, Homo sapiens
aggcacagatttggggaaagca

SEQ ID NO: 7567013 - DNA, 22 bp, Homo sapiens
aggcacagatttggggaaagca

SEQ ID NO: 7567014 - DNA, 18 bp, Homo sapiens
aggcacagagcatacata

SEQ ID NO: 7567015 - DNA, 18 bp, Homo sapiens
aggcacagagcatacata

SEQ ID NO: 7567016 - DNA, 22 bp, Homo sapiens
aggcacagagaatgccctccat

SEQ ID NO: 7567017 - DNA, 22 bp, Homo sapiens
aggcacagagaatgccctccat

SEQ ID NO: 7567018 - DNA, 22 bp, Homo sapiens
aggcacagagaagtaaagtatc

SEQ ID NO: 7567019 - DNA, 22 bp, Homo sapiens
aggcacagaatggcattcagtg

SEQ ID NO: 7567020 - DNA, 22 bp, Homo sapiens
aggcacagagaagtaaagtatc

SEQ ID NO: 7567021 - DNA, 22 bp, Homo sapiens
aggcacagaatggcattcagtg

SEQ ID NO: 7567022 - DNA, 22 bp, Homo sapiens
aggcacagaatggcattcagtg

SEQ ID NO: 7567023 - DNA, 22 bp, Homo sapiens
aggcacagaatggcattcagtg

SEQ ID NO: 7567024 - DNA, 22 bp, Homo sapiens
aggcacagaatggcattcagtg

SEQ ID NO: 7567025 - DNA, 22 bp, Homo sapiens
aggcacagaatggcattcagtg

SEQ ID NO: 7567026 - DNA, 22 bp, Homo sapiens
aggcacagaatggcattcagtg

SEQ ID NO: 7567027 - DNA, 22 bp, Homo sapiens
aggcacagagaggttaaatgca

SEQ ID NO: 7567028 - DNA, 22 bp, Homo sapiens
aggcacagagaatgccctccat

SEQ ID NO: 7567029 - DNA, 22 bp, Homo sapiens
aggcacagagaatgccctccat

SEQ ID NO: 7567030 - DNA, 22 bp, Homo sapiens
aggcacagagaatgccctccat

SEQ ID NO: 7567031 - DNA, 18 bp, Homo sapiens
aggcacagagcatacata

SEQ ID NO: 7567032 - DNA, 18 bp, Homo sapiens
aggcacagagcatacata

SEQ ID NO: 7567033 - DNA, 18 bp, Homo sapiens
aggcacagagcatacata

SEQ ID NO: 7567034 - DNA, 22 bp, Homo sapiens
aggcaaagaagttggtcaggag

SEQ ID NO: 7567035 - DNA, 22 bp, Homo sapiens
aggcaaagagccagcaaatctg

SEQ ID NO: 7567036 - DNA, 22 bp, Homo sapiens
aggcaaagaggatattttgggg

SEQ ID NO: 7567037 - DNA, 22 bp, Homo sapiens
aggcaaagcgataccagagcta

SEQ ID NO: 7567038 - DNA, 22 bp, Homo sapiens
aggcaaagcgataccagagcta

SEQ ID NO: 7567039 - DNA, 22 bp, Homo sapiens
aggcaaattattgtatgcagtt

SEQ ID NO: 7567040 - DNA, 22 bp, Homo sapiens
aggcaaattattgtatgcagtt

SEQ ID NO: 7567041 - DNA, 22 bp, Homo sapiens
aggcaaattattgtatgcagtt

SEQ ID NO: 7567042 - DNA, 22 bp, Homo sapiens
aggcaaattattgtatgcagtt

SEQ ID NO: 7567043 - DNA, 22 bp, Homo sapiens
aggcaaattattgtatgcagtt

SEQ ID NO: 7567044 - DNA, 22 bp, Homo sapiens
aggcaaattattgtatgcagtt

SEQ ID NO: 7567045 - DNA, 22 bp, Homo sapiens
aggcaaatctcagttggcctct

SEQ ID NO: 7567046 - DNA, 22 bp, Homo sapiens
aggcaaatctcagttggcctct

SEQ ID NO: 7567047 - DNA, 22 bp, Homo sapiens
aggcaaatctcagttggcctct

SEQ ID NO: 7567048 - DNA, 22 bp, Homo sapiens
aggcaaatctgagacatttaaa

SEQ ID NO: 7567049 - DNA, 22 bp, Homo sapiens
aggcaaatctgagacatttaaa

SEQ ID NO: 7567050 - DNA, 22 bp, Homo sapiens
aggcaaatagatagtccataca

SEQ ID NO: 7567051 - DNA, 22 bp, Homo sapiens
aggcaaatagatagtccataca

SEQ ID NO: 7567052 - DNA, 22 bp, Homo sapiens
aggcaaaagaatgtcataaatg

SEQ ID NO: 7567053 - DNA, 22 bp, Homo sapiens
aggcaaaagaatgtcataaatg

SEQ ID NO: 7567054 - DNA, 22 bp, Homo sapiens
aggcaaaagaatgtcataaatg

SEQ ID NO: 7567055 - DNA, 22 bp, Homo sapiens
aggcaaaagaatgtcataaatg

SEQ ID NO: 7567056 - DNA, 22 bp, Homo sapiens
aggatggcttgcaggaggctgt

SEQ ID NO: 7567057 - DNA, 22 bp, Homo sapiens
aggattttgctttataaaagcc

SEQ ID NO: 7567058 - DNA, 22 bp, Homo sapiens
aggatggcttgcaggaggctgt

SEQ ID NO: 7567059 - DNA, 22 bp, Homo sapiens
aggatggcttgcaggaggctgt

SEQ ID NO: 7567060 - DNA, 21 bp, Homo sapiens
aggattttgttgaagtttctg

SEQ ID NO: 7567061 - DNA, 22 bp, Homo sapiens
aggatggcgattcgagcacctc

SEQ ID NO: 7567062 - DNA, 22 bp, Homo sapiens
aggatggcgattcgagcacctc

SEQ ID NO: 7567063 - DNA, 22 bp, Homo sapiens
aggatggcgattcgagcacctc

SEQ ID NO: 7567064 - DNA, 22 bp, Homo sapiens
aggcaaagaagttggtcaggag

SEQ ID NO: 7567065 - DNA, 22 bp, Homo sapiens
aggcaaaagaatgtcataaatg

SEQ ID NO: 7567066 - DNA, 22 bp, Homo sapiens
aggcaaaataagcctctcctgt

SEQ ID NO: 7567067 - DNA, 23 bp, Homo sapiens
aggcaaacctataaaataggaat

SEQ ID NO: 7567068 - DNA, 22 bp, Homo sapiens
aggcaaaattacaaagttatta

SEQ ID NO: 7567069 - DNA, 22 bp, Homo sapiens
aggcaaaattacaaagttatta

SEQ ID NO: 7567070 - DNA, 22 bp, Homo sapiens
aggaggggttctcgggtgctga

SEQ ID NO: 7567071 - DNA, 22 bp, Homo sapiens
aggaggggttctcgggtgctga

SEQ ID NO: 7567072 - DNA, 22 bp, Homo sapiens
aggaggggttctcgggtgctga

SEQ ID NO: 7567073 - DNA, 22 bp, Homo sapiens
aggaggggttctcgggtgctga

SEQ ID NO: 7567074 - DNA, 22 bp, Homo sapiens
aggaggggttctcgggtgctga

SEQ ID NO: 7567075 - DNA, 22 bp, Homo sapiens
aggaggggttctcgggtgctga

SEQ ID NO: 7567076 - DNA, 22 bp, Homo sapiens
aggaggggttctcgggtgctga

SEQ ID NO: 7567077 - DNA, 22 bp, Homo sapiens
aggaggggttctcgggtgctga

SEQ ID NO: 7567078 - DNA, 22 bp, Homo sapiens
aggaggggttctcgggtgctga

SEQ ID NO: 7567079 - DNA, 22 bp, Homo sapiens
aggaggggttctcgggtgctga

SEQ ID NO: 7567080 - DNA, 21 bp, Homo sapiens
aggaggggtctttcccactga

SEQ ID NO: 7567081 - DNA, 22 bp, Homo sapiens
aggaggggttctcgggtgctga

SEQ ID NO: 7567082 - DNA, 21 bp, Homo sapiens
aggaggggtctttcccactga

SEQ ID NO: 7567083 - DNA, 21 bp, Homo sapiens
aggaggggtctttcccactga

SEQ ID NO: 7567084 - DNA, 21 bp, Homo sapiens
aggaggggtctttcccactga

SEQ ID NO: 7567085 - DNA, 21 bp, Homo sapiens
aggaggggtctttcccactga

SEQ ID NO: 7567086 - DNA, 22 bp, Homo sapiens
aggagggtacaatgggtggaaa

SEQ ID NO: 7567087 - DNA, 22 bp, Homo sapiens
aggagggtacaatgggtggaaa

SEQ ID NO: 7567088 - DNA, 22 bp, Homo sapiens
aggagggtacaatgggtggaaa

SEQ ID NO: 7567089 - DNA, 22 bp, Homo sapiens
aggaggggttctcgggtgctga

SEQ ID NO: 7567090 - DNA, 22 bp, Homo sapiens
aggaggggttctcgggtgctga

SEQ ID NO: 7567091 - DNA, 22 bp, Homo sapiens
aggaggggttctcgggtgctga

SEQ ID NO: 7567092 - DNA, 22 bp, Homo sapiens
aggaggggttctcgggtgctga

SEQ ID NO: 7567093 - DNA, 22 bp, Homo sapiens
aggaggggttctcgggtgctga

SEQ ID NO: 7567094 - DNA, 22 bp, Homo sapiens
aggagggtacaatgggtggaaa

SEQ ID NO: 7567095 - DNA, 22 bp, Homo sapiens
aggagggtacaatgggtggaaa

SEQ ID NO: 7567096 - DNA, 22 bp, Homo sapiens
aggagggtacaatgggtggaaa

SEQ ID NO: 7567097 - DNA, 22 bp, Homo sapiens
aggagggtacaatgggtggaaa

SEQ ID NO: 7567098 - DNA, 22 bp, Homo sapiens
aggagggtcatgttgaagtgta

SEQ ID NO: 7567099 - DNA, 22 bp, Homo sapiens
aggagggtcatgttgaagtgta

SEQ ID NO: 7567100 - DNA, 22 bp, Homo sapiens
aggagggtcatgttgaagtgta

SEQ ID NO: 7567101 - DNA, 20 bp, Homo sapiens
aggatggcaagcaagtgcat

SEQ ID NO: 7567102 - DNA, 20 bp, Homo sapiens
aggatggcaagcaagtgcat

SEQ ID NO: 7567103 - DNA, 20 bp, Homo sapiens
aggatggcaagcaagtgcat

SEQ ID NO: 7567104 - DNA, 20 bp, Homo sapiens
aggatggcaagcaagtgcat

SEQ ID NO: 7567105 - DNA, 22 bp, Homo sapiens
aggagggagatgcccatcctgg

SEQ ID NO: 7567106 - DNA, 20 bp, Homo sapiens
aggagggacctggattggcg

SEQ ID NO: 7567107 - DNA, 22 bp, Homo sapiens
aggagggagatgcccatcctgg

SEQ ID NO: 7567108 - DNA, 22 bp, Homo sapiens
aggagggagatgcccatcctgg

SEQ ID NO: 7567109 - DNA, 22 bp, Homo sapiens
aggagggagatgcccatcctgg

SEQ ID NO: 7567110 - DNA, 20 bp, Homo sapiens
aggagggacctggattggcg

SEQ ID NO: 7567111 - DNA, 20 bp, Homo sapiens
aggagggacctggattggcg

SEQ ID NO: 7567112 - DNA, 20 bp, Homo sapiens
aggagggacctggattggcg

SEQ ID NO: 7567113 - DNA, 20 bp, Homo sapiens
aggagggacctggattggcg

SEQ ID NO: 7567114 - DNA, 20 bp, Homo sapiens
aggagggacctggattggcg

SEQ ID NO: 7567115 - DNA, 20 bp, Homo sapiens
aggagggacctggattggcg

SEQ ID NO: 7567116 - DNA, 22 bp, Homo sapiens
aggagggacctaggaatattgc

SEQ ID NO: 7567117 - DNA, 22 bp, Homo sapiens
aggagggacctaggaatattgc

SEQ ID NO: 7567118 - DNA, 20 bp, Homo sapiens
aggagggacctggattggcg

SEQ ID NO: 7567119 - DNA, 20 bp, Homo sapiens
aggagggacctggattggcg

SEQ ID NO: 7567120 - DNA, 20 bp, Homo sapiens
aggagggacctggattggcg

SEQ ID NO: 7567121 - DNA, 22 bp, Homo sapiens
aggagggacctaggaatattgc

SEQ ID NO: 7567122 - DNA, 22 bp, Homo sapiens
aggagggagcactatatgggga

SEQ ID NO: 7567123 - DNA, 22 bp, Homo sapiens
aggaggggcatagaaatgtaat

SEQ ID NO: 7567124 - DNA, 22 bp, Homo sapiens
aggaggggcatagaaatgtaat

SEQ ID NO: 7567125 - DNA, 22 bp, Homo sapiens
aggaggggcatagaaatgtaat

SEQ ID NO: 7567126 - DNA, 22 bp, Homo sapiens
aggaggggcatagaaatgtaat

SEQ ID NO: 7567127 - DNA, 22 bp, Homo sapiens
aggaggggcatagaaatgtaat

SEQ ID NO: 7567128 - DNA, 22 bp, Homo sapiens
aggaggggcatagaaatgtaat

SEQ ID NO: 7567129 - DNA, 22 bp, Homo sapiens
aggagggagatgcccatcctgg

SEQ ID NO: 7567130 - DNA, 22 bp, Homo sapiens
aggagggagatgcccatcctgg

SEQ ID NO: 7567131 - DNA, 22 bp, Homo sapiens
aggagggagatgcccatcctgg

SEQ ID NO: 7567132 - DNA, 22 bp, Homo sapiens
aggagggagatgcccatcctgg

SEQ ID NO: 7567133 - DNA, 21 bp, Homo sapiens
aggaggggtctttcccactga

SEQ ID NO: 7567134 - DNA, 21 bp, Homo sapiens
aggaggggtctttcccactga

SEQ ID NO: 7567135 - DNA, 21 bp, Homo sapiens
aggaggggtctttcccactga

SEQ ID NO: 7567136 - DNA, 22 bp, Homo sapiens
aggaggggcatagaaatgtaat

SEQ ID NO: 7567137 - DNA, 21 bp, Homo sapiens
aggaggggtctttcccactga

SEQ ID NO: 7567138 - DNA, 22 bp, Homo sapiens
aggaggggcatagaaatgtaat

SEQ ID NO: 7567139 - DNA, 22 bp, Homo sapiens
aggaggggcatagaaatgtaat

SEQ ID NO: 7567140 - DNA, 22 bp, Homo sapiens
aggaggggcatagaaatgtaat

SEQ ID NO: 7567141 - DNA, 22 bp, Homo sapiens
aggagggaataagaaagagtca

SEQ ID NO: 7567142 - DNA, 22 bp, Homo sapiens
aggagggaataagaaagagtca

SEQ ID NO: 7567143 - DNA, 22 bp, Homo sapiens
aggagggaataagaaagagtca

SEQ ID NO: 7567144 - DNA, 17 bp, Homo sapiens
aggagggaaatagcttg

SEQ ID NO: 7567145 - DNA, 22 bp, Homo sapiens
aggagggaataagaaagagtca

SEQ ID NO: 7567146 - DNA, 22 bp, Homo sapiens
aggagggaataagaaagagtca

SEQ ID NO: 7567147 - DNA, 22 bp, Homo sapiens
aggagggacaccaatatatgtt

SEQ ID NO: 7567148 - DNA, 22 bp, Homo sapiens
aggagggaataagaaagagtca

SEQ ID NO: 7567149 - DNA, 22 bp, Homo sapiens
aggagggacaccaatatatgtt

SEQ ID NO: 7567150 - DNA, 22 bp, Homo sapiens
aggagggacaccaatatatgtt

SEQ ID NO: 7567151 - DNA, 22 bp, Homo sapiens
aggagggacaccaatatatgtt

SEQ ID NO: 7567152 - DNA, 22 bp, Homo sapiens
aggagggaataagaaagagtca

SEQ ID NO: 7567153 - DNA, 17 bp, Homo sapiens
aggagggaaatagcttg

SEQ ID NO: 7567154 - DNA, 17 bp, Homo sapiens
aggagggaaatagcttg

SEQ ID NO: 7567155 - DNA, 17 bp, Homo sapiens
aggagggaaatagcttg

SEQ ID NO: 7567156 - DNA, 17 bp, Homo sapiens
aggagggaaatagcttg

SEQ ID NO: 7567157 - DNA, 22 bp, Homo sapiens
aggaggcttttgcaggtgccac

SEQ ID NO: 7567158 - DNA, 17 bp, Homo sapiens
aggagggaaatagcttg

SEQ ID NO: 7567159 - DNA, 17 bp, Homo sapiens
aggagggaaatagcttg

SEQ ID NO: 7567160 - DNA, 17 bp, Homo sapiens
aggagggaaatagcttg

SEQ ID NO: 7567161 - DNA, 17 bp, Homo sapiens
aggagggaaatagcttg

SEQ ID NO: 7567162 - DNA, 22 bp, Homo sapiens
aggaggccgctgatgggctccc

SEQ ID NO: 7567163 - DNA, 22 bp, Homo sapiens
aggaggccgatttcagaggtcg

SEQ ID NO: 7567164 - DNA, 22 bp, Homo sapiens
aggaggccgatttcagaggtcg

SEQ ID NO: 7567165 - DNA, 22 bp, Homo sapiens
aggaggccgatttcagaggtcg

SEQ ID NO: 7567166 - DNA, 22 bp, Homo sapiens
aggaggctgtggagcactccat

SEQ ID NO: 7567167 - DNA, 22 bp, Homo sapiens
aggaggctgtggagcactccat

SEQ ID NO: 7567168 - DNA, 22 bp, Homo sapiens
aggaggccgctgatgggctccc

SEQ ID NO: 7567169 - DNA, 22 bp, Homo sapiens
aggaggccgctgatgggctccc

SEQ ID NO: 7567170 - DNA, 22 bp, Homo sapiens
aggaggctgtggagcactccat

SEQ ID NO: 7567171 - DNA, 22 bp, Homo sapiens
aggaggcttttgcaggtgccac

SEQ ID NO: 7567172 - DNA, 22 bp, Homo sapiens
aggaggctgtggagcactccat

SEQ ID NO: 7567173 - DNA, 22 bp, Homo sapiens
aggaggcttttgcaggtgccac

SEQ ID NO: 7567174 - DNA, 22 bp, Homo sapiens
aggaggcttttgcaggtgccac

SEQ ID NO: 7567175 - DNA, 22 bp, Homo sapiens
aggaggcttttgcaggtgccac

SEQ ID NO: 7567176 - DNA, 22 bp, Homo sapiens
aggaggcttttgcaggtgccac

SEQ ID NO: 7567177 - DNA, 22 bp, Homo sapiens
aggaggcttttgcaggtgccac

SEQ ID NO: 7567178 - DNA, 22 bp, Homo sapiens
aggaggcttttgcaggtgccac

SEQ ID NO: 7567179 - DNA, 22 bp, Homo sapiens
aggagacataactatgatgaga

SEQ ID NO: 7567180 - DNA, 22 bp, Homo sapiens
aggagacatactataggaatat

SEQ ID NO: 7567181 - DNA, 22 bp, Homo sapiens
aggagacatactataggaatat

SEQ ID NO: 7567182 - DNA, 22 bp, Homo sapiens
aggagacatctaactgtaggtt

SEQ ID NO: 7567183 - DNA, 22 bp, Homo sapiens
aggagacatactataggaatat

SEQ ID NO: 7567184 - DNA, 22 bp, Homo sapiens
aggagacatactataggaatat

SEQ ID NO: 7567185 - DNA, 22 bp, Homo sapiens
aggagacatctaactgtaggtt

SEQ ID NO: 7567186 - DNA, 22 bp, Homo sapiens
aggagacatctaactgtaggtt

SEQ ID NO: 7567187 - DNA, 22 bp, Homo sapiens
aggagacatctaactgtaggtt

SEQ ID NO: 7567188 - DNA, 22 bp, Homo sapiens
aggagacatggaatagtgaggc

SEQ ID NO: 7567189 - DNA, 20 bp, Homo sapiens
aggagaccaagccaagtgga

SEQ ID NO: 7567190 - DNA, 22 bp, Homo sapiens
aggagacatggaatagtgaggc

SEQ ID NO: 7567191 - DNA, 22 bp, Homo sapiens
aggagacatggaatagtgaggc

SEQ ID NO: 7567192 - DNA, 22 bp, Homo sapiens
aggagacatggaatagtgaggc

SEQ ID NO: 7567193 - DNA, 22 bp, Homo sapiens
aggagacatggaatagtgaggc

SEQ ID NO: 7567194 - DNA, 22 bp, Homo sapiens
acaggggctccgaaggtgaggg

SEQ ID NO: 7567195 - DNA, 22 bp, Homo sapiens
aggagactcagagacctggccg

SEQ ID NO: 7567196 - DNA, 22 bp, Homo sapiens
acaggggctccgaaggtgaggg

SEQ ID NO: 7567197 - DNA, 22 bp, Homo sapiens
acaggggctccgaaggtgaggg

SEQ ID NO: 7567198 - DNA, 22 bp, Homo sapiens
aggagaccttttgagtgtgaga

SEQ ID NO: 7567199 - DNA, 22 bp, Homo sapiens
aggagaccttttgagtgtgaga

SEQ ID NO: 7567200 - DNA, 22 bp, Homo sapiens
aggagaccttttgagtgtgaga

SEQ ID NO: 7567201 - DNA, 22 bp, Homo sapiens
aggagactcagagacctggccg

SEQ ID NO: 7567202 - DNA, 22 bp, Homo sapiens
aggagacccaatgccagaaaga

SEQ ID NO: 7567203 - DNA, 22 bp, Homo sapiens
aggagacccagaatgttgctgt

SEQ ID NO: 7567204 - DNA, 22 bp, Homo sapiens
aggagacccaatgccagaaaga

SEQ ID NO: 7567205 - DNA, 20 bp, Homo sapiens
aggagaccaagccaagtgga

SEQ ID NO: 7567206 - DNA, 20 bp, Homo sapiens
aggagaccaagccaagtgga

SEQ ID NO: 7567207 - DNA, 21 bp, Homo sapiens
aggagaccggcttgtttgtgc

SEQ ID NO: 7567208 - DNA, 21 bp, Homo sapiens
aggagaccggcttgtttgtgc

SEQ ID NO: 7567209 - DNA, 22 bp, Homo sapiens
aggagaccttcaccacttccac

SEQ ID NO: 7567210 - DNA, 22 bp, Homo sapiens
aggagacccagaatgttgctgt

SEQ ID NO: 7567211 - DNA, 21 bp, Homo sapiens
aggagaccggcttgtttgtgc

SEQ ID NO: 7567212 - DNA, 17 bp, Homo sapiens
aggaagggcaagtttct

SEQ ID NO: 7567213 - DNA, 22 bp, Homo sapiens
aggacttctccgataagtcaga

SEQ ID NO: 7567214 - DNA, 22 bp, Homo sapiens
aggaagggctgtttctccaaga

SEQ ID NO: 7567215 - DNA, 22 bp, Homo sapiens
aggacttcttagatgccttccg

SEQ ID NO: 7567216 - DNA, 22 bp, Homo sapiens
aggacttgtttaaagtttgtgc

SEQ ID NO: 7567217 - DNA, 22 bp, Homo sapiens
aggacttgtttaaagtttgtgc

SEQ ID NO: 7567218 - DNA, 20 bp, Homo sapiens
aggacttgtttgggcagagt

SEQ ID NO: 7567219 - DNA, 20 bp, Homo sapiens
aggacttgtttgggcagagt

SEQ ID NO: 7567220 - DNA, 20 bp, Homo sapiens
aggacttgtttgggcagagt

SEQ ID NO: 7567221 - DNA, 17 bp, Homo sapiens
aggaagggcaagtttct

SEQ ID NO: 7567222 - DNA, 17 bp, Homo sapiens
aggaagggcaagtttct

SEQ ID NO: 7567223 - DNA, 17 bp, Homo sapiens
aggaagggcaagtttct

SEQ ID NO: 7567224 - DNA, 17 bp, Homo sapiens
aggaagggcaagtttct

SEQ ID NO: 7567225 - DNA, 17 bp, Homo sapiens
aggaagggcaagtttct

SEQ ID NO: 7567226 - DNA, 17 bp, Homo sapiens
aggaagggcaagtttct

SEQ ID NO: 7567227 - DNA, 22 bp, Homo sapiens
aggaagggatacataggatagt

SEQ ID NO: 7567228 - DNA, 22 bp, Homo sapiens
aggaagggatacataggatagt

SEQ ID NO: 7567229 - DNA, 22 bp, Homo sapiens
aggaagggatacataggatagt

SEQ ID NO: 7567230 - DNA, 22 bp, Homo sapiens
aggagacagccaggggcctgag

SEQ ID NO: 7567231 - DNA, 22 bp, Homo sapiens
aggagacagccaggggcctgag

SEQ ID NO: 7567232 - DNA, 22 bp, Homo sapiens
aggagacagccaggggcctgag

SEQ ID NO: 7567233 - DNA, 22 bp, Homo sapiens
aggagacagccaggggcctgag

SEQ ID NO: 7567234 - DNA, 22 bp, Homo sapiens
aggactttaacatattaactgt

SEQ ID NO: 7567235 - DNA, 23 bp, Homo sapiens
aggagacagggaagtgcctggct

SEQ ID NO: 7567236 - DNA, 18 bp, Homo sapiens
aggagacagcctcacctg

SEQ ID NO: 7567237 - DNA, 22 bp, Homo sapiens
aggagacagccaggggcctgag

SEQ ID NO: 7567238 - DNA, 22 bp, Homo sapiens
aggagacagccaggggcctgag

SEQ ID NO: 7567239 - DNA, 18 bp, Homo sapiens
aggagacagcctcacctg

SEQ ID NO: 7567240 - DNA, 23 bp, Homo sapiens
aggagacagggaagtgcctggct

SEQ ID NO: 7567241 - DNA, 23 bp, Homo sapiens
aggagacagggaagtgcctggct

SEQ ID NO: 7567242 - DNA, 23 bp, Homo sapiens
aggagacagggaagtgcctggct

SEQ ID NO: 7567243 - DNA, 22 bp, Homo sapiens
aggagacagtttggacgtgtag

SEQ ID NO: 7567244 - DNA, 22 bp, Homo sapiens
aggagacagtttggacgtgtag

SEQ ID NO: 7567245 - DNA, 22 bp, Homo sapiens
aggagacataactatgatgaga

SEQ ID NO: 7567246 - DNA, 22 bp, Homo sapiens
aggagacataactatgatgaga

SEQ ID NO: 7567247 - DNA, 22 bp, Homo sapiens
aggagacagtttggacgtgtag

SEQ ID NO: 7567248 - DNA, 22 bp, Homo sapiens
aggagacataactatgatgaga

SEQ ID NO: 7567249 - DNA, 22 bp, Homo sapiens
aggaagctaaccagggagtgag

SEQ ID NO: 7567250 - DNA, 22 bp, Homo sapiens
aggaagctaaccagggagtgag

SEQ ID NO: 7567251 - DNA, 23 bp, Homo sapiens
aggaagctaagtgtggctgcgga

SEQ ID NO: 7567252 - DNA, 23 bp, Homo sapiens
aggaagctaagtgtggctgcgga

SEQ ID NO: 7567253 - DNA, 22 bp, Homo sapiens
aggaagctagaaggtcttcttt

SEQ ID NO: 7567254 - DNA, 23 bp, Homo sapiens
aggaagctaccaattttgtaggc

SEQ ID NO: 7567255 - DNA, 23 bp, Homo sapiens
aggaagctaccaattttgtaggc

SEQ ID NO: 7567256 - DNA, 22 bp, Homo sapiens
aggaagctcaaagccatgatgt

SEQ ID NO: 7567257 - DNA, 20 bp, Homo sapiens
aggaaggagaatctgagcaa

SEQ ID NO: 7567258 - DNA, 22 bp, Homo sapiens
aggaagctagagccaccggact

SEQ ID NO: 7567259 - DNA, 22 bp, Homo sapiens
aggaagctagagccaccggact

SEQ ID NO: 7567260 - DNA, 23 bp, Homo sapiens
aggaagcccattttagtctacct

SEQ ID NO: 7567261 - DNA, 22 bp, Homo sapiens
aggaagcccaagtctcatcttc

SEQ ID NO: 7567262 - DNA, 22 bp, Homo sapiens
aggaagccatggtggacgtcta

SEQ ID NO: 7567263 - DNA, 22 bp, Homo sapiens
aggaagcccaagtctcatcttc

SEQ ID NO: 7567264 - DNA, 22 bp, Homo sapiens
aggaagcctgcaggtgactgct

SEQ ID NO: 7567265 - DNA, 22 bp, Homo sapiens
aggaagcctggcattaaaaagc

SEQ ID NO: 7567266 - DNA, 22 bp, Homo sapiens
aggaagcctgcaggtgactgct

SEQ ID NO: 7567267 - DNA, 17 bp, Homo sapiens
aggaagcgagctggcct

SEQ ID NO: 7567268 - DNA, 17 bp, Homo sapiens
aggaagcgagctggcct

SEQ ID NO: 7567269 - DNA, 22 bp, Homo sapiens
aggaagcctggagtcctgccca

SEQ ID NO: 7567270 - DNA, 22 bp, Homo sapiens
aggaagcctggggctgccctcg

SEQ ID NO: 7567271 - DNA, 22 bp, Homo sapiens
aggaagcctggggctgccctcg

SEQ ID NO: 7567272 - DNA, 22 bp, Homo sapiens
aggaagcctgggaggtttggga

SEQ ID NO: 7567273 - DNA, 22 bp, Homo sapiens
aggaagcctggggctgccctcg

SEQ ID NO: 7567274 - DNA, 22 bp, Homo sapiens
aggaagcctggggctgccctcg

SEQ ID NO: 7567275 - DNA, 23 bp, Homo sapiens
aggaaggaggtcctaacagtatc

SEQ ID NO: 7567276 - DNA, 23 bp, Homo sapiens
aggaaggaggtcctaacagtatc

SEQ ID NO: 7567277 - DNA, 23 bp, Homo sapiens
aggaaggaggtcctaacagtatc

SEQ ID NO: 7567278 - DNA, 23 bp, Homo sapiens
aggaaggaggtcctaacagtatc

SEQ ID NO: 7567279 - DNA, 23 bp, Homo sapiens
aggaaggaggtcctaacagtatc

SEQ ID NO: 7567280 - DNA, 22 bp, Homo sapiens
aggaaggagggcagatattaag

SEQ ID NO: 7567281 - DNA, 23 bp, Homo sapiens
aggaaggaggtcctaacagtatc

SEQ ID NO: 7567282 - DNA, 22 bp, Homo sapiens
aggaaggcacattgttggctaa

SEQ ID NO: 7567283 - DNA, 22 bp, Homo sapiens
aggaaggcatgaggtgttcaca

SEQ ID NO: 7567284 - DNA, 22 bp, Homo sapiens
aggaaggcatgaggtgttcaca

SEQ ID NO: 7567285 - DNA, 22 bp, Homo sapiens
aggaaggcacattgttggctaa

SEQ ID NO: 7567286 - DNA, 23 bp, Homo sapiens
aggaaggaggtcctaacagtatc

SEQ ID NO: 7567287 - DNA, 22 bp, Homo sapiens
aggaaggcacattgttggctaa

SEQ ID NO: 7567288 - DNA, 22 bp, Homo sapiens
aggaaggcacattgttggctaa

SEQ ID NO: 7567289 - DNA, 23 bp, Homo sapiens
aggaaggaggtcctaacagtatc

SEQ ID NO: 7567290 - DNA, 23 bp, Homo sapiens
aggaaggaggtcctaacagtatc

SEQ ID NO: 7567291 - DNA, 23 bp, Homo sapiens
aggaaggaggtcctaacagtatc

SEQ ID NO: 7567292 - DNA, 23 bp, Homo sapiens
aggaaggaggtcctaacagtatc

SEQ ID NO: 7567293 - DNA, 20 bp, Homo sapiens
aggaaggagaatctgagcaa

SEQ ID NO: 7567294 - DNA, 20 bp, Homo sapiens
aggaaggagaatctgagcaa

SEQ ID NO: 7567295 - DNA, 22 bp, Homo sapiens
aggaaggagggcagatattaag

SEQ ID NO: 7567296 - DNA, 22 bp, Homo sapiens
aggaaggagggcagatattaag

SEQ ID NO: 7567297 - DNA, 22 bp, Homo sapiens
aggaaggagggcagatattaag

SEQ ID NO: 7567298 - DNA, 22 bp, Homo sapiens
aggaaggagggcagatattaag

SEQ ID NO: 7567299 - DNA, 22 bp, Homo sapiens
aggaagggatacataggatagt

SEQ ID NO: 7567300 - DNA, 22 bp, Homo sapiens
aggaagggatacataggatagt

SEQ ID NO: 7567301 - DNA, 22 bp, Homo sapiens
aggaagggatacataggatagt

SEQ ID NO: 7567302 - DNA, 22 bp, Homo sapiens
aggaagggatacataggatagt

SEQ ID NO: 7567303 - DNA, 22 bp, Homo sapiens
aggaagggatacataggatagt

SEQ ID NO: 7567304 - DNA, 22 bp, Homo sapiens
aggaagggatacataggatagt

SEQ ID NO: 7567305 - DNA, 22 bp, Homo sapiens
aggaagggatacataggatagt

SEQ ID NO: 7567306 - DNA, 22 bp, Homo sapiens
aggaagggagcagtttgttgtt

SEQ ID NO: 7567307 - DNA, 22 bp, Homo sapiens
aggaagggagcagtttgttgtt

SEQ ID NO: 7567308 - DNA, 22 bp, Homo sapiens
aggaagggagcagtttgttgtt

SEQ ID NO: 7567309 - DNA, 22 bp, Homo sapiens
aggaagggagcagtttgttgtt

SEQ ID NO: 7567310 - DNA, 22 bp, Homo sapiens
aggaagggagcagtttgttgtt

SEQ ID NO: 7567311 - DNA, 22 bp, Homo sapiens
aggaaggcttctttggtcttct

SEQ ID NO: 7567312 - DNA, 22 bp, Homo sapiens
aggaaggcttctttggtcttct

SEQ ID NO: 7567313 - DNA, 22 bp, Homo sapiens
aggaaggcttctttggtcttct

SEQ ID NO: 7567314 - DNA, 22 bp, Homo sapiens
aggaaggcttctttggtcttct

SEQ ID NO: 7567315 - DNA, 20 bp, Homo sapiens
aggaaggctgttggccttgc

SEQ ID NO: 7567316 - DNA, 20 bp, Homo sapiens
aggaaggctgttggccttgc

SEQ ID NO: 7567317 - DNA, 20 bp, Homo sapiens
aggaaggctgttggccttgc

SEQ ID NO: 7567318 - DNA, 22 bp, Homo sapiens
aggaaggctgatcactgcttgt

SEQ ID NO: 7567319 - DNA, 22 bp, Homo sapiens
aggaaggctgatcactgcttgt

SEQ ID NO: 7567320 - DNA, 22 bp, Homo sapiens
aggaaggctgatcactgcttgt

SEQ ID NO: 7567321 - DNA, 22 bp, Homo sapiens
aggaaggctgatcactgcttgt

SEQ ID NO: 7567322 - DNA, 22 bp, Homo sapiens
aggaaggcatgaggtgttcaca

SEQ ID NO: 7567323 - DNA, 19 bp, Homo sapiens
aggaaggcggcggctgccc

SEQ ID NO: 7567324 - DNA, 22 bp, Homo sapiens
aggagccattttccaagggcga

SEQ ID NO: 7567325 - DNA, 22 bp, Homo sapiens
aggagccattgcaggatggcag

SEQ ID NO: 7567326 - DNA, 22 bp, Homo sapiens
aggagccattgcaggatggcag

SEQ ID NO: 7567327 - DNA, 22 bp, Homo sapiens
aggagccattgcaggatggcag

SEQ ID NO: 7567328 - DNA, 22 bp, Homo sapiens
aggagccattgcaggatggcag

SEQ ID NO: 7567329 - DNA, 22 bp, Homo sapiens
aggagccattgcaggatggcag

SEQ ID NO: 7567330 - DNA, 22 bp, Homo sapiens
aggagccattttccaagggcga

SEQ ID NO: 7567331 - DNA, 22 bp, Homo sapiens
aggagccattttccaagggcga

SEQ ID NO: 7567332 - DNA, 22 bp, Homo sapiens
aggagccattttccaagggcga

SEQ ID NO: 7567333 - DNA, 20 bp, Homo sapiens
aggagccattgactgcagca

SEQ ID NO: 7567334 - DNA, 20 bp, Homo sapiens
aggagccattgactgcagca

SEQ ID NO: 7567335 - DNA, 20 bp, Homo sapiens
aggagccattgactgcagca

SEQ ID NO: 7567336 - DNA, 20 bp, Homo sapiens
aggagccattgactgcagca

SEQ ID NO: 7567337 - DNA, 21 bp, Homo sapiens
aggagccatgtggtctgatgg

SEQ ID NO: 7567338 - DNA, 20 bp, Homo sapiens
aggagccattgactgcagca

SEQ ID NO: 7567339 - DNA, 20 bp, Homo sapiens
aggagccattgactgcagca

SEQ ID NO: 7567340 - DNA, 20 bp, Homo sapiens
aggagccattgactgcagca

SEQ ID NO: 7567341 - DNA, 22 bp, Homo sapiens
aggagcagaccgtagtcctgca

SEQ ID NO: 7567342 - DNA, 22 bp, Homo sapiens
aggagcagaccgtagtcctgca

SEQ ID NO: 7567343 - DNA, 22 bp, Homo sapiens
aggagcagaccgtagtcctgca

SEQ ID NO: 7567344 - DNA, 22 bp, Homo sapiens
aggagcagaccgtagtcctgca

SEQ ID NO: 7567345 - DNA, 22 bp, Homo sapiens
aggagccatgagtgacatcaca

SEQ ID NO: 7567346 - DNA, 22 bp, Homo sapiens
aggagcagaccgtagtcctgca

SEQ ID NO: 7567347 - DNA, 22 bp, Homo sapiens
aggagcagaccgtagtcctgca

SEQ ID NO: 7567348 - DNA, 22 bp, Homo sapiens
aggagccatgagtgacatcaca

SEQ ID NO: 7567349 - DNA, 22 bp, Homo sapiens
aggagccatggaggtgaggcgg

SEQ ID NO: 7567350 - DNA, 22 bp, Homo sapiens
aggagccatggaggtgaggcgg

SEQ ID NO: 7567351 - DNA, 22 bp, Homo sapiens
aggagccatggaggtgaggcgg

SEQ ID NO: 7567352 - DNA, 22 bp, Homo sapiens
aggagccatggaggtgaggcgg

SEQ ID NO: 7567353 - DNA, 22 bp, Homo sapiens
aggagccatggaggtgaggcgg

SEQ ID NO: 7567354 - DNA, 22 bp, Homo sapiens
aggagccatggaggtgaggcgg

SEQ ID NO: 7567355 - DNA, 23 bp, Homo sapiens
aggagccatgagttggatatgtt

SEQ ID NO: 7567356 - DNA, 23 bp, Homo sapiens
aggagccatgagttggatatgtt

SEQ ID NO: 7567357 - DNA, 23 bp, Homo sapiens
aggagccatgagttggatatgtt

SEQ ID NO: 7567358 - DNA, 22 bp, Homo sapiens
aggagccatgagtgacatcaca

SEQ ID NO: 7567359 - DNA, 23 bp, Homo sapiens
aggagccatgagttggatatgtt

SEQ ID NO: 7567360 - DNA, 22 bp, Homo sapiens
acagggtgaatgtgacattatc

SEQ ID NO: 7567361 - DNA, 22 bp, Homo sapiens
acagggtgactttgtgacagat

SEQ ID NO: 7567362 - DNA, 22 bp, Homo sapiens
acagggtgactttgtgacagat

SEQ ID NO: 7567363 - DNA, 22 bp, Homo sapiens
acagggtgactttgtgacagat

SEQ ID NO: 7567364 - DNA, 22 bp, Homo sapiens
acagggtgactttgtgacagat

SEQ ID NO: 7567365 - DNA, 22 bp, Homo sapiens
acagggtgactttgtgacagat

SEQ ID NO: 7567366 - DNA, 22 bp, Homo sapiens
acagggtgactttgtgacagat

SEQ ID NO: 7567367 - DNA, 22 bp, Homo sapiens
acagggtggggatggtgagctt

SEQ ID NO: 7567368 - DNA, 22 bp, Homo sapiens
acagggtggggatggtgagctt

SEQ ID NO: 7567369 - DNA, 22 bp, Homo sapiens
acagggtggggatggtgagctt

SEQ ID NO: 7567370 - DNA, 22 bp, Homo sapiens
acagggtggggatggtgagctt

SEQ ID NO: 7567371 - DNA, 22 bp, Homo sapiens
acagggtggggatggtgagctt

SEQ ID NO: 7567372 - DNA, 22 bp, Homo sapiens
acagggtgactttgtgacagat

SEQ ID NO: 7567373 - DNA, 22 bp, Homo sapiens
acagggtgactttgtgacagat

SEQ ID NO: 7567374 - DNA, 22 bp, Homo sapiens
acagggtgactttgtgacagat

SEQ ID NO: 7567375 - DNA, 22 bp, Homo sapiens
acaggggtgcatggtgcatggt

SEQ ID NO: 7567376 - DNA, 22 bp, Homo sapiens
acagggggtcccatggcctgga

SEQ ID NO: 7567377 - DNA, 22 bp, Homo sapiens
acagggggtcccatggcctgga

SEQ ID NO: 7567378 - DNA, 22 bp, Homo sapiens
acagggggtcccatggcctgga

SEQ ID NO: 7567379 - DNA, 22 bp, Homo sapiens
acaggggctccgaaggtgaggg

SEQ ID NO: 7567380 - DNA, 22 bp, Homo sapiens
acaggggctccgaaggtgaggg

SEQ ID NO: 7567381 - DNA, 22 bp, Homo sapiens
acaggggctccgaaggtgaggg

SEQ ID NO: 7567382 - DNA, 22 bp, Homo sapiens
acaggggctccgaaggtgaggg

SEQ ID NO: 7567383 - DNA, 22 bp, Homo sapiens
acaggggctccgaaggtgaggg

SEQ ID NO: 7567384 - DNA, 22 bp, Homo sapiens
acaggggctccgaaggtgaggg

SEQ ID NO: 7567385 - DNA, 22 bp, Homo sapiens
acaggggctccgaaggtgaggg

SEQ ID NO: 7567386 - DNA, 22 bp, Homo sapiens
acaggggctccgaaggtgaggg

SEQ ID NO: 7567387 - DNA, 22 bp, Homo sapiens
acagggtcaagggtgctacaag

SEQ ID NO: 7567388 - DNA, 22 bp, Homo sapiens
acaggggtgcatggtgcatggt

SEQ ID NO: 7567389 - DNA, 22 bp, Homo sapiens
acaggggtgcatggtgcatggt

SEQ ID NO: 7567390 - DNA, 22 bp, Homo sapiens
acagggtcttagagatcacctg

SEQ ID NO: 7567391 - DNA, 22 bp, Homo sapiens
acagggtcttagagatcacctg

SEQ ID NO: 7567392 - DNA, 22 bp, Homo sapiens
aggagctggaatggtccttttg

SEQ ID NO: 7567393 - DNA, 22 bp, Homo sapiens
aggagctggaatggtccttttg

SEQ ID NO: 7567394 - DNA, 22 bp, Homo sapiens
aggagctggagtccaggcaagt

SEQ ID NO: 7567395 - DNA, 21 bp, Homo sapiens
aggagctggagaaaactttcc

SEQ ID NO: 7567396 - DNA, 22 bp, Homo sapiens
aggagctgctttggtgcggttt

SEQ ID NO: 7567397 - DNA, 22 bp, Homo sapiens
aggagctggaatggtccttttg

SEQ ID NO: 7567398 - DNA, 22 bp, Homo sapiens
aggagctgctttggtgcggttt

SEQ ID NO: 7567399 - DNA, 22 bp, Homo sapiens
aggagctgcttaaatggttggt

SEQ ID NO: 7567400 - DNA, 22 bp, Homo sapiens
aggagctgcttaaatggttggt

SEQ ID NO: 7567401 - DNA, 22 bp, Homo sapiens
aggagctgcttaaatggttggt

SEQ ID NO: 7567402 - DNA, 22 bp, Homo sapiens
aggagctgcttaaatggttggt

SEQ ID NO: 7567403 - DNA, 22 bp, Homo sapiens
aggagctgctttggtgcggttt

SEQ ID NO: 7567404 - DNA, 22 bp, Homo sapiens
aggagctgcttaaatggttggt

SEQ ID NO: 7567405 - DNA, 22 bp, Homo sapiens
aggagctgctttggtgcggttt

SEQ ID NO: 7567406 - DNA, 22 bp, Homo sapiens
aggagctgcatggatacctggt

SEQ ID NO: 7567407 - DNA, 22 bp, Homo sapiens
aggagctgcatggatacctggt

SEQ ID NO: 7567408 - DNA, 22 bp, Homo sapiens
aggagctgcatggatacctggt

SEQ ID NO: 7567409 - DNA, 22 bp, Homo sapiens
aggagctgcagattctgccttg

SEQ ID NO: 7567410 - DNA, 22 bp, Homo sapiens
aggagctgcactgggagttttt

SEQ ID NO: 7567411 - DNA, 22 bp, Homo sapiens
aggagctgcactgggagttttt

SEQ ID NO: 7567412 - DNA, 22 bp, Homo sapiens
aggagctgcactgggagttttt

SEQ ID NO: 7567413 - DNA, 22 bp, Homo sapiens
aggagctgcaaatattagtaat

SEQ ID NO: 7567414 - DNA, 22 bp, Homo sapiens
aggagctgcagattctgccttg

SEQ ID NO: 7567415 - DNA, 22 bp, Homo sapiens
aggagctgcagattctgccttg

SEQ ID NO: 7567416 - DNA, 22 bp, Homo sapiens
aggagctgcagattctgccttg

SEQ ID NO: 7567417 - DNA, 22 bp, Homo sapiens
aggagctgcagattctgccttg

SEQ ID NO: 7567418 - DNA, 22 bp, Homo sapiens
aggagctgcagattctgccttg

SEQ ID NO: 7567419 - DNA, 22 bp, Homo sapiens
aggagctgcagattctgccttg

SEQ ID NO: 7567420 - DNA, 22 bp, Homo sapiens
aggagctgatgattctttgatc

SEQ ID NO: 7567421 - DNA, 22 bp, Homo sapiens
aggagcctggctggcccacagg

SEQ ID NO: 7567422 - DNA, 22 bp, Homo sapiens
aggagcctgagtcacagtgcct

SEQ ID NO: 7567423 - DNA, 22 bp, Homo sapiens
aggagcctgagtcacagtgcct

SEQ ID NO: 7567424 - DNA, 22 bp, Homo sapiens
aggagctgcaaaaccggccgct

SEQ ID NO: 7567425 - DNA, 22 bp, Homo sapiens
aggagcctccatggtcacattc

SEQ ID NO: 7567426 - DNA, 22 bp, Homo sapiens
aggagcctccatggtcacattc

SEQ ID NO: 7567427 - DNA, 22 bp, Homo sapiens
aggagcctccttctcatgtgca

SEQ ID NO: 7567428 - DNA, 22 bp, Homo sapiens
aggagcctgaatcagagggtga

SEQ ID NO: 7567429 - DNA, 22 bp, Homo sapiens
aggagcctccttctcatgtgca

SEQ ID NO: 7567430 - DNA, 22 bp, Homo sapiens
aggagcctgaatcagagggtga

SEQ ID NO: 7567431 - DNA, 22 bp, Homo sapiens
aggagcctccatggtcacattc

SEQ ID NO: 7567432 - DNA, 22 bp, Homo sapiens
aggagcccagcctgggctcgga

SEQ ID NO: 7567433 - DNA, 22 bp, Homo sapiens
aggagcccagcctgggctcgga

SEQ ID NO: 7567434 - DNA, 23 bp, Homo sapiens
aggagcccaaggagaggtaactt

SEQ ID NO: 7567435 - DNA, 23 bp, Homo sapiens
aggagcccctaattctgggcagc

SEQ ID NO: 7567436 - DNA, 23 bp, Homo sapiens
aggagcccctaattctgggcagc

SEQ ID NO: 7567437 - DNA, 23 bp, Homo sapiens
aggagcccctaattctgggcagc

SEQ ID NO: 7567438 - DNA, 23 bp, Homo sapiens
aggagcccctaattctgggcagc

SEQ ID NO: 7567439 - DNA, 22 bp, Homo sapiens
aggagcccctcttcagtcctgg

SEQ ID NO: 7567440 - DNA, 22 bp, Homo sapiens
aggagcccctcttcagtcctgg

SEQ ID NO: 7567441 - DNA, 22 bp, Homo sapiens
aggagcccctcttcagtcctgg

SEQ ID NO: 7567442 - DNA, 22 bp, Homo sapiens
aggagccctgcgggaggcagag

SEQ ID NO: 7567443 - DNA, 22 bp, Homo sapiens
aggagccctgcgggaggcagag

SEQ ID NO: 7567444 - DNA, 22 bp, Homo sapiens
aggagccctccgttgcttcatc

SEQ ID NO: 7567445 - DNA, 22 bp, Homo sapiens
aggagccctccgttgcttcatc

SEQ ID NO: 7567446 - DNA, 22 bp, Homo sapiens
aggagccctgcgggaggcagag

SEQ ID NO: 7567447 - DNA, 22 bp, Homo sapiens
aggagccctgcgggaggcagag

SEQ ID NO: 7567448 - DNA, 22 bp, Homo sapiens
aggagcccctcttcagtcctgg

SEQ ID NO: 7567449 - DNA, 22 bp, Homo sapiens
acccagtcatcctggtgtgaga

SEQ ID NO: 7567450 - DNA, 22 bp, Homo sapiens
acccagtcatcctggtgtgaga

SEQ ID NO: 7567451 - DNA, 18 bp, Homo sapiens
acccaggttttgaagctt

SEQ ID NO: 7567452 - DNA, 22 bp, Homo sapiens
acccagggtttgagctctgcag

SEQ ID NO: 7567453 - DNA, 22 bp, Homo sapiens
acccagggtttgagctctgcag

SEQ ID NO: 7567454 - DNA, 22 bp, Homo sapiens
acccagggtttgagctctgcag

SEQ ID NO: 7567455 - DNA, 22 bp, Homo sapiens
acccagggtttgagctctgcag

SEQ ID NO: 7567456 - DNA, 22 bp, Homo sapiens
acccagggtttgagctctgcag

SEQ ID NO: 7567457 - DNA, 22 bp, Homo sapiens
acccagtgcatggatagatagc

SEQ ID NO: 7567458 - DNA, 22 bp, Homo sapiens
acccagtgacatcctttacctg

SEQ ID NO: 7567459 - DNA, 22 bp, Homo sapiens
acccagtctggagtgcagtgac

SEQ ID NO: 7567460 - DNA, 22 bp, Homo sapiens
acccagtctggagtgcagtgac

SEQ ID NO: 7567461 - DNA, 22 bp, Homo sapiens
acccagtgacatcctttacctg

SEQ ID NO: 7567462 - DNA, 18 bp, Homo sapiens
acccagtttgaaggaaag

SEQ ID NO: 7567463 - DNA, 18 bp, Homo sapiens
acccagtttgaaggaaag

SEQ ID NO: 7567464 - DNA, 22 bp, Homo sapiens
acccatacacacatatttatgt

SEQ ID NO: 7567465 - DNA, 18 bp, Homo sapiens
acccagtttgaaggaaag

SEQ ID NO: 7567466 - DNA, 23 bp, Homo sapiens
acccagttagagccctttaggaa

SEQ ID NO: 7567467 - DNA, 22 bp, Homo sapiens
acccagggtttgagctctgcag

SEQ ID NO: 7567468 - DNA, 22 bp, Homo sapiens
acccagggtttgagctctgcag

SEQ ID NO: 7567469 - DNA, 19 bp, Homo sapiens
acccagggttgatgtccag

SEQ ID NO: 7567470 - DNA, 19 bp, Homo sapiens
acccagggttgatgtccag

SEQ ID NO: 7567471 - DNA, 19 bp, Homo sapiens
acccagggttgatgtccag

SEQ ID NO: 7567472 - DNA, 22 bp, Homo sapiens
acccagggttcctgggtcccag

SEQ ID NO: 7567473 - DNA, 19 bp, Homo sapiens
acccagggttgatgtccag

SEQ ID NO: 7567474 - DNA, 19 bp, Homo sapiens
acccagggttgatgtccag

SEQ ID NO: 7567475 - DNA, 19 bp, Homo sapiens
acccagggttgatgtccag

SEQ ID NO: 7567476 - DNA, 22 bp, Homo sapiens
acccagggttcctgggtcccag

SEQ ID NO: 7567477 - DNA, 22 bp, Homo sapiens
acccagggttcctgggtcccag

SEQ ID NO: 7567478 - DNA, 22 bp, Homo sapiens
acccagggttcctgggtcccag

SEQ ID NO: 7567479 - DNA, 22 bp, Homo sapiens
acccagggtcaccccgtagggt

SEQ ID NO: 7567480 - DNA, 22 bp, Homo sapiens
acccagggtcaccccgtagggt

SEQ ID NO: 7567481 - DNA, 22 bp, Homo sapiens
acccagggtcaccccgtagggt

SEQ ID NO: 7567482 - DNA, 22 bp, Homo sapiens
acccagggttcctgggtcccag

SEQ ID NO: 7567483 - DNA, 22 bp, Homo sapiens
acccagggtagagtgcagtggc

SEQ ID NO: 7567484 - DNA, 22 bp, Homo sapiens
acccagggtagagtgcagtggc

SEQ ID NO: 7567485 - DNA, 22 bp, Homo sapiens
acccagggagtgctcctgttct

SEQ ID NO: 7567486 - DNA, 22 bp, Homo sapiens
acccagggaccccgctgacgcc

SEQ ID NO: 7567487 - DNA, 22 bp, Homo sapiens
acccagggaccccgctgacgcc

SEQ ID NO: 7567488 - DNA, 22 bp, Homo sapiens
acccagggaccccgctgacgcc

SEQ ID NO: 7567489 - DNA, 22 bp, Homo sapiens
acccagagcagagcttggcttc

SEQ ID NO: 7567490 - DNA, 22 bp, Homo sapiens
acccagggtcaccccgtagggt

SEQ ID NO: 7567491 - DNA, 22 bp, Homo sapiens
acccagggtagagtgcagtggc

SEQ ID NO: 7567492 - DNA, 22 bp, Homo sapiens
acccagggtagagtgcagtggc

SEQ ID NO: 7567493 - DNA, 22 bp, Homo sapiens
acccagggtagagtgcagtggc

SEQ ID NO: 7567494 - DNA, 22 bp, Homo sapiens
acccagggtagagtgcagtggc

SEQ ID NO: 7567495 - DNA, 22 bp, Homo sapiens
acccagggtagagtgcagtggc

SEQ ID NO: 7567496 - DNA, 22 bp, Homo sapiens
acccagggtagagtgcagtggc

SEQ ID NO: 7567497 - DNA, 22 bp, Homo sapiens
acccagagatgtcaatggcttt

SEQ ID NO: 7567498 - DNA, 22 bp, Homo sapiens
acccagagcacagatgcaacgt

SEQ ID NO: 7567499 - DNA, 22 bp, Homo sapiens
acccagagcacagatgcaacgt

SEQ ID NO: 7567500 - DNA, 22 bp, Homo sapiens
acccagagatggacctggctgc

SEQ ID NO: 7567501 - DNA, 22 bp, Homo sapiens
acccagagatggacctggctgc

SEQ ID NO: 7567502 - DNA, 22 bp, Homo sapiens
acccagagatgtcaatggcttt

SEQ ID NO: 7567503 - DNA, 22 bp, Homo sapiens
acccagagactagcacggtaca

SEQ ID NO: 7567504 - DNA, 22 bp, Homo sapiens
acccagagatggacctggctgc

SEQ ID NO: 7567505 - DNA, 22 bp, Homo sapiens
acccagagactagcacggtaca

SEQ ID NO: 7567506 - DNA, 17 bp, Homo sapiens
acccagagaaggaggtc

SEQ ID NO: 7567507 - DNA, 17 bp, Homo sapiens
acccagagaaggaggtc

SEQ ID NO: 7567508 - DNA, 17 bp, Homo sapiens
acccagagaaggaggtc

SEQ ID NO: 7567509 - DNA, 22 bp, Homo sapiens
acccagagaactgtgccttgag

SEQ ID NO: 7567510 - DNA, 22 bp, Homo sapiens
acccaggctggcgtgcagtggc

SEQ ID NO: 7567511 - DNA, 22 bp, Homo sapiens
acccagagcactgggtgtgggc

SEQ ID NO: 7567512 - DNA, 22 bp, Homo sapiens
acccagagcactgggtgtgggc

SEQ ID NO: 7567513 - DNA, 22 bp, Homo sapiens
acccagagcacagatgcaacgt

SEQ ID NO: 7567514 - DNA, 22 bp, Homo sapiens
acccagagcactgggtgtgggc

SEQ ID NO: 7567515 - DNA, 22 bp, Homo sapiens
acccagagcactgggtgtgggc

SEQ ID NO: 7567516 - DNA, 22 bp, Homo sapiens
acccagagcacagatgcaacgt

SEQ ID NO: 7567517 - DNA, 22 bp, Homo sapiens
acccagagcacagatgcaacgt

SEQ ID NO: 7567518 - DNA, 22 bp, Homo sapiens
acccagagcacagatgcaacgt

SEQ ID NO: 7567519 - DNA, 22 bp, Homo sapiens
acccagagcacagatgcaacgt

SEQ ID NO: 7567520 - DNA, 22 bp, Homo sapiens
acccagagcacagatgcaacgt

SEQ ID NO: 7567521 - DNA, 22 bp, Homo sapiens
acccacagccgctgtgcgtccc

SEQ ID NO: 7567522 - DNA, 22 bp, Homo sapiens
acccacagccgctgtgcgtccc

SEQ ID NO: 7567523 - DNA, 22 bp, Homo sapiens
acccacagccgctgtgcgtccc

SEQ ID NO: 7567524 - DNA, 22 bp, Homo sapiens
acccacagccgctgtgcgtccc

SEQ ID NO: 7567525 - DNA, 22 bp, Homo sapiens
agggcctgagctctcctccagt

SEQ ID NO: 7567526 - DNA, 22 bp, Homo sapiens
acccacagccgctgtgcgtccc

SEQ ID NO: 7567527 - DNA, 22 bp, Homo sapiens
acccacagccgctgtgcgtccc

SEQ ID NO: 7567528 - DNA, 22 bp, Homo sapiens
acccaccctactagcagtgtcc

SEQ ID NO: 7567529 - DNA, 22 bp, Homo sapiens
acccaccctactagcagtgtcc

SEQ ID NO: 7567530 - DNA, 22 bp, Homo sapiens
acccaccctactagcagtgtcc

SEQ ID NO: 7567531 - DNA, 22 bp, Homo sapiens
acccaccacagtggctggcaca

SEQ ID NO: 7567532 - DNA, 22 bp, Homo sapiens
acccaccctactagcagtgtcc

SEQ ID NO: 7567533 - DNA, 22 bp, Homo sapiens
agggcctgagctctcctccagt

SEQ ID NO: 7567534 - DNA, 22 bp, Homo sapiens
agggcctgagctctcctccagt

SEQ ID NO: 7567535 - DNA, 22 bp, Homo sapiens
agggcctgagctctcctccagt

SEQ ID NO: 7567536 - DNA, 22 bp, Homo sapiens
agggcctgagctctcctccagt

SEQ ID NO: 7567537 - DNA, 22 bp, Homo sapiens
agggcctgagctctcctccagt

SEQ ID NO: 7567538 - DNA, 19 bp, Homo sapiens
agggcctgagcagatgttg

SEQ ID NO: 7567539 - DNA, 19 bp, Homo sapiens
agggcctgagcagatgttg

SEQ ID NO: 7567540 - DNA, 22 bp, Homo sapiens
acccactgtcatctctgaccac

SEQ ID NO: 7567541 - DNA, 22 bp, Homo sapiens
acccactgtagccactctgggt

SEQ ID NO: 7567542 - DNA, 22 bp, Homo sapiens
acccacgaagatgagcggcatg

SEQ ID NO: 7567543 - DNA, 22 bp, Homo sapiens
acccacgaagatgagcggcatg

SEQ ID NO: 7567544 - DNA, 22 bp, Homo sapiens
acccacgaagatgagcggcatg

SEQ ID NO: 7567545 - DNA, 22 bp, Homo sapiens
acccaccctactagcagtgtcc

SEQ ID NO: 7567546 - DNA, 22 bp, Homo sapiens
acccaccctactagcagtgtcc

SEQ ID NO: 7567547 - DNA, 22 bp, Homo sapiens
acccagagaactgaggcatgaa

SEQ ID NO: 7567548 - DNA, 22 bp, Homo sapiens
acccagagaactgaggcatgaa

SEQ ID NO: 7567549 - DNA, 22 bp, Homo sapiens
acccactgtcatctctgaccac

SEQ ID NO: 7567550 - DNA, 22 bp, Homo sapiens
acccagagaactgaggcatgaa

SEQ ID NO: 7567551 - DNA, 22 bp, Homo sapiens
acccagagaactgaggcatgaa

SEQ ID NO: 7567552 - DNA, 22 bp, Homo sapiens
acccagagaactgaggcatgaa

SEQ ID NO: 7567553 - DNA, 22 bp, Homo sapiens
acccagagaactgaggcatgaa

SEQ ID NO: 7567554 - DNA, 22 bp, Homo sapiens
acccagagaactgtgccttgag

SEQ ID NO: 7567555 - DNA, 22 bp, Homo sapiens
acccagagaactgtgccttgag

SEQ ID NO: 7567556 - DNA, 22 bp, Homo sapiens
acccagagaactgaggcatgaa

SEQ ID NO: 7567557 - DNA, 22 bp, Homo sapiens
acccagagaactgaggcatgaa

SEQ ID NO: 7567558 - DNA, 22 bp, Homo sapiens
acccagagaactgtgccttgag

SEQ ID NO: 7567559 - DNA, 22 bp, Homo sapiens
agggcctctgagccagttctgg

SEQ ID NO: 7567560 - DNA, 22 bp, Homo sapiens
agggcctctgagccagttctgg

SEQ ID NO: 7567561 - DNA, 22 bp, Homo sapiens
agggcctctgacgcccccagcc

SEQ ID NO: 7567562 - DNA, 22 bp, Homo sapiens
agggcctctgacgcccccagcc

SEQ ID NO: 7567563 - DNA, 22 bp, Homo sapiens
agggcctctctgggcctttcct

SEQ ID NO: 7567564 - DNA, 22 bp, Homo sapiens
agggcctctctgggcctttcct

SEQ ID NO: 7567565 - DNA, 21 bp, Homo sapiens
agggcctctgtgtactggggg

SEQ ID NO: 7567566 - DNA, 21 bp, Homo sapiens
agggcctctgtgtactggggg

SEQ ID NO: 7567567 - DNA, 23 bp, Homo sapiens
agggcctctgtcccccagcactc

SEQ ID NO: 7567568 - DNA, 22 bp, Homo sapiens
agggcctctggaacactgaggg

SEQ ID NO: 7567569 - DNA, 22 bp, Homo sapiens
agggcctctggaacactgaggg

SEQ ID NO: 7567570 - DNA, 22 bp, Homo sapiens
agggcctctggaacactgaggg

SEQ ID NO: 7567571 - DNA, 22 bp, Homo sapiens
agggcctctggaacactgaggg

SEQ ID NO: 7567572 - DNA, 19 bp, Homo sapiens
agggcctgagcagatgttg

SEQ ID NO: 7567573 - DNA, 19 bp, Homo sapiens
agggcctgagcagatgttg

SEQ ID NO: 7567574 - DNA, 19 bp, Homo sapiens
agggcctgagcagatgttg

SEQ ID NO: 7567575 - DNA, 19 bp, Homo sapiens
agggcctgagcagatgttg

SEQ ID NO: 7567576 - DNA, 19 bp, Homo sapiens
agggcctgagcagatgttg

SEQ ID NO: 7567577 - DNA, 22 bp, Homo sapiens
agggcctgagaccgtggcttga

SEQ ID NO: 7567578 - DNA, 22 bp, Homo sapiens
agggcctgagaccgtggcttga

SEQ ID NO: 7567579 - DNA, 22 bp, Homo sapiens
agggcctgagaccgtggcttga

SEQ ID NO: 7567580 - DNA, 22 bp, Homo sapiens
agggcctgagaccgtggcttga

SEQ ID NO: 7567581 - DNA, 22 bp, Homo sapiens
agggcctgagaccgtggcttga

SEQ ID NO: 7567582 - DNA, 22 bp, Homo sapiens
agggcctgacacccttgccagc

SEQ ID NO: 7567583 - DNA, 22 bp, Homo sapiens
agggcctgacacccttgccagc

SEQ ID NO: 7567584 - DNA, 22 bp, Homo sapiens
agggcctgacacccttgccagc

SEQ ID NO: 7567585 - DNA, 22 bp, Homo sapiens
agggcctgacacccttgccagc

SEQ ID NO: 7567586 - DNA, 22 bp, Homo sapiens
agggcctgacacccttgccagc

SEQ ID NO: 7567587 - DNA, 20 bp, Homo sapiens
accccacagagtccattgca

SEQ ID NO: 7567588 - DNA, 22 bp, Homo sapiens
accccaagacagtagaagagaa

SEQ ID NO: 7567589 - DNA, 20 bp, Homo sapiens
accccacagagtccattgca

SEQ ID NO: 7567590 - DNA, 22 bp, Homo sapiens
acccatttttaaatataacttg

SEQ ID NO: 7567591 - DNA, 22 bp, Homo sapiens
acccatttttaaatataacttg

SEQ ID NO: 7567592 - DNA, 22 bp, Homo sapiens
accccaaaagagtaatagaatt

SEQ ID NO: 7567593 - DNA, 22 bp, Homo sapiens
accccaaaagagtaatagaatt

SEQ ID NO: 7567594 - DNA, 22 bp, Homo sapiens
accccaagacagtagaagagaa

SEQ ID NO: 7567595 - DNA, 22 bp, Homo sapiens
accccaagacagtagaagagaa

SEQ ID NO: 7567596 - DNA, 22 bp, Homo sapiens
accccacagcatacaaaggcac

SEQ ID NO: 7567597 - DNA, 22 bp, Homo sapiens
accccacagcatacaaaggcac

SEQ ID NO: 7567598 - DNA, 22 bp, Homo sapiens
accccagaggcggaggctgcag

SEQ ID NO: 7567599 - DNA, 22 bp, Homo sapiens
accccagaagcagcagtggcag

SEQ ID NO: 7567600 - DNA, 22 bp, Homo sapiens
accccagaatctatgctttaca

SEQ ID NO: 7567601 - DNA, 22 bp, Homo sapiens
accccagaagcagcagtggcag

SEQ ID NO: 7567602 - DNA, 22 bp, Homo sapiens
accccagaatctatgctttaca

SEQ ID NO: 7567603 - DNA, 22 bp, Homo sapiens
accccagaatctatgctttaca

SEQ ID NO: 7567604 - DNA, 22 bp, Homo sapiens
acccattcctctcctgagggat

SEQ ID NO: 7567605 - DNA, 18 bp, Homo sapiens
acccattatatttgtagc

SEQ ID NO: 7567606 - DNA, 22 bp, Homo sapiens
acccatggtctggtggggccct

SEQ ID NO: 7567607 - DNA, 22 bp, Homo sapiens
acccatgggccagttggggtgg

SEQ ID NO: 7567608 - DNA, 22 bp, Homo sapiens
acccatgtgctcttttgtaccc

SEQ ID NO: 7567609 - DNA, 22 bp, Homo sapiens
acccatgtttatttgtgtggtt

SEQ ID NO: 7567610 - DNA, 22 bp, Homo sapiens
acccatgtgctcttttgtaccc

SEQ ID NO: 7567611 - DNA, 22 bp, Homo sapiens
acccatttcataaacatgcttt

SEQ ID NO: 7567612 - DNA, 22 bp, Homo sapiens
acccatttgtccagcaaagata

SEQ ID NO: 7567613 - DNA, 19 bp, Homo sapiens
acccattttcagtattggc

SEQ ID NO: 7567614 - DNA, 19 bp, Homo sapiens
acccattttcagtattggc

SEQ ID NO: 7567615 - DNA, 17 bp, Homo sapiens
acccattttgcacaggc

SEQ ID NO: 7567616 - DNA, 22 bp, Homo sapiens
acccatttcataaacatgcttt

SEQ ID NO: 7567617 - DNA, 23 bp, Homo sapiens
acccatctctcctgtcatgcaga

SEQ ID NO: 7567618 - DNA, 17 bp, Homo sapiens
acccatccccagggcag

SEQ ID NO: 7567619 - DNA, 17 bp, Homo sapiens
acccatccccagggcag

SEQ ID NO: 7567620 - DNA, 22 bp, Homo sapiens
acccatccagtgtccctgctag

SEQ ID NO: 7567621 - DNA, 22 bp, Homo sapiens
acccatccagtgtccctgctag

SEQ ID NO: 7567622 - DNA, 22 bp, Homo sapiens
acccatcagcggctggagctgg

SEQ ID NO: 7567623 - DNA, 23 bp, Homo sapiens
acccatctctcctgtcatgcaga

SEQ ID NO: 7567624 - DNA, 23 bp, Homo sapiens
acccatctctcctgtcatgcaga

SEQ ID NO: 7567625 - DNA, 22 bp, Homo sapiens
accctggacatcttgtcatagc

SEQ ID NO: 7567626 - DNA, 22 bp, Homo sapiens
accctggacatcttgtcatagc

SEQ ID NO: 7567627 - DNA, 21 bp, Homo sapiens
accctgctttatgccgtcctc

SEQ ID NO: 7567628 - DNA, 22 bp, Homo sapiens
accctgctttatgccgtcctct

SEQ ID NO: 7567629 - DNA, 22 bp, Homo sapiens
accctggactggggctgaggct

SEQ ID NO: 7567630 - DNA, 22 bp, Homo sapiens
accctggactggggctgaggct

SEQ ID NO: 7567631 - DNA, 22 bp, Homo sapiens
accctggactggggctgaggct

SEQ ID NO: 7567632 - DNA, 22 bp, Homo sapiens
accctcttgagggaagcacttt

SEQ ID NO: 7567633 - DNA, 18 bp, Homo sapiens
accctctggcttctgagc

SEQ ID NO: 7567634 - DNA, 22 bp, Homo sapiens
accctgcctgacaacagaggat

SEQ ID NO: 7567635 - DNA, 22 bp, Homo sapiens
accctgcctgacaacagaggat

SEQ ID NO: 7567636 - DNA, 22 bp, Homo sapiens
accctgcctgacaacagaggat

SEQ ID NO: 7567637 - DNA, 22 bp, Homo sapiens
accctgctgacctgaaagaggg

SEQ ID NO: 7567638 - DNA, 22 bp, Homo sapiens
accctgctgacctgaaagaggg

SEQ ID NO: 7567639 - DNA, 22 bp, Homo sapiens
accctgcttctggattaatcca

SEQ ID NO: 7567640 - DNA, 22 bp, Homo sapiens
accctgcttggccccacttcta

SEQ ID NO: 7567641 - DNA, 22 bp, Homo sapiens
accctgcttggccccacttcta

SEQ ID NO: 7567642 - DNA, 22 bp, Homo sapiens
accccagctctgagccacacca

SEQ ID NO: 7567643 - DNA, 22 bp, Homo sapiens
accccagcgcatatggtctgcg

SEQ ID NO: 7567644 - DNA, 22 bp, Homo sapiens
accctctgccttgagcagtgcc

SEQ ID NO: 7567645 - DNA, 22 bp, Homo sapiens
accctctggctcatttcctagt

SEQ ID NO: 7567646 - DNA, 18 bp, Homo sapiens
accctctggcttctgagc

SEQ ID NO: 7567647 - DNA, 20 bp, Homo sapiens
accccagcccctctatctga

SEQ ID NO: 7567648 - DNA, 22 bp, Homo sapiens
accccagaggcggaggctgcag

SEQ ID NO: 7567649 - DNA, 22 bp, Homo sapiens
accccagaggcggaggctgcag

SEQ ID NO: 7567650 - DNA, 22 bp, Homo sapiens
accccagaggcggaggctgcag

SEQ ID NO: 7567651 - DNA, 22 bp, Homo sapiens
accccagccctgcttctgggag

SEQ ID NO: 7567652 - DNA, 22 bp, Homo sapiens
accccagcgcatatggtctgcg

SEQ ID NO: 7567653 - DNA, 22 bp, Homo sapiens
accccacagcatacaaaggcac

SEQ ID NO: 7567654 - DNA, 22 bp, Homo sapiens
accctggattgggaaccagaag

SEQ ID NO: 7567655 - DNA, 22 bp, Homo sapiens
accctggaggtggaggtgcagt

SEQ ID NO: 7567656 - DNA, 22 bp, Homo sapiens
accctggaggtggaggtgcagt

SEQ ID NO: 7567657 - DNA, 22 bp, Homo sapiens
accctggaggtctacagtgcag

SEQ ID NO: 7567658 - DNA, 22 bp, Homo sapiens
accctggagcaataatccctgg

SEQ ID NO: 7567659 - DNA, 22 bp, Homo sapiens
accctggagcttttctggccct

SEQ ID NO: 7567660 - DNA, 22 bp, Homo sapiens
accctggagcttttctggccct

SEQ ID NO: 7567661 - DNA, 22 bp, Homo sapiens
accctggaggtctacagtgcag

SEQ ID NO: 7567662 - DNA, 22 bp, Homo sapiens
accctggagcttttctggccct

SEQ ID NO: 7567663 - DNA, 22 bp, Homo sapiens
accctggcccattgctgtgcct

SEQ ID NO: 7567664 - DNA, 18 bp, Homo sapiens
accctggcatgctcttcc

SEQ ID NO: 7567665 - DNA, 22 bp, Homo sapiens
accctggcagccttctgtcctg

SEQ ID NO: 7567666 - DNA, 18 bp, Homo sapiens
accctggcatgctcttcc

SEQ ID NO: 7567667 - DNA, 18 bp, Homo sapiens
accctggcatgctcttcc

SEQ ID NO: 7567668 - DNA, 22 bp, Homo sapiens
accctggcagccttctgtcctg

SEQ ID NO: 7567669 - DNA, 22 bp, Homo sapiens
accctggcagccttctgtcctg

SEQ ID NO: 7567670 - DNA, 22 bp, Homo sapiens
accctggcagccttctgtcctg

SEQ ID NO: 7567671 - DNA, 22 bp, Homo sapiens
accctggcctggttcatgtgat

SEQ ID NO: 7567672 - DNA, 18 bp, Homo sapiens
accctggcatgctcttcc

SEQ ID NO: 7567673 - DNA, 22 bp, Homo sapiens
accctggcccattgctgtgcct

SEQ ID NO: 7567674 - DNA, 22 bp, Homo sapiens
accctggcccattgctgtgcct

SEQ ID NO: 7567675 - DNA, 22 bp, Homo sapiens
accctggcccattgctgtgcct

SEQ ID NO: 7567676 - DNA, 22 bp, Homo sapiens
accctggctctctggccaccgc

SEQ ID NO: 7567677 - DNA, 22 bp, Homo sapiens
accctggctctctggccaccgc

SEQ ID NO: 7567678 - DNA, 22 bp, Homo sapiens
accctggcctggttcatgtgat

SEQ ID NO: 7567679 - DNA, 22 bp, Homo sapiens
accctggcctggttcatgtgat

SEQ ID NO: 7567680 - DNA, 22 bp, Homo sapiens
accctggcctggttcatgtgat

SEQ ID NO: 7567681 - DNA, 22 bp, Homo sapiens
accctggctctctggccaccgc

SEQ ID NO: 7567682 - DNA, 22 bp, Homo sapiens
accctggctctctggccaccgc

SEQ ID NO: 7567683 - DNA, 22 bp, Homo sapiens
accctgggaactggaaactgga

SEQ ID NO: 7567684 - DNA, 22 bp, Homo sapiens
accctgggaactggaaactgga

SEQ ID NO: 7567685 - DNA, 22 bp, Homo sapiens
accctgggacctggaggtggat

SEQ ID NO: 7567686 - DNA, 22 bp, Homo sapiens
accctgggacctggaggtggat

SEQ ID NO: 7567687 - DNA, 22 bp, Homo sapiens
accctgggagggagaaatcaga

SEQ ID NO: 7567688 - DNA, 22 bp, Homo sapiens
accctgggacttccgagttgag

SEQ ID NO: 7567689 - DNA, 22 bp, Homo sapiens
accctgggacctggaggtggat

SEQ ID NO: 7567690 - DNA, 18 bp, Homo sapiens
accctgggcaattcactc

SEQ ID NO: 7567691 - DNA, 23 bp, Homo sapiens
accctgggcaagtcacctaacct

SEQ ID NO: 7567692 - DNA, 22 bp, Homo sapiens
accctgggcttggcctgctcag

SEQ ID NO: 7567693 - DNA, 22 bp, Homo sapiens
accctgggcttggcctgctcag

SEQ ID NO: 7567694 - DNA, 22 bp, Homo sapiens
accctgggcacaccatttcccc

SEQ ID NO: 7567695 - DNA, 22 bp, Homo sapiens
accctgggttcccgcagcacca

SEQ ID NO: 7567696 - DNA, 22 bp, Homo sapiens
accctgggtgagaggcaaacag

SEQ ID NO: 7567697 - DNA, 22 bp, Homo sapiens
accctgggttcccgcagcacca

SEQ ID NO: 7567698 - DNA, 22 bp, Homo sapiens
accctgggttcccgcagcacca

SEQ ID NO: 7567699 - DNA, 22 bp, Homo sapiens
accctgggtctcaatcatccta

SEQ ID NO: 7567700 - DNA, 22 bp, Homo sapiens
accctgggtgagaggcaaacag

SEQ ID NO: 7567701 - DNA, 22 bp, Homo sapiens
accctgggtgagaggcaaacag

SEQ ID NO: 7567702 - DNA, 22 bp, Homo sapiens
accctggtgatttgagagagta

SEQ ID NO: 7567703 - DNA, 22 bp, Homo sapiens
accctgtcttccctgggcatca

SEQ ID NO: 7567704 - DNA, 21 bp, Homo sapiens
accctgggttctccataccct

SEQ ID NO: 7567705 - DNA, 22 bp, Homo sapiens
accctgggttcccgcagcacca

SEQ ID NO: 7567706 - DNA, 22 bp, Homo sapiens
accctgggttcccgcagcacca

SEQ ID NO: 7567707 - DNA, 22 bp, Homo sapiens
accctgggtcatatacagtgtg

SEQ ID NO: 7567708 - DNA, 22 bp, Homo sapiens
accctgggtcatatacagtgtg

SEQ ID NO: 7567709 - DNA, 22 bp, Homo sapiens
accctgggtcatatacagtgtg

SEQ ID NO: 7567710 - DNA, 22 bp, Homo sapiens
accctgggtatttcccaaactt

SEQ ID NO: 7567711 - DNA, 22 bp, Homo sapiens
accctgggtatttcccaaactt

SEQ ID NO: 7567712 - DNA, 22 bp, Homo sapiens
accctgggtatttcccaaactt

SEQ ID NO: 7567713 - DNA, 16 bp, Homo sapiens
accctgggtagtcctg

SEQ ID NO: 7567714 - DNA, 22 bp, Homo sapiens
accctggggtcacccttctctg

SEQ ID NO: 7567715 - DNA, 22 bp, Homo sapiens
accctggggtcacccttctctg

SEQ ID NO: 7567716 - DNA, 22 bp, Homo sapiens
accctgggggtggccagtgcca

SEQ ID NO: 7567717 - DNA, 22 bp, Homo sapiens
accctgggggtggccagtgcca

SEQ ID NO: 7567718 - DNA, 22 bp, Homo sapiens
accctgggcttggcctgctcag

SEQ ID NO: 7567719 - DNA, 22 bp, Homo sapiens
accctgggggtggccagtgcca

SEQ ID NO: 7567720 - DNA, 22 bp, Homo sapiens
accctgggggtggccagtgcca

SEQ ID NO: 7567721 - DNA, 22 bp, Homo sapiens
accctgggggtggccagtgcca

SEQ ID NO: 7567722 - DNA, 22 bp, Homo sapiens
accaggagggaccctggtggcc

SEQ ID NO: 7567723 - DNA, 22 bp, Homo sapiens
accaggagggaccctggtggcc

SEQ ID NO: 7567724 - DNA, 22 bp, Homo sapiens
accaggagggaccctggtggcc

SEQ ID NO: 7567725 - DNA, 22 bp, Homo sapiens
accaggaggtgtttgctcaagt

SEQ ID NO: 7567726 - DNA, 22 bp, Homo sapiens
accaggaggtgtttgctcaagt

SEQ ID NO: 7567727 - DNA, 22 bp, Homo sapiens
accaggaggtgtttgctcaagt

SEQ ID NO: 7567728 - DNA, 22 bp, Homo sapiens
accaggagtaacagtgagtggt

SEQ ID NO: 7567729 - DNA, 22 bp, Homo sapiens
accaggaggctacactgtccca

SEQ ID NO: 7567730 - DNA, 22 bp, Homo sapiens
accaggagggaccctggtggcc

SEQ ID NO: 7567731 - DNA, 22 bp, Homo sapiens
accaggagggaccctggtggcc

SEQ ID NO: 7567732 - DNA, 22 bp, Homo sapiens
accaggagggaccctggtggcc

SEQ ID NO: 7567733 - DNA, 22 bp, Homo sapiens
accaggagggaccctggtggcc

SEQ ID NO: 7567734 - DNA, 22 bp, Homo sapiens
accaggagtaacagtgagtggt

SEQ ID NO: 7567735 - DNA, 22 bp, Homo sapiens
accaggagtaacagtgagtggt

SEQ ID NO: 7567736 - DNA, 22 bp, Homo sapiens
accaggagtagaatatctgtga

SEQ ID NO: 7567737 - DNA, 19 bp, Homo sapiens
accaggagtatcagagctg

SEQ ID NO: 7567738 - DNA, 19 bp, Homo sapiens
accaggagtatcagagctg

SEQ ID NO: 7567739 - DNA, 19 bp, Homo sapiens
accaggagtatcagagctg

SEQ ID NO: 7567740 - DNA, 22 bp, Homo sapiens
accaggagtagaatatctgtga

SEQ ID NO: 7567741 - DNA, 19 bp, Homo sapiens
accaggagtatcagagctg

SEQ ID NO: 7567742 - DNA, 19 bp, Homo sapiens
accaggagtatcagagctg

SEQ ID NO: 7567743 - DNA, 22 bp, Homo sapiens
accagggcacattccggccaga

SEQ ID NO: 7567744 - DNA, 22 bp, Homo sapiens
accagggcagccgaggtgtgtc

SEQ ID NO: 7567745 - DNA, 22 bp, Homo sapiens
accagggcagccgaggtgtgtc

SEQ ID NO: 7567746 - DNA, 22 bp, Homo sapiens
accagggcagccgaggtgtgtc

SEQ ID NO: 7567747 - DNA, 22 bp, Homo sapiens
accaggctgttgggcccagtgt

SEQ ID NO: 7567748 - DNA, 22 bp, Homo sapiens
accaggctgttgggcccagtgt

SEQ ID NO: 7567749 - DNA, 22 bp, Homo sapiens
accagggcacattccggccaga

SEQ ID NO: 7567750 - DNA, 22 bp, Homo sapiens
accaggctgtgaagtgagacta

SEQ ID NO: 7567751 - DNA, 22 bp, Homo sapiens
accaggctgttgggcccagtgt

SEQ ID NO: 7567752 - DNA, 22 bp, Homo sapiens
accaggagtctagcctagtcaa

SEQ ID NO: 7567753 - DNA, 22 bp, Homo sapiens
accaggagtctagcctagtcaa

SEQ ID NO: 7567754 - DNA, 22 bp, Homo sapiens
accaggagtctagcctagtcaa

SEQ ID NO: 7567755 - DNA, 22 bp, Homo sapiens
accaggagttgggggtgggacc

SEQ ID NO: 7567756 - DNA, 22 bp, Homo sapiens
accaggagttgggggtgggacc

SEQ ID NO: 7567757 - DNA, 22 bp, Homo sapiens
accaggagtctagcctagtcaa

SEQ ID NO: 7567758 - DNA, 22 bp, Homo sapiens
accaggctgtgaagtgagacta

SEQ ID NO: 7567759 - DNA, 22 bp, Homo sapiens
accaggctgtgaagtgagacta

SEQ ID NO: 7567760 - DNA, 22 bp, Homo sapiens
accaggagttgggggtgggacc

SEQ ID NO: 7567761 - DNA, 22 bp, Homo sapiens
accaggctgtgaagtgagacta

SEQ ID NO: 7567762 - DNA, 22 bp, Homo sapiens
accagggttgagtcagctgcgt

SEQ ID NO: 7567763 - DNA, 22 bp, Homo sapiens
accagggttgagtcagctgcgt

SEQ ID NO: 7567764 - DNA, 22 bp, Homo sapiens
accaggggtgtcaacagcattt

SEQ ID NO: 7567765 - DNA, 22 bp, Homo sapiens
accaggggtgtcaacagcattt

SEQ ID NO: 7567766 - DNA, 22 bp, Homo sapiens
accaggggtgtcaacagcattt

SEQ ID NO: 7567767 - DNA, 22 bp, Homo sapiens
accaggggatggttggcactgt

SEQ ID NO: 7567768 - DNA, 22 bp, Homo sapiens
accaggggatggttggcactgt

SEQ ID NO: 7567769 - DNA, 22 bp, Homo sapiens
accagggcttacagcagtagct

SEQ ID NO: 7567770 - DNA, 22 bp, Homo sapiens
accagggcttacagcagtagct

SEQ ID NO: 7567771 - DNA, 22 bp, Homo sapiens
accagggctgggataggtcagg

SEQ ID NO: 7567772 - DNA, 22 bp, Homo sapiens
accagggcccgggagagctctc

SEQ ID NO: 7567773 - DNA, 22 bp, Homo sapiens
accagggctgacaatctgatgg

SEQ ID NO: 7567774 - DNA, 22 bp, Homo sapiens
accagggctgacaatctgatgg

SEQ ID NO: 7567775 - DNA, 22 bp, Homo sapiens
accagggctgggataggtcagg

SEQ ID NO: 7567776 - DNA, 22 bp, Homo sapiens
accagggcttacagcagtagct

SEQ ID NO: 7567777 - DNA, 22 bp, Homo sapiens
accagggcttacagcagtagct

SEQ ID NO: 7567778 - DNA, 22 bp, Homo sapiens
accagggcttacagcagtagct

SEQ ID NO: 7567779 - DNA, 22 bp, Homo sapiens
accagggcagccgaggtgtgtc

SEQ ID NO: 7567780 - DNA, 22 bp, Homo sapiens
accagggcccgggagagctctc

SEQ ID NO: 7567781 - DNA, 22 bp, Homo sapiens
accagggcccgggagagctctc

SEQ ID NO: 7567782 - DNA, 22 bp, Homo sapiens
accagggcggcttgaggaggca

SEQ ID NO: 7567783 - DNA, 22 bp, Homo sapiens
accagggcggcttgaggaggca

SEQ ID NO: 7567784 - DNA, 22 bp, Homo sapiens
accagggcggcttgaggaggca

SEQ ID NO: 7567785 - DNA, 22 bp, Homo sapiens
accagggcggcttgaggaggca

SEQ ID NO: 7567786 - DNA, 22 bp, Homo sapiens
accagggccgcgggcgactagc

SEQ ID NO: 7567787 - DNA, 22 bp, Homo sapiens
accagggccgcgggcgactagc

SEQ ID NO: 7567788 - DNA, 22 bp, Homo sapiens
accagggccgcgggcgactagc

SEQ ID NO: 7567789 - DNA, 22 bp, Homo sapiens
accagggcggcttgaggaggca

SEQ ID NO: 7567790 - DNA, 22 bp, Homo sapiens
accatacacaatttgcaacggt

SEQ ID NO: 7567791 - DNA, 22 bp, Homo sapiens
accataattacttggctttttc

SEQ ID NO: 7567792 - DNA, 20 bp, Homo sapiens
accataatgttaattacaaa

SEQ ID NO: 7567793 - DNA, 22 bp, Homo sapiens
accatacattaaatgactttca

SEQ ID NO: 7567794 - DNA, 22 bp, Homo sapiens
accatacattaaatgactttca

SEQ ID NO: 7567795 - DNA, 22 bp, Homo sapiens
accatacttgaaatggatagga

SEQ ID NO: 7567796 - DNA, 22 bp, Homo sapiens
accatataacaagtttaggaga

SEQ ID NO: 7567797 - DNA, 22 bp, Homo sapiens
accatagttataacaaagtgtt

SEQ ID NO: 7567798 - DNA, 22 bp, Homo sapiens
accagttttttatacatcttct

SEQ ID NO: 7567799 - DNA, 22 bp, Homo sapiens
accagtttgtaacctgttttca

SEQ ID NO: 7567800 - DNA, 22 bp, Homo sapiens
accagtttgtaacctgttttca

SEQ ID NO: 7567801 - DNA, 22 bp, Homo sapiens
accagttctttctctgtttctg

SEQ ID NO: 7567802 - DNA, 22 bp, Homo sapiens
accagttattagccctacaact

SEQ ID NO: 7567803 - DNA, 23 bp, Homo sapiens
agggcccaagcctggacagcagg

SEQ ID NO: 7567804 - DNA, 23 bp, Homo sapiens
agggcccaagcctggacagcagg

SEQ ID NO: 7567805 - DNA, 23 bp, Homo sapiens
agggcccaagcctggacagcagg

SEQ ID NO: 7567806 - DNA, 22 bp, Homo sapiens
agggccagttctacctctgaat

SEQ ID NO: 7567807 - DNA, 22 bp, Homo sapiens
agggcctcctaatttcctcata

SEQ ID NO: 7567808 - DNA, 23 bp, Homo sapiens
agggcccaagcctggacagcagg

SEQ ID NO: 7567809 - DNA, 22 bp, Homo sapiens
agggcctcctagagaatctcca

SEQ ID NO: 7567810 - DNA, 22 bp, Homo sapiens
agggcctcgaaggcagagggat

SEQ ID NO: 7567811 - DNA, 22 bp, Homo sapiens
agggcctcgggctcagtgggtc

SEQ ID NO: 7567812 - DNA, 22 bp, Homo sapiens
agggcctctaccatccaaggtt

SEQ ID NO: 7567813 - DNA, 21 bp, Homo sapiens
agggcctctcatttgtgccag

SEQ ID NO: 7567814 - DNA, 21 bp, Homo sapiens
agggcctctcatttgtgccag

SEQ ID NO: 7567815 - DNA, 22 bp, Homo sapiens
agggcctcgggctcagtgggtc

SEQ ID NO: 7567816 - DNA, 20 bp, Homo sapiens
accaggtggctgatgacacc

SEQ ID NO: 7567817 - DNA, 22 bp, Homo sapiens
accaggtggccccagcgtggtt

SEQ ID NO: 7567818 - DNA, 20 bp, Homo sapiens
accaggtggctgatgacacc

SEQ ID NO: 7567819 - DNA, 20 bp, Homo sapiens
accaggtggctgatgacacc

SEQ ID NO: 7567820 - DNA, 22 bp, Homo sapiens
accaggttggtgtccttctggc

SEQ ID NO: 7567821 - DNA, 22 bp, Homo sapiens
accagtaagatcctgtacatac

SEQ ID NO: 7567822 - DNA, 22 bp, Homo sapiens
accaggtggccccagcgtggtt

SEQ ID NO: 7567823 - DNA, 22 bp, Homo sapiens
accagggttgagtcagctgcgt

SEQ ID NO: 7567824 - DNA, 22 bp, Homo sapiens
accaggtaatgtaaagcagggt

SEQ ID NO: 7567825 - DNA, 22 bp, Homo sapiens
accaggtaccttacacttggct

SEQ ID NO: 7567826 - DNA, 22 bp, Homo sapiens
accaggtggccccagcgtggtt

SEQ ID NO: 7567827 - DNA, 22 bp, Homo sapiens
accagtccgcggagctccgggg

SEQ ID NO: 7567828 - DNA, 22 bp, Homo sapiens
accagtctgttgttgcagagtg

SEQ ID NO: 7567829 - DNA, 22 bp, Homo sapiens
accagtctaggcaatgggggct

SEQ ID NO: 7567830 - DNA, 22 bp, Homo sapiens
accagtctgttgttgcagagtg

SEQ ID NO: 7567831 - DNA, 21 bp, Homo sapiens
accagtccctagtcttatcct

SEQ ID NO: 7567832 - DNA, 23 bp, Homo sapiens
accagtccattcccctcatgatt

SEQ ID NO: 7567833 - DNA, 22 bp, Homo sapiens
accagtatgtgccttcagtgtc

SEQ ID NO: 7567834 - DNA, 22 bp, Homo sapiens
accagtaagatcctgtacatac

SEQ ID NO: 7567835 - DNA, 22 bp, Homo sapiens
accagtcatagaaagcagtggt

SEQ ID NO: 7567836 - DNA, 22 bp, Homo sapiens
accagtgtcttattgaccatct

SEQ ID NO: 7567837 - DNA, 22 bp, Homo sapiens
accagtgtcaccccaaccagga

SEQ ID NO: 7567838 - DNA, 22 bp, Homo sapiens
accagtgtcttattgaccatct

SEQ ID NO: 7567839 - DNA, 22 bp, Homo sapiens
accagtgtcttattgaccatct

SEQ ID NO: 7567840 - DNA, 22 bp, Homo sapiens
accagtgttctggaatcctatg

SEQ ID NO: 7567841 - DNA, 22 bp, Homo sapiens
accagtgtcttattgaccatct

SEQ ID NO: 7567842 - DNA, 22 bp, Homo sapiens
accagttaaagggaaattgaaa

SEQ ID NO: 7567843 - DNA, 22 bp, Homo sapiens
accagttacagcttatgtttga

SEQ ID NO: 7567844 - DNA, 22 bp, Homo sapiens
accagtggatgaatgctggacc

SEQ ID NO: 7567845 - DNA, 22 bp, Homo sapiens
accagtgggtgtcattccctta

SEQ ID NO: 7567846 - DNA, 22 bp, Homo sapiens
accagtgtcaccccaaccagga

SEQ ID NO: 7567847 - DNA, 22 bp, Homo sapiens
accagtgtcaccccaaccagga

SEQ ID NO: 7567848 - DNA, 22 bp, Homo sapiens
accagtgcttcctgctggagct

SEQ ID NO: 7567849 - DNA, 22 bp, Homo sapiens
accagtgcttcctgctggagct

SEQ ID NO: 7567850 - DNA, 22 bp, Homo sapiens
accagtggatgaatgctggacc

SEQ ID NO: 7567851 - DNA, 22 bp, Homo sapiens
accagtcttgttgccatgtctg

SEQ ID NO: 7567852 - DNA, 22 bp, Homo sapiens
accagtcttgttgccatgtctg

SEQ ID NO: 7567853 - DNA, 22 bp, Homo sapiens
accagtcttgttgccatgtctg

SEQ ID NO: 7567854 - DNA, 22 bp, Homo sapiens
accagtgacttcattcctaaaa

SEQ ID NO: 7567855 - DNA, 22 bp, Homo sapiens
accagtgagtatttgtaacaga

SEQ ID NO: 7567856 - DNA, 22 bp, Homo sapiens
accagtgagtatttgtaacaga

SEQ ID NO: 7567857 - DNA, 22 bp, Homo sapiens
accagtgagtatttgtaacaga

SEQ ID NO: 7567858 - DNA, 22 bp, Homo sapiens
accagtgagtatttgtaacaga

SEQ ID NO: 7567859 - DNA, 22 bp, Homo sapiens
accaggagcattttttattagt

SEQ ID NO: 7567860 - DNA, 23 bp, Homo sapiens
accaggagccaagatctccctgg

SEQ ID NO: 7567861 - DNA, 23 bp, Homo sapiens
accaggagccaagatctccctgg

SEQ ID NO: 7567862 - DNA, 22 bp, Homo sapiens
accaggagcattttttattagt

SEQ ID NO: 7567863 - DNA, 22 bp, Homo sapiens
accaggagcattttttattagt

SEQ ID NO: 7567864 - DNA, 22 bp, Homo sapiens
accaggagaggcacttgcaatg

SEQ ID NO: 7567865 - DNA, 22 bp, Homo sapiens
accaggagaggcacttgcaatg

SEQ ID NO: 7567866 - DNA, 22 bp, Homo sapiens
accaggagacatgaccaatgag

SEQ ID NO: 7567867 - DNA, 20 bp, Homo sapiens
accaggagatggaggcaggg

SEQ ID NO: 7567868 - DNA, 20 bp, Homo sapiens
accaggagatggaggcaggg

SEQ ID NO: 7567869 - DNA, 20 bp, Homo sapiens
accaggagatggaggcaggg

SEQ ID NO: 7567870 - DNA, 22 bp, Homo sapiens
accaggagccacaggaggagcc

SEQ ID NO: 7567871 - DNA, 22 bp, Homo sapiens
accaggagccacaggaggagcc

SEQ ID NO: 7567872 - DNA, 23 bp, Homo sapiens
accaggagccaagatctccctgg

SEQ ID NO: 7567873 - DNA, 23 bp, Homo sapiens
accaggagccaagatctccctgg

SEQ ID NO: 7567874 - DNA, 23 bp, Homo sapiens
accaggagccaagatctccctgg

SEQ ID NO: 7567875 - DNA, 22 bp, Homo sapiens
accaggagccacaggaggagcc

SEQ ID NO: 7567876 - DNA, 22 bp, Homo sapiens
accaggagccacaggaggagcc

SEQ ID NO: 7567877 - DNA, 22 bp, Homo sapiens
accaggagccacaggaggagcc

SEQ ID NO: 7567878 - DNA, 22 bp, Homo sapiens
accaggagccacaggaggagcc

SEQ ID NO: 7567879 - DNA, 22 bp, Homo sapiens
accaggagccatagagtcaggc

SEQ ID NO: 7567880 - DNA, 22 bp, Homo sapiens
accaggagccatagagtcaggc

SEQ ID NO: 7567881 - DNA, 22 bp, Homo sapiens
accaggaggaagtgttaatgat

SEQ ID NO: 7567882 - DNA, 22 bp, Homo sapiens
accaggaggaagtgttaatgat

SEQ ID NO: 7567883 - DNA, 22 bp, Homo sapiens
accaggaggaagtgttaatgat

SEQ ID NO: 7567884 - DNA, 22 bp, Homo sapiens
accaggaggaagtgttaatgat

SEQ ID NO: 7567885 - DNA, 22 bp, Homo sapiens
accaggaggaagtgttaatgat

SEQ ID NO: 7567886 - DNA, 22 bp, Homo sapiens
accaggaggcctggagcacaaa

SEQ ID NO: 7567887 - DNA, 22 bp, Homo sapiens
accaggaggcctggagcacaaa

SEQ ID NO: 7567888 - DNA, 22 bp, Homo sapiens
accaggaggcctggagcacaaa

SEQ ID NO: 7567889 - DNA, 22 bp, Homo sapiens
accaggaggcctggagcacaaa

SEQ ID NO: 7567890 - DNA, 22 bp, Homo sapiens
accaggaggctacactgtccca

SEQ ID NO: 7567891 - DNA, 22 bp, Homo sapiens
accaggaggccttggttctgag

SEQ ID NO: 7567892 - DNA, 22 bp, Homo sapiens
accaggaggctacactgtccca

SEQ ID NO: 7567893 - DNA, 22 bp, Homo sapiens
accaggaggccttggttctgag

SEQ ID NO: 7567894 - DNA, 22 bp, Homo sapiens
accaggactaataaaaatgttc

SEQ ID NO: 7567895 - DNA, 22 bp, Homo sapiens
accaggacttcattaggttctt

SEQ ID NO: 7567896 - DNA, 22 bp, Homo sapiens
accaggacttcattaggttctt

SEQ ID NO: 7567897 - DNA, 22 bp, Homo sapiens
accaggactttgtattcagctt

SEQ ID NO: 7567898 - DNA, 20 bp, Homo sapiens
accaggacaagacaaaagtg

SEQ ID NO: 7567899 - DNA, 22 bp, Homo sapiens
accaggacattttagtcatctt

SEQ ID NO: 7567900 - DNA, 22 bp, Homo sapiens
accaggacattttagtcatctt

SEQ ID NO: 7567901 - DNA, 20 bp, Homo sapiens
accaggaatcttttctgagc

SEQ ID NO: 7567902 - DNA, 23 bp, Homo sapiens
accaggagaaaagctttgcggga

SEQ ID NO: 7567903 - DNA, 22 bp, Homo sapiens
accaggactttgtattcagctt

SEQ ID NO: 7567904 - DNA, 22 bp, Homo sapiens
accaggactttgtattcagctt

SEQ ID NO: 7567905 - DNA, 23 bp, Homo sapiens
accaggagaaaagctttgcggga

SEQ ID NO: 7567906 - DNA, 19 bp, Homo sapiens
accaggagacagtgagctt

SEQ ID NO: 7567907 - DNA, 19 bp, Homo sapiens
accaggagacagtgagctt

SEQ ID NO: 7567908 - DNA, 19 bp, Homo sapiens
accaggagacagtgagctt

SEQ ID NO: 7567909 - DNA, 22 bp, Homo sapiens
accaggagagattttattgaga

SEQ ID NO: 7567910 - DNA, 22 bp, Homo sapiens
accaggagagattttattgaga

SEQ ID NO: 7567911 - DNA, 22 bp, Homo sapiens
accaggagaggcacttgcaatg

SEQ ID NO: 7567912 - DNA, 20 bp, Homo sapiens
accaggagatggaggcaggg

SEQ ID NO: 7567913 - DNA, 22 bp, Homo sapiens
accaggagaggcacttgcaatg

SEQ ID NO: 7567914 - DNA, 19 bp, Homo sapiens
accaggagacagtgagctt

SEQ ID NO: 7567915 - DNA, 19 bp, Homo sapiens
accaggagacagtgagctt

SEQ ID NO: 7567916 - DNA, 22 bp, Homo sapiens
accaggagacatgaccaatgag

SEQ ID NO: 7567917 - DNA, 22 bp, Homo sapiens
accaggagacatgaccaatgag

SEQ ID NO: 7567918 - DNA, 22 bp, Homo sapiens
accaggaagaacaggcaaggca

SEQ ID NO: 7567919 - DNA, 19 bp, Homo sapiens
accaggaacttccctaggc

SEQ ID NO: 7567920 - DNA, 22 bp, Homo sapiens
accaggaagagattccaattta

SEQ ID NO: 7567921 - DNA, 19 bp, Homo sapiens
accaggaacttccctaggc

SEQ ID NO: 7567922 - DNA, 22 bp, Homo sapiens
accagctgagtaggggagggcc

SEQ ID NO: 7567923 - DNA, 19 bp, Homo sapiens
accaggaacttccctaggc

SEQ ID NO: 7567924 - DNA, 22 bp, Homo sapiens
accaggaacaagccatggagga

SEQ ID NO: 7567925 - DNA, 22 bp, Homo sapiens
accaggaagctgtgagaccttt

SEQ ID NO: 7567926 - DNA, 22 bp, Homo sapiens
accaggaagagattccaattta

SEQ ID NO: 7567927 - DNA, 22 bp, Homo sapiens
accaggaagcatccctttgtaa

SEQ ID NO: 7567928 - DNA, 18 bp, Homo sapiens
accaggaagcttcttgtc

SEQ ID NO: 7567929 - DNA, 18 bp, Homo sapiens
accaggaagcttcttgtc

SEQ ID NO: 7567930 - DNA, 20 bp, Homo sapiens
accaggaatcttttctgagc

SEQ ID NO: 7567931 - DNA, 22 bp, Homo sapiens
accaggaatattttgctcattt

SEQ ID NO: 7567932 - DNA, 22 bp, Homo sapiens
accaggaatattttgctcattt

SEQ ID NO: 7567933 - DNA, 22 bp, Homo sapiens
accaggaagtgtgggccaacgt

SEQ ID NO: 7567934 - DNA, 22 bp, Homo sapiens
accaggaagtgtgggccaacgt

SEQ ID NO: 7567935 - DNA, 22 bp, Homo sapiens
accaaagggcagaacatgagca

SEQ ID NO: 7567936 - DNA, 22 bp, Homo sapiens
accaaaggctatgggacctgcc

SEQ ID NO: 7567937 - DNA, 22 bp, Homo sapiens
accaaaggcagagctgaacact

SEQ ID NO: 7567938 - DNA, 22 bp, Homo sapiens
aggcttcctcgtgccttagata

SEQ ID NO: 7567939 - DNA, 23 bp, Homo sapiens
aggcttcctatcttagagctggg

SEQ ID NO: 7567940 - DNA, 23 bp, Homo sapiens
aggcttcctatcttagagctggg

SEQ ID NO: 7567941 - DNA, 22 bp, Homo sapiens
accaaaggctcctgaagaactg

SEQ ID NO: 7567942 - DNA, 22 bp, Homo sapiens
accaaagggcagaacatgagca

SEQ ID NO: 7567943 - DNA, 22 bp, Homo sapiens
accaaatgtttttccagaaatg

SEQ ID NO: 7567944 - DNA, 23 bp, Homo sapiens
accaacaagcctctggagagtgg

SEQ ID NO: 7567945 - DNA, 23 bp, Homo sapiens
accaacaagcctctggagagtgg

SEQ ID NO: 7567946 - DNA, 22 bp, Homo sapiens
accaaatgctgacagcatgact

SEQ ID NO: 7567947 - DNA, 22 bp, Homo sapiens
accaaatgctgacagcatgact

SEQ ID NO: 7567948 - DNA, 22 bp, Homo sapiens
accaaatgcttggctgctgtga

SEQ ID NO: 7567949 - DNA, 22 bp, Homo sapiens
accaaggagaaggtgcaagctt

SEQ ID NO: 7567950 - DNA, 22 bp, Homo sapiens
accaaggagaaggtgcaagctt

SEQ ID NO: 7567951 - DNA, 22 bp, Homo sapiens
accaaggaagagattctcagtt

SEQ ID NO: 7567952 - DNA, 22 bp, Homo sapiens
accaaggagaaggtgcaagctt

SEQ ID NO: 7567953 - DNA, 22 bp, Homo sapiens
accaaggaagagattctcagtt

SEQ ID NO: 7567954 - DNA, 22 bp, Homo sapiens
accaaggaagaatctatttgag

SEQ ID NO: 7567955 - DNA, 22 bp, Homo sapiens
accaagctctcttcccggctct

SEQ ID NO: 7567956 - DNA, 22 bp, Homo sapiens
accaagcacaaagatgagtaaa

SEQ ID NO: 7567957 - DNA, 22 bp, Homo sapiens
accaagagtccaagtgaggttg

SEQ ID NO: 7567958 - DNA, 22 bp, Homo sapiens
accaagagccctcatgctaaga

SEQ ID NO: 7567959 - DNA, 22 bp, Homo sapiens
accaagagccctcatgctaaga

SEQ ID NO: 7567960 - DNA, 22 bp, Homo sapiens
accaagagccctcatgctaaga

SEQ ID NO: 7567961 - DNA, 22 bp, Homo sapiens
accaagaaacaaccctcttctg

SEQ ID NO: 7567962 - DNA, 22 bp, Homo sapiens
accaacatgtcctcacacagcc

SEQ ID NO: 7567963 - DNA, 23 bp, Homo sapiens
accaacaagcctctggagagtgg

SEQ ID NO: 7567964 - DNA, 22 bp, Homo sapiens
accaacatgtcctcacacagcc

SEQ ID NO: 7567965 - DNA, 22 bp, Homo sapiens
accacactggctagtgaagaag

SEQ ID NO: 7567966 - DNA, 22 bp, Homo sapiens
accacagaggaatttgaagagg

SEQ ID NO: 7567967 - DNA, 22 bp, Homo sapiens
accaatttttacagctgtggtt

SEQ ID NO: 7567968 - DNA, 22 bp, Homo sapiens
accaattttagagcaccaagaa

SEQ ID NO: 7567969 - DNA, 22 bp, Homo sapiens
accaatttttcctgaagggcat

SEQ ID NO: 7567970 - DNA, 22 bp, Homo sapiens
accacaaacttagtggtgcaaa

SEQ ID NO: 7567971 - DNA, 20 bp, Homo sapiens
accaatttcagaggtgcaga

SEQ ID NO: 7567972 - DNA, 20 bp, Homo sapiens
accaatttcagaggtgcaga

SEQ ID NO: 7567973 - DNA, 22 bp, Homo sapiens
accaatttcttggcttccaaat

SEQ ID NO: 7567974 - DNA, 22 bp, Homo sapiens
accaattttagagcaccaagaa

SEQ ID NO: 7567975 - DNA, 22 bp, Homo sapiens
accaatttcttggcttccaaat

SEQ ID NO: 7567976 - DNA, 22 bp, Homo sapiens
accaatttcttggcttccaaat

SEQ ID NO: 7567977 - DNA, 22 bp, Homo sapiens
accaaggagccacatacaacct

SEQ ID NO: 7567978 - DNA, 22 bp, Homo sapiens
accaaggctaaaataacatgtt

SEQ ID NO: 7567979 - DNA, 22 bp, Homo sapiens
accaaggagtttggtattttag

SEQ ID NO: 7567980 - DNA, 22 bp, Homo sapiens
accaatctgcttaaatgctgac

SEQ ID NO: 7567981 - DNA, 22 bp, Homo sapiens
accaatgccattttctacacat

SEQ ID NO: 7567982 - DNA, 22 bp, Homo sapiens
accaatgcatgattttgtctgg

SEQ ID NO: 7567983 - DNA, 22 bp, Homo sapiens
accaatataagtataggtaagt

SEQ ID NO: 7567984 - DNA, 22 bp, Homo sapiens
accaatataagtataggtaagt

SEQ ID NO: 7567985 - DNA, 22 bp, Homo sapiens
accaatcaaaatgtatggagct

SEQ ID NO: 7567986 - DNA, 22 bp, Homo sapiens
accacaggaattgctctgtggt

SEQ ID NO: 7567987 - DNA, 22 bp, Homo sapiens
accacaggaattgctctgtggt

SEQ ID NO: 7567988 - DNA, 22 bp, Homo sapiens
accacaggaattgctctgtggt

SEQ ID NO: 7567989 - DNA, 22 bp, Homo sapiens
accacaggaattgctctgtggt

SEQ ID NO: 7567990 - DNA, 22 bp, Homo sapiens
accacaggaattgctctgtggt

SEQ ID NO: 7567991 - DNA, 22 bp, Homo sapiens
accacagctttgcaccaggtgt

SEQ ID NO: 7567992 - DNA, 22 bp, Homo sapiens
accacaggaattgctctgtggt

SEQ ID NO: 7567993 - DNA, 22 bp, Homo sapiens
accacagaggaatttgaagagg

SEQ ID NO: 7567994 - DNA, 22 bp, Homo sapiens
accacagctttgcaccaggtgt

SEQ ID NO: 7567995 - DNA, 22 bp, Homo sapiens
accagctgaactgcagcccagg

SEQ ID NO: 7567996 - DNA, 22 bp, Homo sapiens
accagctgagtaggggagggcc

SEQ ID NO: 7567997 - DNA, 22 bp, Homo sapiens
accaggaacaagccatggagga

SEQ ID NO: 7567998 - DNA, 22 bp, Homo sapiens
accaggaacaagccatggagga

SEQ ID NO: 7567999 - DNA, 22 bp, Homo sapiens
accaggaacaagccatggagga

SEQ ID NO: 7568000 - DNA, 22 bp, Homo sapiens
accagctgaactgcagcccagg

SEQ ID NO: 7568001 - DNA, 22 bp, Homo sapiens
accagctgaactgcagcccagg

SEQ ID NO: 7568002 - DNA, 22 bp, Homo sapiens
accagctctttcttttcactat

SEQ ID NO: 7568003 - DNA, 22 bp, Homo sapiens
accagctctttcttttcactat

SEQ ID NO: 7568004 - DNA, 22 bp, Homo sapiens
accagctcttctgctctagttg

SEQ ID NO: 7568005 - DNA, 22 bp, Homo sapiens
accacaggaattgctctgtggt

SEQ ID NO: 7568006 - DNA, 22 bp, Homo sapiens
acatcttttttctctaattgtg

SEQ ID NO: 7568007 - DNA, 22 bp, Homo sapiens
acatgaaaactggttccttcag

SEQ ID NO: 7568008 - DNA, 22 bp, Homo sapiens
acatgaaaactggttccttcag

SEQ ID NO: 7568009 - DNA, 22 bp, Homo sapiens
acatgaaaactggttccttcag

SEQ ID NO: 7568010 - DNA, 22 bp, Homo sapiens
acatgaaaactggttccttcag

SEQ ID NO: 7568011 - DNA, 22 bp, Homo sapiens
acatgaaaaatgtttgcagttt

SEQ ID NO: 7568012 - DNA, 22 bp, Homo sapiens
acatgaaaactggttccttcag

SEQ ID NO: 7568013 - DNA, 22 bp, Homo sapiens
acatgaaaagactatctgatta

SEQ ID NO: 7568014 - DNA, 22 bp, Homo sapiens
acatgaaaagactatctgatta

SEQ ID NO: 7568015 - DNA, 22 bp, Homo sapiens
acatgaaacccagccgtggtcc

SEQ ID NO: 7568016 - DNA, 22 bp, Homo sapiens
acatgaaaagactatctgatta

SEQ ID NO: 7568017 - DNA, 22 bp, Homo sapiens
acatgaaaagactatctgatta

SEQ ID NO: 7568018 - DNA, 22 bp, Homo sapiens
acatgaaaagactatctgatta

SEQ ID NO: 7568019 - DNA, 22 bp, Homo sapiens
acatgaaaagactatctgatta

SEQ ID NO: 7568020 - DNA, 22 bp, Homo sapiens
acatgaaaagactatctgatta

SEQ ID NO: 7568021 - DNA, 22 bp, Homo sapiens
acatctttgtttcttagtgtat

SEQ ID NO: 7568022 - DNA, 22 bp, Homo sapiens
acatctttgctcttatagagct

SEQ ID NO: 7568023 - DNA, 22 bp, Homo sapiens
acatctttgctcttatagagct

SEQ ID NO: 7568024 - DNA, 22 bp, Homo sapiens
acatcttttactctggttcggg

SEQ ID NO: 7568025 - DNA, 22 bp, Homo sapiens
acatctttgtttcttagtgtat

SEQ ID NO: 7568026 - DNA, 22 bp, Homo sapiens
acatctttttggaaacggctga

SEQ ID NO: 7568027 - DNA, 22 bp, Homo sapiens
acatctttttggaaacggctga

SEQ ID NO: 7568028 - DNA, 22 bp, Homo sapiens
acatctttttggaaacggctga

SEQ ID NO: 7568029 - DNA, 22 bp, Homo sapiens
acatctttttggaaacggctga

SEQ ID NO: 7568030 - DNA, 22 bp, Homo sapiens
acatcttttttctctaattgtg

SEQ ID NO: 7568031 - DNA, 22 bp, Homo sapiens
acatcttttttctctaattgtg

SEQ ID NO: 7568032 - DNA, 22 bp, Homo sapiens
aggccagcctcaggcagggacc

SEQ ID NO: 7568033 - DNA, 22 bp, Homo sapiens
aggccagcctcaggcagggacc

SEQ ID NO: 7568034 - DNA, 22 bp, Homo sapiens
aggccagcctcaggcagggacc

SEQ ID NO: 7568035 - DNA, 22 bp, Homo sapiens
aggccagcctcaggcagggacc

SEQ ID NO: 7568036 - DNA, 22 bp, Homo sapiens
aggccagccctgggctgagaga

SEQ ID NO: 7568037 - DNA, 22 bp, Homo sapiens
acatctttgctcttatagagct

SEQ ID NO: 7568038 - DNA, 22 bp, Homo sapiens
acatctttgctcttatagagct

SEQ ID NO: 7568039 - DNA, 22 bp, Homo sapiens
aggccagcctcaggcagggacc

SEQ ID NO: 7568040 - DNA, 18 bp, Homo sapiens
aggccagccctgctactg

SEQ ID NO: 7568041 - DNA, 22 bp, Homo sapiens
aggccagccctcacctgtgttc

SEQ ID NO: 7568042 - DNA, 22 bp, Homo sapiens
aggccagccctcacctgtgttc

SEQ ID NO: 7568043 - DNA, 22 bp, Homo sapiens
aggccagccctcacctgtgttc

SEQ ID NO: 7568044 - DNA, 22 bp, Homo sapiens
aggccagccctcacctgtgttc

SEQ ID NO: 7568045 - DNA, 22 bp, Homo sapiens
aggccagcattctctctccagg

SEQ ID NO: 7568046 - DNA, 22 bp, Homo sapiens
aggccagcattctctctccagg

SEQ ID NO: 7568047 - DNA, 22 bp, Homo sapiens
aggccagccctcacctgtgttc

SEQ ID NO: 7568048 - DNA, 22 bp, Homo sapiens
aggccagccctcacctgtgttc

SEQ ID NO: 7568049 - DNA, 22 bp, Homo sapiens
aggccagccctcacctgtgttc

SEQ ID NO: 7568050 - DNA, 22 bp, Homo sapiens
aggccagccctgggctgagaga

SEQ ID NO: 7568051 - DNA, 22 bp, Homo sapiens
aggccagccctgggctgagaga

SEQ ID NO: 7568052 - DNA, 22 bp, Homo sapiens
aggccagccctgggctgagaga

SEQ ID NO: 7568053 - DNA, 22 bp, Homo sapiens
aggccagccctgggctgagaga

SEQ ID NO: 7568054 - DNA, 22 bp, Homo sapiens
aggccagccctgggctgagaga

SEQ ID NO: 7568055 - DNA, 18 bp, Homo sapiens
aggccagccctgctactg

SEQ ID NO: 7568056 - DNA, 18 bp, Homo sapiens
aggccagccctgctactg

SEQ ID NO: 7568057 - DNA, 18 bp, Homo sapiens
aggccagccctgctactg

SEQ ID NO: 7568058 - DNA, 18 bp, Homo sapiens
aggccagccctgctactg

SEQ ID NO: 7568059 - DNA, 22 bp, Homo sapiens
aggccagcagacgtgggactga

SEQ ID NO: 7568060 - DNA, 22 bp, Homo sapiens
aggccagcagacgtgggactga

SEQ ID NO: 7568061 - DNA, 22 bp, Homo sapiens
aggccagcagacgtgggactga

SEQ ID NO: 7568062 - DNA, 22 bp, Homo sapiens
aggccagcagacgtgggactga

SEQ ID NO: 7568063 - DNA, 22 bp, Homo sapiens
aggccagcatgcagttctaagg

SEQ ID NO: 7568064 - DNA, 22 bp, Homo sapiens
aggccagcagcatgacggcatc

SEQ ID NO: 7568065 - DNA, 22 bp, Homo sapiens
aggccagcagcatgacggcatc

SEQ ID NO: 7568066 - DNA, 22 bp, Homo sapiens
aggccagcagcatgacggcatc

SEQ ID NO: 7568067 - DNA, 22 bp, Homo sapiens
aggccagcattctctctccagg

SEQ ID NO: 7568068 - DNA, 22 bp, Homo sapiens
aggccagcattctctctccagg

SEQ ID NO: 7568069 - DNA, 22 bp, Homo sapiens
aggccagcattctctctccagg

SEQ ID NO: 7568070 - DNA, 22 bp, Homo sapiens
aggccagcattctctctccagg

SEQ ID NO: 7568071 - DNA, 22 bp, Homo sapiens
aggccagcattctctctccagg

SEQ ID NO: 7568072 - DNA, 22 bp, Homo sapiens
aggccagcattctctctccagg

SEQ ID NO: 7568073 - DNA, 22 bp, Homo sapiens
aggccagcatgcagttctaagg

SEQ ID NO: 7568074 - DNA, 22 bp, Homo sapiens
aggccagcatgcagttctaagg

SEQ ID NO: 7568075 - DNA, 22 bp, Homo sapiens
aggccagcattctctctccagg

SEQ ID NO: 7568076 - DNA, 22 bp, Homo sapiens
aggcccagctgggccaggaaca

SEQ ID NO: 7568077 - DNA, 22 bp, Homo sapiens
aggcccagcttgaagtgggaag

SEQ ID NO: 7568078 - DNA, 22 bp, Homo sapiens
aggcccagcttgaagtgggaag

SEQ ID NO: 7568079 - DNA, 22 bp, Homo sapiens
aggcccagcttgaagtgggaag

SEQ ID NO: 7568080 - DNA, 22 bp, Homo sapiens
aggcccagcttgaagtgggaag

SEQ ID NO: 7568081 - DNA, 22 bp, Homo sapiens
aggcccagcttgaagtgggaag

SEQ ID NO: 7568082 - DNA, 22 bp, Homo sapiens
aggccaggtggtcatgcttgct

SEQ ID NO: 7568083 - DNA, 22 bp, Homo sapiens
aggccaggtggtcatgcttgct

SEQ ID NO: 7568084 - DNA, 21 bp, Homo sapiens
aggcccagctttcctcttgct

SEQ ID NO: 7568085 - DNA, 21 bp, Homo sapiens
aggcccagctttcctcttgct

SEQ ID NO: 7568086 - DNA, 21 bp, Homo sapiens
aggcccagctttcctcttgct

SEQ ID NO: 7568087 - DNA, 22 bp, Homo sapiens
aggcccagcttgaagtgggaag

SEQ ID NO: 7568088 - DNA, 22 bp, Homo sapiens
aggcccagcttgaagtgggaag

SEQ ID NO: 7568089 - DNA, 22 bp, Homo sapiens
aggcccagcttgaagtgggaag

SEQ ID NO: 7568090 - DNA, 22 bp, Homo sapiens
aggcccagcttgaagtgggaag

SEQ ID NO: 7568091 - DNA, 22 bp, Homo sapiens
aggccaggtggtcatgcttgct

SEQ ID NO: 7568092 - DNA, 22 bp, Homo sapiens
aggccaggtggtcatgcttgct

SEQ ID NO: 7568093 - DNA, 20 bp, Homo sapiens
acatgaaaggaaacaggaaa

SEQ ID NO: 7568094 - DNA, 20 bp, Homo sapiens
acatgaaaggaaacaggaaa

SEQ ID NO: 7568095 - DNA, 20 bp, Homo sapiens
acatgaaaggaaacaggaaa

SEQ ID NO: 7568096 - DNA, 20 bp, Homo sapiens
acatgaaaggaaacaggaaa

SEQ ID NO: 7568097 - DNA, 22 bp, Homo sapiens
acatgaaactgttgcattagaa

SEQ ID NO: 7568098 - DNA, 22 bp, Homo sapiens
acatgaaacctgagtctaactc

SEQ ID NO: 7568099 - DNA, 22 bp, Homo sapiens
acatgaaactgttgcattagaa

SEQ ID NO: 7568100 - DNA, 20 bp, Homo sapiens
acatgaaaggaaacaggaaa

SEQ ID NO: 7568101 - DNA, 20 bp, Homo sapiens
acatgaaaggaaacaggaaa

SEQ ID NO: 7568102 - DNA, 20 bp, Homo sapiens
acatgaaaggaaacaggaaa

SEQ ID NO: 7568103 - DNA, 20 bp, Homo sapiens
acatgaaaggaaacaggaaa

SEQ ID NO: 7568104 - DNA, 20 bp, Homo sapiens
acatgaaaggaaacaggaaa

SEQ ID NO: 7568105 - DNA, 22 bp, Homo sapiens
acatgaaacctgagtctaactc

SEQ ID NO: 7568106 - DNA, 22 bp, Homo sapiens
acatgaaacctgagtctaactc

SEQ ID NO: 7568107 - DNA, 22 bp, Homo sapiens
acatgaaacctgagtctaactc

SEQ ID NO: 7568108 - DNA, 22 bp, Homo sapiens
aggccctgagcatccgagggca

SEQ ID NO: 7568109 - DNA, 22 bp, Homo sapiens
aggccctgagcatccgagggca

SEQ ID NO: 7568110 - DNA, 22 bp, Homo sapiens
aggccctgagcatccgagggca

SEQ ID NO: 7568111 - DNA, 22 bp, Homo sapiens
aggccctgagcatccgagggca

SEQ ID NO: 7568112 - DNA, 22 bp, Homo sapiens
aggccctgagcatccgagggca

SEQ ID NO: 7568113 - DNA, 22 bp, Homo sapiens
aggccctgagcatccgagggca

SEQ ID NO: 7568114 - DNA, 22 bp, Homo sapiens
aggccctgatccgaatccagat

SEQ ID NO: 7568115 - DNA, 22 bp, Homo sapiens
aggccctgatccgaatccagat

SEQ ID NO: 7568116 - DNA, 22 bp, Homo sapiens
aggccctgatccgaatccagat

SEQ ID NO: 7568117 - DNA, 22 bp, Homo sapiens
aggccctgatccgaatccagat

SEQ ID NO: 7568118 - DNA, 22 bp, Homo sapiens
aggccctgagcatccgagggca

SEQ ID NO: 7568119 - DNA, 22 bp, Homo sapiens
aggccctgagaaaatccctgca

SEQ ID NO: 7568120 - DNA, 22 bp, Homo sapiens
aggcccagtagtcgacggcgct

SEQ ID NO: 7568121 - DNA, 22 bp, Homo sapiens
aggcccagtagtcgacggcgct

SEQ ID NO: 7568122 - DNA, 23 bp, Homo sapiens
aggcccaggtatgtttgttttgg

SEQ ID NO: 7568123 - DNA, 22 bp, Homo sapiens
aggcccagtagtcgacggcgct

SEQ ID NO: 7568124 - DNA, 23 bp, Homo sapiens
aggcccaggtatgtttgttttgg

SEQ ID NO: 7568125 - DNA, 22 bp, Homo sapiens
aggcccagtagtcgacggcgct

SEQ ID NO: 7568126 - DNA, 22 bp, Homo sapiens
aggccctgagaaaatccctgca

SEQ ID NO: 7568127 - DNA, 22 bp, Homo sapiens
aggccctgagaaaatccctgca

SEQ ID NO: 7568128 - DNA, 22 bp, Homo sapiens
aggccctgagaaaatccctgca

SEQ ID NO: 7568129 - DNA, 21 bp, Homo sapiens
aggcccaggaatatgcatttt

SEQ ID NO: 7568130 - DNA, 21 bp, Homo sapiens
aggcccaggaatatgcatttt

SEQ ID NO: 7568131 - DNA, 21 bp, Homo sapiens
aggcccaggaatatgcatttt

SEQ ID NO: 7568132 - DNA, 22 bp, Homo sapiens
aggcccagggctgctctctgaa

SEQ ID NO: 7568133 - DNA, 22 bp, Homo sapiens
aggcccagggctgctctctgaa

SEQ ID NO: 7568134 - DNA, 22 bp, Homo sapiens
aggcccagggctgctctctgaa

SEQ ID NO: 7568135 - DNA, 22 bp, Homo sapiens
aggcccagggctgctctctgaa

SEQ ID NO: 7568136 - DNA, 22 bp, Homo sapiens
aggcccagggctgctctctgaa

SEQ ID NO: 7568137 - DNA, 22 bp, Homo sapiens
aggcccagggctgctctctgaa

SEQ ID NO: 7568138 - DNA, 23 bp, Homo sapiens
aggcccaggtatgtttgttttgg

SEQ ID NO: 7568139 - DNA, 22 bp, Homo sapiens
aggcccagggctgctctctgaa

SEQ ID NO: 7568140 - DNA, 22 bp, Homo sapiens
acatacatgggattaaaaaatt

SEQ ID NO: 7568141 - DNA, 22 bp, Homo sapiens
acatacatgggattaaaaaatt

SEQ ID NO: 7568142 - DNA, 22 bp, Homo sapiens
acatacatggattcatggattc

SEQ ID NO: 7568143 - DNA, 22 bp, Homo sapiens
acatacatgggattaaaaaatt

SEQ ID NO: 7568144 - DNA, 22 bp, Homo sapiens
acatacatgggattaaaaaatt

SEQ ID NO: 7568145 - DNA, 22 bp, Homo sapiens
acatacatgggattaaaaaatt

SEQ ID NO: 7568146 - DNA, 22 bp, Homo sapiens
acatacatggattcatggattc

SEQ ID NO: 7568147 - DNA, 22 bp, Homo sapiens
acatacatggattcatggattc

SEQ ID NO: 7568148 - DNA, 22 bp, Homo sapiens
acatacatggattcatggattc

SEQ ID NO: 7568149 - DNA, 22 bp, Homo sapiens
acatacatggattcatggattc

SEQ ID NO: 7568150 - DNA, 22 bp, Homo sapiens
acatacatggattcatggattc

SEQ ID NO: 7568151 - DNA, 22 bp, Homo sapiens
acatacatggattcatggattc

SEQ ID NO: 7568152 - DNA, 22 bp, Homo sapiens
acatacatggtgctttcttggt

SEQ ID NO: 7568153 - DNA, 22 bp, Homo sapiens
acatacatggtgctttcttggt

SEQ ID NO: 7568154 - DNA, 22 bp, Homo sapiens
acatacatgggattaaaaaatt

SEQ ID NO: 7568155 - DNA, 22 bp, Homo sapiens
acatacatgggattaaaaaatt

SEQ ID NO: 7568156 - DNA, 22 bp, Homo sapiens
acatacatgggattaaaaaatt

SEQ ID NO: 7568157 - DNA, 22 bp, Homo sapiens
acatacatgggattaaaaaatt

SEQ ID NO: 7568158 - DNA, 22 bp, Homo sapiens
aggcatggcattcctcaagcaa

SEQ ID NO: 7568159 - DNA, 22 bp, Homo sapiens
aggcatggcatggggcagatgt

SEQ ID NO: 7568160 - DNA, 22 bp, Homo sapiens
aggcatggctttaggcaggcgt

SEQ ID NO: 7568161 - DNA, 20 bp, Homo sapiens
aggcagttagaaggagatga

SEQ ID NO: 7568162 - DNA, 22 bp, Homo sapiens
aggcatggcatggggcagatgt

SEQ ID NO: 7568163 - DNA, 22 bp, Homo sapiens
aggcagtgttcttctaagggca

SEQ ID NO: 7568164 - DNA, 22 bp, Homo sapiens
acatacatgtaaaggaaattat

SEQ ID NO: 7568165 - DNA, 22 bp, Homo sapiens
acatacatgtaaaggaaattat

SEQ ID NO: 7568166 - DNA, 22 bp, Homo sapiens
acatacatgtaaaggaaattat

SEQ ID NO: 7568167 - DNA, 22 bp, Homo sapiens
acatacatgtaaaggaaattat

SEQ ID NO: 7568168 - DNA, 22 bp, Homo sapiens
acatacatgtaaaggaaattat

SEQ ID NO: 7568169 - DNA, 22 bp, Homo sapiens
acatacatggttctcagccctt

SEQ ID NO: 7568170 - DNA, 22 bp, Homo sapiens
acatacatggttctcagccctt

SEQ ID NO: 7568171 - DNA, 22 bp, Homo sapiens
acatacatggttctcagccctt

SEQ ID NO: 7568172 - DNA, 22 bp, Homo sapiens
acatacatggtgctttcttggt

SEQ ID NO: 7568173 - DNA, 22 bp, Homo sapiens
acatacatggtgctttcttggt

SEQ ID NO: 7568174 - DNA, 22 bp, Homo sapiens
acatacatggtgctttcttggt

SEQ ID NO: 7568175 - DNA, 20 bp, Homo sapiens
aggcatgggatgcccagatt

SEQ ID NO: 7568176 - DNA, 19 bp, Homo sapiens
aggcatgggaagagaagtc

SEQ ID NO: 7568177 - DNA, 19 bp, Homo sapiens
aggcatgggaagagaagtc

SEQ ID NO: 7568178 - DNA, 20 bp, Homo sapiens
aggcatgggatgcccagatt

SEQ ID NO: 7568179 - DNA, 20 bp, Homo sapiens
aggcatgggatgcccagatt

SEQ ID NO: 7568180 - DNA, 20 bp, Homo sapiens
aggcatgggatgcccagatt

SEQ ID NO: 7568181 - DNA, 20 bp, Homo sapiens
aggcatgggatgcccagatt

SEQ ID NO: 7568182 - DNA, 22 bp, Homo sapiens
aggcatggggctgcagtcaggt

SEQ ID NO: 7568183 - DNA, 22 bp, Homo sapiens
aggcatggggctgcagtcaggt

SEQ ID NO: 7568184 - DNA, 20 bp, Homo sapiens
aggcatgggatgcccagatt

SEQ ID NO: 7568185 - DNA, 20 bp, Homo sapiens
aggcatgggatgcccagatt

SEQ ID NO: 7568186 - DNA, 22 bp, Homo sapiens
aggcatgggtagaagagaagcc

SEQ ID NO: 7568187 - DNA, 22 bp, Homo sapiens
aggcatgggtagaagagaagcc

SEQ ID NO: 7568188 - DNA, 22 bp, Homo sapiens
aggcatgggtagaagagaagcc

SEQ ID NO: 7568189 - DNA, 22 bp, Homo sapiens
aggcatgggtagaagagaagcc

SEQ ID NO: 7568190 - DNA, 22 bp, Homo sapiens
aggcatggggctgcagtcaggt

SEQ ID NO: 7568191 - DNA, 22 bp, Homo sapiens
aggcatgggtagaagagaagcc

SEQ ID NO: 7568192 - DNA, 22 bp, Homo sapiens
aggcatggggctgcagtcaggt

SEQ ID NO: 7568193 - DNA, 22 bp, Homo sapiens
aggcatggggctgcagtcaggt

SEQ ID NO: 7568194 - DNA, 22 bp, Homo sapiens
aggcatggggctgcagtcaggt

SEQ ID NO: 7568195 - DNA, 22 bp, Homo sapiens
aggcatggggctgcagtcaggt

SEQ ID NO: 7568196 - DNA, 20 bp, Homo sapiens
aggcatgggatgcccagatt

SEQ ID NO: 7568197 - DNA, 22 bp, Homo sapiens
aggcatggggctgcagtcaggt

SEQ ID NO: 7568198 - DNA, 22 bp, Homo sapiens
aggcatggggctgcagtcaggt

SEQ ID NO: 7568199 - DNA, 22 bp, Homo sapiens
aggcatggggctgcagtcaggt

SEQ ID NO: 7568200 - DNA, 22 bp, Homo sapiens
aggcatggggctgcagtcaggt

SEQ ID NO: 7568201 - DNA, 19 bp, Homo sapiens
aggcatgggaagagaagtc

SEQ ID NO: 7568202 - DNA, 22 bp, Homo sapiens
aggcatggctttaggcaggcgt

SEQ ID NO: 7568203 - DNA, 19 bp, Homo sapiens
aggcatgggaagagaagtc

SEQ ID NO: 7568204 - DNA, 19 bp, Homo sapiens
aggcatgggaagagaagtc

SEQ ID NO: 7568205 - DNA, 19 bp, Homo sapiens
aggcatgggaagagaagtc

SEQ ID NO: 7568206 - DNA, 19 bp, Homo sapiens
aggcatgggaagagaagtc

SEQ ID NO: 7568207 - DNA, 19 bp, Homo sapiens
aggcatgggaagagaagtc

SEQ ID NO: 7568208 - DNA, 22 bp, Homo sapiens
aggcatggctttaggcaggcgt

SEQ ID NO: 7568209 - DNA, 19 bp, Homo sapiens
aggcatgggaagagaagtc

SEQ ID NO: 7568210 - DNA, 19 bp, Homo sapiens
aggcatgggaagagaagtc

SEQ ID NO: 7568211 - DNA, 19 bp, Homo sapiens
aggcatgggaagagaagtc

SEQ ID NO: 7568212 - DNA, 19 bp, Homo sapiens
aggcatgggaagagaagtc

SEQ ID NO: 7568213 - DNA, 22 bp, Homo sapiens
aggcatggctttaggcaggcgt

SEQ ID NO: 7568214 - DNA, 22 bp, Homo sapiens
aggcatggctttaggcaggcgt

SEQ ID NO: 7568215 - DNA, 22 bp, Homo sapiens
aggcatggctttaggcaggcgt

SEQ ID NO: 7568216 - DNA, 22 bp, Homo sapiens
aggcatggctttaggcaggcgt

SEQ ID NO: 7568217 - DNA, 22 bp, Homo sapiens
aggcatggctttaggcaggcgt

SEQ ID NO: 7568218 - DNA, 22 bp, Homo sapiens
aggcatggctttaggcaggcgt

SEQ ID NO: 7568219 - DNA, 22 bp, Homo sapiens
aggcatggctttaggcaggcgt

SEQ ID NO: 7568220 - DNA, 22 bp, Homo sapiens
aggcatggcattcctcaagcaa

SEQ ID NO: 7568221 - DNA, 22 bp, Homo sapiens
aggcatggctttaggcaggcgt

SEQ ID NO: 7568222 - DNA, 22 bp, Homo sapiens
aggccacagagagtgcatgtgc

SEQ ID NO: 7568223 - DNA, 22 bp, Homo sapiens
aggccacagatactgtgaagta

SEQ ID NO: 7568224 - DNA, 22 bp, Homo sapiens
aggccacagatactgtgaagta

SEQ ID NO: 7568225 - DNA, 22 bp, Homo sapiens
aggccacagagagtgcatgtgc

SEQ ID NO: 7568226 - DNA, 22 bp, Homo sapiens
aggccacagagagtgcatgtgc

SEQ ID NO: 7568227 - DNA, 22 bp, Homo sapiens
aggccacagagagtgcatgtgc

SEQ ID NO: 7568228 - DNA, 22 bp, Homo sapiens
aggccacagagagtgcatgtgc

SEQ ID NO: 7568229 - DNA, 22 bp, Homo sapiens
aggccacagagagtgcatgtgc

SEQ ID NO: 7568230 - DNA, 18 bp, Homo sapiens
aggccacactccagaaca

SEQ ID NO: 7568231 - DNA, 18 bp, Homo sapiens
aggccacactccagaaca

SEQ ID NO: 7568232 - DNA, 18 bp, Homo sapiens
aggccacactccagaaca

SEQ ID NO: 7568233 - DNA, 18 bp, Homo sapiens
aggccacactccagaaca

SEQ ID NO: 7568234 - DNA, 18 bp, Homo sapiens
aggccacactccagaaca

SEQ ID NO: 7568235 - DNA, 22 bp, Homo sapiens
aggccacaatttgatttggttt

SEQ ID NO: 7568236 - DNA, 22 bp, Homo sapiens
aggccacaatttgatttggttt

SEQ ID NO: 7568237 - DNA, 22 bp, Homo sapiens
aggccacacaactcttagagat

SEQ ID NO: 7568238 - DNA, 22 bp, Homo sapiens
aggccacacaactcttagagat

SEQ ID NO: 7568239 - DNA, 22 bp, Homo sapiens
aggccacacaactcttagagat

SEQ ID NO: 7568240 - DNA, 22 bp, Homo sapiens
aggccacaagaactaccccatc

SEQ ID NO: 7568241 - DNA, 22 bp, Homo sapiens
aggcatgtcagttgttttagtg

SEQ ID NO: 7568242 - DNA, 18 bp, Homo sapiens
aggcatggtggtgcgcac

SEQ ID NO: 7568243 - DNA, 18 bp, Homo sapiens
aggcatggtggtgcgcac

SEQ ID NO: 7568244 - DNA, 18 bp, Homo sapiens
aggcatggtggtgcgcac

SEQ ID NO: 7568245 - DNA, 18 bp, Homo sapiens
aggcatggtggtgcgcac

SEQ ID NO: 7568246 - DNA, 18 bp, Homo sapiens
aggcatggtggtgcgcac

SEQ ID NO: 7568247 - DNA, 22 bp, Homo sapiens
aggcatgggtagaagagaagcc

SEQ ID NO: 7568248 - DNA, 22 bp, Homo sapiens
aggcatgggtagaagagaagcc

SEQ ID NO: 7568249 - DNA, 22 bp, Homo sapiens
aggcatgggtagaagagaagcc

SEQ ID NO: 7568250 - DNA, 22 bp, Homo sapiens
aggcatgggtagaagagaagcc

SEQ ID NO: 7568251 - DNA, 22 bp, Homo sapiens
aggcatgggtagaagagaagcc

SEQ ID NO: 7568252 - DNA, 17 bp, Homo sapiens
aggcatggtctggggtg

SEQ ID NO: 7568253 - DNA, 22 bp, Homo sapiens
aggcatgggtagaagagaagcc

SEQ ID NO: 7568254 - DNA, 22 bp, Homo sapiens
aggcatgggtagaagagaagcc

SEQ ID NO: 7568255 - DNA, 17 bp, Homo sapiens
aggcatggtctggggtg

SEQ ID NO: 7568256 - DNA, 17 bp, Homo sapiens
aggcatggtctggggtg

SEQ ID NO: 7568257 - DNA, 22 bp, Homo sapiens
aggccacagtactttgcagacc

SEQ ID NO: 7568258 - DNA, 22 bp, Homo sapiens
aggccacagtactttgcagacc

SEQ ID NO: 7568259 - DNA, 22 bp, Homo sapiens
aggccacaggtggaagccagag

SEQ ID NO: 7568260 - DNA, 22 bp, Homo sapiens
aggccacaggtggaagccagag

SEQ ID NO: 7568261 - DNA, 22 bp, Homo sapiens
aggccacaggtggaagccagag

SEQ ID NO: 7568262 - DNA, 22 bp, Homo sapiens
aggccacaggcaccctgtgttc

SEQ ID NO: 7568263 - DNA, 22 bp, Homo sapiens
aggccacaggcaccctgtgttc

SEQ ID NO: 7568264 - DNA, 22 bp, Homo sapiens
aggccacaggcaccctgtgttc

SEQ ID NO: 7568265 - DNA, 22 bp, Homo sapiens
aggccagcacgacagccgcagg

SEQ ID NO: 7568266 - DNA, 22 bp, Homo sapiens
aggccagcacgacagccgcagg

SEQ ID NO: 7568267 - DNA, 22 bp, Homo sapiens
aggccagcacgacagccgcagg

SEQ ID NO: 7568268 - DNA, 22 bp, Homo sapiens
aggccagcaccagagtcaagaa

SEQ ID NO: 7568269 - DNA, 22 bp, Homo sapiens
aggccagcaccagagtcaagaa

SEQ ID NO: 7568270 - DNA, 22 bp, Homo sapiens
aggccagcaccagagtcaagaa

SEQ ID NO: 7568271 - DNA, 22 bp, Homo sapiens
aggccagcaccagagtcaagaa

SEQ ID NO: 7568272 - DNA, 22 bp, Homo sapiens
aggccagcagacgtgggactga

SEQ ID NO: 7568273 - DNA, 22 bp, Homo sapiens
aggccagcagacgtgggactga

SEQ ID NO: 7568274 - DNA, 22 bp, Homo sapiens
aggccagcagacgtgggactga

SEQ ID NO: 7568275 - DNA, 22 bp, Homo sapiens
aggccagcacgacagccgcagg

SEQ ID NO: 7568276 - DNA, 22 bp, Homo sapiens
aggccacaggcaccctgtgttc

SEQ ID NO: 7568277 - DNA, 22 bp, Homo sapiens
aggccacaggcaccctgtgttc

SEQ ID NO: 7568278 - DNA, 22 bp, Homo sapiens
aggccacaggattgcacagcat

SEQ ID NO: 7568279 - DNA, 22 bp, Homo sapiens
aggccacaggattgcacagcat

SEQ ID NO: 7568280 - DNA, 22 bp, Homo sapiens
aggccacaggattgcacagcat

SEQ ID NO: 7568281 - DNA, 22 bp, Homo sapiens
aggccacaggattgcacagcat

SEQ ID NO: 7568282 - DNA, 22 bp, Homo sapiens
aggccacaggattgcacagcat

SEQ ID NO: 7568283 - DNA, 22 bp, Homo sapiens
aggccacaggattgcacagcat

SEQ ID NO: 7568284 - DNA, 22 bp, Homo sapiens
aggccacagcctgggaggtgac

SEQ ID NO: 7568285 - DNA, 22 bp, Homo sapiens
aggccacagcctgggaggtgac

SEQ ID NO: 7568286 - DNA, 22 bp, Homo sapiens
aggccacagcctgggaggtgac

SEQ ID NO: 7568287 - DNA, 22 bp, Homo sapiens
aggccacagcctgggaggtgac

SEQ ID NO: 7568288 - DNA, 22 bp, Homo sapiens
aggccacagcctgggaggtgac

SEQ ID NO: 7568289 - DNA, 22 bp, Homo sapiens
aggccacagatactgtgaagta

SEQ ID NO: 7568290 - DNA, 22 bp, Homo sapiens
aggccacaggagtactgtcggt

SEQ ID NO: 7568291 - DNA, 22 bp, Homo sapiens
aggccacaggagtactgtcggt

SEQ ID NO: 7568292 - DNA, 22 bp, Homo sapiens
aggccacagcctgggaggtgac

SEQ ID NO: 7568293 - DNA, 22 bp, Homo sapiens
aggccctgcaggaagcaggatg

SEQ ID NO: 7568294 - DNA, 22 bp, Homo sapiens
aggccctgcaggaagcaggatg

SEQ ID NO: 7568295 - DNA, 22 bp, Homo sapiens
aggccctgcaggaagcaggatg

SEQ ID NO: 7568296 - DNA, 22 bp, Homo sapiens
aggccctgcaggaagcaggatg

SEQ ID NO: 7568297 - DNA, 22 bp, Homo sapiens
aggccctgcaggaagcaggatg

SEQ ID NO: 7568298 - DNA, 22 bp, Homo sapiens
aggccctgcaggaagcaggatg

SEQ ID NO: 7568299 - DNA, 22 bp, Homo sapiens
aggccctgcaggaagcaggatg

SEQ ID NO: 7568300 - DNA, 22 bp, Homo sapiens
aggccctgcaggagtggggaca

SEQ ID NO: 7568301 - DNA, 22 bp, Homo sapiens
aggccctgcaggaagcaggatg

SEQ ID NO: 7568302 - DNA, 22 bp, Homo sapiens
aggccctgcaggagtggggaca

SEQ ID NO: 7568303 - DNA, 22 bp, Homo sapiens
aggccctgcaggagtggggaca

SEQ ID NO: 7568304 - DNA, 22 bp, Homo sapiens
aggccctgcaggagtggggaca

SEQ ID NO: 7568305 - DNA, 22 bp, Homo sapiens
aggccctgcaggagtggggaca

SEQ ID NO: 7568306 - DNA, 22 bp, Homo sapiens
aggccctgcaggagtggggaca

SEQ ID NO: 7568307 - DNA, 22 bp, Homo sapiens
aggccctgcaggagtggggaca

SEQ ID NO: 7568308 - DNA, 22 bp, Homo sapiens
aggccctgcaggagtggggaca

SEQ ID NO: 7568309 - DNA, 22 bp, Homo sapiens
aggccctgcattgtactgaggg

SEQ ID NO: 7568310 - DNA, 22 bp, Homo sapiens
aggccctgcattgtactgaggg

SEQ ID NO: 7568311 - DNA, 22 bp, Homo sapiens
aggccctgcattgtactgaggg

SEQ ID NO: 7568312 - DNA, 22 bp, Homo sapiens
aggccctgcattgtactgaggg

SEQ ID NO: 7568313 - DNA, 22 bp, Homo sapiens
aggccctgcattgtactgaggg

SEQ ID NO: 7568314 - DNA, 22 bp, Homo sapiens
aggccctgcattgtactgaggg

SEQ ID NO: 7568315 - DNA, 22 bp, Homo sapiens
aggccctgcaggagtggggaca

SEQ ID NO: 7568316 - DNA, 22 bp, Homo sapiens
aggccctgcattgtactgaggg

SEQ ID NO: 7568317 - DNA, 20 bp, Homo sapiens
aggccctgccagggacggag

SEQ ID NO: 7568318 - DNA, 20 bp, Homo sapiens
aggccctgccagggacggag

SEQ ID NO: 7568319 - DNA, 20 bp, Homo sapiens
aggccctgccagggacggag

SEQ ID NO: 7568320 - DNA, 22 bp, Homo sapiens
acattaacactggtgctggtgt

SEQ ID NO: 7568321 - DNA, 20 bp, Homo sapiens
aggccctgccagggacggag

SEQ ID NO: 7568322 - DNA, 22 bp, Homo sapiens
acattaagttttagatgtcaat

SEQ ID NO: 7568323 - DNA, 22 bp, Homo sapiens
acattaatgaggtgatgacaca

SEQ ID NO: 7568324 - DNA, 22 bp, Homo sapiens
acattaatgaggtgatgacaca

SEQ ID NO: 7568325 - DNA, 20 bp, Homo sapiens
aggccctgccagggacggag

SEQ ID NO: 7568326 - DNA, 22 bp, Homo sapiens
aggccctgcattgtactgaggg

SEQ ID NO: 7568327 - DNA, 22 bp, Homo sapiens
acattcaagatgcattcactta

SEQ ID NO: 7568328 - DNA, 22 bp, Homo sapiens
acattcaagatgcattcactta

SEQ ID NO: 7568329 - DNA, 22 bp, Homo sapiens
acattcaagatgcattcactta

SEQ ID NO: 7568330 - DNA, 23 bp, Homo sapiens
acattacacgcagtaattgcccc

SEQ ID NO: 7568331 - DNA, 23 bp, Homo sapiens
acattacacgcagtaattgcccc

SEQ ID NO: 7568332 - DNA, 22 bp, Homo sapiens
acattacactgtggtcctgttc

SEQ ID NO: 7568333 - DNA, 22 bp, Homo sapiens
acattcacgctctcaaagctga

SEQ ID NO: 7568334 - DNA, 22 bp, Homo sapiens
acattcacgctctcaaagctga

SEQ ID NO: 7568335 - DNA, 21 bp, Homo sapiens
acattcacaggatattatcat

SEQ ID NO: 7568336 - DNA, 22 bp, Homo sapiens
acattcaagtttctgctcatgg

SEQ ID NO: 7568337 - DNA, 21 bp, Homo sapiens
acattcacaggatattatcat

SEQ ID NO: 7568338 - DNA, 21 bp, Homo sapiens
acattcacaggatattatcat

SEQ ID NO: 7568339 - DNA, 22 bp, Homo sapiens
acattcaagtttctgctcatgg

SEQ ID NO: 7568340 - DNA, 22 bp, Homo sapiens
acattcaagtttctgctcatgg

SEQ ID NO: 7568341 - DNA, 22 bp, Homo sapiens
acattcacaagcctacaaggtt

SEQ ID NO: 7568342 - DNA, 22 bp, Homo sapiens
acattcacaagcctacaaggtt

SEQ ID NO: 7568343 - DNA, 22 bp, Homo sapiens
acattcaaggccttctgacaca

SEQ ID NO: 7568344 - DNA, 22 bp, Homo sapiens
acattcaaggccttctgacaca

SEQ ID NO: 7568345 - DNA, 22 bp, Homo sapiens
acattcaaggccttctgacaca

SEQ ID NO: 7568346 - DNA, 22 bp, Homo sapiens
acattcaaggcagcactgagtg

SEQ ID NO: 7568347 - DNA, 22 bp, Homo sapiens
acattcaaggcagcactgagtg

SEQ ID NO: 7568348 - DNA, 22 bp, Homo sapiens
acattcaaggccttctgacaca

SEQ ID NO: 7568349 - DNA, 22 bp, Homo sapiens
acattcaaggccttctgacaca

SEQ ID NO: 7568350 - DNA, 22 bp, Homo sapiens
acattcaaggcagcactgagtg

SEQ ID NO: 7568351 - DNA, 22 bp, Homo sapiens
acattcattgagcaacaacaat

SEQ ID NO: 7568352 - DNA, 22 bp, Homo sapiens
acattcattgagcaacaacaat

SEQ ID NO: 7568353 - DNA, 22 bp, Homo sapiens
acattcattgagcaacaacaat

SEQ ID NO: 7568354 - DNA, 22 bp, Homo sapiens
acattcattccaggtcagtcag

SEQ ID NO: 7568355 - DNA, 22 bp, Homo sapiens
acattcattccaggtcagtcag

SEQ ID NO: 7568356 - DNA, 22 bp, Homo sapiens
acattcatgtcccacttctagc

SEQ ID NO: 7568357 - DNA, 22 bp, Homo sapiens
acattcatgtcccacttctagc

SEQ ID NO: 7568358 - DNA, 22 bp, Homo sapiens
acattcaggccacagtggagtc

SEQ ID NO: 7568359 - DNA, 22 bp, Homo sapiens
acattcatgtcccacttctagc

SEQ ID NO: 7568360 - DNA, 22 bp, Homo sapiens
acattcatgtcccacttctagc

SEQ ID NO: 7568361 - DNA, 22 bp, Homo sapiens
acattcatgtcccacttctagc

SEQ ID NO: 7568362 - DNA, 22 bp, Homo sapiens
acattcatgtcccacttctagc

SEQ ID NO: 7568363 - DNA, 22 bp, Homo sapiens
acattcatgcaccttcctatcc

SEQ ID NO: 7568364 - DNA, 22 bp, Homo sapiens
acattcatgggttttacattat

SEQ ID NO: 7568365 - DNA, 22 bp, Homo sapiens
acattcatgggttttacattat

SEQ ID NO: 7568366 - DNA, 22 bp, Homo sapiens
acattcatgggttttacattat

SEQ ID NO: 7568367 - DNA, 22 bp, Homo sapiens
acattcactatgtccaaactct

SEQ ID NO: 7568368 - DNA, 22 bp, Homo sapiens
acattcaccacacttatagggc

SEQ ID NO: 7568369 - DNA, 22 bp, Homo sapiens
acattcaggccacagtggagtc

SEQ ID NO: 7568370 - DNA, 22 bp, Homo sapiens
acattcaggccacagtggagtc

SEQ ID NO: 7568371 - DNA, 22 bp, Homo sapiens
acattcaccacacttatagggc

SEQ ID NO: 7568372 - DNA, 22 bp, Homo sapiens
acattctacagttaaccattag

SEQ ID NO: 7568373 - DNA, 22 bp, Homo sapiens
acattctacagttaaccattag

SEQ ID NO: 7568374 - DNA, 22 bp, Homo sapiens
acattctacagttaaccattag

SEQ ID NO: 7568375 - DNA, 22 bp, Homo sapiens
acattctacagttaaccattag

SEQ ID NO: 7568376 - DNA, 22 bp, Homo sapiens
acattctaacattgtacagata

SEQ ID NO: 7568377 - DNA, 22 bp, Homo sapiens
acattctaacattgtacagata

SEQ ID NO: 7568378 - DNA, 22 bp, Homo sapiens
acattctaacattgtacagata

SEQ ID NO: 7568379 - DNA, 22 bp, Homo sapiens
acattctaacattgtacagata

SEQ ID NO: 7568380 - DNA, 22 bp, Homo sapiens
acattcctgccataaatttttt

SEQ ID NO: 7568381 - DNA, 22 bp, Homo sapiens
acattcctgccataaatttttt

SEQ ID NO: 7568382 - DNA, 22 bp, Homo sapiens
acattcctgcctccccggagat

SEQ ID NO: 7568383 - DNA, 22 bp, Homo sapiens
acattcctgcctccccggagat

SEQ ID NO: 7568384 - DNA, 22 bp, Homo sapiens
acattcctgaggaaatacattc

SEQ ID NO: 7568385 - DNA, 22 bp, Homo sapiens
acattcctgaggaaatacattc

SEQ ID NO: 7568386 - DNA, 22 bp, Homo sapiens
acattcctttcttgagcacagt

SEQ ID NO: 7568387 - DNA, 22 bp, Homo sapiens
acattcctttcttgagcacagt

SEQ ID NO: 7568388 - DNA, 22 bp, Homo sapiens
acattcctttcttgagcacagt

SEQ ID NO: 7568389 - DNA, 22 bp, Homo sapiens
acattctaaagcatgctcagga

SEQ ID NO: 7568390 - DNA, 22 bp, Homo sapiens
acattctaaagcatgctcagga

SEQ ID NO: 7568391 - DNA, 22 bp, Homo sapiens
acattcctgaggaaatacattc

SEQ ID NO: 7568392 - DNA, 22 bp, Homo sapiens
acattcctgaggaaatacattc

SEQ ID NO: 7568393 - DNA, 22 bp, Homo sapiens
acattcctcagtgccagttgag

SEQ ID NO: 7568394 - DNA, 22 bp, Homo sapiens
acattcctgaatgggcacattt

SEQ ID NO: 7568395 - DNA, 22 bp, Homo sapiens
acattcctgaatgggcacattt

SEQ ID NO: 7568396 - DNA, 22 bp, Homo sapiens
acattcctgaatgggcacattt

SEQ ID NO: 7568397 - DNA, 22 bp, Homo sapiens
acattcctcagtgccagttgag

SEQ ID NO: 7568398 - DNA, 22 bp, Homo sapiens
acattcctacctgctcgggtgt

SEQ ID NO: 7568399 - DNA, 22 bp, Homo sapiens
acattcctacctgctcgggtgt

SEQ ID NO: 7568400 - DNA, 22 bp, Homo sapiens
acattcctcagtgccagttgag

SEQ ID NO: 7568401 - DNA, 22 bp, Homo sapiens
acattccaggttggtgcagggt

SEQ ID NO: 7568402 - DNA, 22 bp, Homo sapiens
acattcctcagtgccagttgag

SEQ ID NO: 7568403 - DNA, 22 bp, Homo sapiens
acattccaaaaactagcagata

SEQ ID NO: 7568404 - DNA, 22 bp, Homo sapiens
acattcattgccagggtggaag

SEQ ID NO: 7568405 - DNA, 22 bp, Homo sapiens
acattcattgagcaacaacaat

SEQ ID NO: 7568406 - DNA, 22 bp, Homo sapiens
acattcattgccagggtggaag

SEQ ID NO: 7568407 - DNA, 22 bp, Homo sapiens
acattccaggttggtgcagggt

SEQ ID NO: 7568408 - DNA, 19 bp, Homo sapiens
acattcccatcagcaatgt

SEQ ID NO: 7568409 - DNA, 22 bp, Homo sapiens
acattcccttggcttgaagcag

SEQ ID NO: 7568410 - DNA, 22 bp, Homo sapiens
acattctagaagtctttgcaat

SEQ ID NO: 7568411 - DNA, 22 bp, Homo sapiens
acattctagaagagcttcactt

SEQ ID NO: 7568412 - DNA, 22 bp, Homo sapiens
acattctagaagagcttcactt

SEQ ID NO: 7568413 - DNA, 22 bp, Homo sapiens
acattctagaagagcttcactt

SEQ ID NO: 7568414 - DNA, 22 bp, Homo sapiens
acattctagaagtctttgcaat

SEQ ID NO: 7568415 - DNA, 22 bp, Homo sapiens
acattctagatatgttatattt

SEQ ID NO: 7568416 - DNA, 22 bp, Homo sapiens
acattctagatatgttatattt

SEQ ID NO: 7568417 - DNA, 22 bp, Homo sapiens
acattctagatatgttatattt

SEQ ID NO: 7568418 - DNA, 22 bp, Homo sapiens
acattctatgaagataatttta

SEQ ID NO: 7568419 - DNA, 22 bp, Homo sapiens
acattctatgaagataatttta

SEQ ID NO: 7568420 - DNA, 22 bp, Homo sapiens
acattctatgaagataatttta

SEQ ID NO: 7568421 - DNA, 22 bp, Homo sapiens
acattctatgaagataatttta

SEQ ID NO: 7568422 - DNA, 22 bp, Homo sapiens
acattctagatatgttatattt

SEQ ID NO: 7568423 - DNA, 22 bp, Homo sapiens
acattctagatatgttatattt

SEQ ID NO: 7568424 - DNA, 22 bp, Homo sapiens
acattctagatatgttatattt

SEQ ID NO: 7568425 - DNA, 22 bp, Homo sapiens
acattctatagcaagctgatct

SEQ ID NO: 7568426 - DNA, 22 bp, Homo sapiens
acattctagatatgttatattt

SEQ ID NO: 7568427 - DNA, 22 bp, Homo sapiens
acattctatagcaagctgatct

SEQ ID NO: 7568428 - DNA, 22 bp, Homo sapiens
acattcttggactccactctag

SEQ ID NO: 7568429 - DNA, 22 bp, Homo sapiens
acattctttcaccttgtgtcca

SEQ ID NO: 7568430 - DNA, 22 bp, Homo sapiens
acattctttcgatgtctgattt

SEQ ID NO: 7568431 - DNA, 22 bp, Homo sapiens
acattctttcaccttgtgtcca

SEQ ID NO: 7568432 - DNA, 22 bp, Homo sapiens
acattcttgaagtgaagtttat

SEQ ID NO: 7568433 - DNA, 22 bp, Homo sapiens
acattcttgaagtgaagtttat

SEQ ID NO: 7568434 - DNA, 22 bp, Homo sapiens
acattctatggttgatgagttg

SEQ ID NO: 7568435 - DNA, 22 bp, Homo sapiens
acattcttggactccactctag

SEQ ID NO: 7568436 - DNA, 22 bp, Homo sapiens
acattgaaagcatattatctcc

SEQ ID NO: 7568437 - DNA, 22 bp, Homo sapiens
acattctttgagttttgttaaa

SEQ ID NO: 7568438 - DNA, 22 bp, Homo sapiens
acattctttcgatgtctgattt

SEQ ID NO: 7568439 - DNA, 22 bp, Homo sapiens
acattctttgagttttgttaaa

SEQ ID NO: 7568440 - DNA, 22 bp, Homo sapiens
acattctttcgatgtctgattt

SEQ ID NO: 7568441 - DNA, 18 bp, Homo sapiens
aggcttcccaggcaggcc

SEQ ID NO: 7568442 - DNA, 22 bp, Homo sapiens
aggcttcccttcctctgggggt

SEQ ID NO: 7568443 - DNA, 18 bp, Homo sapiens
aggcttcccaggcaggcc

SEQ ID NO: 7568444 - DNA, 18 bp, Homo sapiens
aggcttcccaggcaggcc

SEQ ID NO: 7568445 - DNA, 18 bp, Homo sapiens
aggcttcccaggcaggcc

SEQ ID NO: 7568446 - DNA, 23 bp, Homo sapiens
aggcttcctatcttagagctggg

SEQ ID NO: 7568447 - DNA, 23 bp, Homo sapiens
aggcttcctatcttagagctggg

SEQ ID NO: 7568448 - DNA, 23 bp, Homo sapiens
aggcttcctatcttagagctggg

SEQ ID NO: 7568449 - DNA, 22 bp, Homo sapiens
aggcttccgagtagctgggact

SEQ ID NO: 7568450 - DNA, 22 bp, Homo sapiens
aggcttccgagtagctgggact

SEQ ID NO: 7568451 - DNA, 22 bp, Homo sapiens
aggcttcattgtggcatcagga

SEQ ID NO: 7568452 - DNA, 22 bp, Homo sapiens
aggcttcattgtggcatcagga

SEQ ID NO: 7568453 - DNA, 22 bp, Homo sapiens
aggcttcccagctgagctcagc

SEQ ID NO: 7568454 - DNA, 22 bp, Homo sapiens
aggcttcccagctgagctcagc

SEQ ID NO: 7568455 - DNA, 22 bp, Homo sapiens
aggcttcccaagcagctgcaaa

SEQ ID NO: 7568456 - DNA, 22 bp, Homo sapiens
aggcttcccagctgagctcagc

SEQ ID NO: 7568457 - DNA, 22 bp, Homo sapiens
aggcttcatatttaggcatatg

SEQ ID NO: 7568458 - DNA, 22 bp, Homo sapiens
aggcttcagttgtaccttcttg

SEQ ID NO: 7568459 - DNA, 22 bp, Homo sapiens
aggcttcagttgtaccttcttg

SEQ ID NO: 7568460 - DNA, 22 bp, Homo sapiens
aggcttcattacagtggttcaa

SEQ ID NO: 7568461 - DNA, 22 bp, Homo sapiens
aggcttcagtagggagcatgtc

SEQ ID NO: 7568462 - DNA, 22 bp, Homo sapiens
aggcttcagtagggagcatgtc

SEQ ID NO: 7568463 - DNA, 22 bp, Homo sapiens
aggcttcaggtttgctttgcag

SEQ ID NO: 7568464 - DNA, 22 bp, Homo sapiens
aggcttcagggcttttgagggt

SEQ ID NO: 7568465 - DNA, 19 bp, Homo sapiens
aggcttcaggccacatgct

SEQ ID NO: 7568466 - DNA, 19 bp, Homo sapiens
aggcttcaggccacatgct

SEQ ID NO: 7568467 - DNA, 22 bp, Homo sapiens
aggctccaggcccttcaccagc

SEQ ID NO: 7568468 - DNA, 22 bp, Homo sapiens
aggctccaggcaatgtttctga

SEQ ID NO: 7568469 - DNA, 22 bp, Homo sapiens
aggctccagcccaaggctgcag

SEQ ID NO: 7568470 - DNA, 22 bp, Homo sapiens
aggctccaggcaaaatttcgga

SEQ ID NO: 7568471 - DNA, 22 bp, Homo sapiens
aggctccagggctgtgtgggag

SEQ ID NO: 7568472 - DNA, 22 bp, Homo sapiens
aggctccaggcctccctgcatg

SEQ ID NO: 7568473 - DNA, 22 bp, Homo sapiens
aggctccaggcctccctgcatg

SEQ ID NO: 7568474 - DNA, 22 bp, Homo sapiens
aggctccagtctcctctggcag

SEQ ID NO: 7568475 - DNA, 22 bp, Homo sapiens
aggctgtgcaattagggtaaga

SEQ ID NO: 7568476 - DNA, 22 bp, Homo sapiens
aggctgtgattccaccactctc

SEQ ID NO: 7568477 - DNA, 22 bp, Homo sapiens
aggcttcaggaagtctcctggg

SEQ ID NO: 7568478 - DNA, 22 bp, Homo sapiens
aggcttcaggaagtctcctggg

SEQ ID NO: 7568479 - DNA, 22 bp, Homo sapiens
aggcttcaggaaatatacattt

SEQ ID NO: 7568480 - DNA, 22 bp, Homo sapiens
aggcttcagcctagagctggag

SEQ ID NO: 7568481 - DNA, 22 bp, Homo sapiens
aggcttcagatgaccttagcat

SEQ ID NO: 7568482 - DNA, 22 bp, Homo sapiens
aggcttcagcctagagctggag

SEQ ID NO: 7568483 - DNA, 22 bp, Homo sapiens
aggcttcagcagccctctcttg

SEQ ID NO: 7568484 - DNA, 22 bp, Homo sapiens
aggcttcagcagccctctcttg

SEQ ID NO: 7568485 - DNA, 22 bp, Homo sapiens
aggcttcagacaaatgttatgg

SEQ ID NO: 7568486 - DNA, 22 bp, Homo sapiens
aggcttcagaaagagtaattgg

SEQ ID NO: 7568487 - DNA, 22 bp, Homo sapiens
aggctgtgcaattagggtaaga

SEQ ID NO: 7568488 - DNA, 22 bp, Homo sapiens
aggctgtgcaattagggtaaga

SEQ ID NO: 7568489 - DNA, 22 bp, Homo sapiens
acattgaagctgtgaaatcaaa

SEQ ID NO: 7568490 - DNA, 22 bp, Homo sapiens
acattgaagctgtgaaatcaaa

SEQ ID NO: 7568491 - DNA, 22 bp, Homo sapiens
acattgaactacttgtaatgag

SEQ ID NO: 7568492 - DNA, 22 bp, Homo sapiens
acattgaactacttgtaatgag

SEQ ID NO: 7568493 - DNA, 22 bp, Homo sapiens
acattgaaccagtagacacaaa

SEQ ID NO: 7568494 - DNA, 22 bp, Homo sapiens
acattgaactacttgtaatgag

SEQ ID NO: 7568495 - DNA, 22 bp, Homo sapiens
acattgaacatggcaggacatt

SEQ ID NO: 7568496 - DNA, 22 bp, Homo sapiens
acattgaacagtacaaatgatc

SEQ ID NO: 7568497 - DNA, 22 bp, Homo sapiens
acattgaacatggcaggacatt

SEQ ID NO: 7568498 - DNA, 22 bp, Homo sapiens
acattgaaagcatattatctcc

SEQ ID NO: 7568499 - DNA, 22 bp, Homo sapiens
acattgaacagtacaaatgatc

SEQ ID NO: 7568500 - DNA, 22 bp, Homo sapiens
acattgaacagtacaaatgatc

SEQ ID NO: 7568501 - DNA, 22 bp, Homo sapiens
acattgaacagtacaaatgatc

SEQ ID NO: 7568502 - DNA, 22 bp, Homo sapiens
acattgaacagtacaaatgatc

SEQ ID NO: 7568503 - DNA, 22 bp, Homo sapiens
acattgaattcaaaattactga

SEQ ID NO: 7568504 - DNA, 22 bp, Homo sapiens
acattgaatttcacttttgtac

SEQ ID NO: 7568505 - DNA, 19 bp, Homo sapiens
acattgaattttcttcttt

SEQ ID NO: 7568506 - DNA, 22 bp, Homo sapiens
acattgaattcaaaattactga

SEQ ID NO: 7568507 - DNA, 22 bp, Homo sapiens
acattgaatgtatgtgatgaaa

SEQ ID NO: 7568508 - DNA, 22 bp, Homo sapiens
acattgaatgtatgtgatgaaa

SEQ ID NO: 7568509 - DNA, 22 bp, Homo sapiens
acattgaagggctatccaatag

SEQ ID NO: 7568510 - DNA, 22 bp, Homo sapiens
acattgaagtgtctggcctcct

SEQ ID NO: 7568511 - DNA, 22 bp, Homo sapiens
acattgaagggaatgcaaagat

SEQ ID NO: 7568512 - DNA, 22 bp, Homo sapiens
acattgaagggaatgcaaagat

SEQ ID NO: 7568513 - DNA, 22 bp, Homo sapiens
acattgaagctgtgaaatcaaa

SEQ ID NO: 7568514 - DNA, 22 bp, Homo sapiens
acattgaagggaatgcaaagat

SEQ ID NO: 7568515 - DNA, 22 bp, Homo sapiens
acattgaagggaatgcaaagat

SEQ ID NO: 7568516 - DNA, 22 bp, Homo sapiens
aggctccagccaatgggtctgt

SEQ ID NO: 7568517 - DNA, 22 bp, Homo sapiens
aggctccagccaatgggtctgt

SEQ ID NO: 7568518 - DNA, 22 bp, Homo sapiens
aggctccagcccaaggctgcag

SEQ ID NO: 7568519 - DNA, 22 bp, Homo sapiens
aggctccagcccaaggctgcag

SEQ ID NO: 7568520 - DNA, 22 bp, Homo sapiens
aggctccagcccaaggctgcag

SEQ ID NO: 7568521 - DNA, 22 bp, Homo sapiens
aggctccagcagccagaggaag

SEQ ID NO: 7568522 - DNA, 22 bp, Homo sapiens
aggctccagcagccagaggaag

SEQ ID NO: 7568523 - DNA, 23 bp, Homo sapiens
aggctccactccctgggatgtgg

SEQ ID NO: 7568524 - DNA, 22 bp, Homo sapiens
aggctccagcagccagaggaag

SEQ ID NO: 7568525 - DNA, 22 bp, Homo sapiens
aggctccagcagccagaggaag

SEQ ID NO: 7568526 - DNA, 22 bp, Homo sapiens
aggctccagcagccagaggaag

SEQ ID NO: 7568527 - DNA, 22 bp, Homo sapiens
aggctccagcagccagaggaag

SEQ ID NO: 7568528 - DNA, 22 bp, Homo sapiens
aggctccagcagccagaggaag

SEQ ID NO: 7568529 - DNA, 19 bp, Homo sapiens
acattgaattttcttcttt

SEQ ID NO: 7568530 - DNA, 22 bp, Homo sapiens
acattgacaaagattgagctgt

SEQ ID NO: 7568531 - DNA, 22 bp, Homo sapiens
acattgacctgattttgaagac

SEQ ID NO: 7568532 - DNA, 22 bp, Homo sapiens
acattgacaaagattgagctgt

SEQ ID NO: 7568533 - DNA, 19 bp, Homo sapiens
acattgaattttcttcttt

SEQ ID NO: 7568534 - DNA, 19 bp, Homo sapiens
acattgaattttcttcttt

SEQ ID NO: 7568535 - DNA, 22 bp, Homo sapiens
acattgacttggatgggtagca

SEQ ID NO: 7568536 - DNA, 22 bp, Homo sapiens
acattgagagttttgaagagta

SEQ ID NO: 7568537 - DNA, 22 bp, Homo sapiens
acattgacttggatgggtagca

SEQ ID NO: 7568538 - DNA, 22 bp, Homo sapiens
acattgatactgagatacaaag

SEQ ID NO: 7568539 - DNA, 22 bp, Homo sapiens
acattgagtgctccataaatca

SEQ ID NO: 7568540 - DNA, 22 bp, Homo sapiens
acattgagtgctccataaatca

SEQ ID NO: 7568541 - DNA, 23 bp, Homo sapiens
aggctccactccctgggatgtgg

SEQ ID NO: 7568542 - DNA, 23 bp, Homo sapiens
aggctccactccctgggatgtgg

SEQ ID NO: 7568543 - DNA, 23 bp, Homo sapiens
aggctccactccctgggatgtgg

SEQ ID NO: 7568544 - DNA, 23 bp, Homo sapiens
aggctccactccctgggatgtgg

SEQ ID NO: 7568545 - DNA, 22 bp, Homo sapiens
acattgatatttcaaatacagg

SEQ ID NO: 7568546 - DNA, 22 bp, Homo sapiens
acattgatatttcaaatacagg

SEQ ID NO: 7568547 - DNA, 22 bp, Homo sapiens
aggctccacggtcactggctct

SEQ ID NO: 7568548 - DNA, 22 bp, Homo sapiens
agatggcaggccctgtgggggt

SEQ ID NO: 7568549 - DNA, 22 bp, Homo sapiens
agatggcaggccctgtgggggt

SEQ ID NO: 7568550 - DNA, 22 bp, Homo sapiens
agatggcaggccctgtgggggt

SEQ ID NO: 7568551 - DNA, 22 bp, Homo sapiens
agatggcaggggtacctggaag

SEQ ID NO: 7568552 - DNA, 22 bp, Homo sapiens
agatggcaggggtacctggaag

SEQ ID NO: 7568553 - DNA, 22 bp, Homo sapiens
agatggcaggggtacctggaag

SEQ ID NO: 7568554 - DNA, 22 bp, Homo sapiens
agatggctatagatagcctttc

SEQ ID NO: 7568555 - DNA, 17 bp, Homo sapiens
agatggcctctaagatt

SEQ ID NO: 7568556 - DNA, 22 bp, Homo sapiens
agatggctctcaagtctgatta

SEQ ID NO: 7568557 - DNA, 22 bp, Homo sapiens
agatggctccagtgtccagagg

SEQ ID NO: 7568558 - DNA, 22 bp, Homo sapiens
agatggctgattaactccatgg

SEQ ID NO: 7568559 - DNA, 22 bp, Homo sapiens
agatggctgatggcaggagcca

SEQ ID NO: 7568560 - DNA, 20 bp, Homo sapiens
agatggctgtcatttctgtc

SEQ ID NO: 7568561 - DNA, 22 bp, Homo sapiens
agatggcttagcctggctccca

SEQ ID NO: 7568562 - DNA, 20 bp, Homo sapiens
agatggctgtcatttctgtc

SEQ ID NO: 7568563 - DNA, 22 bp, Homo sapiens
agatggctgggagctctgtttg

SEQ ID NO: 7568564 - DNA, 22 bp, Homo sapiens
agatggctgggagctctgtttg

SEQ ID NO: 7568565 - DNA, 22 bp, Homo sapiens
agatggcttccttctcactgtg

SEQ ID NO: 7568566 - DNA, 22 bp, Homo sapiens
agatggctttgcttttagaagc

SEQ ID NO: 7568567 - DNA, 22 bp, Homo sapiens
agatggctttgcttttagaagc

SEQ ID NO: 7568568 - DNA, 22 bp, Homo sapiens
agatgggccttcgagcatgccc

SEQ ID NO: 7568569 - DNA, 22 bp, Homo sapiens
attttaaccctcttatatatac

SEQ ID NO: 7568570 - DNA, 22 bp, Homo sapiens
agatgggccttcgagcatgccc

SEQ ID NO: 7568571 - DNA, 22 bp, Homo sapiens
agatgggccttcgagcatgccc

SEQ ID NO: 7568572 - DNA, 22 bp, Homo sapiens
agatggagttagtaccagagtc

SEQ ID NO: 7568573 - DNA, 22 bp, Homo sapiens
agatggagttagtaccagagtc

SEQ ID NO: 7568574 - DNA, 22 bp, Homo sapiens
agatggagtggagatgagtaaa

SEQ ID NO: 7568575 - DNA, 22 bp, Homo sapiens
agatggagtggagatgagtaaa

SEQ ID NO: 7568576 - DNA, 22 bp, Homo sapiens
agatggagtggagatgagtaaa

SEQ ID NO: 7568577 - DNA, 22 bp, Homo sapiens
agatggagtctcactcttgttg

SEQ ID NO: 7568578 - DNA, 22 bp, Homo sapiens
agatggaggaaggctgaactca

SEQ ID NO: 7568579 - DNA, 22 bp, Homo sapiens
agatggagaccttggatgaact

SEQ ID NO: 7568580 - DNA, 22 bp, Homo sapiens
agatggagaccttggatgaact

SEQ ID NO: 7568581 - DNA, 22 bp, Homo sapiens
agatggagaccttggatgaact

SEQ ID NO: 7568582 - DNA, 22 bp, Homo sapiens
agatggagaccttggatgaact

SEQ ID NO: 7568583 - DNA, 22 bp, Homo sapiens
agatggagaccttggatgaact

SEQ ID NO: 7568584 - DNA, 22 bp, Homo sapiens
agatggagaccttggatgaact

SEQ ID NO: 7568585 - DNA, 17 bp, Homo sapiens
agatggcaggaggcaga

SEQ ID NO: 7568586 - DNA, 17 bp, Homo sapiens
agatggcaggaggcaga

SEQ ID NO: 7568587 - DNA, 17 bp, Homo sapiens
agatggcaggaggcaga

SEQ ID NO: 7568588 - DNA, 17 bp, Homo sapiens
agatggcaggaggcaga

SEQ ID NO: 7568589 - DNA, 17 bp, Homo sapiens
agatggcaggaggcaga

SEQ ID NO: 7568590 - DNA, 17 bp, Homo sapiens
agatggcaggaggcaga

SEQ ID NO: 7568591 - DNA, 22 bp, Homo sapiens
agatggcagcagaacaaacagg

SEQ ID NO: 7568592 - DNA, 19 bp, Homo sapiens
agatggcaaaatgcaaaga

SEQ ID NO: 7568593 - DNA, 19 bp, Homo sapiens
agatggcaaaatgcaaaga

SEQ ID NO: 7568594 - DNA, 22 bp, Homo sapiens
agatggatttcttccagtgaga

SEQ ID NO: 7568595 - DNA, 22 bp, Homo sapiens
agatggagttgtagcagtgact

SEQ ID NO: 7568596 - DNA, 22 bp, Homo sapiens
agatggagttgtagcagtgact

SEQ ID NO: 7568597 - DNA, 22 bp, Homo sapiens
agatggagttgtagcagtgact

SEQ ID NO: 7568598 - DNA, 22 bp, Homo sapiens
agatggagttgtagcagtgact

SEQ ID NO: 7568599 - DNA, 22 bp, Homo sapiens
agatggagttgtagcagtgact

SEQ ID NO: 7568600 - DNA, 22 bp, Homo sapiens
agatggagttgtagcagtgact

SEQ ID NO: 7568601 - DNA, 21 bp, Homo sapiens
agatcattcttctgagcactt

SEQ ID NO: 7568602 - DNA, 23 bp, Homo sapiens
agatccaacattgtccatttttt

SEQ ID NO: 7568603 - DNA, 22 bp, Homo sapiens
agatccactatggtgctgatga

SEQ ID NO: 7568604 - DNA, 22 bp, Homo sapiens
agatcattaaccacctgttctg

SEQ ID NO: 7568605 - DNA, 22 bp, Homo sapiens
agatcatatgaaaaatttcaag

SEQ ID NO: 7568606 - DNA, 22 bp, Homo sapiens
agatcatattgtaactttattg

SEQ ID NO: 7568607 - DNA, 22 bp, Homo sapiens
agatgattatgatagcactgtt

SEQ ID NO: 7568608 - DNA, 22 bp, Homo sapiens
agatgcaacctctgcttaacaa

SEQ ID NO: 7568609 - DNA, 22 bp, Homo sapiens
agatgcactataaaagcatctt

SEQ ID NO: 7568610 - DNA, 22 bp, Homo sapiens
agatccaggatgtcccaaaata

SEQ ID NO: 7568611 - DNA, 22 bp, Homo sapiens
agatccactcgaatccaggaat

SEQ ID NO: 7568612 - DNA, 22 bp, Homo sapiens
agatccagatccttcctggttg

SEQ ID NO: 7568613 - DNA, 22 bp, Homo sapiens
agatccagatccttcctggttg

SEQ ID NO: 7568614 - DNA, 22 bp, Homo sapiens
agatccactcgaatccaggaat

SEQ ID NO: 7568615 - DNA, 22 bp, Homo sapiens
agatccactcgaatccaggaat

SEQ ID NO: 7568616 - DNA, 22 bp, Homo sapiens
agatcagaaatgtaatggcagt

SEQ ID NO: 7568617 - DNA, 22 bp, Homo sapiens
agatcagacacggcttgtgacg

SEQ ID NO: 7568618 - DNA, 22 bp, Homo sapiens
agatcagacacggcttgtgacg

SEQ ID NO: 7568619 - DNA, 22 bp, Homo sapiens
agatcagagtggattgtgctgc

SEQ ID NO: 7568620 - DNA, 22 bp, Homo sapiens
agatcagagtggattgtgctgc

SEQ ID NO: 7568621 - DNA, 22 bp, Homo sapiens
agatcagaaagccaatatcata

SEQ ID NO: 7568622 - DNA, 22 bp, Homo sapiens
agatcagaaatgtaatggcagt

SEQ ID NO: 7568623 - DNA, 22 bp, Homo sapiens
agatcactttgatgctacctgg

SEQ ID NO: 7568624 - DNA, 22 bp, Homo sapiens
agatcactggttacttaatgaa

SEQ ID NO: 7568625 - DNA, 22 bp, Homo sapiens
agatcactttgatgctacctgg

SEQ ID NO: 7568626 - DNA, 22 bp, Homo sapiens
agatcatatgaaaaatttcaag

SEQ ID NO: 7568627 - DNA, 22 bp, Homo sapiens
agatcatagcacaaaagtgaca

SEQ ID NO: 7568628 - DNA, 22 bp, Homo sapiens
agatcatactacttgtactaaa

SEQ ID NO: 7568629 - DNA, 22 bp, Homo sapiens
agatcagttagatagcttgatg

SEQ ID NO: 7568630 - DNA, 22 bp, Homo sapiens
agatcagtaagaggaagaatgg

SEQ ID NO: 7568631 - DNA, 23 bp, Homo sapiens
agatcagcatggatcagtcttct

SEQ ID NO: 7568632 - DNA, 22 bp, Homo sapiens
agatcagattctgcctttgtga

SEQ ID NO: 7568633 - DNA, 22 bp, Homo sapiens
agatcagagtggattgtgctgc

SEQ ID NO: 7568634 - DNA, 22 bp, Homo sapiens
agatgctttcctgatatttatg

SEQ ID NO: 7568635 - DNA, 22 bp, Homo sapiens
agatgctttttaggtattacct

SEQ ID NO: 7568636 - DNA, 22 bp, Homo sapiens
agatggaaaatatagacagaga

SEQ ID NO: 7568637 - DNA, 22 bp, Homo sapiens
agatggagaccttggatgaact

SEQ ID NO: 7568638 - DNA, 22 bp, Homo sapiens
agatggaaaatatagacagaga

SEQ ID NO: 7568639 - DNA, 22 bp, Homo sapiens
agatggaaaatatagacagaga

SEQ ID NO: 7568640 - DNA, 22 bp, Homo sapiens
agatggaaaatatagacagaga

SEQ ID NO: 7568641 - DNA, 22 bp, Homo sapiens
agatggaaaatatagacagaga

SEQ ID NO: 7568642 - DNA, 22 bp, Homo sapiens
agatgcttcagtgtttaattta

SEQ ID NO: 7568643 - DNA, 22 bp, Homo sapiens
agatgctttcctgatatttatg

SEQ ID NO: 7568644 - DNA, 22 bp, Homo sapiens
agatgcttcagtgtttaattta

SEQ ID NO: 7568645 - DNA, 22 bp, Homo sapiens
agatgcttactatggttgtatg

SEQ ID NO: 7568646 - DNA, 22 bp, Homo sapiens
agatgcttaagttttcagtgta

SEQ ID NO: 7568647 - DNA, 22 bp, Homo sapiens
agatgctgtgtctgttcccttg

SEQ ID NO: 7568648 - DNA, 22 bp, Homo sapiens
agatgctgggatgcttggatgg

SEQ ID NO: 7568649 - DNA, 22 bp, Homo sapiens
agatgctggggcccctcggatg

SEQ ID NO: 7568650 - DNA, 22 bp, Homo sapiens
agatgctgggaggctgagtgca

SEQ ID NO: 7568651 - DNA, 22 bp, Homo sapiens
agatgcagaaaaactaagtgat

SEQ ID NO: 7568652 - DNA, 22 bp, Homo sapiens
agatgcagaaaaactaagtgat

SEQ ID NO: 7568653 - DNA, 22 bp, Homo sapiens
agatgctgtcacacacactgtt

SEQ ID NO: 7568654 - DNA, 22 bp, Homo sapiens
attggcatagtaggacagatca

SEQ ID NO: 7568655 - DNA, 22 bp, Homo sapiens
attggcataggttaaacagcgg

SEQ ID NO: 7568656 - DNA, 22 bp, Homo sapiens
attggcatatccacgacaatgc

SEQ ID NO: 7568657 - DNA, 22 bp, Homo sapiens
attggcataggttaaacagcgg

SEQ ID NO: 7568658 - DNA, 22 bp, Homo sapiens
attggcagttggctgtggttca

SEQ ID NO: 7568659 - DNA, 22 bp, Homo sapiens
attggcatactttctatattca

SEQ ID NO: 7568660 - DNA, 22 bp, Homo sapiens
agagtggcagcaagtcaggtag

SEQ ID NO: 7568661 - DNA, 22 bp, Homo sapiens
agagtggcagtaaaatagagca

SEQ ID NO: 7568662 - DNA, 22 bp, Homo sapiens
agagtggcagcaaaaagtgtgc

SEQ ID NO: 7568663 - DNA, 22 bp, Homo sapiens
agagtggcagtaaaatagagca

SEQ ID NO: 7568664 - DNA, 22 bp, Homo sapiens
agagtggcccgttggcctgaac

SEQ ID NO: 7568665 - DNA, 22 bp, Homo sapiens
agagtggagagaaacaactctg

SEQ ID NO: 7568666 - DNA, 21 bp, Homo sapiens
agagtggcaaagtgtccaaga

SEQ ID NO: 7568667 - DNA, 22 bp, Homo sapiens
agagtggagagaaacaactctg

SEQ ID NO: 7568668 - DNA, 22 bp, Homo sapiens
agagtgctttattagatgtagc

SEQ ID NO: 7568669 - DNA, 22 bp, Homo sapiens
agagtggcagcaagtcaggtag

SEQ ID NO: 7568670 - DNA, 22 bp, Homo sapiens
agagtggcagcaaaaagtgtgc

SEQ ID NO: 7568671 - DNA, 22 bp, Homo sapiens
agagtggcaccttacctgagac

SEQ ID NO: 7568672 - DNA, 22 bp, Homo sapiens
agagtggcaccttacctgagac

SEQ ID NO: 7568673 - DNA, 22 bp, Homo sapiens
attggcttgcactgtattttaa

SEQ ID NO: 7568674 - DNA, 22 bp, Homo sapiens
attggctttgatatctaaaggg

SEQ ID NO: 7568675 - DNA, 22 bp, Homo sapiens
attgggaagatttagatccact

SEQ ID NO: 7568676 - DNA, 22 bp, Homo sapiens
attgggaagatttagatccact

SEQ ID NO: 7568677 - DNA, 22 bp, Homo sapiens
attggcttagttggcaattgtt

SEQ ID NO: 7568678 - DNA, 22 bp, Homo sapiens
attggcttcgaaagttatatta

SEQ ID NO: 7568679 - DNA, 22 bp, Homo sapiens
attggcttcgaaagttatatta

SEQ ID NO: 7568680 - DNA, 22 bp, Homo sapiens
attggctttcttttgtgaaaat

SEQ ID NO: 7568681 - DNA, 22 bp, Homo sapiens
attggctcctagtcagctgagc

SEQ ID NO: 7568682 - DNA, 22 bp, Homo sapiens
attggctccttctaacatgtct

SEQ ID NO: 7568683 - DNA, 22 bp, Homo sapiens
attggcttccttcttattgtca

SEQ ID NO: 7568684 - DNA, 22 bp, Homo sapiens
attggcttccttcttattgtca

SEQ ID NO: 7568685 - DNA, 20 bp, Homo sapiens
attggccaggcataaaacac

SEQ ID NO: 7568686 - DNA, 22 bp, Homo sapiens
attggccatttgcatgtattat

SEQ ID NO: 7568687 - DNA, 22 bp, Homo sapiens
attggccatttgcatgtattat

SEQ ID NO: 7568688 - DNA, 22 bp, Homo sapiens
attggcatgacagatttgaggc

SEQ ID NO: 7568689 - DNA, 22 bp, Homo sapiens
attggcatgacagatttgaggc

SEQ ID NO: 7568690 - DNA, 22 bp, Homo sapiens
attggccagacttatccttcag

SEQ ID NO: 7568691 - DNA, 22 bp, Homo sapiens
attggcatttctcacagtcccc

SEQ ID NO: 7568692 - DNA, 21 bp, Homo sapiens
attggcctgtttacagagtga

SEQ ID NO: 7568693 - DNA, 22 bp, Homo sapiens
attggcctaaagaaatgacaga

SEQ ID NO: 7568694 - DNA, 22 bp, Homo sapiens
attggccatttgcatgtattat

SEQ ID NO: 7568695 - DNA, 22 bp, Homo sapiens
attggccatttgcatgtattat

SEQ ID NO: 7568696 - DNA, 22 bp, Homo sapiens
attggccatttgcatgtattat

SEQ ID NO: 7568697 - DNA, 22 bp, Homo sapiens
attgggcggtgtccagaggctc

SEQ ID NO: 7568698 - DNA, 22 bp, Homo sapiens
attgggatgccggctgataaga

SEQ ID NO: 7568699 - DNA, 22 bp, Homo sapiens
attgggatgccggctgataaga

SEQ ID NO: 7568700 - DNA, 22 bp, Homo sapiens
attgggagtgtcctgatatccc

SEQ ID NO: 7568701 - DNA, 22 bp, Homo sapiens
attgggatgccggctgataaga

SEQ ID NO: 7568702 - DNA, 22 bp, Homo sapiens
attgggatgccggctgataaga

SEQ ID NO: 7568703 - DNA, 22 bp, Homo sapiens
attgggatgccggctgataaga

SEQ ID NO: 7568704 - DNA, 22 bp, Homo sapiens
attgggatgccggctgataaga

SEQ ID NO: 7568705 - DNA, 22 bp, Homo sapiens
attgggatgccggctgataaga

SEQ ID NO: 7568706 - DNA, 22 bp, Homo sapiens
attgggatgccggctgataaga

SEQ ID NO: 7568707 - DNA, 22 bp, Homo sapiens
attgggctttatgtaggggaag

SEQ ID NO: 7568708 - DNA, 22 bp, Homo sapiens
attgggctggattaggactgtt

SEQ ID NO: 7568709 - DNA, 22 bp, Homo sapiens
attgggctggccttctggagag

SEQ ID NO: 7568710 - DNA, 22 bp, Homo sapiens
attgggctgcaccccagagttt

SEQ ID NO: 7568711 - DNA, 22 bp, Homo sapiens
attgggctggccttctggagag

SEQ ID NO: 7568712 - DNA, 22 bp, Homo sapiens
attgggctggccttctggagag

SEQ ID NO: 7568713 - DNA, 22 bp, Homo sapiens
attggtagttttgtatttctct

SEQ ID NO: 7568714 - DNA, 22 bp, Homo sapiens
attggtagttttgtatttctct

SEQ ID NO: 7568715 - DNA, 22 bp, Homo sapiens
attggtatgtattctgaaaact

SEQ ID NO: 7568716 - DNA, 22 bp, Homo sapiens
attggtagttttgtatttctct

SEQ ID NO: 7568717 - DNA, 22 bp, Homo sapiens
attggtaagcaagatggcaata

SEQ ID NO: 7568718 - DNA, 22 bp, Homo sapiens
attgggctctactgaagggagg

SEQ ID NO: 7568719 - DNA, 22 bp, Homo sapiens
attggtagttttgtatttctct

SEQ ID NO: 7568720 - DNA, 22 bp, Homo sapiens
attggtcataaattgagtgatt

SEQ ID NO: 7568721 - DNA, 22 bp, Homo sapiens
attggtcacctccctcagctct

SEQ ID NO: 7568722 - DNA, 22 bp, Homo sapiens
attggtcccctcctatgtgcca

SEQ ID NO: 7568723 - DNA, 22 bp, Homo sapiens
attggtccatttaccctctctt

SEQ ID NO: 7568724 - DNA, 22 bp, Homo sapiens
attggtctaggctttaaaaaga

SEQ ID NO: 7568725 - DNA, 18 bp, Homo sapiens
attggtcctgtccaccca

SEQ ID NO: 7568726 - DNA, 22 bp, Homo sapiens
attggtctaaagttaagaagat

SEQ ID NO: 7568727 - DNA, 21 bp, Homo sapiens
agatagttgggcatgcagctg

SEQ ID NO: 7568728 - DNA, 22 bp, Homo sapiens
attggtctggggaaatgaagag

SEQ ID NO: 7568729 - DNA, 22 bp, Homo sapiens
attggtctggggaaatgaagag

SEQ ID NO: 7568730 - DNA, 22 bp, Homo sapiens
attggtctccacttgttttaga

SEQ ID NO: 7568731 - DNA, 22 bp, Homo sapiens
attggtctaggctttaaaaaga

SEQ ID NO: 7568732 - DNA, 22 bp, Homo sapiens
attggtctaggctttaaaaaga

SEQ ID NO: 7568733 - DNA, 22 bp, Homo sapiens
attggtctctgctaaagggagg

SEQ ID NO: 7568734 - DNA, 22 bp, Homo sapiens
attggtctctagagtctattgt

SEQ ID NO: 7568735 - DNA, 22 bp, Homo sapiens
agatcaaggacatgaagaggct

SEQ ID NO: 7568736 - DNA, 22 bp, Homo sapiens
agatcaagggagtgctcactct

SEQ ID NO: 7568737 - DNA, 22 bp, Homo sapiens
agatcaatgtgtcagaagagat

SEQ ID NO: 7568738 - DNA, 22 bp, Homo sapiens
agatcaatgtgtcagaagagat

SEQ ID NO: 7568739 - DNA, 22 bp, Homo sapiens
agatcaaggtgtcagcaggctt

SEQ ID NO: 7568740 - DNA, 22 bp, Homo sapiens
agatcaaggtgtcagcaggctt

SEQ ID NO: 7568741 - DNA, 22 bp, Homo sapiens
agatcacagagccaagattcca

SEQ ID NO: 7568742 - DNA, 22 bp, Homo sapiens
agatcacagcccccagatgcca

SEQ ID NO: 7568743 - DNA, 22 bp, Homo sapiens
agatcacagagccaagattcca

SEQ ID NO: 7568744 - DNA, 22 bp, Homo sapiens
agatcacagagccaagattcca

SEQ ID NO: 7568745 - DNA, 22 bp, Homo sapiens
agatcacagcccccagatgcca

SEQ ID NO: 7568746 - DNA, 22 bp, Homo sapiens
agatcaaatctgggatttctaa

SEQ ID NO: 7568747 - DNA, 22 bp, Homo sapiens
agatcaaagccatgagagattt

SEQ ID NO: 7568748 - DNA, 22 bp, Homo sapiens
agatcaaagccatgagagattt

SEQ ID NO: 7568749 - DNA, 22 bp, Homo sapiens
agatcaaaaacttaatggcttt

SEQ ID NO: 7568750 - DNA, 22 bp, Homo sapiens
agatattttgtgtgatgtttca

SEQ ID NO: 7568751 - DNA, 22 bp, Homo sapiens
agatattttgtgtgatgtttca

SEQ ID NO: 7568752 - DNA, 22 bp, Homo sapiens
agatattttgtgtgatgtttca

SEQ ID NO: 7568753 - DNA, 22 bp, Homo sapiens
agatcacagtggcaactccctt

SEQ ID NO: 7568754 - DNA, 22 bp, Homo sapiens
agatcacagtggcaactccctt

SEQ ID NO: 7568755 - DNA, 22 bp, Homo sapiens
agatcacagtggcaactccctt

SEQ ID NO: 7568756 - DNA, 22 bp, Homo sapiens
agatcacataatttcctgtgac

SEQ ID NO: 7568757 - DNA, 22 bp, Homo sapiens
agatcacataatttcctgtgac

SEQ ID NO: 7568758 - DNA, 23 bp, Homo sapiens
agatcacatgctgatggaaaatg

SEQ ID NO: 7568759 - DNA, 23 bp, Homo sapiens
agatcacatgctgatggaaaatg

SEQ ID NO: 7568760 - DNA, 22 bp, Homo sapiens
agatcactggttacttaatgaa

SEQ ID NO: 7568761 - DNA, 22 bp, Homo sapiens
agatcactgaattgaaagtaat

SEQ ID NO: 7568762 - DNA, 23 bp, Homo sapiens
agatcacatgctgatggaaaatg

SEQ ID NO: 7568763 - DNA, 22 bp, Homo sapiens
agatcactgaattgaaagtaat

SEQ ID NO: 7568764 - DNA, 22 bp, Homo sapiens
agatattaggaggattcataat

SEQ ID NO: 7568765 - DNA, 22 bp, Homo sapiens
agatattaggaggattcataat

SEQ ID NO: 7568766 - DNA, 22 bp, Homo sapiens
agatattaccagcagtctatgc

SEQ ID NO: 7568767 - DNA, 22 bp, Homo sapiens
agatattaggaggattcataat

SEQ ID NO: 7568768 - DNA, 22 bp, Homo sapiens
agatattaggaggattcataat

SEQ ID NO: 7568769 - DNA, 22 bp, Homo sapiens
agatattaggaggattcataat

SEQ ID NO: 7568770 - DNA, 22 bp, Homo sapiens
agatattctgcctaacaggttt

SEQ ID NO: 7568771 - DNA, 22 bp, Homo sapiens
agatattctagaacctagtaga

SEQ ID NO: 7568772 - DNA, 22 bp, Homo sapiens
agatattctagaacctagtaga

SEQ ID NO: 7568773 - DNA, 22 bp, Homo sapiens
agatattaggaggattcataat

SEQ ID NO: 7568774 - DNA, 22 bp, Homo sapiens
agatattaatcgtacataaggt

SEQ ID NO: 7568775 - DNA, 22 bp, Homo sapiens
agatataataatttacaagtgt

SEQ ID NO: 7568776 - DNA, 22 bp, Homo sapiens
agatattaatcgtacataaggt

SEQ ID NO: 7568777 - DNA, 22 bp, Homo sapiens
agatataataatttacaagtgt

SEQ ID NO: 7568778 - DNA, 22 bp, Homo sapiens
agatataataatttacaagtgt

SEQ ID NO: 7568779 - DNA, 22 bp, Homo sapiens
agatataataatttacaagtgt

SEQ ID NO: 7568780 - DNA, 22 bp, Homo sapiens
agatattaccagcagtctatgc

SEQ ID NO: 7568781 - DNA, 22 bp, Homo sapiens
agatattaatcgtacataaggt

SEQ ID NO: 7568782 - DNA, 22 bp, Homo sapiens
agatatttgtatcttgctattg

SEQ ID NO: 7568783 - DNA, 22 bp, Homo sapiens
agatattttgtgtgatgtttca

SEQ ID NO: 7568784 - DNA, 22 bp, Homo sapiens
agatattttgtgtgatgtttca

SEQ ID NO: 7568785 - DNA, 22 bp, Homo sapiens
agatattttgtgtgatgtttca

SEQ ID NO: 7568786 - DNA, 22 bp, Homo sapiens
agatatttgtatcttgctattg

SEQ ID NO: 7568787 - DNA, 22 bp, Homo sapiens
agatatttgtatcttgctattg

SEQ ID NO: 7568788 - DNA, 22 bp, Homo sapiens
agatatttgtatcttgctattg

SEQ ID NO: 7568789 - DNA, 22 bp, Homo sapiens
agatatttgtatcttgctattg

SEQ ID NO: 7568790 - DNA, 22 bp, Homo sapiens
agatatttaaatcagacaaaga

SEQ ID NO: 7568791 - DNA, 22 bp, Homo sapiens
agatatttaaatcagacaaaga

SEQ ID NO: 7568792 - DNA, 22 bp, Homo sapiens
agatatttgtatcttgctattg

SEQ ID NO: 7568793 - DNA, 22 bp, Homo sapiens
agatatttaaatcagacaaaga

SEQ ID NO: 7568794 - DNA, 22 bp, Homo sapiens
agatatttaaatcagacaaaga

SEQ ID NO: 7568795 - DNA, 22 bp, Homo sapiens
agatatttaaatcagacaaaga

SEQ ID NO: 7568796 - DNA, 22 bp, Homo sapiens
agatatttaaatcagacaaaga

SEQ ID NO: 7568797 - DNA, 22 bp, Homo sapiens
agatatttaaatcagacaaaga

SEQ ID NO: 7568798 - DNA, 22 bp, Homo sapiens
agatatttaaatcagacaaaga

SEQ ID NO: 7568799 - DNA, 22 bp, Homo sapiens
agatatttaaatcagacaaaga

SEQ ID NO: 7568800 - DNA, 22 bp, Homo sapiens
agatatttaaatcagacaaaga

SEQ ID NO: 7568801 - DNA, 22 bp, Homo sapiens
agatattgtgcatactgctgtt

SEQ ID NO: 7568802 - DNA, 22 bp, Homo sapiens
agatattgtttgtttcaccaat

SEQ ID NO: 7568803 - DNA, 22 bp, Homo sapiens
agcaacagcaacgacatttctc

SEQ ID NO: 7568804 - DNA, 22 bp, Homo sapiens
agcaacagaagatagagtgaat

SEQ ID NO: 7568805 - DNA, 22 bp, Homo sapiens
agcaacagaagatagagtgaat

SEQ ID NO: 7568806 - DNA, 22 bp, Homo sapiens
agcaacagaagatagagtgaat

SEQ ID NO: 7568807 - DNA, 22 bp, Homo sapiens
agcaacagaagatagagtgaat

SEQ ID NO: 7568808 - DNA, 22 bp, Homo sapiens
agcaacagaagatagagtgaat

SEQ ID NO: 7568809 - DNA, 22 bp, Homo sapiens
agcaacagaagatagagtgaat

SEQ ID NO: 7568810 - DNA, 22 bp, Homo sapiens
agcaacagccctgaggttcatg

SEQ ID NO: 7568811 - DNA, 22 bp, Homo sapiens
agcaacagccctgaggttcatg

SEQ ID NO: 7568812 - DNA, 22 bp, Homo sapiens
agcaacagccctgaggttcatg

SEQ ID NO: 7568813 - DNA, 22 bp, Homo sapiens
agcaacagcaggtttgcactcc

SEQ ID NO: 7568814 - DNA, 22 bp, Homo sapiens
agcaacagcaggtttgcactcc

SEQ ID NO: 7568815 - DNA, 22 bp, Homo sapiens
agcaacagcaacgacatttctc

SEQ ID NO: 7568816 - DNA, 22 bp, Homo sapiens
agcaacaggaaatagctgatta

SEQ ID NO: 7568817 - DNA, 22 bp, Homo sapiens
agcaacaggaaatagctgatta

SEQ ID NO: 7568818 - DNA, 22 bp, Homo sapiens
agcaacaggaaatagctgatta

SEQ ID NO: 7568819 - DNA, 22 bp, Homo sapiens
agcaacaggaatattatggcaa

SEQ ID NO: 7568820 - DNA, 22 bp, Homo sapiens
agcaacaggaatattatggcaa

SEQ ID NO: 7568821 - DNA, 19 bp, Homo sapiens
agcaacaccgtttatttcc

SEQ ID NO: 7568822 - DNA, 20 bp, Homo sapiens
agcaacaataaaatgtcctg

SEQ ID NO: 7568823 - DNA, 22 bp, Homo sapiens
agcaaattaggtcaaggagatg

SEQ ID NO: 7568824 - DNA, 22 bp, Homo sapiens
agcaaattcagaagcagaatgg

SEQ ID NO: 7568825 - DNA, 22 bp, Homo sapiens
agcaaattcagaagcagaatgg

SEQ ID NO: 7568826 - DNA, 18 bp, Homo sapiens
agcaacagaaacatatgg

SEQ ID NO: 7568827 - DNA, 22 bp, Homo sapiens
agcaacacgcagtagtatacga

SEQ ID NO: 7568828 - DNA, 19 bp, Homo sapiens
agcaacaccgtttatttcc

SEQ ID NO: 7568829 - DNA, 22 bp, Homo sapiens
agcaaattaggtcaaggagatg

SEQ ID NO: 7568830 - DNA, 22 bp, Homo sapiens
agcaaattcagaagcagaatgg

SEQ ID NO: 7568831 - DNA, 22 bp, Homo sapiens
agcaaatgggtttatatttgac

SEQ ID NO: 7568832 - DNA, 22 bp, Homo sapiens
agcaaattaggtcaaggagatg

SEQ ID NO: 7568833 - DNA, 22 bp, Homo sapiens
agcaaattaggtcaaggagatg

SEQ ID NO: 7568834 - DNA, 22 bp, Homo sapiens
agcaaatgggtttatatttgac

SEQ ID NO: 7568835 - DNA, 22 bp, Homo sapiens
agcaaatggatttctgaaccta

SEQ ID NO: 7568836 - DNA, 22 bp, Homo sapiens
agcaaatggatttctgaaccta

SEQ ID NO: 7568837 - DNA, 22 bp, Homo sapiens
agcaaatctatgaatgtatatt

SEQ ID NO: 7568838 - DNA, 22 bp, Homo sapiens
agcaaatcagctgctcaggaaa

SEQ ID NO: 7568839 - DNA, 22 bp, Homo sapiens
agcaaatctatgaatgtatatt

SEQ ID NO: 7568840 - DNA, 22 bp, Homo sapiens
agcaaagctcatgacattacag

SEQ ID NO: 7568841 - DNA, 22 bp, Homo sapiens
agatgtttataactcatgagtg

SEQ ID NO: 7568842 - DNA, 22 bp, Homo sapiens
agcaaagctatctctatggaga

SEQ ID NO: 7568843 - DNA, 22 bp, Homo sapiens
agatgtttaaaaagatgactct

SEQ ID NO: 7568844 - DNA, 22 bp, Homo sapiens
agatgtttataactcatgagtg

SEQ ID NO: 7568845 - DNA, 22 bp, Homo sapiens
agcaaagctatctctatggaga

SEQ ID NO: 7568846 - DNA, 22 bp, Homo sapiens
agcaaagctcatgacattacag

SEQ ID NO: 7568847 - DNA, 22 bp, Homo sapiens
agcaaatattttgttgaagtgc

SEQ ID NO: 7568848 - DNA, 22 bp, Homo sapiens
agatgttatcattcagagtagc

SEQ ID NO: 7568849 - DNA, 22 bp, Homo sapiens
agatgttatcattcagagtagc

SEQ ID NO: 7568850 - DNA, 22 bp, Homo sapiens
agatgttatcattcagagtagc

SEQ ID NO: 7568851 - DNA, 22 bp, Homo sapiens
agatgtgtttctagttcctgca

SEQ ID NO: 7568852 - DNA, 22 bp, Homo sapiens
agatgtgtttctagttcctgca

SEQ ID NO: 7568853 - DNA, 22 bp, Homo sapiens
agatgtgtttctagttcctgca

SEQ ID NO: 7568854 - DNA, 22 bp, Homo sapiens
agatgtgggagatgcttctgca

SEQ ID NO: 7568855 - DNA, 22 bp, Homo sapiens
agatgtgggagatgcttctgca

SEQ ID NO: 7568856 - DNA, 22 bp, Homo sapiens
agatgtgggcaaaaggcttagc

SEQ ID NO: 7568857 - DNA, 22 bp, Homo sapiens
agatgtgggcaatggaatggag

SEQ ID NO: 7568858 - DNA, 22 bp, Homo sapiens
agatgtgggcaatggaatggag

SEQ ID NO: 7568859 - DNA, 22 bp, Homo sapiens
agatgtgggtgtcaggcagtga

SEQ ID NO: 7568860 - DNA, 22 bp, Homo sapiens
agatgtgggtgtcaggcagtga

SEQ ID NO: 7568861 - DNA, 22 bp, Homo sapiens
agatgtgggtgtcaggcagtga

SEQ ID NO: 7568862 - DNA, 22 bp, Homo sapiens
agatgtgggtgtcaggcagtga

SEQ ID NO: 7568863 - DNA, 22 bp, Homo sapiens
agatgtgggcaatggaatggag

SEQ ID NO: 7568864 - DNA, 22 bp, Homo sapiens
agatgtgggcaatggaatggag

SEQ ID NO: 7568865 - DNA, 22 bp, Homo sapiens
agatgtggtgaaatgcctccca

SEQ ID NO: 7568866 - DNA, 22 bp, Homo sapiens
agatgtggtgaaatgcctccca

SEQ ID NO: 7568867 - DNA, 22 bp, Homo sapiens
agatgtggtagttgaagggaag

SEQ ID NO: 7568868 - DNA, 22 bp, Homo sapiens
agatgtggtagttgaagggaag

SEQ ID NO: 7568869 - DNA, 22 bp, Homo sapiens
agatgtgggtgtcaggcagtga

SEQ ID NO: 7568870 - DNA, 22 bp, Homo sapiens
agatgtggtagttgaagggaag

SEQ ID NO: 7568871 - DNA, 22 bp, Homo sapiens
agatgtggtagttgaagggaag

SEQ ID NO: 7568872 - DNA, 22 bp, Homo sapiens
agatgtgtttctagttcctgca

SEQ ID NO: 7568873 - DNA, 22 bp, Homo sapiens
agatgtgtttctagttcctgca

SEQ ID NO: 7568874 - DNA, 22 bp, Homo sapiens
agatgtgtttctagttcctgca

SEQ ID NO: 7568875 - DNA, 22 bp, Homo sapiens
agatgtgtttctagttcctgca

SEQ ID NO: 7568876 - DNA, 22 bp, Homo sapiens
agatgtggttattctcttcctt

SEQ ID NO: 7568877 - DNA, 22 bp, Homo sapiens
agatgtggttattctcttcctt

SEQ ID NO: 7568878 - DNA, 22 bp, Homo sapiens
agatgtgtttctagttcctgca

SEQ ID NO: 7568879 - DNA, 22 bp, Homo sapiens
agatgtgtttctagttcctgca

SEQ ID NO: 7568880 - DNA, 22 bp, Homo sapiens
agatgtgtttctagttcctgca

SEQ ID NO: 7568881 - DNA, 22 bp, Homo sapiens
attttcaccctgaatatattga

SEQ ID NO: 7568882 - DNA, 22 bp, Homo sapiens
attttcaccctgaatatattga

SEQ ID NO: 7568883 - DNA, 22 bp, Homo sapiens
attttcaccctgaatatattga

SEQ ID NO: 7568884 - DNA, 22 bp, Homo sapiens
attttcaccctgaatatattga

SEQ ID NO: 7568885 - DNA, 22 bp, Homo sapiens
attttcaccctgaatatattga

SEQ ID NO: 7568886 - DNA, 22 bp, Homo sapiens
attttcaagggagaggcctctg

SEQ ID NO: 7568887 - DNA, 22 bp, Homo sapiens
attttcaagggagaggcctctg

SEQ ID NO: 7568888 - DNA, 22 bp, Homo sapiens
attttcaagggagaggcctctg

SEQ ID NO: 7568889 - DNA, 22 bp, Homo sapiens
attttcaccctgaatatattga

SEQ ID NO: 7568890 - DNA, 22 bp, Homo sapiens
attttcaccctgaatatattga

SEQ ID NO: 7568891 - DNA, 22 bp, Homo sapiens
attttcaccctgaatatattga

SEQ ID NO: 7568892 - DNA, 22 bp, Homo sapiens
attttcagaacattcattcact

SEQ ID NO: 7568893 - DNA, 22 bp, Homo sapiens
attttcagaacattcattcact

SEQ ID NO: 7568894 - DNA, 22 bp, Homo sapiens
attttcagaacattcattcact

SEQ ID NO: 7568895 - DNA, 22 bp, Homo sapiens
attttcagaacattcattcact

SEQ ID NO: 7568896 - DNA, 22 bp, Homo sapiens
attttcagagacatctggactt

SEQ ID NO: 7568897 - DNA, 22 bp, Homo sapiens
agatgtggcctttgggagatta

SEQ ID NO: 7568898 - DNA, 22 bp, Homo sapiens
agatgtggctgcacccaccgct

SEQ ID NO: 7568899 - DNA, 22 bp, Homo sapiens
agatgtggcctttgggagatta

SEQ ID NO: 7568900 - DNA, 22 bp, Homo sapiens
agatgtggcctttgggagatta

SEQ ID NO: 7568901 - DNA, 22 bp, Homo sapiens
agatgtggccggctagggagag

SEQ ID NO: 7568902 - DNA, 22 bp, Homo sapiens
agatgtggccggctagggagag

SEQ ID NO: 7568903 - DNA, 22 bp, Homo sapiens
agatgtggccggctagggagag

SEQ ID NO: 7568904 - DNA, 22 bp, Homo sapiens
agatgtggccggctagggagag

SEQ ID NO: 7568905 - DNA, 22 bp, Homo sapiens
agatgtggcctttgggagatta

SEQ ID NO: 7568906 - DNA, 22 bp, Homo sapiens
agatgtggatcctagggtagaa

SEQ ID NO: 7568907 - DNA, 22 bp, Homo sapiens
agatgtggatcctagggtagaa

SEQ ID NO: 7568908 - DNA, 22 bp, Homo sapiens
agatgtggatcctagggtagaa

SEQ ID NO: 7568909 - DNA, 22 bp, Homo sapiens
agatgtggatcctagggtagaa

SEQ ID NO: 7568910 - DNA, 22 bp, Homo sapiens
agatgtggatcctagggtagaa

SEQ ID NO: 7568911 - DNA, 22 bp, Homo sapiens
agatgtggccggctagggagag

SEQ ID NO: 7568912 - DNA, 22 bp, Homo sapiens
agatgtggccggctagggagag

SEQ ID NO: 7568913 - DNA, 22 bp, Homo sapiens
agatgtggccggctagggagag

SEQ ID NO: 7568914 - DNA, 22 bp, Homo sapiens
agatgtggatgagtcgccgacc

SEQ ID NO: 7568915 - DNA, 22 bp, Homo sapiens
attttatgacacgattcttcca

SEQ ID NO: 7568916 - DNA, 22 bp, Homo sapiens
attttatgacacgattcttcca

SEQ ID NO: 7568917 - DNA, 22 bp, Homo sapiens
attttatgacacgattcttcca

SEQ ID NO: 7568918 - DNA, 22 bp, Homo sapiens
attttatctgcttactttcagg

SEQ ID NO: 7568919 - DNA, 22 bp, Homo sapiens
attttatgacacgattcttcca

SEQ ID NO: 7568920 - DNA, 22 bp, Homo sapiens
attttcaaaacatctgctgtgt

SEQ ID NO: 7568921 - DNA, 22 bp, Homo sapiens
attttcaaaacatctgctgtgt

SEQ ID NO: 7568922 - DNA, 22 bp, Homo sapiens
attttcaaaacatctgctgtgt

SEQ ID NO: 7568923 - DNA, 22 bp, Homo sapiens
attttatccccactggattaca

SEQ ID NO: 7568924 - DNA, 22 bp, Homo sapiens
attttagttttagcatccatgc

SEQ ID NO: 7568925 - DNA, 22 bp, Homo sapiens
attttagttttagcatccatgc

SEQ ID NO: 7568926 - DNA, 22 bp, Homo sapiens
attttagttttagcatccatgc

SEQ ID NO: 7568927 - DNA, 22 bp, Homo sapiens
attttatccccactggattaca

SEQ ID NO: 7568928 - DNA, 22 bp, Homo sapiens
attttatccccactggattaca

SEQ ID NO: 7568929 - DNA, 22 bp, Homo sapiens
attttagcaaatgcaagatgga

SEQ ID NO: 7568930 - DNA, 22 bp, Homo sapiens
attttagcaaatgcaagatgga

SEQ ID NO: 7568931 - DNA, 22 bp, Homo sapiens
attttagatttaagaataaggt

SEQ ID NO: 7568932 - DNA, 22 bp, Homo sapiens
agatgggcgccctggactgagg

SEQ ID NO: 7568933 - DNA, 22 bp, Homo sapiens
attttaaccctcttatatatac

SEQ ID NO: 7568934 - DNA, 22 bp, Homo sapiens
attttaaccctcttatatatac

SEQ ID NO: 7568935 - DNA, 22 bp, Homo sapiens
attttaaccctcttatatatac

SEQ ID NO: 7568936 - DNA, 22 bp, Homo sapiens
attttaaccctcttatatatac

SEQ ID NO: 7568937 - DNA, 22 bp, Homo sapiens
attttagctgtccagtggattg

SEQ ID NO: 7568938 - DNA, 22 bp, Homo sapiens
attttagtacctcaagtatcca

SEQ ID NO: 7568939 - DNA, 22 bp, Homo sapiens
attttagtacctcaagtatcca

SEQ ID NO: 7568940 - DNA, 22 bp, Homo sapiens
attttagtacctcaagtatcca

SEQ ID NO: 7568941 - DNA, 22 bp, Homo sapiens
attttagtacctcaagtatcca

SEQ ID NO: 7568942 - DNA, 22 bp, Homo sapiens
attttagtacctcaagtatcca

SEQ ID NO: 7568943 - DNA, 23 bp, Homo sapiens
attttagctgaatgacttcttta

SEQ ID NO: 7568944 - DNA, 23 bp, Homo sapiens
attttagctgaatgacttcttta

SEQ ID NO: 7568945 - DNA, 23 bp, Homo sapiens
caaagatgattggaacatggctt

SEQ ID NO: 7568946 - DNA, 22 bp, Homo sapiens
caaagatatgacatggaaaatg

SEQ ID NO: 7568947 - DNA, 22 bp, Homo sapiens
caaagatatgacatggaaaatg

SEQ ID NO: 7568948 - DNA, 22 bp, Homo sapiens
caaagatatgacatggaaaatg

SEQ ID NO: 7568949 - DNA, 22 bp, Homo sapiens
caaagataatcacagaataccc

SEQ ID NO: 7568950 - DNA, 22 bp, Homo sapiens
caaagatatgacatggaaaatg

SEQ ID NO: 7568951 - DNA, 22 bp, Homo sapiens
caaagatgctgatgttggatca

SEQ ID NO: 7568952 - DNA, 22 bp, Homo sapiens
caaagatgccaaaaggaagaca

SEQ ID NO: 7568953 - DNA, 22 bp, Homo sapiens
caaagatgtcattggtaagaca

SEQ ID NO: 7568954 - DNA, 22 bp, Homo sapiens
caaagattttagaatttgcaat

SEQ ID NO: 7568955 - DNA, 22 bp, Homo sapiens
caaagattttagaatttgcaat

SEQ ID NO: 7568956 - DNA, 22 bp, Homo sapiens
caaagattttagaatttgcaat

SEQ ID NO: 7568957 - DNA, 20 bp, Homo sapiens
agcaagagtaaggacagcga

SEQ ID NO: 7568958 - DNA, 20 bp, Homo sapiens
agcaagagtaaggacagcga

SEQ ID NO: 7568959 - DNA, 20 bp, Homo sapiens
agcaagagtgtacctggcca

SEQ ID NO: 7568960 - DNA, 17 bp, Homo sapiens
caaaccagtaagactgc

SEQ ID NO: 7568961 - DNA, 22 bp, Homo sapiens
caaaccagtaggaagtctatta

SEQ ID NO: 7568962 - DNA, 22 bp, Homo sapiens
caaaccagtaggaagtctatta

SEQ ID NO: 7568963 - DNA, 22 bp, Homo sapiens
caaagataatcacagaataccc

SEQ ID NO: 7568964 - DNA, 22 bp, Homo sapiens
caaagataatcacagaataccc

SEQ ID NO: 7568965 - DNA, 22 bp, Homo sapiens
caaagataatcacagaataccc

SEQ ID NO: 7568966 - DNA, 22 bp, Homo sapiens
caaagataatcacagaataccc

SEQ ID NO: 7568967 - DNA, 22 bp, Homo sapiens
caaagataatcacagaataccc

SEQ ID NO: 7568968 - DNA, 22 bp, Homo sapiens
caaagataatcacagaataccc

SEQ ID NO: 7568969 - DNA, 22 bp, Homo sapiens
caaagataatcacagaataccc

SEQ ID NO: 7568970 - DNA, 22 bp, Homo sapiens
caaagataatcacagaataccc

SEQ ID NO: 7568971 - DNA, 22 bp, Homo sapiens
caaagcaagggctgaagactcc

SEQ ID NO: 7568972 - DNA, 22 bp, Homo sapiens
caaagcaagggctgaagactcc

SEQ ID NO: 7568973 - DNA, 22 bp, Homo sapiens
caaagcaagggctgaagactcc

SEQ ID NO: 7568974 - DNA, 22 bp, Homo sapiens
caaagcaagggctgaagactcc

SEQ ID NO: 7568975 - DNA, 22 bp, Homo sapiens
caaagcaagggctgaagactcc

SEQ ID NO: 7568976 - DNA, 22 bp, Homo sapiens
caaagcaagggctgaagactcc

SEQ ID NO: 7568977 - DNA, 22 bp, Homo sapiens
caaagcaagggctgaagactcc

SEQ ID NO: 7568978 - DNA, 22 bp, Homo sapiens
caaagcaagggctgaagactcc

SEQ ID NO: 7568979 - DNA, 22 bp, Homo sapiens
caaagcaagggctgaagactcc

SEQ ID NO: 7568980 - DNA, 22 bp, Homo sapiens
caaagcaagggctgaagactcc

SEQ ID NO: 7568981 - DNA, 22 bp, Homo sapiens
caaagcaaggctcagtttgaac

SEQ ID NO: 7568982 - DNA, 22 bp, Homo sapiens
caaagcaaggctcagtttgaac

SEQ ID NO: 7568983 - DNA, 22 bp, Homo sapiens
caaagcaaggctcagtttgaac

SEQ ID NO: 7568984 - DNA, 22 bp, Homo sapiens
caaagattttagaatttgcaat

SEQ ID NO: 7568985 - DNA, 22 bp, Homo sapiens
caaagcaaggctcagtttgaac

SEQ ID NO: 7568986 - DNA, 22 bp, Homo sapiens
caaagcaaggctcagtttgaac

SEQ ID NO: 7568987 - DNA, 22 bp, Homo sapiens
caaagcaaggctcagtttgaac

SEQ ID NO: 7568988 - DNA, 22 bp, Homo sapiens
caaagcaccacaaaccaggtga

SEQ ID NO: 7568989 - DNA, 22 bp, Homo sapiens
caaagcaccacaaaccaggtga

SEQ ID NO: 7568990 - DNA, 22 bp, Homo sapiens
caaagcaagggctgaagactcc

SEQ ID NO: 7568991 - DNA, 22 bp, Homo sapiens
caaagcagaaggttctgtggta

SEQ ID NO: 7568992 - DNA, 22 bp, Homo sapiens
caaagcagaaggttctgtggta

SEQ ID NO: 7568993 - DNA, 22 bp, Homo sapiens
caaagcagacctttacccttta

SEQ ID NO: 7568994 - DNA, 22 bp, Homo sapiens
caaagcagacctttacccttta

SEQ ID NO: 7568995 - DNA, 22 bp, Homo sapiens
caaaggcaggtgctgaatattc

SEQ ID NO: 7568996 - DNA, 22 bp, Homo sapiens
caaaggcaggtgctgaatattc

SEQ ID NO: 7568997 - DNA, 22 bp, Homo sapiens
caaaggcaggtgctgaatattc

SEQ ID NO: 7568998 - DNA, 22 bp, Homo sapiens
caaaggcaggtgctgaatattc

SEQ ID NO: 7568999 - DNA, 22 bp, Homo sapiens
caaaggcaggtgctgaatattc

SEQ ID NO: 7569000 - DNA, 22 bp, Homo sapiens
caaaggcaggtgctgaatattc

SEQ ID NO: 7569001 - DNA, 22 bp, Homo sapiens
caaaggcaggtcatggccactt

SEQ ID NO: 7569002 - DNA, 22 bp, Homo sapiens
caaaggcaggtcatggccactt

SEQ ID NO: 7569003 - DNA, 22 bp, Homo sapiens
agcaacaggcataatgtgttga

SEQ ID NO: 7569004 - DNA, 22 bp, Homo sapiens
agcaacaggcataatgtgttga

SEQ ID NO: 7569005 - DNA, 22 bp, Homo sapiens
agcaacagggggatggccactg

SEQ ID NO: 7569006 - DNA, 18 bp, Homo sapiens
agcaacaggatcccaggg

SEQ ID NO: 7569007 - DNA, 18 bp, Homo sapiens
agcaacaggatcccaggg

SEQ ID NO: 7569008 - DNA, 22 bp, Homo sapiens
agcaacagggtggtcttcagaa

SEQ ID NO: 7569009 - DNA, 22 bp, Homo sapiens
agcaacagggggatggccactg

SEQ ID NO: 7569010 - DNA, 22 bp, Homo sapiens
agcaacagggggatggccactg

SEQ ID NO: 7569011 - DNA, 22 bp, Homo sapiens
agcaacagggtggtcttcagaa

SEQ ID NO: 7569012 - DNA, 22 bp, Homo sapiens
agcaacagggtggtcttcagaa

SEQ ID NO: 7569013 - DNA, 22 bp, Homo sapiens
agcaacagtgtatatcataggc

SEQ ID NO: 7569014 - DNA, 23 bp, Homo sapiens
agcaacagtgggtgagtgttgct

SEQ ID NO: 7569015 - DNA, 22 bp, Homo sapiens
agcaacagggtggtcttcagaa

SEQ ID NO: 7569016 - DNA, 22 bp, Homo sapiens
agcaacatatatcaatgcctga

SEQ ID NO: 7569017 - DNA, 22 bp, Homo sapiens
agcaacattgagactgcagttg

SEQ ID NO: 7569018 - DNA, 22 bp, Homo sapiens
agcaacattgagactgcagttg

SEQ ID NO: 7569019 - DNA, 22 bp, Homo sapiens
agcaacattgagactgcagttg

SEQ ID NO: 7569020 - DNA, 22 bp, Homo sapiens
agcaacattgagactgcagttg

SEQ ID NO: 7569021 - DNA, 22 bp, Homo sapiens
agcaacatttttcaattaacat

SEQ ID NO: 7569022 - DNA, 22 bp, Homo sapiens
agcaacatttttcaattaacat

SEQ ID NO: 7569023 - DNA, 22 bp, Homo sapiens
agcaacatttttcaattaacat

SEQ ID NO: 7569024 - DNA, 22 bp, Homo sapiens
agcaacatttttcaattaacat

SEQ ID NO: 7569025 - DNA, 23 bp, Homo sapiens
agcaacagtgggtgagtgttgct

SEQ ID NO: 7569026 - DNA, 21 bp, Homo sapiens
agcaactctgactagatgagg

SEQ ID NO: 7569027 - DNA, 22 bp, Homo sapiens
agcaactatattgaaagccacc

SEQ ID NO: 7569028 - DNA, 21 bp, Homo sapiens
agcaactctgactagatgagg

SEQ ID NO: 7569029 - DNA, 22 bp, Homo sapiens
agcaactgttacaagaacaaca

SEQ ID NO: 7569030 - DNA, 17 bp, Homo sapiens
agcaacctcctcttcct

SEQ ID NO: 7569031 - DNA, 22 bp, Homo sapiens
agcaacctgccaccacaggcaa

SEQ ID NO: 7569032 - DNA, 19 bp, Homo sapiens
agcaacctgtcagagatgc

SEQ ID NO: 7569033 - DNA, 22 bp, Homo sapiens
agcaagagatttccctacctcc

SEQ ID NO: 7569034 - DNA, 22 bp, Homo sapiens
agcaagagatttccctacctcc

SEQ ID NO: 7569035 - DNA, 22 bp, Homo sapiens
agcaagagcatgtcggcctggt

SEQ ID NO: 7569036 - DNA, 22 bp, Homo sapiens
agcaagagcatgtcggcctggt

SEQ ID NO: 7569037 - DNA, 22 bp, Homo sapiens
agcaagagcatgtcggcctggt

SEQ ID NO: 7569038 - DNA, 20 bp, Homo sapiens
agcaagagtaaggacagcga

SEQ ID NO: 7569039 - DNA, 20 bp, Homo sapiens
agcaagagtaaggacagcga

SEQ ID NO: 7569040 - DNA, 20 bp, Homo sapiens
agcaagagtaaggacagcga

SEQ ID NO: 7569041 - DNA, 20 bp, Homo sapiens
agcaagagtaaggacagcga

SEQ ID NO: 7569042 - DNA, 20 bp, Homo sapiens
agcaagaaggttgtgggagc

SEQ ID NO: 7569043 - DNA, 22 bp, Homo sapiens
agcaagaagggcaaggaagttt

SEQ ID NO: 7569044 - DNA, 22 bp, Homo sapiens
agcaagaagggcaaggaagttt

SEQ ID NO: 7569045 - DNA, 21 bp, Homo sapiens
agcaagaatcaggaaggctct

SEQ ID NO: 7569046 - DNA, 22 bp, Homo sapiens
agcaagaatatttctgccactg

SEQ ID NO: 7569047 - DNA, 21 bp, Homo sapiens
agcaagaatcaggaaggctct

SEQ ID NO: 7569048 - DNA, 22 bp, Homo sapiens
agcaagaaatcttcagtgttct

SEQ ID NO: 7569049 - DNA, 20 bp, Homo sapiens
agcaagaacgttctgaggga

SEQ ID NO: 7569050 - DNA, 20 bp, Homo sapiens
agcaagaacgttctgaggga

SEQ ID NO: 7569051 - DNA, 20 bp, Homo sapiens
agcaagaacgttctgaggga

SEQ ID NO: 7569052 - DNA, 22 bp, Homo sapiens
agcaagaagggcaaggaagttt

SEQ ID NO: 7569053 - DNA, 22 bp, Homo sapiens
agcaagaagctttgctgtgata

SEQ ID NO: 7569054 - DNA, 22 bp, Homo sapiens
agcaacttttctagacatggtc

SEQ ID NO: 7569055 - DNA, 22 bp, Homo sapiens
agcaagaaaatctctgtccaat

SEQ ID NO: 7569056 - DNA, 22 bp, Homo sapiens
agcaagaaatcttcagtgttct

SEQ ID NO: 7569057 - DNA, 22 bp, Homo sapiens
agcaagaaatcttcagtgttct

SEQ ID NO: 7569058 - DNA, 22 bp, Homo sapiens
agcaactgttacaagaacaaca

SEQ ID NO: 7569059 - DNA, 22 bp, Homo sapiens
agcaacttctacagatatagca

SEQ ID NO: 7569060 - DNA, 22 bp, Homo sapiens
agcaactttggatagttgcagg

SEQ ID NO: 7569061 - DNA, 22 bp, Homo sapiens
agcaactttgagatagacttag

SEQ ID NO: 7569062 - DNA, 22 bp, Homo sapiens
agaggccactttgcctgtgatg

SEQ ID NO: 7569063 - DNA, 22 bp, Homo sapiens
agaggccactttgcctgtgatg

SEQ ID NO: 7569064 - DNA, 22 bp, Homo sapiens
agaggccagaaagtatgccacc

SEQ ID NO: 7569065 - DNA, 22 bp, Homo sapiens
agaggccactttgcctgtgatg

SEQ ID NO: 7569066 - DNA, 22 bp, Homo sapiens
agaggccactttgcctgtgatg

SEQ ID NO: 7569067 - DNA, 22 bp, Homo sapiens
agaggccactttgcctgtgatg

SEQ ID NO: 7569068 - DNA, 22 bp, Homo sapiens
agaggccactttgcctgtgatg

SEQ ID NO: 7569069 - DNA, 22 bp, Homo sapiens
agaggccactttgcctgtgatg

SEQ ID NO: 7569070 - DNA, 22 bp, Homo sapiens
agaggccaccttctcttgagaa

SEQ ID NO: 7569071 - DNA, 22 bp, Homo sapiens
agaggccaccttctcttgagaa

SEQ ID NO: 7569072 - DNA, 22 bp, Homo sapiens
agaggccaccttctcttgagaa

SEQ ID NO: 7569073 - DNA, 22 bp, Homo sapiens
agaggccagatcatcatagatg

SEQ ID NO: 7569074 - DNA, 22 bp, Homo sapiens
agaggccagatcatcatagatg

SEQ ID NO: 7569075 - DNA, 22 bp, Homo sapiens
agaggccagatcatcatagatg

SEQ ID NO: 7569076 - DNA, 22 bp, Homo sapiens
agaggccagaaggcgcaccccg

SEQ ID NO: 7569077 - DNA, 22 bp, Homo sapiens
agaggccagaaggcgcaccccg

SEQ ID NO: 7569078 - DNA, 22 bp, Homo sapiens
agaggccagaaggcgcaccccg

SEQ ID NO: 7569079 - DNA, 22 bp, Homo sapiens
agaggccagaaggcgcaccccg

SEQ ID NO: 7569080 - DNA, 22 bp, Homo sapiens
agaggccagaaggcgcaccccg

SEQ ID NO: 7569081 - DNA, 22 bp, Homo sapiens
agaggccagaaagtatgccacc

SEQ ID NO: 7569082 - DNA, 22 bp, Homo sapiens
agaggccagaaagtatgccacc

SEQ ID NO: 7569083 - DNA, 22 bp, Homo sapiens
agaggccagaaagtatgccacc

SEQ ID NO: 7569084 - DNA, 22 bp, Homo sapiens
agaggccaccttctcttgagaa

SEQ ID NO: 7569085 - DNA, 22 bp, Homo sapiens
agaggccaccagaggtggtgcc

SEQ ID NO: 7569086 - DNA, 22 bp, Homo sapiens
agaggccaccttctcttgagaa

SEQ ID NO: 7569087 - DNA, 22 bp, Homo sapiens
agaggccaccttctcttgagaa

SEQ ID NO: 7569088 - DNA, 22 bp, Homo sapiens
agaggccaccttctcttgagaa

SEQ ID NO: 7569089 - DNA, 22 bp, Homo sapiens
agaggccaccactgtcagggac

SEQ ID NO: 7569090 - DNA, 22 bp, Homo sapiens
agaggccaccagaggtggtgcc

SEQ ID NO: 7569091 - DNA, 22 bp, Homo sapiens
agaggccaccagaggtggtgcc

SEQ ID NO: 7569092 - DNA, 22 bp, Homo sapiens
agaggccaccagaggtggtgcc

SEQ ID NO: 7569093 - DNA, 22 bp, Homo sapiens
agaggccaccagaggtggtgcc

SEQ ID NO: 7569094 - DNA, 22 bp, Homo sapiens
agaggccaccagaggtggtgcc

SEQ ID NO: 7569095 - DNA, 23 bp, Homo sapiens
agaggcaggagtggcttgcccgg

SEQ ID NO: 7569096 - DNA, 23 bp, Homo sapiens
agaggcaggagtggcttgcccgg

SEQ ID NO: 7569097 - DNA, 23 bp, Homo sapiens
agaggcaggagtggcttgcccgg

SEQ ID NO: 7569098 - DNA, 22 bp, Homo sapiens
agaggccacaccagcctcccgt

SEQ ID NO: 7569099 - DNA, 16 bp, Homo sapiens
agaggccacagacaga

SEQ ID NO: 7569100 - DNA, 22 bp, Homo sapiens
agaggccacaccagcctcccgt

SEQ ID NO: 7569101 - DNA, 22 bp, Homo sapiens
agaggccaccactgtcagggac

SEQ ID NO: 7569102 - DNA, 16 bp, Homo sapiens
agaggccacagacaga

SEQ ID NO: 7569103 - DNA, 22 bp, Homo sapiens
agaggccaccactgtcagggac

SEQ ID NO: 7569104 - DNA, 22 bp, Homo sapiens
agaggccaccactgtcagggac

SEQ ID NO: 7569105 - DNA, 22 bp, Homo sapiens
agaggccagcccaggccaccga

SEQ ID NO: 7569106 - DNA, 22 bp, Homo sapiens
agaggccagcccaggccaccga

SEQ ID NO: 7569107 - DNA, 22 bp, Homo sapiens
agaggccagcccaggccaccga

SEQ ID NO: 7569108 - DNA, 22 bp, Homo sapiens
agaggccagcccaggccaccga

SEQ ID NO: 7569109 - DNA, 22 bp, Homo sapiens
agaggccagcccaggccaccga

SEQ ID NO: 7569110 - DNA, 22 bp, Homo sapiens
agaggccagcagtgcctatctg

SEQ ID NO: 7569111 - DNA, 22 bp, Homo sapiens
agaggccagcagtgcctatctg

SEQ ID NO: 7569112 - DNA, 22 bp, Homo sapiens
agaggccagcagtgcctatctg

SEQ ID NO: 7569113 - DNA, 22 bp, Homo sapiens
agaggccagcagtgcctatctg

SEQ ID NO: 7569114 - DNA, 22 bp, Homo sapiens
agaggccagcagtgcctatctg

SEQ ID NO: 7569115 - DNA, 23 bp, Homo sapiens
agaggccagcctttggagacacc

SEQ ID NO: 7569116 - DNA, 23 bp, Homo sapiens
agaggccagcctttggagacacc

SEQ ID NO: 7569117 - DNA, 23 bp, Homo sapiens
agaggccagcctttggagacacc

SEQ ID NO: 7569118 - DNA, 23 bp, Homo sapiens
agaggccagcctttggagacacc

SEQ ID NO: 7569119 - DNA, 23 bp, Homo sapiens
agaggccagcctttggagacacc

SEQ ID NO: 7569120 - DNA, 23 bp, Homo sapiens
agaggccagcctttggagacacc

SEQ ID NO: 7569121 - DNA, 23 bp, Homo sapiens
agaggccagcctttggagacacc

SEQ ID NO: 7569122 - DNA, 23 bp, Homo sapiens
agaggccagcctttggagacacc

SEQ ID NO: 7569123 - DNA, 23 bp, Homo sapiens
agaggccagcctttggagacacc

SEQ ID NO: 7569124 - DNA, 22 bp, Homo sapiens
agaggccagcactgcagggaag

SEQ ID NO: 7569125 - DNA, 22 bp, Homo sapiens
agaggccagcactgcagggaag

SEQ ID NO: 7569126 - DNA, 22 bp, Homo sapiens
agaggccagcactgcagggaag

SEQ ID NO: 7569127 - DNA, 22 bp, Homo sapiens
agaggccagcactgcagggaag

SEQ ID NO: 7569128 - DNA, 22 bp, Homo sapiens
agaggccagcaaccacagtaaa

SEQ ID NO: 7569129 - DNA, 22 bp, Homo sapiens
agaggccagcaaccacagtaaa

SEQ ID NO: 7569130 - DNA, 22 bp, Homo sapiens
agaggccagatcatcatagatg

SEQ ID NO: 7569131 - DNA, 22 bp, Homo sapiens
agaggccagatcatcatagatg

SEQ ID NO: 7569132 - DNA, 22 bp, Homo sapiens
agaggccagcaaccacagtaaa

SEQ ID NO: 7569133 - DNA, 22 bp, Homo sapiens
agaggccagcaaccacagtaaa

SEQ ID NO: 7569134 - DNA, 22 bp, Homo sapiens
agaggccagcactgcagggaag

SEQ ID NO: 7569135 - DNA, 22 bp, Homo sapiens
agaggccagcagtgcctatctg

SEQ ID NO: 7569136 - DNA, 22 bp, Homo sapiens
agaggccagcagtgcctatctg

SEQ ID NO: 7569137 - DNA, 22 bp, Homo sapiens
agaggccagcactgcagggaag

SEQ ID NO: 7569138 - DNA, 22 bp, Homo sapiens
agaggccagcactgcagggaag

SEQ ID NO: 7569139 - DNA, 22 bp, Homo sapiens
agaggccagcactgcagggaag

SEQ ID NO: 7569140 - DNA, 22 bp, Homo sapiens
agaggccagcactgcagggaag

SEQ ID NO: 7569141 - DNA, 18 bp, Homo sapiens
agaggctggacaggggat

SEQ ID NO: 7569142 - DNA, 18 bp, Homo sapiens
agaggctggacaggggat

SEQ ID NO: 7569143 - DNA, 18 bp, Homo sapiens
agaggctggacaggggat

SEQ ID NO: 7569144 - DNA, 18 bp, Homo sapiens
agaggctggacaggggat

SEQ ID NO: 7569145 - DNA, 18 bp, Homo sapiens
agaggctggacaggggat

SEQ ID NO: 7569146 - DNA, 18 bp, Homo sapiens
agaggctggacaggggat

SEQ ID NO: 7569147 - DNA, 22 bp, Homo sapiens
agaggctggattgagcatagac

SEQ ID NO: 7569148 - DNA, 22 bp, Homo sapiens
agaggctggattgagcatagac

SEQ ID NO: 7569149 - DNA, 18 bp, Homo sapiens
agaggctggacaggggat

SEQ ID NO: 7569150 - DNA, 22 bp, Homo sapiens
agaggctggattgagcatagac

SEQ ID NO: 7569151 - DNA, 22 bp, Homo sapiens
agaggctggattgagcatagac

SEQ ID NO: 7569152 - DNA, 22 bp, Homo sapiens
agaggctggattgagcatagac

SEQ ID NO: 7569153 - DNA, 22 bp, Homo sapiens
agaggctggattgagcatagac

SEQ ID NO: 7569154 - DNA, 22 bp, Homo sapiens
agaggctggattgagcatagac

SEQ ID NO: 7569155 - DNA, 22 bp, Homo sapiens
agaggctgggaagggtccccgg

SEQ ID NO: 7569156 - DNA, 23 bp, Homo sapiens
agaggctgcagggtattgagaat

SEQ ID NO: 7569157 - DNA, 23 bp, Homo sapiens
agaggctgcagggtattgagaat

SEQ ID NO: 7569158 - DNA, 23 bp, Homo sapiens
agaggctgcagggtattgagaat

SEQ ID NO: 7569159 - DNA, 23 bp, Homo sapiens
agaggctgcagggtattgagaat

SEQ ID NO: 7569160 - DNA, 23 bp, Homo sapiens
agaggctgcagggtattgagaat

SEQ ID NO: 7569161 - DNA, 18 bp, Homo sapiens
agaggctggacaggggat

SEQ ID NO: 7569162 - DNA, 18 bp, Homo sapiens
agaggctggacaggggat

SEQ ID NO: 7569163 - DNA, 18 bp, Homo sapiens
agaggctggacaggggat

SEQ ID NO: 7569164 - DNA, 18 bp, Homo sapiens
agaggctggacaggggat

SEQ ID NO: 7569165 - DNA, 18 bp, Homo sapiens
agaggctggacaggggat

SEQ ID NO: 7569166 - DNA, 22 bp, Homo sapiens
agaggctgcacttgctcatgat

SEQ ID NO: 7569167 - DNA, 22 bp, Homo sapiens
agaggctgcaggctggaaatca

SEQ ID NO: 7569168 - DNA, 22 bp, Homo sapiens
agaggctgcaggctggaaatca

SEQ ID NO: 7569169 - DNA, 22 bp, Homo sapiens
agaggctgcaggctggaaatca

SEQ ID NO: 7569170 - DNA, 22 bp, Homo sapiens
agaggctgcaggctggaaatca

SEQ ID NO: 7569171 - DNA, 22 bp, Homo sapiens
agaggctgcaggctggaaatca

SEQ ID NO: 7569172 - DNA, 23 bp, Homo sapiens
agaggctgcagggtattgagaat

SEQ ID NO: 7569173 - DNA, 22 bp, Homo sapiens
agaggctgcaggctggaaatca

SEQ ID NO: 7569174 - DNA, 22 bp, Homo sapiens
agaggctgcaggctggaaatca

SEQ ID NO: 7569175 - DNA, 22 bp, Homo sapiens
agaggctgcaggctggaaatca

SEQ ID NO: 7569176 - DNA, 22 bp, Homo sapiens
agaggccaggctgcagagggat

SEQ ID NO: 7569177 - DNA, 22 bp, Homo sapiens
agaggccaggctgcagagggat

SEQ ID NO: 7569178 - DNA, 22 bp, Homo sapiens
agaggccaggctgcagagggat

SEQ ID NO: 7569179 - DNA, 22 bp, Homo sapiens
agaggccaggctgcagagggat

SEQ ID NO: 7569180 - DNA, 22 bp, Homo sapiens
agaggccaggctgcagagggat

SEQ ID NO: 7569181 - DNA, 22 bp, Homo sapiens
agaggccagggacactgctcaa

SEQ ID NO: 7569182 - DNA, 22 bp, Homo sapiens
agaggccagggacactgctcaa

SEQ ID NO: 7569183 - DNA, 22 bp, Homo sapiens
agaggctcctcggtgcctcgtg

SEQ ID NO: 7569184 - DNA, 22 bp, Homo sapiens
agaggctcctcggtgcctcgtg

SEQ ID NO: 7569185 - DNA, 22 bp, Homo sapiens
agaggctccttcactctggcac

SEQ ID NO: 7569186 - DNA, 22 bp, Homo sapiens
agaggccagctagcgggccatc

SEQ ID NO: 7569187 - DNA, 23 bp, Homo sapiens
agaggccagcctttggagacacc

SEQ ID NO: 7569188 - DNA, 22 bp, Homo sapiens
agaggccagctagcgggccatc

SEQ ID NO: 7569189 - DNA, 22 bp, Homo sapiens
agaggccagctagcgggccatc

SEQ ID NO: 7569190 - DNA, 22 bp, Homo sapiens
agaggccagctagcgggccatc

SEQ ID NO: 7569191 - DNA, 22 bp, Homo sapiens
agaggccaggcagcccaaggtg

SEQ ID NO: 7569192 - DNA, 22 bp, Homo sapiens
agaggccaggcagcccaaggtg

SEQ ID NO: 7569193 - DNA, 22 bp, Homo sapiens
agaggccaggcagcccaaggtg

SEQ ID NO: 7569194 - DNA, 22 bp, Homo sapiens
agaggccaggcagcccaaggtg

SEQ ID NO: 7569195 - DNA, 22 bp, Homo sapiens
agaggctgcacttgctcatgat

SEQ ID NO: 7569196 - DNA, 22 bp, Homo sapiens
agaggctgcacttgctcatgat

SEQ ID NO: 7569197 - DNA, 22 bp, Homo sapiens
agaggctgcacttgctcatgat

SEQ ID NO: 7569198 - DNA, 22 bp, Homo sapiens
agaggctgcacttgctcatgat

SEQ ID NO: 7569199 - DNA, 22 bp, Homo sapiens
agaggctgcacttgctcatgat

SEQ ID NO: 7569200 - DNA, 22 bp, Homo sapiens
agaggctgcacttgctcatgat

SEQ ID NO: 7569201 - DNA, 22 bp, Homo sapiens
agaggctgcacttgctcatgat

SEQ ID NO: 7569202 - DNA, 22 bp, Homo sapiens
agaggctgcacttgctcatgat

SEQ ID NO: 7569203 - DNA, 22 bp, Homo sapiens
agaggctccttcactctggcac

SEQ ID NO: 7569204 - DNA, 22 bp, Homo sapiens
agaggctccttcactctggcac

SEQ ID NO: 7569205 - DNA, 22 bp, Homo sapiens
agaggctgatggagtagtgtct

SEQ ID NO: 7569206 - DNA, 22 bp, Homo sapiens
agaggctgcacttgctcatgat

SEQ ID NO: 7569207 - DNA, 22 bp, Homo sapiens
agaggctgcacttgctcatgat

SEQ ID NO: 7569208 - DNA, 22 bp, Homo sapiens
agaggctgcacttgctcatgat

SEQ ID NO: 7569209 - DNA, 22 bp, Homo sapiens
agaggctgcacttgctcatgat

SEQ ID NO: 7569210 - DNA, 22 bp, Homo sapiens
agaggctgcacttgctcatgat

SEQ ID NO: 7569211 - DNA, 22 bp, Homo sapiens
agaggctgcacttgctcatgat

SEQ ID NO: 7569212 - DNA, 22 bp, Homo sapiens
agaggctgcacttgctcatgat

SEQ ID NO: 7569213 - DNA, 22 bp, Homo sapiens
agaggcacggaggctgcatgga

SEQ ID NO: 7569214 - DNA, 22 bp, Homo sapiens
agaggcacggaggctgcatgga

SEQ ID NO: 7569215 - DNA, 22 bp, Homo sapiens
agaggcacggaggctgcatgga

SEQ ID NO: 7569216 - DNA, 22 bp, Homo sapiens
agaggcacggaggctgcatgga

SEQ ID NO: 7569217 - DNA, 22 bp, Homo sapiens
agaggcactaagggaagagcag

SEQ ID NO: 7569218 - DNA, 22 bp, Homo sapiens
agaggcactaagggaagagcag

SEQ ID NO: 7569219 - DNA, 22 bp, Homo sapiens
agaggcacggaggctgcatgga

SEQ ID NO: 7569220 - DNA, 22 bp, Homo sapiens
agaggcactaagggaagagcag

SEQ ID NO: 7569221 - DNA, 23 bp, Homo sapiens
agaggcactaattattcagagat

SEQ ID NO: 7569222 - DNA, 23 bp, Homo sapiens
agaggcactaattattcagagat

SEQ ID NO: 7569223 - DNA, 22 bp, Homo sapiens
agaggcacccagttaagctgca

SEQ ID NO: 7569224 - DNA, 22 bp, Homo sapiens
agaggcacccgcgcgcggccat

SEQ ID NO: 7569225 - DNA, 22 bp, Homo sapiens
agaggcacccagttaagctgca

SEQ ID NO: 7569226 - DNA, 22 bp, Homo sapiens
agaggcaccgtctgcagcgtgc

SEQ ID NO: 7569227 - DNA, 23 bp, Homo sapiens
agaggcacctaaagtcaagttgt

SEQ ID NO: 7569228 - DNA, 22 bp, Homo sapiens
agaggcacggaggctgcatgga

SEQ ID NO: 7569229 - DNA, 22 bp, Homo sapiens
agaggcacggaggctgcatgga

SEQ ID NO: 7569230 - DNA, 22 bp, Homo sapiens
agaggcaccgtctgcagcgtgc

SEQ ID NO: 7569231 - DNA, 22 bp, Homo sapiens
agaggcaccgtctgcagcgtgc

SEQ ID NO: 7569232 - DNA, 22 bp, Homo sapiens
agaggcacccgcgcgcggccat

SEQ ID NO: 7569233 - DNA, 22 bp, Homo sapiens
agaggcacccgcgcgcggccat

SEQ ID NO: 7569234 - DNA, 22 bp, Homo sapiens
attacacaggctggctctttga

SEQ ID NO: 7569235 - DNA, 22 bp, Homo sapiens
attacacaggctggctctttga

SEQ ID NO: 7569236 - DNA, 22 bp, Homo sapiens
attacacatagacattcgttca

SEQ ID NO: 7569237 - DNA, 22 bp, Homo sapiens
attacacaggctggctctttga

SEQ ID NO: 7569238 - DNA, 22 bp, Homo sapiens
attacacaggctggctctttga

SEQ ID NO: 7569239 - DNA, 22 bp, Homo sapiens
attacacatagacattcgttca

SEQ ID NO: 7569240 - DNA, 22 bp, Homo sapiens
attacacatagacattcgttca

SEQ ID NO: 7569241 - DNA, 22 bp, Homo sapiens
attacacatagacattcgttca

SEQ ID NO: 7569242 - DNA, 22 bp, Homo sapiens
attacacatagacattcgttca

SEQ ID NO: 7569243 - DNA, 22 bp, Homo sapiens
attacacaggctggctctttga

SEQ ID NO: 7569244 - DNA, 22 bp, Homo sapiens
attacactagctattcttatgg

SEQ ID NO: 7569245 - DNA, 22 bp, Homo sapiens
attacactaatgtgacaacaat

SEQ ID NO: 7569246 - DNA, 22 bp, Homo sapiens
attacactaatgtgacaacaat

SEQ ID NO: 7569247 - DNA, 22 bp, Homo sapiens
attacacagcggttactactag

SEQ ID NO: 7569248 - DNA, 22 bp, Homo sapiens
attacacagcggttactactag

SEQ ID NO: 7569249 - DNA, 22 bp, Homo sapiens
attacacagcggttactactag

SEQ ID NO: 7569250 - DNA, 22 bp, Homo sapiens
attacacagcggttactactag

SEQ ID NO: 7569251 - DNA, 22 bp, Homo sapiens
attacacaggatttgccttact

SEQ ID NO: 7569252 - DNA, 22 bp, Homo sapiens
attacacagcggttactactag

SEQ ID NO: 7569253 - DNA, 22 bp, Homo sapiens
attacacagcggttactactag

SEQ ID NO: 7569254 - DNA, 22 bp, Homo sapiens
attacacagcggttactactag

SEQ ID NO: 7569255 - DNA, 22 bp, Homo sapiens
attacagtaaatgctacaggca

SEQ ID NO: 7569256 - DNA, 22 bp, Homo sapiens
attacagcttgctcagtttgca

SEQ ID NO: 7569257 - DNA, 22 bp, Homo sapiens
attacagcttgctcagtttgca

SEQ ID NO: 7569258 - DNA, 22 bp, Homo sapiens
attacagtaacagctacaatgc

SEQ ID NO: 7569259 - DNA, 22 bp, Homo sapiens
attacagtaacagctacaatgc

SEQ ID NO: 7569260 - DNA, 22 bp, Homo sapiens
attacagtaacagctacaatgc

SEQ ID NO: 7569261 - DNA, 23 bp, Homo sapiens
agaggcaggagtggcttgcccgg

SEQ ID NO: 7569262 - DNA, 23 bp, Homo sapiens
agaggcaggagtggcttgcccgg

SEQ ID NO: 7569263 - DNA, 22 bp, Homo sapiens
agaggcaggaggttgacttgag

SEQ ID NO: 7569264 - DNA, 23 bp, Homo sapiens
agaggcaggagtggcttgcccgg

SEQ ID NO: 7569265 - DNA, 23 bp, Homo sapiens
agaggcaggagtggcttgcccgg

SEQ ID NO: 7569266 - DNA, 23 bp, Homo sapiens
agaggcaggagtggcttgcccgg

SEQ ID NO: 7569267 - DNA, 22 bp, Homo sapiens
attacagtaacagctacaatgc

SEQ ID NO: 7569268 - DNA, 22 bp, Homo sapiens
attacagtaacagctacaatgc

SEQ ID NO: 7569269 - DNA, 22 bp, Homo sapiens
attacagtaacagctacaatgc

SEQ ID NO: 7569270 - DNA, 22 bp, Homo sapiens
attacagaagatatgctcaaca

SEQ ID NO: 7569271 - DNA, 22 bp, Homo sapiens
attacagaagatatgctcaaca

SEQ ID NO: 7569272 - DNA, 22 bp, Homo sapiens
attacagaaatatggtcaaaga

SEQ ID NO: 7569273 - DNA, 22 bp, Homo sapiens
attacagaagatatgctcaaca

SEQ ID NO: 7569274 - DNA, 22 bp, Homo sapiens
attacagaagatatgctcaaca

SEQ ID NO: 7569275 - DNA, 22 bp, Homo sapiens
attacagaagatatgctcaaca

SEQ ID NO: 7569276 - DNA, 22 bp, Homo sapiens
attacagaaagcaatattgagt

SEQ ID NO: 7569277 - DNA, 22 bp, Homo sapiens
attacagaaatatggtcaaaga

SEQ ID NO: 7569278 - DNA, 22 bp, Homo sapiens
attacagaaatatggtcaaaga

SEQ ID NO: 7569279 - DNA, 22 bp, Homo sapiens
attacagaaagcaatattgagt

SEQ ID NO: 7569280 - DNA, 22 bp, Homo sapiens
attacagaaagcaatattgagt

SEQ ID NO: 7569281 - DNA, 22 bp, Homo sapiens
attacagatagactttgaagct

SEQ ID NO: 7569282 - DNA, 22 bp, Homo sapiens
attacagagggtcggtcgtttt

SEQ ID NO: 7569283 - DNA, 22 bp, Homo sapiens
attacagagtcttgggaggtca

SEQ ID NO: 7569284 - DNA, 22 bp, Homo sapiens
attacagattataaatttgagc

SEQ ID NO: 7569285 - DNA, 22 bp, Homo sapiens
attacagagggtcggtcgtttt

SEQ ID NO: 7569286 - DNA, 22 bp, Homo sapiens
attacagagtcttgggaggtca

SEQ ID NO: 7569287 - DNA, 22 bp, Homo sapiens
attacagatagactttgaagct

SEQ ID NO: 7569288 - DNA, 22 bp, Homo sapiens
attacagatagactttgaagct

SEQ ID NO: 7569289 - DNA, 22 bp, Homo sapiens
attacagaatgcagttccttat

SEQ ID NO: 7569290 - DNA, 22 bp, Homo sapiens
attacagaatgcagttccttat

SEQ ID NO: 7569291 - DNA, 22 bp, Homo sapiens
attacagaagatatgctcaaca

SEQ ID NO: 7569292 - DNA, 19 bp, Homo sapiens
agaggcaagggtggaagta

SEQ ID NO: 7569293 - DNA, 19 bp, Homo sapiens
agaggcaagggtggaagta

SEQ ID NO: 7569294 - DNA, 19 bp, Homo sapiens
agaggcaagggtggaagta

SEQ ID NO: 7569295 - DNA, 22 bp, Homo sapiens
agaggcaagttcagagctagga

SEQ ID NO: 7569296 - DNA, 22 bp, Homo sapiens
agaggcaagttcagagctagga

SEQ ID NO: 7569297 - DNA, 19 bp, Homo sapiens
agaggcaagggtggaagta

SEQ ID NO: 7569298 - DNA, 19 bp, Homo sapiens
agaggcaagggtggaagta

SEQ ID NO: 7569299 - DNA, 22 bp, Homo sapiens
agaggcaagggacctttctggg

SEQ ID NO: 7569300 - DNA, 22 bp, Homo sapiens
agaggcaagggacctttctggg

SEQ ID NO: 7569301 - DNA, 19 bp, Homo sapiens
agaggcaagggctcatgac

SEQ ID NO: 7569302 - DNA, 19 bp, Homo sapiens
agaggcaagggctcatgac

SEQ ID NO: 7569303 - DNA, 19 bp, Homo sapiens
agaggcaagggctcatgac

SEQ ID NO: 7569304 - DNA, 19 bp, Homo sapiens
agaggcaagggctcatgac

SEQ ID NO: 7569305 - DNA, 22 bp, Homo sapiens
agaggcaagggacctttctggg

SEQ ID NO: 7569306 - DNA, 22 bp, Homo sapiens
agaggcaaggcaggattcttct

SEQ ID NO: 7569307 - DNA, 22 bp, Homo sapiens
agaggcacaacagtcccattgt

SEQ ID NO: 7569308 - DNA, 22 bp, Homo sapiens
agaggcacaacagtcccattgt

SEQ ID NO: 7569309 - DNA, 22 bp, Homo sapiens
agaggcaagttcagagctagga

SEQ ID NO: 7569310 - DNA, 22 bp, Homo sapiens
agaggcacaaactggaaaggac

SEQ ID NO: 7569311 - DNA, 22 bp, Homo sapiens
agaggcacaaactggaaaggac

SEQ ID NO: 7569312 - DNA, 22 bp, Homo sapiens
agaggcacaaactggaaaggac

SEQ ID NO: 7569313 - DNA, 22 bp, Homo sapiens
agaggcaatgaaagcagtctct

SEQ ID NO: 7569314 - DNA, 22 bp, Homo sapiens
agaggcaagttcagagctagga

SEQ ID NO: 7569315 - DNA, 22 bp, Homo sapiens
agaggcaatgaaagcagtctct

SEQ ID NO: 7569316 - DNA, 23 bp, Homo sapiens
agaggcacagcacttggctggcc

SEQ ID NO: 7569317 - DNA, 22 bp, Homo sapiens
agaggcacatggagggtggaag

SEQ ID NO: 7569318 - DNA, 22 bp, Homo sapiens
agaggcacatggagggtggaag

SEQ ID NO: 7569319 - DNA, 22 bp, Homo sapiens
agaggcaccatctggaacagcc

SEQ ID NO: 7569320 - DNA, 22 bp, Homo sapiens
agaggcaccatctggaacagcc

SEQ ID NO: 7569321 - DNA, 22 bp, Homo sapiens
agaggcaccatctggaacagcc

SEQ ID NO: 7569322 - DNA, 22 bp, Homo sapiens
agaggcaccatctggaacagcc

SEQ ID NO: 7569323 - DNA, 22 bp, Homo sapiens
agaggcacagaggcagtcccct

SEQ ID NO: 7569324 - DNA, 23 bp, Homo sapiens
agaggcacagcacttggctggcc

SEQ ID NO: 7569325 - DNA, 22 bp, Homo sapiens
agaggaggtccttttctgatgt

SEQ ID NO: 7569326 - DNA, 22 bp, Homo sapiens
agaggcaagattatcagggcat

SEQ ID NO: 7569327 - DNA, 22 bp, Homo sapiens
agaggcaagattatcagggcat

SEQ ID NO: 7569328 - DNA, 21 bp, Homo sapiens
agagctgggacttgcctgaga

SEQ ID NO: 7569329 - DNA, 21 bp, Homo sapiens
agagctgggacttgcctgaga

SEQ ID NO: 7569330 - DNA, 21 bp, Homo sapiens
agagctgggacttgcctgaga

SEQ ID NO: 7569331 - DNA, 21 bp, Homo sapiens
agagctgggacttgcctgaga

SEQ ID NO: 7569332 - DNA, 21 bp, Homo sapiens
agagctgggacttgcctgaga

SEQ ID NO: 7569333 - DNA, 22 bp, Homo sapiens
agagctgggaccgtctggaagt

SEQ ID NO: 7569334 - DNA, 22 bp, Homo sapiens
agagctgggaccgtctggaagt

SEQ ID NO: 7569335 - DNA, 22 bp, Homo sapiens
agagctgggaccgtctggaagt

SEQ ID NO: 7569336 - DNA, 22 bp, Homo sapiens
agagctgggaccgtctggaagt

SEQ ID NO: 7569337 - DNA, 22 bp, Homo sapiens
agagctgggaccgtctggaagt

SEQ ID NO: 7569338 - DNA, 22 bp, Homo sapiens
agagctgggaccgtctggaagt

SEQ ID NO: 7569339 - DNA, 20 bp, Homo sapiens
agagctgggaagctccctat

SEQ ID NO: 7569340 - DNA, 22 bp, Homo sapiens
agagctgggaccgtctggaagt

SEQ ID NO: 7569341 - DNA, 22 bp, Homo sapiens
agagctgggaccgtctggaagt

SEQ ID NO: 7569342 - DNA, 20 bp, Homo sapiens
agagctgggaagctccctat

SEQ ID NO: 7569343 - DNA, 20 bp, Homo sapiens
agagctgggaagctccctat

SEQ ID NO: 7569344 - DNA, 20 bp, Homo sapiens
agagctgggaagctccctat

SEQ ID NO: 7569345 - DNA, 20 bp, Homo sapiens
agagctgggaagctccctat

SEQ ID NO: 7569346 - DNA, 22 bp, Homo sapiens
agagctggctgtgggtgacttt

SEQ ID NO: 7569347 - DNA, 22 bp, Homo sapiens
agagctggctgtgggtgacttt

SEQ ID NO: 7569348 - DNA, 22 bp, Homo sapiens
agagctggctgtgggtgacttt

SEQ ID NO: 7569349 - DNA, 22 bp, Homo sapiens
agagctggctgtgggtgacttt

SEQ ID NO: 7569350 - DNA, 20 bp, Homo sapiens
agagctgggaagctccctat

SEQ ID NO: 7569351 - DNA, 20 bp, Homo sapiens
agagctgggaagctccctat

SEQ ID NO: 7569352 - DNA, 22 bp, Homo sapiens
agagctggctgtgggtgacttt

SEQ ID NO: 7569353 - DNA, 22 bp, Homo sapiens
agagctggctgtgggtgacttt

SEQ ID NO: 7569354 - DNA, 22 bp, Homo sapiens
agaggggagagctaagcaattc

SEQ ID NO: 7569355 - DNA, 22 bp, Homo sapiens
agaggggagagctaagcaattc

SEQ ID NO: 7569356 - DNA, 22 bp, Homo sapiens
agaggggagagctaagcaattc

SEQ ID NO: 7569357 - DNA, 22 bp, Homo sapiens
agaggggagagctaagcaattc

SEQ ID NO: 7569358 - DNA, 22 bp, Homo sapiens
agaggggagagctaagcaattc

SEQ ID NO: 7569359 - DNA, 22 bp, Homo sapiens
agaggggagagctaagcaattc

SEQ ID NO: 7569360 - DNA, 23 bp, Homo sapiens
agaggggagcatctgctggctga

SEQ ID NO: 7569361 - DNA, 23 bp, Homo sapiens
agaggggagcatctgctggctga

SEQ ID NO: 7569362 - DNA, 23 bp, Homo sapiens
agaggggagcatctgctggctga

SEQ ID NO: 7569363 - DNA, 23 bp, Homo sapiens
agaggggagcatctgctggctga

SEQ ID NO: 7569364 - DNA, 22 bp, Homo sapiens
agaggggagagctaagcaattc

SEQ ID NO: 7569365 - DNA, 22 bp, Homo sapiens
agaggggagagctaagcaattc

SEQ ID NO: 7569366 - DNA, 22 bp, Homo sapiens
agaggggacagccacctgcccg

SEQ ID NO: 7569367 - DNA, 22 bp, Homo sapiens
agaggggacagccacctgcccg

SEQ ID NO: 7569368 - DNA, 22 bp, Homo sapiens
agaggggacagccacctgcccg

SEQ ID NO: 7569369 - DNA, 22 bp, Homo sapiens
agaggggacagccacctgcccg

SEQ ID NO: 7569370 - DNA, 22 bp, Homo sapiens
agaggggaagtaatgaatgata

SEQ ID NO: 7569371 - DNA, 22 bp, Homo sapiens
agaggggaagtaatgaatgata

SEQ ID NO: 7569372 - DNA, 22 bp, Homo sapiens
agaggggaagtaatgaatgata

SEQ ID NO: 7569373 - DNA, 22 bp, Homo sapiens
agaggggaagtaatgaatgata

SEQ ID NO: 7569374 - DNA, 22 bp, Homo sapiens
agaggggaagtaatgaatgata

SEQ ID NO: 7569375 - DNA, 22 bp, Homo sapiens
agaggggaagtaatgaatgata

SEQ ID NO: 7569376 - DNA, 22 bp, Homo sapiens
agaggggacagccacctgcccg

SEQ ID NO: 7569377 - DNA, 22 bp, Homo sapiens
agaggggacagccacctgcccg

SEQ ID NO: 7569378 - DNA, 22 bp, Homo sapiens
agaggggaggcgaaccagagtc

SEQ ID NO: 7569379 - DNA, 22 bp, Homo sapiens
agaggggaggcgaaccagagtc

SEQ ID NO: 7569380 - DNA, 22 bp, Homo sapiens
agaggggaggcgaaccagagtc

SEQ ID NO: 7569381 - DNA, 22 bp, Homo sapiens
agaggggaggcgaaccagagtc

SEQ ID NO: 7569382 - DNA, 22 bp, Homo sapiens
agaggggaggcgaaccagagtc

SEQ ID NO: 7569383 - DNA, 23 bp, Homo sapiens
agaggggagcatctgctggctga

SEQ ID NO: 7569384 - DNA, 23 bp, Homo sapiens
agaggggagcatctgctggctga

SEQ ID NO: 7569385 - DNA, 23 bp, Homo sapiens
agaggggagcatctgctggctga

SEQ ID NO: 7569386 - DNA, 22 bp, Homo sapiens
agaggggaggcgaaccagagtc

SEQ ID NO: 7569387 - DNA, 22 bp, Homo sapiens
agaggggaggcgaaccagagtc

SEQ ID NO: 7569388 - DNA, 22 bp, Homo sapiens
agaggggaggcgaaccagagtc

SEQ ID NO: 7569389 - DNA, 23 bp, Homo sapiens
agaggggagcatctgctggctga

SEQ ID NO: 7569390 - DNA, 23 bp, Homo sapiens
agaggggagcatctgctggctga

SEQ ID NO: 7569391 - DNA, 23 bp, Homo sapiens
agaggggagcatctgctggctga

SEQ ID NO: 7569392 - DNA, 22 bp, Homo sapiens
agaggggcgggaactcaacctc

SEQ ID NO: 7569393 - DNA, 22 bp, Homo sapiens
agaggggcgggaactcaacctc

SEQ ID NO: 7569394 - DNA, 22 bp, Homo sapiens
agaggggcgggaactcaacctc

SEQ ID NO: 7569395 - DNA, 22 bp, Homo sapiens
agaggggcgggaactcaacctc

SEQ ID NO: 7569396 - DNA, 22 bp, Homo sapiens
agaggggcccggttctccgtct

SEQ ID NO: 7569397 - DNA, 22 bp, Homo sapiens
agaggggcccggttctccgtct

SEQ ID NO: 7569398 - DNA, 22 bp, Homo sapiens
agaggggcccggttctccgtct

SEQ ID NO: 7569399 - DNA, 22 bp, Homo sapiens
agaggggcccggttctccgtct

SEQ ID NO: 7569400 - DNA, 22 bp, Homo sapiens
agaggggcagggtctccggatt

SEQ ID NO: 7569401 - DNA, 22 bp, Homo sapiens
agaggggctcaagcagtggtct

SEQ ID NO: 7569402 - DNA, 22 bp, Homo sapiens
agaggggctcaagcagtggtct

SEQ ID NO: 7569403 - DNA, 22 bp, Homo sapiens
agaggggctcaagcagtggtct

SEQ ID NO: 7569404 - DNA, 22 bp, Homo sapiens
agaggggctcaagcagtggtct

SEQ ID NO: 7569405 - DNA, 22 bp, Homo sapiens
agaggggctcaagcagtggtct

SEQ ID NO: 7569406 - DNA, 22 bp, Homo sapiens
agaggggctcaagcagtggtct

SEQ ID NO: 7569407 - DNA, 22 bp, Homo sapiens
agaggggctcaagcagtggtct

SEQ ID NO: 7569408 - DNA, 22 bp, Homo sapiens
agaggggagtcctaatctgatt

SEQ ID NO: 7569409 - DNA, 22 bp, Homo sapiens
agaggggagtcctaatctgatt

SEQ ID NO: 7569410 - DNA, 22 bp, Homo sapiens
agaggggcaagtaaagagtctt

SEQ ID NO: 7569411 - DNA, 22 bp, Homo sapiens
agaggggcaagtaaagagtctt

SEQ ID NO: 7569412 - DNA, 22 bp, Homo sapiens
agaggggcaagtaaagagtctt

SEQ ID NO: 7569413 - DNA, 22 bp, Homo sapiens
agaggggcaagtaaagagtctt

SEQ ID NO: 7569414 - DNA, 22 bp, Homo sapiens
agaggggcaagtaaagagtctt

SEQ ID NO: 7569415 - DNA, 22 bp, Homo sapiens
agaggggcagggtctccggatt

SEQ ID NO: 7569416 - DNA, 22 bp, Homo sapiens
agaggggcagggtctccggatt

SEQ ID NO: 7569417 - DNA, 22 bp, Homo sapiens
agaggggcaagtaaagagtctt

SEQ ID NO: 7569418 - DNA, 22 bp, Homo sapiens
agaggggcagggtctccggatt

SEQ ID NO: 7569419 - DNA, 18 bp, Homo sapiens
agaggggaggtaagtctg

SEQ ID NO: 7569420 - DNA, 22 bp, Homo sapiens
agaggggagtcctaatctgatt

SEQ ID NO: 7569421 - DNA, 22 bp, Homo sapiens
agaggggagtcctaatctgatt

SEQ ID NO: 7569422 - DNA, 22 bp, Homo sapiens
agaggggagtcctaatctgatt

SEQ ID NO: 7569423 - DNA, 18 bp, Homo sapiens
agaggggaggtaagtctg

SEQ ID NO: 7569424 - DNA, 22 bp, Homo sapiens
agaggggaggcgaaccagagtc

SEQ ID NO: 7569425 - DNA, 18 bp, Homo sapiens
agaggggaggtaagtctg

SEQ ID NO: 7569426 - DNA, 18 bp, Homo sapiens
agaggggaggtaagtctg

SEQ ID NO: 7569427 - DNA, 18 bp, Homo sapiens
agaggggaggtaagtctg

SEQ ID NO: 7569428 - DNA, 18 bp, Homo sapiens
agaggggaggtaagtctg

SEQ ID NO: 7569429 - DNA, 18 bp, Homo sapiens
agaggggaggtaagtctg

SEQ ID NO: 7569430 - DNA, 22 bp, Homo sapiens
agagggcagggcggtaagtcct

SEQ ID NO: 7569431 - DNA, 22 bp, Homo sapiens
agaggctgtctcatattttgta

SEQ ID NO: 7569432 - DNA, 22 bp, Homo sapiens
agaggctgtctcatattttgta

SEQ ID NO: 7569433 - DNA, 22 bp, Homo sapiens
agagggcagtctcagattggga

SEQ ID NO: 7569434 - DNA, 22 bp, Homo sapiens
agagggcagtctcagattggga

SEQ ID NO: 7569435 - DNA, 22 bp, Homo sapiens
agagggcagtctcagattggga

SEQ ID NO: 7569436 - DNA, 22 bp, Homo sapiens
agagggcataaaatagagcacg

SEQ ID NO: 7569437 - DNA, 22 bp, Homo sapiens
agagggcagtctcagattggga

SEQ ID NO: 7569438 - DNA, 22 bp, Homo sapiens
agagggctggacgcaggttgga

SEQ ID NO: 7569439 - DNA, 22 bp, Homo sapiens
agagggctggacgcaggttgga

SEQ ID NO: 7569440 - DNA, 22 bp, Homo sapiens
agagggctggacgcaggttgga

SEQ ID NO: 7569441 - DNA, 22 bp, Homo sapiens
agagggctgggatgtgctgtgt

SEQ ID NO: 7569442 - DNA, 22 bp, Homo sapiens
agagggctgggatgtgctgtgt

SEQ ID NO: 7569443 - DNA, 22 bp, Homo sapiens
agagggcttccctaggagtgag

SEQ ID NO: 7569444 - DNA, 22 bp, Homo sapiens
agagggctgggatgtgctgtgt

SEQ ID NO: 7569445 - DNA, 22 bp, Homo sapiens
agagggctgggatgtgctgtgt

SEQ ID NO: 7569446 - DNA, 22 bp, Homo sapiens
agagggcttccctaggagtgag

SEQ ID NO: 7569447 - DNA, 22 bp, Homo sapiens
agagggctttgattctcagttc

SEQ ID NO: 7569448 - DNA, 22 bp, Homo sapiens
agagggctttgattctcagttc

SEQ ID NO: 7569449 - DNA, 22 bp, Homo sapiens
agagggctttgattctcagttc

SEQ ID NO: 7569450 - DNA, 22 bp, Homo sapiens
agagggctttgattctcagttc

SEQ ID NO: 7569451 - DNA, 22 bp, Homo sapiens
agagggcttccctaggagtgag

SEQ ID NO: 7569452 - DNA, 22 bp, Homo sapiens
agagggcttccctaggagtgag

SEQ ID NO: 7569453 - DNA, 22 bp, Homo sapiens
agagggcttccctaggagtgag

SEQ ID NO: 7569454 - DNA, 22 bp, Homo sapiens
agagggcttccctaggagtgag

SEQ ID NO: 7569455 - DNA, 22 bp, Homo sapiens
agaggggaaggatgtgatgtga

SEQ ID NO: 7569456 - DNA, 22 bp, Homo sapiens
agaggggaaggatgtgatgtga

SEQ ID NO: 7569457 - DNA, 22 bp, Homo sapiens
agaggggaaggatgtgatgtga

SEQ ID NO: 7569458 - DNA, 22 bp, Homo sapiens
agaggggaaggatgtgatgtga

SEQ ID NO: 7569459 - DNA, 22 bp, Homo sapiens
agaggggaagtaatgaatgata

SEQ ID NO: 7569460 - DNA, 22 bp, Homo sapiens
agaggggaagtaatgaatgata

SEQ ID NO: 7569461 - DNA, 22 bp, Homo sapiens
agaggggaagtaatgaatgata

SEQ ID NO: 7569462 - DNA, 22 bp, Homo sapiens
agaggggaaggatgtgatgtga

SEQ ID NO: 7569463 - DNA, 22 bp, Homo sapiens
agaggggaaggatgtgatgtga

SEQ ID NO: 7569464 - DNA, 19 bp, Homo sapiens
agaggctgtcacctgtagc

SEQ ID NO: 7569465 - DNA, 19 bp, Homo sapiens
agaggctgtcacctgtagc

SEQ ID NO: 7569466 - DNA, 19 bp, Homo sapiens
agaggctgtcacctgtagc

SEQ ID NO: 7569467 - DNA, 19 bp, Homo sapiens
agaggctgtcacctgtagc

SEQ ID NO: 7569468 - DNA, 19 bp, Homo sapiens
agaggctgtcacctgtagc

SEQ ID NO: 7569469 - DNA, 22 bp, Homo sapiens
agaggctgtcccttgctattcc

SEQ ID NO: 7569470 - DNA, 22 bp, Homo sapiens
agaggctgtcccttgctattcc

SEQ ID NO: 7569471 - DNA, 22 bp, Homo sapiens
agaggctgtcccttgctattcc

SEQ ID NO: 7569472 - DNA, 22 bp, Homo sapiens
agaggctgtcccttgctattcc

SEQ ID NO: 7569473 - DNA, 22 bp, Homo sapiens
agaggctgtcccttgctattcc

SEQ ID NO: 7569474 - DNA, 22 bp, Homo sapiens
agaggctgtcccttgctattcc

SEQ ID NO: 7569475 - DNA, 16 bp, Homo sapiens
agaggctgtaatggaa

SEQ ID NO: 7569476 - DNA, 16 bp, Homo sapiens
agaggctgtaatggaa

SEQ ID NO: 7569477 - DNA, 16 bp, Homo sapiens
agaggctgtaatggaa

SEQ ID NO: 7569478 - DNA, 19 bp, Homo sapiens
agaggctgtcacctgtagc

SEQ ID NO: 7569479 - DNA, 22 bp, Homo sapiens
agaggctgggtacgggccacct

SEQ ID NO: 7569480 - DNA, 16 bp, Homo sapiens
agaggctgtaatggaa

SEQ ID NO: 7569481 - DNA, 16 bp, Homo sapiens
agaggctgtaatggaa

SEQ ID NO: 7569482 - DNA, 22 bp, Homo sapiens
agaggctgggtacgggccacct

SEQ ID NO: 7569483 - DNA, 22 bp, Homo sapiens
agaggctgggtacgggccacct

SEQ ID NO: 7569484 - DNA, 22 bp, Homo sapiens
agaggctgggcaggacccacag

SEQ ID NO: 7569485 - DNA, 22 bp, Homo sapiens
agaggctgggtacgggccacct

SEQ ID NO: 7569486 - DNA, 22 bp, Homo sapiens
agaggctgggcaggacccacag

SEQ ID NO: 7569487 - DNA, 22 bp, Homo sapiens
agaggctgggcaggacccacag

SEQ ID NO: 7569488 - DNA, 22 bp, Homo sapiens
agaggctgggtacgggccacct

SEQ ID NO: 7569489 - DNA, 22 bp, Homo sapiens
agaggctgggtacgggccacct

SEQ ID NO: 7569490 - DNA, 22 bp, Homo sapiens
agaggctgggtacgggccacct

SEQ ID NO: 7569491 - DNA, 22 bp, Homo sapiens
agaggctgggtacgggccacct

SEQ ID NO: 7569492 - DNA, 22 bp, Homo sapiens
agaggctgggtacgggccacct

SEQ ID NO: 7569493 - DNA, 22 bp, Homo sapiens
agaggctgggtacgggccacct

SEQ ID NO: 7569494 - DNA, 22 bp, Homo sapiens
agaggctgggaagggtccccgg

SEQ ID NO: 7569495 - DNA, 22 bp, Homo sapiens
agaggctgggcaggacccacag

SEQ ID NO: 7569496 - DNA, 22 bp, Homo sapiens
agaggctgggcaggacccacag

SEQ ID NO: 7569497 - DNA, 22 bp, Homo sapiens
agaggctgggcaggacccacag

SEQ ID NO: 7569498 - DNA, 22 bp, Homo sapiens
agaggctgggcaggacccacag

SEQ ID NO: 7569499 - DNA, 22 bp, Homo sapiens
agaggctgggaagggtccccgg

SEQ ID NO: 7569500 - DNA, 22 bp, Homo sapiens
agaggctgggaagggtccccgg

SEQ ID NO: 7569501 - DNA, 22 bp, Homo sapiens
agaggctgggaagggtccccgg

SEQ ID NO: 7569502 - DNA, 22 bp, Homo sapiens
agaggctgggaagggtccccgg

SEQ ID NO: 7569503 - DNA, 22 bp, Homo sapiens
agagtcagtcactggcactttg

SEQ ID NO: 7569504 - DNA, 22 bp, Homo sapiens
agagtcagtcactggcactttg

SEQ ID NO: 7569505 - DNA, 22 bp, Homo sapiens
agagtcagtaacatatatggta

SEQ ID NO: 7569506 - DNA, 22 bp, Homo sapiens
agagtcagtaacatatatggta

SEQ ID NO: 7569507 - DNA, 22 bp, Homo sapiens
agagtcagcttatgacacagtc

SEQ ID NO: 7569508 - DNA, 22 bp, Homo sapiens
agagtcagttatgtcaagtgct

SEQ ID NO: 7569509 - DNA, 22 bp, Homo sapiens
agagtcagttatgtcaagtgct

SEQ ID NO: 7569510 - DNA, 22 bp, Homo sapiens
agagtcagttatgtcaagtgct

SEQ ID NO: 7569511 - DNA, 22 bp, Homo sapiens
agagtcagttatgtcaagtgct

SEQ ID NO: 7569512 - DNA, 22 bp, Homo sapiens
agagtcagttagcgaatactta

SEQ ID NO: 7569513 - DNA, 22 bp, Homo sapiens
agagtcagttagcgaatactta

SEQ ID NO: 7569514 - DNA, 22 bp, Homo sapiens
agagtccaaatgtgcagttatg

SEQ ID NO: 7569515 - DNA, 22 bp, Homo sapiens
agagtccaaatgtgcagttatg

SEQ ID NO: 7569516 - DNA, 22 bp, Homo sapiens
agagtccaaatgtgcagttatg

SEQ ID NO: 7569517 - DNA, 23 bp, Homo sapiens
agagtccacaagattttccagtg

SEQ ID NO: 7569518 - DNA, 22 bp, Homo sapiens
agagtccaaatgtgcagttatg

SEQ ID NO: 7569519 - DNA, 22 bp, Homo sapiens
agagtccaccctggggtcaggc

SEQ ID NO: 7569520 - DNA, 22 bp, Homo sapiens
agagtccaccctggggtcaggc

SEQ ID NO: 7569521 - DNA, 22 bp, Homo sapiens
agagtcagaaagcagacagggg

SEQ ID NO: 7569522 - DNA, 22 bp, Homo sapiens
agagtcagaaccaagatgaggc

SEQ ID NO: 7569523 - DNA, 22 bp, Homo sapiens
agagtcagaaccaagatgaggc

SEQ ID NO: 7569524 - DNA, 22 bp, Homo sapiens
agagtcagaaccaagatgaggc

SEQ ID NO: 7569525 - DNA, 22 bp, Homo sapiens
agagtcagaaagcagacagggg

SEQ ID NO: 7569526 - DNA, 22 bp, Homo sapiens
agagtcagaaagcagacagggg

SEQ ID NO: 7569527 - DNA, 22 bp, Homo sapiens
agagtcaccttttcctcaggat

SEQ ID NO: 7569528 - DNA, 22 bp, Homo sapiens
agagtcagaaagcagacagggg

SEQ ID NO: 7569529 - DNA, 22 bp, Homo sapiens
agagtcagaaagcagacagggg

SEQ ID NO: 7569530 - DNA, 22 bp, Homo sapiens
agagtcagactaagccatggtg

SEQ ID NO: 7569531 - DNA, 22 bp, Homo sapiens
agagtcagactaagccatggtg

SEQ ID NO: 7569532 - DNA, 22 bp, Homo sapiens
agagtcagactaagccatggtg

SEQ ID NO: 7569533 - DNA, 22 bp, Homo sapiens
agagtcagcttatgacacagtc

SEQ ID NO: 7569534 - DNA, 22 bp, Homo sapiens
agagtcagcttatgacacagtc

SEQ ID NO: 7569535 - DNA, 22 bp, Homo sapiens
agagtcagcttatgacacagtc

SEQ ID NO: 7569536 - DNA, 22 bp, Homo sapiens
agagtcagcttatgacacagtc

SEQ ID NO: 7569537 - DNA, 22 bp, Homo sapiens
agagtcagcttatgacacagtc

SEQ ID NO: 7569538 - DNA, 22 bp, Homo sapiens
agagtactgctgctgggtactg

SEQ ID NO: 7569539 - DNA, 22 bp, Homo sapiens
agagtactgcctcagttatgaa

SEQ ID NO: 7569540 - DNA, 20 bp, Homo sapiens
agagtagaggtagatttatg

SEQ ID NO: 7569541 - DNA, 20 bp, Homo sapiens
agagtagaggtagatttatg

SEQ ID NO: 7569542 - DNA, 20 bp, Homo sapiens
agagtagaggtagatttatg

SEQ ID NO: 7569543 - DNA, 21 bp, Homo sapiens
agagtataataaaggcatgtc

SEQ ID NO: 7569544 - DNA, 22 bp, Homo sapiens
agagtagttctttgcagagtgg

SEQ ID NO: 7569545 - DNA, 22 bp, Homo sapiens
agagtagcctcatagacactca

SEQ ID NO: 7569546 - DNA, 18 bp, Homo sapiens
agagtatacagacaacaa

SEQ ID NO: 7569547 - DNA, 18 bp, Homo sapiens
agagtatacagacaacaa

SEQ ID NO: 7569548 - DNA, 22 bp, Homo sapiens
agagtataattagtgtcttcta

SEQ ID NO: 7569549 - DNA, 22 bp, Homo sapiens
agagtataggcaggatgccagt

SEQ ID NO: 7569550 - DNA, 18 bp, Homo sapiens
agagtatacagacaacaa

SEQ ID NO: 7569551 - DNA, 22 bp, Homo sapiens
agaggtggagctcttggcatca

SEQ ID NO: 7569552 - DNA, 22 bp, Homo sapiens
agaggtggagctcttggcatca

SEQ ID NO: 7569553 - DNA, 22 bp, Homo sapiens
agaggtgagtcattacctagtg

SEQ ID NO: 7569554 - DNA, 22 bp, Homo sapiens
agaggtgagtcattacctagtg

SEQ ID NO: 7569555 - DNA, 22 bp, Homo sapiens
agaggtgacataggagaggctc

SEQ ID NO: 7569556 - DNA, 22 bp, Homo sapiens
agaggtgacataggagaggctc

SEQ ID NO: 7569557 - DNA, 22 bp, Homo sapiens
agagtactgcctcagttatgaa

SEQ ID NO: 7569558 - DNA, 22 bp, Homo sapiens
agaggtggagctcttggcatca

SEQ ID NO: 7569559 - DNA, 22 bp, Homo sapiens
agagtactgcctcagttatgaa

SEQ ID NO: 7569560 - DNA, 22 bp, Homo sapiens
agagtcaagggtgcagaggaag

SEQ ID NO: 7569561 - DNA, 22 bp, Homo sapiens
agagtcaaggtggcatttagct

SEQ ID NO: 7569562 - DNA, 22 bp, Homo sapiens
agagtcaaggtggcatttagct

SEQ ID NO: 7569563 - DNA, 22 bp, Homo sapiens
agagtcaacatcgagccactgg

SEQ ID NO: 7569564 - DNA, 22 bp, Homo sapiens
agagtcaagggtgcagaggaag

SEQ ID NO: 7569565 - DNA, 22 bp, Homo sapiens
agagtcaagggtgcagaggaag

SEQ ID NO: 7569566 - DNA, 22 bp, Homo sapiens
agagtcaccaaagggccaacat

SEQ ID NO: 7569567 - DNA, 22 bp, Homo sapiens
agagtcaagtagggcatgggct

SEQ ID NO: 7569568 - DNA, 22 bp, Homo sapiens
agagtcaccaaagggccaacat

SEQ ID NO: 7569569 - DNA, 22 bp, Homo sapiens
agagtcaccaaagtaaaacagt

SEQ ID NO: 7569570 - DNA, 19 bp, Homo sapiens
agagtattgaatttgccct

SEQ ID NO: 7569571 - DNA, 19 bp, Homo sapiens
agagtattgaatttgccct

SEQ ID NO: 7569572 - DNA, 19 bp, Homo sapiens
agagtattgaatttgccct

SEQ ID NO: 7569573 - DNA, 19 bp, Homo sapiens
agagtattgaatttgccct

SEQ ID NO: 7569574 - DNA, 22 bp, Homo sapiens
agagtatattgaagcagtcagg

SEQ ID NO: 7569575 - DNA, 22 bp, Homo sapiens
agagtatattgaagcagtcagg

SEQ ID NO: 7569576 - DNA, 22 bp, Homo sapiens
agagtatgcatctattgtacct

SEQ ID NO: 7569577 - DNA, 19 bp, Homo sapiens
agagtattgaatttgccct

SEQ ID NO: 7569578 - DNA, 22 bp, Homo sapiens
agagtattttgattatcctgga

SEQ ID NO: 7569579 - DNA, 22 bp, Homo sapiens
agagtgcagaggtcaaagaaca

SEQ ID NO: 7569580 - DNA, 23 bp, Homo sapiens
agagtgcagagatatgcttgtgt

SEQ ID NO: 7569581 - DNA, 22 bp, Homo sapiens
agagtgcaaccgaaacaagcag

SEQ ID NO: 7569582 - DNA, 22 bp, Homo sapiens
agagtgatcctaattgatttgg

SEQ ID NO: 7569583 - DNA, 22 bp, Homo sapiens
agagtgatcctaattgatttgg

SEQ ID NO: 7569584 - DNA, 22 bp, Homo sapiens
agagtgcaaccgaaacaagcag

SEQ ID NO: 7569585 - DNA, 20 bp, Homo sapiens
agagtgagactccatctcag

SEQ ID NO: 7569586 - DNA, 22 bp, Homo sapiens
agagtctgatatttgtaccaga

SEQ ID NO: 7569587 - DNA, 22 bp, Homo sapiens
agagtctgatatttgtaccaga

SEQ ID NO: 7569588 - DNA, 22 bp, Homo sapiens
agagtgagggggcactgagacg

SEQ ID NO: 7569589 - DNA, 22 bp, Homo sapiens
agagtgagggggcactgagacg

SEQ ID NO: 7569590 - DNA, 22 bp, Homo sapiens
agagtgagggggcactgagacg

SEQ ID NO: 7569591 - DNA, 22 bp, Homo sapiens
agagtgagggggcactgagacg

SEQ ID NO: 7569592 - DNA, 22 bp, Homo sapiens
agagtgagggggcactgagacg

SEQ ID NO: 7569593 - DNA, 22 bp, Homo sapiens
agagtgagggggcactgagacg

SEQ ID NO: 7569594 - DNA, 22 bp, Homo sapiens
agagtgagggggcactgagacg

SEQ ID NO: 7569595 - DNA, 22 bp, Homo sapiens
agagtgagggggcactgagacg

SEQ ID NO: 7569596 - DNA, 22 bp, Homo sapiens
agagtgcatgttttatctttgt

SEQ ID NO: 7569597 - DNA, 22 bp, Homo sapiens
agagtgcccaagcctggcaggg

SEQ ID NO: 7569598 - DNA, 22 bp, Homo sapiens
agagtgccactgacaggtccct

SEQ ID NO: 7569599 - DNA, 22 bp, Homo sapiens
agagtgcatgacatgatcttgg

SEQ ID NO: 7569600 - DNA, 22 bp, Homo sapiens
agagtgcatgttttatctttgt

SEQ ID NO: 7569601 - DNA, 22 bp, Homo sapiens
agagtgcatgacatgatcttgg

SEQ ID NO: 7569602 - DNA, 20 bp, Homo sapiens
agagtgctggactgaggagc

SEQ ID NO: 7569603 - DNA, 20 bp, Homo sapiens
agagtgctggactgaggagc

SEQ ID NO: 7569604 - DNA, 22 bp, Homo sapiens
agagtgctagcctgagggaggt

SEQ ID NO: 7569605 - DNA, 22 bp, Homo sapiens
agagtgctcagatgcatgtctt

SEQ ID NO: 7569606 - DNA, 18 bp, Homo sapiens
agagtccagggtgaggtg

SEQ ID NO: 7569607 - DNA, 22 bp, Homo sapiens
agagtccaggggcctggtgtgt

SEQ ID NO: 7569608 - DNA, 22 bp, Homo sapiens
agagtccaggggcctggtgtgt

SEQ ID NO: 7569609 - DNA, 18 bp, Homo sapiens
agagtccagggtgaggtg

SEQ ID NO: 7569610 - DNA, 22 bp, Homo sapiens
agagtccagaaaacagtgtgct

SEQ ID NO: 7569611 - DNA, 22 bp, Homo sapiens
agagtccagaaaacagtgtgct

SEQ ID NO: 7569612 - DNA, 22 bp, Homo sapiens
agagtccagaaaacagtgtgct

SEQ ID NO: 7569613 - DNA, 22 bp, Homo sapiens
agagtccagaaaacagtgtgct

SEQ ID NO: 7569614 - DNA, 22 bp, Homo sapiens
agagtccatatattgatttgtt

SEQ ID NO: 7569615 - DNA, 22 bp, Homo sapiens
agagtccaggtgggctggaggc

SEQ ID NO: 7569616 - DNA, 18 bp, Homo sapiens
agagtccagggtgaggtg

SEQ ID NO: 7569617 - DNA, 22 bp, Homo sapiens
agagtccaggtgggctggaggc

SEQ ID NO: 7569618 - DNA, 22 bp, Homo sapiens
agagtccatatgtgggaggagt

SEQ ID NO: 7569619 - DNA, 22 bp, Homo sapiens
agagtccaggtgggctggaggc

SEQ ID NO: 7569620 - DNA, 22 bp, Homo sapiens
agagtcccagggacactccaga

SEQ ID NO: 7569621 - DNA, 22 bp, Homo sapiens
agagtccctcttcccaggaggc

SEQ ID NO: 7569622 - DNA, 22 bp, Homo sapiens
agagtccctcttcccaggaggc

SEQ ID NO: 7569623 - DNA, 22 bp, Homo sapiens
agagtccatgaagacagctgag

SEQ ID NO: 7569624 - DNA, 22 bp, Homo sapiens
agagtccctcttcccaggaggc

SEQ ID NO: 7569625 - DNA, 22 bp, Homo sapiens
agagtcctgagtggaaaaatgg

SEQ ID NO: 7569626 - DNA, 22 bp, Homo sapiens
agagtctgaatgctcagagttg

SEQ ID NO: 7569627 - DNA, 21 bp, Homo sapiens
agagtctgagctcttaaccac

SEQ ID NO: 7569628 - DNA, 21 bp, Homo sapiens
agagtctgagctcttaaccac

SEQ ID NO: 7569629 - DNA, 22 bp, Homo sapiens
agagtctgaggaggaccaacag

SEQ ID NO: 7569630 - DNA, 22 bp, Homo sapiens
agagtctgaggcagctgcagcc

SEQ ID NO: 7569631 - DNA, 22 bp, Homo sapiens
agagtctgaatgctcagagttg

SEQ ID NO: 7569632 - DNA, 22 bp, Homo sapiens
agagtctgaggaggaccaacag

SEQ ID NO: 7569633 - DNA, 22 bp, Homo sapiens
agagtctgaggaggaccaacag

SEQ ID NO: 7569634 - DNA, 22 bp, Homo sapiens
agagtctgaggcagctgcagcc

SEQ ID NO: 7569635 - DNA, 22 bp, Homo sapiens
agagtctgaggcagctgcagcc

SEQ ID NO: 7569636 - DNA, 22 bp, Homo sapiens
agagtctgatatttgtaccaga

SEQ ID NO: 7569637 - DNA, 22 bp, Homo sapiens
agagtctgatatttgtaccaga

SEQ ID NO: 7569638 - DNA, 22 bp, Homo sapiens
agagtctgatatttgtaccaga

SEQ ID NO: 7569639 - DNA, 22 bp, Homo sapiens
agagtctgatatttgtaccaga

SEQ ID NO: 7569640 - DNA, 22 bp, Homo sapiens
agaatattcatctgtattctta

SEQ ID NO: 7569641 - DNA, 22 bp, Homo sapiens
agaatattcatctgtattctta

SEQ ID NO: 7569642 - DNA, 22 bp, Homo sapiens
agaatattcatctgtattctta

SEQ ID NO: 7569643 - DNA, 22 bp, Homo sapiens
agaatatgattcagaccattag

SEQ ID NO: 7569644 - DNA, 22 bp, Homo sapiens
agaatatgattcagaccattag

SEQ ID NO: 7569645 - DNA, 22 bp, Homo sapiens
agaatatgatggttggagaatt

SEQ ID NO: 7569646 - DNA, 22 bp, Homo sapiens
agaatatgatggttggagaatt

SEQ ID NO: 7569647 - DNA, 22 bp, Homo sapiens
agaatattcatctgtattctta

SEQ ID NO: 7569648 - DNA, 22 bp, Homo sapiens
agaatattcatctgtattctta

SEQ ID NO: 7569649 - DNA, 22 bp, Homo sapiens
agaatattcatctgtattctta

SEQ ID NO: 7569650 - DNA, 22 bp, Homo sapiens
agaatattcatctgtattctta

SEQ ID NO: 7569651 - DNA, 22 bp, Homo sapiens
agaatattcatctgtattctta

SEQ ID NO: 7569652 - DNA, 22 bp, Homo sapiens
agaatattcatctgtattctta

SEQ ID NO: 7569653 - DNA, 22 bp, Homo sapiens
agaatatcgtagcatattatct

SEQ ID NO: 7569654 - DNA, 22 bp, Homo sapiens
agaatatgaggaaactgtgaat

SEQ ID NO: 7569655 - DNA, 22 bp, Homo sapiens
agaatatgaggaaactgtgaat

SEQ ID NO: 7569656 - DNA, 22 bp, Homo sapiens
agaatatgatcggaatacagat

SEQ ID NO: 7569657 - DNA, 22 bp, Homo sapiens
agaatatgatcggaatacagat

SEQ ID NO: 7569658 - DNA, 22 bp, Homo sapiens
agaatatgatcggaatacagat

SEQ ID NO: 7569659 - DNA, 22 bp, Homo sapiens
agaatatatgactgcaagacta

SEQ ID NO: 7569660 - DNA, 22 bp, Homo sapiens
agaatatatgactgcaagacta

SEQ ID NO: 7569661 - DNA, 22 bp, Homo sapiens
agaatatcgtagcatattatct

SEQ ID NO: 7569662 - DNA, 22 bp, Homo sapiens
agaatatcgtagcatattatct

SEQ ID NO: 7569663 - DNA, 22 bp, Homo sapiens
agaatatatgactgcaagacta

SEQ ID NO: 7569664 - DNA, 22 bp, Homo sapiens
agaatatagttaccaaattctg

SEQ ID NO: 7569665 - DNA, 22 bp, Homo sapiens
agaatatagttaccaaattctg

SEQ ID NO: 7569666 - DNA, 22 bp, Homo sapiens
agaatatagttaccaaattctg

SEQ ID NO: 7569667 - DNA, 22 bp, Homo sapiens
agaatatagttaccaaattctg

SEQ ID NO: 7569668 - DNA, 22 bp, Homo sapiens
agaatatagttaccaaattctg

SEQ ID NO: 7569669 - DNA, 22 bp, Homo sapiens
agaatatagttaccaaattctg

SEQ ID NO: 7569670 - DNA, 22 bp, Homo sapiens
agaatatagttaccaaattctg

SEQ ID NO: 7569671 - DNA, 22 bp, Homo sapiens
agaatatagttaccaaattctg

SEQ ID NO: 7569672 - DNA, 22 bp, Homo sapiens
agaatatagttaccaaattctg

SEQ ID NO: 7569673 - DNA, 22 bp, Homo sapiens
agaatatagttaccaaattctg

SEQ ID NO: 7569674 - DNA, 22 bp, Homo sapiens
atgaagttctcaataatcatgt

SEQ ID NO: 7569675 - DNA, 22 bp, Homo sapiens
atgaagttctcaataatcatgt

SEQ ID NO: 7569676 - DNA, 22 bp, Homo sapiens
atgaagttccagtatatgcagt

SEQ ID NO: 7569677 - DNA, 22 bp, Homo sapiens
atgaagttccagtatatgcagt

SEQ ID NO: 7569678 - DNA, 22 bp, Homo sapiens
atgaagttccagtatatgcagt

SEQ ID NO: 7569679 - DNA, 22 bp, Homo sapiens
atgaagttctagtgagaaatgc

SEQ ID NO: 7569680 - DNA, 22 bp, Homo sapiens
atgaagttctagtgagaaatgc

SEQ ID NO: 7569681 - DNA, 22 bp, Homo sapiens
atgaagttctagtgagaaatgc

SEQ ID NO: 7569682 - DNA, 22 bp, Homo sapiens
atgaagttctagtgagaaatgc

SEQ ID NO: 7569683 - DNA, 22 bp, Homo sapiens
atgaagttctcaataatcatgt

SEQ ID NO: 7569684 - DNA, 22 bp, Homo sapiens
atgaagttctcaataatcatgt

SEQ ID NO: 7569685 - DNA, 19 bp, Homo sapiens
atgaaggcactgagtggga

SEQ ID NO: 7569686 - DNA, 19 bp, Homo sapiens
atgaaggcactgagtggga

SEQ ID NO: 7569687 - DNA, 22 bp, Homo sapiens
atgaaggatggctggctgccct

SEQ ID NO: 7569688 - DNA, 22 bp, Homo sapiens
atgaagctgaggttctctttga

SEQ ID NO: 7569689 - DNA, 22 bp, Homo sapiens
atgaagctggttttggcttggg

SEQ ID NO: 7569690 - DNA, 22 bp, Homo sapiens
atgaagcttgaggtgagagctg

SEQ ID NO: 7569691 - DNA, 22 bp, Homo sapiens
atgaagctgtttattttagcag

SEQ ID NO: 7569692 - DNA, 22 bp, Homo sapiens
atgaagctgtttattttagcag

SEQ ID NO: 7569693 - DNA, 22 bp, Homo sapiens
atgaagctgaccttgtcttgct

SEQ ID NO: 7569694 - DNA, 22 bp, Homo sapiens
atgaagctgaccttgtcttgct

SEQ ID NO: 7569695 - DNA, 22 bp, Homo sapiens
atgaagctctaaatgtacttag

SEQ ID NO: 7569696 - DNA, 22 bp, Homo sapiens
atgaagggtgtccctgtgagca

SEQ ID NO: 7569697 - DNA, 20 bp, Homo sapiens
atgaagtccccatctgatgt

SEQ ID NO: 7569698 - DNA, 22 bp, Homo sapiens
atgaagggtgtccctgtgagca

SEQ ID NO: 7569699 - DNA, 22 bp, Homo sapiens
atgaagtctatttacctaagct

SEQ ID NO: 7569700 - DNA, 21 bp, Homo sapiens
atgaagtctatgcttctgtgt

SEQ ID NO: 7569701 - DNA, 22 bp, Homo sapiens
atgaaggctgtgtggagccccc

SEQ ID NO: 7569702 - DNA, 22 bp, Homo sapiens
atgaaggccaggcttcagtgtg

SEQ ID NO: 7569703 - DNA, 22 bp, Homo sapiens
atgaaggcagttttataagatt

SEQ ID NO: 7569704 - DNA, 22 bp, Homo sapiens
atgaaggcagttaaacgtcatc

SEQ ID NO: 7569705 - DNA, 22 bp, Homo sapiens
atctgcctgcagtggaggtggg

SEQ ID NO: 7569706 - DNA, 22 bp, Homo sapiens
atctgcctgcagtggaggtggg

SEQ ID NO: 7569707 - DNA, 22 bp, Homo sapiens
atctgcctgagtctaggttttc

SEQ ID NO: 7569708 - DNA, 22 bp, Homo sapiens
atctgcctcttcttcattgcga

SEQ ID NO: 7569709 - DNA, 22 bp, Homo sapiens
atctgcctcttcttcattgcga

SEQ ID NO: 7569710 - DNA, 22 bp, Homo sapiens
atctgcctcttcttcattgcga

SEQ ID NO: 7569711 - DNA, 22 bp, Homo sapiens
atctgcctccaagtccatgtgt

SEQ ID NO: 7569712 - DNA, 22 bp, Homo sapiens
atctgcctggtctttgatgcag

SEQ ID NO: 7569713 - DNA, 22 bp, Homo sapiens
atctgcctggtctttgatgcag

SEQ ID NO: 7569714 - DNA, 22 bp, Homo sapiens
atctgcctgtatttaccatcat

SEQ ID NO: 7569715 - DNA, 22 bp, Homo sapiens
atctgcctgcttatgatgcctg

SEQ ID NO: 7569716 - DNA, 22 bp, Homo sapiens
atctgcctgcttatgatgcctg

SEQ ID NO: 7569717 - DNA, 22 bp, Homo sapiens
atctgcctgcttatgatgcctg

SEQ ID NO: 7569718 - DNA, 22 bp, Homo sapiens
atctgcctggctccaggtgagc

SEQ ID NO: 7569719 - DNA, 22 bp, Homo sapiens
atctgcctggctccaggtgagc

SEQ ID NO: 7569720 - DNA, 20 bp, Homo sapiens
atctgctgagaatgaaaggc

SEQ ID NO: 7569721 - DNA, 22 bp, Homo sapiens
atctgctatgttatttcccact

SEQ ID NO: 7569722 - DNA, 19 bp, Homo sapiens
atctgccttagtgctgctg

SEQ ID NO: 7569723 - DNA, 19 bp, Homo sapiens
atctgccttagtgctgctg

SEQ ID NO: 7569724 - DNA, 19 bp, Homo sapiens
atctgcctgttatcacata

SEQ ID NO: 7569725 - DNA, 22 bp, Homo sapiens
atctgctggcatctctagccca

SEQ ID NO: 7569726 - DNA, 19 bp, Homo sapiens
atctgccttagtgctgctg

SEQ ID NO: 7569727 - DNA, 18 bp, Homo sapiens
atctgctggcaggtctgg

SEQ ID NO: 7569728 - DNA, 22 bp, Homo sapiens
atctgctgttcttcacagcttg

SEQ ID NO: 7569729 - DNA, 22 bp, Homo sapiens
atctgcttagaattcattgtcc

SEQ ID NO: 7569730 - DNA, 19 bp, Homo sapiens
atgaagcattgtttttgta

SEQ ID NO: 7569731 - DNA, 19 bp, Homo sapiens
atgaagcattgtttttgta

SEQ ID NO: 7569732 - DNA, 22 bp, Homo sapiens
atgaagcattacaggatgacag

SEQ ID NO: 7569733 - DNA, 22 bp, Homo sapiens
atgaagcattacaggatgacag

SEQ ID NO: 7569734 - DNA, 22 bp, Homo sapiens
atgaagcattacaggatgacag

SEQ ID NO: 7569735 - DNA, 22 bp, Homo sapiens
atgaagcattacaggatgacag

SEQ ID NO: 7569736 - DNA, 22 bp, Homo sapiens
atgaagcattacaggatgacag

SEQ ID NO: 7569737 - DNA, 22 bp, Homo sapiens
atgaagccatctcctccccttc

SEQ ID NO: 7569738 - DNA, 19 bp, Homo sapiens
atgaagcattgtttttgta

SEQ ID NO: 7569739 - DNA, 22 bp, Homo sapiens
atgaagcgttcgagataggtag

SEQ ID NO: 7569740 - DNA, 22 bp, Homo sapiens
atgaagcgttcgagataggtag

SEQ ID NO: 7569741 - DNA, 22 bp, Homo sapiens
atgaagcagttaaggtgcatga

SEQ ID NO: 7569742 - DNA, 22 bp, Homo sapiens
atgaagcagttaaggtgcatga

SEQ ID NO: 7569743 - DNA, 22 bp, Homo sapiens
atgaagcatctcacaatctagt

SEQ ID NO: 7569744 - DNA, 22 bp, Homo sapiens
atgaagcatctcacaatctagt

SEQ ID NO: 7569745 - DNA, 22 bp, Homo sapiens
atgaagcatctcacaatctagt

SEQ ID NO: 7569746 - DNA, 22 bp, Homo sapiens
atgaagcatctcacaatctagt

SEQ ID NO: 7569747 - DNA, 22 bp, Homo sapiens
atgaagcagttaaggtgcatga

SEQ ID NO: 7569748 - DNA, 22 bp, Homo sapiens
atgaacacaatacgtgcatgca

SEQ ID NO: 7569749 - DNA, 22 bp, Homo sapiens
atgaacacaatacgtgcatgca

SEQ ID NO: 7569750 - DNA, 22 bp, Homo sapiens
atctgcttgccctcttaggacc

SEQ ID NO: 7569751 - DNA, 22 bp, Homo sapiens
atgaacaatgactacatattga

SEQ ID NO: 7569752 - DNA, 22 bp, Homo sapiens
atctgcttgaatgagcaacagg

SEQ ID NO: 7569753 - DNA, 22 bp, Homo sapiens
atctgcttgagtttgaagtcag

SEQ ID NO: 7569754 - DNA, 22 bp, Homo sapiens
atctgcttgagtttgaagtcag

SEQ ID NO: 7569755 - DNA, 22 bp, Homo sapiens
atctgcttgaaacttcttatac

SEQ ID NO: 7569756 - DNA, 22 bp, Homo sapiens
atctgcttgccctcttaggacc

SEQ ID NO: 7569757 - DNA, 22 bp, Homo sapiens
atgaacaatgactacatattga

SEQ ID NO: 7569758 - DNA, 22 bp, Homo sapiens
atctgcttgagtttgaagtcag

SEQ ID NO: 7569759 - DNA, 22 bp, Homo sapiens
atctgcttgcaggctggccctt

SEQ ID NO: 7569760 - DNA, 22 bp, Homo sapiens
atctgcttgccctcttaggacc

SEQ ID NO: 7569761 - DNA, 22 bp, Homo sapiens
atctgcttgaaacttcttatac

SEQ ID NO: 7569762 - DNA, 22 bp, Homo sapiens
atctgcttcctccttagggaaa

SEQ ID NO: 7569763 - DNA, 22 bp, Homo sapiens
atctgcttagaattcattgtcc

SEQ ID NO: 7569764 - DNA, 22 bp, Homo sapiens
atctgcttcagtgatatgtgaa

SEQ ID NO: 7569765 - DNA, 17 bp, Homo sapiens
atctgcttcacccagca

SEQ ID NO: 7569766 - DNA, 22 bp, Homo sapiens
atgaggccatggctgtcactaa

SEQ ID NO: 7569767 - DNA, 22 bp, Homo sapiens
atgaggccatggctgtcactaa

SEQ ID NO: 7569768 - DNA, 22 bp, Homo sapiens
atgaggccatggctgtcactaa

SEQ ID NO: 7569769 - DNA, 22 bp, Homo sapiens
atgaggccatggctgtcactaa

SEQ ID NO: 7569770 - DNA, 22 bp, Homo sapiens
atgaggcccaaacattacaaat

SEQ ID NO: 7569771 - DNA, 22 bp, Homo sapiens
atgaggcccaggaatctgtatt

SEQ ID NO: 7569772 - DNA, 22 bp, Homo sapiens
atgaggcccaaacattacaaat

SEQ ID NO: 7569773 - DNA, 22 bp, Homo sapiens
atgaggcccaggaatctgtatt

SEQ ID NO: 7569774 - DNA, 22 bp, Homo sapiens
atgaggcccaaacattacaaat

SEQ ID NO: 7569775 - DNA, 22 bp, Homo sapiens
atgaggcccaggaatctgtatt

SEQ ID NO: 7569776 - DNA, 22 bp, Homo sapiens
atgaggctatgaatggggagat

SEQ ID NO: 7569777 - DNA, 22 bp, Homo sapiens
atgaggctatttcatagatttt

SEQ ID NO: 7569778 - DNA, 22 bp, Homo sapiens
atgaggctatttcatagatttt

SEQ ID NO: 7569779 - DNA, 22 bp, Homo sapiens
atgaggctctcaacaccttgag

SEQ ID NO: 7569780 - DNA, 22 bp, Homo sapiens
atgaggctctcaacaccttgag

SEQ ID NO: 7569781 - DNA, 22 bp, Homo sapiens
atgaggctatgaatggggagat

SEQ ID NO: 7569782 - DNA, 22 bp, Homo sapiens
atgaggctatgaatggggagat

SEQ ID NO: 7569783 - DNA, 22 bp, Homo sapiens
atgaggctatgaatggggagat

SEQ ID NO: 7569784 - DNA, 22 bp, Homo sapiens
atgaggcctatcttggcagagg

SEQ ID NO: 7569785 - DNA, 22 bp, Homo sapiens
atgaggcctatcttggcagagg

SEQ ID NO: 7569786 - DNA, 22 bp, Homo sapiens
atgaggcctttcttcacccttt

SEQ ID NO: 7569787 - DNA, 22 bp, Homo sapiens
atgaggcctatcttggcagagg

SEQ ID NO: 7569788 - DNA, 22 bp, Homo sapiens
atgagggaggcaaggagatgct

SEQ ID NO: 7569789 - DNA, 22 bp, Homo sapiens
atgaggcttaaactgctgcaac

SEQ ID NO: 7569790 - DNA, 22 bp, Homo sapiens
atgagggaagctcacgtgtcca

SEQ ID NO: 7569791 - DNA, 22 bp, Homo sapiens
atgaggcttaaactgctgcaac

SEQ ID NO: 7569792 - DNA, 22 bp, Homo sapiens
atgaggcttaaactgctgcaac

SEQ ID NO: 7569793 - DNA, 22 bp, Homo sapiens
atgaggcttaaactgctgcaac

SEQ ID NO: 7569794 - DNA, 22 bp, Homo sapiens
atgaggcttaaactgctgcaac

SEQ ID NO: 7569795 - DNA, 22 bp, Homo sapiens
atgaggcttaaactgctgcaac

SEQ ID NO: 7569796 - DNA, 22 bp, Homo sapiens
atgaggcttaaactgctgcaac

SEQ ID NO: 7569797 - DNA, 22 bp, Homo sapiens
atgaggcttaaactgctgcaac

SEQ ID NO: 7569798 - DNA, 22 bp, Homo sapiens
atgaggctgaaacacagaggct

SEQ ID NO: 7569799 - DNA, 22 bp, Homo sapiens
atgaggctgaaacacagaggct

SEQ ID NO: 7569800 - DNA, 22 bp, Homo sapiens
atgaggctgaaacacagaggct

SEQ ID NO: 7569801 - DNA, 22 bp, Homo sapiens
atgaggctgaaacacagaggct

SEQ ID NO: 7569802 - DNA, 22 bp, Homo sapiens
atgaggctctcaacaccttgag

SEQ ID NO: 7569803 - DNA, 22 bp, Homo sapiens
atgaggctctcaggggagctgt

SEQ ID NO: 7569804 - DNA, 22 bp, Homo sapiens
atgaggctctcaggggagctgt

SEQ ID NO: 7569805 - DNA, 22 bp, Homo sapiens
atgagggaggggtggtgccgca

SEQ ID NO: 7569806 - DNA, 22 bp, Homo sapiens
atgagggaggggtggtgccgca

SEQ ID NO: 7569807 - DNA, 22 bp, Homo sapiens
atgagggaggggtggtgccgca

SEQ ID NO: 7569808 - DNA, 22 bp, Homo sapiens
atgagggaggcaaggagatgct

SEQ ID NO: 7569809 - DNA, 22 bp, Homo sapiens
agacaaatttcctgcaatgaag

SEQ ID NO: 7569810 - DNA, 22 bp, Homo sapiens
agacaaatttcctgcaatgaag

SEQ ID NO: 7569811 - DNA, 22 bp, Homo sapiens
agacaaatttcctgcaatgaag

SEQ ID NO: 7569812 - DNA, 22 bp, Homo sapiens
atgagggaggcaaggagatgct

SEQ ID NO: 7569813 - DNA, 22 bp, Homo sapiens
atgagggaggcaaggagatgct

SEQ ID NO: 7569814 - DNA, 22 bp, Homo sapiens
atgagggaggcaaggagatgct

SEQ ID NO: 7569815 - DNA, 22 bp, Homo sapiens
atgagggaggcaaggagatgct

SEQ ID NO: 7569816 - DNA, 22 bp, Homo sapiens
atgagggaggcaaggagatgct

SEQ ID NO: 7569817 - DNA, 22 bp, Homo sapiens
agaatcaaagagaaatactttg

SEQ ID NO: 7569818 - DNA, 22 bp, Homo sapiens
agaatcaaagagaaatactttg

SEQ ID NO: 7569819 - DNA, 22 bp, Homo sapiens
agaatcaaagagaaatactttg

SEQ ID NO: 7569820 - DNA, 22 bp, Homo sapiens
agaatcaaagagaaatactttg

SEQ ID NO: 7569821 - DNA, 22 bp, Homo sapiens
agaatattgaaagttcttgaca

SEQ ID NO: 7569822 - DNA, 22 bp, Homo sapiens
agaatattgaaagttcttgaca

SEQ ID NO: 7569823 - DNA, 22 bp, Homo sapiens
agaatattgaaagttcttgaca

SEQ ID NO: 7569824 - DNA, 22 bp, Homo sapiens
agaatattgaaagttcttgaca

SEQ ID NO: 7569825 - DNA, 22 bp, Homo sapiens
agaatattgaaagttcttgaca

SEQ ID NO: 7569826 - DNA, 22 bp, Homo sapiens
agaatattgaaagttcttgaca

SEQ ID NO: 7569827 - DNA, 22 bp, Homo sapiens
agaatattgaaagttcttgaca

SEQ ID NO: 7569828 - DNA, 22 bp, Homo sapiens
agaatattgaaagttcttgaca

SEQ ID NO: 7569829 - DNA, 22 bp, Homo sapiens
agaatcaattagattctatgag

SEQ ID NO: 7569830 - DNA, 22 bp, Homo sapiens
agaatcaaggtgaagcccacag

SEQ ID NO: 7569831 - DNA, 22 bp, Homo sapiens
agaatcaaggtgaagcccacag

SEQ ID NO: 7569832 - DNA, 22 bp, Homo sapiens
agaatcaattagattctatgag

SEQ ID NO: 7569833 - DNA, 22 bp, Homo sapiens
agaatcaaagagaaatactttg

SEQ ID NO: 7569834 - DNA, 22 bp, Homo sapiens
agaatcaactgaaaattggtga

SEQ ID NO: 7569835 - DNA, 22 bp, Homo sapiens
agaatcaactgaaaattggtga

SEQ ID NO: 7569836 - DNA, 22 bp, Homo sapiens
agaatcaactgaaaattggtga

SEQ ID NO: 7569837 - DNA, 22 bp, Homo sapiens
agaatcaaggtgaagcccacag

SEQ ID NO: 7569838 - DNA, 22 bp, Homo sapiens
atgaggccagggtgccatgaaa

SEQ ID NO: 7569839 - DNA, 22 bp, Homo sapiens
atgaggccagggtgccatgaaa

SEQ ID NO: 7569840 - DNA, 22 bp, Homo sapiens
atgaggccagggtgccatgaaa

SEQ ID NO: 7569841 - DNA, 22 bp, Homo sapiens
atgaggccagggtgccatgaaa

SEQ ID NO: 7569842 - DNA, 22 bp, Homo sapiens
atgaggccagaccactctgcat

SEQ ID NO: 7569843 - DNA, 22 bp, Homo sapiens
atgaggcagaaaaaagtcggag

SEQ ID NO: 7569844 - DNA, 20 bp, Homo sapiens
atgaggccagcagggctcag

SEQ ID NO: 7569845 - DNA, 20 bp, Homo sapiens
atgaggccagcagggctcag

SEQ ID NO: 7569846 - DNA, 22 bp, Homo sapiens
atgaggcacgtgttactggcct

SEQ ID NO: 7569847 - DNA, 22 bp, Homo sapiens
atgaggcacttaaaagtgaaga

SEQ ID NO: 7569848 - DNA, 22 bp, Homo sapiens
atgaggcacttaaaagtgaaga

SEQ ID NO: 7569849 - DNA, 22 bp, Homo sapiens
agaatcaattcactgctgcagc

SEQ ID NO: 7569850 - DNA, 22 bp, Homo sapiens
atgaggcacgtgttactggcct

SEQ ID NO: 7569851 - DNA, 22 bp, Homo sapiens
atgaggcagaaaaaagtcggag

SEQ ID NO: 7569852 - DNA, 22 bp, Homo sapiens
atgaggcagaaaaaagtcggag

SEQ ID NO: 7569853 - DNA, 22 bp, Homo sapiens
atgaggcacgtgttactggcct

SEQ ID NO: 7569854 - DNA, 22 bp, Homo sapiens
atgaggcacttaaaagtgaaga

SEQ ID NO: 7569855 - DNA, 22 bp, Homo sapiens
atgaggccagaccactctgcat

SEQ ID NO: 7569856 - DNA, 22 bp, Homo sapiens
atgaggcagagggctgtgccag

SEQ ID NO: 7569857 - DNA, 22 bp, Homo sapiens
agacaaggcccccttgggctct

SEQ ID NO: 7569858 - DNA, 22 bp, Homo sapiens
agacaaggcccccttgggctct

SEQ ID NO: 7569859 - DNA, 22 bp, Homo sapiens
agacaaggcaaggcggccagat

SEQ ID NO: 7569860 - DNA, 22 bp, Homo sapiens
agacaaggcaaggcggccagat

SEQ ID NO: 7569861 - DNA, 22 bp, Homo sapiens
agacaaggcaaggcggccagat

SEQ ID NO: 7569862 - DNA, 22 bp, Homo sapiens
agacaaggcaaggcggccagat

SEQ ID NO: 7569863 - DNA, 22 bp, Homo sapiens
agacaaggcaaggcggccagat

SEQ ID NO: 7569864 - DNA, 22 bp, Homo sapiens
agacaaggaatgtagcttactc

SEQ ID NO: 7569865 - DNA, 22 bp, Homo sapiens
agacaagagctgaggacatatt

SEQ ID NO: 7569866 - DNA, 22 bp, Homo sapiens
agacaagagctgaggacatatt

SEQ ID NO: 7569867 - DNA, 22 bp, Homo sapiens
agacaagagctgaggacatatt

SEQ ID NO: 7569868 - DNA, 22 bp, Homo sapiens
agacaagactaggcagttgttg

SEQ ID NO: 7569869 - DNA, 22 bp, Homo sapiens
agacaagagctgaggacatatt

SEQ ID NO: 7569870 - DNA, 22 bp, Homo sapiens
agacaactgcagagcaaagaat

SEQ ID NO: 7569871 - DNA, 22 bp, Homo sapiens
agacaactgcagagcaaagaat

SEQ ID NO: 7569872 - DNA, 22 bp, Homo sapiens
agacaagaaactgggagtctct

SEQ ID NO: 7569873 - DNA, 22 bp, Homo sapiens
agacaagactaggcagttgttg

SEQ ID NO: 7569874 - DNA, 22 bp, Homo sapiens
agacaagactaggcagttgttg

SEQ ID NO: 7569875 - DNA, 22 bp, Homo sapiens
agacaaatttgttttcctgtct

SEQ ID NO: 7569876 - DNA, 22 bp, Homo sapiens
agacaaatttgttttcctgtct

SEQ ID NO: 7569877 - DNA, 22 bp, Homo sapiens
agacaaatttcctgcaatgaag

SEQ ID NO: 7569878 - DNA, 22 bp, Homo sapiens
agacaaatttcctgcaatgaag

SEQ ID NO: 7569879 - DNA, 22 bp, Homo sapiens
agacaacaccaaatgctagtgt

SEQ ID NO: 7569880 - DNA, 22 bp, Homo sapiens
agacaacatcactaaagctgag

SEQ ID NO: 7569881 - DNA, 22 bp, Homo sapiens
agacaacatcactaaagctgag

SEQ ID NO: 7569882 - DNA, 22 bp, Homo sapiens
agacaacatcactaaagctgag

SEQ ID NO: 7569883 - DNA, 22 bp, Homo sapiens
agacaacaccaaatgctagtgt

SEQ ID NO: 7569884 - DNA, 22 bp, Homo sapiens
agacaacaccaaatgctagtgt

SEQ ID NO: 7569885 - DNA, 22 bp, Homo sapiens
agacaacatctagtttggtgga

SEQ ID NO: 7569886 - DNA, 22 bp, Homo sapiens
agacaacatctagtttggtgga

SEQ ID NO: 7569887 - DNA, 22 bp, Homo sapiens
agacaacatcactaaagctgag

SEQ ID NO: 7569888 - DNA, 22 bp, Homo sapiens
agacaacatcactaaagctgag

SEQ ID NO: 7569889 - DNA, 22 bp, Homo sapiens
agacaacatcactaaagctgag

SEQ ID NO: 7569890 - DNA, 22 bp, Homo sapiens
agacaacatcactaaagctgag

SEQ ID NO: 7569891 - DNA, 22 bp, Homo sapiens
agacaactagaaaactagacag

SEQ ID NO: 7569892 - DNA, 22 bp, Homo sapiens
agacaactagaaaactagacag

SEQ ID NO: 7569893 - DNA, 22 bp, Homo sapiens
agacaacatgatcagcagtcct

SEQ ID NO: 7569894 - DNA, 22 bp, Homo sapiens
agacactgttctcacatgcttg

SEQ ID NO: 7569895 - DNA, 22 bp, Homo sapiens
agacactgttctcacatgcttg

SEQ ID NO: 7569896 - DNA, 22 bp, Homo sapiens
agacactgttctcacatgcttg

SEQ ID NO: 7569897 - DNA, 22 bp, Homo sapiens
agacactgtgtacagaaaaaga

SEQ ID NO: 7569898 - DNA, 22 bp, Homo sapiens
agacactgtgtacagaaaaaga

SEQ ID NO: 7569899 - DNA, 22 bp, Homo sapiens
agacacttcatgtaagtggaat

SEQ ID NO: 7569900 - DNA, 22 bp, Homo sapiens
agacacttggcagagagctgtt

SEQ ID NO: 7569901 - DNA, 22 bp, Homo sapiens
agacacttatttagtgggagtt

SEQ ID NO: 7569902 - DNA, 22 bp, Homo sapiens
agacactgttctcacatgcttg

SEQ ID NO: 7569903 - DNA, 22 bp, Homo sapiens
agacagaaataggagaaaccag

SEQ ID NO: 7569904 - DNA, 21 bp, Homo sapiens
agacagaacaactgctctcca

SEQ ID NO: 7569905 - DNA, 21 bp, Homo sapiens
agacagaacaactgctctcca

SEQ ID NO: 7569906 - DNA, 21 bp, Homo sapiens
agacagaacaactgctctcca

SEQ ID NO: 7569907 - DNA, 22 bp, Homo sapiens
agacagaacagaataattgttg

SEQ ID NO: 7569908 - DNA, 22 bp, Homo sapiens
agacagaacagaataattgttg

SEQ ID NO: 7569909 - DNA, 22 bp, Homo sapiens
agacagaaataggagaaaccag

SEQ ID NO: 7569910 - DNA, 22 bp, Homo sapiens
agacactttcagaagtgtttgc

SEQ ID NO: 7569911 - DNA, 22 bp, Homo sapiens
agacacttggcagagagctgtt

SEQ ID NO: 7569912 - DNA, 22 bp, Homo sapiens
agacactttcagaagtgtttgc

SEQ ID NO: 7569913 - DNA, 22 bp, Homo sapiens
agacactttcagaagtgtttgc

SEQ ID NO: 7569914 - DNA, 22 bp, Homo sapiens
agacacattttacattaactgt

SEQ ID NO: 7569915 - DNA, 19 bp, Homo sapiens
agacaagtttccagaagcc

SEQ ID NO: 7569916 - DNA, 22 bp, Homo sapiens
agacaccagaatctgttgagca

SEQ ID NO: 7569917 - DNA, 22 bp, Homo sapiens
agacaccagaatctgttgagca

SEQ ID NO: 7569918 - DNA, 22 bp, Homo sapiens
agacacccagtgattgagactt

SEQ ID NO: 7569919 - DNA, 22 bp, Homo sapiens
agacaccaaagagttggcagtg

SEQ ID NO: 7569920 - DNA, 23 bp, Homo sapiens
agacactgtaaagaattgcagtt

SEQ ID NO: 7569921 - DNA, 22 bp, Homo sapiens
agacactgtgtacagaaaaaga

SEQ ID NO: 7569922 - DNA, 22 bp, Homo sapiens
agacaaggctggagtttaggca

SEQ ID NO: 7569923 - DNA, 22 bp, Homo sapiens
agacaagtgtttctgggtaact

SEQ ID NO: 7569924 - DNA, 22 bp, Homo sapiens
agacaagtgtggtgagagcagt

SEQ ID NO: 7569925 - DNA, 22 bp, Homo sapiens
agacaagtaggaatggttgaag

SEQ ID NO: 7569926 - DNA, 22 bp, Homo sapiens
agacaagtgtggtgagagcagt

SEQ ID NO: 7569927 - DNA, 22 bp, Homo sapiens
agacacattttacattaactgt

SEQ ID NO: 7569928 - DNA, 22 bp, Homo sapiens
agacaatacatttattcccttt

SEQ ID NO: 7569929 - DNA, 22 bp, Homo sapiens
agacacattttacattaactgt

SEQ ID NO: 7569930 - DNA, 19 bp, Homo sapiens
agacaagtttccagaagcc

SEQ ID NO: 7569931 - DNA, 22 bp, Homo sapiens
agacaagttctgtgggtcacct

SEQ ID NO: 7569932 - DNA, 22 bp, Homo sapiens
agacaagttctgtgggtcacct

SEQ ID NO: 7569933 - DNA, 22 bp, Homo sapiens
agacaagttctgtgggtcacct

SEQ ID NO: 7569934 - DNA, 22 bp, Homo sapiens
agacaagttctgtgggtcacct

SEQ ID NO: 7569935 - DNA, 22 bp, Homo sapiens
atgatacatcttgtttatttca

SEQ ID NO: 7569936 - DNA, 22 bp, Homo sapiens
atgatacatcttgtttatttca

SEQ ID NO: 7569937 - DNA, 22 bp, Homo sapiens
atgatacattgcaaaattttaa

SEQ ID NO: 7569938 - DNA, 22 bp, Homo sapiens
atgatacattgcaaaattttaa

SEQ ID NO: 7569939 - DNA, 22 bp, Homo sapiens
atgatacatcttcatgtcagtg

SEQ ID NO: 7569940 - DNA, 22 bp, Homo sapiens
atgatacatcttcatgtcagtg

SEQ ID NO: 7569941 - DNA, 22 bp, Homo sapiens
atgatacatcttcatgtcagtg

SEQ ID NO: 7569942 - DNA, 22 bp, Homo sapiens
atgatacatcttgtttatttca

SEQ ID NO: 7569943 - DNA, 22 bp, Homo sapiens
atgatacatcttcatgtcagtg

SEQ ID NO: 7569944 - DNA, 22 bp, Homo sapiens
atgatacatcttcatgtcagtg

SEQ ID NO: 7569945 - DNA, 22 bp, Homo sapiens
agacagacatagaaattagtaa

SEQ ID NO: 7569946 - DNA, 15 bp, Homo sapiens
agacagacagtggga

SEQ ID NO: 7569947 - DNA, 22 bp, Homo sapiens
atgatacatcttcatgtcagtg

SEQ ID NO: 7569948 - DNA, 22 bp, Homo sapiens
atgatacatcttcatgtcagtg

SEQ ID NO: 7569949 - DNA, 19 bp, Homo sapiens
atgatacaggtgaaaattg

SEQ ID NO: 7569950 - DNA, 22 bp, Homo sapiens
agacagacatagaaattagtaa

SEQ ID NO: 7569951 - DNA, 22 bp, Homo sapiens
agacagacagagaatttaaata

SEQ ID NO: 7569952 - DNA, 22 bp, Homo sapiens
agacagacagagaatttaaata

SEQ ID NO: 7569953 - DNA, 18 bp, Homo sapiens
agacagacaggtttgtgc

SEQ ID NO: 7569954 - DNA, 18 bp, Homo sapiens
agacagacaggtttgtgc

SEQ ID NO: 7569955 - DNA, 20 bp, Homo sapiens
agacagaatcagagataaag

SEQ ID NO: 7569956 - DNA, 20 bp, Homo sapiens
agacagaatcagagataaag

SEQ ID NO: 7569957 - DNA, 22 bp, Homo sapiens
agacagaacagaataattgttg

SEQ ID NO: 7569958 - DNA, 22 bp, Homo sapiens
agacagaacagaataattgttg

SEQ ID NO: 7569959 - DNA, 22 bp, Homo sapiens
agacagaatttgtcagataaat

SEQ ID NO: 7569960 - DNA, 22 bp, Homo sapiens
agacagaatttgtcagataaat

SEQ ID NO: 7569961 - DNA, 22 bp, Homo sapiens
agacagaatttgtcagataaat

SEQ ID NO: 7569962 - DNA, 22 bp, Homo sapiens
agacagaatttgtcagataaat

SEQ ID NO: 7569963 - DNA, 20 bp, Homo sapiens
agacagaatcagagataaag

SEQ ID NO: 7569964 - DNA, 20 bp, Homo sapiens
agacagaatcagagataaag

SEQ ID NO: 7569965 - DNA, 20 bp, Homo sapiens
agacagaatcagagataaag

SEQ ID NO: 7569966 - DNA, 20 bp, Homo sapiens
agacagaatcagagataaag

SEQ ID NO: 7569967 - DNA, 22 bp, Homo sapiens
agacagacaaaattcctgcctg

SEQ ID NO: 7569968 - DNA, 22 bp, Homo sapiens
agacagaatttgtcagataaat

SEQ ID NO: 7569969 - DNA, 22 bp, Homo sapiens
agacagaatttgtcagataaat

SEQ ID NO: 7569970 - DNA, 22 bp, Homo sapiens
agacagaatttgtcagataaat

SEQ ID NO: 7569971 - DNA, 22 bp, Homo sapiens
agacagacacatggtaacagat

SEQ ID NO: 7569972 - DNA, 22 bp, Homo sapiens
agacagacacatggtaacagat

SEQ ID NO: 7569973 - DNA, 22 bp, Homo sapiens
atgatatagagagtagattaaa

SEQ ID NO: 7569974 - DNA, 22 bp, Homo sapiens
atgatatagagagtagattaaa

SEQ ID NO: 7569975 - DNA, 22 bp, Homo sapiens
atgatatacttcctagaacagt

SEQ ID NO: 7569976 - DNA, 22 bp, Homo sapiens
atgatatacttcctagaacagt

SEQ ID NO: 7569977 - DNA, 22 bp, Homo sapiens
atgcagggttctgggctagaga

SEQ ID NO: 7569978 - DNA, 22 bp, Homo sapiens
atgcagggttctgggctagaga

SEQ ID NO: 7569979 - DNA, 22 bp, Homo sapiens
atgatatagagagtagattaaa

SEQ ID NO: 7569980 - DNA, 22 bp, Homo sapiens
atgatatagagagtagattaaa

SEQ ID NO: 7569981 - DNA, 22 bp, Homo sapiens
atgatatagagagtagattaaa

SEQ ID NO: 7569982 - DNA, 22 bp, Homo sapiens
atgcaggttggatcctatgccc

SEQ ID NO: 7569983 - DNA, 22 bp, Homo sapiens
atgcatatggcttgagggaata

SEQ ID NO: 7569984 - DNA, 22 bp, Homo sapiens
atgcaggttgggcaagtgtggg

SEQ ID NO: 7569985 - DNA, 22 bp, Homo sapiens
atgcatatggcttgagggaata

SEQ ID NO: 7569986 - DNA, 22 bp, Homo sapiens
atgcatatgtacccatgttctg

SEQ ID NO: 7569987 - DNA, 22 bp, Homo sapiens
atgatatacttcctagaacagt

SEQ ID NO: 7569988 - DNA, 22 bp, Homo sapiens
atgatatacttcctagaacagt

SEQ ID NO: 7569989 - DNA, 22 bp, Homo sapiens
atgatatacttcctagaacagt

SEQ ID NO: 7569990 - DNA, 22 bp, Homo sapiens
atgatactctaggtgatttaca

SEQ ID NO: 7569991 - DNA, 23 bp, Homo sapiens
atgatagaaactcttgtagtctc

SEQ ID NO: 7569992 - DNA, 22 bp, Homo sapiens
atgatagaaaggacacttggtg

SEQ ID NO: 7569993 - DNA, 21 bp, Homo sapiens
atgatactgaagcacaactat

SEQ ID NO: 7569994 - DNA, 22 bp, Homo sapiens
atgatactctaggtgatttaca

SEQ ID NO: 7569995 - DNA, 22 bp, Homo sapiens
atgatactctaggtgatttaca

SEQ ID NO: 7569996 - DNA, 22 bp, Homo sapiens
atgatacatttacctatggtct

SEQ ID NO: 7569997 - DNA, 22 bp, Homo sapiens
atgatactctaggtgatttaca

SEQ ID NO: 7569998 - DNA, 22 bp, Homo sapiens
atgatactctaggtgatttaca

SEQ ID NO: 7569999 - DNA, 22 bp, Homo sapiens
atgatacatttacctatggtct

SEQ ID NO: 7570000 - DNA, 22 bp, Homo sapiens
atgcatttttgagtatgaatga

SEQ ID NO: 7570001 - DNA, 22 bp, Homo sapiens
atgcatttttgagtatgaatga

SEQ ID NO: 7570002 - DNA, 22 bp, Homo sapiens
atgcatttttgagtatgaatga

SEQ ID NO: 7570003 - DNA, 22 bp, Homo sapiens
atgccaaaatgttacatttctt

SEQ ID NO: 7570004 - DNA, 22 bp, Homo sapiens
atgccaaaatgttacatttctt

SEQ ID NO: 7570005 - DNA, 22 bp, Homo sapiens
atgcatttttgagtatgaatga

SEQ ID NO: 7570006 - DNA, 22 bp, Homo sapiens
atgccaaattctactttcagca

SEQ ID NO: 7570007 - DNA, 22 bp, Homo sapiens
atgccaaattctcagcctcttt

SEQ ID NO: 7570008 - DNA, 22 bp, Homo sapiens
atgccaaattctactttcagca

SEQ ID NO: 7570009 - DNA, 22 bp, Homo sapiens
atgccaaagggagcactttggg

SEQ ID NO: 7570010 - DNA, 22 bp, Homo sapiens
atgccaaagcccaagttcatca

SEQ ID NO: 7570011 - DNA, 22 bp, Homo sapiens
atgccaaagcccaagttcatca

SEQ ID NO: 7570012 - DNA, 22 bp, Homo sapiens
atgcatttgtaaaatataatcg

SEQ ID NO: 7570013 - DNA, 22 bp, Homo sapiens
atgcatattttctgttggtgac

SEQ ID NO: 7570014 - DNA, 22 bp, Homo sapiens
atgcatattttctgttggtgac

SEQ ID NO: 7570015 - DNA, 22 bp, Homo sapiens
atgcatattttctactatatcg

SEQ ID NO: 7570016 - DNA, 22 bp, Homo sapiens
atgcatattttctactatatcg

SEQ ID NO: 7570017 - DNA, 22 bp, Homo sapiens
atgcatttttgagtatgaatga

SEQ ID NO: 7570018 - DNA, 22 bp, Homo sapiens
atgcatttttgagtatgaatga

SEQ ID NO: 7570019 - DNA, 22 bp, Homo sapiens
atgcatttgtaaaatataatcg

SEQ ID NO: 7570020 - DNA, 22 bp, Homo sapiens
atgcatttgtaaaatataatcg

SEQ ID NO: 7570021 - DNA, 21 bp, Homo sapiens
atgcatattttaagttgtgtc

SEQ ID NO: 7570022 - DNA, 21 bp, Homo sapiens
atgcatattttaagttgtgtc

SEQ ID NO: 7570023 - DNA, 18 bp, Homo sapiens
atgcatattttaagttgt

SEQ ID NO: 7570024 - DNA, 22 bp, Homo sapiens
atgcatatttcttgggcttacc

SEQ ID NO: 7570025 - DNA, 18 bp, Homo sapiens
atgcatattttaagttgt

SEQ ID NO: 7570026 - DNA, 21 bp, Homo sapiens
atgcatattttaagttgtgtc

SEQ ID NO: 7570027 - DNA, 22 bp, Homo sapiens
atgcatattttctactatatcg

SEQ ID NO: 7570028 - DNA, 18 bp, Homo sapiens
atgcatattttaagttgt

SEQ ID NO: 7570029 - DNA, 22 bp, Homo sapiens
atgcatattttctactatatcg

SEQ ID NO: 7570030 - DNA, 22 bp, Homo sapiens
atgcatattttctactatatcg

SEQ ID NO: 7570031 - DNA, 22 bp, Homo sapiens
atgcatattttctactatatcg

SEQ ID NO: 7570032 - DNA, 22 bp, Homo sapiens
atgcatatttcttgggcttacc

SEQ ID NO: 7570033 - DNA, 22 bp, Homo sapiens
atgcatatttcttggagcacct

SEQ ID NO: 7570034 - DNA, 22 bp, Homo sapiens
atgcatatttcttggagcacct

SEQ ID NO: 7570035 - DNA, 22 bp, Homo sapiens
atgcatatttcatgaatctttg

SEQ ID NO: 7570036 - DNA, 22 bp, Homo sapiens
atgcatatttcatgaatctttg

SEQ ID NO: 7570037 - DNA, 22 bp, Homo sapiens
atgcatatttcatgaatctttg

SEQ ID NO: 7570038 - DNA, 22 bp, Homo sapiens
atgcatattgtcatttagtcct

SEQ ID NO: 7570039 - DNA, 22 bp, Homo sapiens
atgcatattgtcatttagtcct

SEQ ID NO: 7570040 - DNA, 22 bp, Homo sapiens
atgcatattgtcatttagtcct

SEQ ID NO: 7570041 - DNA, 22 bp, Homo sapiens
atgcatattggattagcagcca

SEQ ID NO: 7570042 - DNA, 22 bp, Homo sapiens
atgcatattggattagcagcca

SEQ ID NO: 7570043 - DNA, 22 bp, Homo sapiens
atgcatattgattatagattca

SEQ ID NO: 7570044 - DNA, 22 bp, Homo sapiens
atgcatattgattatagattca

SEQ ID NO: 7570045 - DNA, 22 bp, Homo sapiens
atgcatattcttagcccctcct

SEQ ID NO: 7570046 - DNA, 22 bp, Homo sapiens
atgcatattcttagcccctcct

SEQ ID NO: 7570047 - DNA, 22 bp, Homo sapiens
atgcatattgattatagattca

SEQ ID NO: 7570048 - DNA, 22 bp, Homo sapiens
atgcatattgattatagattca

SEQ ID NO: 7570049 - DNA, 22 bp, Homo sapiens
atgcatattgattatagattca

SEQ ID NO: 7570050 - DNA, 22 bp, Homo sapiens
atgcatatgtgtgcacacgtgt

SEQ ID NO: 7570051 - DNA, 22 bp, Homo sapiens
atgcatatgtgtgcacacgtgt

SEQ ID NO: 7570052 - DNA, 22 bp, Homo sapiens
atgcatatgtgtgcacacgtgt

SEQ ID NO: 7570053 - DNA, 22 bp, Homo sapiens
atgcatatgtgtgcacacgtgt

SEQ ID NO: 7570054 - DNA, 22 bp, Homo sapiens
atgcatatgtacttgcatatgt

SEQ ID NO: 7570055 - DNA, 22 bp, Homo sapiens
atgcatatgtacttgcatatgt

SEQ ID NO: 7570056 - DNA, 22 bp, Homo sapiens
atgcatatgtacccatgttctg

SEQ ID NO: 7570057 - DNA, 22 bp, Homo sapiens
atgcatatgtacttgcatatgt

SEQ ID NO: 7570058 - DNA, 22 bp, Homo sapiens
atgcatatgtacttgcatatgt

SEQ ID NO: 7570059 - DNA, 22 bp, Homo sapiens
atgcatatgtacccatgttctg

SEQ ID NO: 7570060 - DNA, 22 bp, Homo sapiens
atgcatatgtacccatgttctg

SEQ ID NO: 7570061 - DNA, 22 bp, Homo sapiens
agacctggagtgaagagttccc

SEQ ID NO: 7570062 - DNA, 22 bp, Homo sapiens
agacctggagtgaagagttccc

SEQ ID NO: 7570063 - DNA, 22 bp, Homo sapiens
agacctggagtggggcctcagg

SEQ ID NO: 7570064 - DNA, 22 bp, Homo sapiens
agacctggagtggggcctcagg

SEQ ID NO: 7570065 - DNA, 22 bp, Homo sapiens
agacctggagtgaagagttccc

SEQ ID NO: 7570066 - DNA, 22 bp, Homo sapiens
agacctggagacctgagtggta

SEQ ID NO: 7570067 - DNA, 22 bp, Homo sapiens
agacctggagtgaagagttccc

SEQ ID NO: 7570068 - DNA, 22 bp, Homo sapiens
agacctggagacctgagtggta

SEQ ID NO: 7570069 - DNA, 22 bp, Homo sapiens
agacctggaagttcaagagaaa

SEQ ID NO: 7570070 - DNA, 22 bp, Homo sapiens
agacctggagacctgagtggta

SEQ ID NO: 7570071 - DNA, 22 bp, Homo sapiens
agacctggagacctgagtggta

SEQ ID NO: 7570072 - DNA, 22 bp, Homo sapiens
agaccccatacctcagcaggta

SEQ ID NO: 7570073 - DNA, 22 bp, Homo sapiens
agacccaggcttcatgtgaatc

SEQ ID NO: 7570074 - DNA, 22 bp, Homo sapiens
agacccaggcttcatgtgaatc

SEQ ID NO: 7570075 - DNA, 22 bp, Homo sapiens
atgccacataattacaaataga

SEQ ID NO: 7570076 - DNA, 22 bp, Homo sapiens
agacccaggattggggctgccg

SEQ ID NO: 7570077 - DNA, 22 bp, Homo sapiens
agacccaggattggggctgccg

SEQ ID NO: 7570078 - DNA, 22 bp, Homo sapiens
agacctggaagttcaagagaaa

SEQ ID NO: 7570079 - DNA, 22 bp, Homo sapiens
agacctgcagggccaggcctgc

SEQ ID NO: 7570080 - DNA, 23 bp, Homo sapiens
agacctgcatctgataggccctg

SEQ ID NO: 7570081 - DNA, 22 bp, Homo sapiens
agacccaggtttcaaactactc

SEQ ID NO: 7570082 - DNA, 22 bp, Homo sapiens
agaccccatacctcagcaggta

SEQ ID NO: 7570083 - DNA, 22 bp, Homo sapiens
agaccccatacctcagcaggta

SEQ ID NO: 7570084 - DNA, 22 bp, Homo sapiens
atgccaataaatgttaatatct

SEQ ID NO: 7570085 - DNA, 22 bp, Homo sapiens
atgccaattgcaggaagaaaac

SEQ ID NO: 7570086 - DNA, 22 bp, Homo sapiens
atgccacataaccagttcactt

SEQ ID NO: 7570087 - DNA, 22 bp, Homo sapiens
atgccacataattacaaataga

SEQ ID NO: 7570088 - DNA, 22 bp, Homo sapiens
atgccaagtacaggcactgctc

SEQ ID NO: 7570089 - DNA, 22 bp, Homo sapiens
atgccaagaatcatatgccagg

SEQ ID NO: 7570090 - DNA, 22 bp, Homo sapiens
atgccaagaatcatatgccagg

SEQ ID NO: 7570091 - DNA, 20 bp, Homo sapiens
atgccaagctatctagaatc

SEQ ID NO: 7570092 - DNA, 20 bp, Homo sapiens
atgccaagctatctagaatc

SEQ ID NO: 7570093 - DNA, 22 bp, Homo sapiens
atgccaaatttctttctgttct

SEQ ID NO: 7570094 - DNA, 22 bp, Homo sapiens
atgccaagtacaggcactgctc

SEQ ID NO: 7570095 - DNA, 22 bp, Homo sapiens
atgccaagcttcagctgaaact

SEQ ID NO: 7570096 - DNA, 22 bp, Homo sapiens
atgccaagctctatccctgacc

SEQ ID NO: 7570097 - DNA, 22 bp, Homo sapiens
agacctttgctgcttcttatag

SEQ ID NO: 7570098 - DNA, 22 bp, Homo sapiens
agacctttgctgcttcttatag

SEQ ID NO: 7570099 - DNA, 22 bp, Homo sapiens
agacctttatttcatgatagga

SEQ ID NO: 7570100 - DNA, 22 bp, Homo sapiens
agacctttatttcatgatagga

SEQ ID NO: 7570101 - DNA, 22 bp, Homo sapiens
agacctgttgggttcattggct

SEQ ID NO: 7570102 - DNA, 22 bp, Homo sapiens
agacctgtgatcacatggaatg

SEQ ID NO: 7570103 - DNA, 22 bp, Homo sapiens
agacctgttgggttcattggct

SEQ ID NO: 7570104 - DNA, 22 bp, Homo sapiens
agacctggtttatcaccagcat

SEQ ID NO: 7570105 - DNA, 22 bp, Homo sapiens
agacctgtgatcacatggaatg

SEQ ID NO: 7570106 - DNA, 22 bp, Homo sapiens
agacctggtttatcaccagcat

SEQ ID NO: 7570107 - DNA, 22 bp, Homo sapiens
agacctggtttatcaccagcat

SEQ ID NO: 7570108 - DNA, 22 bp, Homo sapiens
agacctggtttatcaccagcat

SEQ ID NO: 7570109 - DNA, 22 bp, Homo sapiens
agacctggtaagcaggttgggc

SEQ ID NO: 7570110 - DNA, 22 bp, Homo sapiens
agacctggtaagcaggttgggc

SEQ ID NO: 7570111 - DNA, 22 bp, Homo sapiens
agacctggtaagcaggttgggc

SEQ ID NO: 7570112 - DNA, 22 bp, Homo sapiens
agacctggtaagcaggttgggc

SEQ ID NO: 7570113 - DNA, 22 bp, Homo sapiens
agacctggtgatagctgtccta

SEQ ID NO: 7570114 - DNA, 22 bp, Homo sapiens
agacctggtgatagctgtccta

SEQ ID NO: 7570115 - DNA, 22 bp, Homo sapiens
agacctggtgatagctgtccta

SEQ ID NO: 7570116 - DNA, 22 bp, Homo sapiens
agacctggatgtgagggaagta

SEQ ID NO: 7570117 - DNA, 22 bp, Homo sapiens
agacctggattccaatcctacc

SEQ ID NO: 7570118 - DNA, 22 bp, Homo sapiens
agacctggatgtgagggaagta

SEQ ID NO: 7570119 - DNA, 22 bp, Homo sapiens
agacctggagtggggcctcagg

SEQ ID NO: 7570120 - DNA, 22 bp, Homo sapiens
agacctggagtggggcctcagg

SEQ ID NO: 7570121 - DNA, 22 bp, Homo sapiens
agacctggatgtgagggaagta

SEQ ID NO: 7570122 - DNA, 22 bp, Homo sapiens
agacctggagtggggcctcagg

SEQ ID NO: 7570123 - DNA, 22 bp, Homo sapiens
agacctggatgtgagggaagta

SEQ ID NO: 7570124 - DNA, 22 bp, Homo sapiens
agacctgggtgccctgtgcttt

SEQ ID NO: 7570125 - DNA, 22 bp, Homo sapiens
agacctgggtgccctgtgcttt

SEQ ID NO: 7570126 - DNA, 22 bp, Homo sapiens
agacctgggtgccctgtgcttt

SEQ ID NO: 7570127 - DNA, 22 bp, Homo sapiens
agacctgggtgccctgtgcttt

SEQ ID NO: 7570128 - DNA, 22 bp, Homo sapiens
agacctgggtgccctgtgcttt

SEQ ID NO: 7570129 - DNA, 22 bp, Homo sapiens
agacctgggtgccctgtgcttt

SEQ ID NO: 7570130 - DNA, 22 bp, Homo sapiens
agacctgggttcgagtcctaac

SEQ ID NO: 7570131 - DNA, 22 bp, Homo sapiens
agacctgggttcgagtcctaac

SEQ ID NO: 7570132 - DNA, 22 bp, Homo sapiens
agacctgggttcgagtcctaac

SEQ ID NO: 7570133 - DNA, 22 bp, Homo sapiens
agacctgggttcgagtcctaac

SEQ ID NO: 7570134 - DNA, 22 bp, Homo sapiens
atgcctttctttggtgcaggtt

SEQ ID NO: 7570135 - DNA, 20 bp, Homo sapiens
atgcctttgatagtcaggct

SEQ ID NO: 7570136 - DNA, 20 bp, Homo sapiens
atgcctttgatagtcaggct

SEQ ID NO: 7570137 - DNA, 22 bp, Homo sapiens
atgcctttgccacagattagga

SEQ ID NO: 7570138 - DNA, 22 bp, Homo sapiens
atgcctttgccacagattagga

SEQ ID NO: 7570139 - DNA, 22 bp, Homo sapiens
atgcctttgccacagattagga

SEQ ID NO: 7570140 - DNA, 22 bp, Homo sapiens
atgcctttcttagccctgaagg

SEQ ID NO: 7570141 - DNA, 22 bp, Homo sapiens
atgcctttctggtgttcttcct

SEQ ID NO: 7570142 - DNA, 22 bp, Homo sapiens
atgcctttctggtgttcttcct

SEQ ID NO: 7570143 - DNA, 22 bp, Homo sapiens
atgcctttctctgtagaaagaa

SEQ ID NO: 7570144 - DNA, 22 bp, Homo sapiens
atgcctttcccaacagggtggg

SEQ ID NO: 7570145 - DNA, 22 bp, Homo sapiens
atgcctttatcaggaggtaaat

SEQ ID NO: 7570146 - DNA, 22 bp, Homo sapiens
atgcctttctctgtagaaagaa

SEQ ID NO: 7570147 - DNA, 22 bp, Homo sapiens
atgcctttggagaatccaacat

SEQ ID NO: 7570148 - DNA, 22 bp, Homo sapiens
atgcctttggagaatccaacat

SEQ ID NO: 7570149 - DNA, 22 bp, Homo sapiens
atgcctttggcattatttcttg

SEQ ID NO: 7570150 - DNA, 22 bp, Homo sapiens
atgcctttggcattatttcttg

SEQ ID NO: 7570151 - DNA, 22 bp, Homo sapiens
atgcctttggcattatttcttg

SEQ ID NO: 7570152 - DNA, 22 bp, Homo sapiens
atgcctttgttgaccactataa

SEQ ID NO: 7570153 - DNA, 22 bp, Homo sapiens
atgcctttgttgaccactataa

SEQ ID NO: 7570154 - DNA, 22 bp, Homo sapiens
atgccttttccatctcaggcag

SEQ ID NO: 7570155 - DNA, 22 bp, Homo sapiens
atgccttttcgggtacttctct

SEQ ID NO: 7570156 - DNA, 22 bp, Homo sapiens
atgccttttcgggtacttctct

SEQ ID NO: 7570157 - DNA, 22 bp, Homo sapiens
atgcctttttatcatggatgat

SEQ ID NO: 7570158 - DNA, 22 bp, Homo sapiens
atgcgagtgatgcagagtggct

SEQ ID NO: 7570159 - DNA, 22 bp, Homo sapiens
atgcgagtgatgcagagtggct

SEQ ID NO: 7570160 - DNA, 22 bp, Homo sapiens
atgcgagtgatgcagagtggct

SEQ ID NO: 7570161 - DNA, 22 bp, Homo sapiens
agactgtaatttgtggcctcct

SEQ ID NO: 7570162 - DNA, 22 bp, Homo sapiens
agactggtttttaacttcacct

SEQ ID NO: 7570163 - DNA, 22 bp, Homo sapiens
agactgtaattgacatgtcagc

SEQ ID NO: 7570164 - DNA, 22 bp, Homo sapiens
agactggggttctggcaaggag

SEQ ID NO: 7570165 - DNA, 22 bp, Homo sapiens
agactggggttctggcaaggag

SEQ ID NO: 7570166 - DNA, 22 bp, Homo sapiens
agactgggtttgagacttagca

SEQ ID NO: 7570167 - DNA, 22 bp, Homo sapiens
agactctgattccctcatgtca

SEQ ID NO: 7570168 - DNA, 22 bp, Homo sapiens
agactctgattccctcatgtca

SEQ ID NO: 7570169 - DNA, 22 bp, Homo sapiens
agactctgattccctcatgtca

SEQ ID NO: 7570170 - DNA, 22 bp, Homo sapiens
agactctgataagcaactcttg

SEQ ID NO: 7570171 - DNA, 22 bp, Homo sapiens
atgcgagtgatgcagagtggct

SEQ ID NO: 7570172 - DNA, 22 bp, Homo sapiens
agactctgcatttctaataagc

SEQ ID NO: 7570173 - DNA, 19 bp, Homo sapiens
agactctgccactcttctc

SEQ ID NO: 7570174 - DNA, 22 bp, Homo sapiens
agactctgcatttctaataagc

SEQ ID NO: 7570175 - DNA, 22 bp, Homo sapiens
agactctgattccctcatgtca

SEQ ID NO: 7570176 - DNA, 22 bp, Homo sapiens
agacgcagatttatttcagttt

SEQ ID NO: 7570177 - DNA, 22 bp, Homo sapiens
agacgcgcagaaggaagcggcc

SEQ ID NO: 7570178 - DNA, 22 bp, Homo sapiens
agacgcgcagaaggaagcggcc

SEQ ID NO: 7570179 - DNA, 22 bp, Homo sapiens
atgcctggtatgaagcaaggaa

SEQ ID NO: 7570180 - DNA, 22 bp, Homo sapiens
atgcctggtatgaagcaaggaa

SEQ ID NO: 7570181 - DNA, 22 bp, Homo sapiens
agacgcagatttatttcagttt

SEQ ID NO: 7570182 - DNA, 22 bp, Homo sapiens
atgcctggtatgaagcaaggaa

SEQ ID NO: 7570183 - DNA, 22 bp, Homo sapiens
agacgagggcccccaggacagc

SEQ ID NO: 7570184 - DNA, 22 bp, Homo sapiens
agacgagggcccccaggacagc

SEQ ID NO: 7570185 - DNA, 22 bp, Homo sapiens
agacgagggcccccaggacagc

SEQ ID NO: 7570186 - DNA, 22 bp, Homo sapiens
atgcctgtaatcccagcacttt

SEQ ID NO: 7570187 - DNA, 22 bp, Homo sapiens
atgcctgtaatcccagtgcttt

SEQ ID NO: 7570188 - DNA, 22 bp, Homo sapiens
atgcctgtaaaacagcacccag

SEQ ID NO: 7570189 - DNA, 22 bp, Homo sapiens
atgcctggtcccacctctaggt

SEQ ID NO: 7570190 - DNA, 22 bp, Homo sapiens
atgcctggtatgaagcaaggaa

SEQ ID NO: 7570191 - DNA, 22 bp, Homo sapiens
atgcctggtcccacctctaggt

SEQ ID NO: 7570192 - DNA, 22 bp, Homo sapiens
atgcctggtcccacctctaggt

SEQ ID NO: 7570193 - DNA, 22 bp, Homo sapiens
atgcctggtcccacctctaggt

SEQ ID NO: 7570194 - DNA, 22 bp, Homo sapiens
atgcctggtcccacctctaggt

SEQ ID NO: 7570195 - DNA, 22 bp, Homo sapiens
atgcctttaagagatactgagg

SEQ ID NO: 7570196 - DNA, 22 bp, Homo sapiens
atgcctttaagagatactgagg

SEQ ID NO: 7570197 - DNA, 22 bp, Homo sapiens
atgcctttatcaggaggtaaat

SEQ ID NO: 7570198 - DNA, 22 bp, Homo sapiens
atgcctttaagagatactgagg

SEQ ID NO: 7570199 - DNA, 22 bp, Homo sapiens
atgccttatggtgaattagttc

SEQ ID NO: 7570200 - DNA, 22 bp, Homo sapiens
atgccttattccaacaatctag

SEQ ID NO: 7570201 - DNA, 22 bp, Homo sapiens
atgccttattgtaatctttcca

SEQ ID NO: 7570202 - DNA, 22 bp, Homo sapiens
atgcctttaagagatactgagg

SEQ ID NO: 7570203 - DNA, 22 bp, Homo sapiens
atgccttatagtccacagtgga

SEQ ID NO: 7570204 - DNA, 22 bp, Homo sapiens
atgccttattccaacaatctag

SEQ ID NO: 7570205 - DNA, 22 bp, Homo sapiens
atgccttattccaacaatctag

SEQ ID NO: 7570206 - DNA, 22 bp, Homo sapiens
atgccttaaggcgagatactta

SEQ ID NO: 7570207 - DNA, 22 bp, Homo sapiens
atgcctgtaattccagcatttt

SEQ ID NO: 7570208 - DNA, 22 bp, Homo sapiens
atgcctgtgctatattctcaca

SEQ ID NO: 7570209 - DNA, 22 bp, Homo sapiens
agagacaagaaatacctgggac

SEQ ID NO: 7570210 - DNA, 22 bp, Homo sapiens
agagacaaacactgcaacttct

SEQ ID NO: 7570211 - DNA, 22 bp, Homo sapiens
agagacaatgccaatgcacacg

SEQ ID NO: 7570212 - DNA, 22 bp, Homo sapiens
agagacaatgccaatgcacacg

SEQ ID NO: 7570213 - DNA, 22 bp, Homo sapiens
agagacaatgccaatgcacacg

SEQ ID NO: 7570214 - DNA, 22 bp, Homo sapiens
agagacaagggacctctggaga

SEQ ID NO: 7570215 - DNA, 22 bp, Homo sapiens
agagacaatgccaatgcacacg

SEQ ID NO: 7570216 - DNA, 22 bp, Homo sapiens
agagacaatgccaatgcacacg

SEQ ID NO: 7570217 - DNA, 22 bp, Homo sapiens
agagacaatgccaatgcacacg

SEQ ID NO: 7570218 - DNA, 22 bp, Homo sapiens
agagacaatgccaatgcacacg

SEQ ID NO: 7570219 - DNA, 22 bp, Homo sapiens
agagacaatgccaatgcacacg

SEQ ID NO: 7570220 - DNA, 22 bp, Homo sapiens
agagacaatgccaatgcacacg

SEQ ID NO: 7570221 - DNA, 22 bp, Homo sapiens
agagacaatgccaatgcacacg

SEQ ID NO: 7570222 - DNA, 22 bp, Homo sapiens
agagacaccgcgcatcatggct

SEQ ID NO: 7570223 - DNA, 22 bp, Homo sapiens
agagacacatcatataagtata

SEQ ID NO: 7570224 - DNA, 22 bp, Homo sapiens
agagacacatcatataagtata

SEQ ID NO: 7570225 - DNA, 19 bp, Homo sapiens
agagacacaggtaagtagg

SEQ ID NO: 7570226 - DNA, 19 bp, Homo sapiens
agagacacaggtaagtagg

SEQ ID NO: 7570227 - DNA, 22 bp, Homo sapiens
agagaattacagaagaatgtca

SEQ ID NO: 7570228 - DNA, 20 bp, Homo sapiens
agagaattccctttggagat

SEQ ID NO: 7570229 - DNA, 22 bp, Homo sapiens
agagaattctggtgctaacaag

SEQ ID NO: 7570230 - DNA, 22 bp, Homo sapiens
agagaattacagaagaatgtca

SEQ ID NO: 7570231 - DNA, 22 bp, Homo sapiens
agagaattacagaagaatgtca

SEQ ID NO: 7570232 - DNA, 22 bp, Homo sapiens
agagaattaacattccatggct

SEQ ID NO: 7570233 - DNA, 22 bp, Homo sapiens
agagaattaattaggagcactg

SEQ ID NO: 7570234 - DNA, 22 bp, Homo sapiens
agagaattttaaaagccttgaa

SEQ ID NO: 7570235 - DNA, 22 bp, Homo sapiens
agagacaaacactgcaacttct

SEQ ID NO: 7570236 - DNA, 22 bp, Homo sapiens
agagacaaacactgcaacttct

SEQ ID NO: 7570237 - DNA, 21 bp, Homo sapiens
agagaattgccttagatgttc

SEQ ID NO: 7570238 - DNA, 21 bp, Homo sapiens
agagaattgccttagatgttc

SEQ ID NO: 7570239 - DNA, 21 bp, Homo sapiens
agagaattgccttagatgttc

SEQ ID NO: 7570240 - DNA, 22 bp, Homo sapiens
agagaattggagcagtgacagg

SEQ ID NO: 7570241 - DNA, 22 bp, Homo sapiens
agagaattctggtgctaacaag

SEQ ID NO: 7570242 - DNA, 22 bp, Homo sapiens
agagaattctggtgctaacaag

SEQ ID NO: 7570243 - DNA, 21 bp, Homo sapiens
agagacagagaaagtaacatt

SEQ ID NO: 7570244 - DNA, 21 bp, Homo sapiens
agagacagagaaagtaacatt

SEQ ID NO: 7570245 - DNA, 21 bp, Homo sapiens
agagacagagaaagtaacatt

SEQ ID NO: 7570246 - DNA, 21 bp, Homo sapiens
agagacagagaaagtaacatt

SEQ ID NO: 7570247 - DNA, 21 bp, Homo sapiens
agagacagagaaagtaacatt

SEQ ID NO: 7570248 - DNA, 22 bp, Homo sapiens
agagacagacacatcgggctgc

SEQ ID NO: 7570249 - DNA, 22 bp, Homo sapiens
agagacagacacatcgggctgc

SEQ ID NO: 7570250 - DNA, 21 bp, Homo sapiens
agagacagagaaagtaacatt

SEQ ID NO: 7570251 - DNA, 21 bp, Homo sapiens
agagacagagaaagtaacatt

SEQ ID NO: 7570252 - DNA, 21 bp, Homo sapiens
agagacagagaaagtaacatt

SEQ ID NO: 7570253 - DNA, 22 bp, Homo sapiens
agagacaccgcgcatcatggct

SEQ ID NO: 7570254 - DNA, 22 bp, Homo sapiens
agagacagacacatcgggctgc

SEQ ID NO: 7570255 - DNA, 22 bp, Homo sapiens
agagacagacacatcgggctgc

SEQ ID NO: 7570256 - DNA, 22 bp, Homo sapiens
agagacagacacatcgggctgc

SEQ ID NO: 7570257 - DNA, 22 bp, Homo sapiens
agagacagacacatcgggctgc

SEQ ID NO: 7570258 - DNA, 22 bp, Homo sapiens
agagagcatggcacagaggggt

SEQ ID NO: 7570259 - DNA, 22 bp, Homo sapiens
agagagcattgaggaaatcttc

SEQ ID NO: 7570260 - DNA, 22 bp, Homo sapiens
agagagcattgaggaaatcttc

SEQ ID NO: 7570261 - DNA, 22 bp, Homo sapiens
agagagcatggcacagaggggt

SEQ ID NO: 7570262 - DNA, 22 bp, Homo sapiens
agagagcatggcacagaggggt

SEQ ID NO: 7570263 - DNA, 22 bp, Homo sapiens
agagagcatggcacagaggggt

SEQ ID NO: 7570264 - DNA, 22 bp, Homo sapiens
agagagcccgggccagggcaca

SEQ ID NO: 7570265 - DNA, 22 bp, Homo sapiens
agagagcccgggccagggcaca

SEQ ID NO: 7570266 - DNA, 22 bp, Homo sapiens
agagagcccgggccagggcaca

SEQ ID NO: 7570267 - DNA, 22 bp, Homo sapiens
agagagcattgaggaaatcttc

SEQ ID NO: 7570268 - DNA, 21 bp, Homo sapiens
agagagaaggccatatggtcc

SEQ ID NO: 7570269 - DNA, 21 bp, Homo sapiens
agagagaaggccatatggtcc

SEQ ID NO: 7570270 - DNA, 22 bp, Homo sapiens
agagagaagcaatcagtggcca

SEQ ID NO: 7570271 - DNA, 22 bp, Homo sapiens
agagagaagcaatcagtggcca

SEQ ID NO: 7570272 - DNA, 21 bp, Homo sapiens
agagagaaggccatatggtcc

SEQ ID NO: 7570273 - DNA, 21 bp, Homo sapiens
agagagaaggccatatggtcc

SEQ ID NO: 7570274 - DNA, 22 bp, Homo sapiens
agagagcagtggatcacctagc

SEQ ID NO: 7570275 - DNA, 22 bp, Homo sapiens
agagagcatggcacagaggggt

SEQ ID NO: 7570276 - DNA, 22 bp, Homo sapiens
agagagcatggcacagaggggt

SEQ ID NO: 7570277 - DNA, 22 bp, Homo sapiens
agagagcatggcacagaggggt

SEQ ID NO: 7570278 - DNA, 22 bp, Homo sapiens
agagaggctgctggactatatg

SEQ ID NO: 7570279 - DNA, 22 bp, Homo sapiens
agagaggctgctggactatatg

SEQ ID NO: 7570280 - DNA, 22 bp, Homo sapiens
agagaggctgggcgtagggctt

SEQ ID NO: 7570281 - DNA, 22 bp, Homo sapiens
agagaggctgggcgtagggctt

SEQ ID NO: 7570282 - DNA, 22 bp, Homo sapiens
agagaggctgggcgtagggctt

SEQ ID NO: 7570283 - DNA, 22 bp, Homo sapiens
agagaggctgggcgtagggctt

SEQ ID NO: 7570284 - DNA, 19 bp, Homo sapiens
agagaggctgtgtgaggga

SEQ ID NO: 7570285 - DNA, 19 bp, Homo sapiens
agagaggctgtgtgaggga

SEQ ID NO: 7570286 - DNA, 19 bp, Homo sapiens
agagaggctgtgtgaggga

SEQ ID NO: 7570287 - DNA, 19 bp, Homo sapiens
agagaggctgtgtgaggga

SEQ ID NO: 7570288 - DNA, 19 bp, Homo sapiens
agagaggctgtgtgaggga

SEQ ID NO: 7570289 - DNA, 22 bp, Homo sapiens
agagagggaatatttggggtat

SEQ ID NO: 7570290 - DNA, 19 bp, Homo sapiens
agagaggctgtgtgaggga

SEQ ID NO: 7570291 - DNA, 22 bp, Homo sapiens
agagagggaatatttggggtat

SEQ ID NO: 7570292 - DNA, 22 bp, Homo sapiens
agagagggaatatttggggtat

SEQ ID NO: 7570293 - DNA, 22 bp, Homo sapiens
agagagggaatatttggggtat

SEQ ID NO: 7570294 - DNA, 22 bp, Homo sapiens
agagagggaatatttggggtat

SEQ ID NO: 7570295 - DNA, 21 bp, Homo sapiens
agagagggagatgaaacatcc

SEQ ID NO: 7570296 - DNA, 21 bp, Homo sapiens
agagagggagatgaaacatcc

SEQ ID NO: 7570297 - DNA, 21 bp, Homo sapiens
agagagggagatgaaacatcc

SEQ ID NO: 7570298 - DNA, 21 bp, Homo sapiens
agagagggagatgaaacatcc

SEQ ID NO: 7570299 - DNA, 21 bp, Homo sapiens
agagagggagatgaaacatcc

SEQ ID NO: 7570300 - DNA, 22 bp, Homo sapiens
agagagggcatagaaaaaggga

SEQ ID NO: 7570301 - DNA, 22 bp, Homo sapiens
agagagggcatagaaaaaggga

SEQ ID NO: 7570302 - DNA, 22 bp, Homo sapiens
agagaggtctcaggagaaacca

SEQ ID NO: 7570303 - DNA, 22 bp, Homo sapiens
agagagggcatagaaaaaggga

SEQ ID NO: 7570304 - DNA, 22 bp, Homo sapiens
agagagggcatagaaaaaggga

SEQ ID NO: 7570305 - DNA, 22 bp, Homo sapiens
agagagggcatagaaaaaggga

SEQ ID NO: 7570306 - DNA, 22 bp, Homo sapiens
agagaggtctcaggagaaacca

SEQ ID NO: 7570307 - DNA, 22 bp, Homo sapiens
agagaggtctcaggagaaacca

SEQ ID NO: 7570308 - DNA, 22 bp, Homo sapiens
agagaggttaaggagctcttgt

SEQ ID NO: 7570309 - DNA, 22 bp, Homo sapiens
agagaggttaaggagctcttgt

SEQ ID NO: 7570310 - DNA, 22 bp, Homo sapiens
agagaggttggctaggatgttt

SEQ ID NO: 7570311 - DNA, 22 bp, Homo sapiens
agagaggttggctaggatgttt

SEQ ID NO: 7570312 - DNA, 22 bp, Homo sapiens
agagaggttggctaggatgttt

SEQ ID NO: 7570313 - DNA, 22 bp, Homo sapiens
agagaggcgagttacctgtgct

SEQ ID NO: 7570314 - DNA, 22 bp, Homo sapiens
agagaggcgagttacctgtgct

SEQ ID NO: 7570315 - DNA, 22 bp, Homo sapiens
agagaggcgagttacctgtgct

SEQ ID NO: 7570316 - DNA, 22 bp, Homo sapiens
agagaggcgagttacctgtgct

SEQ ID NO: 7570317 - DNA, 22 bp, Homo sapiens
agagaggcgagttacctgtgct

SEQ ID NO: 7570318 - DNA, 22 bp, Homo sapiens
agagaggctgctggactatatg

SEQ ID NO: 7570319 - DNA, 22 bp, Homo sapiens
agagaggctgctggactatatg

SEQ ID NO: 7570320 - DNA, 22 bp, Homo sapiens
agagaggcgagttacctgtgct

SEQ ID NO: 7570321 - DNA, 22 bp, Homo sapiens
agagaggctgctggactatatg

SEQ ID NO: 7570322 - DNA, 22 bp, Homo sapiens
agagaggcgagttacctgtgct

SEQ ID NO: 7570323 - DNA, 22 bp, Homo sapiens
agagaggatttgtttttctcct

SEQ ID NO: 7570324 - DNA, 22 bp, Homo sapiens
agagaggatttgtttttctcct

SEQ ID NO: 7570325 - DNA, 22 bp, Homo sapiens
agagaggatttgtttttctcct

SEQ ID NO: 7570326 - DNA, 22 bp, Homo sapiens
agagaggcattcggtgatccca

SEQ ID NO: 7570327 - DNA, 22 bp, Homo sapiens
agagaggcattcggtgatccca

SEQ ID NO: 7570328 - DNA, 22 bp, Homo sapiens
agagaggcattcggtgatccca

SEQ ID NO: 7570329 - DNA, 22 bp, Homo sapiens
agagaggatttgtttttctcct

SEQ ID NO: 7570330 - DNA, 22 bp, Homo sapiens
agagaggatttgtttttctcct

SEQ ID NO: 7570331 - DNA, 22 bp, Homo sapiens
agagaggatttgtttttctcct

SEQ ID NO: 7570332 - DNA, 22 bp, Homo sapiens
agagagcttccattctagtgat

SEQ ID NO: 7570333 - DNA, 22 bp, Homo sapiens
agagagcttccattctagtgat

SEQ ID NO: 7570334 - DNA, 22 bp, Homo sapiens
agagagcccgggccagggcaca

SEQ ID NO: 7570335 - DNA, 22 bp, Homo sapiens
agagagcctgagtggcagctat

SEQ ID NO: 7570336 - DNA, 22 bp, Homo sapiens
agagagcctgagtggcagctat

SEQ ID NO: 7570337 - DNA, 22 bp, Homo sapiens
agagagcccgggccagggcaca

SEQ ID NO: 7570338 - DNA, 22 bp, Homo sapiens
agagagctctgatgggaggtga

SEQ ID NO: 7570339 - DNA, 22 bp, Homo sapiens
agagagctctgatgggaggtga

SEQ ID NO: 7570340 - DNA, 23 bp, Homo sapiens
agagagctcactatatagcattg

SEQ ID NO: 7570341 - DNA, 22 bp, Homo sapiens
agagagcctgagtggcagctat

SEQ ID NO: 7570342 - DNA, 22 bp, Homo sapiens
agagagctctggctgggtgacc

SEQ ID NO: 7570343 - DNA, 22 bp, Homo sapiens
agagagctctggctgggtgacc

SEQ ID NO: 7570344 - DNA, 23 bp, Homo sapiens
agagagctcactatatagcattg

SEQ ID NO: 7570345 - DNA, 22 bp, Homo sapiens
agagagctgtcctgggacaccc

SEQ ID NO: 7570346 - DNA, 22 bp, Homo sapiens
agagagctgtcctgggacaccc

SEQ ID NO: 7570347 - DNA, 22 bp, Homo sapiens
agagagctgactttggagtcag

SEQ ID NO: 7570348 - DNA, 22 bp, Homo sapiens
agagaaggtcactaaggaccca

SEQ ID NO: 7570349 - DNA, 22 bp, Homo sapiens
agagaaggtcactaaggaccca

SEQ ID NO: 7570350 - DNA, 22 bp, Homo sapiens
agagaaggtcactaaggaccca

SEQ ID NO: 7570351 - DNA, 22 bp, Homo sapiens
agagaaggtcactaaggaccca

SEQ ID NO: 7570352 - DNA, 22 bp, Homo sapiens
agagaaggtcactaaggaccca

SEQ ID NO: 7570353 - DNA, 22 bp, Homo sapiens
agagaaggtcactaaggaccca

SEQ ID NO: 7570354 - DNA, 22 bp, Homo sapiens
agagaagggtgtagcctgggcc

SEQ ID NO: 7570355 - DNA, 22 bp, Homo sapiens
agagaaggtcactaaggaccca

SEQ ID NO: 7570356 - DNA, 22 bp, Homo sapiens
agagaagggtgtagcctgggcc

SEQ ID NO: 7570357 - DNA, 22 bp, Homo sapiens
agagaagggtgtagcctgggcc

SEQ ID NO: 7570358 - DNA, 22 bp, Homo sapiens
agagaagggtgtagcctgggcc

SEQ ID NO: 7570359 - DNA, 22 bp, Homo sapiens
agagaagggtgtagcctgggcc

SEQ ID NO: 7570360 - DNA, 22 bp, Homo sapiens
agagaagggtgtagcctgggcc

SEQ ID NO: 7570361 - DNA, 22 bp, Homo sapiens
agagaagggtgtagcctgggcc

SEQ ID NO: 7570362 - DNA, 22 bp, Homo sapiens
agagaagggtgtagcctgggcc

SEQ ID NO: 7570363 - DNA, 22 bp, Homo sapiens
agagaagggtgtagcctgggcc

SEQ ID NO: 7570364 - DNA, 22 bp, Homo sapiens
agagaatacaaagaagatatgt

SEQ ID NO: 7570365 - DNA, 22 bp, Homo sapiens
agagaatacaaagaagatatgt

SEQ ID NO: 7570366 - DNA, 22 bp, Homo sapiens
agagaatacaaagaagatatgt

SEQ ID NO: 7570367 - DNA, 22 bp, Homo sapiens
agagaatacaaagaagatatgt

SEQ ID NO: 7570368 - DNA, 22 bp, Homo sapiens
agagaatacaaagaagatatgt

SEQ ID NO: 7570369 - DNA, 22 bp, Homo sapiens
agagaatacaaagaagatatgt

SEQ ID NO: 7570370 - DNA, 22 bp, Homo sapiens
agagaatacaaagaagatatgt

SEQ ID NO: 7570371 - DNA, 22 bp, Homo sapiens
agagaatacaaagaagatatgt

SEQ ID NO: 7570372 - DNA, 22 bp, Homo sapiens
agagaagtgagcttgttcactc

SEQ ID NO: 7570373 - DNA, 22 bp, Homo sapiens
agagaatcctctacatgttttt

SEQ ID NO: 7570374 - DNA, 22 bp, Homo sapiens
agagaatcctctacatgttttt

SEQ ID NO: 7570375 - DNA, 22 bp, Homo sapiens
agagaatctagaatgtttatac

SEQ ID NO: 7570376 - DNA, 22 bp, Homo sapiens
agagaatctagaatgtttatac

SEQ ID NO: 7570377 - DNA, 22 bp, Homo sapiens
agagaatgcagggcttcggaca

SEQ ID NO: 7570378 - DNA, 22 bp, Homo sapiens
agagaatctgggaagatgttaa

SEQ ID NO: 7570379 - DNA, 22 bp, Homo sapiens
agagaatctgggaagatgttaa

SEQ ID NO: 7570380 - DNA, 22 bp, Homo sapiens
agagaatccccagacagagtta

SEQ ID NO: 7570381 - DNA, 22 bp, Homo sapiens
agagaatccccagacagagtta

SEQ ID NO: 7570382 - DNA, 23 bp, Homo sapiens
agagaatcatggaaactctttct

SEQ ID NO: 7570383 - DNA, 22 bp, Homo sapiens
agagaatacagggtaacaggaa

SEQ ID NO: 7570384 - DNA, 22 bp, Homo sapiens
agagaatacagggtaacaggaa

SEQ ID NO: 7570385 - DNA, 19 bp, Homo sapiens
agacttttgtaagttgaga

SEQ ID NO: 7570386 - DNA, 23 bp, Homo sapiens
agagaaaaatatctgggcacatt

SEQ ID NO: 7570387 - DNA, 23 bp, Homo sapiens
agagaaaaatatctgggcacatt

SEQ ID NO: 7570388 - DNA, 23 bp, Homo sapiens
agagaaaaatatctgggcacatt

SEQ ID NO: 7570389 - DNA, 23 bp, Homo sapiens
agagaaaaatatctgggcacatt

SEQ ID NO: 7570390 - DNA, 23 bp, Homo sapiens
agagaaaaatatctgggcacatt

SEQ ID NO: 7570391 - DNA, 19 bp, Homo sapiens
agacttttgtaagttgaga

SEQ ID NO: 7570392 - DNA, 19 bp, Homo sapiens
agacttttgtaagttgaga

SEQ ID NO: 7570393 - DNA, 19 bp, Homo sapiens
agacttttgtaagttgaga

SEQ ID NO: 7570394 - DNA, 22 bp, Homo sapiens
agagaaaactcattgaggtgtc

SEQ ID NO: 7570395 - DNA, 22 bp, Homo sapiens
agagaaaactcattgaggtgtc

SEQ ID NO: 7570396 - DNA, 22 bp, Homo sapiens
agagaaaactcattgaggtgtc

SEQ ID NO: 7570397 - DNA, 22 bp, Homo sapiens
agagaaaagagttcaggctttg

SEQ ID NO: 7570398 - DNA, 22 bp, Homo sapiens
agagaaaactcattgaggtgtc

SEQ ID NO: 7570399 - DNA, 22 bp, Homo sapiens
agagaaaactcattgaggtgtc

SEQ ID NO: 7570400 - DNA, 23 bp, Homo sapiens
agagaaaaatatctgggcacatt

SEQ ID NO: 7570401 - DNA, 23 bp, Homo sapiens
agagaaaaatatctgggcacatt

SEQ ID NO: 7570402 - DNA, 23 bp, Homo sapiens
agagaaaaatatctgggcacatt

SEQ ID NO: 7570403 - DNA, 22 bp, Homo sapiens
agagaaaactcattgaggtgtc

SEQ ID NO: 7570404 - DNA, 22 bp, Homo sapiens
agagaaaactcattgaggtgtc

SEQ ID NO: 7570405 - DNA, 22 bp, Homo sapiens
agagaagggtgtagcctgggcc

SEQ ID NO: 7570406 - DNA, 22 bp, Homo sapiens
agagaagggtgtagcctgggcc

SEQ ID NO: 7570407 - DNA, 22 bp, Homo sapiens
agagaagggtgtagcctgggcc

SEQ ID NO: 7570408 - DNA, 22 bp, Homo sapiens
agagaagggtagcccattctcc

SEQ ID NO: 7570409 - DNA, 22 bp, Homo sapiens
agagaagggtagcccattctcc

SEQ ID NO: 7570410 - DNA, 22 bp, Homo sapiens
agagaagggtagcccattctcc

SEQ ID NO: 7570411 - DNA, 19 bp, Homo sapiens
agagaaggatcctatggtt

SEQ ID NO: 7570412 - DNA, 19 bp, Homo sapiens
agagaaggatcctatggtt

SEQ ID NO: 7570413 - DNA, 19 bp, Homo sapiens
agagaaggatcctatggtt

SEQ ID NO: 7570414 - DNA, 22 bp, Homo sapiens
agagaaaagagttcaggctttg

SEQ ID NO: 7570415 - DNA, 22 bp, Homo sapiens
agagaaaagagttcaggctttg

SEQ ID NO: 7570416 - DNA, 22 bp, Homo sapiens
agagaaaagagttcaggctttg

SEQ ID NO: 7570417 - DNA, 22 bp, Homo sapiens
agagaaaagagttcaggctttg

SEQ ID NO: 7570418 - DNA, 22 bp, Homo sapiens
agagaaaactcattgaggtgtc

SEQ ID NO: 7570419 - DNA, 22 bp, Homo sapiens
agagaaaagagttcaggctttg

SEQ ID NO: 7570420 - DNA, 22 bp, Homo sapiens
agagaaaagagttcaggctttg

SEQ ID NO: 7570421 - DNA, 22 bp, Homo sapiens
agagaaaagagttcaggctttg

SEQ ID NO: 7570422 - DNA, 22 bp, Homo sapiens
agagaaggaaagctgacatggg

SEQ ID NO: 7570423 - DNA, 19 bp, Homo sapiens
agagaaggatcctatggtt

SEQ ID NO: 7570424 - DNA, 19 bp, Homo sapiens
agagaaggatcctatggtt

SEQ ID NO: 7570425 - DNA, 19 bp, Homo sapiens
agagaaggatcctatggtt

SEQ ID NO: 7570426 - DNA, 23 bp, Homo sapiens
agacttctccaacaagcttggct

SEQ ID NO: 7570427 - DNA, 23 bp, Homo sapiens
agacttctccaacaagcttggct

SEQ ID NO: 7570428 - DNA, 22 bp, Homo sapiens
agacttctctaacttgaggacc

SEQ ID NO: 7570429 - DNA, 22 bp, Homo sapiens
agacttctctaacttgaggacc

SEQ ID NO: 7570430 - DNA, 22 bp, Homo sapiens
agacttctctccttgacttgca

SEQ ID NO: 7570431 - DNA, 22 bp, Homo sapiens
agacttctaaatagcagcttct

SEQ ID NO: 7570432 - DNA, 21 bp, Homo sapiens
agacttctagaagtgagatag

SEQ ID NO: 7570433 - DNA, 22 bp, Homo sapiens
agacttctataaatttgggaat

SEQ ID NO: 7570434 - DNA, 22 bp, Homo sapiens
agacttctaaatagcagcttct

SEQ ID NO: 7570435 - DNA, 21 bp, Homo sapiens
agacttctagaagtgagatag

SEQ ID NO: 7570436 - DNA, 22 bp, Homo sapiens
agacttcactcccagagattct

SEQ ID NO: 7570437 - DNA, 22 bp, Homo sapiens
agacttcactcccagagattct

SEQ ID NO: 7570438 - DNA, 22 bp, Homo sapiens
agacttagtgagttctaagttt

SEQ ID NO: 7570439 - DNA, 22 bp, Homo sapiens
agacttcacctacagcagtctc

SEQ ID NO: 7570440 - DNA, 22 bp, Homo sapiens
agacttcaaagcctttgttcat

SEQ ID NO: 7570441 - DNA, 22 bp, Homo sapiens
agacttatgcttcaaatagtaa

SEQ ID NO: 7570442 - DNA, 21 bp, Homo sapiens
agactgtggattttgacatgt

SEQ ID NO: 7570443 - DNA, 22 bp, Homo sapiens
agactgtgagggagatacaggg

SEQ ID NO: 7570444 - DNA, 22 bp, Homo sapiens
agactgtttgggttccaaatct

SEQ ID NO: 7570445 - DNA, 22 bp, Homo sapiens
agacttaaggcatttccaagaa

SEQ ID NO: 7570446 - DNA, 22 bp, Homo sapiens
agacttaatagaagcatgacat

SEQ ID NO: 7570447 - DNA, 22 bp, Homo sapiens
agactgtagggatagaggtctt

SEQ ID NO: 7570448 - DNA, 22 bp, Homo sapiens
agactgtgagaagatggctgcg

SEQ ID NO: 7570449 - DNA, 22 bp, Homo sapiens
agactgtgagaagatggctgcg

SEQ ID NO: 7570450 - DNA, 22 bp, Homo sapiens
agactgtaattgacatgtcagc

SEQ ID NO: 7570451 - DNA, 22 bp, Homo sapiens
agactgtactttctgcagctct

SEQ ID NO: 7570452 - DNA, 22 bp, Homo sapiens
agactgtactttctgcagctct

SEQ ID NO: 7570453 - DNA, 22 bp, Homo sapiens
agactgtagggatagaggtctt

SEQ ID NO: 7570454 - DNA, 19 bp, Homo sapiens
agacttgtcaaattatagt

SEQ ID NO: 7570455 - DNA, 19 bp, Homo sapiens
agacttgtcaaattatagt

SEQ ID NO: 7570456 - DNA, 22 bp, Homo sapiens
agactttaacaatgggtatgaa

SEQ ID NO: 7570457 - DNA, 22 bp, Homo sapiens
agactttaatgtgcaaatgaaa

SEQ ID NO: 7570458 - DNA, 22 bp, Homo sapiens
agactttaatgtgcaaatgaaa

SEQ ID NO: 7570459 - DNA, 22 bp, Homo sapiens
agactttaatgtgcaaatgaaa

SEQ ID NO: 7570460 - DNA, 22 bp, Homo sapiens
agactttaatgtgcaaatgaaa

SEQ ID NO: 7570461 - DNA, 22 bp, Homo sapiens
agactttaatgtgcaaatgaaa

SEQ ID NO: 7570462 - DNA, 22 bp, Homo sapiens
agactttaatgtgcaaatgaaa

SEQ ID NO: 7570463 - DNA, 22 bp, Homo sapiens
agactttagaatcagatagcct

SEQ ID NO: 7570464 - DNA, 22 bp, Homo sapiens
agacttgatgttaaaagaaact

SEQ ID NO: 7570465 - DNA, 22 bp, Homo sapiens
agacttcttgagctggcacttc

SEQ ID NO: 7570466 - DNA, 22 bp, Homo sapiens
agacttcttgagctggcacttc

SEQ ID NO: 7570467 - DNA, 22 bp, Homo sapiens
agacttctctccttgacttgca

SEQ ID NO: 7570468 - DNA, 22 bp, Homo sapiens
agacttctcttggctatattat

SEQ ID NO: 7570469 - DNA, 22 bp, Homo sapiens
agactttcatctcttctgggca

SEQ ID NO: 7570470 - DNA, 22 bp, Homo sapiens
agactttcgtgttatgttgcct

SEQ ID NO: 7570471 - DNA, 21 bp, Homo sapiens
agactttgcttgcagagagtc

SEQ ID NO: 7570472 - DNA, 18 bp, Homo sapiens
agactttgagttagaggg

SEQ ID NO: 7570473 - DNA, 22 bp, Homo sapiens
agactttcttgacctagttaat

SEQ ID NO: 7570474 - DNA, 22 bp, Homo sapiens
agactttcttgacctagttaat

SEQ ID NO: 7570475 - DNA, 22 bp, Homo sapiens
agactttcttgacctagttaat

SEQ ID NO: 7570476 - DNA, 22 bp, Homo sapiens
agactttataaatcttaatttc

SEQ ID NO: 7570477 - DNA, 22 bp, Homo sapiens
agactttataaatcttaatttc

SEQ ID NO: 7570478 - DNA, 22 bp, Homo sapiens
agactttataaatcttaatttc

SEQ ID NO: 7570479 - DNA, 22 bp, Homo sapiens
agactttagggccatggtaggt

SEQ ID NO: 7570480 - DNA, 22 bp, Homo sapiens
agactttagaatcagatagcct

SEQ ID NO: 7570481 - DNA, 22 bp, Homo sapiens
agactttagaatcagatagcct

SEQ ID NO: 7570482 - DNA, 22 bp, Homo sapiens
agactttagaatcagatagcct

SEQ ID NO: 7570483 - DNA, 22 bp, Homo sapiens
agagagttgaggaagcaacact

SEQ ID NO: 7570484 - DNA, 22 bp, Homo sapiens
agagagttctttctagttgaag

SEQ ID NO: 7570485 - DNA, 22 bp, Homo sapiens
agagagttctttctagttgaag

SEQ ID NO: 7570486 - DNA, 22 bp, Homo sapiens
agagaggtttgctggaagattc

SEQ ID NO: 7570487 - DNA, 22 bp, Homo sapiens
agagaggtttgctggaagattc

SEQ ID NO: 7570488 - DNA, 22 bp, Homo sapiens
agagaggtttgctggaagattc

SEQ ID NO: 7570489 - DNA, 22 bp, Homo sapiens
agagaggtttgctggaagattc

SEQ ID NO: 7570490 - DNA, 22 bp, Homo sapiens
agagagtctttctcttcctgtt

SEQ ID NO: 7570491 - DNA, 22 bp, Homo sapiens
agagagtctttctcttcctgtt

SEQ ID NO: 7570492 - DNA, 22 bp, Homo sapiens
agagagtctttctcttcctgtt

SEQ ID NO: 7570493 - DNA, 22 bp, Homo sapiens
agagaggtttgctggaagattc

SEQ ID NO: 7570494 - DNA, 22 bp, Homo sapiens
agagaggtttgctggaagattc

SEQ ID NO: 7570495 - DNA, 22 bp, Homo sapiens
agagcacaggctctggagtcta

SEQ ID NO: 7570496 - DNA, 22 bp, Homo sapiens
agagcacaggctctggagtcta

SEQ ID NO: 7570497 - DNA, 22 bp, Homo sapiens
agagcacaggctcaccattgtt

SEQ ID NO: 7570498 - DNA, 22 bp, Homo sapiens
agagcacaggctctggagtcta

SEQ ID NO: 7570499 - DNA, 22 bp, Homo sapiens
agagagttctttctagttgaag

SEQ ID NO: 7570500 - DNA, 22 bp, Homo sapiens
agagcacaggctcaccattgtt

SEQ ID NO: 7570501 - DNA, 22 bp, Homo sapiens
agagatttacacatgccttttc

SEQ ID NO: 7570502 - DNA, 21 bp, Homo sapiens
agagcacaggtggacaatgct

SEQ ID NO: 7570503 - DNA, 21 bp, Homo sapiens
agagcacaggtggacaatgct

SEQ ID NO: 7570504 - DNA, 22 bp, Homo sapiens
agagcacaggtgctggagccca

SEQ ID NO: 7570505 - DNA, 22 bp, Homo sapiens
agagcacaggtgctggagccca

SEQ ID NO: 7570506 - DNA, 22 bp, Homo sapiens
agagcacagggttttgtgccgg

SEQ ID NO: 7570507 - DNA, 22 bp, Homo sapiens
agagcacagggttttgtgccgg

SEQ ID NO: 7570508 - DNA, 22 bp, Homo sapiens
agagcacagggttttgtgccgg

SEQ ID NO: 7570509 - DNA, 22 bp, Homo sapiens
agagcacagtgcaggatccccg

SEQ ID NO: 7570510 - DNA, 22 bp, Homo sapiens
agagcacagtatctgcacatca

SEQ ID NO: 7570511 - DNA, 22 bp, Homo sapiens
agagcacagtatctgcacatca

SEQ ID NO: 7570512 - DNA, 22 bp, Homo sapiens
agagcacagtatctgcacatca

SEQ ID NO: 7570513 - DNA, 22 bp, Homo sapiens
agagcacagtatctgcacatca

SEQ ID NO: 7570514 - DNA, 22 bp, Homo sapiens
agagcacagtatctgcacatca

SEQ ID NO: 7570515 - DNA, 22 bp, Homo sapiens
agagcacagtatctgcacatca

SEQ ID NO: 7570516 - DNA, 22 bp, Homo sapiens
agagcacagtatctgcacatca

SEQ ID NO: 7570517 - DNA, 21 bp, Homo sapiens
agagcacaggtggacaatgct

SEQ ID NO: 7570518 - DNA, 21 bp, Homo sapiens
agagcacaggtggacaatgct

SEQ ID NO: 7570519 - DNA, 21 bp, Homo sapiens
agagcacaggtggacaatgct

SEQ ID NO: 7570520 - DNA, 22 bp, Homo sapiens
agagcagagggctctgggacaa

SEQ ID NO: 7570521 - DNA, 22 bp, Homo sapiens
agagcagagggctctgggacaa

SEQ ID NO: 7570522 - DNA, 22 bp, Homo sapiens
agagcagagggctctgggacaa

SEQ ID NO: 7570523 - DNA, 22 bp, Homo sapiens
agagcagagggctctgggacaa

SEQ ID NO: 7570524 - DNA, 22 bp, Homo sapiens
agagcagaggcatggccgtggg

SEQ ID NO: 7570525 - DNA, 22 bp, Homo sapiens
agagcagaggcatggccgtggg

SEQ ID NO: 7570526 - DNA, 22 bp, Homo sapiens
agagcagaggcatggccgtggg

SEQ ID NO: 7570527 - DNA, 22 bp, Homo sapiens
agagcagagggctctgggacaa

SEQ ID NO: 7570528 - DNA, 22 bp, Homo sapiens
agagcagagggctctgggacaa

SEQ ID NO: 7570529 - DNA, 22 bp, Homo sapiens
agagcagagggctctgggacaa

SEQ ID NO: 7570530 - DNA, 22 bp, Homo sapiens
agagcagagggctctgggacaa

SEQ ID NO: 7570531 - DNA, 22 bp, Homo sapiens
agagcagagggctctgggacaa

SEQ ID NO: 7570532 - DNA, 22 bp, Homo sapiens
agagcagagggctctgggacaa

SEQ ID NO: 7570533 - DNA, 22 bp, Homo sapiens
agagcagagtggctgtagcttg

SEQ ID NO: 7570534 - DNA, 22 bp, Homo sapiens
agagcagagtggctgtagcttg

SEQ ID NO: 7570535 - DNA, 22 bp, Homo sapiens
agagcagagtggctgtagcttg

SEQ ID NO: 7570536 - DNA, 22 bp, Homo sapiens
agagcagagtggctgtagcttg

SEQ ID NO: 7570537 - DNA, 22 bp, Homo sapiens
agagcagagtggctgtagcttg

SEQ ID NO: 7570538 - DNA, 22 bp, Homo sapiens
agagcagagggctctgggacaa

SEQ ID NO: 7570539 - DNA, 22 bp, Homo sapiens
agagcagagggctctgggacaa

SEQ ID NO: 7570540 - DNA, 22 bp, Homo sapiens
agagcagatggagctggaagag

SEQ ID NO: 7570541 - DNA, 22 bp, Homo sapiens
agagcagatggagctggaagag

SEQ ID NO: 7570542 - DNA, 22 bp, Homo sapiens
agagcagatggagctggaagag

SEQ ID NO: 7570543 - DNA, 22 bp, Homo sapiens
agagcagagtggctgtagcttg

SEQ ID NO: 7570544 - DNA, 22 bp, Homo sapiens
agagcagagtggctgtagcttg

SEQ ID NO: 7570545 - DNA, 22 bp, Homo sapiens
agagcagaggcatggccgtggg

SEQ ID NO: 7570546 - DNA, 22 bp, Homo sapiens
agagcagaggcatggccgtggg

SEQ ID NO: 7570547 - DNA, 22 bp, Homo sapiens
agagcagacatccttgtcttgt

SEQ ID NO: 7570548 - DNA, 22 bp, Homo sapiens
agagcagaggcatggccgtggg

SEQ ID NO: 7570549 - DNA, 22 bp, Homo sapiens
agagcagaggcatggccgtggg

SEQ ID NO: 7570550 - DNA, 22 bp, Homo sapiens
agagcagacatccttgtcttgt

SEQ ID NO: 7570551 - DNA, 22 bp, Homo sapiens
agagcactttcgagagccggag

SEQ ID NO: 7570552 - DNA, 22 bp, Homo sapiens
agagcagacatccttgtcttgt

SEQ ID NO: 7570553 - DNA, 22 bp, Homo sapiens
agagcagacatccttgtcttgt

SEQ ID NO: 7570554 - DNA, 22 bp, Homo sapiens
agagcagacatccttgtcttgt

SEQ ID NO: 7570555 - DNA, 22 bp, Homo sapiens
agagcactgctgatttacagtc

SEQ ID NO: 7570556 - DNA, 22 bp, Homo sapiens
agagcactttcgagagccggag

SEQ ID NO: 7570557 - DNA, 22 bp, Homo sapiens
agagcaccccgggaagagcaag

SEQ ID NO: 7570558 - DNA, 22 bp, Homo sapiens
agagcacatggttcctgtgtcc

SEQ ID NO: 7570559 - DNA, 22 bp, Homo sapiens
agagcaccaaggtggtttggac

SEQ ID NO: 7570560 - DNA, 22 bp, Homo sapiens
agagcacagtgcaggatccccg

SEQ ID NO: 7570561 - DNA, 22 bp, Homo sapiens
agagcactgagtgagcaaggcc

SEQ ID NO: 7570562 - DNA, 22 bp, Homo sapiens
agagcacggccaccatttacaa

SEQ ID NO: 7570563 - DNA, 22 bp, Homo sapiens
agagcactgagtgagcaaggcc

SEQ ID NO: 7570564 - DNA, 22 bp, Homo sapiens
agagcccctggtggagtgagaa

SEQ ID NO: 7570565 - DNA, 22 bp, Homo sapiens
agagcccctgggtcacacagcc

SEQ ID NO: 7570566 - DNA, 22 bp, Homo sapiens
agagcccctcggtggaggggtc

SEQ ID NO: 7570567 - DNA, 22 bp, Homo sapiens
agagcccatcagtggcagtgga

SEQ ID NO: 7570568 - DNA, 22 bp, Homo sapiens
agagcccctcggtggaggggtc

SEQ ID NO: 7570569 - DNA, 22 bp, Homo sapiens
agagcccctggtggagtgagaa

SEQ ID NO: 7570570 - DNA, 22 bp, Homo sapiens
agagcccctggtggagtgagaa

SEQ ID NO: 7570571 - DNA, 22 bp, Homo sapiens
agagcccctggtggagtgagaa

SEQ ID NO: 7570572 - DNA, 22 bp, Homo sapiens
agagcccctggtggagtgagaa

SEQ ID NO: 7570573 - DNA, 22 bp, Homo sapiens
agagcccctggtggagtgagaa

SEQ ID NO: 7570574 - DNA, 22 bp, Homo sapiens
agagcccagtgacatcagcaca

SEQ ID NO: 7570575 - DNA, 22 bp, Homo sapiens
agagcccagtgacatcagcaca

SEQ ID NO: 7570576 - DNA, 22 bp, Homo sapiens
agagcccagtctttgtgtgaag

SEQ ID NO: 7570577 - DNA, 22 bp, Homo sapiens
agagcccagtctttgtgtgaag

SEQ ID NO: 7570578 - DNA, 22 bp, Homo sapiens
agagcccatcagtggcagtgga

SEQ ID NO: 7570579 - DNA, 22 bp, Homo sapiens
agagcccatcagtggcagtgga

SEQ ID NO: 7570580 - DNA, 22 bp, Homo sapiens
agagcccatcagtggcagtgga

SEQ ID NO: 7570581 - DNA, 22 bp, Homo sapiens
agagcccatcagtggcagtgga

SEQ ID NO: 7570582 - DNA, 22 bp, Homo sapiens
agagcccatcagtggcagtgga

SEQ ID NO: 7570583 - DNA, 22 bp, Homo sapiens
agagcccatcagtggcagtgga

SEQ ID NO: 7570584 - DNA, 22 bp, Homo sapiens
agagccaggccaggccggggca

SEQ ID NO: 7570585 - DNA, 22 bp, Homo sapiens
agagccaggcggctgggcacct

SEQ ID NO: 7570586 - DNA, 22 bp, Homo sapiens
agagccaggccaggccggggca

SEQ ID NO: 7570587 - DNA, 22 bp, Homo sapiens
agagccaggccaggccggggca

SEQ ID NO: 7570588 - DNA, 22 bp, Homo sapiens
agagccaggccaggccggggca

SEQ ID NO: 7570589 - DNA, 22 bp, Homo sapiens
agagccaggccaggccggggca

SEQ ID NO: 7570590 - DNA, 22 bp, Homo sapiens
agagccaggccaggccggggca

SEQ ID NO: 7570591 - DNA, 22 bp, Homo sapiens
agagccaggcaggcaatgttga

SEQ ID NO: 7570592 - DNA, 20 bp, Homo sapiens
agagcccagatgtctgtatt

SEQ ID NO: 7570593 - DNA, 20 bp, Homo sapiens
agagcccagatgtctgtatt

SEQ ID NO: 7570594 - DNA, 20 bp, Homo sapiens
agagcccagatgtctgtatt

SEQ ID NO: 7570595 - DNA, 22 bp, Homo sapiens
agagcccagaaagtatgtcata

SEQ ID NO: 7570596 - DNA, 22 bp, Homo sapiens
agagccagttgttaagcactta

SEQ ID NO: 7570597 - DNA, 22 bp, Homo sapiens
agagcccagaaagtatgtcata

SEQ ID NO: 7570598 - DNA, 22 bp, Homo sapiens
agagcccaggtcctggagaggg

SEQ ID NO: 7570599 - DNA, 22 bp, Homo sapiens
agagcccaggtcctggagaggg

SEQ ID NO: 7570600 - DNA, 22 bp, Homo sapiens
agagcccaggtcctggagaggg

SEQ ID NO: 7570601 - DNA, 22 bp, Homo sapiens
agagcccaggcaggcatccagg

SEQ ID NO: 7570602 - DNA, 22 bp, Homo sapiens
agagcccaggcaggcatccagg

SEQ ID NO: 7570603 - DNA, 22 bp, Homo sapiens
agagcccaggcaggcatccagg

SEQ ID NO: 7570604 - DNA, 22 bp, Homo sapiens
agagcagatggccagggggcct

SEQ ID NO: 7570605 - DNA, 22 bp, Homo sapiens
agagcagatggccagggggcct

SEQ ID NO: 7570606 - DNA, 22 bp, Homo sapiens
agagcagatggccagggggcct

SEQ ID NO: 7570607 - DNA, 22 bp, Homo sapiens
agagcagatggccagggggcct

SEQ ID NO: 7570608 - DNA, 22 bp, Homo sapiens
agagcagatggagctggaagag

SEQ ID NO: 7570609 - DNA, 22 bp, Homo sapiens
agagcagatggagctggaagag

SEQ ID NO: 7570610 - DNA, 22 bp, Homo sapiens
agagcagatggagctggaagag

SEQ ID NO: 7570611 - DNA, 22 bp, Homo sapiens
agagcagatggagctggaagag

SEQ ID NO: 7570612 - DNA, 22 bp, Homo sapiens
agagcagatggagctggaagag

SEQ ID NO: 7570613 - DNA, 22 bp, Homo sapiens
agagcagatggagctggaagag

SEQ ID NO: 7570614 - DNA, 22 bp, Homo sapiens
agagcagatggagctggaagag

SEQ ID NO: 7570615 - DNA, 22 bp, Homo sapiens
agagcagatggagctggaagag

SEQ ID NO: 7570616 - DNA, 22 bp, Homo sapiens
agagcagatggagctggaagag

SEQ ID NO: 7570617 - DNA, 22 bp, Homo sapiens
agagcagatggagctggaagag

SEQ ID NO: 7570618 - DNA, 22 bp, Homo sapiens
agagcagatggagctggaagag

SEQ ID NO: 7570619 - DNA, 22 bp, Homo sapiens
agagcagatggagctggaagag

SEQ ID NO: 7570620 - DNA, 22 bp, Homo sapiens
agagcagatggagctggaagag

SEQ ID NO: 7570621 - DNA, 22 bp, Homo sapiens
agagcagatttcaaatattggc

SEQ ID NO: 7570622 - DNA, 22 bp, Homo sapiens
agagcagatttcaaatattggc

SEQ ID NO: 7570623 - DNA, 22 bp, Homo sapiens
agagcagcacgttgtccccaca

SEQ ID NO: 7570624 - DNA, 22 bp, Homo sapiens
agagcagatttcaaatattggc

SEQ ID NO: 7570625 - DNA, 22 bp, Homo sapiens
agagcagatggccagggggcct

SEQ ID NO: 7570626 - DNA, 22 bp, Homo sapiens
agagcagatggccagggggcct

SEQ ID NO: 7570627 - DNA, 22 bp, Homo sapiens
agagcagatggccagggggcct

SEQ ID NO: 7570628 - DNA, 22 bp, Homo sapiens
agagcagatttcaaatattggc

SEQ ID NO: 7570629 - DNA, 22 bp, Homo sapiens
agagcagatttcaaatattggc

SEQ ID NO: 7570630 - DNA, 22 bp, Homo sapiens
agagcagatggccagggggcct

SEQ ID NO: 7570631 - DNA, 20 bp, Homo sapiens
agagcagcagttggtgaggt

SEQ ID NO: 7570632 - DNA, 20 bp, Homo sapiens
agagcagcagttggtgaggt

SEQ ID NO: 7570633 - DNA, 20 bp, Homo sapiens
agagcagcagttggtgaggt

SEQ ID NO: 7570634 - DNA, 22 bp, Homo sapiens
agagcagcctcagctccctgtg

SEQ ID NO: 7570635 - DNA, 22 bp, Homo sapiens
agagcagcctcagctccctgtg

SEQ ID NO: 7570636 - DNA, 20 bp, Homo sapiens
agagcagcagttggtgaggt

SEQ ID NO: 7570637 - DNA, 22 bp, Homo sapiens
agagcagcacgttgtccccaca

SEQ ID NO: 7570638 - DNA, 20 bp, Homo sapiens
agagcagcagttggtgaggt

SEQ ID NO: 7570639 - DNA, 22 bp, Homo sapiens
agagcagcacgttgtccccaca

SEQ ID NO: 7570640 - DNA, 22 bp, Homo sapiens
agagctgaaaaagctgacccgg

SEQ ID NO: 7570641 - DNA, 22 bp, Homo sapiens
agagctctttgatttgcttctc

SEQ ID NO: 7570642 - DNA, 22 bp, Homo sapiens
agagctctttgatttgcttctc

SEQ ID NO: 7570643 - DNA, 22 bp, Homo sapiens
agagctctttgatttgcttctc

SEQ ID NO: 7570644 - DNA, 22 bp, Homo sapiens
agagctgaaaaagctgacccgg

SEQ ID NO: 7570645 - DNA, 22 bp, Homo sapiens
agagcctgcagctgtgaagaaa

SEQ ID NO: 7570646 - DNA, 22 bp, Homo sapiens
agagcctgcagctgtgaagaaa

SEQ ID NO: 7570647 - DNA, 22 bp, Homo sapiens
agagcctgaggtctaacagggg

SEQ ID NO: 7570648 - DNA, 22 bp, Homo sapiens
agagcctgaggccctgagaggg

SEQ ID NO: 7570649 - DNA, 22 bp, Homo sapiens
agagcctgaggccctgagaggg

SEQ ID NO: 7570650 - DNA, 22 bp, Homo sapiens
agagcctgaggccctgagaggg

SEQ ID NO: 7570651 - DNA, 22 bp, Homo sapiens
agagcctgaggccctgagaggg

SEQ ID NO: 7570652 - DNA, 22 bp, Homo sapiens
agagcctgagcctgatcttgaa

SEQ ID NO: 7570653 - DNA, 22 bp, Homo sapiens
agagcctgagcctgatcttgaa

SEQ ID NO: 7570654 - DNA, 22 bp, Homo sapiens
agagcctgagcctgaaagccct

SEQ ID NO: 7570655 - DNA, 22 bp, Homo sapiens
agagcctgagcctgaaagccct

SEQ ID NO: 7570656 - DNA, 22 bp, Homo sapiens
agagcctgaggccaggaaaatg

SEQ ID NO: 7570657 - DNA, 22 bp, Homo sapiens
agagcctgaggatgtcccagct

SEQ ID NO: 7570658 - DNA, 22 bp, Homo sapiens
agagcctgaggatgtcccagct

SEQ ID NO: 7570659 - DNA, 22 bp, Homo sapiens
agagcctgagcctgaaagccct

SEQ ID NO: 7570660 - DNA, 22 bp, Homo sapiens
agagcctgagcctgaaagccct

SEQ ID NO: 7570661 - DNA, 21 bp, Homo sapiens
agagcctgagatcttccagca

SEQ ID NO: 7570662 - DNA, 22 bp, Homo sapiens
agagcctgagaggataatgggg

SEQ ID NO: 7570663 - DNA, 22 bp, Homo sapiens
agagcctgagaggataatgggg

SEQ ID NO: 7570664 - DNA, 21 bp, Homo sapiens
agagcctgagatcttccagca

SEQ ID NO: 7570665 - DNA, 22 bp, Homo sapiens
agagccctgtggactgtcaagt

SEQ ID NO: 7570666 - DNA, 22 bp, Homo sapiens
agagcccttgccctcagtcacc

SEQ ID NO: 7570667 - DNA, 22 bp, Homo sapiens
agagccctgtggttctggtaag

SEQ ID NO: 7570668 - DNA, 22 bp, Homo sapiens
agagccctggagggcagtcccg

SEQ ID NO: 7570669 - DNA, 22 bp, Homo sapiens
agagccctgccaatggatgagg

SEQ ID NO: 7570670 - DNA, 22 bp, Homo sapiens
agagccctgcagttcttcagga

SEQ ID NO: 7570671 - DNA, 22 bp, Homo sapiens
agagccctgcagttcttcagga

SEQ ID NO: 7570672 - DNA, 22 bp, Homo sapiens
agagccctttctccaggcacct

SEQ ID NO: 7570673 - DNA, 22 bp, Homo sapiens
agagcccttgccctcagtcacc

SEQ ID NO: 7570674 - DNA, 22 bp, Homo sapiens
agagcccttgccctcagtcacc

SEQ ID NO: 7570675 - DNA, 22 bp, Homo sapiens
agagccctttctccaggcacct

SEQ ID NO: 7570676 - DNA, 22 bp, Homo sapiens
agagccctttctccaggcacct

SEQ ID NO: 7570677 - DNA, 22 bp, Homo sapiens
agagcctctgtcatggagagaa

SEQ ID NO: 7570678 - DNA, 23 bp, Homo sapiens
agagcctgaaagacttctggcac

SEQ ID NO: 7570679 - DNA, 22 bp, Homo sapiens
agagccctgaagcagagctaaa

SEQ ID NO: 7570680 - DNA, 22 bp, Homo sapiens
agagccctctgcaatgcctcag

SEQ ID NO: 7570681 - DNA, 22 bp, Homo sapiens
agagccctaaaccctgccttgg

SEQ ID NO: 7570682 - DNA, 22 bp, Homo sapiens
agagcccctggtggagtgagaa

SEQ ID NO: 7570683 - DNA, 22 bp, Homo sapiens
agagccctctcattggcttatt

SEQ ID NO: 7570684 - DNA, 22 bp, Homo sapiens
agagccctgacggggacagatg

SEQ ID NO: 7570685 - DNA, 22 bp, Homo sapiens
agagccctgacggggacagatg

SEQ ID NO: 7570686 - DNA, 22 bp, Homo sapiens
agagccctgagtcagttctgga

SEQ ID NO: 7570687 - DNA, 22 bp, Homo sapiens
agagccctgcagttcttcagga

SEQ ID NO: 7570688 - DNA, 22 bp, Homo sapiens
agagctggatggtcaagatggc

SEQ ID NO: 7570689 - DNA, 22 bp, Homo sapiens
agagctggcactgaccctcacc

SEQ ID NO: 7570690 - DNA, 22 bp, Homo sapiens
agagctggcactgaccctcacc

SEQ ID NO: 7570691 - DNA, 22 bp, Homo sapiens
agagctggcagcagcttctcct

SEQ ID NO: 7570692 - DNA, 22 bp, Homo sapiens
agagctggcagcagcttctcct

SEQ ID NO: 7570693 - DNA, 22 bp, Homo sapiens
agagctggcagcagcttctcct

SEQ ID NO: 7570694 - DNA, 22 bp, Homo sapiens
agagctggcagcagcttctcct

SEQ ID NO: 7570695 - DNA, 22 bp, Homo sapiens
agagctggcactgaccctcacc

SEQ ID NO: 7570696 - DNA, 22 bp, Homo sapiens
agagctggcagcagcttctcct

SEQ ID NO: 7570697 - DNA, 22 bp, Homo sapiens
agagctggcagcagcttctcct

SEQ ID NO: 7570698 - DNA, 22 bp, Homo sapiens
agagctggcagcagcttctcct

SEQ ID NO: 7570699 - DNA, 22 bp, Homo sapiens
agagctggcagcagcttctcct

SEQ ID NO: 7570700 - DNA, 22 bp, Homo sapiens
agagctggatggtcaagatggc

SEQ ID NO: 7570701 - DNA, 22 bp, Homo sapiens
agagctggatggtcaagatggc

SEQ ID NO: 7570702 - DNA, 22 bp, Homo sapiens
agagctggatggtcaagatggc

SEQ ID NO: 7570703 - DNA, 22 bp, Homo sapiens
agagctggatggtcaagatggc

SEQ ID NO: 7570704 - DNA, 22 bp, Homo sapiens
agagctggatggtcaagatggc

SEQ ID NO: 7570705 - DNA, 22 bp, Homo sapiens
agagctggatggtcaagatggc

SEQ ID NO: 7570706 - DNA, 22 bp, Homo sapiens
agagctggatggtcaagatggc

SEQ ID NO: 7570707 - DNA, 22 bp, Homo sapiens
agagctggatggtcaagatggc

SEQ ID NO: 7570708 - DNA, 22 bp, Homo sapiens
agagctggatggtcaagatggc

SEQ ID NO: 7570709 - DNA, 22 bp, Homo sapiens
agagctggatggtcaagatggc

SEQ ID NO: 7570710 - DNA, 22 bp, Homo sapiens
agagctggatggtcaagatggc

SEQ ID NO: 7570711 - DNA, 22 bp, Homo sapiens
agagctggatggtcaagatggc

SEQ ID NO: 7570712 - DNA, 22 bp, Homo sapiens
agagctggacgtctgagcccta

SEQ ID NO: 7570713 - DNA, 22 bp, Homo sapiens
agagctggacgtctgagcccta

SEQ ID NO: 7570714 - DNA, 22 bp, Homo sapiens
agagctggacgtctgagcccta

SEQ ID NO: 7570715 - DNA, 22 bp, Homo sapiens
agagctggacgtctgagcccta

SEQ ID NO: 7570716 - DNA, 22 bp, Homo sapiens
agagctggaatcagacctcagg

SEQ ID NO: 7570717 - DNA, 22 bp, Homo sapiens
agagctgaaaaagctgacccgg

SEQ ID NO: 7570718 - DNA, 22 bp, Homo sapiens
agagctggaatcagacctcagg

SEQ ID NO: 7570719 - DNA, 22 bp, Homo sapiens
agagctggagcagccccactgg

SEQ ID NO: 7570720 - DNA, 22 bp, Homo sapiens
agagctggagatgcaggtttcg

SEQ ID NO: 7570721 - DNA, 22 bp, Homo sapiens
agagctggagcagccccactgg

SEQ ID NO: 7570722 - DNA, 22 bp, Homo sapiens
agagctggagcagccccactgg

SEQ ID NO: 7570723 - DNA, 22 bp, Homo sapiens
agagctggagcagccccactgg

SEQ ID NO: 7570724 - DNA, 22 bp, Homo sapiens
agagctggagatgcaggtttcg

SEQ ID NO: 7570725 - DNA, 22 bp, Homo sapiens
agagctggagatgcaggtttcg

SEQ ID NO: 7570726 - DNA, 22 bp, Homo sapiens
agagctggagatgcaggtttcg

SEQ ID NO: 7570727 - DNA, 22 bp, Homo sapiens
agagctggagatgcaggtttcg

SEQ ID NO: 7570728 - DNA, 21 bp, Homo sapiens
agagctggcctgccaggccct

SEQ ID NO: 7570729 - DNA, 21 bp, Homo sapiens
agagctggcctgccaggccct

SEQ ID NO: 7570730 - DNA, 21 bp, Homo sapiens
agagctggcctgccaggccct

SEQ ID NO: 7570731 - DNA, 21 bp, Homo sapiens
agagctggcctgccaggccct

SEQ ID NO: 7570732 - DNA, 21 bp, Homo sapiens
agagctggcctgccaggccct

SEQ ID NO: 7570733 - DNA, 21 bp, Homo sapiens
agagctggcctgccaggccct

SEQ ID NO: 7570734 - DNA, 22 bp, Homo sapiens
agagctggctgctgcggtgctt

SEQ ID NO: 7570735 - DNA, 22 bp, Homo sapiens
agagctggctgctgcggtgctt

SEQ ID NO: 7570736 - DNA, 22 bp, Homo sapiens
agagctggctgctgcggtgctt

SEQ ID NO: 7570737 - DNA, 22 bp, Homo sapiens
agagctggctgctgcggtgctt

SEQ ID NO: 7570738 - DNA, 22 bp, Homo sapiens
agagctggctgctgcggtgctt

SEQ ID NO: 7570739 - DNA, 21 bp, Homo sapiens
agagctggcctgccaggccct

SEQ ID NO: 7570740 - DNA, 21 bp, Homo sapiens
agagctggcctgccaggccct

SEQ ID NO: 7570741 - DNA, 22 bp, Homo sapiens
agagctggccagggatcactct

SEQ ID NO: 7570742 - DNA, 22 bp, Homo sapiens
agagctggccagggatcactct

SEQ ID NO: 7570743 - DNA, 22 bp, Homo sapiens
agagctggccagggatcactct

SEQ ID NO: 7570744 - DNA, 22 bp, Homo sapiens
agagctggccagggatcactct

SEQ ID NO: 7570745 - DNA, 22 bp, Homo sapiens
agagctggccagggatcactct

SEQ ID NO: 7570746 - DNA, 22 bp, Homo sapiens
agagctggccagggatcactct

SEQ ID NO: 7570747 - DNA, 22 bp, Homo sapiens
agagctggctggtagccctgat

SEQ ID NO: 7570748 - DNA, 22 bp, Homo sapiens
agagctggctggtagccctgat

SEQ ID NO: 7570749 - DNA, 22 bp, Homo sapiens
agagctggctggtagccctgat

SEQ ID NO: 7570750 - DNA, 22 bp, Homo sapiens
agagctggctggtagccctgat

SEQ ID NO: 7570751 - DNA, 22 bp, Homo sapiens
agagctggctggtagccctgat

SEQ ID NO: 7570752 - DNA, 22 bp, Homo sapiens
agagctggctggtagccctgat

SEQ ID NO: 7570753 - DNA, 22 bp, Homo sapiens
agagctggctgctgcggtgctt

SEQ ID NO: 7570754 - DNA, 22 bp, Homo sapiens
agagctggctgctgcggtgctt

SEQ ID NO: 7570755 - DNA, 22 bp, Homo sapiens
agagctggctgctgcggtgctt

SEQ ID NO: 7570756 - DNA, 22 bp, Homo sapiens
agagctggctgtgggtgacttt

SEQ ID NO: 7570757 - DNA, 22 bp, Homo sapiens
agagctggctgtgggtgacttt

SEQ ID NO: 7570758 - DNA, 22 bp, Homo sapiens
agagctggctgtgggtgacttt

SEQ ID NO: 7570759 - DNA, 22 bp, Homo sapiens
agagctggctgtgggtgacttt

SEQ ID NO: 7570760 - DNA, 22 bp, Homo sapiens
agagctggctgtgggtgacttt

SEQ ID NO: 7570761 - DNA, 22 bp, Homo sapiens
agagctggctggtagccctgat

SEQ ID NO: 7570762 - DNA, 22 bp, Homo sapiens
agccagcacggcgccatggagt

SEQ ID NO: 7570763 - DNA, 19 bp, Homo sapiens
agccagcagcgtagcatct

SEQ ID NO: 7570764 - DNA, 22 bp, Homo sapiens
agccagcacggcgccatggagt

SEQ ID NO: 7570765 - DNA, 22 bp, Homo sapiens
agccagcacggcgccatggagt

SEQ ID NO: 7570766 - DNA, 22 bp, Homo sapiens
agccagcacggatttcccagga

SEQ ID NO: 7570767 - DNA, 23 bp, Homo sapiens
agccagatttctttgcagggcag

SEQ ID NO: 7570768 - DNA, 22 bp, Homo sapiens
agccagatgtgagaaagaacac

SEQ ID NO: 7570769 - DNA, 21 bp, Homo sapiens
agccagcaacacagcatctcc

SEQ ID NO: 7570770 - DNA, 21 bp, Homo sapiens
agccagcaacacagcatctcc

SEQ ID NO: 7570771 - DNA, 22 bp, Homo sapiens
agccagatgaagaggtccttaa

SEQ ID NO: 7570772 - DNA, 22 bp, Homo sapiens
agccagatgaagaggtccttaa

SEQ ID NO: 7570773 - DNA, 21 bp, Homo sapiens
agccagatccattttgcatgg

SEQ ID NO: 7570774 - DNA, 22 bp, Homo sapiens
agccagcacggatttcccagga

SEQ ID NO: 7570775 - DNA, 22 bp, Homo sapiens
agccagcacggatttcccagga

SEQ ID NO: 7570776 - DNA, 22 bp, Homo sapiens
agccagcacggatttcccagga

SEQ ID NO: 7570777 - DNA, 22 bp, Homo sapiens
agccagagttgaatgtgagtct

SEQ ID NO: 7570778 - DNA, 22 bp, Homo sapiens
agccagataaaagcatttaaag

SEQ ID NO: 7570779 - DNA, 21 bp, Homo sapiens
agccagatccattttgcatgg

SEQ ID NO: 7570780 - DNA, 22 bp, Homo sapiens
agccagatccaggagacagctc

SEQ ID NO: 7570781 - DNA, 22 bp, Homo sapiens
agccagatccaggagacagctc

SEQ ID NO: 7570782 - DNA, 19 bp, Homo sapiens
agccagagtggcccagggg

SEQ ID NO: 7570783 - DNA, 19 bp, Homo sapiens
agccagagtggcccagggg

SEQ ID NO: 7570784 - DNA, 19 bp, Homo sapiens
agccagagtggcccagggg

SEQ ID NO: 7570785 - DNA, 22 bp, Homo sapiens
cactttctgtgttgtgcaaaaa

SEQ ID NO: 7570786 - DNA, 22 bp, Homo sapiens
cactttctgtgttgtgcaaaaa

SEQ ID NO: 7570787 - DNA, 22 bp, Homo sapiens
cactttctgtgttgtgcaaaaa

SEQ ID NO: 7570788 - DNA, 22 bp, Homo sapiens
agccagagagtgttggagatgt

SEQ ID NO: 7570789 - DNA, 19 bp, Homo sapiens
agccagagtggcccagggg

SEQ ID NO: 7570790 - DNA, 22 bp, Homo sapiens
agccagagatccatccctagga

SEQ ID NO: 7570791 - DNA, 22 bp, Homo sapiens
agccagagatccatccctagga

SEQ ID NO: 7570792 - DNA, 22 bp, Homo sapiens
agccagagagtgttggagatgt

SEQ ID NO: 7570793 - DNA, 22 bp, Homo sapiens
agccagagagtgttggagatgt

SEQ ID NO: 7570794 - DNA, 22 bp, Homo sapiens
cactttataaaattggtgtgag

SEQ ID NO: 7570795 - DNA, 22 bp, Homo sapiens
cactttataaaattggtgtgag

SEQ ID NO: 7570796 - DNA, 22 bp, Homo sapiens
cactttactatctataaaataa

SEQ ID NO: 7570797 - DNA, 22 bp, Homo sapiens
cactttattataaatttgagag

SEQ ID NO: 7570798 - DNA, 22 bp, Homo sapiens
cactttattataaatttgagag

SEQ ID NO: 7570799 - DNA, 22 bp, Homo sapiens
cactttatgggaagcaaaaatt

SEQ ID NO: 7570800 - DNA, 22 bp, Homo sapiens
cactttatgggaagcaaaaatt

SEQ ID NO: 7570801 - DNA, 22 bp, Homo sapiens
cactttctcatgaatttggccc

SEQ ID NO: 7570802 - DNA, 22 bp, Homo sapiens
cactttcaagtttcagaggata

SEQ ID NO: 7570803 - DNA, 22 bp, Homo sapiens
cactttcaagtttcagaggata

SEQ ID NO: 7570804 - DNA, 22 bp, Homo sapiens
cactttcaagtttcagaggata

SEQ ID NO: 7570805 - DNA, 22 bp, Homo sapiens
cactttctcatgaatttggccc

SEQ ID NO: 7570806 - DNA, 22 bp, Homo sapiens
cactttctcatgaatttggccc

SEQ ID NO: 7570807 - DNA, 22 bp, Homo sapiens
cactttctgtgtatcttccatt

SEQ ID NO: 7570808 - DNA, 22 bp, Homo sapiens
cactttctcatgaatttggccc

SEQ ID NO: 7570809 - DNA, 22 bp, Homo sapiens
cactttctgtgtatcttccatt

SEQ ID NO: 7570810 - DNA, 22 bp, Homo sapiens
agccagctaccggggctcctgg

SEQ ID NO: 7570811 - DNA, 22 bp, Homo sapiens
agccagccgggggaccacagtg

SEQ ID NO: 7570812 - DNA, 22 bp, Homo sapiens
agccagctaagggaagcatgat

SEQ ID NO: 7570813 - DNA, 22 bp, Homo sapiens
agccagctaagggaagcatgat

SEQ ID NO: 7570814 - DNA, 22 bp, Homo sapiens
agccagctaccggggctcctgg

SEQ ID NO: 7570815 - DNA, 22 bp, Homo sapiens
agccagctaccggggctcctgg

SEQ ID NO: 7570816 - DNA, 22 bp, Homo sapiens
agccagctaccggggctcctgg

SEQ ID NO: 7570817 - DNA, 22 bp, Homo sapiens
agccagctaccggggctcctgg

SEQ ID NO: 7570818 - DNA, 22 bp, Homo sapiens
agccagctaccggggctcctgg

SEQ ID NO: 7570819 - DNA, 22 bp, Homo sapiens
agccagcccctgactgtgtcct

SEQ ID NO: 7570820 - DNA, 22 bp, Homo sapiens
agccagccagttcactaggaaa

SEQ ID NO: 7570821 - DNA, 22 bp, Homo sapiens
agccagcccctgactgtgtcct

SEQ ID NO: 7570822 - DNA, 22 bp, Homo sapiens
agccagcctgatctcttcttgc

SEQ ID NO: 7570823 - DNA, 22 bp, Homo sapiens
agccagccgggggaccacagtg

SEQ ID NO: 7570824 - DNA, 22 bp, Homo sapiens
agccagccgggggaccacagtg

SEQ ID NO: 7570825 - DNA, 22 bp, Homo sapiens
agccagcccctgactgtgtcct

SEQ ID NO: 7570826 - DNA, 22 bp, Homo sapiens
agccagccgggggaccacagtg

SEQ ID NO: 7570827 - DNA, 22 bp, Homo sapiens
agccagcatgaagacagaggcc

SEQ ID NO: 7570828 - DNA, 20 bp, Homo sapiens
agccagccacttcctgctcc

SEQ ID NO: 7570829 - DNA, 20 bp, Homo sapiens
agccagccacttcctgctcc

SEQ ID NO: 7570830 - DNA, 20 bp, Homo sapiens
agccagccacttcctgctcc

SEQ ID NO: 7570831 - DNA, 22 bp, Homo sapiens
agccagcatgaagacagaggcc

SEQ ID NO: 7570832 - DNA, 22 bp, Homo sapiens
agccagccagttcactaggaaa

SEQ ID NO: 7570833 - DNA, 19 bp, Homo sapiens
agccagccagcaggtatgc

SEQ ID NO: 7570834 - DNA, 22 bp, Homo sapiens
agccagccagttcactaggaaa

SEQ ID NO: 7570835 - DNA, 20 bp, Homo sapiens
agccagccacttcctgctcc

SEQ ID NO: 7570836 - DNA, 22 bp, Homo sapiens
agccagcatgaagacagaggcc

SEQ ID NO: 7570837 - DNA, 22 bp, Homo sapiens
agccagcatgaagacagaggcc

SEQ ID NO: 7570838 - DNA, 22 bp, Homo sapiens
agccagcatgaagacagaggcc

SEQ ID NO: 7570839 - DNA, 22 bp, Homo sapiens
agccagcatgaagacagaggcc

SEQ ID NO: 7570840 - DNA, 22 bp, Homo sapiens
agccagcatgaagacagaggcc

SEQ ID NO: 7570841 - DNA, 22 bp, Homo sapiens
agccagcatcttgcttcttgag

SEQ ID NO: 7570842 - DNA, 22 bp, Homo sapiens
agccagcatcccttcagtctcc

SEQ ID NO: 7570843 - DNA, 22 bp, Homo sapiens
agccagcatcccttcagtctcc

SEQ ID NO: 7570844 - DNA, 19 bp, Homo sapiens
agccagcaggcctctgagc

SEQ ID NO: 7570845 - DNA, 22 bp, Homo sapiens
agccagcagggcttagaggaca

SEQ ID NO: 7570846 - DNA, 22 bp, Homo sapiens
agccagcagggcttagaggaca

SEQ ID NO: 7570847 - DNA, 19 bp, Homo sapiens
agccagcaggcctctgagc

SEQ ID NO: 7570848 - DNA, 22 bp, Homo sapiens
agccagcaggtgagtgcagcct

SEQ ID NO: 7570849 - DNA, 22 bp, Homo sapiens
agccagcagggcttagaggaca

SEQ ID NO: 7570850 - DNA, 22 bp, Homo sapiens
agccagcagggcttagaggaca

SEQ ID NO: 7570851 - DNA, 22 bp, Homo sapiens
agccagcaggaacgtctaggtt

SEQ ID NO: 7570852 - DNA, 22 bp, Homo sapiens
agccagcacggcgccatggagt

SEQ ID NO: 7570853 - DNA, 22 bp, Homo sapiens
agccagcaggaacgtctaggtt

SEQ ID NO: 7570854 - DNA, 22 bp, Homo sapiens
agccagcaggaacgtctaggtt

SEQ ID NO: 7570855 - DNA, 22 bp, Homo sapiens
agccagcaggaacgtctaggtt

SEQ ID NO: 7570856 - DNA, 22 bp, Homo sapiens
agccagcaggaacgtctaggtt

SEQ ID NO: 7570857 - DNA, 19 bp, Homo sapiens
agccagcagcgtagcatct

SEQ ID NO: 7570858 - DNA, 19 bp, Homo sapiens
agccagcagcgtagcatct

SEQ ID NO: 7570859 - DNA, 19 bp, Homo sapiens
agccagcagcgtagcatct

SEQ ID NO: 7570860 - DNA, 19 bp, Homo sapiens
agccagcagcgtagcatct

SEQ ID NO: 7570861 - DNA, 22 bp, Homo sapiens
agccagcaggtgggaaactgga

SEQ ID NO: 7570862 - DNA, 17 bp, Homo sapiens
agccagcagtagctggt

SEQ ID NO: 7570863 - DNA, 17 bp, Homo sapiens
agccagcagtagctggt

SEQ ID NO: 7570864 - DNA, 17 bp, Homo sapiens
agccagcagtagctggt

SEQ ID NO: 7570865 - DNA, 22 bp, Homo sapiens
agccagcatatatatagttgaa

SEQ ID NO: 7570866 - DNA, 22 bp, Homo sapiens
agccagcatatatatagttgaa

SEQ ID NO: 7570867 - DNA, 22 bp, Homo sapiens
agccagcatatatatagttgaa

SEQ ID NO: 7570868 - DNA, 22 bp, Homo sapiens
agccagcatcccttcagtctcc

SEQ ID NO: 7570869 - DNA, 22 bp, Homo sapiens
agccagcatcccttcagtctcc

SEQ ID NO: 7570870 - DNA, 17 bp, Homo sapiens
agccagcagtagctggt

SEQ ID NO: 7570871 - DNA, 17 bp, Homo sapiens
agccagcagtagctggt

SEQ ID NO: 7570872 - DNA, 17 bp, Homo sapiens
agccagcagtagctggt

SEQ ID NO: 7570873 - DNA, 22 bp, Homo sapiens
agccagcaggtgagtgcagcct

SEQ ID NO: 7570874 - DNA, 22 bp, Homo sapiens
agccagcaggtgagtgcagcct

SEQ ID NO: 7570875 - DNA, 22 bp, Homo sapiens
agccagcaggtgagtgcagcct

SEQ ID NO: 7570876 - DNA, 22 bp, Homo sapiens
agccagcaggtgcagaattcca

SEQ ID NO: 7570877 - DNA, 22 bp, Homo sapiens
agccagcaggtgcagaattcca

SEQ ID NO: 7570878 - DNA, 22 bp, Homo sapiens
agccagcaggtgcagaattcca

SEQ ID NO: 7570879 - DNA, 18 bp, Homo sapiens
cagagctcctggatgcag

SEQ ID NO: 7570880 - DNA, 18 bp, Homo sapiens
cagagctcctggatgcag

SEQ ID NO: 7570881 - DNA, 18 bp, Homo sapiens
cagagctcctggatgcag

SEQ ID NO: 7570882 - DNA, 18 bp, Homo sapiens
cagagctcctggatgcag

SEQ ID NO: 7570883 - DNA, 22 bp, Homo sapiens
cagagctcagagctgccaggca

SEQ ID NO: 7570884 - DNA, 22 bp, Homo sapiens
cagagctcagagctgccaggca

SEQ ID NO: 7570885 - DNA, 22 bp, Homo sapiens
cagagctcagagctgccaggca

SEQ ID NO: 7570886 - DNA, 22 bp, Homo sapiens
cagagctcagagcagggcactc

SEQ ID NO: 7570887 - DNA, 22 bp, Homo sapiens
cagagctcagagcagggcactc

SEQ ID NO: 7570888 - DNA, 22 bp, Homo sapiens
cagagctcagagctgccaggca

SEQ ID NO: 7570889 - DNA, 22 bp, Homo sapiens
cagagctcagagctgccaggca

SEQ ID NO: 7570890 - DNA, 22 bp, Homo sapiens
cagagcggccactagagggcgc

SEQ ID NO: 7570891 - DNA, 22 bp, Homo sapiens
cagagcggccactagagggcgc

SEQ ID NO: 7570892 - DNA, 22 bp, Homo sapiens
cagagctcagagcagggcactc

SEQ ID NO: 7570893 - DNA, 22 bp, Homo sapiens
cagagctcagagcagggcactc

SEQ ID NO: 7570894 - DNA, 22 bp, Homo sapiens
cagagctcagagcagggcactc

SEQ ID NO: 7570895 - DNA, 22 bp, Homo sapiens
cagagccttcctagcagactct

SEQ ID NO: 7570896 - DNA, 22 bp, Homo sapiens
cagagccttcctagcagactct

SEQ ID NO: 7570897 - DNA, 22 bp, Homo sapiens
cagagcctttgtgtccacattt

SEQ ID NO: 7570898 - DNA, 22 bp, Homo sapiens
cagagcctttgtgtccacattt

SEQ ID NO: 7570899 - DNA, 22 bp, Homo sapiens
cagagcggccactagagggcgc

SEQ ID NO: 7570900 - DNA, 19 bp, Homo sapiens
cagagccttcagtgactcc

SEQ ID NO: 7570901 - DNA, 19 bp, Homo sapiens
cagagccttcagtgactcc

SEQ ID NO: 7570902 - DNA, 19 bp, Homo sapiens
cagagccttcagtgactcc

SEQ ID NO: 7570903 - DNA, 22 bp, Homo sapiens
cagagccttagttctcctagaa

SEQ ID NO: 7570904 - DNA, 22 bp, Homo sapiens
cagagccttagttctcctagaa

SEQ ID NO: 7570905 - DNA, 22 bp, Homo sapiens
agccaggccttagggagaggca

SEQ ID NO: 7570906 - DNA, 22 bp, Homo sapiens
agccaggccttagggagaggca

SEQ ID NO: 7570907 - DNA, 22 bp, Homo sapiens
agccaggccttagggagaggca

SEQ ID NO: 7570908 - DNA, 22 bp, Homo sapiens
agccaggccttagggagaggca

SEQ ID NO: 7570909 - DNA, 20 bp, Homo sapiens
agccaggcctcaagttaagt

SEQ ID NO: 7570910 - DNA, 22 bp, Homo sapiens
agccaggccttagggagaggca

SEQ ID NO: 7570911 - DNA, 22 bp, Homo sapiens
agccaggccttagggagaggca

SEQ ID NO: 7570912 - DNA, 22 bp, Homo sapiens
agccaggccttagggagaggca

SEQ ID NO: 7570913 - DNA, 22 bp, Homo sapiens
agccaggccttagggagaggca

SEQ ID NO: 7570914 - DNA, 22 bp, Homo sapiens
agccaggccagctgtcttgagt

SEQ ID NO: 7570915 - DNA, 22 bp, Homo sapiens
agccaggccagctgtcttgagt

SEQ ID NO: 7570916 - DNA, 22 bp, Homo sapiens
agccaggccagactcacaccct

SEQ ID NO: 7570917 - DNA, 20 bp, Homo sapiens
agccaggcctcaagttaagt

SEQ ID NO: 7570918 - DNA, 22 bp, Homo sapiens
agccaggccagctgtcttgagt

SEQ ID NO: 7570919 - DNA, 22 bp, Homo sapiens
agccaggccttttctcaaggtt

SEQ ID NO: 7570920 - DNA, 22 bp, Homo sapiens
agccaggccttttctcaaggtt

SEQ ID NO: 7570921 - DNA, 22 bp, Homo sapiens
cagagccattatggagacttgc

SEQ ID NO: 7570922 - DNA, 22 bp, Homo sapiens
cagagcccaagagcaagccatg

SEQ ID NO: 7570923 - DNA, 22 bp, Homo sapiens
agccaggccttttctcaaggtt

SEQ ID NO: 7570924 - DNA, 22 bp, Homo sapiens
agccaggccttagggagaggca

SEQ ID NO: 7570925 - DNA, 22 bp, Homo sapiens
agccaggccttttctcaaggtt

SEQ ID NO: 7570926 - DNA, 22 bp, Homo sapiens
cagagcccagggcctacgtccc

SEQ ID NO: 7570927 - DNA, 20 bp, Homo sapiens
cagagcccactttcttatca

SEQ ID NO: 7570928 - DNA, 22 bp, Homo sapiens
cagagcctggcgatgtcatgga

SEQ ID NO: 7570929 - DNA, 21 bp, Homo sapiens
cagagcctgtgttgacagttg

SEQ ID NO: 7570930 - DNA, 21 bp, Homo sapiens
cagagcctgtgttgacagttg

SEQ ID NO: 7570931 - DNA, 22 bp, Homo sapiens
cagagcctggcgatgtcatgga

SEQ ID NO: 7570932 - DNA, 22 bp, Homo sapiens
cagagacatccatgttagttgg

SEQ ID NO: 7570933 - DNA, 22 bp, Homo sapiens
cagagacatccatgttagttgg

SEQ ID NO: 7570934 - DNA, 22 bp, Homo sapiens
cagagacatccatgttagttgg

SEQ ID NO: 7570935 - DNA, 22 bp, Homo sapiens
cagagacatccattttatatgc

SEQ ID NO: 7570936 - DNA, 22 bp, Homo sapiens
cagagacatccattttatatgc

SEQ ID NO: 7570937 - DNA, 22 bp, Homo sapiens
cagagacatccattttatatgc

SEQ ID NO: 7570938 - DNA, 22 bp, Homo sapiens
cagagacatccattttatatgc

SEQ ID NO: 7570939 - DNA, 22 bp, Homo sapiens
cagagacatccattttatatgc

SEQ ID NO: 7570940 - DNA, 22 bp, Homo sapiens
cagagacatgtggcctgcacgt

SEQ ID NO: 7570941 - DNA, 22 bp, Homo sapiens
cagagacatgtggcctgcacgt

SEQ ID NO: 7570942 - DNA, 22 bp, Homo sapiens
cagagacatgtggcctgcacgt

SEQ ID NO: 7570943 - DNA, 22 bp, Homo sapiens
cagagaacaaagctgagggttt

SEQ ID NO: 7570944 - DNA, 22 bp, Homo sapiens
cagagaacaaagctgagggttt

SEQ ID NO: 7570945 - DNA, 21 bp, Homo sapiens
agccagctatcacacagcatt

SEQ ID NO: 7570946 - DNA, 21 bp, Homo sapiens
agccagctatcacacagcatt

SEQ ID NO: 7570947 - DNA, 22 bp, Homo sapiens
cagagaaagggtgaattccttc

SEQ ID NO: 7570948 - DNA, 22 bp, Homo sapiens
cagagaacaaagctgagggttt

SEQ ID NO: 7570949 - DNA, 22 bp, Homo sapiens
cagagaacattcagagctgtag

SEQ ID NO: 7570950 - DNA, 22 bp, Homo sapiens
cagagaactccagtggctggcg

SEQ ID NO: 7570951 - DNA, 22 bp, Homo sapiens
cagagaacattcagagctgtag

SEQ ID NO: 7570952 - DNA, 22 bp, Homo sapiens
cagagaacattcagagctgtag

SEQ ID NO: 7570953 - DNA, 22 bp, Homo sapiens
cagagaactccagtggctggcg

SEQ ID NO: 7570954 - DNA, 22 bp, Homo sapiens
cagagacattaagtgccatgat

SEQ ID NO: 7570955 - DNA, 22 bp, Homo sapiens
cagagacattaagtgccatgat

SEQ ID NO: 7570956 - DNA, 22 bp, Homo sapiens
cagagacattaagtgccatgat

SEQ ID NO: 7570957 - DNA, 22 bp, Homo sapiens
cagagacatgtggcctgcacgt

SEQ ID NO: 7570958 - DNA, 22 bp, Homo sapiens
cagagacatgtggcctgcacgt

SEQ ID NO: 7570959 - DNA, 22 bp, Homo sapiens
cagagacattaagtgccatgat

SEQ ID NO: 7570960 - DNA, 22 bp, Homo sapiens
cagagacattaagtgccatgat

SEQ ID NO: 7570961 - DNA, 22 bp, Homo sapiens
cagagacattaagtgccatgat

SEQ ID NO: 7570962 - DNA, 22 bp, Homo sapiens
cagagacattaagtgccatgat

SEQ ID NO: 7570963 - DNA, 22 bp, Homo sapiens
cagagacattaagtgccatgat

SEQ ID NO: 7570964 - DNA, 22 bp, Homo sapiens
cagagacattcagtaaattatc

SEQ ID NO: 7570965 - DNA, 22 bp, Homo sapiens
cagagacattcagtaaattatc

SEQ ID NO: 7570966 - DNA, 22 bp, Homo sapiens
cagagacattcagtaaattatc

SEQ ID NO: 7570967 - DNA, 22 bp, Homo sapiens
cagagacattaagtgccatgat

SEQ ID NO: 7570968 - DNA, 22 bp, Homo sapiens
cagagacattaagtgccatgat

SEQ ID NO: 7570969 - DNA, 22 bp, Homo sapiens
cagagacattaagtgccatgat

SEQ ID NO: 7570970 - DNA, 22 bp, Homo sapiens
cagagacattctccccattgga

SEQ ID NO: 7570971 - DNA, 22 bp, Homo sapiens
cagagacattctccccattgga

SEQ ID NO: 7570972 - DNA, 22 bp, Homo sapiens
cagagacattctccccattgga

SEQ ID NO: 7570973 - DNA, 22 bp, Homo sapiens
cagagacattctccccattgga

SEQ ID NO: 7570974 - DNA, 20 bp, Homo sapiens
cagagaccaggccaggtgtc

SEQ ID NO: 7570975 - DNA, 20 bp, Homo sapiens
cagagacccaggcttcagct

SEQ ID NO: 7570976 - DNA, 20 bp, Homo sapiens
cagagacccaggcttcagct

SEQ ID NO: 7570977 - DNA, 20 bp, Homo sapiens
cagagaccaggccaggtgtc

SEQ ID NO: 7570978 - DNA, 20 bp, Homo sapiens
cagagaccaggccaggtgtc

SEQ ID NO: 7570979 - DNA, 22 bp, Homo sapiens
cagagaccccgctgcccttctg

SEQ ID NO: 7570980 - DNA, 22 bp, Homo sapiens
cagagaccccgctgcccttctg

SEQ ID NO: 7570981 - DNA, 22 bp, Homo sapiens
cagagacccctggcatggtggt

SEQ ID NO: 7570982 - DNA, 22 bp, Homo sapiens
cagagacccctggcatggtggt

SEQ ID NO: 7570983 - DNA, 22 bp, Homo sapiens
cagagaccctaggcaggtgaca

SEQ ID NO: 7570984 - DNA, 22 bp, Homo sapiens
cagagaccctaggcaggtgaca

SEQ ID NO: 7570985 - DNA, 22 bp, Homo sapiens
cagagaccctaggcaggtgaca

SEQ ID NO: 7570986 - DNA, 22 bp, Homo sapiens
cagagaccctaggcaggtgaca

SEQ ID NO: 7570987 - DNA, 22 bp, Homo sapiens
cagagacctcaaattatttcct

SEQ ID NO: 7570988 - DNA, 22 bp, Homo sapiens
agccaggcagggctctcgctct

SEQ ID NO: 7570989 - DNA, 22 bp, Homo sapiens
cagagacctgcccatttacgct

SEQ ID NO: 7570990 - DNA, 22 bp, Homo sapiens
agccaggcagggctctcgctct

SEQ ID NO: 7570991 - DNA, 22 bp, Homo sapiens
cagagacccttctcagtggcca

SEQ ID NO: 7570992 - DNA, 22 bp, Homo sapiens
cagagacccttctcagtggcca

SEQ ID NO: 7570993 - DNA, 22 bp, Homo sapiens
cagagacccttctcagtggcca

SEQ ID NO: 7570994 - DNA, 22 bp, Homo sapiens
cagagacccttctcagtggcca

SEQ ID NO: 7570995 - DNA, 22 bp, Homo sapiens
cagagacccttctcagtggcca

SEQ ID NO: 7570996 - DNA, 17 bp, Homo sapiens
agccaggcatatgaagt

SEQ ID NO: 7570997 - DNA, 17 bp, Homo sapiens
agccaggcatatgaagt

SEQ ID NO: 7570998 - DNA, 17 bp, Homo sapiens
agccaggcatatgaagt

SEQ ID NO: 7570999 - DNA, 17 bp, Homo sapiens
agccaggcatatgaagt

SEQ ID NO: 7571000 - DNA, 22 bp, Homo sapiens
agccaggccagactcacaccct

SEQ ID NO: 7571001 - DNA, 22 bp, Homo sapiens
agccaggccagactcacaccct

SEQ ID NO: 7571002 - DNA, 22 bp, Homo sapiens
agccaggccagactcacaccct

SEQ ID NO: 7571003 - DNA, 22 bp, Homo sapiens
agccaggccagactcacaccct

SEQ ID NO: 7571004 - DNA, 22 bp, Homo sapiens
agccagtgccagtcatgcctgc

SEQ ID NO: 7571005 - DNA, 22 bp, Homo sapiens
agccagtgccagtcatgcctgc

SEQ ID NO: 7571006 - DNA, 22 bp, Homo sapiens
agccagtgccagtcatgcctgc

SEQ ID NO: 7571007 - DNA, 22 bp, Homo sapiens
agccagtgccagtcatgcctgc

SEQ ID NO: 7571008 - DNA, 22 bp, Homo sapiens
agccagtggaattcccaggggt

SEQ ID NO: 7571009 - DNA, 22 bp, Homo sapiens
agccagtgccagtcatgcctgc

SEQ ID NO: 7571010 - DNA, 22 bp, Homo sapiens
agccagtgccagtcatgcctgc

SEQ ID NO: 7571011 - DNA, 22 bp, Homo sapiens
agccagtgcagctggaaattca

SEQ ID NO: 7571012 - DNA, 22 bp, Homo sapiens
agccagtgcaacagcagtgaag

SEQ ID NO: 7571013 - DNA, 22 bp, Homo sapiens
agccagtgcagctggaaattca

SEQ ID NO: 7571014 - DNA, 22 bp, Homo sapiens
agccagtgcagctggaaattca

SEQ ID NO: 7571015 - DNA, 22 bp, Homo sapiens
cagagctctgacagctacagcc

SEQ ID NO: 7571016 - DNA, 22 bp, Homo sapiens
cagagctctgacagctacagcc

SEQ ID NO: 7571017 - DNA, 22 bp, Homo sapiens
cagagctctatgttcatggagg

SEQ ID NO: 7571018 - DNA, 22 bp, Homo sapiens
cagagctctatgttcatggagg

SEQ ID NO: 7571019 - DNA, 22 bp, Homo sapiens
cagagctctgacagctacagcc

SEQ ID NO: 7571020 - DNA, 22 bp, Homo sapiens
cagagctctctttgctactaca

SEQ ID NO: 7571021 - DNA, 22 bp, Homo sapiens
cagagctctgacagctacagcc

SEQ ID NO: 7571022 - DNA, 22 bp, Homo sapiens
cagagctctgacagctacagcc

SEQ ID NO: 7571023 - DNA, 22 bp, Homo sapiens
agccagttcaagttatggcgtt

SEQ ID NO: 7571024 - DNA, 17 bp, Homo sapiens
agccagttcatagcact

SEQ ID NO: 7571025 - DNA, 17 bp, Homo sapiens
agccagttcatagcact

SEQ ID NO: 7571026 - DNA, 22 bp, Homo sapiens
agccagttccagcacaccactg

SEQ ID NO: 7571027 - DNA, 22 bp, Homo sapiens
agccagttccagcacaccactg

SEQ ID NO: 7571028 - DNA, 22 bp, Homo sapiens
agccagttccagcacaccactg

SEQ ID NO: 7571029 - DNA, 19 bp, Homo sapiens
agccagttctagacaatgg

SEQ ID NO: 7571030 - DNA, 22 bp, Homo sapiens
agccagtgttaagtgactggtt

SEQ ID NO: 7571031 - DNA, 22 bp, Homo sapiens
agccagtgttaagtgactggtt

SEQ ID NO: 7571032 - DNA, 22 bp, Homo sapiens
agccagtgtcgtgtgacatgag

SEQ ID NO: 7571033 - DNA, 22 bp, Homo sapiens
agccagtgttaagtgactggtt

SEQ ID NO: 7571034 - DNA, 22 bp, Homo sapiens
cagagctctatgttcatggagg

SEQ ID NO: 7571035 - DNA, 22 bp, Homo sapiens
agccagtgttaagtgactggtt

SEQ ID NO: 7571036 - DNA, 22 bp, Homo sapiens
agccagtggaattcccaggggt

SEQ ID NO: 7571037 - DNA, 22 bp, Homo sapiens
agccagtgggattagagcctct

SEQ ID NO: 7571038 - DNA, 22 bp, Homo sapiens
agccagtgtcgtgtgacatgag

SEQ ID NO: 7571039 - DNA, 22 bp, Homo sapiens
agccagtgtcgtgtgacatgag

SEQ ID NO: 7571040 - DNA, 22 bp, Homo sapiens
agccagtgggattagagcctct

SEQ ID NO: 7571041 - DNA, 22 bp, Homo sapiens
agccagtggtgtaatgccgtct

SEQ ID NO: 7571042 - DNA, 22 bp, Homo sapiens
agccagtttaagcaggaggggt

SEQ ID NO: 7571043 - DNA, 22 bp, Homo sapiens
agccagttgtggggctagccct

SEQ ID NO: 7571044 - DNA, 22 bp, Homo sapiens
agccagtttaagcaggaggggt

SEQ ID NO: 7571045 - DNA, 23 bp, Homo sapiens
agccagttgtagccacagaactc

SEQ ID NO: 7571046 - DNA, 22 bp, Homo sapiens
agccagttgtggggctagccct

SEQ ID NO: 7571047 - DNA, 23 bp, Homo sapiens
agccagttgtagccacagaactc

SEQ ID NO: 7571048 - DNA, 22 bp, Homo sapiens
agccagtttaagcaggaggggt

SEQ ID NO: 7571049 - DNA, 22 bp, Homo sapiens
agcccagggacagggcggatgt

SEQ ID NO: 7571050 - DNA, 22 bp, Homo sapiens
agccagtttgcttgtaataaca

SEQ ID NO: 7571051 - DNA, 22 bp, Homo sapiens
agccagtttccagatattaact

SEQ ID NO: 7571052 - DNA, 22 bp, Homo sapiens
agccagttggctatgaggagga

SEQ ID NO: 7571053 - DNA, 22 bp, Homo sapiens
agccagttggctatgaggagga

SEQ ID NO: 7571054 - DNA, 19 bp, Homo sapiens
agccagttggtaagaggct

SEQ ID NO: 7571055 - DNA, 23 bp, Homo sapiens
agccagttgtagccacagaactc

SEQ ID NO: 7571056 - DNA, 23 bp, Homo sapiens
agccagttgtagccacagaactc

SEQ ID NO: 7571057 - DNA, 19 bp, Homo sapiens
agccagttctagacaatgg

SEQ ID NO: 7571058 - DNA, 22 bp, Homo sapiens
agccagttctctagtgatattt

SEQ ID NO: 7571059 - DNA, 22 bp, Homo sapiens
agccagttgatgggtttccaat

SEQ ID NO: 7571060 - DNA, 22 bp, Homo sapiens
agccagttgatgggtttccaat

SEQ ID NO: 7571061 - DNA, 22 bp, Homo sapiens
agccagttggctatgaggagga

SEQ ID NO: 7571062 - DNA, 22 bp, Homo sapiens
agcccaggttgaggctgcagtg

SEQ ID NO: 7571063 - DNA, 22 bp, Homo sapiens
agcccaggttgaggctgcagtg

SEQ ID NO: 7571064 - DNA, 22 bp, Homo sapiens
agcccaggttgaggctgcagtg

SEQ ID NO: 7571065 - DNA, 22 bp, Homo sapiens
agcccaggttgaggctgcagtg

SEQ ID NO: 7571066 - DNA, 22 bp, Homo sapiens
agcccaggttgaggctgcagtg

SEQ ID NO: 7571067 - DNA, 22 bp, Homo sapiens
agcccaggttgaggctgcagtg

SEQ ID NO: 7571068 - DNA, 22 bp, Homo sapiens
agcccaggttctaaagccaaac

SEQ ID NO: 7571069 - DNA, 22 bp, Homo sapiens
agcccaggttctaaagccaaac

SEQ ID NO: 7571070 - DNA, 22 bp, Homo sapiens
agcccaggttctaaagccaaac

SEQ ID NO: 7571071 - DNA, 22 bp, Homo sapiens
agcccaggttgaggctgcagtg

SEQ ID NO: 7571072 - DNA, 22 bp, Homo sapiens
agcccagggacagggcggatgt

SEQ ID NO: 7571073 - DNA, 22 bp, Homo sapiens
agcccagggacagggcggatgt

SEQ ID NO: 7571074 - DNA, 22 bp, Homo sapiens
agcccagggacagggcggatgt

SEQ ID NO: 7571075 - DNA, 22 bp, Homo sapiens
agcccagggacagggcggatgt

SEQ ID NO: 7571076 - DNA, 22 bp, Homo sapiens
agcccagggacagggcggatgt

SEQ ID NO: 7571077 - DNA, 22 bp, Homo sapiens
agcccaggttctaaagccaaac

SEQ ID NO: 7571078 - DNA, 22 bp, Homo sapiens
agcccaggttctaaagccaaac

SEQ ID NO: 7571079 - DNA, 22 bp, Homo sapiens
agcccagggagttgattagcat

SEQ ID NO: 7571080 - DNA, 22 bp, Homo sapiens
agcccagggagttgattagcat

SEQ ID NO: 7571081 - DNA, 22 bp, Homo sapiens
agcccaggttgaggctgcagtg

SEQ ID NO: 7571082 - DNA, 22 bp, Homo sapiens
agcccaggttgaggctgcagtg

SEQ ID NO: 7571083 - DNA, 22 bp, Homo sapiens
agcccagtgggccgaggcgggg

SEQ ID NO: 7571084 - DNA, 22 bp, Homo sapiens
agcccagtgggccgaggcgggg

SEQ ID NO: 7571085 - DNA, 20 bp, Homo sapiens
agcccatctcccacagctac

SEQ ID NO: 7571086 - DNA, 22 bp, Homo sapiens
agcccagttgctccacgctgca

SEQ ID NO: 7571087 - DNA, 22 bp, Homo sapiens
agcccagttgctccacgctgca

SEQ ID NO: 7571088 - DNA, 22 bp, Homo sapiens
agcccaggttgaggctgcagtg

SEQ ID NO: 7571089 - DNA, 22 bp, Homo sapiens
agcccaggttgaggctgcagtg

SEQ ID NO: 7571090 - DNA, 22 bp, Homo sapiens
agcccaggttgaggctgcagtg

SEQ ID NO: 7571091 - DNA, 22 bp, Homo sapiens
agcccaggttgaggctgcagtg

SEQ ID NO: 7571092 - DNA, 22 bp, Homo sapiens
agcccaggttgaggctgcagtg

SEQ ID NO: 7571093 - DNA, 22 bp, Homo sapiens
agcccaggttgaggctgcagtg

SEQ ID NO: 7571094 - DNA, 22 bp, Homo sapiens
agcccaggttgaggctgcagtg

SEQ ID NO: 7571095 - DNA, 22 bp, Homo sapiens
agcccaggttgaggctgcagtg

SEQ ID NO: 7571096 - DNA, 22 bp, Homo sapiens
agcccaggttgaggctgcagtg

SEQ ID NO: 7571097 - DNA, 22 bp, Homo sapiens
agcccatgcaacaggcctagcg

SEQ ID NO: 7571098 - DNA, 22 bp, Homo sapiens
agcccatgcaaatactcggtga

SEQ ID NO: 7571099 - DNA, 22 bp, Homo sapiens
agcccatgcaaatactcggtga

SEQ ID NO: 7571100 - DNA, 22 bp, Homo sapiens
agcccatgcaacaggcctagcg

SEQ ID NO: 7571101 - DNA, 22 bp, Homo sapiens
agcccatgcaacaggcctagcg

SEQ ID NO: 7571102 - DNA, 22 bp, Homo sapiens
agcccatgcaacaggcctagcg

SEQ ID NO: 7571103 - DNA, 20 bp, Homo sapiens
agcccatctcccacagctac

SEQ ID NO: 7571104 - DNA, 22 bp, Homo sapiens
agcccatggtgtactctgtggc

SEQ ID NO: 7571105 - DNA, 22 bp, Homo sapiens
agcccatggtgtactctgtggc

SEQ ID NO: 7571106 - DNA, 22 bp, Homo sapiens
agcccatgcagaccttcccaga

SEQ ID NO: 7571107 - DNA, 22 bp, Homo sapiens
agcccatgcagaccttcccaga

SEQ ID NO: 7571108 - DNA, 22 bp, Homo sapiens
agcccatgcaacaggcctagcg

SEQ ID NO: 7571109 - DNA, 22 bp, Homo sapiens
agccccacactctctctgagaa

SEQ ID NO: 7571110 - DNA, 22 bp, Homo sapiens
agccccacactctctctgagaa

SEQ ID NO: 7571111 - DNA, 22 bp, Homo sapiens
agccccacactctctctgagaa

SEQ ID NO: 7571112 - DNA, 22 bp, Homo sapiens
agcccatggtgtactctgtggc

SEQ ID NO: 7571113 - DNA, 22 bp, Homo sapiens
agcccatggtgtactctgtggc

SEQ ID NO: 7571114 - DNA, 22 bp, Homo sapiens
agcccatggtgtactctgtggc

SEQ ID NO: 7571115 - DNA, 22 bp, Homo sapiens
agcccatgtggctgaggcttct

SEQ ID NO: 7571116 - DNA, 22 bp, Homo sapiens
agcccatgtggctgaggcttct

SEQ ID NO: 7571117 - DNA, 20 bp, Homo sapiens
agccccacccttgtcctggc

SEQ ID NO: 7571118 - DNA, 22 bp, Homo sapiens
agccccacactctctctgagaa

SEQ ID NO: 7571119 - DNA, 22 bp, Homo sapiens
agccccagtaagggagggcctg

SEQ ID NO: 7571120 - DNA, 22 bp, Homo sapiens
agccccagtaagggagggcctg

SEQ ID NO: 7571121 - DNA, 22 bp, Homo sapiens
agccccaggcccggacgcctct

SEQ ID NO: 7571122 - DNA, 22 bp, Homo sapiens
agccccagtaagggagggcctg

SEQ ID NO: 7571123 - DNA, 22 bp, Homo sapiens
agccccagtaagggagggcctg

SEQ ID NO: 7571124 - DNA, 22 bp, Homo sapiens
agccccagtccgctgcgggcgg

SEQ ID NO: 7571125 - DNA, 22 bp, Homo sapiens
agccccagtccgctgcgggcgg

SEQ ID NO: 7571126 - DNA, 22 bp, Homo sapiens
agccccagtccgctgcgggcgg

SEQ ID NO: 7571127 - DNA, 22 bp, Homo sapiens
agccccagtaagggagggcctg

SEQ ID NO: 7571128 - DNA, 22 bp, Homo sapiens
agccccagtaagggagggcctg

SEQ ID NO: 7571129 - DNA, 22 bp, Homo sapiens
agccccaggatgggccgcagga

SEQ ID NO: 7571130 - DNA, 22 bp, Homo sapiens
agccccaggatgggccgcagga

SEQ ID NO: 7571131 - DNA, 22 bp, Homo sapiens
agccccaggcccggacgcctct

SEQ ID NO: 7571132 - DNA, 22 bp, Homo sapiens
agccccaggatgggccgcagga

SEQ ID NO: 7571133 - DNA, 22 bp, Homo sapiens
agccccaggatgggccgcagga

SEQ ID NO: 7571134 - DNA, 22 bp, Homo sapiens
agccccaggcccggacgcctct

SEQ ID NO: 7571135 - DNA, 22 bp, Homo sapiens
agccccaggcccggacgcctct

SEQ ID NO: 7571136 - DNA, 22 bp, Homo sapiens
agccccaggcccggacgcctct

SEQ ID NO: 7571137 - DNA, 22 bp, Homo sapiens
agccccaggcccggacgcctct

SEQ ID NO: 7571138 - DNA, 22 bp, Homo sapiens
agccccaggatgggccgcagga

SEQ ID NO: 7571139 - DNA, 22 bp, Homo sapiens
agccccaggatgggccgcagga

SEQ ID NO: 7571140 - DNA, 22 bp, Homo sapiens
agccccaggatgggccgcagga

SEQ ID NO: 7571141 - DNA, 22 bp, Homo sapiens
agccccagcccctctctcacaa

SEQ ID NO: 7571142 - DNA, 22 bp, Homo sapiens
agccccagcccctctctcacaa

SEQ ID NO: 7571143 - DNA, 22 bp, Homo sapiens
agccccaggatgggccgcagga

SEQ ID NO: 7571144 - DNA, 22 bp, Homo sapiens
agccccaggatgggccgcagga

SEQ ID NO: 7571145 - DNA, 22 bp, Homo sapiens
agccccaggatgggccgcagga

SEQ ID NO: 7571146 - DNA, 22 bp, Homo sapiens
agccccaggatgggccgcagga

SEQ ID NO: 7571147 - DNA, 22 bp, Homo sapiens
agccccaggatgggccgcagga

SEQ ID NO: 7571148 - DNA, 22 bp, Homo sapiens
agccccacgttgtctagcacct

SEQ ID NO: 7571149 - DNA, 22 bp, Homo sapiens
agccccacgttgtctagcacct

SEQ ID NO: 7571150 - DNA, 22 bp, Homo sapiens
agccccacgttgtctagcacct

SEQ ID NO: 7571151 - DNA, 22 bp, Homo sapiens
agccccagcccctctctcacaa

SEQ ID NO: 7571152 - DNA, 22 bp, Homo sapiens
agccccagcccctctctcacaa

SEQ ID NO: 7571153 - DNA, 22 bp, Homo sapiens
agccccagcccctctctcacaa

SEQ ID NO: 7571154 - DNA, 22 bp, Homo sapiens
agccccacgttgtctagcacct

SEQ ID NO: 7571155 - DNA, 22 bp, Homo sapiens
agccccagcccctctctcacaa

SEQ ID NO: 7571156 - DNA, 22 bp, Homo sapiens
agccccagcccctctctcacaa

SEQ ID NO: 7571157 - DNA, 22 bp, Homo sapiens
agccccagcccctctctcacaa

SEQ ID NO: 7571158 - DNA, 22 bp, Homo sapiens
agccccagttccctggaagtct

SEQ ID NO: 7571159 - DNA, 22 bp, Homo sapiens
agcccccaaaagtgcttatgat

SEQ ID NO: 7571160 - DNA, 22 bp, Homo sapiens
agccccagttccctggaagtct

SEQ ID NO: 7571161 - DNA, 22 bp, Homo sapiens
agccccagttccctggaagtct

SEQ ID NO: 7571162 - DNA, 22 bp, Homo sapiens
agccccagtccgctgcgggcgg

SEQ ID NO: 7571163 - DNA, 22 bp, Homo sapiens
agccccagttccctggaagtct

SEQ ID NO: 7571164 - DNA, 22 bp, Homo sapiens
agccccagttccctggaagtct

SEQ ID NO: 7571165 - DNA, 22 bp, Homo sapiens
agccccagttccctggaagtct

SEQ ID NO: 7571166 - DNA, 22 bp, Homo sapiens
agccccagttccctggaagtct

SEQ ID NO: 7571167 - DNA, 22 bp, Homo sapiens
agcccccacgtttcctgggtcc

SEQ ID NO: 7571168 - DNA, 22 bp, Homo sapiens
agcccccacgtttcctgggtcc

SEQ ID NO: 7571169 - DNA, 22 bp, Homo sapiens
agcccccaaaagtgcttatgat

SEQ ID NO: 7571170 - DNA, 22 bp, Homo sapiens
agcccccaaaagtgcttatgat

SEQ ID NO: 7571171 - DNA, 22 bp, Homo sapiens
agccctgagctggcctgggctt

SEQ ID NO: 7571172 - DNA, 22 bp, Homo sapiens
agccctgagctggcctgggctt

SEQ ID NO: 7571173 - DNA, 17 bp, Homo sapiens
agcccccactcccaagt

SEQ ID NO: 7571174 - DNA, 17 bp, Homo sapiens
agcccccactcccaagt

SEQ ID NO: 7571175 - DNA, 17 bp, Homo sapiens
agcccccactcccaagt

SEQ ID NO: 7571176 - DNA, 23 bp, Homo sapiens
agccctgctgagacccagctccc

SEQ ID NO: 7571177 - DNA, 23 bp, Homo sapiens
agccctgctgagacccagctccc

SEQ ID NO: 7571178 - DNA, 23 bp, Homo sapiens
agccctgctgagacccagctccc

SEQ ID NO: 7571179 - DNA, 23 bp, Homo sapiens
agccctgctgagacccagctccc

SEQ ID NO: 7571180 - DNA, 22 bp, Homo sapiens
agccctgctgcctgaattagct

SEQ ID NO: 7571181 - DNA, 22 bp, Homo sapiens
agccctgctcatctggatcccg

SEQ ID NO: 7571182 - DNA, 22 bp, Homo sapiens
agccctgctcatctggatcccg

SEQ ID NO: 7571183 - DNA, 23 bp, Homo sapiens
agccctgctgagacccagctccc

SEQ ID NO: 7571184 - DNA, 22 bp, Homo sapiens
agccctgattaaccttggcttt

SEQ ID NO: 7571185 - DNA, 22 bp, Homo sapiens
agccctgagctggcctgggctt

SEQ ID NO: 7571186 - DNA, 22 bp, Homo sapiens
agccctgcgtgccaggggactg

SEQ ID NO: 7571187 - DNA, 22 bp, Homo sapiens
agccctgattaaccttggcttt

SEQ ID NO: 7571188 - DNA, 22 bp, Homo sapiens
agccctgcgtgccaggggactg

SEQ ID NO: 7571189 - DNA, 22 bp, Homo sapiens
agccctggcagagccaggtagt

SEQ ID NO: 7571190 - DNA, 22 bp, Homo sapiens
agccctggcagagccaggtagt

SEQ ID NO: 7571191 - DNA, 22 bp, Homo sapiens
agccctggcagagccaggtagt

SEQ ID NO: 7571192 - DNA, 22 bp, Homo sapiens
agccctggcagagccaggtagt

SEQ ID NO: 7571193 - DNA, 22 bp, Homo sapiens
agccctggcagagccaggtagt

SEQ ID NO: 7571194 - DNA, 22 bp, Homo sapiens
agccctggcagagccaggtagt

SEQ ID NO: 7571195 - DNA, 22 bp, Homo sapiens
agccctggcagagccaggtagt

SEQ ID NO: 7571196 - DNA, 22 bp, Homo sapiens
agccctggcagagccaggtagt

SEQ ID NO: 7571197 - DNA, 22 bp, Homo sapiens
agccctggattctgaggtccaa

SEQ ID NO: 7571198 - DNA, 22 bp, Homo sapiens
agccctggattctgaggtccaa

SEQ ID NO: 7571199 - DNA, 22 bp, Homo sapiens
agccctggattctgaggtccaa

SEQ ID NO: 7571200 - DNA, 22 bp, Homo sapiens
agccctggattctgaggtccaa

SEQ ID NO: 7571201 - DNA, 22 bp, Homo sapiens
agccctggagcaaaggtgtctt

SEQ ID NO: 7571202 - DNA, 22 bp, Homo sapiens
agccctggatggacagtttccc

SEQ ID NO: 7571203 - DNA, 22 bp, Homo sapiens
agccctggatggacagtttccc

SEQ ID NO: 7571204 - DNA, 22 bp, Homo sapiens
agccctggatggacagtttccc

SEQ ID NO: 7571205 - DNA, 22 bp, Homo sapiens
agccctggattctgaggtccaa

SEQ ID NO: 7571206 - DNA, 22 bp, Homo sapiens
agccctggatggacagtttccc

SEQ ID NO: 7571207 - DNA, 22 bp, Homo sapiens
agccctgcttcaccatttactt

SEQ ID NO: 7571208 - DNA, 22 bp, Homo sapiens
agccctggaagccacagtccta

SEQ ID NO: 7571209 - DNA, 22 bp, Homo sapiens
agccctggaagccacagtccta

SEQ ID NO: 7571210 - DNA, 22 bp, Homo sapiens
agccctggaagccacagtccta

SEQ ID NO: 7571211 - DNA, 22 bp, Homo sapiens
agccctggaccttagcccccac

SEQ ID NO: 7571212 - DNA, 22 bp, Homo sapiens
agccctggaagccacagtccta

SEQ ID NO: 7571213 - DNA, 22 bp, Homo sapiens
agccctggaagccacagtccta

SEQ ID NO: 7571214 - DNA, 22 bp, Homo sapiens
agccctggaagccacagtccta

SEQ ID NO: 7571215 - DNA, 22 bp, Homo sapiens
agccctggaagccacagtccta

SEQ ID NO: 7571216 - DNA, 22 bp, Homo sapiens
agccctggaagccacagtccta

SEQ ID NO: 7571217 - DNA, 22 bp, Homo sapiens
agccctggagcaaaggtgtctt

SEQ ID NO: 7571218 - DNA, 22 bp, Homo sapiens
agccctggagcaaaggtgtctt

SEQ ID NO: 7571219 - DNA, 22 bp, Homo sapiens
agccctggagcaaaggtgtctt

SEQ ID NO: 7571220 - DNA, 22 bp, Homo sapiens
agccctggagcaaaggtgtctt

SEQ ID NO: 7571221 - DNA, 22 bp, Homo sapiens
agccctggagcaaaggtgtctt

SEQ ID NO: 7571222 - DNA, 22 bp, Homo sapiens
agccctggaccttagcccccac

SEQ ID NO: 7571223 - DNA, 22 bp, Homo sapiens
agccctggagcaaaggtgtctt

SEQ ID NO: 7571224 - DNA, 22 bp, Homo sapiens
agccctggagcaaaggtgtctt

SEQ ID NO: 7571225 - DNA, 22 bp, Homo sapiens
agccctggaccttagcccccac

SEQ ID NO: 7571226 - DNA, 22 bp, Homo sapiens
agccctggaccttagcccccac

SEQ ID NO: 7571227 - DNA, 22 bp, Homo sapiens
agccctggaccttagcccccac

SEQ ID NO: 7571228 - DNA, 19 bp, Homo sapiens
cagatggccacctacttgc

SEQ ID NO: 7571229 - DNA, 22 bp, Homo sapiens
cagatggcatttcctttctggc

SEQ ID NO: 7571230 - DNA, 22 bp, Homo sapiens
cagatggcagggcagctctgca

SEQ ID NO: 7571231 - DNA, 22 bp, Homo sapiens
cagatggcatttcctttctggc

SEQ ID NO: 7571232 - DNA, 22 bp, Homo sapiens
cagatggcagggcagctctgca

SEQ ID NO: 7571233 - DNA, 20 bp, Homo sapiens
cagatggcacgtcagggcat

SEQ ID NO: 7571234 - DNA, 22 bp, Homo sapiens
cagatggcagggcagctctgca

SEQ ID NO: 7571235 - DNA, 22 bp, Homo sapiens
cagatggccagaggcagctgca

SEQ ID NO: 7571236 - DNA, 22 bp, Homo sapiens
cagatggctgccaagatgggct

SEQ ID NO: 7571237 - DNA, 22 bp, Homo sapiens
cagatggctgccaagatgggct

SEQ ID NO: 7571238 - DNA, 20 bp, Homo sapiens
cagatgggacgtggaggagt

SEQ ID NO: 7571239 - DNA, 22 bp, Homo sapiens
cagatggctgccttcttgctgt

SEQ ID NO: 7571240 - DNA, 22 bp, Homo sapiens
agccctgggcgttactgggatg

SEQ ID NO: 7571241 - DNA, 22 bp, Homo sapiens
agccctgggcgttactgggatg

SEQ ID NO: 7571242 - DNA, 22 bp, Homo sapiens
agccctgggctgtagataagca

SEQ ID NO: 7571243 - DNA, 20 bp, Homo sapiens
cagatggcacgtcagggcat

SEQ ID NO: 7571244 - DNA, 22 bp, Homo sapiens
cagatgaaggcctgaatgtcta

SEQ ID NO: 7571245 - DNA, 22 bp, Homo sapiens
cagatgaagtaggtgacgagca

SEQ ID NO: 7571246 - DNA, 22 bp, Homo sapiens
cagatgaaggcctgaatgtcta

SEQ ID NO: 7571247 - DNA, 22 bp, Homo sapiens
cagatgaagatcatagaatagt

SEQ ID NO: 7571248 - DNA, 22 bp, Homo sapiens
agccctgggcgttactgggatg

SEQ ID NO: 7571249 - DNA, 22 bp, Homo sapiens
agccctgggcgttactgggatg

SEQ ID NO: 7571250 - DNA, 22 bp, Homo sapiens
agccctgggcgttactgggatg

SEQ ID NO: 7571251 - DNA, 22 bp, Homo sapiens
agccctgggcgttactgggatg

SEQ ID NO: 7571252 - DNA, 22 bp, Homo sapiens
agccctgggcagccaaggaagc

SEQ ID NO: 7571253 - DNA, 22 bp, Homo sapiens
agccctgggcagccaaggaagc

SEQ ID NO: 7571254 - DNA, 22 bp, Homo sapiens
agccctgggcagccaaggaagc

SEQ ID NO: 7571255 - DNA, 22 bp, Homo sapiens
agccctgggcagccaaggaagc

SEQ ID NO: 7571256 - DNA, 22 bp, Homo sapiens
agccctggctcccagcagcgct

SEQ ID NO: 7571257 - DNA, 22 bp, Homo sapiens
agccctggcccggctgtgcttt

SEQ ID NO: 7571258 - DNA, 22 bp, Homo sapiens
agccctggcccggctgtgcttt

SEQ ID NO: 7571259 - DNA, 22 bp, Homo sapiens
agccctggctcccagcagcgct

SEQ ID NO: 7571260 - DNA, 22 bp, Homo sapiens
agccctggctcccagcagcgct

SEQ ID NO: 7571261 - DNA, 22 bp, Homo sapiens
agccctggctcccagcagcgct

SEQ ID NO: 7571262 - DNA, 22 bp, Homo sapiens
agccctggctcccagcagcgct

SEQ ID NO: 7571263 - DNA, 22 bp, Homo sapiens
agccctggctcccagcagcgct

SEQ ID NO: 7571264 - DNA, 22 bp, Homo sapiens
agccctggctcccagcagcgct

SEQ ID NO: 7571265 - DNA, 22 bp, Homo sapiens
agccctggcccggctgtgcttt

SEQ ID NO: 7571266 - DNA, 22 bp, Homo sapiens
agccctggcccggctgtgcttt

SEQ ID NO: 7571267 - DNA, 22 bp, Homo sapiens
agccctggcccggctgtgcttt

SEQ ID NO: 7571268 - DNA, 22 bp, Homo sapiens
agccctggcccggctgtgcttt

SEQ ID NO: 7571269 - DNA, 22 bp, Homo sapiens
agccctggcccggctgtgcttt

SEQ ID NO: 7571270 - DNA, 22 bp, Homo sapiens
agccctggcccggctgtgcttt

SEQ ID NO: 7571271 - DNA, 22 bp, Homo sapiens
agccctggcccggctgtgcttt

SEQ ID NO: 7571272 - DNA, 22 bp, Homo sapiens
agccctggcccggctgtgcttt

SEQ ID NO: 7571273 - DNA, 22 bp, Homo sapiens
agccctggcccggctgtgcttt

SEQ ID NO: 7571274 - DNA, 22 bp, Homo sapiens
agccctggcccggctgtgcttt

SEQ ID NO: 7571275 - DNA, 22 bp, Homo sapiens
agccctgggcacctgtgagggg

SEQ ID NO: 7571276 - DNA, 22 bp, Homo sapiens
agccctgggcacctgtgagggg

SEQ ID NO: 7571277 - DNA, 22 bp, Homo sapiens
agccctgggcacctgtgagggg

SEQ ID NO: 7571278 - DNA, 22 bp, Homo sapiens
agccctgggatacagtaaaagc

SEQ ID NO: 7571279 - DNA, 22 bp, Homo sapiens
agccctgggaggccagcttgta

SEQ ID NO: 7571280 - DNA, 22 bp, Homo sapiens
agccctgggaggccagcttgta

SEQ ID NO: 7571281 - DNA, 22 bp, Homo sapiens
agccctgggatacagtaaaagc

SEQ ID NO: 7571282 - DNA, 22 bp, Homo sapiens
agccctgggatacagtaaaagc

SEQ ID NO: 7571283 - DNA, 22 bp, Homo sapiens
agccctgggatacagtaaaagc

SEQ ID NO: 7571284 - DNA, 22 bp, Homo sapiens
agccctgggcacctgtgagggg

SEQ ID NO: 7571285 - DNA, 22 bp, Homo sapiens
agccctgggcacctgtgagggg

SEQ ID NO: 7571286 - DNA, 22 bp, Homo sapiens
agccctgggaggccagcttgta

SEQ ID NO: 7571287 - DNA, 22 bp, Homo sapiens
agccctgggaggccagcttgta

SEQ ID NO: 7571288 - DNA, 22 bp, Homo sapiens
agccctgggaggccagcttgta

SEQ ID NO: 7571289 - DNA, 22 bp, Homo sapiens
agccctgggaggccagcttgta

SEQ ID NO: 7571290 - DNA, 22 bp, Homo sapiens
agccctgggaggccagcttgta

SEQ ID NO: 7571291 - DNA, 22 bp, Homo sapiens
agccctgggagattttctgggt

SEQ ID NO: 7571292 - DNA, 22 bp, Homo sapiens
agccctgggaggccagcttgta

SEQ ID NO: 7571293 - DNA, 22 bp, Homo sapiens
agccctgggaggccagcttgta

SEQ ID NO: 7571294 - DNA, 22 bp, Homo sapiens
agccctgggagattttctgggt

SEQ ID NO: 7571295 - DNA, 22 bp, Homo sapiens
agccctgggaggccagcttgta

SEQ ID NO: 7571296 - DNA, 22 bp, Homo sapiens
agccctggctcccagcagcgct

SEQ ID NO: 7571297 - DNA, 22 bp, Homo sapiens
agccctgggagattttctgggt

SEQ ID NO: 7571298 - DNA, 22 bp, Homo sapiens
agccctggctcccagcagcgct

SEQ ID NO: 7571299 - DNA, 22 bp, Homo sapiens
agctctttgctggcagtaggct

SEQ ID NO: 7571300 - DNA, 22 bp, Homo sapiens
agctctttgctggcagtaggct

SEQ ID NO: 7571301 - DNA, 19 bp, Homo sapiens
agctctttgctgcattcca

SEQ ID NO: 7571302 - DNA, 19 bp, Homo sapiens
agctctttgctgcattcca

SEQ ID NO: 7571303 - DNA, 19 bp, Homo sapiens
agctctttgctgcattcca

SEQ ID NO: 7571304 - DNA, 22 bp, Homo sapiens
agctctttggcactgagcagca

SEQ ID NO: 7571305 - DNA, 22 bp, Homo sapiens
agctctttggcactgagcagca

SEQ ID NO: 7571306 - DNA, 22 bp, Homo sapiens
agctctttggaaggtgtgcact

SEQ ID NO: 7571307 - DNA, 22 bp, Homo sapiens
agctctttggaaggtgtgcact

SEQ ID NO: 7571308 - DNA, 22 bp, Homo sapiens
agctctttgagaaggcagtgtg

SEQ ID NO: 7571309 - DNA, 22 bp, Homo sapiens
agctctttgagaaggcagtgtg

SEQ ID NO: 7571310 - DNA, 22 bp, Homo sapiens
agctctttgactaatcttgctt

SEQ ID NO: 7571311 - DNA, 22 bp, Homo sapiens
agctctttgagcaaggcagctc

SEQ ID NO: 7571312 - DNA, 22 bp, Homo sapiens
agctctttgagcaaggcagctc

SEQ ID NO: 7571313 - DNA, 22 bp, Homo sapiens
agctctttctacaagcaggcag

SEQ ID NO: 7571314 - DNA, 22 bp, Homo sapiens
agctctttcccctccctatggc

SEQ ID NO: 7571315 - DNA, 22 bp, Homo sapiens
agctctttctacaagcaggcag

SEQ ID NO: 7571316 - DNA, 22 bp, Homo sapiens
agctctttatgggtaaatgcca

SEQ ID NO: 7571317 - DNA, 22 bp, Homo sapiens
agctctttatgggtaaatgcca

SEQ ID NO: 7571318 - DNA, 15 bp, Homo sapiens
agctctttcagctac

SEQ ID NO: 7571319 - DNA, 22 bp, Homo sapiens
agctctttatgtggaagaggca

SEQ ID NO: 7571320 - DNA, 22 bp, Homo sapiens
agctcttcctgcacctgtggct

SEQ ID NO: 7571321 - DNA, 22 bp, Homo sapiens
agctctttaatcttagccccag

SEQ ID NO: 7571322 - DNA, 22 bp, Homo sapiens
agctctttagagtctcccttct

SEQ ID NO: 7571323 - DNA, 22 bp, Homo sapiens
agctctttacacagagtccctc

SEQ ID NO: 7571324 - DNA, 22 bp, Homo sapiens
agctcttacatttaggtctatg

SEQ ID NO: 7571325 - DNA, 22 bp, Homo sapiens
agctcttacatttaggtctatg

SEQ ID NO: 7571326 - DNA, 22 bp, Homo sapiens
agctcttacatttaggtctatg

SEQ ID NO: 7571327 - DNA, 22 bp, Homo sapiens
agctcttacatttaggtctatg

SEQ ID NO: 7571328 - DNA, 20 bp, Homo sapiens
agctcttactttgcagcagc

SEQ ID NO: 7571329 - DNA, 22 bp, Homo sapiens
agctcttccacctcatgatggg

SEQ ID NO: 7571330 - DNA, 22 bp, Homo sapiens
agctcttccacctcatgatggg

SEQ ID NO: 7571331 - DNA, 22 bp, Homo sapiens
agctcttcctgcacctgtggct

SEQ ID NO: 7571332 - DNA, 19 bp, Homo sapiens
agctctgtcaggctacata

SEQ ID NO: 7571333 - DNA, 22 bp, Homo sapiens
agctctgtctttctcttagtaa

SEQ ID NO: 7571334 - DNA, 22 bp, Homo sapiens
agctctgtctttctcttagtaa

SEQ ID NO: 7571335 - DNA, 22 bp, Homo sapiens
agctctggtttagaaggggaaa

SEQ ID NO: 7571336 - DNA, 22 bp, Homo sapiens
agctctggtttagaaggggaaa

SEQ ID NO: 7571337 - DNA, 22 bp, Homo sapiens
agctctgggccaggaaccctaa

SEQ ID NO: 7571338 - DNA, 22 bp, Homo sapiens
agctctgggccaggaaccctaa

SEQ ID NO: 7571339 - DNA, 22 bp, Homo sapiens
agctctggtttagaaggggaaa

SEQ ID NO: 7571340 - DNA, 22 bp, Homo sapiens
agctctggttattgaagcaggg

SEQ ID NO: 7571341 - DNA, 22 bp, Homo sapiens
agctctggtttagaaggggaaa

SEQ ID NO: 7571342 - DNA, 22 bp, Homo sapiens
agctctggtttagaaggggaaa

SEQ ID NO: 7571343 - DNA, 22 bp, Homo sapiens
agctctggtttagaaggggaaa

SEQ ID NO: 7571344 - DNA, 22 bp, Homo sapiens
agctctgtgttcacagcactaa

SEQ ID NO: 7571345 - DNA, 22 bp, Homo sapiens
agctctgtggccttgggtgaat

SEQ ID NO: 7571346 - DNA, 22 bp, Homo sapiens
agctctgtgttcacagcactaa

SEQ ID NO: 7571347 - DNA, 22 bp, Homo sapiens
agctctgtgttcacagcactaa

SEQ ID NO: 7571348 - DNA, 22 bp, Homo sapiens
agctctgttactgattttcctg

SEQ ID NO: 7571349 - DNA, 22 bp, Homo sapiens
agctctgttactgattttcctg

SEQ ID NO: 7571350 - DNA, 20 bp, Homo sapiens
agctcttaagaagaagatga

SEQ ID NO: 7571351 - DNA, 22 bp, Homo sapiens
agctctgtgaagccagcagttc

SEQ ID NO: 7571352 - DNA, 22 bp, Homo sapiens
agctctgtgaagccagcagttc

SEQ ID NO: 7571353 - DNA, 22 bp, Homo sapiens
agctctgtgcaggcagaggcat

SEQ ID NO: 7571354 - DNA, 22 bp, Homo sapiens
agctctgtggccttgggtgaat

SEQ ID NO: 7571355 - DNA, 22 bp, Homo sapiens
agctcctgtggcagctcttctg

SEQ ID NO: 7571356 - DNA, 22 bp, Homo sapiens
agctcctgtggctgaaagagga

SEQ ID NO: 7571357 - DNA, 22 bp, Homo sapiens
agctcctgtgtgaagcctccct

SEQ ID NO: 7571358 - DNA, 22 bp, Homo sapiens
agctcctgtgtgaagcctccct

SEQ ID NO: 7571359 - DNA, 22 bp, Homo sapiens
agctcctgtgtgaagcctccct

SEQ ID NO: 7571360 - DNA, 22 bp, Homo sapiens
agctcctgtggctgaaagagga

SEQ ID NO: 7571361 - DNA, 22 bp, Homo sapiens
agctcctgtggctgaaagagga

SEQ ID NO: 7571362 - DNA, 22 bp, Homo sapiens
agctcctgtgtgaagcctccct

SEQ ID NO: 7571363 - DNA, 22 bp, Homo sapiens
agctctgggccaggaaccctaa

SEQ ID NO: 7571364 - DNA, 22 bp, Homo sapiens
agctctgggattctcaggccac

SEQ ID NO: 7571365 - DNA, 22 bp, Homo sapiens
agctcctgtggcagctcttctg

SEQ ID NO: 7571366 - DNA, 22 bp, Homo sapiens
agctcctgtggcagctcttctg

SEQ ID NO: 7571367 - DNA, 22 bp, Homo sapiens
agctcctgtggcagctcttctg

SEQ ID NO: 7571368 - DNA, 22 bp, Homo sapiens
agctcctgtctcaagggagcct

SEQ ID NO: 7571369 - DNA, 22 bp, Homo sapiens
agctcctgtctcaagggagcct

SEQ ID NO: 7571370 - DNA, 22 bp, Homo sapiens
agctcctgtctcaagggagcct

SEQ ID NO: 7571371 - DNA, 22 bp, Homo sapiens
agctcctgtggcagctcttctg

SEQ ID NO: 7571372 - DNA, 22 bp, Homo sapiens
agctcctgtggcagctcttctg

SEQ ID NO: 7571373 - DNA, 22 bp, Homo sapiens
agctcctgtggcagctcttctg

SEQ ID NO: 7571374 - DNA, 22 bp, Homo sapiens
agctcctggtgcctcagccgaa

SEQ ID NO: 7571375 - DNA, 22 bp, Homo sapiens
agctcctggtgcctcagccgaa

SEQ ID NO: 7571376 - DNA, 22 bp, Homo sapiens
agctcctggtgcctcagccgaa

SEQ ID NO: 7571377 - DNA, 23 bp, Homo sapiens
agctcctgtaaggtggtcgtcac

SEQ ID NO: 7571378 - DNA, 23 bp, Homo sapiens
agctcctgtaaggtggtcgtcac

SEQ ID NO: 7571379 - DNA, 22 bp, Homo sapiens
agctcctggtctttgtccagag

SEQ ID NO: 7571380 - DNA, 22 bp, Homo sapiens
agctcctggtctttgtccagag

SEQ ID NO: 7571381 - DNA, 22 bp, Homo sapiens
agctcctggtctttgtccagag

SEQ ID NO: 7571382 - DNA, 22 bp, Homo sapiens
agctcctggtctttgtccagag

SEQ ID NO: 7571383 - DNA, 22 bp, Homo sapiens
agctcctgtctcaagggagcct

SEQ ID NO: 7571384 - DNA, 22 bp, Homo sapiens
agctcctgtagtacatattatt

SEQ ID NO: 7571385 - DNA, 23 bp, Homo sapiens
agctcctgtaaggtggtcgtcac

SEQ ID NO: 7571386 - DNA, 22 bp, Homo sapiens
agctcctgtctcaagggagcct

SEQ ID NO: 7571387 - DNA, 22 bp, Homo sapiens
agctcctgtctcaagggagcct

SEQ ID NO: 7571388 - DNA, 22 bp, Homo sapiens
agctcctgtctcaagggagcct

SEQ ID NO: 7571389 - DNA, 22 bp, Homo sapiens
agctcctgtctcaagggagcct

SEQ ID NO: 7571390 - DNA, 22 bp, Homo sapiens
agctcctgtctcaagggagcct

SEQ ID NO: 7571391 - DNA, 22 bp, Homo sapiens
agctcctgtctcaagggagcct

SEQ ID NO: 7571392 - DNA, 22 bp, Homo sapiens
agctcctgtctcaagggagcct

SEQ ID NO: 7571393 - DNA, 22 bp, Homo sapiens
agctcctgtctcaagggagcct

SEQ ID NO: 7571394 - DNA, 17 bp, Homo sapiens
agctcctggggtcttta

SEQ ID NO: 7571395 - DNA, 20 bp, Homo sapiens
agctcctggtataggtgcct

SEQ ID NO: 7571396 - DNA, 20 bp, Homo sapiens
agctcctggtataggtgcct

SEQ ID NO: 7571397 - DNA, 20 bp, Homo sapiens
agctcctggtataggtgcct

SEQ ID NO: 7571398 - DNA, 17 bp, Homo sapiens
agctcctggggtcttta

SEQ ID NO: 7571399 - DNA, 17 bp, Homo sapiens
agctcctggggtcttta

SEQ ID NO: 7571400 - DNA, 22 bp, Homo sapiens
agctcctgggggttccaagcag

SEQ ID NO: 7571401 - DNA, 22 bp, Homo sapiens
agctcctgggggttccaagcag

SEQ ID NO: 7571402 - DNA, 22 bp, Homo sapiens
agctcctgggggttccaagcag

SEQ ID NO: 7571403 - DNA, 22 bp, Homo sapiens
agctcctgggggttccaagcag

SEQ ID NO: 7571404 - DNA, 18 bp, Homo sapiens
agctcctggtctcaggga

SEQ ID NO: 7571405 - DNA, 18 bp, Homo sapiens
agctcctggtctcaggga

SEQ ID NO: 7571406 - DNA, 18 bp, Homo sapiens
agctcctggtctcaggga

SEQ ID NO: 7571407 - DNA, 18 bp, Homo sapiens
agctcctggtctcaggga

SEQ ID NO: 7571408 - DNA, 20 bp, Homo sapiens
agctcctggtataggtgcct

SEQ ID NO: 7571409 - DNA, 18 bp, Homo sapiens
agctcctggtctcaggga

SEQ ID NO: 7571410 - DNA, 18 bp, Homo sapiens
agctcctggtctcaggga

SEQ ID NO: 7571411 - DNA, 18 bp, Homo sapiens
agctcctggtctcaggga

SEQ ID NO: 7571412 - DNA, 18 bp, Homo sapiens
agctcctggtctcaggga

SEQ ID NO: 7571413 - DNA, 18 bp, Homo sapiens
agctcctggtctcaggga

SEQ ID NO: 7571414 - DNA, 22 bp, Homo sapiens
agctcctggcaaggtcatggtg

SEQ ID NO: 7571415 - DNA, 22 bp, Homo sapiens
agctcctggcaaggtcatggtg

SEQ ID NO: 7571416 - DNA, 22 bp, Homo sapiens
agctcctggcaaggtcatggtg

SEQ ID NO: 7571417 - DNA, 22 bp, Homo sapiens
agctcctggcaaggtcatggtg

SEQ ID NO: 7571418 - DNA, 22 bp, Homo sapiens
agctcctggatgaggcttatgt

SEQ ID NO: 7571419 - DNA, 22 bp, Homo sapiens
agctcctggcaaggtcatggtg

SEQ ID NO: 7571420 - DNA, 22 bp, Homo sapiens
agctcctggcaaggtcatggtg

SEQ ID NO: 7571421 - DNA, 22 bp, Homo sapiens
agctcctggctttcctctcacc

SEQ ID NO: 7571422 - DNA, 22 bp, Homo sapiens
agctcctgggagcaggtggtac

SEQ ID NO: 7571423 - DNA, 22 bp, Homo sapiens
agctcctgggagcaggtggtac

SEQ ID NO: 7571424 - DNA, 22 bp, Homo sapiens
agctcctggctttcctctcacc

SEQ ID NO: 7571425 - DNA, 22 bp, Homo sapiens
agctcctggctttcctctcacc

SEQ ID NO: 7571426 - DNA, 22 bp, Homo sapiens
agctcctggctttcctctcacc

SEQ ID NO: 7571427 - DNA, 22 bp, Homo sapiens
agctcctggctttcctctcacc

SEQ ID NO: 7571428 - DNA, 22 bp, Homo sapiens
agctcctggctttcctctcacc

SEQ ID NO: 7571429 - DNA, 19 bp, Homo sapiens
agctcctgggctctgggcc

SEQ ID NO: 7571430 - DNA, 19 bp, Homo sapiens
agctcctgggctctgggcc

SEQ ID NO: 7571431 - DNA, 19 bp, Homo sapiens
agctcctgggctctgggcc

SEQ ID NO: 7571432 - DNA, 19 bp, Homo sapiens
agctcctgggctctgggcc

SEQ ID NO: 7571433 - DNA, 19 bp, Homo sapiens
agctcctgggctctgggcc

SEQ ID NO: 7571434 - DNA, 19 bp, Homo sapiens
agctcctgggctctgggcc

SEQ ID NO: 7571435 - DNA, 19 bp, Homo sapiens
agctcctgggctctgggcc

SEQ ID NO: 7571436 - DNA, 19 bp, Homo sapiens
agctcctgggctctgggcc

SEQ ID NO: 7571437 - DNA, 19 bp, Homo sapiens
agctcctgggctctgggcc

SEQ ID NO: 7571438 - DNA, 22 bp, Homo sapiens
agctcctgggccatcacaacca

SEQ ID NO: 7571439 - DNA, 22 bp, Homo sapiens
agctcctgggccaagcccatgc

SEQ ID NO: 7571440 - DNA, 22 bp, Homo sapiens
agctcctgggcacctctttcac

SEQ ID NO: 7571441 - DNA, 22 bp, Homo sapiens
agctcctgggcacctctttcac

SEQ ID NO: 7571442 - DNA, 22 bp, Homo sapiens
agctcctgggccaagcccatgc

SEQ ID NO: 7571443 - DNA, 22 bp, Homo sapiens
agctcctgggccaagcccatgc

SEQ ID NO: 7571444 - DNA, 22 bp, Homo sapiens
agctcctgggcacctctttcac

SEQ ID NO: 7571445 - DNA, 22 bp, Homo sapiens
agctaggaaattgaggctgaga

SEQ ID NO: 7571446 - DNA, 22 bp, Homo sapiens
agctaggacaggtagagatggg

SEQ ID NO: 7571447 - DNA, 22 bp, Homo sapiens
agctaggacaggtagagatggg

SEQ ID NO: 7571448 - DNA, 22 bp, Homo sapiens
agctaggaaattgaggctgaga

SEQ ID NO: 7571449 - DNA, 22 bp, Homo sapiens
agctaggaaattgaggctgaga

SEQ ID NO: 7571450 - DNA, 22 bp, Homo sapiens
agctaggaaattgaggctgaga

SEQ ID NO: 7571451 - DNA, 22 bp, Homo sapiens
agctaggacaggtagagatggg

SEQ ID NO: 7571452 - DNA, 22 bp, Homo sapiens
agctaggaaattgaggctgaga

SEQ ID NO: 7571453 - DNA, 22 bp, Homo sapiens
agctaggacaggtagagatggg

SEQ ID NO: 7571454 - DNA, 20 bp, Homo sapiens
agctaggagaaagcatggag

SEQ ID NO: 7571455 - DNA, 22 bp, Homo sapiens
agctagaggtgaaacatgccaa

SEQ ID NO: 7571456 - DNA, 22 bp, Homo sapiens
agctagcaaatagcatgtagga

SEQ ID NO: 7571457 - DNA, 22 bp, Homo sapiens
agctagcaaatagcatgtagga

SEQ ID NO: 7571458 - DNA, 22 bp, Homo sapiens
agctagcaaatagcatgtagga

SEQ ID NO: 7571459 - DNA, 22 bp, Homo sapiens
agctagcaaatagcatgtagga

SEQ ID NO: 7571460 - DNA, 22 bp, Homo sapiens
agctagccatgtggctcctgtg

SEQ ID NO: 7571461 - DNA, 22 bp, Homo sapiens
agctagcagttttgtggtttgg

SEQ ID NO: 7571462 - DNA, 23 bp, Homo sapiens
agctagcataatgtctggctcct

SEQ ID NO: 7571463 - DNA, 22 bp, Homo sapiens
agctagcttagcctgtgaggta

SEQ ID NO: 7571464 - DNA, 22 bp, Homo sapiens
agctagcttagcctgtgaggta

SEQ ID NO: 7571465 - DNA, 22 bp, Homo sapiens
agctagctttaactcttagaca

SEQ ID NO: 7571466 - DNA, 22 bp, Homo sapiens
agctagcctaggcagagtgcat

SEQ ID NO: 7571467 - DNA, 22 bp, Homo sapiens
agctagccatgtggctcctgtg

SEQ ID NO: 7571468 - DNA, 23 bp, Homo sapiens
agctccagaacatagcacaggaa

SEQ ID NO: 7571469 - DNA, 23 bp, Homo sapiens
agctccagaacatagcacaggaa

SEQ ID NO: 7571470 - DNA, 23 bp, Homo sapiens
agctccagaacatagcacaggaa

SEQ ID NO: 7571471 - DNA, 23 bp, Homo sapiens
agctccagaacatagcacaggaa

SEQ ID NO: 7571472 - DNA, 23 bp, Homo sapiens
agctccagaacatagcacaggaa

SEQ ID NO: 7571473 - DNA, 23 bp, Homo sapiens
agctccagaacatagcacaggaa

SEQ ID NO: 7571474 - DNA, 23 bp, Homo sapiens
agctccagaacatagcacaggaa

SEQ ID NO: 7571475 - DNA, 22 bp, Homo sapiens
agctccagaaaggtacacacag

SEQ ID NO: 7571476 - DNA, 19 bp, Homo sapiens
agctcaggcccatcgtccc

SEQ ID NO: 7571477 - DNA, 23 bp, Homo sapiens
agctccagaacatagcacaggaa

SEQ ID NO: 7571478 - DNA, 23 bp, Homo sapiens
agctccagaacatagcacaggaa

SEQ ID NO: 7571479 - DNA, 23 bp, Homo sapiens
agctccagaacatagcacaggaa

SEQ ID NO: 7571480 - DNA, 23 bp, Homo sapiens
agctccagaacatagcacaggaa

SEQ ID NO: 7571481 - DNA, 20 bp, Homo sapiens
agctaggagaaagcatggag

SEQ ID NO: 7571482 - DNA, 20 bp, Homo sapiens
agctaggagaaagcatggag

SEQ ID NO: 7571483 - DNA, 20 bp, Homo sapiens
agctaggagaaagcatggag

SEQ ID NO: 7571484 - DNA, 22 bp, Homo sapiens
agctcaggccggagctacaggc

SEQ ID NO: 7571485 - DNA, 19 bp, Homo sapiens
agctcaggcccatcgtccc

SEQ ID NO: 7571486 - DNA, 22 bp, Homo sapiens
agctcaggcaactctgggcccc

SEQ ID NO: 7571487 - DNA, 19 bp, Homo sapiens
agctcaggcccatcgtccc

SEQ ID NO: 7571488 - DNA, 19 bp, Homo sapiens
agctcaggcccatcgtccc

SEQ ID NO: 7571489 - DNA, 23 bp, Homo sapiens
agctccagaacatagcacaggaa

SEQ ID NO: 7571490 - DNA, 22 bp, Homo sapiens
agctccagaagcctgcaaggta

SEQ ID NO: 7571491 - DNA, 22 bp, Homo sapiens
agctccagaagcctgcaaggta

SEQ ID NO: 7571492 - DNA, 22 bp, Homo sapiens
agctccagaagcctgcaaggta

SEQ ID NO: 7571493 - DNA, 23 bp, Homo sapiens
agctccagaacatagcacaggaa

SEQ ID NO: 7571494 - DNA, 22 bp, Homo sapiens
agctccagaagcctgcaaggta

SEQ ID NO: 7571495 - DNA, 22 bp, Homo sapiens
agctccagaagcctgcaaggta

SEQ ID NO: 7571496 - DNA, 22 bp, Homo sapiens
agctccagaagcctgcaaggta

SEQ ID NO: 7571497 - DNA, 22 bp, Homo sapiens
agctccagaagcctgcaaggta

SEQ ID NO: 7571498 - DNA, 22 bp, Homo sapiens
agctccagagtctgaactattc

SEQ ID NO: 7571499 - DNA, 22 bp, Homo sapiens
agctccagagtctgaactattc

SEQ ID NO: 7571500 - DNA, 22 bp, Homo sapiens
agctccagagtctgaactattc

SEQ ID NO: 7571501 - DNA, 22 bp, Homo sapiens
agctccagagtctgaactattc

SEQ ID NO: 7571502 - DNA, 22 bp, Homo sapiens
agctccagagtctgaactattc

SEQ ID NO: 7571503 - DNA, 22 bp, Homo sapiens
agctccagaggcagtgatgaag

SEQ ID NO: 7571504 - DNA, 22 bp, Homo sapiens
agctccagaggcagtgatgaag

SEQ ID NO: 7571505 - DNA, 22 bp, Homo sapiens
agctccagagccacatccatca

SEQ ID NO: 7571506 - DNA, 22 bp, Homo sapiens
agctccagaggcagtgatgaag

SEQ ID NO: 7571507 - DNA, 22 bp, Homo sapiens
agctccagaggcagtgatgaag

SEQ ID NO: 7571508 - DNA, 22 bp, Homo sapiens
agctccagaagcctgcaaggta

SEQ ID NO: 7571509 - DNA, 22 bp, Homo sapiens
agctccagagccacatccatca

SEQ ID NO: 7571510 - DNA, 22 bp, Homo sapiens
agctccagccctagtacagctg

SEQ ID NO: 7571511 - DNA, 22 bp, Homo sapiens
agctccagccgctgatgggttt

SEQ ID NO: 7571512 - DNA, 22 bp, Homo sapiens
agctccagccgctgatgggttt

SEQ ID NO: 7571513 - DNA, 22 bp, Homo sapiens
agctccagccgctgatgggttt

SEQ ID NO: 7571514 - DNA, 22 bp, Homo sapiens
agctccagccctagtacagctg

SEQ ID NO: 7571515 - DNA, 22 bp, Homo sapiens
agctccagccgctgatgggttt

SEQ ID NO: 7571516 - DNA, 22 bp, Homo sapiens
agctccagccgctgatgggttt

SEQ ID NO: 7571517 - DNA, 22 bp, Homo sapiens
agctccagccgctgatgggttt

SEQ ID NO: 7571518 - DNA, 22 bp, Homo sapiens
agctccagccgctgatgggttt

SEQ ID NO: 7571519 - DNA, 22 bp, Homo sapiens
agctccagcctcttctggaggt

SEQ ID NO: 7571520 - DNA, 22 bp, Homo sapiens
agctccagcccatctgctcgtg

SEQ ID NO: 7571521 - DNA, 22 bp, Homo sapiens
agctccagattaattgtaggag

SEQ ID NO: 7571522 - DNA, 22 bp, Homo sapiens
agctccagattaattgtaggag

SEQ ID NO: 7571523 - DNA, 22 bp, Homo sapiens
agctccagattaattgtaggag

SEQ ID NO: 7571524 - DNA, 22 bp, Homo sapiens
agctccagccctagtacagctg

SEQ ID NO: 7571525 - DNA, 22 bp, Homo sapiens
agctccagccctagtacagctg

SEQ ID NO: 7571526 - DNA, 22 bp, Homo sapiens
agctccagccctagtacagctg

SEQ ID NO: 7571527 - DNA, 22 bp, Homo sapiens
agctccagccctagtacagctg

SEQ ID NO: 7571528 - DNA, 22 bp, Homo sapiens
agctccagcccatctgctcgtg

SEQ ID NO: 7571529 - DNA, 23 bp, Homo sapiens
agctccagctgacgtgggcagcc

SEQ ID NO: 7571530 - DNA, 23 bp, Homo sapiens
agctccagctgacgtgggcagcc

SEQ ID NO: 7571531 - DNA, 23 bp, Homo sapiens
agctccagctgacgtgggcagcc

SEQ ID NO: 7571532 - DNA, 23 bp, Homo sapiens
agctccagctgacgtgggcagcc

SEQ ID NO: 7571533 - DNA, 23 bp, Homo sapiens
agctccagctgacgtgggcagcc

SEQ ID NO: 7571534 - DNA, 23 bp, Homo sapiens
agctccagctgacgtgggcagcc

SEQ ID NO: 7571535 - DNA, 23 bp, Homo sapiens
agctccagctgacgtgggcagcc

SEQ ID NO: 7571536 - DNA, 23 bp, Homo sapiens
agctccagctgacgtgggcagcc

SEQ ID NO: 7571537 - DNA, 23 bp, Homo sapiens
agctccagctgacgtgggcagcc

SEQ ID NO: 7571538 - DNA, 23 bp, Homo sapiens
agctccagctgacgtgggcagcc

SEQ ID NO: 7571539 - DNA, 22 bp, Homo sapiens
agctccaggataagacaggtgc

SEQ ID NO: 7571540 - DNA, 23 bp, Homo sapiens
agctccagctgacgtgggcagcc

SEQ ID NO: 7571541 - DNA, 23 bp, Homo sapiens
agctccagctgacgtgggcagcc

SEQ ID NO: 7571542 - DNA, 22 bp, Homo sapiens
agctccagcggatggtcttata

SEQ ID NO: 7571543 - DNA, 22 bp, Homo sapiens
agctccagcctcttctggaggt

SEQ ID NO: 7571544 - DNA, 23 bp, Homo sapiens
agctccagctgacgtgggcagcc

SEQ ID NO: 7571545 - DNA, 22 bp, Homo sapiens
agctccagcggatggtcttata

SEQ ID NO: 7571546 - DNA, 22 bp, Homo sapiens
agctccagcggatggtcttata

SEQ ID NO: 7571547 - DNA, 22 bp, Homo sapiens
agctccagcctcttctggaggt

SEQ ID NO: 7571548 - DNA, 22 bp, Homo sapiens
agctccagcctcttctggaggt

SEQ ID NO: 7571549 - DNA, 22 bp, Homo sapiens
agctccagcctcttctggaggt

SEQ ID NO: 7571550 - DNA, 22 bp, Homo sapiens
agctccagccgctgatgggttt

SEQ ID NO: 7571551 - DNA, 22 bp, Homo sapiens
agctccagcctcttctggaggt

SEQ ID NO: 7571552 - DNA, 22 bp, Homo sapiens
agctccaggcagcattaataaa

SEQ ID NO: 7571553 - DNA, 22 bp, Homo sapiens
agctccaggcagcattaataaa

SEQ ID NO: 7571554 - DNA, 22 bp, Homo sapiens
agctccaggcagcattaataaa

SEQ ID NO: 7571555 - DNA, 22 bp, Homo sapiens
agctccaggatctgaaagttcg

SEQ ID NO: 7571556 - DNA, 22 bp, Homo sapiens
agctccaggatctgaaagttcg

SEQ ID NO: 7571557 - DNA, 22 bp, Homo sapiens
agctccaggatctgaaagttcg

SEQ ID NO: 7571558 - DNA, 22 bp, Homo sapiens
agctccaggatctgaaagttcg

SEQ ID NO: 7571559 - DNA, 19 bp, Homo sapiens
agctccaggcctggatgct

SEQ ID NO: 7571560 - DNA, 19 bp, Homo sapiens
agctccaggcctggatgct

SEQ ID NO: 7571561 - DNA, 19 bp, Homo sapiens
agctccaggcctggatgct

SEQ ID NO: 7571562 - DNA, 22 bp, Homo sapiens
agctccaggataagacaggtgc

SEQ ID NO: 7571563 - DNA, 22 bp, Homo sapiens
agctccaggataagacaggtgc

SEQ ID NO: 7571564 - DNA, 22 bp, Homo sapiens
agctccaggataagacaggtgc

SEQ ID NO: 7571565 - DNA, 22 bp, Homo sapiens
agctccaggataagacaggtgc

SEQ ID NO: 7571566 - DNA, 22 bp, Homo sapiens
agctccaggataagacaggtgc

SEQ ID NO: 7571567 - DNA, 22 bp, Homo sapiens
agctccaggataagacaggtgc

SEQ ID NO: 7571568 - DNA, 22 bp, Homo sapiens
agctccaggataagacaggtgc

SEQ ID NO: 7571569 - DNA, 22 bp, Homo sapiens
agctcctggatgaggcttatgt

SEQ ID NO: 7571570 - DNA, 22 bp, Homo sapiens
agctcctggaggtgcgcactcg

SEQ ID NO: 7571571 - DNA, 22 bp, Homo sapiens
agctcctggaggtgcgcactcg

SEQ ID NO: 7571572 - DNA, 22 bp, Homo sapiens
agctcctggaggtgcgcactcg

SEQ ID NO: 7571573 - DNA, 22 bp, Homo sapiens
agctcctggaggtgcgcactcg

SEQ ID NO: 7571574 - DNA, 22 bp, Homo sapiens
agctcctggaggtgcgcactcg

SEQ ID NO: 7571575 - DNA, 20 bp, Homo sapiens
agctcctggactagagagtg

SEQ ID NO: 7571576 - DNA, 20 bp, Homo sapiens
agctcctggactagagagtg

SEQ ID NO: 7571577 - DNA, 20 bp, Homo sapiens
agctcctggactagagagtg

SEQ ID NO: 7571578 - DNA, 20 bp, Homo sapiens
agctcctggactagagagtg

SEQ ID NO: 7571579 - DNA, 20 bp, Homo sapiens
agctcctggactagagagtg

SEQ ID NO: 7571580 - DNA, 22 bp, Homo sapiens
agctcctggacgaacagggagt

SEQ ID NO: 7571581 - DNA, 22 bp, Homo sapiens
agctcctggacgaacagggagt

SEQ ID NO: 7571582 - DNA, 22 bp, Homo sapiens
agctcctggacgaacagggagt

SEQ ID NO: 7571583 - DNA, 22 bp, Homo sapiens
agctcctggacgaacagggagt

SEQ ID NO: 7571584 - DNA, 22 bp, Homo sapiens
agctcctggacgaacagggagt

SEQ ID NO: 7571585 - DNA, 22 bp, Homo sapiens
agctcctggacgaacagggagt

SEQ ID NO: 7571586 - DNA, 19 bp, Homo sapiens
agctcctgattgtgcctcg

SEQ ID NO: 7571587 - DNA, 22 bp, Homo sapiens
agctccaggccttgggccccgg

SEQ ID NO: 7571588 - DNA, 22 bp, Homo sapiens
agctccaggccttgggccccgg

SEQ ID NO: 7571589 - DNA, 22 bp, Homo sapiens
agctccaggccttgggccccgg

SEQ ID NO: 7571590 - DNA, 21 bp, Homo sapiens
agctccaggctcctggggttc

SEQ ID NO: 7571591 - DNA, 21 bp, Homo sapiens
agctccaggctcctggggttc

SEQ ID NO: 7571592 - DNA, 21 bp, Homo sapiens
agctccaggctcctggggttc

SEQ ID NO: 7571593 - DNA, 22 bp, Homo sapiens
agctccagggaaagagtggatc

SEQ ID NO: 7571594 - DNA, 22 bp, Homo sapiens
agctccagggaaagagtggatc

SEQ ID NO: 7571595 - DNA, 21 bp, Homo sapiens
agctccaggctcctggggttc

SEQ ID NO: 7571596 - DNA, 21 bp, Homo sapiens
agctccaggctcctggggttc

SEQ ID NO: 7571597 - DNA, 19 bp, Homo sapiens
agctcctgattgtgcctcg

SEQ ID NO: 7571598 - DNA, 19 bp, Homo sapiens
agctcctgattgtgcctcg

SEQ ID NO: 7571599 - DNA, 19 bp, Homo sapiens
agctcctgattgtgcctcg

SEQ ID NO: 7571600 - DNA, 19 bp, Homo sapiens
agctcctgattgtgcctcg

SEQ ID NO: 7571601 - DNA, 19 bp, Homo sapiens
agctcctgattgtgcctcg

SEQ ID NO: 7571602 - DNA, 19 bp, Homo sapiens
agctcctgattgtgcctcg

SEQ ID NO: 7571603 - DNA, 19 bp, Homo sapiens
agctcctgattgtgcctcg

SEQ ID NO: 7571604 - DNA, 22 bp, Homo sapiens
agctccagggaaagagtggatc

SEQ ID NO: 7571605 - DNA, 22 bp, Homo sapiens
agctccagggaaagagtggatc

SEQ ID NO: 7571606 - DNA, 22 bp, Homo sapiens
agctccagggaaagagtggatc

SEQ ID NO: 7571607 - DNA, 21 bp, Homo sapiens
agcggcagaccctgcatttga

SEQ ID NO: 7571608 - DNA, 22 bp, Homo sapiens
agcggagctagtttttgtcctc

SEQ ID NO: 7571609 - DNA, 22 bp, Homo sapiens
agcctggtttaagcattttata

SEQ ID NO: 7571610 - DNA, 22 bp, Homo sapiens
agcctggtttaagcattttata

SEQ ID NO: 7571611 - DNA, 22 bp, Homo sapiens
agcctggtttaagcattttata

SEQ ID NO: 7571612 - DNA, 23 bp, Homo sapiens
agctaacagatcgacaaagtata

SEQ ID NO: 7571613 - DNA, 22 bp, Homo sapiens
agcggcagcagatgtgatcagg

SEQ ID NO: 7571614 - DNA, 20 bp, Homo sapiens
agcggcagcttcctgcttcg

SEQ ID NO: 7571615 - DNA, 22 bp, Homo sapiens
agctaagacttagtgacttagt

SEQ ID NO: 7571616 - DNA, 22 bp, Homo sapiens
agctaagacttagtgacttagt

SEQ ID NO: 7571617 - DNA, 22 bp, Homo sapiens
agctaacatggaggaaaaagtt

SEQ ID NO: 7571618 - DNA, 22 bp, Homo sapiens
agctaacatgactagaagcttc

SEQ ID NO: 7571619 - DNA, 22 bp, Homo sapiens
agctaagaacttgagctctgga

SEQ ID NO: 7571620 - DNA, 22 bp, Homo sapiens
agctaagaacttgagctctgga

SEQ ID NO: 7571621 - DNA, 22 bp, Homo sapiens
agcctgggttagggttcttccc

SEQ ID NO: 7571622 - DNA, 22 bp, Homo sapiens
agcctgggttagggttcttccc

SEQ ID NO: 7571623 - DNA, 22 bp, Homo sapiens
agcctgggttagggttcttccc

SEQ ID NO: 7571624 - DNA, 22 bp, Homo sapiens
agcctgggtgggggttcggaga

SEQ ID NO: 7571625 - DNA, 22 bp, Homo sapiens
agcctgggtgggggttcggaga

SEQ ID NO: 7571626 - DNA, 22 bp, Homo sapiens
agcctgggtgggggttcggaga

SEQ ID NO: 7571627 - DNA, 22 bp, Homo sapiens
agcctgggtttttattaaggag

SEQ ID NO: 7571628 - DNA, 22 bp, Homo sapiens
agcctgggtttttattaaggag

SEQ ID NO: 7571629 - DNA, 22 bp, Homo sapiens
agcctgggtttttattaaggag

SEQ ID NO: 7571630 - DNA, 22 bp, Homo sapiens
agcctggtgtggggctgcagag

SEQ ID NO: 7571631 - DNA, 22 bp, Homo sapiens
agcctggtgatatcagtggttt

SEQ ID NO: 7571632 - DNA, 22 bp, Homo sapiens
agcctggtgatatcagtggttt

SEQ ID NO: 7571633 - DNA, 22 bp, Homo sapiens
agcctggtgatatcagtggttt

SEQ ID NO: 7571634 - DNA, 22 bp, Homo sapiens
agcctggtgtggggctgcagag

SEQ ID NO: 7571635 - DNA, 18 bp, Homo sapiens
agcctgggctctgcctgg

SEQ ID NO: 7571636 - DNA, 18 bp, Homo sapiens
agcctgggctctgcctgg

SEQ ID NO: 7571637 - DNA, 18 bp, Homo sapiens
agcctgggctctgcctgg

SEQ ID NO: 7571638 - DNA, 18 bp, Homo sapiens
agcctgggctctgcctgg

SEQ ID NO: 7571639 - DNA, 22 bp, Homo sapiens
agcctgggcctggcttcccgcc

SEQ ID NO: 7571640 - DNA, 22 bp, Homo sapiens
agcctgggcctggcttcccgcc

SEQ ID NO: 7571641 - DNA, 18 bp, Homo sapiens
agcctgggctctgcctgg

SEQ ID NO: 7571642 - DNA, 18 bp, Homo sapiens
agcctgggctctgcctgg

SEQ ID NO: 7571643 - DNA, 18 bp, Homo sapiens
agcctgggctctgcctgg

SEQ ID NO: 7571644 - DNA, 22 bp, Homo sapiens
agcctgggccctgcctcttctc

SEQ ID NO: 7571645 - DNA, 22 bp, Homo sapiens
agcctgggccctgcctcttctc

SEQ ID NO: 7571646 - DNA, 22 bp, Homo sapiens
agcctgggccctgcctcttctc

SEQ ID NO: 7571647 - DNA, 22 bp, Homo sapiens
agcctgggcatgggacgggagg

SEQ ID NO: 7571648 - DNA, 22 bp, Homo sapiens
agcctgggccctgcctcttctc

SEQ ID NO: 7571649 - DNA, 22 bp, Homo sapiens
agcctgggcatgggacgggagg

SEQ ID NO: 7571650 - DNA, 22 bp, Homo sapiens
agcctggggtttcagtttgcac

SEQ ID NO: 7571651 - DNA, 22 bp, Homo sapiens
agcctggggtttcagtttgcac

SEQ ID NO: 7571652 - DNA, 22 bp, Homo sapiens
agcctggggtttcagtttgcac

SEQ ID NO: 7571653 - DNA, 22 bp, Homo sapiens
agcctggggtttcagtttgcac

SEQ ID NO: 7571654 - DNA, 22 bp, Homo sapiens
agcctgggggcgcagaaaccgg

SEQ ID NO: 7571655 - DNA, 22 bp, Homo sapiens
agcctgggggcgcagaaaccgg

SEQ ID NO: 7571656 - DNA, 22 bp, Homo sapiens
agcctgggggcgcagaaaccgg

SEQ ID NO: 7571657 - DNA, 21 bp, Homo sapiens
agcctgggtatcctttgagga

SEQ ID NO: 7571658 - DNA, 21 bp, Homo sapiens
agcctgggtatcctttgagga

SEQ ID NO: 7571659 - DNA, 21 bp, Homo sapiens
agcctgggtatcctttgagga

SEQ ID NO: 7571660 - DNA, 23 bp, Homo sapiens
agcctgggtagcctaaataacag

SEQ ID NO: 7571661 - DNA, 21 bp, Homo sapiens
agcctgggtatcctttgagga

SEQ ID NO: 7571662 - DNA, 21 bp, Homo sapiens
agcctgggtatcctttgagga

SEQ ID NO: 7571663 - DNA, 21 bp, Homo sapiens
agcctgggtatcctttgagga

SEQ ID NO: 7571664 - DNA, 22 bp, Homo sapiens
agcctggggcacttctccaaac

SEQ ID NO: 7571665 - DNA, 22 bp, Homo sapiens
agcctggggcacttctccaaac

SEQ ID NO: 7571666 - DNA, 22 bp, Homo sapiens
agcctggggcacttctccaaac

SEQ ID NO: 7571667 - DNA, 22 bp, Homo sapiens
agcctggggcacttctccaaac

SEQ ID NO: 7571668 - DNA, 20 bp, Homo sapiens
agcctggggaattccacccc

SEQ ID NO: 7571669 - DNA, 18 bp, Homo sapiens
agcctgggctctgcctgg

SEQ ID NO: 7571670 - DNA, 20 bp, Homo sapiens
agcctggggaattccacccc

SEQ ID NO: 7571671 - DNA, 20 bp, Homo sapiens
agcctggggaattccacccc

SEQ ID NO: 7571672 - DNA, 22 bp, Homo sapiens
agctacacccctttacagtcct

SEQ ID NO: 7571673 - DNA, 22 bp, Homo sapiens
agctacacccctttacagtcct

SEQ ID NO: 7571674 - DNA, 22 bp, Homo sapiens
agctacacaggaggactcttct

SEQ ID NO: 7571675 - DNA, 20 bp, Homo sapiens
agctacaatgcgaagctggc

SEQ ID NO: 7571676 - DNA, 20 bp, Homo sapiens
agctacaatgcgaagctggc

SEQ ID NO: 7571677 - DNA, 20 bp, Homo sapiens
agctacaatgcgaagctggc

SEQ ID NO: 7571678 - DNA, 22 bp, Homo sapiens
agctacacttaaccacatagca

SEQ ID NO: 7571679 - DNA, 22 bp, Homo sapiens
agctacacccctttacagtcct

SEQ ID NO: 7571680 - DNA, 22 bp, Homo sapiens
agctacagatgagcccagtatc

SEQ ID NO: 7571681 - DNA, 19 bp, Homo sapiens
agctacagcatggcgaggt

SEQ ID NO: 7571682 - DNA, 22 bp, Homo sapiens
agctacacttaaccacatagca

SEQ ID NO: 7571683 - DNA, 22 bp, Homo sapiens
agctaattagaaatagattatt

SEQ ID NO: 7571684 - DNA, 22 bp, Homo sapiens
agctacaaaattactaagtcct

SEQ ID NO: 7571685 - DNA, 22 bp, Homo sapiens
agctacaaatgtatgtgctgat

SEQ ID NO: 7571686 - DNA, 22 bp, Homo sapiens
agctacaacttttccatgagca

SEQ ID NO: 7571687 - DNA, 22 bp, Homo sapiens
agctacaaaattactaagtcct

SEQ ID NO: 7571688 - DNA, 22 bp, Homo sapiens
agctacaagtcatcagctatca

SEQ ID NO: 7571689 - DNA, 17 bp, Homo sapiens
agctacaaggcagttca

SEQ ID NO: 7571690 - DNA, 22 bp, Homo sapiens
agctacaacttttccatgagca

SEQ ID NO: 7571691 - DNA, 20 bp, Homo sapiens
agctaagaggaaaagtgaga

SEQ ID NO: 7571692 - DNA, 20 bp, Homo sapiens
agctaagaggaaaagtgaga

SEQ ID NO: 7571693 - DNA, 22 bp, Homo sapiens
agctaaggaatcagaagaggtt

SEQ ID NO: 7571694 - DNA, 22 bp, Homo sapiens
agctaaggaatcagaagaggtt

SEQ ID NO: 7571695 - DNA, 22 bp, Homo sapiens
agctaaggactggagggtttct

SEQ ID NO: 7571696 - DNA, 22 bp, Homo sapiens
agctaagtggaaaatgcagtta

SEQ ID NO: 7571697 - DNA, 22 bp, Homo sapiens
agctaaggtgtcctggaggccc

SEQ ID NO: 7571698 - DNA, 22 bp, Homo sapiens
agctaatgatgagatacagata

SEQ ID NO: 7571699 - DNA, 22 bp, Homo sapiens
agctaatggaacagagatgtca

SEQ ID NO: 7571700 - DNA, 19 bp, Homo sapiens
agctaatggaagtttactg

SEQ ID NO: 7571701 - DNA, 23 bp, Homo sapiens
agctaatgggacagattccatgg

SEQ ID NO: 7571702 - DNA, 23 bp, Homo sapiens
agctactaggattcattcaccct

SEQ ID NO: 7571703 - DNA, 22 bp, Homo sapiens
agctactggagaacacaaaacc

SEQ ID NO: 7571704 - DNA, 22 bp, Homo sapiens
agctacttccctgtaggaaaca

SEQ ID NO: 7571705 - DNA, 22 bp, Homo sapiens
agctagaactacaggcatgtgc

SEQ ID NO: 7571706 - DNA, 22 bp, Homo sapiens
agctagaagtcctagataaagg

SEQ ID NO: 7571707 - DNA, 22 bp, Homo sapiens
agctacttccctgtaggaaaca

SEQ ID NO: 7571708 - DNA, 22 bp, Homo sapiens
agctagaactacaggcatgtgc

SEQ ID NO: 7571709 - DNA, 22 bp, Homo sapiens
agctagaagtcctagataaagg

SEQ ID NO: 7571710 - DNA, 22 bp, Homo sapiens
agctagaatattgatctgaaat

SEQ ID NO: 7571711 - DNA, 22 bp, Homo sapiens
agctagaatattgatctgaaat

SEQ ID NO: 7571712 - DNA, 22 bp, Homo sapiens
agctagaatattgatctgaaat

SEQ ID NO: 7571713 - DNA, 22 bp, Homo sapiens
agctagagaatgacagagtctg

SEQ ID NO: 7571714 - DNA, 22 bp, Homo sapiens
agctagagaatgacagagtctg

SEQ ID NO: 7571715 - DNA, 22 bp, Homo sapiens
agctagagctgagaagcacttg

SEQ ID NO: 7571716 - DNA, 22 bp, Homo sapiens
agctagaggtgaaacatgccaa

SEQ ID NO: 7571717 - DNA, 22 bp, Homo sapiens
agctagagctgagaagcacttg

SEQ ID NO: 7571718 - DNA, 22 bp, Homo sapiens
agctacctataatgagacctgg

SEQ ID NO: 7571719 - DNA, 22 bp, Homo sapiens
agctacctgatccttcttctga

SEQ ID NO: 7571720 - DNA, 22 bp, Homo sapiens
agctacctgatccttcttctga

SEQ ID NO: 7571721 - DNA, 22 bp, Homo sapiens
agctacccgaggacaggctaag

SEQ ID NO: 7571722 - DNA, 22 bp, Homo sapiens
agctacccgaggacaggctaag

SEQ ID NO: 7571723 - DNA, 22 bp, Homo sapiens
agctacatgaaattgctgatat

SEQ ID NO: 7571724 - DNA, 22 bp, Homo sapiens
agctacatgaaattgctgatat

SEQ ID NO: 7571725 - DNA, 22 bp, Homo sapiens
agctacagctgtactctgcagg

SEQ ID NO: 7571726 - DNA, 22 bp, Homo sapiens
agctacagctgtactctgcagg

SEQ ID NO: 7571727 - DNA, 22 bp, Homo sapiens
agctacagggaactaaaagcta

SEQ ID NO: 7571728 - DNA, 22 bp, Homo sapiens
agctacagggaactaaaagcta

SEQ ID NO: 7571729 - DNA, 22 bp, Homo sapiens
agctacagtcggaaggacagac

SEQ ID NO: 7571730 - DNA, 22 bp, Homo sapiens
agctacagtcggaaggacagac

SEQ ID NO: 7571731 - DNA, 22 bp, Homo sapiens
agctacagtcggaaggacagac

SEQ ID NO: 7571732 - DNA, 22 bp, Homo sapiens
agctacagttgccctcagcagg

SEQ ID NO: 7571733 - DNA, 22 bp, Homo sapiens
agctacagttgccctcagcagg

SEQ ID NO: 7571734 - DNA, 22 bp, Homo sapiens
agctacaatcaatgtacatcat

SEQ ID NO: 7571735 - DNA, 22 bp, Homo sapiens
agctacagttgccctcagcagg

SEQ ID NO: 7571736 - DNA, 22 bp, Homo sapiens
agctacagtggacaagtgaact

SEQ ID NO: 7571737 - DNA, 22 bp, Homo sapiens
agctacagtggacaagtgaact

SEQ ID NO: 7571738 - DNA, 22 bp, Homo sapiens
cagatgtggaatgcagcaggct

SEQ ID NO: 7571739 - DNA, 21 bp, Homo sapiens
cagcaaatcattgggcagact

SEQ ID NO: 7571740 - DNA, 21 bp, Homo sapiens
cagcaaatcattgggcagact

SEQ ID NO: 7571741 - DNA, 22 bp, Homo sapiens
cagcaaattttaatactgcttt

SEQ ID NO: 7571742 - DNA, 22 bp, Homo sapiens
cagcaacatatatgaaactgtg

SEQ ID NO: 7571743 - DNA, 21 bp, Homo sapiens
cagcaaatcattgggcagact

SEQ ID NO: 7571744 - DNA, 22 bp, Homo sapiens
cagcaaatgagtggcagggcag

SEQ ID NO: 7571745 - DNA, 22 bp, Homo sapiens
cagcaaatgagtggcagggcag

SEQ ID NO: 7571746 - DNA, 22 bp, Homo sapiens
cagcaaattttaatactgcttt

SEQ ID NO: 7571747 - DNA, 22 bp, Homo sapiens
cagcaaattttaatactgcttt

SEQ ID NO: 7571748 - DNA, 22 bp, Homo sapiens
cagcaacatatatgaaactgtg

SEQ ID NO: 7571749 - DNA, 22 bp, Homo sapiens
cagcaacatgtggtagtgtagg

SEQ ID NO: 7571750 - DNA, 22 bp, Homo sapiens
cagcaacatgtggtagtgtagg

SEQ ID NO: 7571751 - DNA, 22 bp, Homo sapiens
cagcaacatgtggtagtgtagg

SEQ ID NO: 7571752 - DNA, 22 bp, Homo sapiens
cagcaacatgtggtagtgtagg

SEQ ID NO: 7571753 - DNA, 22 bp, Homo sapiens
cagcaacggaaaatacacatag

SEQ ID NO: 7571754 - DNA, 22 bp, Homo sapiens
cagcaacatgtggtagtgtagg

SEQ ID NO: 7571755 - DNA, 22 bp, Homo sapiens
cagcaacatgtggtagtgtagg

SEQ ID NO: 7571756 - DNA, 22 bp, Homo sapiens
cagcaacatgtggtagtgtagg

SEQ ID NO: 7571757 - DNA, 22 bp, Homo sapiens
cagcaacttggacagcagtctt

SEQ ID NO: 7571758 - DNA, 22 bp, Homo sapiens
cagcaacttggacagcagtctt

SEQ ID NO: 7571759 - DNA, 22 bp, Homo sapiens
cagcaacttggacagcagtctt

SEQ ID NO: 7571760 - DNA, 22 bp, Homo sapiens
cagcaacttggacagcagtctt

SEQ ID NO: 7571761 - DNA, 22 bp, Homo sapiens
cagcaacttaggcagaacatct

SEQ ID NO: 7571762 - DNA, 22 bp, Homo sapiens
cagcaacttaggcagaacatct

SEQ ID NO: 7571763 - DNA, 22 bp, Homo sapiens
cagcaacttaggcagaacatct

SEQ ID NO: 7571764 - DNA, 20 bp, Homo sapiens
cagcaactttggactgagtt

SEQ ID NO: 7571765 - DNA, 18 bp, Homo sapiens
cagcaactttagatcctg

SEQ ID NO: 7571766 - DNA, 20 bp, Homo sapiens
cagcaactttggactgagtt

SEQ ID NO: 7571767 - DNA, 20 bp, Homo sapiens
cagcaactttggactgagtt

SEQ ID NO: 7571768 - DNA, 20 bp, Homo sapiens
cagcaactttggactgagtt

SEQ ID NO: 7571769 - DNA, 22 bp, Homo sapiens
cagcaactctcctgtgctcaaa

SEQ ID NO: 7571770 - DNA, 22 bp, Homo sapiens
cagcaactctcctgtgctcaaa

SEQ ID NO: 7571771 - DNA, 22 bp, Homo sapiens
cagcaactggtcattgctctcc

SEQ ID NO: 7571772 - DNA, 22 bp, Homo sapiens
cagcaactgtgcctgacacaca

SEQ ID NO: 7571773 - DNA, 22 bp, Homo sapiens
cagcaactgtgcctgacacaca

SEQ ID NO: 7571774 - DNA, 22 bp, Homo sapiens
cagcaactgtgcctgacacaca

SEQ ID NO: 7571775 - DNA, 22 bp, Homo sapiens
cagcaactcctatattgaaagc

SEQ ID NO: 7571776 - DNA, 22 bp, Homo sapiens
cagcaactcctgtagcttatgc

SEQ ID NO: 7571777 - DNA, 22 bp, Homo sapiens
cagcaactcctatattgaaagc

SEQ ID NO: 7571778 - DNA, 22 bp, Homo sapiens
cagcaactcctgtagcttatgc

SEQ ID NO: 7571779 - DNA, 22 bp, Homo sapiens
cagcaactcctgtagcttatgc

SEQ ID NO: 7571780 - DNA, 22 bp, Homo sapiens
cagcaactcctgtagcttatgc

SEQ ID NO: 7571781 - DNA, 22 bp, Homo sapiens
cagcaactctcctgtgctcaaa

SEQ ID NO: 7571782 - DNA, 22 bp, Homo sapiens
cagcaactctcctgtgctcaaa

SEQ ID NO: 7571783 - DNA, 22 bp, Homo sapiens
cagcaactctcctgtgctcaaa

SEQ ID NO: 7571784 - DNA, 22 bp, Homo sapiens
cagatgtacatgaagggcaatg

SEQ ID NO: 7571785 - DNA, 22 bp, Homo sapiens
cagatgtacatgaagggcaatg

SEQ ID NO: 7571786 - DNA, 22 bp, Homo sapiens
cagatgtacatgaagggcaatg

SEQ ID NO: 7571787 - DNA, 22 bp, Homo sapiens
cagatgtacatgaagggcaatg

SEQ ID NO: 7571788 - DNA, 22 bp, Homo sapiens
cagatgtacatgaagggcaatg

SEQ ID NO: 7571789 - DNA, 22 bp, Homo sapiens
cagatgtaatctgacagctgga

SEQ ID NO: 7571790 - DNA, 22 bp, Homo sapiens
cagatgtaattactcaagtcaa

SEQ ID NO: 7571791 - DNA, 22 bp, Homo sapiens
cagatgtaatctgacagctgga

SEQ ID NO: 7571792 - DNA, 22 bp, Homo sapiens
cagatgtaattactcaagtcaa

SEQ ID NO: 7571793 - DNA, 20 bp, Homo sapiens
cagatgggacgtggaggagt

SEQ ID NO: 7571794 - DNA, 20 bp, Homo sapiens
cagatgggacgtggaggagt

SEQ ID NO: 7571795 - DNA, 20 bp, Homo sapiens
cagatgggacgtggaggagt

SEQ ID NO: 7571796 - DNA, 20 bp, Homo sapiens
cagatgggacgtggaggagt

SEQ ID NO: 7571797 - DNA, 18 bp, Homo sapiens
cagatggtggagttttta

SEQ ID NO: 7571798 - DNA, 22 bp, Homo sapiens
cagatggggcaaggccatctgt

SEQ ID NO: 7571799 - DNA, 22 bp, Homo sapiens
cagatggggcaaggccatctgt

SEQ ID NO: 7571800 - DNA, 22 bp, Homo sapiens
cagatgtgcctccagggctttg

SEQ ID NO: 7571801 - DNA, 22 bp, Homo sapiens
cagatgtgcctccagggctttg

SEQ ID NO: 7571802 - DNA, 23 bp, Homo sapiens
cagatgtgcaactctaggcaatg

SEQ ID NO: 7571803 - DNA, 22 bp, Homo sapiens
cagatgtgccgcggcgccgctc

SEQ ID NO: 7571804 - DNA, 22 bp, Homo sapiens
cagatgtgccgcggcgccgctc

SEQ ID NO: 7571805 - DNA, 22 bp, Homo sapiens
cagatgtgcatgatgggaaggg

SEQ ID NO: 7571806 - DNA, 22 bp, Homo sapiens
cagatgtgcatgatgggaaggg

SEQ ID NO: 7571807 - DNA, 22 bp, Homo sapiens
cagatgtgattcttccctcagc

SEQ ID NO: 7571808 - DNA, 23 bp, Homo sapiens
cagatgtgcaactctaggcaatg

SEQ ID NO: 7571809 - DNA, 22 bp, Homo sapiens
cagatgtgagctggggagagtg

SEQ ID NO: 7571810 - DNA, 22 bp, Homo sapiens
cagatgtgagctggggagagtg

SEQ ID NO: 7571811 - DNA, 22 bp, Homo sapiens
cagatgtgagctggggagagtg

SEQ ID NO: 7571812 - DNA, 22 bp, Homo sapiens
cagatgtcatttcccatgcagc

SEQ ID NO: 7571813 - DNA, 22 bp, Homo sapiens
cagatgtcgaaggatgtgaccg

SEQ ID NO: 7571814 - DNA, 22 bp, Homo sapiens
cagatgtatatgcataaaaagt

SEQ ID NO: 7571815 - DNA, 22 bp, Homo sapiens
cagatgtacatgaagggcaatg

SEQ ID NO: 7571816 - DNA, 22 bp, Homo sapiens
cagatgtagtagctttattgca

SEQ ID NO: 7571817 - DNA, 19 bp, Homo sapiens
agcctggctttgctctgct

SEQ ID NO: 7571818 - DNA, 19 bp, Homo sapiens
agcctggctttgctctgct

SEQ ID NO: 7571819 - DNA, 19 bp, Homo sapiens
agcctggctttgctctgct

SEQ ID NO: 7571820 - DNA, 19 bp, Homo sapiens
agcctggctttgctctgct

SEQ ID NO: 7571821 - DNA, 19 bp, Homo sapiens
agcctggctttgctctgct

SEQ ID NO: 7571822 - DNA, 19 bp, Homo sapiens
agcctggctttgctctgct

SEQ ID NO: 7571823 - DNA, 22 bp, Homo sapiens
agcctggccactcagggcctga

SEQ ID NO: 7571824 - DNA, 22 bp, Homo sapiens
agcctggcttagctctctcact

SEQ ID NO: 7571825 - DNA, 22 bp, Homo sapiens
agcctggcttagctctctcact

SEQ ID NO: 7571826 - DNA, 22 bp, Homo sapiens
agcctggcttagctctctcact

SEQ ID NO: 7571827 - DNA, 22 bp, Homo sapiens
agcctggcttagctctctcact

SEQ ID NO: 7571828 - DNA, 17 bp, Homo sapiens
agcctgggaaggagtga

SEQ ID NO: 7571829 - DNA, 17 bp, Homo sapiens
agcctgggaaggagtga

SEQ ID NO: 7571830 - DNA, 17 bp, Homo sapiens
agcctgggaaggagtga

SEQ ID NO: 7571831 - DNA, 17 bp, Homo sapiens
agcctgggaaggagtga

SEQ ID NO: 7571832 - DNA, 17 bp, Homo sapiens
agcctgggaaggagtga

SEQ ID NO: 7571833 - DNA, 17 bp, Homo sapiens
agcctgggaaggagtga

SEQ ID NO: 7571834 - DNA, 17 bp, Homo sapiens
agcctgggaaggagtga

SEQ ID NO: 7571835 - DNA, 17 bp, Homo sapiens
agcctgggaaggagtga

SEQ ID NO: 7571836 - DNA, 17 bp, Homo sapiens
agcctgggaaggagtga

SEQ ID NO: 7571837 - DNA, 19 bp, Homo sapiens
agcctggctttgctctgct

SEQ ID NO: 7571838 - DNA, 22 bp, Homo sapiens
agcctggcttagctctctcact

SEQ ID NO: 7571839 - DNA, 22 bp, Homo sapiens
agcctggccactcagggcctga

SEQ ID NO: 7571840 - DNA, 22 bp, Homo sapiens
agcctggccactcagggcctga

SEQ ID NO: 7571841 - DNA, 22 bp, Homo sapiens
agcctggccactcagggcctga

SEQ ID NO: 7571842 - DNA, 22 bp, Homo sapiens
cagcaagaatcagacaacctca

SEQ ID NO: 7571843 - DNA, 22 bp, Homo sapiens
cagcaagaatcagacaacctca

SEQ ID NO: 7571844 - DNA, 22 bp, Homo sapiens
cagcaagaacagcctgatgtgc

SEQ ID NO: 7571845 - DNA, 22 bp, Homo sapiens
cagcaagaacagcctgatgtgc

SEQ ID NO: 7571846 - DNA, 22 bp, Homo sapiens
cagcaagaatcagacaacctca

SEQ ID NO: 7571847 - DNA, 22 bp, Homo sapiens
cagcaagaatcagacaacctca

SEQ ID NO: 7571848 - DNA, 22 bp, Homo sapiens
cagcaagaatcagacaacctca

SEQ ID NO: 7571849 - DNA, 22 bp, Homo sapiens
cagcaagaaaattcacatgctc

SEQ ID NO: 7571850 - DNA, 22 bp, Homo sapiens
cagcaagaaaattcacatgctc

SEQ ID NO: 7571851 - DNA, 22 bp, Homo sapiens
cagcaagaacagcctgatgtgc

SEQ ID NO: 7571852 - DNA, 22 bp, Homo sapiens
cagcaagaacagcctgatgtgc

SEQ ID NO: 7571853 - DNA, 22 bp, Homo sapiens
cagcaagaaaattcacatgctc

SEQ ID NO: 7571854 - DNA, 22 bp, Homo sapiens
cagcaagaaaattcacatgctc

SEQ ID NO: 7571855 - DNA, 22 bp, Homo sapiens
cagcaagaaaattcacatgctc

SEQ ID NO: 7571856 - DNA, 22 bp, Homo sapiens
cagcaagaaaattcacatgctc

SEQ ID NO: 7571857 - DNA, 22 bp, Homo sapiens
cagcaagaaaattcacatgctc

SEQ ID NO: 7571858 - DNA, 22 bp, Homo sapiens
agcctgggcaacaacacagcga

SEQ ID NO: 7571859 - DNA, 22 bp, Homo sapiens
agcctgggcaacaacacagcga

SEQ ID NO: 7571860 - DNA, 22 bp, Homo sapiens
agcctgggcaacaacacagcga

SEQ ID NO: 7571861 - DNA, 22 bp, Homo sapiens
agcctgggcaacaacacagcga

SEQ ID NO: 7571862 - DNA, 21 bp, Homo sapiens
agcctgggaggcggaggttgc

SEQ ID NO: 7571863 - DNA, 21 bp, Homo sapiens
agcctgggaggcggaggttgc

SEQ ID NO: 7571864 - DNA, 22 bp, Homo sapiens
agcctgggcaacagagcaaaac

SEQ ID NO: 7571865 - DNA, 22 bp, Homo sapiens
agcctgggcaacaacacagcga

SEQ ID NO: 7571866 - DNA, 22 bp, Homo sapiens
agcctgggcaacaacacagcga

SEQ ID NO: 7571867 - DNA, 22 bp, Homo sapiens
agcctgggcatgggacgggagg

SEQ ID NO: 7571868 - DNA, 22 bp, Homo sapiens
agcctgggcatgggacgggagg

SEQ ID NO: 7571869 - DNA, 22 bp, Homo sapiens
agcctgggcatgggacgggagg

SEQ ID NO: 7571870 - DNA, 22 bp, Homo sapiens
agcctgggcatgggacgggagg

SEQ ID NO: 7571871 - DNA, 22 bp, Homo sapiens
agcctgggcatgggacgggagg

SEQ ID NO: 7571872 - DNA, 22 bp, Homo sapiens
agcctgggcatgggacgggagg

SEQ ID NO: 7571873 - DNA, 22 bp, Homo sapiens
agcctgggcaactccattcact

SEQ ID NO: 7571874 - DNA, 22 bp, Homo sapiens
agcctgggcaactccattcact

SEQ ID NO: 7571875 - DNA, 22 bp, Homo sapiens
agcctgggcaacagagcaaaac

SEQ ID NO: 7571876 - DNA, 22 bp, Homo sapiens
agcctgggcaacagagcaaaac

SEQ ID NO: 7571877 - DNA, 22 bp, Homo sapiens
agcctgggcaacagagcaaaac

SEQ ID NO: 7571878 - DNA, 22 bp, Homo sapiens
agcctgggaatttagagttcgg

SEQ ID NO: 7571879 - DNA, 22 bp, Homo sapiens
agcctgggaatttagagttcgg

SEQ ID NO: 7571880 - DNA, 22 bp, Homo sapiens
agcctgggaatttagagttcgg

SEQ ID NO: 7571881 - DNA, 22 bp, Homo sapiens
agcctgggaatttagagttcgg

SEQ ID NO: 7571882 - DNA, 22 bp, Homo sapiens
agcctgggaatttagagttcgg

SEQ ID NO: 7571883 - DNA, 17 bp, Homo sapiens
agcctgggaaggagtga

SEQ ID NO: 7571884 - DNA, 22 bp, Homo sapiens
agcctgggagacactaagttgt

SEQ ID NO: 7571885 - DNA, 22 bp, Homo sapiens
agcctgggagacactaagttgt

SEQ ID NO: 7571886 - DNA, 22 bp, Homo sapiens
agcctgggagacactaagttgt

SEQ ID NO: 7571887 - DNA, 22 bp, Homo sapiens
agcctgggagacactaagttgt

SEQ ID NO: 7571888 - DNA, 21 bp, Homo sapiens
agcctgggaggcggaggttgc

SEQ ID NO: 7571889 - DNA, 21 bp, Homo sapiens
agcctgggaggcggaggttgc

SEQ ID NO: 7571890 - DNA, 21 bp, Homo sapiens
agcctgggaggcggaggttgc

SEQ ID NO: 7571891 - DNA, 21 bp, Homo sapiens
agcctgggaggcggaggttgc

SEQ ID NO: 7571892 - DNA, 21 bp, Homo sapiens
agcctgggaggcggaggttgc

SEQ ID NO: 7571893 - DNA, 21 bp, Homo sapiens
agcctgggaggcggaggttgc

SEQ ID NO: 7571894 - DNA, 22 bp, Homo sapiens
caaagggaaacgcagtgtcaag

SEQ ID NO: 7571895 - DNA, 17 bp, Homo sapiens
caaagggagcccaccaa

SEQ ID NO: 7571896 - DNA, 17 bp, Homo sapiens
caaagggagcccaccaa

SEQ ID NO: 7571897 - DNA, 17 bp, Homo sapiens
caaagggagcccaccaa

SEQ ID NO: 7571898 - DNA, 17 bp, Homo sapiens
caaagggagcccaccaa

SEQ ID NO: 7571899 - DNA, 22 bp, Homo sapiens
caaagggaaacgcagtgtcaag

SEQ ID NO: 7571900 - DNA, 22 bp, Homo sapiens
caaagggaaacgcagtgtcaag

SEQ ID NO: 7571901 - DNA, 22 bp, Homo sapiens
caaagggaaaagccatgtgggc

SEQ ID NO: 7571902 - DNA, 22 bp, Homo sapiens
caaagggcattttagtgaactg

SEQ ID NO: 7571903 - DNA, 22 bp, Homo sapiens
caaagggcattttagtgaactg

SEQ ID NO: 7571904 - DNA, 22 bp, Homo sapiens
caaagggcatggcctgagcact

SEQ ID NO: 7571905 - DNA, 22 bp, Homo sapiens
caaagggcatggcctgagcact

SEQ ID NO: 7571906 - DNA, 22 bp, Homo sapiens
caaagggcatggcctgagcact

SEQ ID NO: 7571907 - DNA, 22 bp, Homo sapiens
caaaggcttccactgcatcctt

SEQ ID NO: 7571908 - DNA, 22 bp, Homo sapiens
caaaggcttccactgcatcctt

SEQ ID NO: 7571909 - DNA, 22 bp, Homo sapiens
caaaggcttcatctcagagcag

SEQ ID NO: 7571910 - DNA, 22 bp, Homo sapiens
caaaggcttcatctcagagcag

SEQ ID NO: 7571911 - DNA, 22 bp, Homo sapiens
caaaggcttcatctcagagcag

SEQ ID NO: 7571912 - DNA, 22 bp, Homo sapiens
caaaggctttgctatgatgcat

SEQ ID NO: 7571913 - DNA, 22 bp, Homo sapiens
caaaggctttgctatgatgcat

SEQ ID NO: 7571914 - DNA, 22 bp, Homo sapiens
caaagggaaaagccatgtgggc

SEQ ID NO: 7571915 - DNA, 22 bp, Homo sapiens
caaagggaaaagccatgtgggc

SEQ ID NO: 7571916 - DNA, 22 bp, Homo sapiens
caaagggaaaagccatgtgggc

SEQ ID NO: 7571917 - DNA, 22 bp, Homo sapiens
caaaggcatgtgagtatatgtg

SEQ ID NO: 7571918 - DNA, 22 bp, Homo sapiens
caaaggcatgtgagtatatgtg

SEQ ID NO: 7571919 - DNA, 22 bp, Homo sapiens
caaaggcatcggcaattaggga

SEQ ID NO: 7571920 - DNA, 22 bp, Homo sapiens
caaaggcatcggcaattaggga

SEQ ID NO: 7571921 - DNA, 22 bp, Homo sapiens
caaaggcatgtgagtatatgtg

SEQ ID NO: 7571922 - DNA, 22 bp, Homo sapiens
caaaggcagttactgaatgaag

SEQ ID NO: 7571923 - DNA, 22 bp, Homo sapiens
caaaggcagttactgaatgaag

SEQ ID NO: 7571924 - DNA, 22 bp, Homo sapiens
caaaggcagttactgaatgaag

SEQ ID NO: 7571925 - DNA, 22 bp, Homo sapiens
caaaggcagttactgaatgaag

SEQ ID NO: 7571926 - DNA, 22 bp, Homo sapiens
caaaggcctgagaactgagggg

SEQ ID NO: 7571927 - DNA, 22 bp, Homo sapiens
caaaggctgccactgtggctgt

SEQ ID NO: 7571928 - DNA, 22 bp, Homo sapiens
caaaggctgccactgtggctgt

SEQ ID NO: 7571929 - DNA, 22 bp, Homo sapiens
caaaggctcagtaaatctttgt

SEQ ID NO: 7571930 - DNA, 22 bp, Homo sapiens
caaaggctcagtaaatctttgt

SEQ ID NO: 7571931 - DNA, 22 bp, Homo sapiens
caaaggctggtagaatgagcca

SEQ ID NO: 7571932 - DNA, 22 bp, Homo sapiens
caaaggctggtagaatgagcca

SEQ ID NO: 7571933 - DNA, 22 bp, Homo sapiens
agcacctgtcacaagcagaagg

SEQ ID NO: 7571934 - DNA, 22 bp, Homo sapiens
agcacctgtcaagtccaggctg

SEQ ID NO: 7571935 - DNA, 22 bp, Homo sapiens
agcacctgtcacaagcagaagg

SEQ ID NO: 7571936 - DNA, 22 bp, Homo sapiens
agcacctgtcaagtccaggctg

SEQ ID NO: 7571937 - DNA, 22 bp, Homo sapiens
agcacctgtcaagtccaggctg

SEQ ID NO: 7571938 - DNA, 22 bp, Homo sapiens
agcacctgtcaagtccaggctg

SEQ ID NO: 7571939 - DNA, 22 bp, Homo sapiens
agcacctgggctggaagacccc

SEQ ID NO: 7571940 - DNA, 22 bp, Homo sapiens
agcacctggtctcctggcgctg

SEQ ID NO: 7571941 - DNA, 22 bp, Homo sapiens
agcacctggtctcctggcgctg

SEQ ID NO: 7571942 - DNA, 19 bp, Homo sapiens
agcacctgtgagagcctgg

SEQ ID NO: 7571943 - DNA, 19 bp, Homo sapiens
agcacctgtgagagcctgg

SEQ ID NO: 7571944 - DNA, 19 bp, Homo sapiens
agcacctgtgagagcctgg

SEQ ID NO: 7571945 - DNA, 17 bp, Homo sapiens
agcacctgtccagtccc

SEQ ID NO: 7571946 - DNA, 17 bp, Homo sapiens
agcacctgtccagtccc

SEQ ID NO: 7571947 - DNA, 17 bp, Homo sapiens
agcacctgtccagtccc

SEQ ID NO: 7571948 - DNA, 23 bp, Homo sapiens
agcacctgtgatttcctagctct

SEQ ID NO: 7571949 - DNA, 23 bp, Homo sapiens
agcacctgtgatttcctagctct

SEQ ID NO: 7571950 - DNA, 23 bp, Homo sapiens
agcacctgtgatttcctagctct

SEQ ID NO: 7571951 - DNA, 23 bp, Homo sapiens
agcacctgtgatttcctagctct

SEQ ID NO: 7571952 - DNA, 23 bp, Homo sapiens
agcacctgtgatttcctagctct

SEQ ID NO: 7571953 - DNA, 22 bp, Homo sapiens
caaagggcggctgtcggagggt

SEQ ID NO: 7571954 - DNA, 22 bp, Homo sapiens
caaagggcggctgtcggagggt

SEQ ID NO: 7571955 - DNA, 22 bp, Homo sapiens
caaagggcattttagtgaactg

SEQ ID NO: 7571956 - DNA, 22 bp, Homo sapiens
caaagggcggctgtcggagggt

SEQ ID NO: 7571957 - DNA, 22 bp, Homo sapiens
caaagggctctagactcagcag

SEQ ID NO: 7571958 - DNA, 22 bp, Homo sapiens
agcaccaggtcgctggcacgct

SEQ ID NO: 7571959 - DNA, 22 bp, Homo sapiens
caaagggcggctgtcggagggt

SEQ ID NO: 7571960 - DNA, 20 bp, Homo sapiens
agcaccagtgggggcagccc

SEQ ID NO: 7571961 - DNA, 18 bp, Homo sapiens
agcaccagtcactaacag

SEQ ID NO: 7571962 - DNA, 22 bp, Homo sapiens
agcacctgcttaatgtgcagtg

SEQ ID NO: 7571963 - DNA, 18 bp, Homo sapiens
agcaccagtcactaacag

SEQ ID NO: 7571964 - DNA, 22 bp, Homo sapiens
agcaccaggtcgctggcacgct

SEQ ID NO: 7571965 - DNA, 18 bp, Homo sapiens
agcaccagtcactaacag

SEQ ID NO: 7571966 - DNA, 22 bp, Homo sapiens
agcaccaggtcgctggcacgct

SEQ ID NO: 7571967 - DNA, 22 bp, Homo sapiens
agcacctggagggctgggacct

SEQ ID NO: 7571968 - DNA, 22 bp, Homo sapiens
agcacctggagggctgggacct

SEQ ID NO: 7571969 - DNA, 22 bp, Homo sapiens
agcacctggagggctgggacct

SEQ ID NO: 7571970 - DNA, 22 bp, Homo sapiens
agcacctggagggctgggacct

SEQ ID NO: 7571971 - DNA, 22 bp, Homo sapiens
agcacctggatttgatagtcag

SEQ ID NO: 7571972 - DNA, 22 bp, Homo sapiens
agcacctgggaagctattctca

SEQ ID NO: 7571973 - DNA, 22 bp, Homo sapiens
agcacctgggaagctattctca

SEQ ID NO: 7571974 - DNA, 22 bp, Homo sapiens
agcacctgcttaatgtgcagtg

SEQ ID NO: 7571975 - DNA, 22 bp, Homo sapiens
agcacctgcttaatgtgcagtg

SEQ ID NO: 7571976 - DNA, 22 bp, Homo sapiens
agcacctgcttaatgtgcagtg

SEQ ID NO: 7571977 - DNA, 22 bp, Homo sapiens
agcacctgcttgtgactaggga

SEQ ID NO: 7571978 - DNA, 22 bp, Homo sapiens
agcacctgcttgtgactaggga

SEQ ID NO: 7571979 - DNA, 22 bp, Homo sapiens
agcactgggaacgcatggggcc

SEQ ID NO: 7571980 - DNA, 22 bp, Homo sapiens
agcactgggaacgcatggggcc

SEQ ID NO: 7571981 - DNA, 22 bp, Homo sapiens
agcactgggaacgcatggggcc

SEQ ID NO: 7571982 - DNA, 22 bp, Homo sapiens
agcactgggaacgcatggggcc

SEQ ID NO: 7571983 - DNA, 20 bp, Homo sapiens
agcactgtctgaccagtggc

SEQ ID NO: 7571984 - DNA, 22 bp, Homo sapiens
agcactgtccggtaagatgctc

SEQ ID NO: 7571985 - DNA, 22 bp, Homo sapiens
agcactgggaacgcatggggcc

SEQ ID NO: 7571986 - DNA, 22 bp, Homo sapiens
agcactgtagttatagctaaca

SEQ ID NO: 7571987 - DNA, 22 bp, Homo sapiens
agcactgtagttatagctaaca

SEQ ID NO: 7571988 - DNA, 22 bp, Homo sapiens
agcactggaaagttaagagttt

SEQ ID NO: 7571989 - DNA, 22 bp, Homo sapiens
agcactggagtttagtgggatt

SEQ ID NO: 7571990 - DNA, 22 bp, Homo sapiens
agcactggagtttagtgggatt

SEQ ID NO: 7571991 - DNA, 22 bp, Homo sapiens
agcactgattttgttgcactta

SEQ ID NO: 7571992 - DNA, 22 bp, Homo sapiens
agcactgattttgttgcactta

SEQ ID NO: 7571993 - DNA, 22 bp, Homo sapiens
agcactgctttagagcctctgc

SEQ ID NO: 7571994 - DNA, 22 bp, Homo sapiens
agcactgcctctgagctccagc

SEQ ID NO: 7571995 - DNA, 22 bp, Homo sapiens
agcactgcctctgagctccagc

SEQ ID NO: 7571996 - DNA, 22 bp, Homo sapiens
agcactgctttagagcctctgc

SEQ ID NO: 7571997 - DNA, 22 bp, Homo sapiens
agcactgctttagagcctctgc

SEQ ID NO: 7571998 - DNA, 22 bp, Homo sapiens
agcactcttctgtgatagttgt

SEQ ID NO: 7571999 - DNA, 22 bp, Homo sapiens
agcactctggagtaggagtggg

SEQ ID NO: 7572000 - DNA, 22 bp, Homo sapiens
agcactcctgtctttccccttt

SEQ ID NO: 7572001 - DNA, 22 bp, Homo sapiens
agcactcctgtctttccccttt

SEQ ID NO: 7572002 - DNA, 19 bp, Homo sapiens
agcactccctgttctgtct

SEQ ID NO: 7572003 - DNA, 22 bp, Homo sapiens
agcactattttccagaatgtag

SEQ ID NO: 7572004 - DNA, 22 bp, Homo sapiens
agcactctaagtgcaagacact

SEQ ID NO: 7572005 - DNA, 22 bp, Homo sapiens
agcactattttccagaatgtag

SEQ ID NO: 7572006 - DNA, 22 bp, Homo sapiens
agcactattccaatgatccaat

SEQ ID NO: 7572007 - DNA, 23 bp, Homo sapiens
agcactcatgctgcagaagtcat

SEQ ID NO: 7572008 - DNA, 23 bp, Homo sapiens
agcactcatgctgcagaagtcat

SEQ ID NO: 7572009 - DNA, 23 bp, Homo sapiens
agcactcatgctgcagaagtcat

SEQ ID NO: 7572010 - DNA, 22 bp, Homo sapiens
agcactatgtaattagtaagta

SEQ ID NO: 7572011 - DNA, 22 bp, Homo sapiens
agcactatgcaacagggacagc

SEQ ID NO: 7572012 - DNA, 22 bp, Homo sapiens
agcactatgtaattagtaagta

SEQ ID NO: 7572013 - DNA, 22 bp, Homo sapiens
agcactatgcaacagggacagc

SEQ ID NO: 7572014 - DNA, 20 bp, Homo sapiens
agcactataaggggaaaggg

SEQ ID NO: 7572015 - DNA, 20 bp, Homo sapiens
agcactaggtgtggcaggtg

SEQ ID NO: 7572016 - DNA, 22 bp, Homo sapiens
agcactagctttaagcattctg

SEQ ID NO: 7572017 - DNA, 20 bp, Homo sapiens
agcactataaggggaaaggg

SEQ ID NO: 7572018 - DNA, 22 bp, Homo sapiens
agcactagctttaagcattctg

SEQ ID NO: 7572019 - DNA, 22 bp, Homo sapiens
agcactagcctgttttgctgtg

SEQ ID NO: 7572020 - DNA, 22 bp, Homo sapiens
agcactagagccaaaatttggg

SEQ ID NO: 7572021 - DNA, 22 bp, Homo sapiens
agcactagcctgttttgctgtg

SEQ ID NO: 7572022 - DNA, 22 bp, Homo sapiens
agcactagctttaagcattctg

SEQ ID NO: 7572023 - DNA, 22 bp, Homo sapiens
agcacgagatcgatgtgccttt

SEQ ID NO: 7572024 - DNA, 22 bp, Homo sapiens
agcaccttgctcttggccttcc

SEQ ID NO: 7572025 - DNA, 22 bp, Homo sapiens
agcacgagatcgatgtgccttt

SEQ ID NO: 7572026 - DNA, 23 bp, Homo sapiens
agcacgggtacagcctggccagg

SEQ ID NO: 7572027 - DNA, 17 bp, Homo sapiens
agcactaaaatgcttcc

SEQ ID NO: 7572028 - DNA, 22 bp, Homo sapiens
agcacgttcttcattacttcac

SEQ ID NO: 7572029 - DNA, 17 bp, Homo sapiens
agcactaaaatgcttcc

SEQ ID NO: 7572030 - DNA, 22 bp, Homo sapiens
agcactaagtaatctcacagga

SEQ ID NO: 7572031 - DNA, 22 bp, Homo sapiens
agcactagagccaaaatttggg

SEQ ID NO: 7572032 - DNA, 22 bp, Homo sapiens
agcactagacatgtaagtgagc

SEQ ID NO: 7572033 - DNA, 17 bp, Homo sapiens
agcactaaggataatac

SEQ ID NO: 7572034 - DNA, 22 bp, Homo sapiens
agcactaagtaatctcacagga

SEQ ID NO: 7572035 - DNA, 22 bp, Homo sapiens
agcaccttcacaggctctcagg

SEQ ID NO: 7572036 - DNA, 21 bp, Homo sapiens
agcaccttacagctataatgg

SEQ ID NO: 7572037 - DNA, 21 bp, Homo sapiens
agcaccttcaattctattgtc

SEQ ID NO: 7572038 - DNA, 22 bp, Homo sapiens
agcaccttgagatcaagcagtg

SEQ ID NO: 7572039 - DNA, 22 bp, Homo sapiens
agcaccttcacaggctctcagg

SEQ ID NO: 7572040 - DNA, 21 bp, Homo sapiens
agcaccttcaattctattgtc

SEQ ID NO: 7572041 - DNA, 22 bp, Homo sapiens
agcaccttcacaggctctcagg

SEQ ID NO: 7572042 - DNA, 22 bp, Homo sapiens
agcaccttgatcttggacttcc

SEQ ID NO: 7572043 - DNA, 22 bp, Homo sapiens
agcaccttcacaggctctcagg

SEQ ID NO: 7572044 - DNA, 22 bp, Homo sapiens
agcaccttgagatcaagcagtg

SEQ ID NO: 7572045 - DNA, 22 bp, Homo sapiens
agcaccttgagatcaagcagtg

SEQ ID NO: 7572046 - DNA, 22 bp, Homo sapiens
agcaccttgatcttggacttcc

SEQ ID NO: 7572047 - DNA, 22 bp, Homo sapiens
agcaccttgatcttggacttcc

SEQ ID NO: 7572048 - DNA, 22 bp, Homo sapiens
agcacctgtgtgagctagatgt

SEQ ID NO: 7572049 - DNA, 20 bp, Homo sapiens
agcacctgtgtagaagcatc

SEQ ID NO: 7572050 - DNA, 20 bp, Homo sapiens
agcacctgtgtagaagcatc

SEQ ID NO: 7572051 - DNA, 20 bp, Homo sapiens
agcacctgtgtagaagcatc

SEQ ID NO: 7572052 - DNA, 20 bp, Homo sapiens
agcacctgtgtagaagcatc

SEQ ID NO: 7572053 - DNA, 22 bp, Homo sapiens
agcacctgtggctcatgctcgt

SEQ ID NO: 7572054 - DNA, 22 bp, Homo sapiens
agcacctgtggctcatgctcgt

SEQ ID NO: 7572055 - DNA, 22 bp, Homo sapiens
agcacctgtgccctgatggaga

SEQ ID NO: 7572056 - DNA, 22 bp, Homo sapiens
agcacctgtgccctgatggaga

SEQ ID NO: 7572057 - DNA, 22 bp, Homo sapiens
agcacctgtgtgagctagatgt

SEQ ID NO: 7572058 - DNA, 22 bp, Homo sapiens
agcacctgtgtgagctagatgt

SEQ ID NO: 7572059 - DNA, 22 bp, Homo sapiens
agcacctgtgtggtagggaggt

SEQ ID NO: 7572060 - DNA, 22 bp, Homo sapiens
agcacctgtgtggtagggaggt

SEQ ID NO: 7572061 - DNA, 22 bp, Homo sapiens
agcacctgtgttcatgcctcat

SEQ ID NO: 7572062 - DNA, 22 bp, Homo sapiens
agcacctgtgttcatgcctcat

SEQ ID NO: 7572063 - DNA, 22 bp, Homo sapiens
agcacctgtgttcatgcctcat

SEQ ID NO: 7572064 - DNA, 22 bp, Homo sapiens
agcacctgtgttcatgcctcat

SEQ ID NO: 7572065 - DNA, 22 bp, Homo sapiens
agcacctgttgcacttcataat

SEQ ID NO: 7572066 - DNA, 22 bp, Homo sapiens
agcagagctgcagtggcctgct

SEQ ID NO: 7572067 - DNA, 22 bp, Homo sapiens
agcagagctgcagtggcctgct

SEQ ID NO: 7572068 - DNA, 22 bp, Homo sapiens
agcagagctgcagtggcctgct

SEQ ID NO: 7572069 - DNA, 22 bp, Homo sapiens
agcagagctgcagtggcctgct

SEQ ID NO: 7572070 - DNA, 22 bp, Homo sapiens
agcagagctgcagtggcctgct

SEQ ID NO: 7572071 - DNA, 22 bp, Homo sapiens
agcagagctgcagtggcctgct

SEQ ID NO: 7572072 - DNA, 22 bp, Homo sapiens
agcagagctattcttgtgcaat

SEQ ID NO: 7572073 - DNA, 22 bp, Homo sapiens
agcagagcgcctgctcagaggg

SEQ ID NO: 7572074 - DNA, 22 bp, Homo sapiens
agcagagcgcctgctcagaggg

SEQ ID NO: 7572075 - DNA, 22 bp, Homo sapiens
agcactgtgagcaccagcacgc

SEQ ID NO: 7572076 - DNA, 22 bp, Homo sapiens
agcactgtgatttataacattt

SEQ ID NO: 7572077 - DNA, 22 bp, Homo sapiens
agcactgtgagcaccagcacgc

SEQ ID NO: 7572078 - DNA, 22 bp, Homo sapiens
agcactgtgatttataacattt

SEQ ID NO: 7572079 - DNA, 22 bp, Homo sapiens
agcactgtgatttataacattt

SEQ ID NO: 7572080 - DNA, 22 bp, Homo sapiens
agcagagaccatatagcccaga

SEQ ID NO: 7572081 - DNA, 22 bp, Homo sapiens
agcactgtggggaactcacaga

SEQ ID NO: 7572082 - DNA, 22 bp, Homo sapiens
agcactgtggggaactcacaga

SEQ ID NO: 7572083 - DNA, 22 bp, Homo sapiens
agcagagacctggttttgttga

SEQ ID NO: 7572084 - DNA, 22 bp, Homo sapiens
agcagagacctggttttgttga

SEQ ID NO: 7572085 - DNA, 22 bp, Homo sapiens
agcagagaggaggtggccctgt

SEQ ID NO: 7572086 - DNA, 22 bp, Homo sapiens
agcagagaggaggtggccctgt

SEQ ID NO: 7572087 - DNA, 22 bp, Homo sapiens
agcagagaggaggtggccctgt

SEQ ID NO: 7572088 - DNA, 22 bp, Homo sapiens
agcagagcgcctgctcagaggg

SEQ ID NO: 7572089 - DNA, 22 bp, Homo sapiens
agcagagcgcctgctcagaggg

SEQ ID NO: 7572090 - DNA, 22 bp, Homo sapiens
agcagagcgcctgctcagaggg

SEQ ID NO: 7572091 - DNA, 22 bp, Homo sapiens
agcagagcctgggctaggggtg

SEQ ID NO: 7572092 - DNA, 22 bp, Homo sapiens
agcagagacctggttttgttga

SEQ ID NO: 7572093 - DNA, 22 bp, Homo sapiens
agcagagacctggttttgttga

SEQ ID NO: 7572094 - DNA, 22 bp, Homo sapiens
agcagagacctggttttgttga

SEQ ID NO: 7572095 - DNA, 22 bp, Homo sapiens
agcactgtggggaactcacaga

SEQ ID NO: 7572096 - DNA, 22 bp, Homo sapiens
agcagagaccatatagcccaga

SEQ ID NO: 7572097 - DNA, 22 bp, Homo sapiens
agcagagaccatatagcccaga

SEQ ID NO: 7572098 - DNA, 22 bp, Homo sapiens
agcagagaccatatagcccaga

SEQ ID NO: 7572099 - DNA, 22 bp, Homo sapiens
agcagaggacagttcttaggaa

SEQ ID NO: 7572100 - DNA, 22 bp, Homo sapiens
agcagaggacagttcttaggaa

SEQ ID NO: 7572101 - DNA, 22 bp, Homo sapiens
agcagaggacagttcttaggaa

SEQ ID NO: 7572102 - DNA, 22 bp, Homo sapiens
agcagaggacagttcttaggaa

SEQ ID NO: 7572103 - DNA, 22 bp, Homo sapiens
agcagaggacagttcttaggaa

SEQ ID NO: 7572104 - DNA, 22 bp, Homo sapiens
agcagaggaggatttagttagg

SEQ ID NO: 7572105 - DNA, 22 bp, Homo sapiens
agcagaggaggatttagttagg

SEQ ID NO: 7572106 - DNA, 22 bp, Homo sapiens
agcagaggaggatttagttagg

SEQ ID NO: 7572107 - DNA, 22 bp, Homo sapiens
agcagaggacagttcttaggaa

SEQ ID NO: 7572108 - DNA, 22 bp, Homo sapiens
agcagagctttttggactcaga

SEQ ID NO: 7572109 - DNA, 22 bp, Homo sapiens
agcagagctttttggactcaga

SEQ ID NO: 7572110 - DNA, 22 bp, Homo sapiens
agcagagctttttggactcaga

SEQ ID NO: 7572111 - DNA, 22 bp, Homo sapiens
agcagagctttttggactcaga

SEQ ID NO: 7572112 - DNA, 22 bp, Homo sapiens
agcagagctttttggactcaga

SEQ ID NO: 7572113 - DNA, 22 bp, Homo sapiens
agcagagctgggatcctgggtc

SEQ ID NO: 7572114 - DNA, 22 bp, Homo sapiens
agcagagctgggatcctgggtc

SEQ ID NO: 7572115 - DNA, 22 bp, Homo sapiens
agcagagctgggatcctgggtc

SEQ ID NO: 7572116 - DNA, 21 bp, Homo sapiens
agcagaggcagaatgtatgca

SEQ ID NO: 7572117 - DNA, 21 bp, Homo sapiens
agcagaggcagaatgtatgca

SEQ ID NO: 7572118 - DNA, 21 bp, Homo sapiens
agcagaggcagaatgtatgca

SEQ ID NO: 7572119 - DNA, 21 bp, Homo sapiens
agcagaggcagaatgtatgca

SEQ ID NO: 7572120 - DNA, 22 bp, Homo sapiens
agcagaggaggatttagttagg

SEQ ID NO: 7572121 - DNA, 21 bp, Homo sapiens
agcagaggcagaatgtatgca

SEQ ID NO: 7572122 - DNA, 21 bp, Homo sapiens
agcagaggcagaatgtatgca

SEQ ID NO: 7572123 - DNA, 21 bp, Homo sapiens
agcagaggcagaatgtatgca

SEQ ID NO: 7572124 - DNA, 21 bp, Homo sapiens
agcagaggctgcctggtgact

SEQ ID NO: 7572125 - DNA, 21 bp, Homo sapiens
agcagaggctgcctggtgact

SEQ ID NO: 7572126 - DNA, 21 bp, Homo sapiens
agcagaggctgcctggtgact

SEQ ID NO: 7572127 - DNA, 21 bp, Homo sapiens
agcagaggctgcctggtgact

SEQ ID NO: 7572128 - DNA, 21 bp, Homo sapiens
agcagaggctgcctggtgact

SEQ ID NO: 7572129 - DNA, 21 bp, Homo sapiens
agcagaggctgcctggtgact

SEQ ID NO: 7572130 - DNA, 21 bp, Homo sapiens
agcagaggctgcctggtgact

SEQ ID NO: 7572131 - DNA, 21 bp, Homo sapiens
agcagaggctgcctggtgact

SEQ ID NO: 7572132 - DNA, 21 bp, Homo sapiens
agcagaggctgcctggtgact

SEQ ID NO: 7572133 - DNA, 20 bp, Homo sapiens
agcagagtgcccatcccgga

SEQ ID NO: 7572134 - DNA, 20 bp, Homo sapiens
agcagagtgcccatcccgga

SEQ ID NO: 7572135 - DNA, 20 bp, Homo sapiens
agcagagtgcccatcccgga

SEQ ID NO: 7572136 - DNA, 20 bp, Homo sapiens
agcagagtgcccatcccgga

SEQ ID NO: 7572137 - DNA, 22 bp, Homo sapiens
agcagagtcttcaagggcaggc

SEQ ID NO: 7572138 - DNA, 22 bp, Homo sapiens
agcagagtcttcaagggcaggc

SEQ ID NO: 7572139 - DNA, 22 bp, Homo sapiens
agcagagtcttcaagggcaggc

SEQ ID NO: 7572140 - DNA, 20 bp, Homo sapiens
agcagagtgcccatcccgga

SEQ ID NO: 7572141 - DNA, 20 bp, Homo sapiens
agcagagtgcccatcccgga

SEQ ID NO: 7572142 - DNA, 22 bp, Homo sapiens
agcagagtcttcaagggcaggc

SEQ ID NO: 7572143 - DNA, 22 bp, Homo sapiens
agcagaggtttgttggaaacct

SEQ ID NO: 7572144 - DNA, 22 bp, Homo sapiens
agcagaggtttgttggaaacct

SEQ ID NO: 7572145 - DNA, 22 bp, Homo sapiens
agcagaggtttgttggaaacct

SEQ ID NO: 7572146 - DNA, 22 bp, Homo sapiens
agcagaggtttgttggaaacct

SEQ ID NO: 7572147 - DNA, 22 bp, Homo sapiens
agcagaggtttgttggaaacct

SEQ ID NO: 7572148 - DNA, 22 bp, Homo sapiens
agcagagtctgtgtgcacttta

SEQ ID NO: 7572149 - DNA, 22 bp, Homo sapiens
agcagagtctgtgtgcacttta

SEQ ID NO: 7572150 - DNA, 22 bp, Homo sapiens
agcagagtctgtgtgcacttta

SEQ ID NO: 7572151 - DNA, 22 bp, Homo sapiens
agcagaggtttgttggaaacct

SEQ ID NO: 7572152 - DNA, 22 bp, Homo sapiens
agcagaggtgtttattatggga

SEQ ID NO: 7572153 - DNA, 22 bp, Homo sapiens
agcagaggtgtttattatggga

SEQ ID NO: 7572154 - DNA, 22 bp, Homo sapiens
agcagaggtttgttggaaacct

SEQ ID NO: 7572155 - DNA, 22 bp, Homo sapiens
agcagaggtttgttggaaacct

SEQ ID NO: 7572156 - DNA, 16 bp, Homo sapiens
agcagaggtgagtgaa

SEQ ID NO: 7572157 - DNA, 16 bp, Homo sapiens
agcagaggtgagtgaa

SEQ ID NO: 7572158 - DNA, 22 bp, Homo sapiens
agcagaggtgtttattatggga

SEQ ID NO: 7572159 - DNA, 21 bp, Homo sapiens
agcagaggggacatgtttgat

SEQ ID NO: 7572160 - DNA, 21 bp, Homo sapiens
agcagaggggacatgtttgat

SEQ ID NO: 7572161 - DNA, 16 bp, Homo sapiens
agcagaggtgagtgaa

SEQ ID NO: 7572162 - DNA, 21 bp, Homo sapiens
agcagaggggacatgtttgat

SEQ ID NO: 7572163 - DNA, 21 bp, Homo sapiens
agcagaggctgcctggtgact

SEQ ID NO: 7572164 - DNA, 21 bp, Homo sapiens
agcagaggggacatgtttgat

SEQ ID NO: 7572165 - DNA, 22 bp, Homo sapiens
caataatttacattggatacca

SEQ ID NO: 7572166 - DNA, 22 bp, Homo sapiens
caataattgctttccagagtta

SEQ ID NO: 7572167 - DNA, 22 bp, Homo sapiens
caataatttacattggatacca

SEQ ID NO: 7572168 - DNA, 20 bp, Homo sapiens
caataatttacttccctatt

SEQ ID NO: 7572169 - DNA, 20 bp, Homo sapiens
caataatttacttccctatt

SEQ ID NO: 7572170 - DNA, 22 bp, Homo sapiens
caataatttacattggatacca

SEQ ID NO: 7572171 - DNA, 22 bp, Homo sapiens
caataatttacattggatacca

SEQ ID NO: 7572172 - DNA, 22 bp, Homo sapiens
caataattgctttccagagtta

SEQ ID NO: 7572173 - DNA, 22 bp, Homo sapiens
caataattgctttccagagtta

SEQ ID NO: 7572174 - DNA, 22 bp, Homo sapiens
caataatatcctgtgctgtttg

SEQ ID NO: 7572175 - DNA, 22 bp, Homo sapiens
caatacaattaccagttaatca

SEQ ID NO: 7572176 - DNA, 22 bp, Homo sapiens
caatacaattaccagttaatca

SEQ ID NO: 7572177 - DNA, 22 bp, Homo sapiens
caatacaattaccagttaatca

SEQ ID NO: 7572178 - DNA, 22 bp, Homo sapiens
caatacaattaccagttaatca

SEQ ID NO: 7572179 - DNA, 22 bp, Homo sapiens
caatacaattaccagttaatca

SEQ ID NO: 7572180 - DNA, 22 bp, Homo sapiens
caatacaattaccagttaatca

SEQ ID NO: 7572181 - DNA, 22 bp, Homo sapiens
caatacaattaccagttaatca

SEQ ID NO: 7572182 - DNA, 20 bp, Homo sapiens
caataatttacttccctatt

SEQ ID NO: 7572183 - DNA, 20 bp, Homo sapiens
caataatttacttccctatt

SEQ ID NO: 7572184 - DNA, 20 bp, Homo sapiens
caataatttacttccctatt

SEQ ID NO: 7572185 - DNA, 22 bp, Homo sapiens
caataatatcctgtgctgtttg

SEQ ID NO: 7572186 - DNA, 22 bp, Homo sapiens
caataatatcctgtgctgtttg

SEQ ID NO: 7572187 - DNA, 22 bp, Homo sapiens
caataatatcctgtgctgtttg

SEQ ID NO: 7572188 - DNA, 22 bp, Homo sapiens
caataatatcctgtgctgtttg

SEQ ID NO: 7572189 - DNA, 19 bp, Homo sapiens
caataagtcagtagtgggc

SEQ ID NO: 7572190 - DNA, 22 bp, Homo sapiens
caataatatcctgtgctgtttg

SEQ ID NO: 7572191 - DNA, 22 bp, Homo sapiens
caataatatcctgtgctgtttg

SEQ ID NO: 7572192 - DNA, 22 bp, Homo sapiens
caataatatcctgtgctgtttg

SEQ ID NO: 7572193 - DNA, 22 bp, Homo sapiens
caataatatcctgtgctgtttg

SEQ ID NO: 7572194 - DNA, 22 bp, Homo sapiens
caataatatcctgtgctgtttg

SEQ ID NO: 7572195 - DNA, 22 bp, Homo sapiens
caagtgagtgaccagagttggt

SEQ ID NO: 7572196 - DNA, 22 bp, Homo sapiens
caagtgacttctttgagcccgt

SEQ ID NO: 7572197 - DNA, 22 bp, Homo sapiens
caagtgactgtgctggcaacat

SEQ ID NO: 7572198 - DNA, 22 bp, Homo sapiens
caagtgacattcaatactagag

SEQ ID NO: 7572199 - DNA, 22 bp, Homo sapiens
caagtgactgtgctggcaacat

SEQ ID NO: 7572200 - DNA, 20 bp, Homo sapiens
agcagagtgcccatcccgga

SEQ ID NO: 7572201 - DNA, 20 bp, Homo sapiens
agcagagtgcccatcccgga

SEQ ID NO: 7572202 - DNA, 20 bp, Homo sapiens
agcagagtgcccatcccgga

SEQ ID NO: 7572203 - DNA, 20 bp, Homo sapiens
agcagagtgcccatcccgga

SEQ ID NO: 7572204 - DNA, 22 bp, Homo sapiens
agcagagtgccccatcacaagg

SEQ ID NO: 7572205 - DNA, 22 bp, Homo sapiens
caagtgacaagacctgtgggcc

SEQ ID NO: 7572206 - DNA, 22 bp, Homo sapiens
caagtgacagtttgaaagccag

SEQ ID NO: 7572207 - DNA, 21 bp, Homo sapiens
agcagcagatctggtgagggc

SEQ ID NO: 7572208 - DNA, 20 bp, Homo sapiens
agcagcagatgttggaggtg

SEQ ID NO: 7572209 - DNA, 20 bp, Homo sapiens
agcagcagatgttggaggtg

SEQ ID NO: 7572210 - DNA, 22 bp, Homo sapiens
agcagccagaaatccagaggtg

SEQ ID NO: 7572211 - DNA, 20 bp, Homo sapiens
agcagcagatgttggaggtg

SEQ ID NO: 7572212 - DNA, 22 bp, Homo sapiens
agcagccagaaatccagaggtg

SEQ ID NO: 7572213 - DNA, 21 bp, Homo sapiens
agcagcagatctggtgagggc

SEQ ID NO: 7572214 - DNA, 21 bp, Homo sapiens
agcagcagatctggtgagggc

SEQ ID NO: 7572215 - DNA, 22 bp, Homo sapiens
agcagccagagaatgatgcagt

SEQ ID NO: 7572216 - DNA, 22 bp, Homo sapiens
agcagccagagaatgatgcagt

SEQ ID NO: 7572217 - DNA, 22 bp, Homo sapiens
agcagccagaaatccagaggtg

SEQ ID NO: 7572218 - DNA, 22 bp, Homo sapiens
agcagccagaaatccagaggtg

SEQ ID NO: 7572219 - DNA, 22 bp, Homo sapiens
agcagcccagataaagctcagg

SEQ ID NO: 7572220 - DNA, 22 bp, Homo sapiens
agcagccagagaatgatgcagt

SEQ ID NO: 7572221 - DNA, 22 bp, Homo sapiens
agcagccagagaatgatgcagt

SEQ ID NO: 7572222 - DNA, 23 bp, Homo sapiens
agcagcccaatggcaagctctgg

SEQ ID NO: 7572223 - DNA, 23 bp, Homo sapiens
agcagcccaatggcaagctctgg

SEQ ID NO: 7572224 - DNA, 22 bp, Homo sapiens
agcagccctagggattgctgtt

SEQ ID NO: 7572225 - DNA, 22 bp, Homo sapiens
agcagcccctcggcgggtgcgc

SEQ ID NO: 7572226 - DNA, 22 bp, Homo sapiens
agcagcccctcggcgggtgcgc

SEQ ID NO: 7572227 - DNA, 23 bp, Homo sapiens
agcagcccagatgccttccatcc

SEQ ID NO: 7572228 - DNA, 22 bp, Homo sapiens
agcagcccctcggcgggtgcgc

SEQ ID NO: 7572229 - DNA, 23 bp, Homo sapiens
agcagcccagatgccttccatcc

SEQ ID NO: 7572230 - DNA, 22 bp, Homo sapiens
agcagccttgcaggggtcgcac

SEQ ID NO: 7572231 - DNA, 22 bp, Homo sapiens
agcagccttgcaggggtcgcac

SEQ ID NO: 7572232 - DNA, 21 bp, Homo sapiens
agcagccttgtgtgccaggca

SEQ ID NO: 7572233 - DNA, 22 bp, Homo sapiens
agcagccttgcaggggtcgcac

SEQ ID NO: 7572234 - DNA, 22 bp, Homo sapiens
agcagccttaggtattgtgatt

SEQ ID NO: 7572235 - DNA, 22 bp, Homo sapiens
agcagccttaggtattgtgatt

SEQ ID NO: 7572236 - DNA, 22 bp, Homo sapiens
agcagccttaggtattgtgatt

SEQ ID NO: 7572237 - DNA, 22 bp, Homo sapiens
agcagcctgcagatattggtct

SEQ ID NO: 7572238 - DNA, 22 bp, Homo sapiens
agcagcctgcagatattggtct

SEQ ID NO: 7572239 - DNA, 22 bp, Homo sapiens
agcagcctctgtagaggtctcc

SEQ ID NO: 7572240 - DNA, 22 bp, Homo sapiens
agcagcctctgtagaggtctcc

SEQ ID NO: 7572241 - DNA, 22 bp, Homo sapiens
agcagcctctgtagaggtctcc

SEQ ID NO: 7572242 - DNA, 22 bp, Homo sapiens
agcagcctggacttggatgtgg

SEQ ID NO: 7572243 - DNA, 22 bp, Homo sapiens
agcagcctggtctctcgccaat

SEQ ID NO: 7572244 - DNA, 22 bp, Homo sapiens
agcagcctggacttggatgtgg

SEQ ID NO: 7572245 - DNA, 22 bp, Homo sapiens
agcagcctattcttctcttgga

SEQ ID NO: 7572246 - DNA, 22 bp, Homo sapiens
agcagcctattcttctcttgga

SEQ ID NO: 7572247 - DNA, 22 bp, Homo sapiens
agcagcctattcttctcttgga

SEQ ID NO: 7572248 - DNA, 22 bp, Homo sapiens
agcagcctcccagggagcagcc

SEQ ID NO: 7572249 - DNA, 22 bp, Homo sapiens
agcagcctcccagggagcagcc

SEQ ID NO: 7572250 - DNA, 22 bp, Homo sapiens
agcagcctcccagggagcagcc

SEQ ID NO: 7572251 - DNA, 22 bp, Homo sapiens
agcagcctcccagggagcagcc

SEQ ID NO: 7572252 - DNA, 22 bp, Homo sapiens
agcagcctcccagggagcagcc

SEQ ID NO: 7572253 - DNA, 22 bp, Homo sapiens
agcagcctcccagggagcagcc

SEQ ID NO: 7572254 - DNA, 22 bp, Homo sapiens
agcagcctcccagggagcagcc

SEQ ID NO: 7572255 - DNA, 23 bp, Homo sapiens
agcagccctgggacctggcctgc

SEQ ID NO: 7572256 - DNA, 22 bp, Homo sapiens
agcagccgtattatggtggttt

SEQ ID NO: 7572257 - DNA, 22 bp, Homo sapiens
agcagcctattcttctcttgga

SEQ ID NO: 7572258 - DNA, 22 bp, Homo sapiens
agcagcctattcttctcttgga

SEQ ID NO: 7572259 - DNA, 23 bp, Homo sapiens
agcagccctgggacctggcctgc

SEQ ID NO: 7572260 - DNA, 22 bp, Homo sapiens
agcagccctatgtaattggact

SEQ ID NO: 7572261 - DNA, 23 bp, Homo sapiens
agcagccctgggacctggcctgc

SEQ ID NO: 7572262 - DNA, 23 bp, Homo sapiens
agcagccctgggacctggcctgc

SEQ ID NO: 7572263 - DNA, 23 bp, Homo sapiens
agcagccctgggacctggcctgc

SEQ ID NO: 7572264 - DNA, 22 bp, Homo sapiens
caatactgagtttacattcatc

SEQ ID NO: 7572265 - DNA, 22 bp, Homo sapiens
caatactgagtttacattcatc

SEQ ID NO: 7572266 - DNA, 22 bp, Homo sapiens
caatactgagtttacattcatc

SEQ ID NO: 7572267 - DNA, 22 bp, Homo sapiens
caatactgagtttacattcatc

SEQ ID NO: 7572268 - DNA, 22 bp, Homo sapiens
caatacctgtggagctgagcct

SEQ ID NO: 7572269 - DNA, 18 bp, Homo sapiens
caatactgagaggtgggg

SEQ ID NO: 7572270 - DNA, 18 bp, Homo sapiens
caatactgagaggtgggg

SEQ ID NO: 7572271 - DNA, 22 bp, Homo sapiens
caatactattcggaccatctct

SEQ ID NO: 7572272 - DNA, 16 bp, Homo sapiens
caatacatggcatttc

SEQ ID NO: 7572273 - DNA, 16 bp, Homo sapiens
caatacatggcatttc

SEQ ID NO: 7572274 - DNA, 19 bp, Homo sapiens
agcagcagaagtgtgcctt

SEQ ID NO: 7572275 - DNA, 22 bp, Homo sapiens
agcagcagagctctggtctgca

SEQ ID NO: 7572276 - DNA, 19 bp, Homo sapiens
agcagcagaagtgtgcctt

SEQ ID NO: 7572277 - DNA, 19 bp, Homo sapiens
agcagcagaagtgtgcctt

SEQ ID NO: 7572278 - DNA, 19 bp, Homo sapiens
agcagcagaagtgtgcctt

SEQ ID NO: 7572279 - DNA, 22 bp, Homo sapiens
caatacactaaacttctctgaa

SEQ ID NO: 7572280 - DNA, 22 bp, Homo sapiens
caatacagcacacctgtatcag

SEQ ID NO: 7572281 - DNA, 22 bp, Homo sapiens
caatacatcaggtcaaaatgtg

SEQ ID NO: 7572282 - DNA, 22 bp, Homo sapiens
caatacatcaggtcaaaatgtg

SEQ ID NO: 7572283 - DNA, 22 bp, Homo sapiens
caatacatcaggtcaaaatgtg

SEQ ID NO: 7572284 - DNA, 22 bp, Homo sapiens
caatacatcaggtcaaaatgtg

SEQ ID NO: 7572285 - DNA, 22 bp, Homo sapiens
caatacatcaggtcaaaatgtg

SEQ ID NO: 7572286 - DNA, 22 bp, Homo sapiens
caatacatcaggtcaaaatgtg

SEQ ID NO: 7572287 - DNA, 22 bp, Homo sapiens
caatacaattaccagttaatca

SEQ ID NO: 7572288 - DNA, 22 bp, Homo sapiens
caatacaattaccagttaatca

SEQ ID NO: 7572289 - DNA, 22 bp, Homo sapiens
caatacactaaacttctctgaa

SEQ ID NO: 7572290 - DNA, 22 bp, Homo sapiens
caatacactaaacttctctgaa

SEQ ID NO: 7572291 - DNA, 22 bp, Homo sapiens
caatacaattaccagttaatca

SEQ ID NO: 7572292 - DNA, 22 bp, Homo sapiens
caatacaattaccagttaatca

SEQ ID NO: 7572293 - DNA, 22 bp, Homo sapiens
caatacaattaccagttaatca

SEQ ID NO: 7572294 - DNA, 22 bp, Homo sapiens
agcagcagatcaaacaggcttg

SEQ ID NO: 7572295 - DNA, 22 bp, Homo sapiens
agcagcagatcaaacaggcttg

SEQ ID NO: 7572296 - DNA, 22 bp, Homo sapiens
agcagcagaggtcagaaaggta

SEQ ID NO: 7572297 - DNA, 22 bp, Homo sapiens
agcagcagaggtcagaaaggta

SEQ ID NO: 7572298 - DNA, 22 bp, Homo sapiens
agcagcagaggtcagaaaggta

SEQ ID NO: 7572299 - DNA, 22 bp, Homo sapiens
agcagcagagctctggtctgca

SEQ ID NO: 7572300 - DNA, 22 bp, Homo sapiens
agcagcagagctctggtctgca

SEQ ID NO: 7572301 - DNA, 22 bp, Homo sapiens
agcagcagagctctggtctgca

SEQ ID NO: 7572302 - DNA, 22 bp, Homo sapiens
agcagcagagctctggtctgca

SEQ ID NO: 7572303 - DNA, 22 bp, Homo sapiens
agcagcagagctctggtctgca

SEQ ID NO: 7572304 - DNA, 22 bp, Homo sapiens
agcagcagaggtcagaaaggta

SEQ ID NO: 7572305 - DNA, 22 bp, Homo sapiens
agcagcagaggtcagaaaggta

SEQ ID NO: 7572306 - DNA, 22 bp, Homo sapiens
agcagcagaggtcagaaaggta

SEQ ID NO: 7572307 - DNA, 22 bp, Homo sapiens
agcagcagatcaaacaggcttg

SEQ ID NO: 7572308 - DNA, 22 bp, Homo sapiens
agcagcagatccaaaaaatgtg

SEQ ID NO: 7572309 - DNA, 22 bp, Homo sapiens
agcagcagatccaaaaaatgtg

SEQ ID NO: 7572310 - DNA, 22 bp, Homo sapiens
agcagcagatcaaacaggcttg

SEQ ID NO: 7572311 - DNA, 22 bp, Homo sapiens
agcagcagatcaaacaggcttg

SEQ ID NO: 7572312 - DNA, 22 bp, Homo sapiens
agcagcagatcaaacaggcttg

SEQ ID NO: 7572313 - DNA, 21 bp, Homo sapiens
agcagcagatctggtgagggc

SEQ ID NO: 7572314 - DNA, 21 bp, Homo sapiens
agcagcagatctggtgagggc

SEQ ID NO: 7572315 - DNA, 22 bp, Homo sapiens
agcagcagatccaaaaaatgtg

SEQ ID NO: 7572316 - DNA, 21 bp, Homo sapiens
agcagcagatctggtgagggc

SEQ ID NO: 7572317 - DNA, 21 bp, Homo sapiens
agcagcagatctggtgagggc

SEQ ID NO: 7572318 - DNA, 21 bp, Homo sapiens
agcagcagatctggtgagggc

SEQ ID NO: 7572319 - DNA, 22 bp, Homo sapiens
agcagcagatccaaaaaatgtg

SEQ ID NO: 7572320 - DNA, 22 bp, Homo sapiens
agcagcagatccaaaaaatgtg

SEQ ID NO: 7572321 - DNA, 22 bp, Homo sapiens
cacagagatcggaacagaagta

SEQ ID NO: 7572322 - DNA, 21 bp, Homo sapiens
cacagagatattggtgagcct

SEQ ID NO: 7572323 - DNA, 22 bp, Homo sapiens
cacagagatcggaacagaagta

SEQ ID NO: 7572324 - DNA, 22 bp, Homo sapiens
cacagagatcggaacagaagta

SEQ ID NO: 7572325 - DNA, 22 bp, Homo sapiens
cacagagatcggaacagaagta

SEQ ID NO: 7572326 - DNA, 22 bp, Homo sapiens
cacagagatcggaacagaagta

SEQ ID NO: 7572327 - DNA, 21 bp, Homo sapiens
cacagagatattggtgagcct

SEQ ID NO: 7572328 - DNA, 21 bp, Homo sapiens
cacagagatattggtgagcct

SEQ ID NO: 7572329 - DNA, 21 bp, Homo sapiens
cacagagatattggtgagcct

SEQ ID NO: 7572330 - DNA, 22 bp, Homo sapiens
cacagagatcggaacagaagta

SEQ ID NO: 7572331 - DNA, 22 bp, Homo sapiens
cacagagatggccagggcacat

SEQ ID NO: 7572332 - DNA, 22 bp, Homo sapiens
cacagagatggccagggcacat

SEQ ID NO: 7572333 - DNA, 22 bp, Homo sapiens
cacagagatggccagggcacat

SEQ ID NO: 7572334 - DNA, 22 bp, Homo sapiens
cacagagatggccagggcacat

SEQ ID NO: 7572335 - DNA, 22 bp, Homo sapiens
cacagagatcggaacagaagta

SEQ ID NO: 7572336 - DNA, 22 bp, Homo sapiens
cacagagatcggaacagaagta

SEQ ID NO: 7572337 - DNA, 22 bp, Homo sapiens
cacagagatcggaacagaagta

SEQ ID NO: 7572338 - DNA, 22 bp, Homo sapiens
cacagagatcggaacagaagta

SEQ ID NO: 7572339 - DNA, 22 bp, Homo sapiens
cacagagatcggaacagaagta

SEQ ID NO: 7572340 - DNA, 22 bp, Homo sapiens
cacagaacatccttagctcatg

SEQ ID NO: 7572341 - DNA, 22 bp, Homo sapiens
cacagaacatccttagctcatg

SEQ ID NO: 7572342 - DNA, 22 bp, Homo sapiens
cacagaacatttttagatgcag

SEQ ID NO: 7572343 - DNA, 22 bp, Homo sapiens
agcagctcccctcatgctccac

SEQ ID NO: 7572344 - DNA, 22 bp, Homo sapiens
agcagctcccctcatgctccac

SEQ ID NO: 7572345 - DNA, 22 bp, Homo sapiens
agcagctcccctcatgctccac

SEQ ID NO: 7572346 - DNA, 22 bp, Homo sapiens
agcagctcccctcatgctccac

SEQ ID NO: 7572347 - DNA, 22 bp, Homo sapiens
agcagctcccctcatgctccac

SEQ ID NO: 7572348 - DNA, 22 bp, Homo sapiens
cacagaactggttaatagcaga

SEQ ID NO: 7572349 - DNA, 22 bp, Homo sapiens
cacagaacatttttagatgcag

SEQ ID NO: 7572350 - DNA, 22 bp, Homo sapiens
cacagaacatttttagatgcag

SEQ ID NO: 7572351 - DNA, 22 bp, Homo sapiens
cacagagaggcttgtctccaag

SEQ ID NO: 7572352 - DNA, 22 bp, Homo sapiens
cacagagaggcttgtctccaag

SEQ ID NO: 7572353 - DNA, 22 bp, Homo sapiens
cacagagaggcttgtctccaag

SEQ ID NO: 7572354 - DNA, 22 bp, Homo sapiens
cacagagaggcttgtctccaag

SEQ ID NO: 7572355 - DNA, 21 bp, Homo sapiens
cacagagatattggtgagcct

SEQ ID NO: 7572356 - DNA, 21 bp, Homo sapiens
cacagagatattggtgagcct

SEQ ID NO: 7572357 - DNA, 21 bp, Homo sapiens
cacagagatattggtgagcct

SEQ ID NO: 7572358 - DNA, 21 bp, Homo sapiens
agcagccttgtgtgccaggca

SEQ ID NO: 7572359 - DNA, 21 bp, Homo sapiens
agcagccttgtgtgccaggca

SEQ ID NO: 7572360 - DNA, 21 bp, Homo sapiens
agcagccttgtgtgccaggca

SEQ ID NO: 7572361 - DNA, 22 bp, Homo sapiens
agcagcctttgatcatctggga

SEQ ID NO: 7572362 - DNA, 21 bp, Homo sapiens
agcagccttgtgtgccaggca

SEQ ID NO: 7572363 - DNA, 22 bp, Homo sapiens
agcagcctttgatcatctggga

SEQ ID NO: 7572364 - DNA, 22 bp, Homo sapiens
agcagcctttgatcatctggga

SEQ ID NO: 7572365 - DNA, 22 bp, Homo sapiens
agcagcctttgatcatctggga

SEQ ID NO: 7572366 - DNA, 22 bp, Homo sapiens
agcagcctttgatcatctggga

SEQ ID NO: 7572367 - DNA, 22 bp, Homo sapiens
agcagctagaatagtgcctggt

SEQ ID NO: 7572368 - DNA, 22 bp, Homo sapiens
agcagctagacttcagaatctg

SEQ ID NO: 7572369 - DNA, 22 bp, Homo sapiens
agcagctcaaagcctgcaagga

SEQ ID NO: 7572370 - DNA, 22 bp, Homo sapiens
agcagctcaaagcctgcaagga

SEQ ID NO: 7572371 - DNA, 22 bp, Homo sapiens
agcagctcaaagcctgcaagga

SEQ ID NO: 7572372 - DNA, 22 bp, Homo sapiens
agcagctcaaagcctgcaagga

SEQ ID NO: 7572373 - DNA, 22 bp, Homo sapiens
agcagctaagtagcgcagttaa

SEQ ID NO: 7572374 - DNA, 22 bp, Homo sapiens
agcagctacttaaccttgtaca

SEQ ID NO: 7572375 - DNA, 22 bp, Homo sapiens
agcagcctttgatcatctggga

SEQ ID NO: 7572376 - DNA, 22 bp, Homo sapiens
agcagctcatggagtaggcact

SEQ ID NO: 7572377 - DNA, 22 bp, Homo sapiens
agcagctcatggagtaggcact

SEQ ID NO: 7572378 - DNA, 22 bp, Homo sapiens
agcagctcatggagtaggcact

SEQ ID NO: 7572379 - DNA, 22 bp, Homo sapiens
agcagctcatggagtaggcact

SEQ ID NO: 7572380 - DNA, 19 bp, Homo sapiens
agcagctcagggaggcacc

SEQ ID NO: 7572381 - DNA, 19 bp, Homo sapiens
agcagctcagggaggcacc

SEQ ID NO: 7572382 - DNA, 19 bp, Homo sapiens
agcagctcagggaggcacc

SEQ ID NO: 7572383 - DNA, 19 bp, Homo sapiens
agcagctcagggaggcacc

SEQ ID NO: 7572384 - DNA, 19 bp, Homo sapiens
agcagctcagggaggcacc

SEQ ID NO: 7572385 - DNA, 22 bp, Homo sapiens
agcagctcagaggcaccagggc

SEQ ID NO: 7572386 - DNA, 22 bp, Homo sapiens
agcagctcagaggcaccagggc

SEQ ID NO: 7572387 - DNA, 22 bp, Homo sapiens
agcagctcacaggattcctgaa

SEQ ID NO: 7572388 - DNA, 22 bp, Homo sapiens
agcagctcagaggcaccagggc

SEQ ID NO: 7572389 - DNA, 22 bp, Homo sapiens
agcagctcaacagtgtctctat

SEQ ID NO: 7572390 - DNA, 22 bp, Homo sapiens
agcagctcaaagcctgcaagga

SEQ ID NO: 7572391 - DNA, 22 bp, Homo sapiens
agcagctcaaagcctgcaagga

SEQ ID NO: 7572392 - DNA, 22 bp, Homo sapiens
agcagctcaaagcctgcaagga

SEQ ID NO: 7572393 - DNA, 22 bp, Homo sapiens
agcagctcacaggattcctgaa

SEQ ID NO: 7572394 - DNA, 22 bp, Homo sapiens
agcagctcaagacttaaatttg

SEQ ID NO: 7572395 - DNA, 22 bp, Homo sapiens
agcagctcaacagtgtctctat

SEQ ID NO: 7572396 - DNA, 22 bp, Homo sapiens
cacagagattagaattagacta

SEQ ID NO: 7572397 - DNA, 22 bp, Homo sapiens
cacagagatggtctggcaggtg

SEQ ID NO: 7572398 - DNA, 22 bp, Homo sapiens
cacagagatggtctggcaggtg

SEQ ID NO: 7572399 - DNA, 22 bp, Homo sapiens
cacagagcaactcaaatcagct

SEQ ID NO: 7572400 - DNA, 22 bp, Homo sapiens
cacagagattagaattagacta

SEQ ID NO: 7572401 - DNA, 22 bp, Homo sapiens
cacagagattagaattagacta

SEQ ID NO: 7572402 - DNA, 22 bp, Homo sapiens
cacagagattagaattagacta

SEQ ID NO: 7572403 - DNA, 22 bp, Homo sapiens
cacagagatggtctggcaggtg

SEQ ID NO: 7572404 - DNA, 22 bp, Homo sapiens
cacagagatggtctggcaggtg

SEQ ID NO: 7572405 - DNA, 22 bp, Homo sapiens
cacagagatggtctggcaggtg

SEQ ID NO: 7572406 - DNA, 22 bp, Homo sapiens
cacagagatggtctggcaggtg

SEQ ID NO: 7572407 - DNA, 22 bp, Homo sapiens
cacagagatggtctggcaggtg

SEQ ID NO: 7572408 - DNA, 22 bp, Homo sapiens
cacagagatggccagggcacat

SEQ ID NO: 7572409 - DNA, 22 bp, Homo sapiens
cacagagatggccagggcacat

SEQ ID NO: 7572410 - DNA, 22 bp, Homo sapiens
cacagagatggccagggcacat

SEQ ID NO: 7572411 - DNA, 22 bp, Homo sapiens
cacagagatggccagggcacat

SEQ ID NO: 7572412 - DNA, 22 bp, Homo sapiens
agcagctggaacatatgaagaa

SEQ ID NO: 7572413 - DNA, 22 bp, Homo sapiens
agcagctggaacatatgaagaa

SEQ ID NO: 7572414 - DNA, 22 bp, Homo sapiens
agcagctggaacatatgaagaa

SEQ ID NO: 7572415 - DNA, 22 bp, Homo sapiens
agcagctgcttttcttcattgg

SEQ ID NO: 7572416 - DNA, 22 bp, Homo sapiens
agcagctggaacatatgaagaa

SEQ ID NO: 7572417 - DNA, 22 bp, Homo sapiens
agcagctggaacatatgaagaa

SEQ ID NO: 7572418 - DNA, 22 bp, Homo sapiens
agcagctggaacatatgaagaa

SEQ ID NO: 7572419 - DNA, 22 bp, Homo sapiens
agcagctggaacatatgaagaa

SEQ ID NO: 7572420 - DNA, 22 bp, Homo sapiens
agcagctggaactaatagtggt

SEQ ID NO: 7572421 - DNA, 22 bp, Homo sapiens
agcagctggaactaatagtggt

SEQ ID NO: 7572422 - DNA, 22 bp, Homo sapiens
agcagctgcttttcttcattgg

SEQ ID NO: 7572423 - DNA, 22 bp, Homo sapiens
agcagctgcttttcttcattgg

SEQ ID NO: 7572424 - DNA, 22 bp, Homo sapiens
agcagctgcttttcttcattgg

SEQ ID NO: 7572425 - DNA, 22 bp, Homo sapiens
agcagctgcttttcttcattgg

SEQ ID NO: 7572426 - DNA, 22 bp, Homo sapiens
cacagagcaggtgctgggaaga

SEQ ID NO: 7572427 - DNA, 22 bp, Homo sapiens
cacagagcaggtgctgggaaga

SEQ ID NO: 7572428 - DNA, 22 bp, Homo sapiens
cacagagctcaagtcttagaaa

SEQ ID NO: 7572429 - DNA, 22 bp, Homo sapiens
cacagagctcaagtcttagaaa

SEQ ID NO: 7572430 - DNA, 22 bp, Homo sapiens
cacagagcaactcaaatcagct

SEQ ID NO: 7572431 - DNA, 22 bp, Homo sapiens
cacagagcaggtgctgggaaga

SEQ ID NO: 7572432 - DNA, 19 bp, Homo sapiens
agcagctggaggtggagtg

SEQ ID NO: 7572433 - DNA, 19 bp, Homo sapiens
agcagctggaggtggagtg

SEQ ID NO: 7572434 - DNA, 19 bp, Homo sapiens
agcagctggaggtggagtg

SEQ ID NO: 7572435 - DNA, 19 bp, Homo sapiens
agcagctggaggtggagtg

SEQ ID NO: 7572436 - DNA, 19 bp, Homo sapiens
agcagctggaggtggagtg

SEQ ID NO: 7572437 - DNA, 17 bp, Homo sapiens
agcagctggcacaggag

SEQ ID NO: 7572438 - DNA, 17 bp, Homo sapiens
agcagctggcacaggag

SEQ ID NO: 7572439 - DNA, 19 bp, Homo sapiens
agcagctggaggtggagtg

SEQ ID NO: 7572440 - DNA, 17 bp, Homo sapiens
agcagctggcacaggag

SEQ ID NO: 7572441 - DNA, 17 bp, Homo sapiens
agcagctggcacaggag

SEQ ID NO: 7572442 - DNA, 22 bp, Homo sapiens
agcagctggaactaatagtggt

SEQ ID NO: 7572443 - DNA, 22 bp, Homo sapiens
agcagctggaactaatagtggt

SEQ ID NO: 7572444 - DNA, 19 bp, Homo sapiens
agcagctggaggtggagtg

SEQ ID NO: 7572445 - DNA, 22 bp, Homo sapiens
agcagctggaactaatagtggt

SEQ ID NO: 7572446 - DNA, 19 bp, Homo sapiens
agcagctggaggtggagtg

SEQ ID NO: 7572447 - DNA, 19 bp, Homo sapiens
agcagctggaggtggagtg

SEQ ID NO: 7572448 - DNA, 19 bp, Homo sapiens
agcagctggaggtggagtg

SEQ ID NO: 7572449 - DNA, 19 bp, Homo sapiens
agcagctggaggtggagtg

SEQ ID NO: 7572450 - DNA, 19 bp, Homo sapiens
agcagctggaggtggagtg

SEQ ID NO: 7572451 - DNA, 19 bp, Homo sapiens
agcagctggaggtggagtg

SEQ ID NO: 7572452 - DNA, 17 bp, Homo sapiens
agcagctggcacaggag

SEQ ID NO: 7572453 - DNA, 17 bp, Homo sapiens
agcagctggcacaggag

SEQ ID NO: 7572454 - DNA, 17 bp, Homo sapiens
agcagctggcacaggag

SEQ ID NO: 7572455 - DNA, 17 bp, Homo sapiens
agcagctggcacaggag

SEQ ID NO: 7572456 - DNA, 22 bp, Homo sapiens
agcagctggcagcttcttctct

SEQ ID NO: 7572457 - DNA, 17 bp, Homo sapiens
agcagctggcacaggag

SEQ ID NO: 7572458 - DNA, 22 bp, Homo sapiens
agcagctggcagcttcttctct

SEQ ID NO: 7572459 - DNA, 22 bp, Homo sapiens
agcagctggcagcttcttctct

SEQ ID NO: 7572460 - DNA, 21 bp, Homo sapiens
agcagctgggcaacatggagg

SEQ ID NO: 7572461 - DNA, 21 bp, Homo sapiens
agcagctgggcaacatggagg

SEQ ID NO: 7572462 - DNA, 21 bp, Homo sapiens
agcagctgggcaacatggagg

SEQ ID NO: 7572463 - DNA, 21 bp, Homo sapiens
agcagctgggcaacatggagg

SEQ ID NO: 7572464 - DNA, 21 bp, Homo sapiens
agcagctgggcaacatggagg

SEQ ID NO: 7572465 - DNA, 21 bp, Homo sapiens
agcagctgggcaacatggagg

SEQ ID NO: 7572466 - DNA, 22 bp, Homo sapiens
agcagtggcctggggctctgtg

SEQ ID NO: 7572467 - DNA, 22 bp, Homo sapiens
agcagtggcctggggctctgtg

SEQ ID NO: 7572468 - DNA, 22 bp, Homo sapiens
agcagtggcctggggctctgtg

SEQ ID NO: 7572469 - DNA, 22 bp, Homo sapiens
agcagtggcctggggctctgtg

SEQ ID NO: 7572470 - DNA, 19 bp, Homo sapiens
agcagtggagccatgcctg

SEQ ID NO: 7572471 - DNA, 19 bp, Homo sapiens
agcagtggagccatgcctg

SEQ ID NO: 7572472 - DNA, 22 bp, Homo sapiens
agcagtggagcgagatgtttaa

SEQ ID NO: 7572473 - DNA, 22 bp, Homo sapiens
agcagtggagcgagatgtttaa

SEQ ID NO: 7572474 - DNA, 22 bp, Homo sapiens
agcatcagagagaagttaacta

SEQ ID NO: 7572475 - DNA, 22 bp, Homo sapiens
agcatcaacaatgaacataaat

SEQ ID NO: 7572476 - DNA, 22 bp, Homo sapiens
agcatgaaagcataggacagtc

SEQ ID NO: 7572477 - DNA, 22 bp, Homo sapiens
agcatcagagagaagttaacta

SEQ ID NO: 7572478 - DNA, 22 bp, Homo sapiens
agcatcagcagactctcagcta

SEQ ID NO: 7572479 - DNA, 22 bp, Homo sapiens
agcatattgtatgtctatatgt

SEQ ID NO: 7572480 - DNA, 22 bp, Homo sapiens
agcatattgtatgtctatatgt

SEQ ID NO: 7572481 - DNA, 22 bp, Homo sapiens
agcatataggaaatgttgaatc

SEQ ID NO: 7572482 - DNA, 22 bp, Homo sapiens
agcatattcatgccagactact

SEQ ID NO: 7572483 - DNA, 18 bp, Homo sapiens
agcatgagagaggctgtg

SEQ ID NO: 7572484 - DNA, 18 bp, Homo sapiens
agcatgagtcaggggtgc

SEQ ID NO: 7572485 - DNA, 18 bp, Homo sapiens
agcatgagtcaggggtgc

SEQ ID NO: 7572486 - DNA, 18 bp, Homo sapiens
agcatgagagaggctgtg

SEQ ID NO: 7572487 - DNA, 18 bp, Homo sapiens
agcatgagagaggctgtg

SEQ ID NO: 7572488 - DNA, 22 bp, Homo sapiens
agcatgaagacttcagagctag

SEQ ID NO: 7572489 - DNA, 22 bp, Homo sapiens
agcatgaagacttcagagctag

SEQ ID NO: 7572490 - DNA, 22 bp, Homo sapiens
agcatgcacatgactggcttaa

SEQ ID NO: 7572491 - DNA, 21 bp, Homo sapiens
agcatgcactacttcatctta

SEQ ID NO: 7572492 - DNA, 22 bp, Homo sapiens
agcatgatgtagaatcactgga

SEQ ID NO: 7572493 - DNA, 18 bp, Homo sapiens
agcatgagtcaggggtgc

SEQ ID NO: 7572494 - DNA, 22 bp, Homo sapiens
agcatgaaaggcgtgccaactt

SEQ ID NO: 7572495 - DNA, 22 bp, Homo sapiens
agcatgaaaggcgtgccaactt

SEQ ID NO: 7572496 - DNA, 22 bp, Homo sapiens
agcatgaagacttcagagctag

SEQ ID NO: 7572497 - DNA, 22 bp, Homo sapiens
agcatgaagacttcagagctag

SEQ ID NO: 7572498 - DNA, 22 bp, Homo sapiens
agcatgaaagcataggacagtc

SEQ ID NO: 7572499 - DNA, 22 bp, Homo sapiens
agcatgaaaggcgtgccaactt

SEQ ID NO: 7572500 - DNA, 21 bp, Homo sapiens
agcagtgctcctgggatgagg

SEQ ID NO: 7572501 - DNA, 22 bp, Homo sapiens
agcagtgctatggccaggctaa

SEQ ID NO: 7572502 - DNA, 22 bp, Homo sapiens
agcagtggacctcagtgctatt

SEQ ID NO: 7572503 - DNA, 19 bp, Homo sapiens
agcagtggagccatgcctg

SEQ ID NO: 7572504 - DNA, 22 bp, Homo sapiens
agcagtggacctcagtgctatt

SEQ ID NO: 7572505 - DNA, 22 bp, Homo sapiens
agcagtggacctcagtgctatt

SEQ ID NO: 7572506 - DNA, 22 bp, Homo sapiens
agcagtgcctggcacatgtaag

SEQ ID NO: 7572507 - DNA, 22 bp, Homo sapiens
agcagtgcctggcacatgtaag

SEQ ID NO: 7572508 - DNA, 22 bp, Homo sapiens
agcagtgcctggcacatgtaag

SEQ ID NO: 7572509 - DNA, 22 bp, Homo sapiens
agcagtgccgcatcttgtgacc

SEQ ID NO: 7572510 - DNA, 22 bp, Homo sapiens
agcagtgcccattctgccccct

SEQ ID NO: 7572511 - DNA, 22 bp, Homo sapiens
agcagtgcccattctgccccct

SEQ ID NO: 7572512 - DNA, 22 bp, Homo sapiens
agcagtgcccattctgccccct

SEQ ID NO: 7572513 - DNA, 22 bp, Homo sapiens
agcagtgatgcatgacagccta

SEQ ID NO: 7572514 - DNA, 22 bp, Homo sapiens
agcagtgattctcttggactca

SEQ ID NO: 7572515 - DNA, 22 bp, Homo sapiens
agcagtgattctcttggactca

SEQ ID NO: 7572516 - DNA, 22 bp, Homo sapiens
agcagtgatgcatgacagccta

SEQ ID NO: 7572517 - DNA, 22 bp, Homo sapiens
agcagtgatgcatgacagccta

SEQ ID NO: 7572518 - DNA, 23 bp, Homo sapiens
agcagtgagtaaacagataggat

SEQ ID NO: 7572519 - DNA, 23 bp, Homo sapiens
agcagtgagtaaacagataggat

SEQ ID NO: 7572520 - DNA, 22 bp, Homo sapiens
agcagtgagtaacacagaccag

SEQ ID NO: 7572521 - DNA, 22 bp, Homo sapiens
agcagtgagtaacacagaccag

SEQ ID NO: 7572522 - DNA, 22 bp, Homo sapiens
agcagtgagtgggaggaccatg

SEQ ID NO: 7572523 - DNA, 22 bp, Homo sapiens
agcagtgagtgggaggaccatg

SEQ ID NO: 7572524 - DNA, 22 bp, Homo sapiens
agcagtgatgaaatgagcatcc

SEQ ID NO: 7572525 - DNA, 22 bp, Homo sapiens
agcagtgatgaaatgagcatcc

SEQ ID NO: 7572526 - DNA, 22 bp, Homo sapiens
agcagtgagtaacacagaccag

SEQ ID NO: 7572527 - DNA, 22 bp, Homo sapiens
agcagtgagtgggaggaccatg

SEQ ID NO: 7572528 - DNA, 22 bp, Homo sapiens
agcagtgagtgggaggaccatg

SEQ ID NO: 7572529 - DNA, 22 bp, Homo sapiens
agcagtgatgcatgacagccta

SEQ ID NO: 7572530 - DNA, 22 bp, Homo sapiens
agcagtgatgaaatgagcatcc

SEQ ID NO: 7572531 - DNA, 22 bp, Homo sapiens
agcagtgatgaaatgagcatcc

SEQ ID NO: 7572532 - DNA, 22 bp, Homo sapiens
agcagtgaaacagctgcatatg

SEQ ID NO: 7572533 - DNA, 22 bp, Homo sapiens
agcagtgaaacagctgcatatg

SEQ ID NO: 7572534 - DNA, 22 bp, Homo sapiens
agcagtgaaacagctgcatatg

SEQ ID NO: 7572535 - DNA, 22 bp, Homo sapiens
agcagtgaaacagctgcatatg

SEQ ID NO: 7572536 - DNA, 22 bp, Homo sapiens
agcagtgaaacagctgcatatg

SEQ ID NO: 7572537 - DNA, 22 bp, Homo sapiens
agcagtgagccataagtgctag

SEQ ID NO: 7572538 - DNA, 22 bp, Homo sapiens
agcagtgagccataagtgctag

SEQ ID NO: 7572539 - DNA, 22 bp, Homo sapiens
agcagtgagccataagtgctag

SEQ ID NO: 7572540 - DNA, 23 bp, Homo sapiens
agcagtgagtaaacagataggat

SEQ ID NO: 7572541 - DNA, 23 bp, Homo sapiens
agcagtgagtaaacagataggat

SEQ ID NO: 7572542 - DNA, 22 bp, Homo sapiens
agcagtgagccataagtgctag

SEQ ID NO: 7572543 - DNA, 22 bp, Homo sapiens
agcagtgagccataagtgctag

SEQ ID NO: 7572544 - DNA, 22 bp, Homo sapiens
agcagtgacttgctttgtttcc

SEQ ID NO: 7572545 - DNA, 22 bp, Homo sapiens
agcagtgacttgctttgtttcc

SEQ ID NO: 7572546 - DNA, 22 bp, Homo sapiens
agcaggttaaaccaaaatataa

SEQ ID NO: 7572547 - DNA, 18 bp, Homo sapiens
agcaggttctcacagcca

SEQ ID NO: 7572548 - DNA, 18 bp, Homo sapiens
agcaggttctcacagcca

SEQ ID NO: 7572549 - DNA, 22 bp, Homo sapiens
agcaggttccaggcactgtggc

SEQ ID NO: 7572550 - DNA, 22 bp, Homo sapiens
agcaggttccaggcactgtggc

SEQ ID NO: 7572551 - DNA, 22 bp, Homo sapiens
agcaggttgttttgtggccagg

SEQ ID NO: 7572552 - DNA, 22 bp, Homo sapiens
agcaggttgttttcttcaatat

SEQ ID NO: 7572553 - DNA, 22 bp, Homo sapiens
agcaggttgtgatacactcaga

SEQ ID NO: 7572554 - DNA, 22 bp, Homo sapiens
agcagtaagtgaagactagttt

SEQ ID NO: 7572555 - DNA, 22 bp, Homo sapiens
agcagtaagtgaagactagttt

SEQ ID NO: 7572556 - DNA, 22 bp, Homo sapiens
agcagtaagacttttttctgtg

SEQ ID NO: 7572557 - DNA, 23 bp, Homo sapiens
agcagtaacttcagaaacatcag

SEQ ID NO: 7572558 - DNA, 22 bp, Homo sapiens
agcagtaagcaactgagcttgc

SEQ ID NO: 7572559 - DNA, 22 bp, Homo sapiens
agcagtaagcaactgagcttgc

SEQ ID NO: 7572560 - DNA, 22 bp, Homo sapiens
agcaggtttaaactctaatgca

SEQ ID NO: 7572561 - DNA, 22 bp, Homo sapiens
agcaggtttaaactctaatgca

SEQ ID NO: 7572562 - DNA, 22 bp, Homo sapiens
agcaggtttgttttcttctgag

SEQ ID NO: 7572563 - DNA, 23 bp, Homo sapiens
agcagtaacttcagaaacatcag

SEQ ID NO: 7572564 - DNA, 23 bp, Homo sapiens
agcagtaacttcagaaacatcag

SEQ ID NO: 7572565 - DNA, 18 bp, Homo sapiens
agcagtagcgccaggtgc

SEQ ID NO: 7572566 - DNA, 20 bp, Homo sapiens
agcagtaggacctctgggcc

SEQ ID NO: 7572567 - DNA, 22 bp, Homo sapiens
agcagtagtgatggcccctgag

SEQ ID NO: 7572568 - DNA, 18 bp, Homo sapiens
agcagtagcgccaggtgc

SEQ ID NO: 7572569 - DNA, 18 bp, Homo sapiens
agcagtagcgccaggtgc

SEQ ID NO: 7572570 - DNA, 22 bp, Homo sapiens
agcagtagtgatggcccctgag

SEQ ID NO: 7572571 - DNA, 22 bp, Homo sapiens
agcagtagtgatggcccctgag

SEQ ID NO: 7572572 - DNA, 22 bp, Homo sapiens
agcagtcaggcctcagagccgt

SEQ ID NO: 7572573 - DNA, 22 bp, Homo sapiens
agcagtcaggcctcagagccgt

SEQ ID NO: 7572574 - DNA, 22 bp, Homo sapiens
agcagtcaggcctcagagccgt

SEQ ID NO: 7572575 - DNA, 22 bp, Homo sapiens
agcagtcattttaggtcatgca

SEQ ID NO: 7572576 - DNA, 22 bp, Homo sapiens
agcagtcattttaggtcatgca

SEQ ID NO: 7572577 - DNA, 20 bp, Homo sapiens
agcagtccaaaagggcagac

SEQ ID NO: 7572578 - DNA, 22 bp, Homo sapiens
agcagtctggaacaagatatga

SEQ ID NO: 7572579 - DNA, 22 bp, Homo sapiens
agcagtccttctttagagagcc

SEQ ID NO: 7572580 - DNA, 22 bp, Homo sapiens
agcagtctggaacaagatatga

SEQ ID NO: 7572581 - DNA, 22 bp, Homo sapiens
agcagtccttctttagagagcc

SEQ ID NO: 7572582 - DNA, 22 bp, Homo sapiens
agcagtccttctttagagagcc

SEQ ID NO: 7572583 - DNA, 22 bp, Homo sapiens
agcagtccaactgaggtggcat

SEQ ID NO: 7572584 - DNA, 22 bp, Homo sapiens
agcagtccaactgaggtggcat

SEQ ID NO: 7572585 - DNA, 22 bp, Homo sapiens
agcagggctggggcacgagcca

SEQ ID NO: 7572586 - DNA, 22 bp, Homo sapiens
agcagggctggggcacgagcca

SEQ ID NO: 7572587 - DNA, 22 bp, Homo sapiens
agcagggctggatttggcaaga

SEQ ID NO: 7572588 - DNA, 22 bp, Homo sapiens
agcagggctggggcacgagcca

SEQ ID NO: 7572589 - DNA, 22 bp, Homo sapiens
agcagggctggggcacgagcca

SEQ ID NO: 7572590 - DNA, 22 bp, Homo sapiens
agcaggtgggcatgaaagctga

SEQ ID NO: 7572591 - DNA, 22 bp, Homo sapiens
agcaggtgggcatgaaagctga

SEQ ID NO: 7572592 - DNA, 22 bp, Homo sapiens
agcagggctgcggccccaccac

SEQ ID NO: 7572593 - DNA, 22 bp, Homo sapiens
agcagggctgcggccccaccac

SEQ ID NO: 7572594 - DNA, 22 bp, Homo sapiens
agcagggctgcggccccaccac

SEQ ID NO: 7572595 - DNA, 22 bp, Homo sapiens
agcagggctggatttggcaaga

SEQ ID NO: 7572596 - DNA, 22 bp, Homo sapiens
agcagggctggggcacgagcca

SEQ ID NO: 7572597 - DNA, 22 bp, Homo sapiens
agcagggctggggcacgagcca

SEQ ID NO: 7572598 - DNA, 22 bp, Homo sapiens
agcagggctggatttggcaaga

SEQ ID NO: 7572599 - DNA, 22 bp, Homo sapiens
agcagggctggatttggcaaga

SEQ ID NO: 7572600 - DNA, 22 bp, Homo sapiens
agcagggctggatttggcaaga

SEQ ID NO: 7572601 - DNA, 22 bp, Homo sapiens
agcaggtgttagggatccaatg

SEQ ID NO: 7572602 - DNA, 18 bp, Homo sapiens
agcaggtgtgcagaatgt

SEQ ID NO: 7572603 - DNA, 22 bp, Homo sapiens
agcaggtgttagggatccaatg

SEQ ID NO: 7572604 - DNA, 22 bp, Homo sapiens
agcaggtgttggctgggccatc

SEQ ID NO: 7572605 - DNA, 22 bp, Homo sapiens
agcaggtgtttgtatcataagg

SEQ ID NO: 7572606 - DNA, 22 bp, Homo sapiens
agcaggtgttggctgggccatc

SEQ ID NO: 7572607 - DNA, 18 bp, Homo sapiens
agcaggtgtgcagaatgt

SEQ ID NO: 7572608 - DNA, 18 bp, Homo sapiens
agcaggtgtgcagaatgt

SEQ ID NO: 7572609 - DNA, 22 bp, Homo sapiens
agcaggtgtcggcgagggtctt

SEQ ID NO: 7572610 - DNA, 19 bp, Homo sapiens
agcaggtgggtaagaaaat

SEQ ID NO: 7572611 - DNA, 22 bp, Homo sapiens
agcaggtgtcggcgagggtctt

SEQ ID NO: 7572612 - DNA, 22 bp, Homo sapiens
agcaggtgtcggcgagggtctt

SEQ ID NO: 7572613 - DNA, 22 bp, Homo sapiens
agcaggtgtcggcgagggtctt

SEQ ID NO: 7572614 - DNA, 22 bp, Homo sapiens
cactgtgggtcccagactggag

SEQ ID NO: 7572615 - DNA, 22 bp, Homo sapiens
cactgtgggtcccagactggag

SEQ ID NO: 7572616 - DNA, 22 bp, Homo sapiens
cactgtggggtttggctggaac

SEQ ID NO: 7572617 - DNA, 19 bp, Homo sapiens
cactgtggtccttcactgc

SEQ ID NO: 7572618 - DNA, 22 bp, Homo sapiens
cactgtggtgtgagggctgatg

SEQ ID NO: 7572619 - DNA, 22 bp, Homo sapiens
cactgtggttattatcactgtt

SEQ ID NO: 7572620 - DNA, 22 bp, Homo sapiens
cactgtgtaagaagatgggctt

SEQ ID NO: 7572621 - DNA, 22 bp, Homo sapiens
cactgtgtcagtttggttagac

SEQ ID NO: 7572622 - DNA, 22 bp, Homo sapiens
cactgtggggtttggctggaac

SEQ ID NO: 7572623 - DNA, 22 bp, Homo sapiens
cactgtggggtttggctggaac

SEQ ID NO: 7572624 - DNA, 22 bp, Homo sapiens
cactgtggcttaccaaagctaa

SEQ ID NO: 7572625 - DNA, 22 bp, Homo sapiens
cactggtgagtccagaagtcat

SEQ ID NO: 7572626 - DNA, 22 bp, Homo sapiens
cactggtgagtccagaagtcat

SEQ ID NO: 7572627 - DNA, 22 bp, Homo sapiens
agcattaataagaaatggctcc

SEQ ID NO: 7572628 - DNA, 22 bp, Homo sapiens
agcattaataagaaatggctcc

SEQ ID NO: 7572629 - DNA, 22 bp, Homo sapiens
agcattaataagaaatggctcc

SEQ ID NO: 7572630 - DNA, 22 bp, Homo sapiens
agcattaataagaaatggctcc

SEQ ID NO: 7572631 - DNA, 22 bp, Homo sapiens
cactgtttggctcctgtactta

SEQ ID NO: 7572632 - DNA, 22 bp, Homo sapiens
cactgttttattccaacatagg

SEQ ID NO: 7572633 - DNA, 22 bp, Homo sapiens
cactgttttcagtcagttctat

SEQ ID NO: 7572634 - DNA, 22 bp, Homo sapiens
cactgttttcagtcagttctat

SEQ ID NO: 7572635 - DNA, 22 bp, Homo sapiens
cactgtttttatgtaatcagtg

SEQ ID NO: 7572636 - DNA, 22 bp, Homo sapiens
cactgtttttatgtaatcagtg

SEQ ID NO: 7572637 - DNA, 22 bp, Homo sapiens
cacttaaaactcctggaattgt

SEQ ID NO: 7572638 - DNA, 22 bp, Homo sapiens
cactgtttttatgtaatcagtg

SEQ ID NO: 7572639 - DNA, 22 bp, Homo sapiens
cactgtttggctcctgtactta

SEQ ID NO: 7572640 - DNA, 22 bp, Homo sapiens
cacttaaaactcctggaattgt

SEQ ID NO: 7572641 - DNA, 22 bp, Homo sapiens
cacttaaaactcctggaattgt

SEQ ID NO: 7572642 - DNA, 22 bp, Homo sapiens
cacttaaagtcttagcttacag

SEQ ID NO: 7572643 - DNA, 22 bp, Homo sapiens
cactttactatctataaaataa

SEQ ID NO: 7572644 - DNA, 22 bp, Homo sapiens
cactttactatctataaaataa

SEQ ID NO: 7572645 - DNA, 22 bp, Homo sapiens
cactgttattactactatacat

SEQ ID NO: 7572646 - DNA, 22 bp, Homo sapiens
cactgttcacattttagtctat

SEQ ID NO: 7572647 - DNA, 22 bp, Homo sapiens
cactgttcacattttagtctat

SEQ ID NO: 7572648 - DNA, 22 bp, Homo sapiens
cactgttcacattttagtctat

SEQ ID NO: 7572649 - DNA, 22 bp, Homo sapiens
cactgttattactactatacat

SEQ ID NO: 7572650 - DNA, 22 bp, Homo sapiens
cactgtgtctggagtgagctgg

SEQ ID NO: 7572651 - DNA, 23 bp, Homo sapiens
cactgtgttacatgttgaagatg

SEQ ID NO: 7572652 - DNA, 22 bp, Homo sapiens
cactgtgtctggagtgagctgg

SEQ ID NO: 7572653 - DNA, 22 bp, Homo sapiens
cactgttgagcaatgtacagtg

SEQ ID NO: 7572654 - DNA, 22 bp, Homo sapiens
cactgttgaagatacttcctct

SEQ ID NO: 7572655 - DNA, 19 bp, Homo sapiens
cactgttgtcctagtactt

SEQ ID NO: 7572656 - DNA, 22 bp, Homo sapiens
cactgtttaataatattgttaa

SEQ ID NO: 7572657 - DNA, 22 bp, Homo sapiens
cactgttcatcaaaactgctct

SEQ ID NO: 7572658 - DNA, 22 bp, Homo sapiens
cactgttcatcaaaactgctct

SEQ ID NO: 7572659 - DNA, 22 bp, Homo sapiens
cactgttctttttgtagtccaa

SEQ ID NO: 7572660 - DNA, 22 bp, Homo sapiens
agcatggggcaatgcatgtgct

SEQ ID NO: 7572661 - DNA, 22 bp, Homo sapiens
agcatggggcaatgcatgtgct

SEQ ID NO: 7572662 - DNA, 22 bp, Homo sapiens
agcatggggcaatgcatgtgct

SEQ ID NO: 7572663 - DNA, 22 bp, Homo sapiens
agcatggggcaatgcatgtgct

SEQ ID NO: 7572664 - DNA, 22 bp, Homo sapiens
agcatggggcaatgcatgtgct

SEQ ID NO: 7572665 - DNA, 22 bp, Homo sapiens
agcatggctttggaggatagca

SEQ ID NO: 7572666 - DNA, 22 bp, Homo sapiens
agcatggctttggaggatagca

SEQ ID NO: 7572667 - DNA, 22 bp, Homo sapiens
agcatggctttggaggatagca

SEQ ID NO: 7572668 - DNA, 22 bp, Homo sapiens
agcatggctttggaggatagca

SEQ ID NO: 7572669 - DNA, 22 bp, Homo sapiens
agcatggccatctgggccgtcc

SEQ ID NO: 7572670 - DNA, 19 bp, Homo sapiens
agcatggcctacagtgtgc

SEQ ID NO: 7572671 - DNA, 19 bp, Homo sapiens
agcatggcctacagtgtgc

SEQ ID NO: 7572672 - DNA, 22 bp, Homo sapiens
agcatggcctcccgggcctggc

SEQ ID NO: 7572673 - DNA, 22 bp, Homo sapiens
agcatggcctcccgggcctggc

SEQ ID NO: 7572674 - DNA, 22 bp, Homo sapiens
agcatggcctcccgggcctggc

SEQ ID NO: 7572675 - DNA, 22 bp, Homo sapiens
agcatggcctcccgggcctggc

SEQ ID NO: 7572676 - DNA, 22 bp, Homo sapiens
agcatggcctgcagcggccacc

SEQ ID NO: 7572677 - DNA, 22 bp, Homo sapiens
agcatggcctgcagcggccacc

SEQ ID NO: 7572678 - DNA, 22 bp, Homo sapiens
agcatgtctaactcttcagggt

SEQ ID NO: 7572679 - DNA, 21 bp, Homo sapiens
agcatgtctcagtcaacaagg

SEQ ID NO: 7572680 - DNA, 22 bp, Homo sapiens
agcatgtaaagctcttagcacc

SEQ ID NO: 7572681 - DNA, 22 bp, Homo sapiens
agcatggggcaatgcatgtgct

SEQ ID NO: 7572682 - DNA, 22 bp, Homo sapiens
agcatggggcaatgcatgtgct

SEQ ID NO: 7572683 - DNA, 22 bp, Homo sapiens
agcatggggctccgcaatgaac

SEQ ID NO: 7572684 - DNA, 22 bp, Homo sapiens
agcatgtgtggagaaatatttt

SEQ ID NO: 7572685 - DNA, 22 bp, Homo sapiens
agcatgtggctatctttggggg

SEQ ID NO: 7572686 - DNA, 21 bp, Homo sapiens
agcatgtctcagtcaacaagg

SEQ ID NO: 7572687 - DNA, 22 bp, Homo sapiens
agcatgtgtaatctcaatacct

SEQ ID NO: 7572688 - DNA, 22 bp, Homo sapiens
agcattaagcctggctcagagg

SEQ ID NO: 7572689 - DNA, 22 bp, Homo sapiens
agcattaagagagactgaactg

SEQ ID NO: 7572690 - DNA, 22 bp, Homo sapiens
agcattaagagagactgaactg

SEQ ID NO: 7572691 - DNA, 22 bp, Homo sapiens
agcatgttcatcttctgttggt

SEQ ID NO: 7572692 - DNA, 22 bp, Homo sapiens
agcatgttcatcttctgttggt

SEQ ID NO: 7572693 - DNA, 22 bp, Homo sapiens
agcatgctgggtcatttttgcc

SEQ ID NO: 7572694 - DNA, 22 bp, Homo sapiens
agcatgcgcttgatcagctcca

SEQ ID NO: 7572695 - DNA, 22 bp, Homo sapiens
agcatgcatttttggactgtgc

SEQ ID NO: 7572696 - DNA, 22 bp, Homo sapiens
agcatgctggtgttcatggcag

SEQ ID NO: 7572697 - DNA, 22 bp, Homo sapiens
agcatgcttggcatttgtcaga

SEQ ID NO: 7572698 - DNA, 22 bp, Homo sapiens
agcatgcttattttatctcatt

SEQ ID NO: 7572699 - DNA, 22 bp, Homo sapiens
agcatgctggtgttcatggcag

SEQ ID NO: 7572700 - DNA, 20 bp, Homo sapiens
agcatgcagccagagccaac

SEQ ID NO: 7572701 - DNA, 22 bp, Homo sapiens
agcatgcaggaaccacatggca

SEQ ID NO: 7572702 - DNA, 21 bp, Homo sapiens
agcatgcactacttcatctta

SEQ ID NO: 7572703 - DNA, 22 bp, Homo sapiens
agcatgcgcttgatcagctcca

SEQ ID NO: 7572704 - DNA, 22 bp, Homo sapiens
agcatgcagtaaagcccatgtc

SEQ ID NO: 7572705 - DNA, 22 bp, Homo sapiens
agcatgcgcttgatcagctcca

SEQ ID NO: 7572706 - DNA, 22 bp, Homo sapiens
agcatgcatttttggactgtgc

SEQ ID NO: 7572707 - DNA, 22 bp, Homo sapiens
agcatgcatgaagattcagcaa

SEQ ID NO: 7572708 - DNA, 22 bp, Homo sapiens
agcatggcattattggaaggac

SEQ ID NO: 7572709 - DNA, 22 bp, Homo sapiens
agcatggcattattggaaggac

SEQ ID NO: 7572710 - DNA, 22 bp, Homo sapiens
agcatggcattattggaaggac

SEQ ID NO: 7572711 - DNA, 22 bp, Homo sapiens
agcatggccacgggggtaggta

SEQ ID NO: 7572712 - DNA, 22 bp, Homo sapiens
agcatggccacgggggtaggta

SEQ ID NO: 7572713 - DNA, 22 bp, Homo sapiens
agcatggccacgggggtaggta

SEQ ID NO: 7572714 - DNA, 22 bp, Homo sapiens
agcatggcattattggaaggac

SEQ ID NO: 7572715 - DNA, 18 bp, Homo sapiens
agcatggcacaggctccc

SEQ ID NO: 7572716 - DNA, 18 bp, Homo sapiens
agcatggcacaggctccc

SEQ ID NO: 7572717 - DNA, 18 bp, Homo sapiens
agcatggcacaggctccc

SEQ ID NO: 7572718 - DNA, 22 bp, Homo sapiens
agcatggcactcaaggctcctg

SEQ ID NO: 7572719 - DNA, 18 bp, Homo sapiens
agcatggcacaggctccc

SEQ ID NO: 7572720 - DNA, 22 bp, Homo sapiens
agcatggcactcaaggctcctg

SEQ ID NO: 7572721 - DNA, 23 bp, Homo sapiens
agcatggaagaagctggactcct

SEQ ID NO: 7572722 - DNA, 23 bp, Homo sapiens
agcatggaagaagctggactcct

SEQ ID NO: 7572723 - DNA, 23 bp, Homo sapiens
agcatggaagaagctggactcct

SEQ ID NO: 7572724 - DNA, 23 bp, Homo sapiens
agcatggaataggaaagaggcag

SEQ ID NO: 7572725 - DNA, 18 bp, Homo sapiens
agcatggcacaggctccc

SEQ ID NO: 7572726 - DNA, 22 bp, Homo sapiens
agcatggacagtggcagcagtg

SEQ ID NO: 7572727 - DNA, 22 bp, Homo sapiens
agcatggacagtggcagcagtg

SEQ ID NO: 7572728 - DNA, 22 bp, Homo sapiens
agcatggacagtggcagcagtg

SEQ ID NO: 7572729 - DNA, 22 bp, Homo sapiens
agcatggacagtggcagcagtg

SEQ ID NO: 7572730 - DNA, 23 bp, Homo sapiens
agcatggaataggaaagaggcag

SEQ ID NO: 7572731 - DNA, 22 bp, Homo sapiens
agcagggaggcccagggcactg

SEQ ID NO: 7572732 - DNA, 22 bp, Homo sapiens
agcagggaggcccagggcactg

SEQ ID NO: 7572733 - DNA, 22 bp, Homo sapiens
agcagggaggcccagggcactg

SEQ ID NO: 7572734 - DNA, 22 bp, Homo sapiens
agcagggaggcccagggcactg

SEQ ID NO: 7572735 - DNA, 22 bp, Homo sapiens
agcagggaggcccagggcactg

SEQ ID NO: 7572736 - DNA, 22 bp, Homo sapiens
agcagggaggcggtgtgctggc

SEQ ID NO: 7572737 - DNA, 22 bp, Homo sapiens
agcagggaggcccagggcactg

SEQ ID NO: 7572738 - DNA, 22 bp, Homo sapiens
agcagggaggcccagggcactg

SEQ ID NO: 7572739 - DNA, 22 bp, Homo sapiens
agcaggcttactttctgattag

SEQ ID NO: 7572740 - DNA, 22 bp, Homo sapiens
agcaggcttactttctgattag

SEQ ID NO: 7572741 - DNA, 22 bp, Homo sapiens
agcaggcttatggttgaaggga

SEQ ID NO: 7572742 - DNA, 22 bp, Homo sapiens
agcagggagaccatctcttcct

SEQ ID NO: 7572743 - DNA, 22 bp, Homo sapiens
agcagggagaccatctcttcct

SEQ ID NO: 7572744 - DNA, 22 bp, Homo sapiens
agcagggagaccatctcttcct

SEQ ID NO: 7572745 - DNA, 22 bp, Homo sapiens
agcagggaggcccagggcactg

SEQ ID NO: 7572746 - DNA, 22 bp, Homo sapiens
agcagggaggcccagggcactg

SEQ ID NO: 7572747 - DNA, 17 bp, Homo sapiens
agcagggagtcaaggga

SEQ ID NO: 7572748 - DNA, 17 bp, Homo sapiens
agcagggagtcaaggga

SEQ ID NO: 7572749 - DNA, 17 bp, Homo sapiens
agcagggagtcaaggga

SEQ ID NO: 7572750 - DNA, 17 bp, Homo sapiens
agcagggagtcaaggga

SEQ ID NO: 7572751 - DNA, 17 bp, Homo sapiens
agcagggagtcaaggga

SEQ ID NO: 7572752 - DNA, 17 bp, Homo sapiens
agcagggagtcaaggga

SEQ ID NO: 7572753 - DNA, 17 bp, Homo sapiens
agcagggagtcaaggga

SEQ ID NO: 7572754 - DNA, 17 bp, Homo sapiens
agcagggagtcaaggga

SEQ ID NO: 7572755 - DNA, 22 bp, Homo sapiens
agcagggaggtctagcacgtgg

SEQ ID NO: 7572756 - DNA, 22 bp, Homo sapiens
agcagggaggtctagcacgtgg

SEQ ID NO: 7572757 - DNA, 22 bp, Homo sapiens
agcagggaggtctagcacgtgg

SEQ ID NO: 7572758 - DNA, 22 bp, Homo sapiens
agcagggaggcggtgtgctggc

SEQ ID NO: 7572759 - DNA, 22 bp, Homo sapiens
agcagggaggcggtgtgctggc

SEQ ID NO: 7572760 - DNA, 22 bp, Homo sapiens
agcagggaggcggtgtgctggc

SEQ ID NO: 7572761 - DNA, 22 bp, Homo sapiens
agcagggaggcggtgtgctggc

SEQ ID NO: 7572762 - DNA, 22 bp, Homo sapiens
agcagggaggcggtgtgctggc

SEQ ID NO: 7572763 - DNA, 22 bp, Homo sapiens
agcagggaggcggtgtgctggc

SEQ ID NO: 7572764 - DNA, 22 bp, Homo sapiens
agcagggaggcggtgtgctggc

SEQ ID NO: 7572765 - DNA, 22 bp, Homo sapiens
agcagggaggtctagcacgtgg

SEQ ID NO: 7572766 - DNA, 22 bp, Homo sapiens
agcagggaggtctagcacgtgg

SEQ ID NO: 7572767 - DNA, 22 bp, Homo sapiens
agcagggaggtctagcacgtgg

SEQ ID NO: 7572768 - DNA, 22 bp, Homo sapiens
cacagcagaaatatgaaggcag

SEQ ID NO: 7572769 - DNA, 22 bp, Homo sapiens
cacagcagaaagtgtaggagga

SEQ ID NO: 7572770 - DNA, 22 bp, Homo sapiens
cacagcagaaagtgtaggagga

SEQ ID NO: 7572771 - DNA, 22 bp, Homo sapiens
cacagcagaaagtgtaggagga

SEQ ID NO: 7572772 - DNA, 22 bp, Homo sapiens
cacagcagaaagtgtaggagga

SEQ ID NO: 7572773 - DNA, 22 bp, Homo sapiens
cacagcagaaagtgtaggagga

SEQ ID NO: 7572774 - DNA, 22 bp, Homo sapiens
cacagcagaaagtgtaggagga

SEQ ID NO: 7572775 - DNA, 22 bp, Homo sapiens
cacagcagaaagtgtaggagga

SEQ ID NO: 7572776 - DNA, 22 bp, Homo sapiens
cacagcaatagctaactgatac

SEQ ID NO: 7572777 - DNA, 22 bp, Homo sapiens
cacagcaatagctaactgatac

SEQ ID NO: 7572778 - DNA, 22 bp, Homo sapiens
cacagcagaacttaatttcaaa

SEQ ID NO: 7572779 - DNA, 22 bp, Homo sapiens
cacagcagaacttaatttcaaa

SEQ ID NO: 7572780 - DNA, 22 bp, Homo sapiens
cacagcagaacttaatttcaaa

SEQ ID NO: 7572781 - DNA, 22 bp, Homo sapiens
cacagcagaacttaatttcaaa

SEQ ID NO: 7572782 - DNA, 22 bp, Homo sapiens
cacagcagaacttaatttcaaa

SEQ ID NO: 7572783 - DNA, 22 bp, Homo sapiens
cacagcagaaatatgaaggcag

SEQ ID NO: 7572784 - DNA, 22 bp, Homo sapiens
cacagcagaaatatgaaggcag

SEQ ID NO: 7572785 - DNA, 22 bp, Homo sapiens
cacagcagaaatatgaaggcag

SEQ ID NO: 7572786 - DNA, 22 bp, Homo sapiens
agcaggctgggcaatatgggca

SEQ ID NO: 7572787 - DNA, 22 bp, Homo sapiens
cacagcagcatcatttatctgg

SEQ ID NO: 7572788 - DNA, 22 bp, Homo sapiens
cacagcagatccaggggttgtg

SEQ ID NO: 7572789 - DNA, 22 bp, Homo sapiens
cacagcagatccaggggttgtg

SEQ ID NO: 7572790 - DNA, 22 bp, Homo sapiens
cacagcagagggagccattgaa

SEQ ID NO: 7572791 - DNA, 22 bp, Homo sapiens
cacagcagagggagccattgaa

SEQ ID NO: 7572792 - DNA, 22 bp, Homo sapiens
cacagcagagggagccattgaa

SEQ ID NO: 7572793 - DNA, 22 bp, Homo sapiens
cacagcagagggagccattgaa

SEQ ID NO: 7572794 - DNA, 22 bp, Homo sapiens
cacagcagagggagccattgaa

SEQ ID NO: 7572795 - DNA, 22 bp, Homo sapiens
cacagcagagggagccattgaa

SEQ ID NO: 7572796 - DNA, 22 bp, Homo sapiens
cacagcagagggagccattgaa

SEQ ID NO: 7572797 - DNA, 22 bp, Homo sapiens
cacagcagacagggaggcggct

SEQ ID NO: 7572798 - DNA, 22 bp, Homo sapiens
cacagcagacagggaggcggct

SEQ ID NO: 7572799 - DNA, 22 bp, Homo sapiens
cacagcagacagggaggcggct

SEQ ID NO: 7572800 - DNA, 22 bp, Homo sapiens
cacagcagacagggaggcggct

SEQ ID NO: 7572801 - DNA, 22 bp, Homo sapiens
cacagcagaaatatgaaggcag

SEQ ID NO: 7572802 - DNA, 22 bp, Homo sapiens
cacagcagacagggaggcggct

SEQ ID NO: 7572803 - DNA, 22 bp, Homo sapiens
cacagcagacagggaggcggct

SEQ ID NO: 7572804 - DNA, 22 bp, Homo sapiens
agcaggaagtcctctcaggaga

SEQ ID NO: 7572805 - DNA, 22 bp, Homo sapiens
agcaggaagtcctctcaggaga

SEQ ID NO: 7572806 - DNA, 22 bp, Homo sapiens
agcaggaagtcctctcaggaga

SEQ ID NO: 7572807 - DNA, 22 bp, Homo sapiens
agcaggaagtagtctgtaagca

SEQ ID NO: 7572808 - DNA, 20 bp, Homo sapiens
agcaggaatgatgctttcat

SEQ ID NO: 7572809 - DNA, 22 bp, Homo sapiens
agcaggaatctgttctgtataa

SEQ ID NO: 7572810 - DNA, 20 bp, Homo sapiens
agcaggaatgatgctttcat

SEQ ID NO: 7572811 - DNA, 22 bp, Homo sapiens
agcaggaagtcctctcaggaga

SEQ ID NO: 7572812 - DNA, 22 bp, Homo sapiens
agcaggaccaagaaggggaaaa

SEQ ID NO: 7572813 - DNA, 22 bp, Homo sapiens
agcaggacacgatgcggcagga

SEQ ID NO: 7572814 - DNA, 22 bp, Homo sapiens
agcaggaccaagaaggggaaaa

SEQ ID NO: 7572815 - DNA, 22 bp, Homo sapiens
agcaggacacgatgcggcagga

SEQ ID NO: 7572816 - DNA, 22 bp, Homo sapiens
agcaggacacgatgcggcagga

SEQ ID NO: 7572817 - DNA, 22 bp, Homo sapiens
agcaggacaatatgggatcagg

SEQ ID NO: 7572818 - DNA, 22 bp, Homo sapiens
agcaggacaatatgggatcagg

SEQ ID NO: 7572819 - DNA, 22 bp, Homo sapiens
agcaggacaatatgggatcagg

SEQ ID NO: 7572820 - DNA, 20 bp, Homo sapiens
agcaggaatgatgctttcat

SEQ ID NO: 7572821 - DNA, 20 bp, Homo sapiens
agcaggaatgatgctttcat

SEQ ID NO: 7572822 - DNA, 22 bp, Homo sapiens
cacagcaatagctaactgatac

SEQ ID NO: 7572823 - DNA, 22 bp, Homo sapiens
cacagcaatagctaactgatac

SEQ ID NO: 7572824 - DNA, 22 bp, Homo sapiens
cacagcaatagctaactgatac

SEQ ID NO: 7572825 - DNA, 22 bp, Homo sapiens
cacagcaatagctaactgatac

SEQ ID NO: 7572826 - DNA, 22 bp, Homo sapiens
cacagcaatagctaactgatac

SEQ ID NO: 7572827 - DNA, 22 bp, Homo sapiens
cacagcaagagctaaatgacca

SEQ ID NO: 7572828 - DNA, 22 bp, Homo sapiens
cacagcaagagctaaatgacca

SEQ ID NO: 7572829 - DNA, 22 bp, Homo sapiens
cacagcaagagctaaatgacca

SEQ ID NO: 7572830 - DNA, 22 bp, Homo sapiens
cacagcaagagctaaatgacca

SEQ ID NO: 7572831 - DNA, 18 bp, Homo sapiens
agcaggactgtggggtgg

SEQ ID NO: 7572832 - DNA, 17 bp, Homo sapiens
agcaggaccccagagca

SEQ ID NO: 7572833 - DNA, 17 bp, Homo sapiens
agcaggaccccagagca

SEQ ID NO: 7572834 - DNA, 22 bp, Homo sapiens
agcaggaccaagaaggggaaaa

SEQ ID NO: 7572835 - DNA, 17 bp, Homo sapiens
agcaggaccccagagca

SEQ ID NO: 7572836 - DNA, 17 bp, Homo sapiens
agcaggaccccagagca

SEQ ID NO: 7572837 - DNA, 22 bp, Homo sapiens
cacagcaagagctaaatgacca

SEQ ID NO: 7572838 - DNA, 22 bp, Homo sapiens
cacagcaagagctaaatgacca

SEQ ID NO: 7572839 - DNA, 22 bp, Homo sapiens
cacagcaagagctaaatgacca

SEQ ID NO: 7572840 - DNA, 18 bp, Homo sapiens
agcaggactgtggggtgg

SEQ ID NO: 7572841 - DNA, 22 bp, Homo sapiens
cacagcaagagctaaatgacca

SEQ ID NO: 7572842 - DNA, 21 bp, Homo sapiens
agcagctgggcaacatggagg

SEQ ID NO: 7572843 - DNA, 22 bp, Homo sapiens
agcagcttctttcactcctgga

SEQ ID NO: 7572844 - DNA, 21 bp, Homo sapiens
agcagctgggcaacatggagg

SEQ ID NO: 7572845 - DNA, 21 bp, Homo sapiens
agcagctgggcaacatggagg

SEQ ID NO: 7572846 - DNA, 22 bp, Homo sapiens
agcagcttgaggctggattcca

SEQ ID NO: 7572847 - DNA, 22 bp, Homo sapiens
agcagcttgaggctggattcca

SEQ ID NO: 7572848 - DNA, 22 bp, Homo sapiens
agcagcttgaggctggattcca

SEQ ID NO: 7572849 - DNA, 22 bp, Homo sapiens
agcagcttgagctggggctggc

SEQ ID NO: 7572850 - DNA, 22 bp, Homo sapiens
agcaggaactgacaccaagcca

SEQ ID NO: 7572851 - DNA, 22 bp, Homo sapiens
agcaggaactcagggagttctc

SEQ ID NO: 7572852 - DNA, 22 bp, Homo sapiens
agcaggaactcagggagttctc

SEQ ID NO: 7572853 - DNA, 22 bp, Homo sapiens
agcaggaaggctttgggggttc

SEQ ID NO: 7572854 - DNA, 22 bp, Homo sapiens
agcaggaaggctttgggggttc

SEQ ID NO: 7572855 - DNA, 22 bp, Homo sapiens
agcaggaactgacaccaagcca

SEQ ID NO: 7572856 - DNA, 22 bp, Homo sapiens
agcaggaactgacaccaagcca

SEQ ID NO: 7572857 - DNA, 22 bp, Homo sapiens
agcaggaaggtctgttagtcca

SEQ ID NO: 7572858 - DNA, 22 bp, Homo sapiens
agcaggaaggtctgtgtgagtc

SEQ ID NO: 7572859 - DNA, 22 bp, Homo sapiens
agcaggaaggtctgtgtgagtc

SEQ ID NO: 7572860 - DNA, 22 bp, Homo sapiens
agcaggaagtagtctgtaagca

SEQ ID NO: 7572861 - DNA, 22 bp, Homo sapiens
agcaggaagtagtctgtaagca

SEQ ID NO: 7572862 - DNA, 22 bp, Homo sapiens
agcaggaaggtctgttagtcca

SEQ ID NO: 7572863 - DNA, 22 bp, Homo sapiens
agcaggaagtagtctgtaagca

SEQ ID NO: 7572864 - DNA, 22 bp, Homo sapiens
agcaggaaggtctgtgtgagtc

SEQ ID NO: 7572865 - DNA, 22 bp, Homo sapiens
agcaggaaggtctgtgtgagtc

SEQ ID NO: 7572866 - DNA, 22 bp, Homo sapiens
agcaggaaggggcctagcctgg

SEQ ID NO: 7572867 - DNA, 22 bp, Homo sapiens
agcaggaaggtctgtgtgagtc

SEQ ID NO: 7572868 - DNA, 22 bp, Homo sapiens
agcaggaaggtctgtgtgagtc

SEQ ID NO: 7572869 - DNA, 22 bp, Homo sapiens
agcaggaaggggatgatgggca

SEQ ID NO: 7572870 - DNA, 22 bp, Homo sapiens
agcaggaaggggcctagcctgg

SEQ ID NO: 7572871 - DNA, 22 bp, Homo sapiens
agcaggaaggtctgtgtgagtc

SEQ ID NO: 7572872 - DNA, 22 bp, Homo sapiens
agcaggaaggggcctagcctgg

SEQ ID NO: 7572873 - DNA, 22 bp, Homo sapiens
agcaggaaggctttgggggttc

SEQ ID NO: 7572874 - DNA, 22 bp, Homo sapiens
agcaggaaggctttgggggttc

SEQ ID NO: 7572875 - DNA, 22 bp, Homo sapiens
agcaggaaggggatgatgggca

SEQ ID NO: 7572876 - DNA, 22 bp, Homo sapiens
agcaggaaggggatgatgggca

SEQ ID NO: 7572877 - DNA, 22 bp, Homo sapiens
agcagggcactggaaggcactg

SEQ ID NO: 7572878 - DNA, 22 bp, Homo sapiens
agcagggcactggaaggcactg

SEQ ID NO: 7572879 - DNA, 22 bp, Homo sapiens
agcagggcagctgatgcgcacg

SEQ ID NO: 7572880 - DNA, 22 bp, Homo sapiens
agcagggcagctgatgcgcacg

SEQ ID NO: 7572881 - DNA, 22 bp, Homo sapiens
agcagggcagctgatgcgcacg

SEQ ID NO: 7572882 - DNA, 22 bp, Homo sapiens
agcagggcagctgatgcgcacg

SEQ ID NO: 7572883 - DNA, 22 bp, Homo sapiens
agcagggcagctgatgcgcacg

SEQ ID NO: 7572884 - DNA, 22 bp, Homo sapiens
agcagggcagctgatgcgcacg

SEQ ID NO: 7572885 - DNA, 22 bp, Homo sapiens
agcagggcactggaaggcactg

SEQ ID NO: 7572886 - DNA, 22 bp, Homo sapiens
agcagggcagctgatgcgcacg

SEQ ID NO: 7572887 - DNA, 22 bp, Homo sapiens
agcagggcagctgatgcgcacg

SEQ ID NO: 7572888 - DNA, 22 bp, Homo sapiens
agcagggcaaagtcaggctaac

SEQ ID NO: 7572889 - DNA, 22 bp, Homo sapiens
agcagggcaaagtcaggctaac

SEQ ID NO: 7572890 - DNA, 22 bp, Homo sapiens
agcagggcaaagtcaggctaac

SEQ ID NO: 7572891 - DNA, 22 bp, Homo sapiens
agcagggcaaagtcaggctaac

SEQ ID NO: 7572892 - DNA, 22 bp, Homo sapiens
agcagggcaaagtcaggctaac

SEQ ID NO: 7572893 - DNA, 22 bp, Homo sapiens
agcagggcaaagtcaggctaac

SEQ ID NO: 7572894 - DNA, 19 bp, Homo sapiens
agcagggagtggttgtggg

SEQ ID NO: 7572895 - DNA, 19 bp, Homo sapiens
agcagggagtggttgtggg

SEQ ID NO: 7572896 - DNA, 19 bp, Homo sapiens
agcagggagtggttgtggg

SEQ ID NO: 7572897 - DNA, 19 bp, Homo sapiens
agcagggagtggttgtggg

SEQ ID NO: 7572898 - DNA, 19 bp, Homo sapiens
agcagggagtggttgtggg

SEQ ID NO: 7572899 - DNA, 17 bp, Homo sapiens
agcagggagtcaaggga

SEQ ID NO: 7572900 - DNA, 17 bp, Homo sapiens
agcagggagtcaaggga

SEQ ID NO: 7572901 - DNA, 22 bp, Homo sapiens
agcagggcaggtaaggatcaga

SEQ ID NO: 7572902 - DNA, 22 bp, Homo sapiens
agcagggcaggtaaggatcaga

SEQ ID NO: 7572903 - DNA, 22 bp, Homo sapiens
agcagggcaggtaaggatcaga

SEQ ID NO: 7572904 - DNA, 22 bp, Homo sapiens
agcagggcagcttttttcagaa

SEQ ID NO: 7572905 - DNA, 22 bp, Homo sapiens
agcagggcagcttttttcagaa

SEQ ID NO: 7572906 - DNA, 22 bp, Homo sapiens
agcagggcagcttttttcagaa

SEQ ID NO: 7572907 - DNA, 22 bp, Homo sapiens
agcagggcaggtaaggatcaga

SEQ ID NO: 7572908 - DNA, 22 bp, Homo sapiens
agcagggcaggtaaggatcaga

SEQ ID NO: 7572909 - DNA, 22 bp, Homo sapiens
agcagggcaggtaaggatcaga

SEQ ID NO: 7572910 - DNA, 22 bp, Homo sapiens
cacatttaatcctttataagta

SEQ ID NO: 7572911 - DNA, 22 bp, Homo sapiens
cacatttaatcctttataagta

SEQ ID NO: 7572912 - DNA, 22 bp, Homo sapiens
cacatttaattggtttagggtg

SEQ ID NO: 7572913 - DNA, 22 bp, Homo sapiens
cacatttaatcctttataagta

SEQ ID NO: 7572914 - DNA, 23 bp, Homo sapiens
caccactttctccttctccttgg

SEQ ID NO: 7572915 - DNA, 23 bp, Homo sapiens
caccactttctccttctccttgg

SEQ ID NO: 7572916 - DNA, 22 bp, Homo sapiens
cacatttaatcctttataagta

SEQ ID NO: 7572917 - DNA, 22 bp, Homo sapiens
agcagggcagtgatcagaaagg

SEQ ID NO: 7572918 - DNA, 22 bp, Homo sapiens
agcagggcagtgatcagaaagg

SEQ ID NO: 7572919 - DNA, 22 bp, Homo sapiens
agcagggcagtgatcagaaagg

SEQ ID NO: 7572920 - DNA, 20 bp, Homo sapiens
caccagcagcagctgccacc

SEQ ID NO: 7572921 - DNA, 20 bp, Homo sapiens
caccagcagcagctgccacc

SEQ ID NO: 7572922 - DNA, 20 bp, Homo sapiens
caccagcagcagctgccacc

SEQ ID NO: 7572923 - DNA, 20 bp, Homo sapiens
caccagcagcagctgccacc

SEQ ID NO: 7572924 - DNA, 22 bp, Homo sapiens
caccagcagcggtgtgagggtg

SEQ ID NO: 7572925 - DNA, 22 bp, Homo sapiens
caccagccagagtgacagctcc

SEQ ID NO: 7572926 - DNA, 20 bp, Homo sapiens
caccagcagcagctgccacc

SEQ ID NO: 7572927 - DNA, 20 bp, Homo sapiens
caccagcagcagctgccacc

SEQ ID NO: 7572928 - DNA, 22 bp, Homo sapiens
caccagcagaagactgagggtg

SEQ ID NO: 7572929 - DNA, 22 bp, Homo sapiens
caccagatgagggatgtgctca

SEQ ID NO: 7572930 - DNA, 22 bp, Homo sapiens
caccagcaccagctctgtgcct

SEQ ID NO: 7572931 - DNA, 22 bp, Homo sapiens
caccagcagaagactgagggtg

SEQ ID NO: 7572932 - DNA, 22 bp, Homo sapiens
caccagcaccagctctgtgcct

SEQ ID NO: 7572933 - DNA, 23 bp, Homo sapiens
caccactttctccttctccttgg

SEQ ID NO: 7572934 - DNA, 23 bp, Homo sapiens
caccactttctccttctccttgg

SEQ ID NO: 7572935 - DNA, 23 bp, Homo sapiens
caccactttctccttctccttgg

SEQ ID NO: 7572936 - DNA, 23 bp, Homo sapiens
caccactttctccttctccttgg

SEQ ID NO: 7572937 - DNA, 22 bp, Homo sapiens
caccagaacaagacaggagaat

SEQ ID NO: 7572938 - DNA, 22 bp, Homo sapiens
caccagaacaagacaggagaat

SEQ ID NO: 7572939 - DNA, 22 bp, Homo sapiens
caccagaacaagacaggagaat

SEQ ID NO: 7572940 - DNA, 22 bp, Homo sapiens
caccagacaggtgtatgcatat

SEQ ID NO: 7572941 - DNA, 22 bp, Homo sapiens
caccagaacaagacaggagaat

SEQ ID NO: 7572942 - DNA, 22 bp, Homo sapiens
caccagagttgtccaaatgatt

SEQ ID NO: 7572943 - DNA, 22 bp, Homo sapiens
caccagagttgtccaaatgatt

SEQ ID NO: 7572944 - DNA, 22 bp, Homo sapiens
caccagagttgtccaaatgatt

SEQ ID NO: 7572945 - DNA, 22 bp, Homo sapiens
caccagagttgtccaaatgatt

SEQ ID NO: 7572946 - DNA, 22 bp, Homo sapiens
caccagagtgagtggactgtcg

SEQ ID NO: 7572947 - DNA, 22 bp, Homo sapiens
caccagagtgggtgagggtgat

SEQ ID NO: 7572948 - DNA, 22 bp, Homo sapiens
caccagagtgggtgagggtgat

SEQ ID NO: 7572949 - DNA, 22 bp, Homo sapiens
caccagagtgggtgagggtgat

SEQ ID NO: 7572950 - DNA, 22 bp, Homo sapiens
caccagagtgagtggactgtcg

SEQ ID NO: 7572951 - DNA, 22 bp, Homo sapiens
caccagagccacttggaggtca

SEQ ID NO: 7572952 - DNA, 22 bp, Homo sapiens
caccagagccacttggaggtca

SEQ ID NO: 7572953 - DNA, 22 bp, Homo sapiens
caccagagtgagtggactgtcg

SEQ ID NO: 7572954 - DNA, 22 bp, Homo sapiens
caccagagtgagtggactgtcg

SEQ ID NO: 7572955 - DNA, 22 bp, Homo sapiens
caccagagtgagtggactgtcg

SEQ ID NO: 7572956 - DNA, 22 bp, Homo sapiens
caccagccagagtgacagctcc

SEQ ID NO: 7572957 - DNA, 22 bp, Homo sapiens
caccagccagagtgacagctcc

SEQ ID NO: 7572958 - DNA, 22 bp, Homo sapiens
caccagccagagtgacagctcc

SEQ ID NO: 7572959 - DNA, 22 bp, Homo sapiens
caccagccagagtgacagctcc

SEQ ID NO: 7572960 - DNA, 22 bp, Homo sapiens
caccagccccctcacgctgtca

SEQ ID NO: 7572961 - DNA, 22 bp, Homo sapiens
caccagccccctcacgctgtca

SEQ ID NO: 7572962 - DNA, 22 bp, Homo sapiens
caccagccccctcacgctgtca

SEQ ID NO: 7572963 - DNA, 22 bp, Homo sapiens
caccagcgactgtgaccagcaa

SEQ ID NO: 7572964 - DNA, 22 bp, Homo sapiens
caccagctaattaaaacagcag

SEQ ID NO: 7572965 - DNA, 22 bp, Homo sapiens
caccagccccctcacgctgtca

SEQ ID NO: 7572966 - DNA, 22 bp, Homo sapiens
agcagggctctgccatgggccc

SEQ ID NO: 7572967 - DNA, 22 bp, Homo sapiens
agcagggctctgtggagggtgg

SEQ ID NO: 7572968 - DNA, 22 bp, Homo sapiens
agcagggctctgccatgggccc

SEQ ID NO: 7572969 - DNA, 22 bp, Homo sapiens
caccagctacagactactgtgt

SEQ ID NO: 7572970 - DNA, 22 bp, Homo sapiens
agcagggctgcagtgtgtcttt

SEQ ID NO: 7572971 - DNA, 22 bp, Homo sapiens
agcagggctgcagtgtgtcttt

SEQ ID NO: 7572972 - DNA, 22 bp, Homo sapiens
agcagggctgcagtgtgtcttt

SEQ ID NO: 7572973 - DNA, 22 bp, Homo sapiens
agcagggctgcagtgtgtcttt

SEQ ID NO: 7572974 - DNA, 22 bp, Homo sapiens
agcagggctctgtggagggtgg

SEQ ID NO: 7572975 - DNA, 22 bp, Homo sapiens
agcagggctctgtggagggtgg

SEQ ID NO: 7572976 - DNA, 22 bp, Homo sapiens
agcagggctctgtggagggtgg

SEQ ID NO: 7572977 - DNA, 22 bp, Homo sapiens
agcagggctctgtggagggtgg

SEQ ID NO: 7572978 - DNA, 22 bp, Homo sapiens
agcagggctctgtggagggtgg

SEQ ID NO: 7572979 - DNA, 22 bp, Homo sapiens
agcagggctctgtggagggtgg

SEQ ID NO: 7572980 - DNA, 22 bp, Homo sapiens
agcagggctctgtggagggtgg

SEQ ID NO: 7572981 - DNA, 22 bp, Homo sapiens
agcagggctctgtggagggtgg

SEQ ID NO: 7572982 - DNA, 22 bp, Homo sapiens
aaattattataggcagagctga

SEQ ID NO: 7572983 - DNA, 22 bp, Homo sapiens
aaattattatgcccctctataa

SEQ ID NO: 7572984 - DNA, 22 bp, Homo sapiens
aaattattatgcccctctataa

SEQ ID NO: 7572985 - DNA, 22 bp, Homo sapiens
aaattattatgcccctctataa

SEQ ID NO: 7572986 - DNA, 22 bp, Homo sapiens
aaattattatgcccctctataa

SEQ ID NO: 7572987 - DNA, 22 bp, Homo sapiens
aaattattatgcccctctataa

SEQ ID NO: 7572988 - DNA, 22 bp, Homo sapiens
aaattattatgcccctctataa

SEQ ID NO: 7572989 - DNA, 22 bp, Homo sapiens
aaattattataggcagagctga

SEQ ID NO: 7572990 - DNA, 22 bp, Homo sapiens
aaggacaggttggggcttcagg

SEQ ID NO: 7572991 - DNA, 22 bp, Homo sapiens
aaggacaggttggggcttcagg

SEQ ID NO: 7572992 - DNA, 22 bp, Homo sapiens
aaggacagggatggttgattgt

SEQ ID NO: 7572993 - DNA, 22 bp, Homo sapiens
aaggacagggatggttgattgt

SEQ ID NO: 7572994 - DNA, 22 bp, Homo sapiens
aaggacagggatggttgattgt

SEQ ID NO: 7572995 - DNA, 22 bp, Homo sapiens
aaattattatgcccctctataa

SEQ ID NO: 7572996 - DNA, 22 bp, Homo sapiens
aaattattatgcccctctataa

SEQ ID NO: 7572997 - DNA, 22 bp, Homo sapiens
aaattattatgcccctctataa

SEQ ID NO: 7572998 - DNA, 22 bp, Homo sapiens
aaggacaggttggggcttcagg

SEQ ID NO: 7572999 - DNA, 22 bp, Homo sapiens
aaggacaggttggggcttcagg

SEQ ID NO: 7573000 - DNA, 22 bp, Homo sapiens
aaggacaggttggggcttcagg

SEQ ID NO: 7573001 - DNA, 22 bp, Homo sapiens
aaggacaggttggggcttcagg

SEQ ID NO: 7573002 - DNA, 22 bp, Homo sapiens
aaggacaggttggggcttcagg

SEQ ID NO: 7573003 - DNA, 22 bp, Homo sapiens
aaggacatttacaaggatttct

SEQ ID NO: 7573004 - DNA, 22 bp, Homo sapiens
aaggacatttacaaggatttct

SEQ ID NO: 7573005 - DNA, 17 bp, Homo sapiens
aaggaccaacaggaaat

SEQ ID NO: 7573006 - DNA, 22 bp, Homo sapiens
aaggaccacctagggtgggggt

SEQ ID NO: 7573007 - DNA, 22 bp, Homo sapiens
aaattattacaagctagttggc

SEQ ID NO: 7573008 - DNA, 22 bp, Homo sapiens
aaattattacaagctagttggc

SEQ ID NO: 7573009 - DNA, 22 bp, Homo sapiens
aaattattagttaagttgggca

SEQ ID NO: 7573010 - DNA, 22 bp, Homo sapiens
aaattattagttaagttgggca

SEQ ID NO: 7573011 - DNA, 22 bp, Homo sapiens
aaattattacaagctagttggc

SEQ ID NO: 7573012 - DNA, 22 bp, Homo sapiens
aaattattacaagctagttggc

SEQ ID NO: 7573013 - DNA, 22 bp, Homo sapiens
aaattattacaagctagttggc

SEQ ID NO: 7573014 - DNA, 22 bp, Homo sapiens
aaattattagttaagttgggca

SEQ ID NO: 7573015 - DNA, 22 bp, Homo sapiens
aaattattagttaagttgggca

SEQ ID NO: 7573016 - DNA, 22 bp, Homo sapiens
aaattattataggcagagctga

SEQ ID NO: 7573017 - DNA, 22 bp, Homo sapiens
aaattattataggcagagctga

SEQ ID NO: 7573018 - DNA, 22 bp, Homo sapiens
aaattattataggcagagctga

SEQ ID NO: 7573019 - DNA, 22 bp, Homo sapiens
aaattattataggcagagctga

SEQ ID NO: 7573020 - DNA, 22 bp, Homo sapiens
aaattattataggcagagctga

SEQ ID NO: 7573021 - DNA, 22 bp, Homo sapiens
aaattattaaacagtgggatgc

SEQ ID NO: 7573022 - DNA, 22 bp, Homo sapiens
aaattattaaacagtgggatgc

SEQ ID NO: 7573023 - DNA, 22 bp, Homo sapiens
aaattattacaagctagttggc

SEQ ID NO: 7573024 - DNA, 22 bp, Homo sapiens
aaattattaaacagtgggatgc

SEQ ID NO: 7573025 - DNA, 22 bp, Homo sapiens
aaattattacaagctagttggc

SEQ ID NO: 7573026 - DNA, 22 bp, Homo sapiens
aaattattacaagctagttggc

SEQ ID NO: 7573027 - DNA, 22 bp, Homo sapiens
aaattattacaagctagttggc

SEQ ID NO: 7573028 - DNA, 22 bp, Homo sapiens
aaattagtgttttcttactggt

SEQ ID NO: 7573029 - DNA, 22 bp, Homo sapiens
aaattagtgcaccaggttgaag

SEQ ID NO: 7573030 - DNA, 22 bp, Homo sapiens
aaattagtcatgttgtattact

SEQ ID NO: 7573031 - DNA, 22 bp, Homo sapiens
aaattataggtgccaccttgga

SEQ ID NO: 7573032 - DNA, 22 bp, Homo sapiens
aaattataggtgccaccttgga

SEQ ID NO: 7573033 - DNA, 22 bp, Homo sapiens
aaattataggtgccaccttgga

SEQ ID NO: 7573034 - DNA, 22 bp, Homo sapiens
aaattataggtgccaccttgga

SEQ ID NO: 7573035 - DNA, 22 bp, Homo sapiens
aaattataggtgccaccttgga

SEQ ID NO: 7573036 - DNA, 22 bp, Homo sapiens
aaattagtcggtttaggaattt

SEQ ID NO: 7573037 - DNA, 22 bp, Homo sapiens
aaattagtcggtttaggaattt

SEQ ID NO: 7573038 - DNA, 22 bp, Homo sapiens
aaattagtcatgttgtattact

SEQ ID NO: 7573039 - DNA, 22 bp, Homo sapiens
aaattagtcatgttgtattact

SEQ ID NO: 7573040 - DNA, 22 bp, Homo sapiens
aaattagtcatgttgtattact

SEQ ID NO: 7573041 - DNA, 22 bp, Homo sapiens
aaattagtcatgttgtattact

SEQ ID NO: 7573042 - DNA, 22 bp, Homo sapiens
aaattagtcatgttgtattact

SEQ ID NO: 7573043 - DNA, 22 bp, Homo sapiens
aaggaaacagaggatgaccttg

SEQ ID NO: 7573044 - DNA, 22 bp, Homo sapiens
aaggaaacagaggatgaccttg

SEQ ID NO: 7573045 - DNA, 21 bp, Homo sapiens
aaggaaaagcttggtctctga

SEQ ID NO: 7573046 - DNA, 21 bp, Homo sapiens
aaggaaaagcttggtctctga

SEQ ID NO: 7573047 - DNA, 22 bp, Homo sapiens
aaggaaacactgaactttgtag

SEQ ID NO: 7573048 - DNA, 22 bp, Homo sapiens
aaattaactatcacttttgtga

SEQ ID NO: 7573049 - DNA, 22 bp, Homo sapiens
aaattaactatcacttttgtga

SEQ ID NO: 7573050 - DNA, 22 bp, Homo sapiens
aaattaactatcacttttgtga

SEQ ID NO: 7573051 - DNA, 22 bp, Homo sapiens
aaattagtacattgcaaagtcc

SEQ ID NO: 7573052 - DNA, 22 bp, Homo sapiens
aaattagtacattgcaaagtcc

SEQ ID NO: 7573053 - DNA, 22 bp, Homo sapiens
aaattagtacattgcaaagtcc

SEQ ID NO: 7573054 - DNA, 22 bp, Homo sapiens
aaattagtacattgcaaagtcc

SEQ ID NO: 7573055 - DNA, 22 bp, Homo sapiens
aaattaagagtaactctgtaga

SEQ ID NO: 7573056 - DNA, 18 bp, Homo sapiens
aaattagatggacctgtg

SEQ ID NO: 7573057 - DNA, 22 bp, Homo sapiens
aaatttaaggaggtgctcactt

SEQ ID NO: 7573058 - DNA, 22 bp, Homo sapiens
aaatttaagaagtgtgtgcgtg

SEQ ID NO: 7573059 - DNA, 22 bp, Homo sapiens
aaatttaagaagtgtgtgcgtg

SEQ ID NO: 7573060 - DNA, 22 bp, Homo sapiens
aaatttaagaagtgtgtgcgtg

SEQ ID NO: 7573061 - DNA, 20 bp, Homo sapiens
aaatttaggaaattttacgc

SEQ ID NO: 7573062 - DNA, 20 bp, Homo sapiens
aaatttaggaaattttacgc

SEQ ID NO: 7573063 - DNA, 20 bp, Homo sapiens
aaatttaggaaattttacgc

SEQ ID NO: 7573064 - DNA, 22 bp, Homo sapiens
aaatttaaggaggtgctcactt

SEQ ID NO: 7573065 - DNA, 22 bp, Homo sapiens
aaatttaaggaggtgctcactt

SEQ ID NO: 7573066 - DNA, 22 bp, Homo sapiens
aaatttaaggaggtgctcactt

SEQ ID NO: 7573067 - DNA, 22 bp, Homo sapiens
aaatttaaaaagcagcattgca

SEQ ID NO: 7573068 - DNA, 22 bp, Homo sapiens
aaatttaaaaagcagcattgca

SEQ ID NO: 7573069 - DNA, 22 bp, Homo sapiens
aaatttaaaaagcagcattgca

SEQ ID NO: 7573070 - DNA, 22 bp, Homo sapiens
aaatttaaaaagcagcattgca

SEQ ID NO: 7573071 - DNA, 22 bp, Homo sapiens
aaatttaaaaagcagcattgca

SEQ ID NO: 7573072 - DNA, 22 bp, Homo sapiens
aaatttaaaaagcagcattgca

SEQ ID NO: 7573073 - DNA, 22 bp, Homo sapiens
aaatttaaaaagcagcattgca

SEQ ID NO: 7573074 - DNA, 22 bp, Homo sapiens
aaattgctagttgcttttttca

SEQ ID NO: 7573075 - DNA, 22 bp, Homo sapiens
aaattgctaaggatctcatgtg

SEQ ID NO: 7573076 - DNA, 22 bp, Homo sapiens
aaattgcattgagctgcttatt

SEQ ID NO: 7573077 - DNA, 22 bp, Homo sapiens
aaattgcattgagctgcttatt

SEQ ID NO: 7573078 - DNA, 22 bp, Homo sapiens
aaattgttgatctacagtaagg

SEQ ID NO: 7573079 - DNA, 22 bp, Homo sapiens
aaatttaaaaagcagcattgca

SEQ ID NO: 7573080 - DNA, 22 bp, Homo sapiens
aaattgttgatctacagtaagg

SEQ ID NO: 7573081 - DNA, 22 bp, Homo sapiens
aaattgttgatctacagtaagg

SEQ ID NO: 7573082 - DNA, 22 bp, Homo sapiens
aaattgttgatctacagtaagg

SEQ ID NO: 7573083 - DNA, 22 bp, Homo sapiens
aaattgttgatctacagtaagg

SEQ ID NO: 7573084 - DNA, 22 bp, Homo sapiens
aaattgttgatctacagtaagg

SEQ ID NO: 7573085 - DNA, 22 bp, Homo sapiens
aaattgcattgagctgcttatt

SEQ ID NO: 7573086 - DNA, 22 bp, Homo sapiens
aaggagaaggcatcattcaagt

SEQ ID NO: 7573087 - DNA, 22 bp, Homo sapiens
aaggagaaggcatcattcaagt

SEQ ID NO: 7573088 - DNA, 22 bp, Homo sapiens
aaggagaaggcatcattcaagt

SEQ ID NO: 7573089 - DNA, 22 bp, Homo sapiens
aaggagaaatggtagatgtgca

SEQ ID NO: 7573090 - DNA, 22 bp, Homo sapiens
aaggagaaggcatcattcaagt

SEQ ID NO: 7573091 - DNA, 22 bp, Homo sapiens
aaggagaaggcatcattcaagt

SEQ ID NO: 7573092 - DNA, 22 bp, Homo sapiens
aaggagaaatggtagatgtgca

SEQ ID NO: 7573093 - DNA, 22 bp, Homo sapiens
aaggagaaatggtagatgtgca

SEQ ID NO: 7573094 - DNA, 22 bp, Homo sapiens
aaggagaaatggtagatgtgca

SEQ ID NO: 7573095 - DNA, 22 bp, Homo sapiens
aaggagaaatggtagatgtgca

SEQ ID NO: 7573096 - DNA, 22 bp, Homo sapiens
aaggagaaatggtagatgtgca

SEQ ID NO: 7573097 - DNA, 22 bp, Homo sapiens
aaggactgtctaaggcctccaa

SEQ ID NO: 7573098 - DNA, 22 bp, Homo sapiens
aaggactggcattatcttatgt

SEQ ID NO: 7573099 - DNA, 22 bp, Homo sapiens
aaggactgctaggaagccgtgt

SEQ ID NO: 7573100 - DNA, 22 bp, Homo sapiens
aaggactgaataattctctttc

SEQ ID NO: 7573101 - DNA, 22 bp, Homo sapiens
aaggactgaataattctctttc

SEQ ID NO: 7573102 - DNA, 22 bp, Homo sapiens
aaggactgacaaatgtcttcct

SEQ ID NO: 7573103 - DNA, 22 bp, Homo sapiens
aaggactctccagctagcaaat

SEQ ID NO: 7573104 - DNA, 22 bp, Homo sapiens
aaggactctccagctagcaaat

SEQ ID NO: 7573105 - DNA, 22 bp, Homo sapiens
aaggactaatgaatagatgaat

SEQ ID NO: 7573106 - DNA, 22 bp, Homo sapiens
aaggactaaaagaagggtttct

SEQ ID NO: 7573107 - DNA, 22 bp, Homo sapiens
aaggactaatgaatagatgaat

SEQ ID NO: 7573108 - DNA, 22 bp, Homo sapiens
aaggactagatattcatacatg

SEQ ID NO: 7573109 - DNA, 22 bp, Homo sapiens
aaggactagattatacaatagg

SEQ ID NO: 7573110 - DNA, 22 bp, Homo sapiens
aaggacctatattgtcagagga

SEQ ID NO: 7573111 - DNA, 22 bp, Homo sapiens
aaggacctatattgtcagagga

SEQ ID NO: 7573112 - DNA, 22 bp, Homo sapiens
aaggacctatattgtcagagga

SEQ ID NO: 7573113 - DNA, 22 bp, Homo sapiens
aaggacctgattttgagcatct

SEQ ID NO: 7573114 - DNA, 22 bp, Homo sapiens
aaggacctgattttgagcatct

SEQ ID NO: 7573115 - DNA, 22 bp, Homo sapiens
aaggaccagttttgcagaattg

SEQ ID NO: 7573116 - DNA, 22 bp, Homo sapiens
aaggaccagttttgcagaattg

SEQ ID NO: 7573117 - DNA, 22 bp, Homo sapiens
aaggacatttctgactaatgca

SEQ ID NO: 7573118 - DNA, 22 bp, Homo sapiens
aaggaccagttgagtgatctta

SEQ ID NO: 7573119 - DNA, 22 bp, Homo sapiens
aaggaccagattatccttaata

SEQ ID NO: 7573120 - DNA, 22 bp, Homo sapiens
aaggaccagttgagtgatctta

SEQ ID NO: 7573121 - DNA, 22 bp, Homo sapiens
aagctgtgaaatctctagtgca

SEQ ID NO: 7573122 - DNA, 22 bp, Homo sapiens
aagctgtgaaatagattacaca

SEQ ID NO: 7573123 - DNA, 22 bp, Homo sapiens
aagctgtcagtgtcaggctaaa

SEQ ID NO: 7573124 - DNA, 22 bp, Homo sapiens
aagctttagagatgagttcctt

SEQ ID NO: 7573125 - DNA, 22 bp, Homo sapiens
aagctttaagtgtcagtcagcc

SEQ ID NO: 7573126 - DNA, 22 bp, Homo sapiens
aagctttagagatgagttcctt

SEQ ID NO: 7573127 - DNA, 22 bp, Homo sapiens
aagctgtatgacctaaatcttg

SEQ ID NO: 7573128 - DNA, 22 bp, Homo sapiens
aagctgtagaggcagtacattt

SEQ ID NO: 7573129 - DNA, 22 bp, Homo sapiens
aagctgtagcttttcaaaacgt

SEQ ID NO: 7573130 - DNA, 22 bp, Homo sapiens
aagctgtcaggaggttaccttt

SEQ ID NO: 7573131 - DNA, 22 bp, Homo sapiens
aagctgtcaatgtatctagtct

SEQ ID NO: 7573132 - DNA, 22 bp, Homo sapiens
aagctgtcaatgtatctagtct

SEQ ID NO: 7573133 - DNA, 22 bp, Homo sapiens
aagctgtacttagcattgactc

SEQ ID NO: 7573134 - DNA, 20 bp, Homo sapiens
aagctgggtaggagaggagc

SEQ ID NO: 7573135 - DNA, 20 bp, Homo sapiens
aagctgggtaggagaggagc

SEQ ID NO: 7573136 - DNA, 20 bp, Homo sapiens
aagctgggtaggagaggagc

SEQ ID NO: 7573137 - DNA, 20 bp, Homo sapiens
aagctgggtaggagaggagc

SEQ ID NO: 7573138 - DNA, 22 bp, Homo sapiens
aagctggggactcagaccccat

SEQ ID NO: 7573139 - DNA, 22 bp, Homo sapiens
aagctgggacttagcgcagata

SEQ ID NO: 7573140 - DNA, 22 bp, Homo sapiens
aagctgggagggagcccagagt

SEQ ID NO: 7573141 - DNA, 22 bp, Homo sapiens
aagctgggagggagcccagagt

SEQ ID NO: 7573142 - DNA, 22 bp, Homo sapiens
aagctgggagggagcccagagt

SEQ ID NO: 7573143 - DNA, 22 bp, Homo sapiens
aagctgggacttagcgcagata

SEQ ID NO: 7573144 - DNA, 22 bp, Homo sapiens
aagctgggacttagcgcagata

SEQ ID NO: 7573145 - DNA, 22 bp, Homo sapiens
aagctgggacttagcgcagata

SEQ ID NO: 7573146 - DNA, 22 bp, Homo sapiens
aagctttcagagcagaatgtga

SEQ ID NO: 7573147 - DNA, 22 bp, Homo sapiens
aagctttcagagcagaatgtga

SEQ ID NO: 7573148 - DNA, 22 bp, Homo sapiens
aagctttatgatctctcagcta

SEQ ID NO: 7573149 - DNA, 22 bp, Homo sapiens
aagctgtgaaatctctagtgca

SEQ ID NO: 7573150 - DNA, 22 bp, Homo sapiens
aagctttatgacttggagacag

SEQ ID NO: 7573151 - DNA, 22 bp, Homo sapiens
aagctttgactactgcctcttg

SEQ ID NO: 7573152 - DNA, 22 bp, Homo sapiens
aagctttgactactgcctcttg

SEQ ID NO: 7573153 - DNA, 22 bp, Homo sapiens
aagctttcagagcagaatgtga

SEQ ID NO: 7573154 - DNA, 19 bp, Homo sapiens
aagctttcccattaacccc

SEQ ID NO: 7573155 - DNA, 22 bp, Homo sapiens
aagctttgcaatgcttcattat

SEQ ID NO: 7573156 - DNA, 22 bp, Homo sapiens
aagctttgataattggattact

SEQ ID NO: 7573157 - DNA, 22 bp, Homo sapiens
aagctttgcaatgcttcattat

SEQ ID NO: 7573158 - DNA, 22 bp, Homo sapiens
aagctttgcaccggtggctgga

SEQ ID NO: 7573159 - DNA, 22 bp, Homo sapiens
aagctttggaagggcagggttg

SEQ ID NO: 7573160 - DNA, 22 bp, Homo sapiens
aagctttggaagggcagggttg

SEQ ID NO: 7573161 - DNA, 22 bp, Homo sapiens
aagctttgggcagaagaggatt

SEQ ID NO: 7573162 - DNA, 22 bp, Homo sapiens
aagctttgtccaaggccatgca

SEQ ID NO: 7573163 - DNA, 22 bp, Homo sapiens
aagctttgttcttcacagagtg

SEQ ID NO: 7573164 - DNA, 21 bp, Homo sapiens
aagcttttcctgagagttgtc

SEQ ID NO: 7573165 - DNA, 22 bp, Homo sapiens
aagcttttctcagtgtccttgg

SEQ ID NO: 7573166 - DNA, 22 bp, Homo sapiens
aagcttttctcagtgtccttgg

SEQ ID NO: 7573167 - DNA, 21 bp, Homo sapiens
aaggaaaagcttggtctctga

SEQ ID NO: 7573168 - DNA, 21 bp, Homo sapiens
aaggaaaagcttggtctctga

SEQ ID NO: 7573169 - DNA, 21 bp, Homo sapiens
aaggaaaagcttggtctctga

SEQ ID NO: 7573170 - DNA, 21 bp, Homo sapiens
aaggaaaagcttggtctctga

SEQ ID NO: 7573171 - DNA, 22 bp, Homo sapiens
aagcttttgacttggtagggaa

SEQ ID NO: 7573172 - DNA, 22 bp, Homo sapiens
aagctttttggatttgcttcag

SEQ ID NO: 7573173 - DNA, 22 bp, Homo sapiens
aagccatgcaagccacaaggtg

SEQ ID NO: 7573174 - DNA, 22 bp, Homo sapiens
aagccatggcatgccaggatca

SEQ ID NO: 7573175 - DNA, 22 bp, Homo sapiens
aagccatggcatgccaggatca

SEQ ID NO: 7573176 - DNA, 22 bp, Homo sapiens
aagccatggctgcatcagcctg

SEQ ID NO: 7573177 - DNA, 22 bp, Homo sapiens
aagccatggctgcatcagcctg

SEQ ID NO: 7573178 - DNA, 22 bp, Homo sapiens
aagccattcatctaatgtcctg

SEQ ID NO: 7573179 - DNA, 22 bp, Homo sapiens
aagccattcccatagacttcag

SEQ ID NO: 7573180 - DNA, 22 bp, Homo sapiens
aagccattcatctaatgtcctg

SEQ ID NO: 7573181 - DNA, 22 bp, Homo sapiens
aagccattcccatagacttcag

SEQ ID NO: 7573182 - DNA, 22 bp, Homo sapiens
aagccatttcctgatacaccta

SEQ ID NO: 7573183 - DNA, 22 bp, Homo sapiens
aagccagtgtttttgagagttg

SEQ ID NO: 7573184 - DNA, 22 bp, Homo sapiens
aagccagtgtgacaggaaactt

SEQ ID NO: 7573185 - DNA, 22 bp, Homo sapiens
aagccagtgtggtctgcccatt

SEQ ID NO: 7573186 - DNA, 22 bp, Homo sapiens
aagccagtgtttttgagagttg

SEQ ID NO: 7573187 - DNA, 22 bp, Homo sapiens
aagccatcgaactgtacactta

SEQ ID NO: 7573188 - DNA, 16 bp, Homo sapiens
aagccagttcagcatt

SEQ ID NO: 7573189 - DNA, 22 bp, Homo sapiens
aagccagttagcacatcattgc

SEQ ID NO: 7573190 - DNA, 22 bp, Homo sapiens
aagccagttagcacatcattgc

SEQ ID NO: 7573191 - DNA, 22 bp, Homo sapiens
aagccagttagcacatcattgc

SEQ ID NO: 7573192 - DNA, 22 bp, Homo sapiens
aagccagtgggcatagcagttg

SEQ ID NO: 7573193 - DNA, 22 bp, Homo sapiens
aagccagtggcttctccctgct

SEQ ID NO: 7573194 - DNA, 22 bp, Homo sapiens
aagccagtcctctactgggcac

SEQ ID NO: 7573195 - DNA, 22 bp, Homo sapiens
aagccagtcctctactgggcac

SEQ ID NO: 7573196 - DNA, 22 bp, Homo sapiens
aagccagtcctctactgggcac

SEQ ID NO: 7573197 - DNA, 22 bp, Homo sapiens
aagccagtgtccagaatgggca

SEQ ID NO: 7573198 - DNA, 22 bp, Homo sapiens
aagccagtgtccagaatgggca

SEQ ID NO: 7573199 - DNA, 22 bp, Homo sapiens
aagccagtggtgagaagatagc

SEQ ID NO: 7573200 - DNA, 21 bp, Homo sapiens
aagccagcccacagtggtttg

SEQ ID NO: 7573201 - DNA, 22 bp, Homo sapiens
aagccagcattttcccattcct

SEQ ID NO: 7573202 - DNA, 22 bp, Homo sapiens
aagccagtaagtttttgtcatt

SEQ ID NO: 7573203 - DNA, 22 bp, Homo sapiens
aagccagtattcaatggggcta

SEQ ID NO: 7573204 - DNA, 22 bp, Homo sapiens
aagccagatttcactcttaatt

SEQ ID NO: 7573205 - DNA, 22 bp, Homo sapiens
aagccagccagtgccagtctta

SEQ ID NO: 7573206 - DNA, 22 bp, Homo sapiens
aagctgattctaaaatttatta

SEQ ID NO: 7573207 - DNA, 22 bp, Homo sapiens
aagctgatgtcccagtttgaag

SEQ ID NO: 7573208 - DNA, 22 bp, Homo sapiens
aagctggcaattatcaaaactg

SEQ ID NO: 7573209 - DNA, 22 bp, Homo sapiens
aagctgcaaaaaatttctgtct

SEQ ID NO: 7573210 - DNA, 22 bp, Homo sapiens
aagctgcaaaaaatttctgtct

SEQ ID NO: 7573211 - DNA, 22 bp, Homo sapiens
aagcccagaatcaagtctactg

SEQ ID NO: 7573212 - DNA, 22 bp, Homo sapiens
aagcccagatgagatccctgga

SEQ ID NO: 7573213 - DNA, 22 bp, Homo sapiens
aagcccagatgagatccctgga

SEQ ID NO: 7573214 - DNA, 22 bp, Homo sapiens
aagcccagatgagatccctgga

SEQ ID NO: 7573215 - DNA, 22 bp, Homo sapiens
aagcccagaatcaagtctactg

SEQ ID NO: 7573216 - DNA, 22 bp, Homo sapiens
aagcccagaatcaagtctactg

SEQ ID NO: 7573217 - DNA, 22 bp, Homo sapiens
aagccatttgttgtccttcagg

SEQ ID NO: 7573218 - DNA, 22 bp, Homo sapiens
aagccatttcctgatacaccta

SEQ ID NO: 7573219 - DNA, 22 bp, Homo sapiens
aagctggcctgtacctgctgag

SEQ ID NO: 7573220 - DNA, 22 bp, Homo sapiens
aagctggcctgtacctgctgag

SEQ ID NO: 7573221 - DNA, 22 bp, Homo sapiens
aagctggcctcaaactcctagc

SEQ ID NO: 7573222 - DNA, 22 bp, Homo sapiens
aagctggcatgtcacctgagaa

SEQ ID NO: 7573223 - DNA, 22 bp, Homo sapiens
aagctggcctcaaactcctagc

SEQ ID NO: 7573224 - DNA, 22 bp, Homo sapiens
aagctggcatgtcacctgagaa

SEQ ID NO: 7573225 - DNA, 22 bp, Homo sapiens
aagctggctctgatgtcagaat

SEQ ID NO: 7573226 - DNA, 22 bp, Homo sapiens
aagctggctctgatgtcagaat

SEQ ID NO: 7573227 - DNA, 23 bp, Homo sapiens
aagctggctgggagcagaaggga

SEQ ID NO: 7573228 - DNA, 18 bp, Homo sapiens
aagctgggaaggagacag

SEQ ID NO: 7573229 - DNA, 18 bp, Homo sapiens
aagctgggaaggagacag

SEQ ID NO: 7573230 - DNA, 18 bp, Homo sapiens
aagctgggaaggagacag

SEQ ID NO: 7573231 - DNA, 18 bp, Homo sapiens
aagctgggaaggagacag

SEQ ID NO: 7573232 - DNA, 22 bp, Homo sapiens
aaatttcaagcaaagtagctat

SEQ ID NO: 7573233 - DNA, 22 bp, Homo sapiens
aaatttcaagcaaagtagctat

SEQ ID NO: 7573234 - DNA, 22 bp, Homo sapiens
aaatttcaagcaaagtagctat

SEQ ID NO: 7573235 - DNA, 22 bp, Homo sapiens
aaatttcaagcaaagtagctat

SEQ ID NO: 7573236 - DNA, 20 bp, Homo sapiens
aaatttaggaaattttacgc

SEQ ID NO: 7573237 - DNA, 20 bp, Homo sapiens
aaatttaggaaattttacgc

SEQ ID NO: 7573238 - DNA, 22 bp, Homo sapiens
aaatttcaagcaaagtagctat

SEQ ID NO: 7573239 - DNA, 22 bp, Homo sapiens
aaatttcaagcaaagtagctat

SEQ ID NO: 7573240 - DNA, 22 bp, Homo sapiens
aaatttcagttggaatgagctc

SEQ ID NO: 7573241 - DNA, 22 bp, Homo sapiens
aaatttcagttggaatgagctc

SEQ ID NO: 7573242 - DNA, 22 bp, Homo sapiens
aaatttcagttggaatgagctc

SEQ ID NO: 7573243 - DNA, 22 bp, Homo sapiens
aaatttcagttggaatgagctc

SEQ ID NO: 7573244 - DNA, 22 bp, Homo sapiens
aaatttcagttggaatgagctc

SEQ ID NO: 7573245 - DNA, 22 bp, Homo sapiens
aaatttcagttggaatgagctc

SEQ ID NO: 7573246 - DNA, 22 bp, Homo sapiens
aaatttcagttacctttacgtt

SEQ ID NO: 7573247 - DNA, 22 bp, Homo sapiens
aaatttcagttacctttacgtt

SEQ ID NO: 7573248 - DNA, 22 bp, Homo sapiens
aaatttcagttacctttacgtt

SEQ ID NO: 7573249 - DNA, 22 bp, Homo sapiens
aaatttcagttacctttacgtt

SEQ ID NO: 7573250 - DNA, 22 bp, Homo sapiens
aaatttctaagtcaagaagaac

SEQ ID NO: 7573251 - DNA, 22 bp, Homo sapiens
aaatttctaagtcaagaagaac

SEQ ID NO: 7573252 - DNA, 22 bp, Homo sapiens
aaatttctaagtcaagaagaac

SEQ ID NO: 7573253 - DNA, 22 bp, Homo sapiens
aaatttctaagcagccacttcc

SEQ ID NO: 7573254 - DNA, 22 bp, Homo sapiens
aaatttctaagcagccacttcc

SEQ ID NO: 7573255 - DNA, 22 bp, Homo sapiens
aaatttctaagcagccacttcc

SEQ ID NO: 7573256 - DNA, 22 bp, Homo sapiens
aaatttccatcaggtccagtct

SEQ ID NO: 7573257 - DNA, 22 bp, Homo sapiens
aaatttcagttggaatgagctc

SEQ ID NO: 7573258 - DNA, 22 bp, Homo sapiens
aaatttctaagcagccacttcc

SEQ ID NO: 7573259 - DNA, 22 bp, Homo sapiens
aaatttctaagcagccacttcc

SEQ ID NO: 7573260 - DNA, 22 bp, Homo sapiens
aaatttctaagcagccacttcc

SEQ ID NO: 7573261 - DNA, 22 bp, Homo sapiens
aaggcattggactagtatcaga

SEQ ID NO: 7573262 - DNA, 23 bp, Homo sapiens
aaggcattggcttctctcatttc

SEQ ID NO: 7573263 - DNA, 22 bp, Homo sapiens
aaggcatttgttggatttctca

SEQ ID NO: 7573264 - DNA, 22 bp, Homo sapiens
aaggcatttgttggatttctca

SEQ ID NO: 7573265 - DNA, 22 bp, Homo sapiens
aaggccaactaggatgagctag

SEQ ID NO: 7573266 - DNA, 22 bp, Homo sapiens
aaggccaactaggatgagctag

SEQ ID NO: 7573267 - DNA, 22 bp, Homo sapiens
aaggccaaagttttcaggctaa

SEQ ID NO: 7573268 - DNA, 22 bp, Homo sapiens
aaggccaaagacacctacacag

SEQ ID NO: 7573269 - DNA, 22 bp, Homo sapiens
aaggccaccaccagcgaggggg

SEQ ID NO: 7573270 - DNA, 22 bp, Homo sapiens
aaggccaccaccagcgaggggg

SEQ ID NO: 7573271 - DNA, 22 bp, Homo sapiens
aaggccaccaccagcgaggggg

SEQ ID NO: 7573272 - DNA, 22 bp, Homo sapiens
aaggccacagagcctcagagag

SEQ ID NO: 7573273 - DNA, 22 bp, Homo sapiens
aaggccacagagcctcagagag

SEQ ID NO: 7573274 - DNA, 22 bp, Homo sapiens
aaggccacgtctccttccagag

SEQ ID NO: 7573275 - DNA, 22 bp, Homo sapiens
aaggccacgtctccttccagag

SEQ ID NO: 7573276 - DNA, 22 bp, Homo sapiens
aaggccaccaccagcgaggggg

SEQ ID NO: 7573277 - DNA, 22 bp, Homo sapiens
aaggccactgaagaaatcacaa

SEQ ID NO: 7573278 - DNA, 22 bp, Homo sapiens
aaggccacgtctccttccagag

SEQ ID NO: 7573279 - DNA, 22 bp, Homo sapiens
aaggccaaggctgcagtgagcc

SEQ ID NO: 7573280 - DNA, 22 bp, Homo sapiens
aaggccaaggctgcagtgagcc

SEQ ID NO: 7573281 - DNA, 22 bp, Homo sapiens
aaggccacacttgctggccagc

SEQ ID NO: 7573282 - DNA, 22 bp, Homo sapiens
aaggccacacttgctggccagc

SEQ ID NO: 7573283 - DNA, 22 bp, Homo sapiens
aaggccacacttgctggccagc

SEQ ID NO: 7573284 - DNA, 22 bp, Homo sapiens
aaggccacagagcctcagagag

SEQ ID NO: 7573285 - DNA, 22 bp, Homo sapiens
aaggccacacttgctggccagc

SEQ ID NO: 7573286 - DNA, 22 bp, Homo sapiens
aaggccacacttgctggccagc

SEQ ID NO: 7573287 - DNA, 22 bp, Homo sapiens
aacaaatgtgtggcagtgtggg

SEQ ID NO: 7573288 - DNA, 22 bp, Homo sapiens
aacaaatgtgtggcagtgtggg

SEQ ID NO: 7573289 - DNA, 22 bp, Homo sapiens
aacaaatgtgtggcagtgtggg

SEQ ID NO: 7573290 - DNA, 22 bp, Homo sapiens
aacaaatgtgtggcagtgtggg

SEQ ID NO: 7573291 - DNA, 22 bp, Homo sapiens
aaggccagacaggaccacatct

SEQ ID NO: 7573292 - DNA, 22 bp, Homo sapiens
aaggccagactctggaatgaca

SEQ ID NO: 7573293 - DNA, 22 bp, Homo sapiens
aaggccagactctggaatgaca

SEQ ID NO: 7573294 - DNA, 22 bp, Homo sapiens
aaggccagacaggaccacatct

SEQ ID NO: 7573295 - DNA, 23 bp, Homo sapiens
aaggccagaatttcaatggtgcc

SEQ ID NO: 7573296 - DNA, 23 bp, Homo sapiens
aaggccagaatttcaatggtgcc

SEQ ID NO: 7573297 - DNA, 23 bp, Homo sapiens
aaggccagaatttcaatggtgcc

SEQ ID NO: 7573298 - DNA, 23 bp, Homo sapiens
aaggccagaatttcaatggtgcc

SEQ ID NO: 7573299 - DNA, 22 bp, Homo sapiens
aaggccactttaccttaaatcc

SEQ ID NO: 7573300 - DNA, 22 bp, Homo sapiens
aaggccactttaccttaaatcc

SEQ ID NO: 7573301 - DNA, 22 bp, Homo sapiens
aacaagatagagctcttgcctt

SEQ ID NO: 7573302 - DNA, 22 bp, Homo sapiens
aacaaatgtgttttgtaattaa

SEQ ID NO: 7573303 - DNA, 22 bp, Homo sapiens
aacaaatgtgttttgtaattaa

SEQ ID NO: 7573304 - DNA, 22 bp, Homo sapiens
aacaaatgtgttttgtaattaa

SEQ ID NO: 7573305 - DNA, 22 bp, Homo sapiens
aacaagatagatatcacttagg

SEQ ID NO: 7573306 - DNA, 22 bp, Homo sapiens
aacaagatagagctcttgcctt

SEQ ID NO: 7573307 - DNA, 22 bp, Homo sapiens
aacaagcagatgcaatgcactt

SEQ ID NO: 7573308 - DNA, 22 bp, Homo sapiens
aacaagatgggagaaggacctc

SEQ ID NO: 7573309 - DNA, 22 bp, Homo sapiens
aacaagatgttttgatatatgt

SEQ ID NO: 7573310 - DNA, 22 bp, Homo sapiens
aacaagatgttttgatatatgt

SEQ ID NO: 7573311 - DNA, 22 bp, Homo sapiens
aacaagcagatgcaatgcactt

SEQ ID NO: 7573312 - DNA, 22 bp, Homo sapiens
aacaagcagatgcaatgcactt

SEQ ID NO: 7573313 - DNA, 22 bp, Homo sapiens
aacaagcagatgcaatgcactt

SEQ ID NO: 7573314 - DNA, 22 bp, Homo sapiens
aacaaggcaagtctgtgagcat

SEQ ID NO: 7573315 - DNA, 22 bp, Homo sapiens
aacaaggcaagtctgtgagcat

SEQ ID NO: 7573316 - DNA, 22 bp, Homo sapiens
aacaaggcacaagctggctgtt

SEQ ID NO: 7573317 - DNA, 22 bp, Homo sapiens
aacaaggcacaagctggctgtt

SEQ ID NO: 7573318 - DNA, 22 bp, Homo sapiens
aacaaggctggtatcttaaaga

SEQ ID NO: 7573319 - DNA, 22 bp, Homo sapiens
aacaagtaagtttatatatatt

SEQ ID NO: 7573320 - DNA, 22 bp, Homo sapiens
aacaagtaagtttatatatatt

SEQ ID NO: 7573321 - DNA, 22 bp, Homo sapiens
aacaagtaagtttatatatatt

SEQ ID NO: 7573322 - DNA, 19 bp, Homo sapiens
aacaagtaggaatggaaga

SEQ ID NO: 7573323 - DNA, 19 bp, Homo sapiens
aacaagtaggaatggaaga

SEQ ID NO: 7573324 - DNA, 19 bp, Homo sapiens
aacaagtaggaatggaaga

SEQ ID NO: 7573325 - DNA, 22 bp, Homo sapiens
aacaagtaagtttatatatatt

SEQ ID NO: 7573326 - DNA, 22 bp, Homo sapiens
aacaagtaagtttatatatatt

SEQ ID NO: 7573327 - DNA, 22 bp, Homo sapiens
aacaagtaagtttatatatatt

SEQ ID NO: 7573328 - DNA, 19 bp, Homo sapiens
aacaagtaggaatggaaga

SEQ ID NO: 7573329 - DNA, 19 bp, Homo sapiens
aacaagtaggaatggaaga

SEQ ID NO: 7573330 - DNA, 22 bp, Homo sapiens
aacaagtgaaagtccttttcga

SEQ ID NO: 7573331 - DNA, 22 bp, Homo sapiens
aacaagtgagtcatttaaactc

SEQ ID NO: 7573332 - DNA, 22 bp, Homo sapiens
aacaagttactcttaaagtata

SEQ ID NO: 7573333 - DNA, 22 bp, Homo sapiens
aacaagtgtattaatggaaata

SEQ ID NO: 7573334 - DNA, 22 bp, Homo sapiens
aacaagttactcttaaagtata

SEQ ID NO: 7573335 - DNA, 22 bp, Homo sapiens
aacaagttactcttaaagtata

SEQ ID NO: 7573336 - DNA, 22 bp, Homo sapiens
aacaagttactcttaaagtata

SEQ ID NO: 7573337 - DNA, 22 bp, Homo sapiens
aacaagtgatatataatggaag

SEQ ID NO: 7573338 - DNA, 22 bp, Homo sapiens
aacaagtgatgctcatgattca

SEQ ID NO: 7573339 - DNA, 22 bp, Homo sapiens
aacaagttctaagtgtctactt

SEQ ID NO: 7573340 - DNA, 22 bp, Homo sapiens
aacaagttctaagtgtctactt

SEQ ID NO: 7573341 - DNA, 22 bp, Homo sapiens
aacaagttctacctcacaaggt

SEQ ID NO: 7573342 - DNA, 22 bp, Homo sapiens
aacaagttgttgaaaataatta

SEQ ID NO: 7573343 - DNA, 22 bp, Homo sapiens
aacaagttctacctcacaaggt

SEQ ID NO: 7573344 - DNA, 22 bp, Homo sapiens
aacaagttagattttgtgtctt

SEQ ID NO: 7573345 - DNA, 22 bp, Homo sapiens
aacaagttagggtcttttactt

SEQ ID NO: 7573346 - DNA, 22 bp, Homo sapiens
aacaagttagggtcttttactt

SEQ ID NO: 7573347 - DNA, 22 bp, Homo sapiens
aacaagttagattttgtgtctt

SEQ ID NO: 7573348 - DNA, 22 bp, Homo sapiens
aacaagttagggtcttttactt

SEQ ID NO: 7573349 - DNA, 22 bp, Homo sapiens
aacaataactagacatgccatg

SEQ ID NO: 7573350 - DNA, 22 bp, Homo sapiens
aacaataactagacatgccatg

SEQ ID NO: 7573351 - DNA, 22 bp, Homo sapiens
aacaataactagacatgccatg

SEQ ID NO: 7573352 - DNA, 22 bp, Homo sapiens
aacaataactagacatgccatg

SEQ ID NO: 7573353 - DNA, 22 bp, Homo sapiens
aacaataactagacatgccatg

SEQ ID NO: 7573354 - DNA, 22 bp, Homo sapiens
aacaataactagacatgccatg

SEQ ID NO: 7573355 - DNA, 22 bp, Homo sapiens
aacaagttgttgaaaataatta

SEQ ID NO: 7573356 - DNA, 22 bp, Homo sapiens
aacaagttgttgaaaataatta

SEQ ID NO: 7573357 - DNA, 22 bp, Homo sapiens
aacaagttgttgaaaataatta

SEQ ID NO: 7573358 - DNA, 22 bp, Homo sapiens
aacaagttgttgaaaataatta

SEQ ID NO: 7573359 - DNA, 22 bp, Homo sapiens
aagggagacagttgtgtgagga

SEQ ID NO: 7573360 - DNA, 22 bp, Homo sapiens
aagggagacccaccgtcctgga

SEQ ID NO: 7573361 - DNA, 22 bp, Homo sapiens
aagggagacccaccgtcctgga

SEQ ID NO: 7573362 - DNA, 22 bp, Homo sapiens
aagggagacagttgtgtgagga

SEQ ID NO: 7573363 - DNA, 22 bp, Homo sapiens
aacaataattgcggttctctat

SEQ ID NO: 7573364 - DNA, 22 bp, Homo sapiens
aagggagacagttgtgtgagga

SEQ ID NO: 7573365 - DNA, 22 bp, Homo sapiens
aagggagacagttgtgtgagga

SEQ ID NO: 7573366 - DNA, 22 bp, Homo sapiens
aagggagacagttgtgtgagga

SEQ ID NO: 7573367 - DNA, 22 bp, Homo sapiens
aagggagacagttgtgtgagga

SEQ ID NO: 7573368 - DNA, 22 bp, Homo sapiens
aagggagacagttgtgtgagga

SEQ ID NO: 7573369 - DNA, 22 bp, Homo sapiens
aagggagacagttgtgtgagga

SEQ ID NO: 7573370 - DNA, 22 bp, Homo sapiens
aacaataattgcggttctctat

SEQ ID NO: 7573371 - DNA, 22 bp, Homo sapiens
aagggagacagttgtgtgagga

SEQ ID NO: 7573372 - DNA, 22 bp, Homo sapiens
aacaataattgcggttctctat

SEQ ID NO: 7573373 - DNA, 22 bp, Homo sapiens
aacaataattgcggttctctat

SEQ ID NO: 7573374 - DNA, 22 bp, Homo sapiens
aacaataattgcggttctctat

SEQ ID NO: 7573375 - DNA, 22 bp, Homo sapiens
aacaataactagacatgccatg

SEQ ID NO: 7573376 - DNA, 22 bp, Homo sapiens
aacaataactagacatgccatg

SEQ ID NO: 7573377 - DNA, 22 bp, Homo sapiens
aacaatcaagtttctaaatgac

SEQ ID NO: 7573378 - DNA, 22 bp, Homo sapiens
aacaatcaagtttctaaatgac

SEQ ID NO: 7573379 - DNA, 22 bp, Homo sapiens
aacaatcaagtttctaaatgac

SEQ ID NO: 7573380 - DNA, 20 bp, Homo sapiens
aacaatctagaagctattct

SEQ ID NO: 7573381 - DNA, 22 bp, Homo sapiens
aacaatctccaagaccaatgtg

SEQ ID NO: 7573382 - DNA, 22 bp, Homo sapiens
aacaatctccaagaccaatgtg

SEQ ID NO: 7573383 - DNA, 20 bp, Homo sapiens
aacaatctagaagctattct

SEQ ID NO: 7573384 - DNA, 22 bp, Homo sapiens
aacaatgaggatctgttctgag

SEQ ID NO: 7573385 - DNA, 22 bp, Homo sapiens
aacaatgaggatctgttctgag

SEQ ID NO: 7573386 - DNA, 22 bp, Homo sapiens
aacaatgaggatctgttctgag

SEQ ID NO: 7573387 - DNA, 22 bp, Homo sapiens
aacaatgaccacacaatgtact

SEQ ID NO: 7573388 - DNA, 22 bp, Homo sapiens
aacaatgaccacacaatgtact

SEQ ID NO: 7573389 - DNA, 22 bp, Homo sapiens
aacaatgaccacacaatgtact

SEQ ID NO: 7573390 - DNA, 22 bp, Homo sapiens
aacaatgaccacacaatgtact

SEQ ID NO: 7573391 - DNA, 22 bp, Homo sapiens
aacaatgaccacacaatgtact

SEQ ID NO: 7573392 - DNA, 22 bp, Homo sapiens
aacaatctgttcgatagaaaat

SEQ ID NO: 7573393 - DNA, 22 bp, Homo sapiens
aacaatctgttcgatagaaaat

SEQ ID NO: 7573394 - DNA, 22 bp, Homo sapiens
aacaatctgttcgatagaaaat

SEQ ID NO: 7573395 - DNA, 23 bp, Homo sapiens
aacaatagagataaagtgagatc

SEQ ID NO: 7573396 - DNA, 22 bp, Homo sapiens
aagggggcacagtcactgtaat

SEQ ID NO: 7573397 - DNA, 22 bp, Homo sapiens
aagggggagaggtgtttggatg

SEQ ID NO: 7573398 - DNA, 22 bp, Homo sapiens
aagggggcacagtcactgtaat

SEQ ID NO: 7573399 - DNA, 22 bp, Homo sapiens
aagggggcacagtcactgtaat

SEQ ID NO: 7573400 - DNA, 22 bp, Homo sapiens
aaggggctcttgtcaggcgcag

SEQ ID NO: 7573401 - DNA, 22 bp, Homo sapiens
aaggggctcttgtcaggcgcag

SEQ ID NO: 7573402 - DNA, 22 bp, Homo sapiens
aaggggctcttgtcaggcgcag

SEQ ID NO: 7573403 - DNA, 22 bp, Homo sapiens
aagggggaaatcctagcgccgc

SEQ ID NO: 7573404 - DNA, 22 bp, Homo sapiens
aagggggaaatcctagcgccgc

SEQ ID NO: 7573405 - DNA, 22 bp, Homo sapiens
aagggggagaggtgtttggatg

SEQ ID NO: 7573406 - DNA, 22 bp, Homo sapiens
aagggggagaggtgtttggatg

SEQ ID NO: 7573407 - DNA, 17 bp, Homo sapiens
aacaataggatgtgtat

SEQ ID NO: 7573408 - DNA, 17 bp, Homo sapiens
aacaataggatgtgtat

SEQ ID NO: 7573409 - DNA, 22 bp, Homo sapiens
aacaataggagtgatgcagtat

SEQ ID NO: 7573410 - DNA, 22 bp, Homo sapiens
aacaataggacctttatgttct

SEQ ID NO: 7573411 - DNA, 22 bp, Homo sapiens
aacaataggagtgatgcagtat

SEQ ID NO: 7573412 - DNA, 22 bp, Homo sapiens
aacaataggagtgatgcagtat

SEQ ID NO: 7573413 - DNA, 22 bp, Homo sapiens
aacaataggagtgatgcagtat

SEQ ID NO: 7573414 - DNA, 22 bp, Homo sapiens
aacaatcaagtttctaaatgac

SEQ ID NO: 7573415 - DNA, 23 bp, Homo sapiens
aacaataggttttggcagaatag

SEQ ID NO: 7573416 - DNA, 22 bp, Homo sapiens
aacaataggctatatgctaggc

SEQ ID NO: 7573417 - DNA, 22 bp, Homo sapiens
aacaatgagtcctctgaggtta

SEQ ID NO: 7573418 - DNA, 22 bp, Homo sapiens
aacaatgatatagggattggca

SEQ ID NO: 7573419 - DNA, 22 bp, Homo sapiens
aacaatgatatagggattggca

SEQ ID NO: 7573420 - DNA, 22 bp, Homo sapiens
aacaatgaggatctgttctgag

SEQ ID NO: 7573421 - DNA, 22 bp, Homo sapiens
aacaatgaggatctgttctgag

SEQ ID NO: 7573422 - DNA, 22 bp, Homo sapiens
aacaatgaggatctgttctgag

SEQ ID NO: 7573423 - DNA, 22 bp, Homo sapiens
aacaatgagtcctctgaggtta

SEQ ID NO: 7573424 - DNA, 22 bp, Homo sapiens
aacaatgcagttaatgggaaga

SEQ ID NO: 7573425 - DNA, 22 bp, Homo sapiens
aacaatgcactatcgtaagtgg

SEQ ID NO: 7573426 - DNA, 22 bp, Homo sapiens
aacaatgcactatcgtaagtgg

SEQ ID NO: 7573427 - DNA, 22 bp, Homo sapiens
aacaatgcagttaatgggaaga

SEQ ID NO: 7573428 - DNA, 22 bp, Homo sapiens
aacaatgccaacagcatgctgg

SEQ ID NO: 7573429 - DNA, 22 bp, Homo sapiens
aacaatgccaacagcatgctgg

SEQ ID NO: 7573430 - DNA, 16 bp, Homo sapiens
aacaatgccaatccag

SEQ ID NO: 7573431 - DNA, 16 bp, Homo sapiens
aacaatgccaatccag

SEQ ID NO: 7573432 - DNA, 22 bp, Homo sapiens
aacaatgccacattaagtgtat

SEQ ID NO: 7573433 - DNA, 22 bp, Homo sapiens
aacaatgccacattaagtgtat

SEQ ID NO: 7573434 - DNA, 22 bp, Homo sapiens
aacaatgccacattaagtgtat

SEQ ID NO: 7573435 - DNA, 22 bp, Homo sapiens
aacaatgctgaactgaggaaag

SEQ ID NO: 7573436 - DNA, 22 bp, Homo sapiens
aacaatgcctgatgacctcctg

SEQ ID NO: 7573437 - DNA, 22 bp, Homo sapiens
aacaatgcctgatgacctcctg

SEQ ID NO: 7573438 - DNA, 22 bp, Homo sapiens
aacaatgcctgatgacctcctg

SEQ ID NO: 7573439 - DNA, 22 bp, Homo sapiens
aacaatgctgaactgaggaaag

SEQ ID NO: 7573440 - DNA, 22 bp, Homo sapiens
aacaatgcttgccaagtgtgat

SEQ ID NO: 7573441 - DNA, 22 bp, Homo sapiens
aagtatgtgtgggatgctggga

SEQ ID NO: 7573442 - DNA, 22 bp, Homo sapiens
aagtatgtgatacatgttaatt

SEQ ID NO: 7573443 - DNA, 22 bp, Homo sapiens
aagtatgtgatacatgttaatt

SEQ ID NO: 7573444 - DNA, 22 bp, Homo sapiens
aagtatgtctttgggtattatt

SEQ ID NO: 7573445 - DNA, 22 bp, Homo sapiens
aagtatgtctttgggtattatt

SEQ ID NO: 7573446 - DNA, 22 bp, Homo sapiens
aagtatgctattacagtgtcat

SEQ ID NO: 7573447 - DNA, 18 bp, Homo sapiens
aagtatgcctatgttatt

SEQ ID NO: 7573448 - DNA, 22 bp, Homo sapiens
aagtacagaaggagcgaacaat

SEQ ID NO: 7573449 - DNA, 22 bp, Homo sapiens
aagtatgacatttaagacaatt

SEQ ID NO: 7573450 - DNA, 22 bp, Homo sapiens
aagtatgacatttaagacaatt

SEQ ID NO: 7573451 - DNA, 22 bp, Homo sapiens
aagtacagaaggagcgaacaat

SEQ ID NO: 7573452 - DNA, 22 bp, Homo sapiens
aagtacagaaggagcgaacaat

SEQ ID NO: 7573453 - DNA, 22 bp, Homo sapiens
aagtacacctttggagtccacg

SEQ ID NO: 7573454 - DNA, 22 bp, Homo sapiens
aagtacagaaatagcaggtgca

SEQ ID NO: 7573455 - DNA, 22 bp, Homo sapiens
aagtacagaaatagcaggtgca

SEQ ID NO: 7573456 - DNA, 22 bp, Homo sapiens
aagtacacatcgttggccccga

SEQ ID NO: 7573457 - DNA, 22 bp, Homo sapiens
aagtacacctttggagtccacg

SEQ ID NO: 7573458 - DNA, 22 bp, Homo sapiens
aagtacaatctttctgtaaagg

SEQ ID NO: 7573459 - DNA, 22 bp, Homo sapiens
aagtacaatctttctgtaaagg

SEQ ID NO: 7573460 - DNA, 22 bp, Homo sapiens
aagggagcggggagaccctatg

SEQ ID NO: 7573461 - DNA, 22 bp, Homo sapiens
aagggagcggggagaccctatg

SEQ ID NO: 7573462 - DNA, 22 bp, Homo sapiens
aagggagcttaggagatcaggc

SEQ ID NO: 7573463 - DNA, 22 bp, Homo sapiens
aagggagcttaggagatcaggc

SEQ ID NO: 7573464 - DNA, 22 bp, Homo sapiens
aagggagcttaggagatcaggc

SEQ ID NO: 7573465 - DNA, 22 bp, Homo sapiens
aagggaggaggatttattgtac

SEQ ID NO: 7573466 - DNA, 22 bp, Homo sapiens
aagggagcttaggagatcaggc

SEQ ID NO: 7573467 - DNA, 22 bp, Homo sapiens
aagggagcttaggagatcaggc

SEQ ID NO: 7573468 - DNA, 22 bp, Homo sapiens
aagggaggaggatttattgtac

SEQ ID NO: 7573469 - DNA, 22 bp, Homo sapiens
aagggaggaggatttattgtac

SEQ ID NO: 7573470 - DNA, 22 bp, Homo sapiens
aagggaggaggatttattgtac

SEQ ID NO: 7573471 - DNA, 22 bp, Homo sapiens
aagggaggaggatttattgtac

SEQ ID NO: 7573472 - DNA, 22 bp, Homo sapiens
aagggaggccagaggttttgca

SEQ ID NO: 7573473 - DNA, 22 bp, Homo sapiens
aagggaggccagaggttttgca

SEQ ID NO: 7573474 - DNA, 22 bp, Homo sapiens
aagggaggccagaggttttgca

SEQ ID NO: 7573475 - DNA, 22 bp, Homo sapiens
aagggaggaggatttattgtac

SEQ ID NO: 7573476 - DNA, 22 bp, Homo sapiens
aagggaggccagaggttttgca

SEQ ID NO: 7573477 - DNA, 22 bp, Homo sapiens
aagggctggagactgggtcttc

SEQ ID NO: 7573478 - DNA, 22 bp, Homo sapiens
aaggggaagtagcaccagaggt

SEQ ID NO: 7573479 - DNA, 22 bp, Homo sapiens
aagggctggagactgggtcttc

SEQ ID NO: 7573480 - DNA, 22 bp, Homo sapiens
aagggctggagactgggtcttc

SEQ ID NO: 7573481 - DNA, 22 bp, Homo sapiens
aagggagccaagaaagcagggc

SEQ ID NO: 7573482 - DNA, 22 bp, Homo sapiens
aagggagccaagaaagcagggc

SEQ ID NO: 7573483 - DNA, 22 bp, Homo sapiens
aagggagccaagaaagcagggc

SEQ ID NO: 7573484 - DNA, 22 bp, Homo sapiens
aagggagccaagaaagcagggc

SEQ ID NO: 7573485 - DNA, 22 bp, Homo sapiens
aagggagatagttcgccatggg

SEQ ID NO: 7573486 - DNA, 22 bp, Homo sapiens
aagggagccaagaaagcagggc

SEQ ID NO: 7573487 - DNA, 22 bp, Homo sapiens
aagggagcggggagaccctatg

SEQ ID NO: 7573488 - DNA, 22 bp, Homo sapiens
aagggagcaaatggacagacgg

SEQ ID NO: 7573489 - DNA, 22 bp, Homo sapiens
aagggagcaaatggacagacgg

SEQ ID NO: 7573490 - DNA, 22 bp, Homo sapiens
aagggagatagttcgccatggg

SEQ ID NO: 7573491 - DNA, 22 bp, Homo sapiens
aagggagatagttcgccatggg

SEQ ID NO: 7573492 - DNA, 22 bp, Homo sapiens
aagggagcaaatggacagacgg

SEQ ID NO: 7573493 - DNA, 21 bp, Homo sapiens
aagggagataggaatcaggcc

SEQ ID NO: 7573494 - DNA, 21 bp, Homo sapiens
aagggagataggaatcaggcc

SEQ ID NO: 7573495 - DNA, 21 bp, Homo sapiens
aagggagataggaatcaggcc

SEQ ID NO: 7573496 - DNA, 21 bp, Homo sapiens
aagggagataggaatcaggcc

SEQ ID NO: 7573497 - DNA, 22 bp, Homo sapiens
aagggagaggagggtcttgttg

SEQ ID NO: 7573498 - DNA, 22 bp, Homo sapiens
aagggagaggagggtcttgttg

SEQ ID NO: 7573499 - DNA, 22 bp, Homo sapiens
aagggagaggagggtcttgttg

SEQ ID NO: 7573500 - DNA, 22 bp, Homo sapiens
aagggagaggagggtcttgttg

SEQ ID NO: 7573501 - DNA, 21 bp, Homo sapiens
aagggagataggaatcaggcc

SEQ ID NO: 7573502 - DNA, 21 bp, Homo sapiens
aagggagataggaatcaggcc

SEQ ID NO: 7573503 - DNA, 22 bp, Homo sapiens
aagggagaggagggtcttgttg

SEQ ID NO: 7573504 - DNA, 21 bp, Homo sapiens
aagggagataggaatcaggcc

SEQ ID NO: 7573505 - DNA, 22 bp, Homo sapiens
aaggggagatgtcatgggccct

SEQ ID NO: 7573506 - DNA, 22 bp, Homo sapiens
aaggggagttagtgataaaacc

SEQ ID NO: 7573507 - DNA, 22 bp, Homo sapiens
aaggggagttagtgataaaacc

SEQ ID NO: 7573508 - DNA, 22 bp, Homo sapiens
aaggggagttagtgataaaacc

SEQ ID NO: 7573509 - DNA, 22 bp, Homo sapiens
aaggggaatagagtgggttgtg

SEQ ID NO: 7573510 - DNA, 22 bp, Homo sapiens
aaggggagatgtcatgggccct

SEQ ID NO: 7573511 - DNA, 22 bp, Homo sapiens
aaggggaagtagcaccagaggt

SEQ ID NO: 7573512 - DNA, 22 bp, Homo sapiens
aaggggaatagagtgggttgtg

SEQ ID NO: 7573513 - DNA, 22 bp, Homo sapiens
aaggggaatagagtgggttgtg

SEQ ID NO: 7573514 - DNA, 22 bp, Homo sapiens
aaggggaatagagtgggttgtg

SEQ ID NO: 7573515 - DNA, 22 bp, Homo sapiens
aaggggaatagagtgggttgtg

SEQ ID NO: 7573516 - DNA, 22 bp, Homo sapiens
aaggggaagtagcaccagaggt

SEQ ID NO: 7573517 - DNA, 22 bp, Homo sapiens
aaggggaagtagcaccagaggt

SEQ ID NO: 7573518 - DNA, 22 bp, Homo sapiens
aaggggaagtagcaccagaggt

SEQ ID NO: 7573519 - DNA, 22 bp, Homo sapiens
aaggggaagtagcaccagaggt

SEQ ID NO: 7573520 - DNA, 21 bp, Homo sapiens
aaggggcaaacccaggacacc

SEQ ID NO: 7573521 - DNA, 22 bp, Homo sapiens
aaggggcacaattgtacccaag

SEQ ID NO: 7573522 - DNA, 21 bp, Homo sapiens
aaggggcaaacccaggacacc

SEQ ID NO: 7573523 - DNA, 21 bp, Homo sapiens
aaggggcaaacccaggacacc

SEQ ID NO: 7573524 - DNA, 21 bp, Homo sapiens
aaggggcaaacccaggacacc

SEQ ID NO: 7573525 - DNA, 21 bp, Homo sapiens
aaggggcaaacccaggacacc

SEQ ID NO: 7573526 - DNA, 22 bp, Homo sapiens
aaggggatttaaggtaagaaga

SEQ ID NO: 7573527 - DNA, 22 bp, Homo sapiens
aaggggagttagtgataaaacc

SEQ ID NO: 7573528 - DNA, 22 bp, Homo sapiens
aaggggatttaaggtaagaaga

SEQ ID NO: 7573529 - DNA, 22 bp, Homo sapiens
aaggggcctcacagatgggctt

SEQ ID NO: 7573530 - DNA, 22 bp, Homo sapiens
aaggggctcttgtcaggcgcag

SEQ ID NO: 7573531 - DNA, 22 bp, Homo sapiens
aaggggcctcacagatgggctt

SEQ ID NO: 7573532 - DNA, 22 bp, Homo sapiens
aaggggcctcacagatgggctt

SEQ ID NO: 7573533 - DNA, 22 bp, Homo sapiens
aaggggcatgcttttgccagga

SEQ ID NO: 7573534 - DNA, 22 bp, Homo sapiens
aaggggcatgcttttgccagga

SEQ ID NO: 7573535 - DNA, 22 bp, Homo sapiens
aaggggcatgcttttgccagga

SEQ ID NO: 7573536 - DNA, 22 bp, Homo sapiens
aaggggcatgcttttgccagga

SEQ ID NO: 7573537 - DNA, 22 bp, Homo sapiens
aagttctggggtaatgagaatt

SEQ ID NO: 7573538 - DNA, 22 bp, Homo sapiens
aagttctgccaggctgtggcag

SEQ ID NO: 7573539 - DNA, 23 bp, Homo sapiens
aagttctgattgtttttccatag

SEQ ID NO: 7573540 - DNA, 23 bp, Homo sapiens
aagttctgattgtttttccatag

SEQ ID NO: 7573541 - DNA, 22 bp, Homo sapiens
aagttctgaagggttctgcaga

SEQ ID NO: 7573542 - DNA, 22 bp, Homo sapiens
aagttctgaagggttctgcaga

SEQ ID NO: 7573543 - DNA, 22 bp, Homo sapiens
aagttctgaagggttctgcaga

SEQ ID NO: 7573544 - DNA, 22 bp, Homo sapiens
aagttctatatctgcctcacca

SEQ ID NO: 7573545 - DNA, 22 bp, Homo sapiens
aagttctatagtctttctacta

SEQ ID NO: 7573546 - DNA, 22 bp, Homo sapiens
aagttctattgtcactttatta

SEQ ID NO: 7573547 - DNA, 19 bp, Homo sapiens
aagttctcagagttcaaag

SEQ ID NO: 7573548 - DNA, 22 bp, Homo sapiens
aagttacattttggtctaattg

SEQ ID NO: 7573549 - DNA, 20 bp, Homo sapiens
aagttacattgtattgtacc

SEQ ID NO: 7573550 - DNA, 20 bp, Homo sapiens
aagttacattgtattgtacc

SEQ ID NO: 7573551 - DNA, 20 bp, Homo sapiens
aagttacattgtattgtacc

SEQ ID NO: 7573552 - DNA, 20 bp, Homo sapiens
aagttacattgtattgtacc

SEQ ID NO: 7573553 - DNA, 22 bp, Homo sapiens
aacactgtactggaagatggac

SEQ ID NO: 7573554 - DNA, 20 bp, Homo sapiens
aagttacattgtattgtacc

SEQ ID NO: 7573555 - DNA, 22 bp, Homo sapiens
aacactgggataggtgatagac

SEQ ID NO: 7573556 - DNA, 22 bp, Homo sapiens
aacactgggataggtgatagac

SEQ ID NO: 7573557 - DNA, 22 bp, Homo sapiens
aacactgggataggtgatagac

SEQ ID NO: 7573558 - DNA, 17 bp, Homo sapiens
aacactgggtgagcctc

SEQ ID NO: 7573559 - DNA, 17 bp, Homo sapiens
aacactgggtgagcctc

SEQ ID NO: 7573560 - DNA, 22 bp, Homo sapiens
aacactggtttggcattagatg

SEQ ID NO: 7573561 - DNA, 22 bp, Homo sapiens
aacactggtttggcattagatg

SEQ ID NO: 7573562 - DNA, 22 bp, Homo sapiens
aacactggtttggcattagatg

SEQ ID NO: 7573563 - DNA, 22 bp, Homo sapiens
aacactggttctgactacacag

SEQ ID NO: 7573564 - DNA, 22 bp, Homo sapiens
aacactggttctgactacacag

SEQ ID NO: 7573565 - DNA, 22 bp, Homo sapiens
aacactgtaacagcatcatttt

SEQ ID NO: 7573566 - DNA, 22 bp, Homo sapiens
aacactgtactggaagatggac

SEQ ID NO: 7573567 - DNA, 22 bp, Homo sapiens
aacactgtactggaagatggac

SEQ ID NO: 7573568 - DNA, 22 bp, Homo sapiens
aacactgtaacagcatcatttt

SEQ ID NO: 7573569 - DNA, 22 bp, Homo sapiens
aacactgtaacagcatcatttt

SEQ ID NO: 7573570 - DNA, 22 bp, Homo sapiens
aacactgtaacagcatcatttt

SEQ ID NO: 7573571 - DNA, 22 bp, Homo sapiens
aacactgtaacagcatcatttt

SEQ ID NO: 7573572 - DNA, 22 bp, Homo sapiens
aacactgtaacagcatcatttt

SEQ ID NO: 7573573 - DNA, 22 bp, Homo sapiens
aacactgtaacagcatcatttt

SEQ ID NO: 7573574 - DNA, 22 bp, Homo sapiens
aagttgaatgcgtacgtgacat

SEQ ID NO: 7573575 - DNA, 22 bp, Homo sapiens
aagttgaatcagtaacacagtt

SEQ ID NO: 7573576 - DNA, 22 bp, Homo sapiens
aagttgagatgtcataggagac

SEQ ID NO: 7573577 - DNA, 22 bp, Homo sapiens
aagttgagatgtcataggagac

SEQ ID NO: 7573578 - DNA, 18 bp, Homo sapiens
aagttgagtgcctgtcat

SEQ ID NO: 7573579 - DNA, 22 bp, Homo sapiens
aagttgaatcagtaacacagtt

SEQ ID NO: 7573580 - DNA, 22 bp, Homo sapiens
aagttgaatcagtaacacagtt

SEQ ID NO: 7573581 - DNA, 23 bp, Homo sapiens
aagttcttttagatgtcttcgtg

SEQ ID NO: 7573582 - DNA, 22 bp, Homo sapiens
aagttgaagcatgaaccaaggt

SEQ ID NO: 7573583 - DNA, 22 bp, Homo sapiens
aagttgaagcatgaaccaaggt

SEQ ID NO: 7573584 - DNA, 22 bp, Homo sapiens
aagttgattgcttcaaatttct

SEQ ID NO: 7573585 - DNA, 22 bp, Homo sapiens
aagttgatttaaactactagtc

SEQ ID NO: 7573586 - DNA, 22 bp, Homo sapiens
aagttgatttaaactactagtc

SEQ ID NO: 7573587 - DNA, 19 bp, Homo sapiens
aagttgatcattttgacag

SEQ ID NO: 7573588 - DNA, 22 bp, Homo sapiens
aagttcttgagccctattctag

SEQ ID NO: 7573589 - DNA, 22 bp, Homo sapiens
aagttcttgagccctattctag

SEQ ID NO: 7573590 - DNA, 22 bp, Homo sapiens
aagttcttgagccctattctag

SEQ ID NO: 7573591 - DNA, 22 bp, Homo sapiens
aagttcttgagccctattctag

SEQ ID NO: 7573592 - DNA, 22 bp, Homo sapiens
aagttcttgaagactttaaata

SEQ ID NO: 7573593 - DNA, 22 bp, Homo sapiens
aagttcttgataagtccactgt

SEQ ID NO: 7573594 - DNA, 22 bp, Homo sapiens
aagttcttgctgtgtgtcagat

SEQ ID NO: 7573595 - DNA, 22 bp, Homo sapiens
aagttcttgctgtgtgtcagat

SEQ ID NO: 7573596 - DNA, 23 bp, Homo sapiens
aagttcttaggttgatactaatg

SEQ ID NO: 7573597 - DNA, 22 bp, Homo sapiens
aagttcttagacaagcttgtgg

SEQ ID NO: 7573598 - DNA, 22 bp, Homo sapiens
aagttcttgaagactttaaata

SEQ ID NO: 7573599 - DNA, 23 bp, Homo sapiens
aagttcttaggttgatactaatg

SEQ ID NO: 7573600 - DNA, 22 bp, Homo sapiens
aagttctttcatatcttaatta

SEQ ID NO: 7573601 - DNA, 22 bp, Homo sapiens
aagttctttcatatcttaatta

SEQ ID NO: 7573602 - DNA, 22 bp, Homo sapiens
aagttctttcatatcttaatta

SEQ ID NO: 7573603 - DNA, 22 bp, Homo sapiens
aagttctttctggaaggtctgc

SEQ ID NO: 7573604 - DNA, 23 bp, Homo sapiens
aagttcttttagatgtcttcgtg

SEQ ID NO: 7573605 - DNA, 22 bp, Homo sapiens
aagttctttgccagacacgtgt

SEQ ID NO: 7573606 - DNA, 22 bp, Homo sapiens
aagttctttgccagacacgtgt

SEQ ID NO: 7573607 - DNA, 22 bp, Homo sapiens
aagttcttggaggatgaagagt

SEQ ID NO: 7573608 - DNA, 22 bp, Homo sapiens
aagttctttcatatcttaatta

SEQ ID NO: 7573609 - DNA, 22 bp, Homo sapiens
aagttcttgtatttgcctttct

SEQ ID NO: 7573610 - DNA, 22 bp, Homo sapiens
aacactgcctacactttatgaa

SEQ ID NO: 7573611 - DNA, 22 bp, Homo sapiens
aacactgctgctgggttctgtg

SEQ ID NO: 7573612 - DNA, 22 bp, Homo sapiens
aacactgctgctgggttctgtg

SEQ ID NO: 7573613 - DNA, 22 bp, Homo sapiens
aacactgagtatcagagttggg

SEQ ID NO: 7573614 - DNA, 22 bp, Homo sapiens
aacactgatggaaagtatgttt

SEQ ID NO: 7573615 - DNA, 22 bp, Homo sapiens
aacactgatggaaagtatgttt

SEQ ID NO: 7573616 - DNA, 22 bp, Homo sapiens
aacactgagtatcagagttggg

SEQ ID NO: 7573617 - DNA, 22 bp, Homo sapiens
aacactggacaggaggctaggt

SEQ ID NO: 7573618 - DNA, 22 bp, Homo sapiens
aacactggacaggaggctaggt

SEQ ID NO: 7573619 - DNA, 22 bp, Homo sapiens
aacactggacaggaggctaggt

SEQ ID NO: 7573620 - DNA, 22 bp, Homo sapiens
aacactggaagggacatcaagt

SEQ ID NO: 7573621 - DNA, 22 bp, Homo sapiens
aacactggaagggacatcaagt

SEQ ID NO: 7573622 - DNA, 22 bp, Homo sapiens
aacactggaagggacatcaagt

SEQ ID NO: 7573623 - DNA, 20 bp, Homo sapiens
aacactgcttctatattttc

SEQ ID NO: 7573624 - DNA, 20 bp, Homo sapiens
aacactgcttctatattttc

SEQ ID NO: 7573625 - DNA, 22 bp, Homo sapiens
aacactggaagggacatcaagt

SEQ ID NO: 7573626 - DNA, 22 bp, Homo sapiens
aacactgctgctgggttctgtg

SEQ ID NO: 7573627 - DNA, 22 bp, Homo sapiens
aacactgctgctgggttctgtg

SEQ ID NO: 7573628 - DNA, 22 bp, Homo sapiens
aacactgctgctgggttctgtg

SEQ ID NO: 7573629 - DNA, 20 bp, Homo sapiens
aacactgagggctactcttc

SEQ ID NO: 7573630 - DNA, 22 bp, Homo sapiens
aacactgagggaaaagagatag

SEQ ID NO: 7573631 - DNA, 22 bp, Homo sapiens
aacactgagggaaaagagatag

SEQ ID NO: 7573632 - DNA, 22 bp, Homo sapiens
aacactgagggaaaagagatag

SEQ ID NO: 7573633 - DNA, 21 bp, Homo sapiens
aagtcaatacagataagtctt

SEQ ID NO: 7573634 - DNA, 21 bp, Homo sapiens
aagtcaatacagataagtctt

SEQ ID NO: 7573635 - DNA, 22 bp, Homo sapiens
aagtcaagtactacaggaaaca

SEQ ID NO: 7573636 - DNA, 22 bp, Homo sapiens
aagtcaagtactacaggaaaca

SEQ ID NO: 7573637 - DNA, 22 bp, Homo sapiens
aagtcaagataaaggtgctggc

SEQ ID NO: 7573638 - DNA, 22 bp, Homo sapiens
aagtcaaagctttcagaggaaa

SEQ ID NO: 7573639 - DNA, 22 bp, Homo sapiens
aagtcaaagctttcagaggaaa

SEQ ID NO: 7573640 - DNA, 22 bp, Homo sapiens
aagtatttcgttctgaaaaagt

SEQ ID NO: 7573641 - DNA, 22 bp, Homo sapiens
aagtatttcgttctgaaaaagt

SEQ ID NO: 7573642 - DNA, 22 bp, Homo sapiens
aagtatttcgttctgaaaaagt

SEQ ID NO: 7573643 - DNA, 22 bp, Homo sapiens
aagtatttctggcctgtgaaag

SEQ ID NO: 7573644 - DNA, 22 bp, Homo sapiens
aagtatttctggcctgtgaaag

SEQ ID NO: 7573645 - DNA, 22 bp, Homo sapiens
aagtatttcgttctgaaaaagt

SEQ ID NO: 7573646 - DNA, 22 bp, Homo sapiens
aagtatttcgttctgaaaaagt

SEQ ID NO: 7573647 - DNA, 22 bp, Homo sapiens
aagtatttggaatggcattttt

SEQ ID NO: 7573648 - DNA, 22 bp, Homo sapiens
aagtcaaaccttgctcacagga

SEQ ID NO: 7573649 - DNA, 22 bp, Homo sapiens
aagtatttctggcctgtgaaag

SEQ ID NO: 7573650 - DNA, 22 bp, Homo sapiens
aagtatttctggcctgtgaaag

SEQ ID NO: 7573651 - DNA, 22 bp, Homo sapiens
aagtatttctggcctgtgaaag

SEQ ID NO: 7573652 - DNA, 22 bp, Homo sapiens
aagtatttggaatggcattttt

SEQ ID NO: 7573653 - DNA, 22 bp, Homo sapiens
aagtatttcgttctgaaaaagt

SEQ ID NO: 7573654 - DNA, 22 bp, Homo sapiens
aagtatttcgttctgaaaaagt

SEQ ID NO: 7573655 - DNA, 22 bp, Homo sapiens
aagtatttcgttctgaaaaagt

SEQ ID NO: 7573656 - DNA, 22 bp, Homo sapiens
aagtatttcgttctgaaaaagt

SEQ ID NO: 7573657 - DNA, 22 bp, Homo sapiens
aagtatttcgttctgaaaaagt

SEQ ID NO: 7573658 - DNA, 22 bp, Homo sapiens
aagtatttcgttctgaaaaagt

SEQ ID NO: 7573659 - DNA, 22 bp, Homo sapiens
aagtatttcagcggttctttgt

SEQ ID NO: 7573660 - DNA, 22 bp, Homo sapiens
aagtatttcagcggttctttgt

SEQ ID NO: 7573661 - DNA, 22 bp, Homo sapiens
aagtatttcagcggttctttgt

SEQ ID NO: 7573662 - DNA, 22 bp, Homo sapiens
aagtattctggcagtcattcag

SEQ ID NO: 7573663 - DNA, 22 bp, Homo sapiens
aagtattctggcagtcattcag

SEQ ID NO: 7573664 - DNA, 19 bp, Homo sapiens
aagtattctttgttagcag

SEQ ID NO: 7573665 - DNA, 19 bp, Homo sapiens
aagtattctttgttagcag

SEQ ID NO: 7573666 - DNA, 22 bp, Homo sapiens
aagtattcataaggacatatgt

SEQ ID NO: 7573667 - DNA, 22 bp, Homo sapiens
aagtattcataaggacatatgt

SEQ ID NO: 7573668 - DNA, 22 bp, Homo sapiens
aagtattcataaggacatatgt

SEQ ID NO: 7573669 - DNA, 22 bp, Homo sapiens
aagtattatttaacaaatttgt

SEQ ID NO: 7573670 - DNA, 22 bp, Homo sapiens
aagtattcataaggacatatgt

SEQ ID NO: 7573671 - DNA, 22 bp, Homo sapiens
aagtattcataaggacatatgt

SEQ ID NO: 7573672 - DNA, 22 bp, Homo sapiens
aagtattctacaaagaaattga

SEQ ID NO: 7573673 - DNA, 22 bp, Homo sapiens
aagtattctacaaagaaattga

SEQ ID NO: 7573674 - DNA, 22 bp, Homo sapiens
aagtattctacaaagaaattga

SEQ ID NO: 7573675 - DNA, 22 bp, Homo sapiens
aagtattctggcagtcattcag

SEQ ID NO: 7573676 - DNA, 22 bp, Homo sapiens
aataaaatggtcagttttctca

SEQ ID NO: 7573677 - DNA, 22 bp, Homo sapiens
aataaaatggtcagttttctca

SEQ ID NO: 7573678 - DNA, 22 bp, Homo sapiens
aataaaatggtcagttttctca

SEQ ID NO: 7573679 - DNA, 22 bp, Homo sapiens
aagtttgggcataaggctgtct

SEQ ID NO: 7573680 - DNA, 22 bp, Homo sapiens
aagtttgggatgctccttggac

SEQ ID NO: 7573681 - DNA, 22 bp, Homo sapiens
aagtttggggagaatttcattt

SEQ ID NO: 7573682 - DNA, 22 bp, Homo sapiens
aataaaatggtcagttttctca

SEQ ID NO: 7573683 - DNA, 22 bp, Homo sapiens
aataaaatggtcagttttctca

SEQ ID NO: 7573684 - DNA, 22 bp, Homo sapiens
aataaaatggtcagttttctca

SEQ ID NO: 7573685 - DNA, 22 bp, Homo sapiens
aataaaatggtcagttttctca

SEQ ID NO: 7573686 - DNA, 22 bp, Homo sapiens
aataaaatggtcagttttctca

SEQ ID NO: 7573687 - DNA, 22 bp, Homo sapiens
aataaaatggtcagttttctca

SEQ ID NO: 7573688 - DNA, 22 bp, Homo sapiens
aataaaatggtcagttttctca

SEQ ID NO: 7573689 - DNA, 22 bp, Homo sapiens
aataaaatggtcagttttctca

SEQ ID NO: 7573690 - DNA, 22 bp, Homo sapiens
aataaacaaaggacaaggaggt

SEQ ID NO: 7573691 - DNA, 22 bp, Homo sapiens
aataaaatggtcagttttctca

SEQ ID NO: 7573692 - DNA, 22 bp, Homo sapiens
aataaaatggtcagttttctca

SEQ ID NO: 7573693 - DNA, 22 bp, Homo sapiens
aataaaatggtcagttttctca

SEQ ID NO: 7573694 - DNA, 22 bp, Homo sapiens
aataaacaaaggacaaggaggt

SEQ ID NO: 7573695 - DNA, 22 bp, Homo sapiens
aataaacaaaggacaaggaggt

SEQ ID NO: 7573696 - DNA, 22 bp, Homo sapiens
aagtttgacagaagtttctaat

SEQ ID NO: 7573697 - DNA, 22 bp, Homo sapiens
aagtttgacagaagtttctaat

SEQ ID NO: 7573698 - DNA, 22 bp, Homo sapiens
aagtttgagaagcttatagata

SEQ ID NO: 7573699 - DNA, 22 bp, Homo sapiens
aagtttgagaagcttatagata

SEQ ID NO: 7573700 - DNA, 22 bp, Homo sapiens
aagtttgagaagcttatagata

SEQ ID NO: 7573701 - DNA, 22 bp, Homo sapiens
aagtttgagagcctttagtata

SEQ ID NO: 7573702 - DNA, 22 bp, Homo sapiens
aagtttgagagcctttagtata

SEQ ID NO: 7573703 - DNA, 22 bp, Homo sapiens
aagtttgagagcctttagtata

SEQ ID NO: 7573704 - DNA, 22 bp, Homo sapiens
aagtttgcggggaaagaacaca

SEQ ID NO: 7573705 - DNA, 22 bp, Homo sapiens
aagtttgcggggaaagaacaca

SEQ ID NO: 7573706 - DNA, 22 bp, Homo sapiens
aagtttgcatagattaagcatt

SEQ ID NO: 7573707 - DNA, 22 bp, Homo sapiens
aagtttgatgagtttctggagg

SEQ ID NO: 7573708 - DNA, 22 bp, Homo sapiens
aagtttgcgtgtcctatttgat

SEQ ID NO: 7573709 - DNA, 22 bp, Homo sapiens
aagtttggaagccgtctgcaaa

SEQ ID NO: 7573710 - DNA, 21 bp, Homo sapiens
aagtttggaagaaagcaaggg

SEQ ID NO: 7573711 - DNA, 22 bp, Homo sapiens
aagtttggaatgatagagacct

SEQ ID NO: 7573712 - DNA, 21 bp, Homo sapiens
aagtttggaagaaagcaaggg

SEQ ID NO: 7573713 - DNA, 22 bp, Homo sapiens
aagtttgctaacccttgctcta

SEQ ID NO: 7573714 - DNA, 22 bp, Homo sapiens
aagtttgctaacccttgctcta

SEQ ID NO: 7573715 - DNA, 22 bp, Homo sapiens
aagtttgcgtgtcctatttgat

SEQ ID NO: 7573716 - DNA, 22 bp, Homo sapiens
aagtttgcggggaaagaacaca

SEQ ID NO: 7573717 - DNA, 21 bp, Homo sapiens
aagtttgggattcagtttcca

SEQ ID NO: 7573718 - DNA, 21 bp, Homo sapiens
aagtttgggattcagtttcca

SEQ ID NO: 7573719 - DNA, 22 bp, Homo sapiens
aagtttggaatgatagagacct

SEQ ID NO: 7573720 - DNA, 20 bp, Homo sapiens
aagtttggagtcaggagacc

SEQ ID NO: 7573721 - DNA, 22 bp, Homo sapiens
aagtttggcaagttggtttagt

SEQ ID NO: 7573722 - DNA, 22 bp, Homo sapiens
aagtttggccaaggagacatgg

SEQ ID NO: 7573723 - DNA, 22 bp, Homo sapiens
aagtttggaggtcactggtctt

SEQ ID NO: 7573724 - DNA, 23 bp, Homo sapiens
aagtttggacgaagtcaaatgcc

SEQ ID NO: 7573725 - DNA, 20 bp, Homo sapiens
aagtttggagtcaggagacc

SEQ ID NO: 7573726 - DNA, 22 bp, Homo sapiens
aagtttctgatattgttaaagc

SEQ ID NO: 7573727 - DNA, 22 bp, Homo sapiens
aagtttctgccatactgtggtg

SEQ ID NO: 7573728 - DNA, 22 bp, Homo sapiens
aagtttctgccatactgtggtg

SEQ ID NO: 7573729 - DNA, 22 bp, Homo sapiens
aagtttctggaccttacctgct

SEQ ID NO: 7573730 - DNA, 22 bp, Homo sapiens
aagtttctgggcaagacaaggc

SEQ ID NO: 7573731 - DNA, 22 bp, Homo sapiens
aagtttctggaccttacctgct

SEQ ID NO: 7573732 - DNA, 20 bp, Homo sapiens
aagtttctggtttatatctt

SEQ ID NO: 7573733 - DNA, 20 bp, Homo sapiens
aagtttctggtttatatctt

SEQ ID NO: 7573734 - DNA, 22 bp, Homo sapiens
aagtttctgggcaagacaaggc

SEQ ID NO: 7573735 - DNA, 22 bp, Homo sapiens
aagtttctgggcaagacaaggc

SEQ ID NO: 7573736 - DNA, 22 bp, Homo sapiens
aagtttctgatattgttaaagc

SEQ ID NO: 7573737 - DNA, 22 bp, Homo sapiens
aagtttctgatattgttaaagc

SEQ ID NO: 7573738 - DNA, 22 bp, Homo sapiens
aagttggaatctggaactgatc

SEQ ID NO: 7573739 - DNA, 22 bp, Homo sapiens
aagtttctgatattgttaaagc

SEQ ID NO: 7573740 - DNA, 22 bp, Homo sapiens
aagttgctaatgatgtgtttgc

SEQ ID NO: 7573741 - DNA, 20 bp, Homo sapiens
aagttgcagagagttgtctt

SEQ ID NO: 7573742 - DNA, 20 bp, Homo sapiens
aagttgcagagagttgtctt

SEQ ID NO: 7573743 - DNA, 22 bp, Homo sapiens
aagttgctaaaggagttctttg

SEQ ID NO: 7573744 - DNA, 22 bp, Homo sapiens
aagtttctttattagcttgtcc

SEQ ID NO: 7573745 - DNA, 22 bp, Homo sapiens
aagtttctttattagcttgtcc

SEQ ID NO: 7573746 - DNA, 22 bp, Homo sapiens
aagtttctttattagcttgtcc

SEQ ID NO: 7573747 - DNA, 22 bp, Homo sapiens
aagtttgacagaagtttctaat

SEQ ID NO: 7573748 - DNA, 22 bp, Homo sapiens
aagtttctgttcatatctctga

SEQ ID NO: 7573749 - DNA, 22 bp, Homo sapiens
aagtttctgttcatatctctga

SEQ ID NO: 7573750 - DNA, 22 bp, Homo sapiens
aagtttctgttcgctttaataa

SEQ ID NO: 7573751 - DNA, 22 bp, Homo sapiens
aagtttctgttcgctttaataa

SEQ ID NO: 7573752 - DNA, 22 bp, Homo sapiens
aagtttctgttcatatctctga

SEQ ID NO: 7573753 - DNA, 22 bp, Homo sapiens
aagtttctgttcatatctctga

SEQ ID NO: 7573754 - DNA, 22 bp, Homo sapiens
aagtttctgttcatatctctga

SEQ ID NO: 7573755 - DNA, 22 bp, Homo sapiens
aagtttctgttcatatctctga

SEQ ID NO: 7573756 - DNA, 22 bp, Homo sapiens
aagtttctgtatgctcttctgt

SEQ ID NO: 7573757 - DNA, 22 bp, Homo sapiens
aagtttctgtatgctcttctgt

SEQ ID NO: 7573758 - DNA, 20 bp, Homo sapiens
aagtttctggtttatatctt

SEQ ID NO: 7573759 - DNA, 22 bp, Homo sapiens
aagtttctgtatgctcttctgt

SEQ ID NO: 7573760 - DNA, 22 bp, Homo sapiens
aagtttctgtatgctcttctgt

SEQ ID NO: 7573761 - DNA, 20 bp, Homo sapiens
aagtttctggtttatatctt

SEQ ID NO: 7573762 - DNA, 20 bp, Homo sapiens
aagtttctggtttatatctt

SEQ ID NO: 7573763 - DNA, 20 bp, Homo sapiens
aagtttctggtttatatctt

SEQ ID NO: 7573764 - DNA, 22 bp, Homo sapiens
aataaacaaatccttccttccc

SEQ ID NO: 7573765 - DNA, 22 bp, Homo sapiens
aataaacaaatccttccttccc

SEQ ID NO: 7573766 - DNA, 22 bp, Homo sapiens
aataaacaaatccttccttccc

SEQ ID NO: 7573767 - DNA, 22 bp, Homo sapiens
aataaacaaatccttccttccc

SEQ ID NO: 7573768 - DNA, 22 bp, Homo sapiens
aataaacaaatccttccttccc

SEQ ID NO: 7573769 - DNA, 22 bp, Homo sapiens
aataaacaaatccttccttccc

SEQ ID NO: 7573770 - DNA, 22 bp, Homo sapiens
aataaacaaatccttccttccc

SEQ ID NO: 7573771 - DNA, 22 bp, Homo sapiens
aataaacaaatccttccttccc

SEQ ID NO: 7573772 - DNA, 22 bp, Homo sapiens
aataaacaaaggacaaggaggt

SEQ ID NO: 7573773 - DNA, 22 bp, Homo sapiens
aataaacaaatctttcctgtgg

SEQ ID NO: 7573774 - DNA, 22 bp, Homo sapiens
aataaacaaatctttcctgtgg

SEQ ID NO: 7573775 - DNA, 22 bp, Homo sapiens
aataaacaaatctttcctgtgg

SEQ ID NO: 7573776 - DNA, 22 bp, Homo sapiens
aataaacaaatccttccttccc

SEQ ID NO: 7573777 - DNA, 22 bp, Homo sapiens
aataaacaaatctttcctgtgg

SEQ ID NO: 7573778 - DNA, 22 bp, Homo sapiens
aataaacaaatctttcctgtgg

SEQ ID NO: 7573779 - DNA, 22 bp, Homo sapiens
aataaacaaatctttcctgtgg

SEQ ID NO: 7573780 - DNA, 22 bp, Homo sapiens
aataaacaaatctttcctgtgg

SEQ ID NO: 7573781 - DNA, 22 bp, Homo sapiens
aataaacaaatctttcctgtgg

SEQ ID NO: 7573782 - DNA, 22 bp, Homo sapiens
aataaacaaatctttcctgtgg

SEQ ID NO: 7573783 - DNA, 22 bp, Homo sapiens
aataaactgctcaattgcatca

SEQ ID NO: 7573784 - DNA, 22 bp, Homo sapiens
aataaactgctcaattgcatca

SEQ ID NO: 7573785 - DNA, 22 bp, Homo sapiens
aataaactgctcaattgcatca

SEQ ID NO: 7573786 - DNA, 22 bp, Homo sapiens
aataaactgctcaattgcatca

SEQ ID NO: 7573787 - DNA, 22 bp, Homo sapiens
aataaactgctcaattgcatca

SEQ ID NO: 7573788 - DNA, 22 bp, Homo sapiens
aataaactgctcaattgcatca

SEQ ID NO: 7573789 - DNA, 22 bp, Homo sapiens
aataaactgctcaattgcatca

SEQ ID NO: 7573790 - DNA, 22 bp, Homo sapiens
aataaactgctcaattgcatca

SEQ ID NO: 7573791 - DNA, 22 bp, Homo sapiens
aataaactgctcaattgcatca

SEQ ID NO: 7573792 - DNA, 20 bp, Homo sapiens
aataaactactgagagatgt

SEQ ID NO: 7573793 - DNA, 20 bp, Homo sapiens
aataaactactgagagatgt

SEQ ID NO: 7573794 - DNA, 22 bp, Homo sapiens
aataaacaaatctttcctgtgg

SEQ ID NO: 7573795 - DNA, 20 bp, Homo sapiens
aataaactactgagagatgt

SEQ ID NO: 7573796 - DNA, 20 bp, Homo sapiens
aataaactactgagagatgt

SEQ ID NO: 7573797 - DNA, 22 bp, Homo sapiens
aataaacaaatctttcctgtgg

SEQ ID NO: 7573798 - DNA, 22 bp, Homo sapiens
aataaacaaatctttcctgtgg

SEQ ID NO: 7573799 - DNA, 20 bp, Homo sapiens
aataaactactgagagatgt

SEQ ID NO: 7573800 - DNA, 22 bp, Homo sapiens
aataaactgctcaattgcatca

SEQ ID NO: 7573801 - DNA, 22 bp, Homo sapiens
aataaactgctcaattgcatca

SEQ ID NO: 7573802 - DNA, 22 bp, Homo sapiens
aataaactgctcaattgcatca

SEQ ID NO: 7573803 - DNA, 22 bp, Homo sapiens
aataaactgctcaattgcatca

SEQ ID NO: 7573804 - DNA, 22 bp, Homo sapiens
aacagtttctatgttagtggtt

SEQ ID NO: 7573805 - DNA, 22 bp, Homo sapiens
aacagtttctatgttagtggtt

SEQ ID NO: 7573806 - DNA, 22 bp, Homo sapiens
aacagtttctatgttagtggtt

SEQ ID NO: 7573807 - DNA, 22 bp, Homo sapiens
aacagtttgagctttgaatttc

SEQ ID NO: 7573808 - DNA, 22 bp, Homo sapiens
aacagtttgagctttgaatttc

SEQ ID NO: 7573809 - DNA, 22 bp, Homo sapiens
aacagtttgagctttgaatttc

SEQ ID NO: 7573810 - DNA, 22 bp, Homo sapiens
aacagtttgagctttgaatttc

SEQ ID NO: 7573811 - DNA, 22 bp, Homo sapiens
aacagtttgagctttgaatttc

SEQ ID NO: 7573812 - DNA, 22 bp, Homo sapiens
aacagtttgctttaagaggcac

SEQ ID NO: 7573813 - DNA, 22 bp, Homo sapiens
aacagtttgcctgaaatgtatt

SEQ ID NO: 7573814 - DNA, 22 bp, Homo sapiens
aacagtttgcctgaaatgtatt

SEQ ID NO: 7573815 - DNA, 22 bp, Homo sapiens
aacagtttgcctgaaatgtatt

SEQ ID NO: 7573816 - DNA, 22 bp, Homo sapiens
aacagtttgcctgaaatgtatt

SEQ ID NO: 7573817 - DNA, 22 bp, Homo sapiens
aacagtttgcctgaaatgtatt

SEQ ID NO: 7573818 - DNA, 22 bp, Homo sapiens
aacagtttgagctttgaatttc

SEQ ID NO: 7573819 - DNA, 22 bp, Homo sapiens
aacagtttgcctgaaatgtatt

SEQ ID NO: 7573820 - DNA, 22 bp, Homo sapiens
aacagtttatgtaaatgtccag

SEQ ID NO: 7573821 - DNA, 22 bp, Homo sapiens
aacagtttatgtaaatgtccag

SEQ ID NO: 7573822 - DNA, 22 bp, Homo sapiens
aacagtttcagttactgatgag

SEQ ID NO: 7573823 - DNA, 22 bp, Homo sapiens
aacagtttatgtaaatgtccag

SEQ ID NO: 7573824 - DNA, 22 bp, Homo sapiens
aacagtttcagttactgatgag

SEQ ID NO: 7573825 - DNA, 22 bp, Homo sapiens
aacagtttcagttactgatgag

SEQ ID NO: 7573826 - DNA, 22 bp, Homo sapiens
aacagtttcagttactgatgag

SEQ ID NO: 7573827 - DNA, 22 bp, Homo sapiens
aacagtttatgataaattctta

SEQ ID NO: 7573828 - DNA, 22 bp, Homo sapiens
aataaacttccactgtgttttt

SEQ ID NO: 7573829 - DNA, 22 bp, Homo sapiens
aataaacttccactgtgttttt

SEQ ID NO: 7573830 - DNA, 22 bp, Homo sapiens
aataaacttccactgtgttttt

SEQ ID NO: 7573831 - DNA, 22 bp, Homo sapiens
aataaacttccactgtgttttt

SEQ ID NO: 7573832 - DNA, 22 bp, Homo sapiens
aacagtttatgataaattctta

SEQ ID NO: 7573833 - DNA, 22 bp, Homo sapiens
aacagtttatgtaaatgtccag

SEQ ID NO: 7573834 - DNA, 22 bp, Homo sapiens
aacagtttcctgactcctatga

SEQ ID NO: 7573835 - DNA, 22 bp, Homo sapiens
aacagtttcctgactcctatga

SEQ ID NO: 7573836 - DNA, 18 bp, Homo sapiens
aacagtttccagattctc

SEQ ID NO: 7573837 - DNA, 22 bp, Homo sapiens
aacagtttcagttactgatgag

SEQ ID NO: 7573838 - DNA, 22 bp, Homo sapiens
aacagtttcagttactgatgag

SEQ ID NO: 7573839 - DNA, 18 bp, Homo sapiens
aacagtttccagattctc

SEQ ID NO: 7573840 - DNA, 22 bp, Homo sapiens
aaccattagtcaatcagcaaga

SEQ ID NO: 7573841 - DNA, 22 bp, Homo sapiens
aaccattagtcaatcagcaaga

SEQ ID NO: 7573842 - DNA, 22 bp, Homo sapiens
aaccatgatgcagggtgggatg

SEQ ID NO: 7573843 - DNA, 22 bp, Homo sapiens
aaccatggatttcagttcacct

SEQ ID NO: 7573844 - DNA, 22 bp, Homo sapiens
aaccatgtactttattctgttt

SEQ ID NO: 7573845 - DNA, 22 bp, Homo sapiens
aaccattcacagtgtagccaaa

SEQ ID NO: 7573846 - DNA, 22 bp, Homo sapiens
aactatacatatttacatagac

SEQ ID NO: 7573847 - DNA, 22 bp, Homo sapiens
aactataatggggttaggaaat

SEQ ID NO: 7573848 - DNA, 22 bp, Homo sapiens
aactataatggggttaggaaat

SEQ ID NO: 7573849 - DNA, 22 bp, Homo sapiens
aaccattcacagtgtagccaaa

SEQ ID NO: 7573850 - DNA, 22 bp, Homo sapiens
aactcagttacatattagaata

SEQ ID NO: 7573851 - DNA, 22 bp, Homo sapiens
aactcagttacatattagaata

SEQ ID NO: 7573852 - DNA, 22 bp, Homo sapiens
aactcagttctttccacaatgc

SEQ ID NO: 7573853 - DNA, 22 bp, Homo sapiens
aactcagttacatattagaata

SEQ ID NO: 7573854 - DNA, 22 bp, Homo sapiens
aactcagtgtgtttcttagtat

SEQ ID NO: 7573855 - DNA, 22 bp, Homo sapiens
aactcagttacatattagaata

SEQ ID NO: 7573856 - DNA, 22 bp, Homo sapiens
aactatacatatttacatagac

SEQ ID NO: 7573857 - DNA, 22 bp, Homo sapiens
aactatacatatttacatagac

SEQ ID NO: 7573858 - DNA, 22 bp, Homo sapiens
aactatacatatttacatagac

SEQ ID NO: 7573859 - DNA, 22 bp, Homo sapiens
aactcagttacatattagaata

SEQ ID NO: 7573860 - DNA, 22 bp, Homo sapiens
aaccatgaatgggttctggtgt

SEQ ID NO: 7573861 - DNA, 22 bp, Homo sapiens
aaccagtttcaaagaaaattgc

SEQ ID NO: 7573862 - DNA, 22 bp, Homo sapiens
aaccagtttagtcatgctgtaa

SEQ ID NO: 7573863 - DNA, 22 bp, Homo sapiens
aaccagtgaaacaccaggcaag

SEQ ID NO: 7573864 - DNA, 22 bp, Homo sapiens
aaccagtgaaacaccaggcaag

SEQ ID NO: 7573865 - DNA, 20 bp, Homo sapiens
aaccaggatagaccagggaa

SEQ ID NO: 7573866 - DNA, 22 bp, Homo sapiens
aaccaggatttaagattctaga

SEQ ID NO: 7573867 - DNA, 22 bp, Homo sapiens
aaccaggatttaagattctaga

SEQ ID NO: 7573868 - DNA, 22 bp, Homo sapiens
aaccaggtgactcatggtgagc

SEQ ID NO: 7573869 - DNA, 22 bp, Homo sapiens
aaccaggtgactcatggtgagc

SEQ ID NO: 7573870 - DNA, 22 bp, Homo sapiens
aaccaggagattaaagaaaggt

SEQ ID NO: 7573871 - DNA, 22 bp, Homo sapiens
aaccaggagattaaagaaaggt

SEQ ID NO: 7573872 - DNA, 22 bp, Homo sapiens
aaccaggagattaaagaaaggt

SEQ ID NO: 7573873 - DNA, 20 bp, Homo sapiens
aaccagtacccaagtaggaa

SEQ ID NO: 7573874 - DNA, 22 bp, Homo sapiens
aaccagtactttacacagctct

SEQ ID NO: 7573875 - DNA, 22 bp, Homo sapiens
aaccaggtgactcatggtgagc

SEQ ID NO: 7573876 - DNA, 22 bp, Homo sapiens
aaccaggtgactcatggtgagc

SEQ ID NO: 7573877 - DNA, 22 bp, Homo sapiens
aactcattctaagtataccaaa

SEQ ID NO: 7573878 - DNA, 22 bp, Homo sapiens
aactcattctaagtataccaaa

SEQ ID NO: 7573879 - DNA, 22 bp, Homo sapiens
aactcatttgcatttttcctgt

SEQ ID NO: 7573880 - DNA, 22 bp, Homo sapiens
aactccagactactaatttagt

SEQ ID NO: 7573881 - DNA, 22 bp, Homo sapiens
aactccagcaggaaggtgagaa

SEQ ID NO: 7573882 - DNA, 22 bp, Homo sapiens
aactccagactactaatttagt

SEQ ID NO: 7573883 - DNA, 22 bp, Homo sapiens
aactcatcttcgagtgaggctg

SEQ ID NO: 7573884 - DNA, 22 bp, Homo sapiens
aactcattctaagtataccaaa

SEQ ID NO: 7573885 - DNA, 22 bp, Homo sapiens
aactcatctgggtgagtttgtc

SEQ ID NO: 7573886 - DNA, 22 bp, Homo sapiens
aactcatcccagtttgaccgga

SEQ ID NO: 7573887 - DNA, 22 bp, Homo sapiens
aactcagttctttccacaatgc

SEQ ID NO: 7573888 - DNA, 22 bp, Homo sapiens
aactccaggcagggaggccact

SEQ ID NO: 7573889 - DNA, 22 bp, Homo sapiens
aactccagctcacacagtgacc

SEQ ID NO: 7573890 - DNA, 22 bp, Homo sapiens
aactccagctcacacagtgacc

SEQ ID NO: 7573891 - DNA, 22 bp, Homo sapiens
aactccagctcacacagtgacc

SEQ ID NO: 7573892 - DNA, 22 bp, Homo sapiens
aactccagcaggaaggtgagaa

SEQ ID NO: 7573893 - DNA, 22 bp, Homo sapiens
aactccagcaggaaggtgagaa

SEQ ID NO: 7573894 - DNA, 22 bp, Homo sapiens
aactccaggcagggaggccact

SEQ ID NO: 7573895 - DNA, 22 bp, Homo sapiens
aactccaggcagggaggccact

SEQ ID NO: 7573896 - DNA, 22 bp, Homo sapiens
aactccagactactaatttagt

SEQ ID NO: 7573897 - DNA, 22 bp, Homo sapiens
aactccaggcagggaggccact

SEQ ID NO: 7573898 - DNA, 22 bp, Homo sapiens
aactccagggcattgtctcctg

SEQ ID NO: 7573899 - DNA, 21 bp, Homo sapiens
aactcccagtgccttcccagc

SEQ ID NO: 7573900 - DNA, 22 bp, Homo sapiens
aactcccactcagcttcttaat

SEQ ID NO: 7573901 - DNA, 22 bp, Homo sapiens
aactccatttccctgcctcctg

SEQ ID NO: 7573902 - DNA, 22 bp, Homo sapiens
aactccatttccctgcctcctg

SEQ ID NO: 7573903 - DNA, 20 bp, Homo sapiens
aactcctagcctcaagtgat

SEQ ID NO: 7573904 - DNA, 20 bp, Homo sapiens
aactcctagcctcaagtgat

SEQ ID NO: 7573905 - DNA, 20 bp, Homo sapiens
aactcctagcctcaagtgat

SEQ ID NO: 7573906 - DNA, 20 bp, Homo sapiens
aactcctagcctcaagtgat

SEQ ID NO: 7573907 - DNA, 20 bp, Homo sapiens
aactcctagcctcaagtgat

SEQ ID NO: 7573908 - DNA, 20 bp, Homo sapiens
aactcctagcctcaagtgat

SEQ ID NO: 7573909 - DNA, 22 bp, Homo sapiens
aactccaggtcctttgaatctg

SEQ ID NO: 7573910 - DNA, 22 bp, Homo sapiens
aactccagtgtcagctgcaatg

SEQ ID NO: 7573911 - DNA, 22 bp, Homo sapiens
aactccaggtcctttgaatctg

SEQ ID NO: 7573912 - DNA, 22 bp, Homo sapiens
aactccatggttctcagattct

SEQ ID NO: 7573913 - DNA, 22 bp, Homo sapiens
aactccagggtcaccattcaca

SEQ ID NO: 7573914 - DNA, 22 bp, Homo sapiens
aactccatggttctcagattct

SEQ ID NO: 7573915 - DNA, 22 bp, Homo sapiens
aactccagtgtcagctgcaatg

SEQ ID NO: 7573916 - DNA, 22 bp, Homo sapiens
aactccagggggtcaatattta

SEQ ID NO: 7573917 - DNA, 22 bp, Homo sapiens
aactccagggggtcaatattta

SEQ ID NO: 7573918 - DNA, 22 bp, Homo sapiens
aactccagggcattgtctcctg

SEQ ID NO: 7573919 - DNA, 22 bp, Homo sapiens
aactccagggggtcaatattta

SEQ ID NO: 7573920 - DNA, 22 bp, Homo sapiens
aactccagggggtcaatattta

SEQ ID NO: 7573921 - DNA, 22 bp, Homo sapiens
aatcacatttacattgctaatt

SEQ ID NO: 7573922 - DNA, 22 bp, Homo sapiens
aatcacattgaatctgctacct

SEQ ID NO: 7573923 - DNA, 22 bp, Homo sapiens
aatcacattgaatctgctacct

SEQ ID NO: 7573924 - DNA, 22 bp, Homo sapiens
aatcacatttacattgctaatt

SEQ ID NO: 7573925 - DNA, 22 bp, Homo sapiens
aatcacattgaatctgctacct

SEQ ID NO: 7573926 - DNA, 22 bp, Homo sapiens
aatcacattagtgaaacactga

SEQ ID NO: 7573927 - DNA, 22 bp, Homo sapiens
aatcacattgaatctgctacct

SEQ ID NO: 7573928 - DNA, 22 bp, Homo sapiens
aatcacattagtgaaacactga

SEQ ID NO: 7573929 - DNA, 22 bp, Homo sapiens
aatcacattagtgaaacactga

SEQ ID NO: 7573930 - DNA, 22 bp, Homo sapiens
aatcacattagtgaaacactga

SEQ ID NO: 7573931 - DNA, 22 bp, Homo sapiens
aatcacattagtgaaacactga

SEQ ID NO: 7573932 - DNA, 22 bp, Homo sapiens
aatcacattagtgaaacactga

SEQ ID NO: 7573933 - DNA, 22 bp, Homo sapiens
aatcacattagtgaaacactga

SEQ ID NO: 7573934 - DNA, 22 bp, Homo sapiens
aatcacattacagcatatctgt

SEQ ID NO: 7573935 - DNA, 22 bp, Homo sapiens
aatcacattagtgaaacactga

SEQ ID NO: 7573936 - DNA, 22 bp, Homo sapiens
aatcacattagtgaaacactga

SEQ ID NO: 7573937 - DNA, 22 bp, Homo sapiens
aatcacattacagcatatctgt

SEQ ID NO: 7573938 - DNA, 22 bp, Homo sapiens
aatcacattaagccctgttcag

SEQ ID NO: 7573939 - DNA, 22 bp, Homo sapiens
aatcacattacagcatatctgt

SEQ ID NO: 7573940 - DNA, 22 bp, Homo sapiens
aatcacattacagcatatctgt

SEQ ID NO: 7573941 - DNA, 22 bp, Homo sapiens
aatcacattacagcatatctgt

SEQ ID NO: 7573942 - DNA, 22 bp, Homo sapiens
aatcacttagaacccaggaagt

SEQ ID NO: 7573943 - DNA, 22 bp, Homo sapiens
aatcacttaatagctacactgg

SEQ ID NO: 7573944 - DNA, 22 bp, Homo sapiens
aatcacttaatagctacactgg

SEQ ID NO: 7573945 - DNA, 22 bp, Homo sapiens
aatcacttagaacccaggaagt

SEQ ID NO: 7573946 - DNA, 22 bp, Homo sapiens
aatcaccatctctcttgtcccc

SEQ ID NO: 7573947 - DNA, 23 bp, Homo sapiens
aatcaccagcagccaatgtgcag

SEQ ID NO: 7573948 - DNA, 23 bp, Homo sapiens
aatcaccagcagccaatgtgcag

SEQ ID NO: 7573949 - DNA, 22 bp, Homo sapiens
aatcacatttgcccccatattc

SEQ ID NO: 7573950 - DNA, 22 bp, Homo sapiens
aatcacatttgcccccatattc

SEQ ID NO: 7573951 - DNA, 22 bp, Homo sapiens
aatcacatttacattgctaatt

SEQ ID NO: 7573952 - DNA, 22 bp, Homo sapiens
aatcacttgtgccatgggtacc

SEQ ID NO: 7573953 - DNA, 22 bp, Homo sapiens
aatcacttgtaaggaattcaat

SEQ ID NO: 7573954 - DNA, 22 bp, Homo sapiens
aatcacttgtaaggaattcaat

SEQ ID NO: 7573955 - DNA, 22 bp, Homo sapiens
aatcacttgtaaggaattcaat

SEQ ID NO: 7573956 - DNA, 22 bp, Homo sapiens
aatcacttgtaaggaattcaat

SEQ ID NO: 7573957 - DNA, 22 bp, Homo sapiens
aatcacttcagtttttggacag

SEQ ID NO: 7573958 - DNA, 23 bp, Homo sapiens
aatcacttccctccaaatggatt

SEQ ID NO: 7573959 - DNA, 22 bp, Homo sapiens
aatcacttcagtttttggacag

SEQ ID NO: 7573960 - DNA, 22 bp, Homo sapiens
aaccagctctgcaaaatgtcat

SEQ ID NO: 7573961 - DNA, 22 bp, Homo sapiens
aaccagctcctcaccccattgt

SEQ ID NO: 7573962 - DNA, 22 bp, Homo sapiens
aaccagctccagcctccattca

SEQ ID NO: 7573963 - DNA, 22 bp, Homo sapiens
aaccagctttgatacgcattat

SEQ ID NO: 7573964 - DNA, 22 bp, Homo sapiens
aaccagctttgatacgcattat

SEQ ID NO: 7573965 - DNA, 17 bp, Homo sapiens
aaccagctgtcccctcc

SEQ ID NO: 7573966 - DNA, 22 bp, Homo sapiens
aaccagctgagaatgcttctgc

SEQ ID NO: 7573967 - DNA, 22 bp, Homo sapiens
aaccaggacaatttgaatagaa

SEQ ID NO: 7573968 - DNA, 22 bp, Homo sapiens
aaccaggaattgcagggctgca

SEQ ID NO: 7573969 - DNA, 19 bp, Homo sapiens
aaccaggacaaggggctgg

SEQ ID NO: 7573970 - DNA, 19 bp, Homo sapiens
aaccaggacaaggggctgg

SEQ ID NO: 7573971 - DNA, 19 bp, Homo sapiens
aaccaggacaaggggctgg

SEQ ID NO: 7573972 - DNA, 22 bp, Homo sapiens
aaccaggaattgcagggctgca

SEQ ID NO: 7573973 - DNA, 22 bp, Homo sapiens
aaccaggaattgcagggctgca

SEQ ID NO: 7573974 - DNA, 22 bp, Homo sapiens
aaccaggaattgcagggctgca

SEQ ID NO: 7573975 - DNA, 22 bp, Homo sapiens
aaccaggaattgcagggctgca

SEQ ID NO: 7573976 - DNA, 22 bp, Homo sapiens
aaccaggaaaagttatgaatag

SEQ ID NO: 7573977 - DNA, 19 bp, Homo sapiens
aaccaggaactaaagcaga

SEQ ID NO: 7573978 - DNA, 22 bp, Homo sapiens
aaccaggaacttttgtgagagc

SEQ ID NO: 7573979 - DNA, 22 bp, Homo sapiens
aaccaggaagggcgcaaattat

SEQ ID NO: 7573980 - DNA, 22 bp, Homo sapiens
aatcacttttctctaatgtagc

SEQ ID NO: 7573981 - DNA, 20 bp, Homo sapiens
aatcactttgtacaggaagc

SEQ ID NO: 7573982 - DNA, 22 bp, Homo sapiens
aatcactttgcactcttatttg

SEQ ID NO: 7573983 - DNA, 22 bp, Homo sapiens
aatcactttgcactcttatttg

SEQ ID NO: 7573984 - DNA, 22 bp, Homo sapiens
aatcagaaaattcagtggaatt

SEQ ID NO: 7573985 - DNA, 22 bp, Homo sapiens
aatcagaaaattcagtggaatt

SEQ ID NO: 7573986 - DNA, 22 bp, Homo sapiens
aatcagaaaattcagtggaatt

SEQ ID NO: 7573987 - DNA, 22 bp, Homo sapiens
aatcagaaaattcagtggaatt

SEQ ID NO: 7573988 - DNA, 22 bp, Homo sapiens
aaccagctccagcctccattca

SEQ ID NO: 7573989 - DNA, 22 bp, Homo sapiens
aaccagctaacatgtggaatga

SEQ ID NO: 7573990 - DNA, 22 bp, Homo sapiens
aaccagctaaactttgctcgaa

SEQ ID NO: 7573991 - DNA, 22 bp, Homo sapiens
aaccagcactgctggggcctgc

SEQ ID NO: 7573992 - DNA, 22 bp, Homo sapiens
aaccagatctgggatgtagcta

SEQ ID NO: 7573993 - DNA, 22 bp, Homo sapiens
aaccagatgctttgtggagtta

SEQ ID NO: 7573994 - DNA, 22 bp, Homo sapiens
aaccagatggtgcggcaggaca

SEQ ID NO: 7573995 - DNA, 22 bp, Homo sapiens
aaccagatattatgaccatgga

SEQ ID NO: 7573996 - DNA, 22 bp, Homo sapiens
aaccagatcgactgttaacagc

SEQ ID NO: 7573997 - DNA, 22 bp, Homo sapiens
aaccagaggggccctgcctggg

SEQ ID NO: 7573998 - DNA, 22 bp, Homo sapiens
aaccagaggggccctgcctggg

SEQ ID NO: 7573999 - DNA, 22 bp, Homo sapiens
aaccagagtgacactctacaga

SEQ ID NO: 7574000 - DNA, 22 bp, Homo sapiens
aaccagagtgacactctacaga

SEQ ID NO: 7574001 - DNA, 22 bp, Homo sapiens
aaccagagtgacactctacaga

SEQ ID NO: 7574002 - DNA, 21 bp, Homo sapiens
aacatttcaggatccaaattg

SEQ ID NO: 7574003 - DNA, 21 bp, Homo sapiens
aacatttcaggatccaaattg

SEQ ID NO: 7574004 - DNA, 21 bp, Homo sapiens
aacatttcaggatccaaattg

SEQ ID NO: 7574005 - DNA, 21 bp, Homo sapiens
aacatttcaggatccaaattg

SEQ ID NO: 7574006 - DNA, 22 bp, Homo sapiens
aacatttcagcacctgattcct

SEQ ID NO: 7574007 - DNA, 22 bp, Homo sapiens
aacatttcagcacctgattcct

SEQ ID NO: 7574008 - DNA, 22 bp, Homo sapiens
aacatttcagcaaataagaaca

SEQ ID NO: 7574009 - DNA, 22 bp, Homo sapiens
aacatttcagcaaataagaaca

SEQ ID NO: 7574010 - DNA, 22 bp, Homo sapiens
aacatttcagcaaataagaaca

SEQ ID NO: 7574011 - DNA, 22 bp, Homo sapiens
aacatttcagcaaataagaaca

SEQ ID NO: 7574012 - DNA, 22 bp, Homo sapiens
aacatttcagcaaataagaaca

SEQ ID NO: 7574013 - DNA, 22 bp, Homo sapiens
aacatttattgagcacctactg

SEQ ID NO: 7574014 - DNA, 22 bp, Homo sapiens
aacatttattgagcacctactg

SEQ ID NO: 7574015 - DNA, 22 bp, Homo sapiens
aacatttattgagcacctactg

SEQ ID NO: 7574016 - DNA, 22 bp, Homo sapiens
aatcacatgtgctcaattttaa

SEQ ID NO: 7574017 - DNA, 22 bp, Homo sapiens
aatcacatgtgctcaattttaa

SEQ ID NO: 7574018 - DNA, 22 bp, Homo sapiens
aatcacatgtgctcaattttaa

SEQ ID NO: 7574019 - DNA, 22 bp, Homo sapiens
aatcacatgtgctcaattttaa

SEQ ID NO: 7574020 - DNA, 22 bp, Homo sapiens
aatcacatgtgctcaattttaa

SEQ ID NO: 7574021 - DNA, 22 bp, Homo sapiens
aatcacatgtgctcaattttaa

SEQ ID NO: 7574022 - DNA, 22 bp, Homo sapiens
aatcacattaagccctgttcag

SEQ ID NO: 7574023 - DNA, 22 bp, Homo sapiens
aatcacattaagccctgttcag

SEQ ID NO: 7574024 - DNA, 22 bp, Homo sapiens
aatcacatgtgggtcttgtagc

SEQ ID NO: 7574025 - DNA, 22 bp, Homo sapiens
aatcacatgcagggcctccacc

SEQ ID NO: 7574026 - DNA, 22 bp, Homo sapiens
aatcacatgcagggcctccacc

SEQ ID NO: 7574027 - DNA, 22 bp, Homo sapiens
aatatttgttagtgttttaatg

SEQ ID NO: 7574028 - DNA, 22 bp, Homo sapiens
aatatttgttagtgttttaatg

SEQ ID NO: 7574029 - DNA, 22 bp, Homo sapiens
aatcacatgcagggcctccacc

SEQ ID NO: 7574030 - DNA, 22 bp, Homo sapiens
aatatttgaacagtcactgagt

SEQ ID NO: 7574031 - DNA, 22 bp, Homo sapiens
aatatttgaacagtcactgagt

SEQ ID NO: 7574032 - DNA, 22 bp, Homo sapiens
aatatttcttctaaagcccttt

SEQ ID NO: 7574033 - DNA, 22 bp, Homo sapiens
aacatttatatgggttcatgaa

SEQ ID NO: 7574034 - DNA, 22 bp, Homo sapiens
aacatttatatgggttcatgaa

SEQ ID NO: 7574035 - DNA, 22 bp, Homo sapiens
aacatttatgattgaggtaaat

SEQ ID NO: 7574036 - DNA, 22 bp, Homo sapiens
aacatttaggaaggacctcctc

SEQ ID NO: 7574037 - DNA, 22 bp, Homo sapiens
aacatttatatgggttcatgaa

SEQ ID NO: 7574038 - DNA, 22 bp, Homo sapiens
aacatttatatgggttcatgaa

SEQ ID NO: 7574039 - DNA, 22 bp, Homo sapiens
aacatttaggaaggacctcctc

SEQ ID NO: 7574040 - DNA, 22 bp, Homo sapiens
aacatttaggaaggacctcctc

SEQ ID NO: 7574041 - DNA, 22 bp, Homo sapiens
aacatttaggaaggacctcctc

SEQ ID NO: 7574042 - DNA, 22 bp, Homo sapiens
aacatttacaaatccttctgca

SEQ ID NO: 7574043 - DNA, 22 bp, Homo sapiens
aacatttacaaatccttctgca

SEQ ID NO: 7574044 - DNA, 22 bp, Homo sapiens
aacatttacaaatccttctgca

SEQ ID NO: 7574045 - DNA, 22 bp, Homo sapiens
aacatttatggtagtcattgca

SEQ ID NO: 7574046 - DNA, 22 bp, Homo sapiens
aacatttatggtagtcattgca

SEQ ID NO: 7574047 - DNA, 22 bp, Homo sapiens
aacatttatggtagtcattgca

SEQ ID NO: 7574048 - DNA, 22 bp, Homo sapiens
aacatttatggtagtcattgca

SEQ ID NO: 7574049 - DNA, 22 bp, Homo sapiens
aacatttatggtagtcattgca

SEQ ID NO: 7574050 - DNA, 22 bp, Homo sapiens
aacatttatgattgaggtaaat

SEQ ID NO: 7574051 - DNA, 22 bp, Homo sapiens
aacatttatgattgaggtaaat

SEQ ID NO: 7574052 - DNA, 22 bp, Homo sapiens
aacatttattctaattctggga

SEQ ID NO: 7574053 - DNA, 22 bp, Homo sapiens
aacatttatggtagtcattgca

SEQ ID NO: 7574054 - DNA, 22 bp, Homo sapiens
aacatttattctaattctggga

SEQ ID NO: 7574055 - DNA, 22 bp, Homo sapiens
aacatttattctaattctggga

SEQ ID NO: 7574056 - DNA, 22 bp, Homo sapiens
aacatttattgagcacctactg

SEQ ID NO: 7574057 - DNA, 22 bp, Homo sapiens
aacatttattgagcacctactg

SEQ ID NO: 7574058 - DNA, 22 bp, Homo sapiens
aacatttattgagcacctactg

SEQ ID NO: 7574059 - DNA, 22 bp, Homo sapiens
aacatttattgagcacctactg

SEQ ID NO: 7574060 - DNA, 22 bp, Homo sapiens
aacatttattgagcacctactg

SEQ ID NO: 7574061 - DNA, 22 bp, Homo sapiens
aacatttattgagcacctactg

SEQ ID NO: 7574062 - DNA, 22 bp, Homo sapiens
aacattgccatggttaatttta

SEQ ID NO: 7574063 - DNA, 20 bp, Homo sapiens
aacattgcttcaatgtaacc

SEQ ID NO: 7574064 - DNA, 20 bp, Homo sapiens
aacattgcttcaatgtaacc

SEQ ID NO: 7574065 - DNA, 22 bp, Homo sapiens
aacattggatatttattaaaag

SEQ ID NO: 7574066 - DNA, 22 bp, Homo sapiens
aacattgcagcttaattgcagg

SEQ ID NO: 7574067 - DNA, 22 bp, Homo sapiens
aacattgcattctctatgagat

SEQ ID NO: 7574068 - DNA, 22 bp, Homo sapiens
aacattgttttccctatatcca

SEQ ID NO: 7574069 - DNA, 22 bp, Homo sapiens
aacattgttttccctatatcca

SEQ ID NO: 7574070 - DNA, 22 bp, Homo sapiens
aacattgttttccctatatcca

SEQ ID NO: 7574071 - DNA, 22 bp, Homo sapiens
aacattgttttgcacaactctt

SEQ ID NO: 7574072 - DNA, 22 bp, Homo sapiens
aacattgttttgcacaactctt

SEQ ID NO: 7574073 - DNA, 22 bp, Homo sapiens
aacattgttttgcacaactctt

SEQ ID NO: 7574074 - DNA, 22 bp, Homo sapiens
aacattgttttgcacaactctt

SEQ ID NO: 7574075 - DNA, 22 bp, Homo sapiens
aacatttacaaatccttctgca

SEQ ID NO: 7574076 - DNA, 22 bp, Homo sapiens
aacatttacaaatccttctgca

SEQ ID NO: 7574077 - DNA, 22 bp, Homo sapiens
aacattgaatttaaaatacagt

SEQ ID NO: 7574078 - DNA, 22 bp, Homo sapiens
aacattgagttctacttccatt

SEQ ID NO: 7574079 - DNA, 22 bp, Homo sapiens
aacattgagttctacttccatt

SEQ ID NO: 7574080 - DNA, 22 bp, Homo sapiens
aacattgaacttggcacaccca

SEQ ID NO: 7574081 - DNA, 22 bp, Homo sapiens
aacattgaaatatttgcaatag

SEQ ID NO: 7574082 - DNA, 22 bp, Homo sapiens
aacattgaaatatttgcaatag

SEQ ID NO: 7574083 - DNA, 22 bp, Homo sapiens
aacattgaaatatttgcaatag

SEQ ID NO: 7574084 - DNA, 20 bp, Homo sapiens
aacattgaaagtctagaaga

SEQ ID NO: 7574085 - DNA, 20 bp, Homo sapiens
aacattgaaagtctagaaga

SEQ ID NO: 7574086 - DNA, 20 bp, Homo sapiens
aacattgaaagtctagaaga

SEQ ID NO: 7574087 - DNA, 22 bp, Homo sapiens
aacattctttggaggattattc

SEQ ID NO: 7574088 - DNA, 22 bp, Homo sapiens
aacattctttggaggattattc

SEQ ID NO: 7574089 - DNA, 22 bp, Homo sapiens
aacattctttggaggattattc

SEQ ID NO: 7574090 - DNA, 22 bp, Homo sapiens
aacattctttggaggattattc

SEQ ID NO: 7574091 - DNA, 22 bp, Homo sapiens
aacataaatttgaagtggcaaa

SEQ ID NO: 7574092 - DNA, 22 bp, Homo sapiens
aacataaatttgaagtggcaaa

SEQ ID NO: 7574093 - DNA, 22 bp, Homo sapiens
aacataaatttgaagtggcaaa

SEQ ID NO: 7574094 - DNA, 22 bp, Homo sapiens
aacatgtttccagtgtaaggcc

SEQ ID NO: 7574095 - DNA, 22 bp, Homo sapiens
aacataaatttgaagtggcaaa

SEQ ID NO: 7574096 - DNA, 22 bp, Homo sapiens
aacagtttgggtaggtatgtag

SEQ ID NO: 7574097 - DNA, 22 bp, Homo sapiens
aacagtttgcctgaaatgtatt

SEQ ID NO: 7574098 - DNA, 22 bp, Homo sapiens
aacagtttgggtaggtatgtag

SEQ ID NO: 7574099 - DNA, 22 bp, Homo sapiens
aacagtttgggtaggtatgtag

SEQ ID NO: 7574100 - DNA, 22 bp, Homo sapiens
aacagtttgggtaggtatgtag

SEQ ID NO: 7574101 - DNA, 22 bp, Homo sapiens
aacagtttgtggatagcttgta

SEQ ID NO: 7574102 - DNA, 22 bp, Homo sapiens
aacagtttgtggatagcttgta

SEQ ID NO: 7574103 - DNA, 22 bp, Homo sapiens
aacagtttttaaagctggcttc

SEQ ID NO: 7574104 - DNA, 22 bp, Homo sapiens
aacagtttttaaagctggcttc

SEQ ID NO: 7574105 - DNA, 22 bp, Homo sapiens
aacagtttgtggatagcttgta

SEQ ID NO: 7574106 - DNA, 22 bp, Homo sapiens
aacattcttcaaatatcactct

SEQ ID NO: 7574107 - DNA, 22 bp, Homo sapiens
aacattctttagctcttcctgc

SEQ ID NO: 7574108 - DNA, 22 bp, Homo sapiens
aacattctttagctcttcctgc

SEQ ID NO: 7574109 - DNA, 22 bp, Homo sapiens
aacattcttaagatttgtgtct

SEQ ID NO: 7574110 - DNA, 22 bp, Homo sapiens
aacattcttaagatttgtgtct

SEQ ID NO: 7574111 - DNA, 22 bp, Homo sapiens
aacattcttaagatttgtgtct

SEQ ID NO: 7574112 - DNA, 22 bp, Homo sapiens
aacattcttcaaatatcactct

SEQ ID NO: 7574113 - DNA, 22 bp, Homo sapiens
aacattcttcaaatatcactct

SEQ ID NO: 7574114 - DNA, 22 bp, Homo sapiens
aacattcttcaaatatcactct

SEQ ID NO: 7574115 - DNA, 22 bp, Homo sapiens
aacattcttcaaatatcactct

SEQ ID NO: 7574116 - DNA, 22 bp, Homo sapiens
aacattctggttctaaaaacct

SEQ ID NO: 7574117 - DNA, 22 bp, Homo sapiens
aacattctggttctaaaaacct

SEQ ID NO: 7574118 - DNA, 22 bp, Homo sapiens
aacattctgtcaattgatgacc

SEQ ID NO: 7574119 - DNA, 22 bp, Homo sapiens
aacattctgtcaattgatgacc

SEQ ID NO: 7574120 - DNA, 22 bp, Homo sapiens
aacattctgtcaattgatgacc

SEQ ID NO: 7574121 - DNA, 22 bp, Homo sapiens
aacatgtttccagtgtaaggcc

SEQ ID NO: 7574122 - DNA, 22 bp, Homo sapiens
aacattctggttctaaaaacct

SEQ ID NO: 7574123 - DNA, 22 bp, Homo sapiens
aacattaagatggcggaacagt

SEQ ID NO: 7574124 - DNA, 22 bp, Homo sapiens
aacattaagatggcggaacagt

SEQ ID NO: 7574125 - DNA, 22 bp, Homo sapiens
aacattaagatggcggaacagt

SEQ ID NO: 7574126 - DNA, 22 bp, Homo sapiens
aacattaagatggcggaacagt

SEQ ID NO: 7574127 - DNA, 22 bp, Homo sapiens
aacattaagatggcggaacagt

SEQ ID NO: 7574128 - DNA, 23 bp, Homo sapiens
aattcaaattcagtgtgactagg

SEQ ID NO: 7574129 - DNA, 23 bp, Homo sapiens
aattcaaattcagtgtgactagg

SEQ ID NO: 7574130 - DNA, 23 bp, Homo sapiens
aattcaaattcagtgtgactagg

SEQ ID NO: 7574131 - DNA, 23 bp, Homo sapiens
aattcaaattcagtgtgactagg

SEQ ID NO: 7574132 - DNA, 23 bp, Homo sapiens
aattcaaattcagtgtgactagg

SEQ ID NO: 7574133 - DNA, 22 bp, Homo sapiens
aattcaaattacaatagttgtt

SEQ ID NO: 7574134 - DNA, 22 bp, Homo sapiens
aattcaaattacaatagttgtt

SEQ ID NO: 7574135 - DNA, 22 bp, Homo sapiens
aattcaaattacaatagttgtt

SEQ ID NO: 7574136 - DNA, 22 bp, Homo sapiens
aattcaaattacaatagttgtt

SEQ ID NO: 7574137 - DNA, 22 bp, Homo sapiens
aattcaaagactagaattttgc

SEQ ID NO: 7574138 - DNA, 22 bp, Homo sapiens
aattcaaagactagaattttgc

SEQ ID NO: 7574139 - DNA, 22 bp, Homo sapiens
aattcaaagactagaattttgc

SEQ ID NO: 7574140 - DNA, 22 bp, Homo sapiens
aattcaaagactagaattttgc

SEQ ID NO: 7574141 - DNA, 22 bp, Homo sapiens
aattcaaattacaatagttgtt

SEQ ID NO: 7574142 - DNA, 22 bp, Homo sapiens
aattcaaattacaatagttgtt

SEQ ID NO: 7574143 - DNA, 22 bp, Homo sapiens
aattcaaattacaatagttgtt

SEQ ID NO: 7574144 - DNA, 22 bp, Homo sapiens
aattcaaagccgcttgggaatc

SEQ ID NO: 7574145 - DNA, 22 bp, Homo sapiens
aattcaaattacaatagttgtt

SEQ ID NO: 7574146 - DNA, 22 bp, Homo sapiens
aattcaaagccgcttgggaatc

SEQ ID NO: 7574147 - DNA, 22 bp, Homo sapiens
aattcaacagtcagttatctca

SEQ ID NO: 7574148 - DNA, 22 bp, Homo sapiens
aattcaatctaagaaatgatca

SEQ ID NO: 7574149 - DNA, 22 bp, Homo sapiens
aattcaaatttgagtttgtgat

SEQ ID NO: 7574150 - DNA, 22 bp, Homo sapiens
aattcaaggatctgttaaatct

SEQ ID NO: 7574151 - DNA, 23 bp, Homo sapiens
aattcaaattcagtgtgactagg

SEQ ID NO: 7574152 - DNA, 22 bp, Homo sapiens
aattcaaatttgagtttgtgat

SEQ ID NO: 7574153 - DNA, 22 bp, Homo sapiens
aattcaatctgtagattgtgat

SEQ ID NO: 7574154 - DNA, 22 bp, Homo sapiens
aattcaatctgtagattgtgat

SEQ ID NO: 7574155 - DNA, 22 bp, Homo sapiens
aattcaatggtttttaggatat

SEQ ID NO: 7574156 - DNA, 22 bp, Homo sapiens
aattcaatctaagaaatgatca

SEQ ID NO: 7574157 - DNA, 22 bp, Homo sapiens
aattcaatctaagaaatgatca

SEQ ID NO: 7574158 - DNA, 22 bp, Homo sapiens
aattcaatctaagaaatgatca

SEQ ID NO: 7574159 - DNA, 22 bp, Homo sapiens
aattcaatctaagaaatgatca

SEQ ID NO: 7574160 - DNA, 22 bp, Homo sapiens
aattagagatcgcaataacggg

SEQ ID NO: 7574161 - DNA, 22 bp, Homo sapiens
aattagagatcagttctttgac

SEQ ID NO: 7574162 - DNA, 22 bp, Homo sapiens
aattagaagggagttattgata

SEQ ID NO: 7574163 - DNA, 22 bp, Homo sapiens
aattagaagggagttattgata

SEQ ID NO: 7574164 - DNA, 22 bp, Homo sapiens
aattagaatcttatttggggaa

SEQ ID NO: 7574165 - DNA, 22 bp, Homo sapiens
aattagaagctgttagcaaaat

SEQ ID NO: 7574166 - DNA, 22 bp, Homo sapiens
aattagaagggagttattgata

SEQ ID NO: 7574167 - DNA, 22 bp, Homo sapiens
aattagaagggagttattgata

SEQ ID NO: 7574168 - DNA, 22 bp, Homo sapiens
aattagaagctgttagcaaaat

SEQ ID NO: 7574169 - DNA, 22 bp, Homo sapiens
aattagaagctgttagcaaaat

SEQ ID NO: 7574170 - DNA, 22 bp, Homo sapiens
aattagaagctgttagcaaaat

SEQ ID NO: 7574171 - DNA, 22 bp, Homo sapiens
aattagaagctgttagcaaaat

SEQ ID NO: 7574172 - DNA, 22 bp, Homo sapiens
aattagaagctgttagcaaaat

SEQ ID NO: 7574173 - DNA, 22 bp, Homo sapiens
aattagaagctgttagcaaaat

SEQ ID NO: 7574174 - DNA, 20 bp, Homo sapiens
aattagatgtttaatcaata

SEQ ID NO: 7574175 - DNA, 22 bp, Homo sapiens
aattagcagcatattctgcgat

SEQ ID NO: 7574176 - DNA, 20 bp, Homo sapiens
aattagatgtttaatcaata

SEQ ID NO: 7574177 - DNA, 22 bp, Homo sapiens
aattagcatttcccatataaat

SEQ ID NO: 7574178 - DNA, 20 bp, Homo sapiens
aattagatgtttaatcaata

SEQ ID NO: 7574179 - DNA, 22 bp, Homo sapiens
aattagagtggcgagtgattta

SEQ ID NO: 7574180 - DNA, 22 bp, Homo sapiens
aattagagtggcgagtgattta

SEQ ID NO: 7574181 - DNA, 20 bp, Homo sapiens
aattagatgtttaatcaata

SEQ ID NO: 7574182 - DNA, 20 bp, Homo sapiens
aattagatgtttaatcaata

SEQ ID NO: 7574183 - DNA, 20 bp, Homo sapiens
aattagatgtttaatcaata

SEQ ID NO: 7574184 - DNA, 22 bp, Homo sapiens
aattagcatttcccatataaat

SEQ ID NO: 7574185 - DNA, 22 bp, Homo sapiens
aattagcatttcccatataaat

SEQ ID NO: 7574186 - DNA, 22 bp, Homo sapiens
aattagcatttcccatataaat

SEQ ID NO: 7574187 - DNA, 22 bp, Homo sapiens
aattatttaactcctttggaga

SEQ ID NO: 7574188 - DNA, 22 bp, Homo sapiens
aattatttaactcctttggaga

SEQ ID NO: 7574189 - DNA, 22 bp, Homo sapiens
aattatttaactcctttggaga

SEQ ID NO: 7574190 - DNA, 22 bp, Homo sapiens
aattatttaactcctttggaga

SEQ ID NO: 7574191 - DNA, 22 bp, Homo sapiens
aagacaaaggggtccttggatg

SEQ ID NO: 7574192 - DNA, 22 bp, Homo sapiens
aagacaaaggggtccttggatg

SEQ ID NO: 7574193 - DNA, 22 bp, Homo sapiens
aagacaacagagatgacagact

SEQ ID NO: 7574194 - DNA, 22 bp, Homo sapiens
aagacaacagagatgacagact

SEQ ID NO: 7574195 - DNA, 22 bp, Homo sapiens
aagacaaaggggtccttggatg

SEQ ID NO: 7574196 - DNA, 22 bp, Homo sapiens
aagacaacagagatgacagact

SEQ ID NO: 7574197 - DNA, 22 bp, Homo sapiens
aagacaacagagatgacagact

SEQ ID NO: 7574198 - DNA, 22 bp, Homo sapiens
aagacaacagagatgacagact

SEQ ID NO: 7574199 - DNA, 17 bp, Homo sapiens
aagacaagacaaatgca

SEQ ID NO: 7574200 - DNA, 17 bp, Homo sapiens
aagacaagacaaatgca

SEQ ID NO: 7574201 - DNA, 17 bp, Homo sapiens
aagacaagacaaatgca

SEQ ID NO: 7574202 - DNA, 17 bp, Homo sapiens
aagacaagacaaatgca

SEQ ID NO: 7574203 - DNA, 17 bp, Homo sapiens
aagacaagacaaatgca

SEQ ID NO: 7574204 - DNA, 22 bp, Homo sapiens
aagaattttccagcatgtcagt

SEQ ID NO: 7574205 - DNA, 22 bp, Homo sapiens
aagacaaaggggtccttggatg

SEQ ID NO: 7574206 - DNA, 22 bp, Homo sapiens
aagaattttccagcatgtcagt

SEQ ID NO: 7574207 - DNA, 22 bp, Homo sapiens
aagaatttaaactaaccatatg

SEQ ID NO: 7574208 - DNA, 22 bp, Homo sapiens
aagaatttaaactaaccatatg

SEQ ID NO: 7574209 - DNA, 22 bp, Homo sapiens
aagaattttccagcatgtcagt

SEQ ID NO: 7574210 - DNA, 22 bp, Homo sapiens
aagaattttccagcatgtcagt

SEQ ID NO: 7574211 - DNA, 17 bp, Homo sapiens
aagacaagacaaatgca

SEQ ID NO: 7574212 - DNA, 17 bp, Homo sapiens
aagacaagacaaatgca

SEQ ID NO: 7574213 - DNA, 17 bp, Homo sapiens
aagacaagacaaatgca

SEQ ID NO: 7574214 - DNA, 17 bp, Homo sapiens
aagacaagacaaatgca

SEQ ID NO: 7574215 - DNA, 22 bp, Homo sapiens
aagacaagcatcaaatcaggca

SEQ ID NO: 7574216 - DNA, 22 bp, Homo sapiens
aagacaagcatcaaatcaggca

SEQ ID NO: 7574217 - DNA, 22 bp, Homo sapiens
aagacaagcatcaaatcaggca

SEQ ID NO: 7574218 - DNA, 22 bp, Homo sapiens
aagacaagcatcaaatcaggca

SEQ ID NO: 7574219 - DNA, 22 bp, Homo sapiens
aagacaagccttgtttttctgc

SEQ ID NO: 7574220 - DNA, 22 bp, Homo sapiens
aagacaagccttgtttttctgc

SEQ ID NO: 7574221 - DNA, 22 bp, Homo sapiens
aagacaataatttttgggcagg

SEQ ID NO: 7574222 - DNA, 22 bp, Homo sapiens
aagacaataatttttgggcagg

SEQ ID NO: 7574223 - DNA, 22 bp, Homo sapiens
aagacaatattgctgtgaacgt

SEQ ID NO: 7574224 - DNA, 22 bp, Homo sapiens
aagacaatattgctgtgaacgt

SEQ ID NO: 7574225 - DNA, 22 bp, Homo sapiens
aagacaatattgctgtgaacgt

SEQ ID NO: 7574226 - DNA, 22 bp, Homo sapiens
aagacaatcctggacagtcagc

SEQ ID NO: 7574227 - DNA, 22 bp, Homo sapiens
aagacaatattgctgtgaacgt

SEQ ID NO: 7574228 - DNA, 22 bp, Homo sapiens
aagacaatcctggacagtcagc

SEQ ID NO: 7574229 - DNA, 22 bp, Homo sapiens
aagacaatcctggacagtcagc

SEQ ID NO: 7574230 - DNA, 22 bp, Homo sapiens
aagacaatcctggacagtcagc

SEQ ID NO: 7574231 - DNA, 22 bp, Homo sapiens
aagacaatcctggacagtcagc

SEQ ID NO: 7574232 - DNA, 22 bp, Homo sapiens
aagaattattgcaatactagat

SEQ ID NO: 7574233 - DNA, 22 bp, Homo sapiens
aagaattattgcaatactagat

SEQ ID NO: 7574234 - DNA, 22 bp, Homo sapiens
aagaattcactggtagagtcaa

SEQ ID NO: 7574235 - DNA, 22 bp, Homo sapiens
aagaattattgcaatactagat

SEQ ID NO: 7574236 - DNA, 22 bp, Homo sapiens
aagaattattgcaatactagat

SEQ ID NO: 7574237 - DNA, 22 bp, Homo sapiens
aagaattattgcaatactagat

SEQ ID NO: 7574238 - DNA, 22 bp, Homo sapiens
aagaattattgcaatactagat

SEQ ID NO: 7574239 - DNA, 22 bp, Homo sapiens
aagaatttaaactaaccatatg

SEQ ID NO: 7574240 - DNA, 22 bp, Homo sapiens
aagaattgcctttcaattgttt

SEQ ID NO: 7574241 - DNA, 22 bp, Homo sapiens
aagaattgatgtgaattgcagc

SEQ ID NO: 7574242 - DNA, 22 bp, Homo sapiens
aagaattcactggtagagtcaa

SEQ ID NO: 7574243 - DNA, 22 bp, Homo sapiens
aattcacaaaagttagatccat

SEQ ID NO: 7574244 - DNA, 22 bp, Homo sapiens
aattcacaaaagttagatccat

SEQ ID NO: 7574245 - DNA, 22 bp, Homo sapiens
aattcacaaaagttagatccat

SEQ ID NO: 7574246 - DNA, 22 bp, Homo sapiens
aagaatctttccagttttgatg

SEQ ID NO: 7574247 - DNA, 22 bp, Homo sapiens
aagaatcttaatccagaaacct

SEQ ID NO: 7574248 - DNA, 22 bp, Homo sapiens
aagaatctttccagttttgatg

SEQ ID NO: 7574249 - DNA, 22 bp, Homo sapiens
aagaatcttaatccagaaacct

SEQ ID NO: 7574250 - DNA, 22 bp, Homo sapiens
aagaatcttaatccagaaacct

SEQ ID NO: 7574251 - DNA, 22 bp, Homo sapiens
aagaatcttaatccagaaacct

SEQ ID NO: 7574252 - DNA, 22 bp, Homo sapiens
aattcacaaaaccagattgctt

SEQ ID NO: 7574253 - DNA, 22 bp, Homo sapiens
aattcacaaaaccagattgctt

SEQ ID NO: 7574254 - DNA, 22 bp, Homo sapiens
aattcaatggtttttaggatat

SEQ ID NO: 7574255 - DNA, 22 bp, Homo sapiens
aattcacaaaaccagattgctt

SEQ ID NO: 7574256 - DNA, 22 bp, Homo sapiens
aattcacaaaaccagattgctt

SEQ ID NO: 7574257 - DNA, 22 bp, Homo sapiens
aattcacaaaaccagattgctt

SEQ ID NO: 7574258 - DNA, 22 bp, Homo sapiens
aattcacaaaaccagattgctt

SEQ ID NO: 7574259 - DNA, 22 bp, Homo sapiens
aattcacaaaaccagattgctt

SEQ ID NO: 7574260 - DNA, 22 bp, Homo sapiens
aattcacaaaagttagatccat

SEQ ID NO: 7574261 - DNA, 22 bp, Homo sapiens
aattcacaaaagttagatccat

SEQ ID NO: 7574262 - DNA, 22 bp, Homo sapiens
aattcacaaaaccagattgctt

SEQ ID NO: 7574263 - DNA, 22 bp, Homo sapiens
aattcacaaaaccagattgctt

SEQ ID NO: 7574264 - DNA, 22 bp, Homo sapiens
aattcacaaaaccagattgctt

SEQ ID NO: 7574265 - DNA, 22 bp, Homo sapiens
aagacaatcctggacagtcagc

SEQ ID NO: 7574266 - DNA, 22 bp, Homo sapiens
aagacaatcctggacagtcagc

SEQ ID NO: 7574267 - DNA, 22 bp, Homo sapiens
aagacaatctaaggggaatggt

SEQ ID NO: 7574268 - DNA, 22 bp, Homo sapiens
aagacaatgagtcctgatggga

SEQ ID NO: 7574269 - DNA, 22 bp, Homo sapiens
aagacaatgcattactaagaag

SEQ ID NO: 7574270 - DNA, 22 bp, Homo sapiens
aagacaatgcattactaagaag

SEQ ID NO: 7574271 - DNA, 22 bp, Homo sapiens
aagacaatgcattactaagaag

SEQ ID NO: 7574272 - DNA, 22 bp, Homo sapiens
aagacaatgcattactaagaag

SEQ ID NO: 7574273 - DNA, 22 bp, Homo sapiens
aagacaatgcattactaagaag

SEQ ID NO: 7574274 - DNA, 22 bp, Homo sapiens
aagacaatgcattactaagaag

SEQ ID NO: 7574275 - DNA, 22 bp, Homo sapiens
aagacaatgcattactaagaag

SEQ ID NO: 7574276 - DNA, 22 bp, Homo sapiens
aagacaatgtttctgatagata

SEQ ID NO: 7574277 - DNA, 22 bp, Homo sapiens
aagacaatgtttctgatagata

SEQ ID NO: 7574278 - DNA, 22 bp, Homo sapiens
aagacaatgtttctgatagata

SEQ ID NO: 7574279 - DNA, 22 bp, Homo sapiens
aagacaatgcattactaagaag

SEQ ID NO: 7574280 - DNA, 22 bp, Homo sapiens
aagacaatgcattactaagaag

SEQ ID NO: 7574281 - DNA, 22 bp, Homo sapiens
aagacaatgtttctgatagata

SEQ ID NO: 7574282 - DNA, 22 bp, Homo sapiens
aagacaatgtttctgatagata

SEQ ID NO: 7574283 - DNA, 22 bp, Homo sapiens
aagacaattttgagtatgcaca

SEQ ID NO: 7574284 - DNA, 22 bp, Homo sapiens
aagacaattttgagtatgcaca

SEQ ID NO: 7574285 - DNA, 22 bp, Homo sapiens
aagacaattttgagtatgcaca

SEQ ID NO: 7574286 - DNA, 22 bp, Homo sapiens
aagacaattttgagtatgcaca

SEQ ID NO: 7574287 - DNA, 22 bp, Homo sapiens
aagacacaaagcttcccttttc

SEQ ID NO: 7574288 - DNA, 22 bp, Homo sapiens
aagacacaatgtagcccagcac

SEQ ID NO: 7574289 - DNA, 22 bp, Homo sapiens
aagacacaatgtagcccagcac

SEQ ID NO: 7574290 - DNA, 22 bp, Homo sapiens
aagacacaaagcttcccttttc

SEQ ID NO: 7574291 - DNA, 22 bp, Homo sapiens
aagacacaaagcttcccttttc

SEQ ID NO: 7574292 - DNA, 22 bp, Homo sapiens
aagacaatttgatactagttgc

SEQ ID NO: 7574293 - DNA, 22 bp, Homo sapiens
aagacaatttatgttagggtca

SEQ ID NO: 7574294 - DNA, 22 bp, Homo sapiens
aagacaatttgatactagttgc

SEQ ID NO: 7574295 - DNA, 22 bp, Homo sapiens
aagacaattttgagtatgcaca

SEQ ID NO: 7574296 - DNA, 22 bp, Homo sapiens
aagacaattttgagtatgcaca

SEQ ID NO: 7574297 - DNA, 22 bp, Homo sapiens
aagacaattttgagtatgcaca

SEQ ID NO: 7574298 - DNA, 22 bp, Homo sapiens
aagacaatttgatactagttgc

SEQ ID NO: 7574299 - DNA, 22 bp, Homo sapiens
aagacacagcgaaatgttcctg

SEQ ID NO: 7574300 - DNA, 22 bp, Homo sapiens
aagacacagcgaaatgttcctg

SEQ ID NO: 7574301 - DNA, 22 bp, Homo sapiens
aagacacagcgaaatgttcctg

SEQ ID NO: 7574302 - DNA, 22 bp, Homo sapiens
aagacacacacatatgctgagt

SEQ ID NO: 7574303 - DNA, 22 bp, Homo sapiens
aagacacacacatatgctgagt

SEQ ID NO: 7574304 - DNA, 22 bp, Homo sapiens
acaacaaaatgaggaagtggtc

SEQ ID NO: 7574305 - DNA, 22 bp, Homo sapiens
acaacaaaatcactagtcttcc

SEQ ID NO: 7574306 - DNA, 22 bp, Homo sapiens
acaacaaaatgaggaagtggtc

SEQ ID NO: 7574307 - DNA, 22 bp, Homo sapiens
aagacacacacatatgctgagt

SEQ ID NO: 7574308 - DNA, 22 bp, Homo sapiens
aagacacacacatatgctgagt

SEQ ID NO: 7574309 - DNA, 22 bp, Homo sapiens
aagacacacacatatgctgagt

SEQ ID NO: 7574310 - DNA, 22 bp, Homo sapiens
aagacacacacatatgctgagt

SEQ ID NO: 7574311 - DNA, 22 bp, Homo sapiens
acaactgtcttcttcatgctcc

SEQ ID NO: 7574312 - DNA, 22 bp, Homo sapiens
acaactgtcagtaaagaatatt

SEQ ID NO: 7574313 - DNA, 22 bp, Homo sapiens
acaactgtcagtaaagaatatt

SEQ ID NO: 7574314 - DNA, 22 bp, Homo sapiens
acaactgtcagtaaagaatatt

SEQ ID NO: 7574315 - DNA, 22 bp, Homo sapiens
acaactgtcttcttcatgctcc

SEQ ID NO: 7574316 - DNA, 22 bp, Homo sapiens
acaactgttagacacttctaag

SEQ ID NO: 7574317 - DNA, 22 bp, Homo sapiens
acaactgttggaggaacacagg

SEQ ID NO: 7574318 - DNA, 22 bp, Homo sapiens
acaactgttggaggaacacagg

SEQ ID NO: 7574319 - DNA, 22 bp, Homo sapiens
acaactctcagttaaataaaga

SEQ ID NO: 7574320 - DNA, 22 bp, Homo sapiens
acaactgatgggtcatgtggga

SEQ ID NO: 7574321 - DNA, 22 bp, Homo sapiens
acaactggctttttagcttgtt

SEQ ID NO: 7574322 - DNA, 22 bp, Homo sapiens
acaactgggggcattactggca

SEQ ID NO: 7574323 - DNA, 22 bp, Homo sapiens
acaactgtcagtaaagaatatt

SEQ ID NO: 7574324 - DNA, 22 bp, Homo sapiens
acaactctcagttaaataaaga

SEQ ID NO: 7574325 - DNA, 22 bp, Homo sapiens
acaactctcagttaaataaaga

SEQ ID NO: 7574326 - DNA, 22 bp, Homo sapiens
acaactctcagttaaataaaga

SEQ ID NO: 7574327 - DNA, 22 bp, Homo sapiens
acaactccttcttgggtcctgg

SEQ ID NO: 7574328 - DNA, 22 bp, Homo sapiens
acaactccttcttgggtcctgg

SEQ ID NO: 7574329 - DNA, 22 bp, Homo sapiens
aagacattgtcattttataatt

SEQ ID NO: 7574330 - DNA, 22 bp, Homo sapiens
aagacattgtcattttataatt

SEQ ID NO: 7574331 - DNA, 22 bp, Homo sapiens
aagacattgtcattttataatt

SEQ ID NO: 7574332 - DNA, 22 bp, Homo sapiens
aagacattgtggagatgttgct

SEQ ID NO: 7574333 - DNA, 22 bp, Homo sapiens
aagacattggcattgactgtaa

SEQ ID NO: 7574334 - DNA, 22 bp, Homo sapiens
aagacattggcattgactgtaa

SEQ ID NO: 7574335 - DNA, 22 bp, Homo sapiens
aagacattgtcattttataatt

SEQ ID NO: 7574336 - DNA, 22 bp, Homo sapiens
aagacattgtcattttataatt

SEQ ID NO: 7574337 - DNA, 22 bp, Homo sapiens
aagacattgtcattttataatt

SEQ ID NO: 7574338 - DNA, 22 bp, Homo sapiens
aagacattgtcattttataatt

SEQ ID NO: 7574339 - DNA, 22 bp, Homo sapiens
aagacattgctgcttttaattg

SEQ ID NO: 7574340 - DNA, 22 bp, Homo sapiens
aagacattgctgcttttaattg

SEQ ID NO: 7574341 - DNA, 22 bp, Homo sapiens
aagacattgctgcttttaattg

SEQ ID NO: 7574342 - DNA, 22 bp, Homo sapiens
aagacattgctgcttttaattg

SEQ ID NO: 7574343 - DNA, 22 bp, Homo sapiens
aagacattgctgcttttaattg

SEQ ID NO: 7574344 - DNA, 22 bp, Homo sapiens
aagacattgctgcttttaattg

SEQ ID NO: 7574345 - DNA, 22 bp, Homo sapiens
aagacattggacaatccagagg

SEQ ID NO: 7574346 - DNA, 22 bp, Homo sapiens
aagacattggacaatccagagg

SEQ ID NO: 7574347 - DNA, 22 bp, Homo sapiens
aagacattggacaatccagagg

SEQ ID NO: 7574348 - DNA, 22 bp, Homo sapiens
aagacattggcattgactgtaa

SEQ ID NO: 7574349 - DNA, 22 bp, Homo sapiens
aagacattggcattgactgtaa

SEQ ID NO: 7574350 - DNA, 22 bp, Homo sapiens
aagacattggcattgactgtaa

SEQ ID NO: 7574351 - DNA, 22 bp, Homo sapiens
acaagaataaggataagagatt

SEQ ID NO: 7574352 - DNA, 22 bp, Homo sapiens
acaagaataaggataagagatt

SEQ ID NO: 7574353 - DNA, 22 bp, Homo sapiens
acaagaatgtagattagttaag

SEQ ID NO: 7574354 - DNA, 22 bp, Homo sapiens
acaagaatgtagattagttaag

SEQ ID NO: 7574355 - DNA, 22 bp, Homo sapiens
acaagaataaggataagagatt

SEQ ID NO: 7574356 - DNA, 22 bp, Homo sapiens
acaagaataaggataagagatt

SEQ ID NO: 7574357 - DNA, 22 bp, Homo sapiens
aagacattcacaaatgttcact

SEQ ID NO: 7574358 - DNA, 22 bp, Homo sapiens
aagacattcacaaatgttcact

SEQ ID NO: 7574359 - DNA, 22 bp, Homo sapiens
aagacattcacaaatgttcact

SEQ ID NO: 7574360 - DNA, 22 bp, Homo sapiens
aagacattcacaaatgttcact

SEQ ID NO: 7574361 - DNA, 22 bp, Homo sapiens
aagacattcacaaatgttcact

SEQ ID NO: 7574362 - DNA, 22 bp, Homo sapiens
aagacattagaatcagcctgtt

SEQ ID NO: 7574363 - DNA, 22 bp, Homo sapiens
aagacattagaatcagcctgtt

SEQ ID NO: 7574364 - DNA, 22 bp, Homo sapiens
aagacattgcatgataatgctg

SEQ ID NO: 7574365 - DNA, 22 bp, Homo sapiens
aagacattgcatgataatgctg

SEQ ID NO: 7574366 - DNA, 22 bp, Homo sapiens
aagacattccaaagtggctaat

SEQ ID NO: 7574367 - DNA, 22 bp, Homo sapiens
aagacattgcatgataatgctg

SEQ ID NO: 7574368 - DNA, 22 bp, Homo sapiens
aagacattgcatgataatgctg

SEQ ID NO: 7574369 - DNA, 22 bp, Homo sapiens
aagacattcacaaatgttcact

SEQ ID NO: 7574370 - DNA, 22 bp, Homo sapiens
aagacattcatgaagaagggat

SEQ ID NO: 7574371 - DNA, 22 bp, Homo sapiens
aagacattcatgaagaagggat

SEQ ID NO: 7574372 - DNA, 22 bp, Homo sapiens
aagacattcatgaagaagggat

SEQ ID NO: 7574373 - DNA, 22 bp, Homo sapiens
aagacattccaaagtggctaat

SEQ ID NO: 7574374 - DNA, 22 bp, Homo sapiens
acaagaaaggtaggattcaggt

SEQ ID NO: 7574375 - DNA, 22 bp, Homo sapiens
acaagaaaggtaggattcaggt

SEQ ID NO: 7574376 - DNA, 22 bp, Homo sapiens
acaagaaaggtaggattcaggt

SEQ ID NO: 7574377 - DNA, 22 bp, Homo sapiens
acaagaaaggtaggattcaggt

SEQ ID NO: 7574378 - DNA, 22 bp, Homo sapiens
acaagaaaggtaggattcaggt

SEQ ID NO: 7574379 - DNA, 22 bp, Homo sapiens
acaacttttctatcatgtggaa

SEQ ID NO: 7574380 - DNA, 22 bp, Homo sapiens
acaactttgtagcaattccacg

SEQ ID NO: 7574381 - DNA, 22 bp, Homo sapiens
acaacttttctatcatgtggaa

SEQ ID NO: 7574382 - DNA, 22 bp, Homo sapiens
acaactttgtagcaattccacg

SEQ ID NO: 7574383 - DNA, 22 bp, Homo sapiens
acaactttgtagcaattccacg

SEQ ID NO: 7574384 - DNA, 22 bp, Homo sapiens
acaactttgtagcaattccacg

SEQ ID NO: 7574385 - DNA, 22 bp, Homo sapiens
acaagaagtcacatctaggagt

SEQ ID NO: 7574386 - DNA, 22 bp, Homo sapiens
acaagaagtcacatctaggagt

SEQ ID NO: 7574387 - DNA, 22 bp, Homo sapiens
acaagaagtaaaggtcggatgc

SEQ ID NO: 7574388 - DNA, 22 bp, Homo sapiens
acaagaagtcacatctaggagt

SEQ ID NO: 7574389 - DNA, 22 bp, Homo sapiens
acaagaagagcatttgcagggt

SEQ ID NO: 7574390 - DNA, 22 bp, Homo sapiens
acaagaagtaaaggtcggatgc

SEQ ID NO: 7574391 - DNA, 22 bp, Homo sapiens
acaagaagggtgattaggggca

SEQ ID NO: 7574392 - DNA, 22 bp, Homo sapiens
acaagaagagcatttgcagggt

SEQ ID NO: 7574393 - DNA, 22 bp, Homo sapiens
acaagaaccaaagaaggatatt

SEQ ID NO: 7574394 - DNA, 22 bp, Homo sapiens
acaagaaccaaagaaggatatt

SEQ ID NO: 7574395 - DNA, 22 bp, Homo sapiens
acaagaaccaaagaaggatatt

SEQ ID NO: 7574396 - DNA, 22 bp, Homo sapiens
acaagaaccaaagaaggatatt

SEQ ID NO: 7574397 - DNA, 20 bp, Homo sapiens
acaacttagttgagagacta

SEQ ID NO: 7574398 - DNA, 22 bp, Homo sapiens
acaacttcaattgggattctcc

SEQ ID NO: 7574399 - DNA, 22 bp, Homo sapiens
acaacttcaattgggattctcc

SEQ ID NO: 7574400 - DNA, 22 bp, Homo sapiens
acaactttaatgggtttcagct

SEQ ID NO: 7574401 - DNA, 22 bp, Homo sapiens
acaactttaatgggtttcagct

SEQ ID NO: 7574402 - DNA, 22 bp, Homo sapiens
acaactttaatgggtttcagct

SEQ ID NO: 7574403 - DNA, 22 bp, Homo sapiens
acaacttctcacagataaattt

SEQ ID NO: 7574404 - DNA, 22 bp, Homo sapiens
acaacttctcacagataaattt

SEQ ID NO: 7574405 - DNA, 22 bp, Homo sapiens
acaacttctcacagataaattt

SEQ ID NO: 7574406 - DNA, 23 bp, Homo sapiens
acaactttacagatacattttgt

SEQ ID NO: 7574407 - DNA, 23 bp, Homo sapiens
acaactttacagatacattttgt

SEQ ID NO: 7574408 - DNA, 23 bp, Homo sapiens
acaactttacagatacattttgt

SEQ ID NO: 7574409 - DNA, 22 bp, Homo sapiens
acaactttaatgggtttcagct

SEQ ID NO: 7574410 - DNA, 22 bp, Homo sapiens
acaactttctgggttatctgat

SEQ ID NO: 7574411 - DNA, 22 bp, Homo sapiens
acaactttagtctggagggaaa

SEQ ID NO: 7574412 - DNA, 22 bp, Homo sapiens
acaactttctgggttatctgat

SEQ ID NO: 7574413 - DNA, 22 bp, Homo sapiens
acaactttctgggttatctgat

SEQ ID NO: 7574414 - DNA, 22 bp, Homo sapiens
acaactttgtagcaattccacg

SEQ ID NO: 7574415 - DNA, 22 bp, Homo sapiens
acaactttgtagcaattccacg

SEQ ID NO: 7574416 - DNA, 22 bp, Homo sapiens
acaactttgacccttgttctta

SEQ ID NO: 7574417 - DNA, 22 bp, Homo sapiens
acaactttgacccttgttctta

SEQ ID NO: 7574418 - DNA, 22 bp, Homo sapiens
aatgtctttgcaggagggattg

SEQ ID NO: 7574419 - DNA, 22 bp, Homo sapiens
aatgtctttcttggttctggtt

SEQ ID NO: 7574420 - DNA, 22 bp, Homo sapiens
aatgtctttcttggttctggtt

SEQ ID NO: 7574421 - DNA, 22 bp, Homo sapiens
aatgtctttgccagggtcgggc

SEQ ID NO: 7574422 - DNA, 21 bp, Homo sapiens
aatgtctttgtccatgctctg

SEQ ID NO: 7574423 - DNA, 21 bp, Homo sapiens
aatgtctttgtccatgctctg

SEQ ID NO: 7574424 - DNA, 22 bp, Homo sapiens
aatgtcttttaacctctggact

SEQ ID NO: 7574425 - DNA, 22 bp, Homo sapiens
aatgtcttttaacctctggact

SEQ ID NO: 7574426 - DNA, 22 bp, Homo sapiens
aatgtcttttaaatgttgaggt

SEQ ID NO: 7574427 - DNA, 22 bp, Homo sapiens
aatgtcttttaaatgttgaggt

SEQ ID NO: 7574428 - DNA, 22 bp, Homo sapiens
aatgtcttttaaatgttgaggt

SEQ ID NO: 7574429 - DNA, 21 bp, Homo sapiens
aatgtctttgtccatgctctg

SEQ ID NO: 7574430 - DNA, 22 bp, Homo sapiens
aatgtcttttgatacaagttac

SEQ ID NO: 7574431 - DNA, 22 bp, Homo sapiens
aatgtcttttgatacaagttac

SEQ ID NO: 7574432 - DNA, 22 bp, Homo sapiens
aatgtcttttgatacaagttac

SEQ ID NO: 7574433 - DNA, 22 bp, Homo sapiens
aatgtcttttgatacaagttac

SEQ ID NO: 7574434 - DNA, 22 bp, Homo sapiens
aatgtcttttcccttactttcc

SEQ ID NO: 7574435 - DNA, 22 bp, Homo sapiens
aatgtcttttaacctctggact

SEQ ID NO: 7574436 - DNA, 22 bp, Homo sapiens
aatgtcttttcccttactttcc

SEQ ID NO: 7574437 - DNA, 22 bp, Homo sapiens
aatgtcttttcccttactttcc

SEQ ID NO: 7574438 - DNA, 22 bp, Homo sapiens
aatgtcttttgatacaagttac

SEQ ID NO: 7574439 - DNA, 22 bp, Homo sapiens
aatgtgttttcactgaagattc

SEQ ID NO: 7574440 - DNA, 22 bp, Homo sapiens
aatgtgttttatgagagaatat

SEQ ID NO: 7574441 - DNA, 22 bp, Homo sapiens
aatgtgttttatgagagaatat

SEQ ID NO: 7574442 - DNA, 22 bp, Homo sapiens
aatgtgttttatgagagaatat

SEQ ID NO: 7574443 - DNA, 22 bp, Homo sapiens
aatgttaaaaccttcagtgctt

SEQ ID NO: 7574444 - DNA, 22 bp, Homo sapiens
aatgttaaaaccttcagtgctt

SEQ ID NO: 7574445 - DNA, 22 bp, Homo sapiens
aatgttaaaaccttcagtgctt

SEQ ID NO: 7574446 - DNA, 22 bp, Homo sapiens
aatgttaaaaccttcagtgctt

SEQ ID NO: 7574447 - DNA, 22 bp, Homo sapiens
aatgtgttttcactgaagattc

SEQ ID NO: 7574448 - DNA, 22 bp, Homo sapiens
aatgtgttttcactgaagattc

SEQ ID NO: 7574449 - DNA, 22 bp, Homo sapiens
aatgtcttttgcagttcaagat

SEQ ID NO: 7574450 - DNA, 22 bp, Homo sapiens
aatgtcttttgcagttcaagat

SEQ ID NO: 7574451 - DNA, 22 bp, Homo sapiens
aatgtgaaaccgcacagaataa

SEQ ID NO: 7574452 - DNA, 22 bp, Homo sapiens
aatgtgaaaccgcacagaataa

SEQ ID NO: 7574453 - DNA, 22 bp, Homo sapiens
aatgtgaaaccgcacagaataa

SEQ ID NO: 7574454 - DNA, 22 bp, Homo sapiens
aatgtgaactttgtcatgtaac

SEQ ID NO: 7574455 - DNA, 22 bp, Homo sapiens
aatgtgtttatttagtgattta

SEQ ID NO: 7574456 - DNA, 22 bp, Homo sapiens
aatgtgaaaccgcacagaataa

SEQ ID NO: 7574457 - DNA, 22 bp, Homo sapiens
aatgtgaaaccgcacagaataa

SEQ ID NO: 7574458 - DNA, 22 bp, Homo sapiens
aatgtgaaaccgcacagaataa

SEQ ID NO: 7574459 - DNA, 22 bp, Homo sapiens
aatgtgaactttgtcatgtaac

SEQ ID NO: 7574460 - DNA, 22 bp, Homo sapiens
aatgttaagtttagattataac

SEQ ID NO: 7574461 - DNA, 22 bp, Homo sapiens
aatgttaagtttagattataac

SEQ ID NO: 7574462 - DNA, 22 bp, Homo sapiens
aatgttaagtttagattataac

SEQ ID NO: 7574463 - DNA, 22 bp, Homo sapiens
aatgttaatgtgtttgcttatg

SEQ ID NO: 7574464 - DNA, 22 bp, Homo sapiens
aatgttaagtttagattataac

SEQ ID NO: 7574465 - DNA, 22 bp, Homo sapiens
aatgttaatgtgtttgcttatg

SEQ ID NO: 7574466 - DNA, 22 bp, Homo sapiens
aatgttaatgtgtttgcttatg

SEQ ID NO: 7574467 - DNA, 22 bp, Homo sapiens
aatgttaatgtgtttgcttatg

SEQ ID NO: 7574468 - DNA, 22 bp, Homo sapiens
aatgttaattcacagccaaata

SEQ ID NO: 7574469 - DNA, 22 bp, Homo sapiens
aatgttaatgtgtttgcttatg

SEQ ID NO: 7574470 - DNA, 22 bp, Homo sapiens
aatgttaattcacagccaaata

SEQ ID NO: 7574471 - DNA, 22 bp, Homo sapiens
aatgttaattcacagccaaata

SEQ ID NO: 7574472 - DNA, 22 bp, Homo sapiens
aatgttaatttactgtcttcat

SEQ ID NO: 7574473 - DNA, 22 bp, Homo sapiens
aatgttaatttactgtcttcat

SEQ ID NO: 7574474 - DNA, 22 bp, Homo sapiens
aatgttaatttactgtcttcat

SEQ ID NO: 7574475 - DNA, 22 bp, Homo sapiens
aatgttatgtggttcaacttaa

SEQ ID NO: 7574476 - DNA, 22 bp, Homo sapiens
aatgttatgtggttcaacttaa

SEQ ID NO: 7574477 - DNA, 22 bp, Homo sapiens
aatgttatgtggttcaacttaa

SEQ ID NO: 7574478 - DNA, 22 bp, Homo sapiens
aatgttagtaacttgagtattt

SEQ ID NO: 7574479 - DNA, 22 bp, Homo sapiens
aatgttatgtggttcaacttaa

SEQ ID NO: 7574480 - DNA, 22 bp, Homo sapiens
aatgttagattcctccacctag

SEQ ID NO: 7574481 - DNA, 22 bp, Homo sapiens
aatgttacgatcaacaacacat

SEQ ID NO: 7574482 - DNA, 22 bp, Homo sapiens
aatgttacgatcaacaacacat

SEQ ID NO: 7574483 - DNA, 22 bp, Homo sapiens
aatgttacgatcaacaacacat

SEQ ID NO: 7574484 - DNA, 22 bp, Homo sapiens
aatgttacgatcaacaacacat

SEQ ID NO: 7574485 - DNA, 22 bp, Homo sapiens
aatgttacagttttaattctga

SEQ ID NO: 7574486 - DNA, 22 bp, Homo sapiens
aatgttacaggacctaagatga

SEQ ID NO: 7574487 - DNA, 22 bp, Homo sapiens
aatgttacaggacaaagatgga

SEQ ID NO: 7574488 - DNA, 22 bp, Homo sapiens
aatgttacataacccattgtcc

SEQ ID NO: 7574489 - DNA, 22 bp, Homo sapiens
aatgttacataacccattgtcc

SEQ ID NO: 7574490 - DNA, 22 bp, Homo sapiens
aatgttacagttttaattctga

SEQ ID NO: 7574491 - DNA, 22 bp, Homo sapiens
aatgttacgatcaacaacacat

SEQ ID NO: 7574492 - DNA, 22 bp, Homo sapiens
aatgttacgatcaacaacacat

SEQ ID NO: 7574493 - DNA, 22 bp, Homo sapiens
aatgttacgatcaacaacacat

SEQ ID NO: 7574494 - DNA, 22 bp, Homo sapiens
aatgttacaggacaaagatgga

SEQ ID NO: 7574495 - DNA, 22 bp, Homo sapiens
aatgttacgatcaacaacacat

SEQ ID NO: 7574496 - DNA, 22 bp, Homo sapiens
aatgttacgatcaacaacacat

SEQ ID NO: 7574497 - DNA, 22 bp, Homo sapiens
aatgttacgatcaacaacacat

SEQ ID NO: 7574498 - DNA, 20 bp, Homo sapiens
aactttagacataatctctt

SEQ ID NO: 7574499 - DNA, 22 bp, Homo sapiens
aactttagaaaggaaggaagtg

SEQ ID NO: 7574500 - DNA, 20 bp, Homo sapiens
aactttagacataatctctt

SEQ ID NO: 7574501 - DNA, 22 bp, Homo sapiens
aactttatcggaacaggtactc

SEQ ID NO: 7574502 - DNA, 22 bp, Homo sapiens
aactttatcggaacaggtactc

SEQ ID NO: 7574503 - DNA, 22 bp, Homo sapiens
aactttatcggaacaggtactc

SEQ ID NO: 7574504 - DNA, 22 bp, Homo sapiens
aactttatcggaacaggtactc

SEQ ID NO: 7574505 - DNA, 22 bp, Homo sapiens
aactttattgttaggggctaaa

SEQ ID NO: 7574506 - DNA, 22 bp, Homo sapiens
aactttattgttaggggctaaa

SEQ ID NO: 7574507 - DNA, 21 bp, Homo sapiens
aactttagaaagactgggaag

SEQ ID NO: 7574508 - DNA, 22 bp, Homo sapiens
aatgttattacacttgtgaaat

SEQ ID NO: 7574509 - DNA, 22 bp, Homo sapiens
aatgttattacacttgtgaaat

SEQ ID NO: 7574510 - DNA, 22 bp, Homo sapiens
aatgttattacacttgtgaaat

SEQ ID NO: 7574511 - DNA, 22 bp, Homo sapiens
aatgttattacacttgtgaaat

SEQ ID NO: 7574512 - DNA, 22 bp, Homo sapiens
aatgttattacacttgtgaaat

SEQ ID NO: 7574513 - DNA, 22 bp, Homo sapiens
aatgttattacacttgtgaaat

SEQ ID NO: 7574514 - DNA, 22 bp, Homo sapiens
aactttctagagatgagttcgg

SEQ ID NO: 7574515 - DNA, 22 bp, Homo sapiens
aactttctaattttggctgagc

SEQ ID NO: 7574516 - DNA, 22 bp, Homo sapiens
aactttctagagatgagttcgg

SEQ ID NO: 7574517 - DNA, 22 bp, Homo sapiens
aactttctagagatgagttcgg

SEQ ID NO: 7574518 - DNA, 22 bp, Homo sapiens
aactttctataggttgggattt

SEQ ID NO: 7574519 - DNA, 22 bp, Homo sapiens
aactttctaaagtcaaattggt

SEQ ID NO: 7574520 - DNA, 22 bp, Homo sapiens
aactttctaaagtcaaattggt

SEQ ID NO: 7574521 - DNA, 22 bp, Homo sapiens
aactttccatcatttgaagccc

SEQ ID NO: 7574522 - DNA, 22 bp, Homo sapiens
aactttccatctttatcgtctt

SEQ ID NO: 7574523 - DNA, 22 bp, Homo sapiens
aactttcaggcaatgaatattt

SEQ ID NO: 7574524 - DNA, 22 bp, Homo sapiens
aactttccatcatttgaagccc

SEQ ID NO: 7574525 - DNA, 22 bp, Homo sapiens
aactttcagaatcctatgcatt

SEQ ID NO: 7574526 - DNA, 22 bp, Homo sapiens
aactttcagaatcctatgcatt

SEQ ID NO: 7574527 - DNA, 22 bp, Homo sapiens
aactttcagaatcctatgcatt

SEQ ID NO: 7574528 - DNA, 22 bp, Homo sapiens
aactttcagaatcctatgcatt

SEQ ID NO: 7574529 - DNA, 22 bp, Homo sapiens
aactttcaggcaatgaatattt

SEQ ID NO: 7574530 - DNA, 22 bp, Homo sapiens
aactttcaggcaatgaatattt

SEQ ID NO: 7574531 - DNA, 22 bp, Homo sapiens
aactttcagcaagtaattctgg

SEQ ID NO: 7574532 - DNA, 22 bp, Homo sapiens
aactttcagcaagtaattctgg

SEQ ID NO: 7574533 - DNA, 22 bp, Homo sapiens
aactttctctacggcatttgtt

SEQ ID NO: 7574534 - DNA, 22 bp, Homo sapiens
aactttctctacggcatttgtt

SEQ ID NO: 7574535 - DNA, 20 bp, Homo sapiens
aactttctcccattggactg

SEQ ID NO: 7574536 - DNA, 22 bp, Homo sapiens
aactttctctggatggcttcct

SEQ ID NO: 7574537 - DNA, 22 bp, Homo sapiens
aactttctctggatggcttcct

SEQ ID NO: 7574538 - DNA, 22 bp, Homo sapiens
aactttctccagtgccaactat

SEQ ID NO: 7574539 - DNA, 22 bp, Homo sapiens
aactttctataggttgggattt

SEQ ID NO: 7574540 - DNA, 22 bp, Homo sapiens
aactttctataggttgggattt

SEQ ID NO: 7574541 - DNA, 22 bp, Homo sapiens
aactttctccagtgccaactat

SEQ ID NO: 7574542 - DNA, 20 bp, Homo sapiens
aactttctcccattggactg

SEQ ID NO: 7574543 - DNA, 22 bp, Homo sapiens
aactttctgaaaagcttgatca

SEQ ID NO: 7574544 - DNA, 22 bp, Homo sapiens
aactttctgaaaagcttgatca

SEQ ID NO: 7574545 - DNA, 22 bp, Homo sapiens
aactttctgaaaagcttgatca

SEQ ID NO: 7574546 - DNA, 22 bp, Homo sapiens
aactttctgaaaagcttgatca

SEQ ID NO: 7574547 - DNA, 22 bp, Homo sapiens
aactttctgaaaagcttgatca

SEQ ID NO: 7574548 - DNA, 22 bp, Homo sapiens
aactttctgaaaagcttgatca

SEQ ID NO: 7574549 - DNA, 22 bp, Homo sapiens
aatgttttgtatgcctctgagc

SEQ ID NO: 7574550 - DNA, 22 bp, Homo sapiens
aatgttttgtatgcctctgagc

SEQ ID NO: 7574551 - DNA, 22 bp, Homo sapiens
aactttctggctttggggagag

SEQ ID NO: 7574552 - DNA, 22 bp, Homo sapiens
aactttctggctttggggagag

SEQ ID NO: 7574553 - DNA, 22 bp, Homo sapiens
aattagaaccagaagccatatt

SEQ ID NO: 7574554 - DNA, 22 bp, Homo sapiens
aattacttaagagaaactttga

SEQ ID NO: 7574555 - DNA, 22 bp, Homo sapiens
aattacttaagagaaactttga

SEQ ID NO: 7574556 - DNA, 22 bp, Homo sapiens
aattagaaccagaagccatatt

SEQ ID NO: 7574557 - DNA, 22 bp, Homo sapiens
aattagaagctgttagcaaaat

SEQ ID NO: 7574558 - DNA, 22 bp, Homo sapiens
aattagaaccagaagccatatt

SEQ ID NO: 7574559 - DNA, 22 bp, Homo sapiens
aattagaaccagaagccatatt

SEQ ID NO: 7574560 - DNA, 22 bp, Homo sapiens
aattactgtaattttctacagc

SEQ ID NO: 7574561 - DNA, 22 bp, Homo sapiens
aattactgtctcctgctggtgt

SEQ ID NO: 7574562 - DNA, 22 bp, Homo sapiens
aattactgtaattttctacagc

SEQ ID NO: 7574563 - DNA, 22 bp, Homo sapiens
aattactgggtctgagattaat

SEQ ID NO: 7574564 - DNA, 22 bp, Homo sapiens
aattactgtaattttctacagc

SEQ ID NO: 7574565 - DNA, 22 bp, Homo sapiens
aattactgtaattttctacagc

SEQ ID NO: 7574566 - DNA, 22 bp, Homo sapiens
aattactgtaattttctacagc

SEQ ID NO: 7574567 - DNA, 22 bp, Homo sapiens
aatgttttttggtctgatgaat

SEQ ID NO: 7574568 - DNA, 22 bp, Homo sapiens
aatgttttttggtctgatgaat

SEQ ID NO: 7574569 - DNA, 22 bp, Homo sapiens
aatgttttttggtctgatgaat

SEQ ID NO: 7574570 - DNA, 22 bp, Homo sapiens
aatgttttttggtctgatgaat

SEQ ID NO: 7574571 - DNA, 20 bp, Homo sapiens
aatgtattgttttgtttcag

SEQ ID NO: 7574572 - DNA, 20 bp, Homo sapiens
aatgtattgttttgtttcag

SEQ ID NO: 7574573 - DNA, 22 bp, Homo sapiens
aatgtattcttcaaccttgcta

SEQ ID NO: 7574574 - DNA, 22 bp, Homo sapiens
aatgtatttgatgtattagcct

SEQ ID NO: 7574575 - DNA, 22 bp, Homo sapiens
aatgtatttgatgtattagcct

SEQ ID NO: 7574576 - DNA, 22 bp, Homo sapiens
aatgtatttgatgtattagcct

SEQ ID NO: 7574577 - DNA, 22 bp, Homo sapiens
aatgtatttgatgtattagcct

SEQ ID NO: 7574578 - DNA, 22 bp, Homo sapiens
aatgtattttgggagtttcttt

SEQ ID NO: 7574579 - DNA, 22 bp, Homo sapiens
aatgtattttgggagtttcttt

SEQ ID NO: 7574580 - DNA, 22 bp, Homo sapiens
aatgtcaaaataattgatttgt

SEQ ID NO: 7574581 - DNA, 22 bp, Homo sapiens
aatgtcaaaataattgatttgt

SEQ ID NO: 7574582 - DNA, 22 bp, Homo sapiens
aatgtcaaaatggaatgagact

SEQ ID NO: 7574583 - DNA, 22 bp, Homo sapiens
aatgtcaaaatggaatgagact

SEQ ID NO: 7574584 - DNA, 22 bp, Homo sapiens
aatgtcaaaggctatacattca

SEQ ID NO: 7574585 - DNA, 22 bp, Homo sapiens
aatgtcaaaggctatacattca

SEQ ID NO: 7574586 - DNA, 22 bp, Homo sapiens
aatgtcaaaggctatacattca

SEQ ID NO: 7574587 - DNA, 22 bp, Homo sapiens
aatgtcaaaggctatacattca

SEQ ID NO: 7574588 - DNA, 22 bp, Homo sapiens
aatgtcaaaggctatacattca

SEQ ID NO: 7574589 - DNA, 22 bp, Homo sapiens
aatgtcaaaggctatacattca

SEQ ID NO: 7574590 - DNA, 22 bp, Homo sapiens
aatgtcaaaggctatacattca

SEQ ID NO: 7574591 - DNA, 22 bp, Homo sapiens
aatgtcaaaggctatacattca

SEQ ID NO: 7574592 - DNA, 22 bp, Homo sapiens
aatgtcaaaatggaatgagact

SEQ ID NO: 7574593 - DNA, 22 bp, Homo sapiens
aatgtcaaaatggaatgagact

SEQ ID NO: 7574594 - DNA, 22 bp, Homo sapiens
aatgtcaaaatggaatgagact

SEQ ID NO: 7574595 - DNA, 22 bp, Homo sapiens
aatgtcaaacagagcagagcta

SEQ ID NO: 7574596 - DNA, 22 bp, Homo sapiens
aatgtcaaacagagcagagcta

SEQ ID NO: 7574597 - DNA, 22 bp, Homo sapiens
aatgtcaacacaagagaaatgc

SEQ ID NO: 7574598 - DNA, 22 bp, Homo sapiens
aatgtcaacacaagagaaatgc

SEQ ID NO: 7574599 - DNA, 22 bp, Homo sapiens
aatgtcaacacaagagaaatgc

SEQ ID NO: 7574600 - DNA, 22 bp, Homo sapiens
aatgtcaaatgagaggggagaa

SEQ ID NO: 7574601 - DNA, 22 bp, Homo sapiens
aatgtcaaagtgctttgcaaac

SEQ ID NO: 7574602 - DNA, 22 bp, Homo sapiens
aatgtcaaaggctatacattca

SEQ ID NO: 7574603 - DNA, 22 bp, Homo sapiens
aatgtcaaagtgctttgcaaac

SEQ ID NO: 7574604 - DNA, 22 bp, Homo sapiens
aatgtcttcttcagctgaataa

SEQ ID NO: 7574605 - DNA, 22 bp, Homo sapiens
aatgtcaatctcagagaacaca

SEQ ID NO: 7574606 - DNA, 22 bp, Homo sapiens
aatgtcaatctcagagaacaca

SEQ ID NO: 7574607 - DNA, 22 bp, Homo sapiens
aatgtcaatctcagagaacaca

SEQ ID NO: 7574608 - DNA, 22 bp, Homo sapiens
aatgtcttgagaagagaaatct

SEQ ID NO: 7574609 - DNA, 22 bp, Homo sapiens
aatgtcttctcttgttgaattt

SEQ ID NO: 7574610 - DNA, 20 bp, Homo sapiens
aatgtcttgagacatttcag

SEQ ID NO: 7574611 - DNA, 20 bp, Homo sapiens
aatgtcttgagacatttcag

SEQ ID NO: 7574612 - DNA, 20 bp, Homo sapiens
aatgtcttgagacatttcag

SEQ ID NO: 7574613 - DNA, 22 bp, Homo sapiens
aatgtcttgagaagagaaatct

SEQ ID NO: 7574614 - DNA, 22 bp, Homo sapiens
aatgtcaagtagccaatgcttc

SEQ ID NO: 7574615 - DNA, 22 bp, Homo sapiens
aatgtcaataactttatccctc

SEQ ID NO: 7574616 - DNA, 22 bp, Homo sapiens
aatgtcaataactttatccctc

SEQ ID NO: 7574617 - DNA, 22 bp, Homo sapiens
aatgtcaataactttatccctc

SEQ ID NO: 7574618 - DNA, 22 bp, Homo sapiens
aatgtcaacacttggtatgtca

SEQ ID NO: 7574619 - DNA, 22 bp, Homo sapiens
aatgtcaacacttggtatgtca

SEQ ID NO: 7574620 - DNA, 22 bp, Homo sapiens
aatgtcaagggaagcaggaaat

SEQ ID NO: 7574621 - DNA, 22 bp, Homo sapiens
aatgtcaagggaagcaggaaat

SEQ ID NO: 7574622 - DNA, 22 bp, Homo sapiens
aatgtctttctcataacagata

SEQ ID NO: 7574623 - DNA, 22 bp, Homo sapiens
aatgtctttctcataacagata

SEQ ID NO: 7574624 - DNA, 22 bp, Homo sapiens
aatgtctttctcataacagata

SEQ ID NO: 7574625 - DNA, 22 bp, Homo sapiens
aatgtctttatttcaggtttac

SEQ ID NO: 7574626 - DNA, 22 bp, Homo sapiens
aatgtctttacttttgtgggca

SEQ ID NO: 7574627 - DNA, 22 bp, Homo sapiens
aatgtctttctcataacagata

SEQ ID NO: 7574628 - DNA, 22 bp, Homo sapiens
aatgtctttctgttctatgaga

SEQ ID NO: 7574629 - DNA, 22 bp, Homo sapiens
aatgtctttctgttctatgaga

SEQ ID NO: 7574630 - DNA, 22 bp, Homo sapiens
aatgtctttctcataacagata

SEQ ID NO: 7574631 - DNA, 22 bp, Homo sapiens
aatgtctttacttttgtgggca

SEQ ID NO: 7574632 - DNA, 22 bp, Homo sapiens
aatgtctttaaagtgcaataga

SEQ ID NO: 7574633 - DNA, 22 bp, Homo sapiens
aatgtctttaaagtgcaataga

SEQ ID NO: 7574634 - DNA, 22 bp, Homo sapiens
aatgtctttaaagtgcaataga

SEQ ID NO: 7574635 - DNA, 22 bp, Homo sapiens
aatgtctttaaagtgcaataga

SEQ ID NO: 7574636 - DNA, 22 bp, Homo sapiens
aatgtcttggatacagaggttg

SEQ ID NO: 7574637 - DNA, 22 bp, Homo sapiens
aatgtcttggatacagaggttg

SEQ ID NO: 7574638 - DNA, 22 bp, Homo sapiens
aatgtctttaaagtgcaataga

SEQ ID NO: 7574639 - DNA, 22 bp, Homo sapiens
aactctctctggctcccagcaa

SEQ ID NO: 7574640 - DNA, 22 bp, Homo sapiens
aactctcttgggagtacctgga

SEQ ID NO: 7574641 - DNA, 22 bp, Homo sapiens
aactctcttgggagtacctgga

SEQ ID NO: 7574642 - DNA, 22 bp, Homo sapiens
aactctcagaacttttggtggg

SEQ ID NO: 7574643 - DNA, 22 bp, Homo sapiens
aactctatttaccctactaaac

SEQ ID NO: 7574644 - DNA, 22 bp, Homo sapiens
aactctggctgcttcccaggtc

SEQ ID NO: 7574645 - DNA, 22 bp, Homo sapiens
aactctggttcagtgatttcag

SEQ ID NO: 7574646 - DNA, 22 bp, Homo sapiens
aactctggaagggtgaggctgt

SEQ ID NO: 7574647 - DNA, 22 bp, Homo sapiens
aactctacttgggactcctctg

SEQ ID NO: 7574648 - DNA, 22 bp, Homo sapiens
aactctagggaggcaggaagca

SEQ ID NO: 7574649 - DNA, 22 bp, Homo sapiens
aactctagggaggcaggaagca

SEQ ID NO: 7574650 - DNA, 22 bp, Homo sapiens
aactctatttaccctactaaac

SEQ ID NO: 7574651 - DNA, 22 bp, Homo sapiens
aactctatttaccctactaaac

SEQ ID NO: 7574652 - DNA, 22 bp, Homo sapiens
aactctatttaccctactaaac

SEQ ID NO: 7574653 - DNA, 22 bp, Homo sapiens
aactctatttaccctactaaac

SEQ ID NO: 7574654 - DNA, 20 bp, Homo sapiens
aactcctagcctcaagtgat

SEQ ID NO: 7574655 - DNA, 22 bp, Homo sapiens
aactcctatgacccactgaact

SEQ ID NO: 7574656 - DNA, 20 bp, Homo sapiens
aactcctagcctcaagtgat

SEQ ID NO: 7574657 - DNA, 22 bp, Homo sapiens
aactcctctctggtggttcgtc

SEQ ID NO: 7574658 - DNA, 23 bp, Homo sapiens
aactcctgaatcgtgagccatct

SEQ ID NO: 7574659 - DNA, 22 bp, Homo sapiens
aactcctctctggtggttcgtc

SEQ ID NO: 7574660 - DNA, 22 bp, Homo sapiens
aatgtattctgggaaaatgtta

SEQ ID NO: 7574661 - DNA, 22 bp, Homo sapiens
aatgtattcttcaaccttgcta

SEQ ID NO: 7574662 - DNA, 22 bp, Homo sapiens
aatgtacaccgtgggtttttta

SEQ ID NO: 7574663 - DNA, 22 bp, Homo sapiens
aatgtattctgggaaaatgtta

SEQ ID NO: 7574664 - DNA, 22 bp, Homo sapiens
aatgtattctgggaaaatgtta

SEQ ID NO: 7574665 - DNA, 22 bp, Homo sapiens
aatgtattctgggaaaatgtta

SEQ ID NO: 7574666 - DNA, 22 bp, Homo sapiens
aatgtattctgggaaaatgtta

SEQ ID NO: 7574667 - DNA, 22 bp, Homo sapiens
aatgtattctgggaaaatgtta

SEQ ID NO: 7574668 - DNA, 22 bp, Homo sapiens
aatgtattctgggaaaatgtta

SEQ ID NO: 7574669 - DNA, 22 bp, Homo sapiens
aactgaaacggtgatcttttaa

SEQ ID NO: 7574670 - DNA, 22 bp, Homo sapiens
aactgaaacggtgatcttttaa

SEQ ID NO: 7574671 - DNA, 22 bp, Homo sapiens
aatgtacaataagacaaagagg

SEQ ID NO: 7574672 - DNA, 22 bp, Homo sapiens
aatgtacaataagacaaagagg

SEQ ID NO: 7574673 - DNA, 22 bp, Homo sapiens
aatgtacaataagacaaagagg

SEQ ID NO: 7574674 - DNA, 22 bp, Homo sapiens
aatgtacaataagacaaagagg

SEQ ID NO: 7574675 - DNA, 22 bp, Homo sapiens
aatgtattctgggaaaatgtta

SEQ ID NO: 7574676 - DNA, 22 bp, Homo sapiens
aatgtacaccgtgggtttttta

SEQ ID NO: 7574677 - DNA, 22 bp, Homo sapiens
aatgtattctctttataagata

SEQ ID NO: 7574678 - DNA, 22 bp, Homo sapiens
aatgtattctctttataagata

SEQ ID NO: 7574679 - DNA, 22 bp, Homo sapiens
aactctttgaacagtgaggcta

SEQ ID NO: 7574680 - DNA, 22 bp, Homo sapiens
aactctttctgaggattgggag

SEQ ID NO: 7574681 - DNA, 22 bp, Homo sapiens
aactctttctgaggattgggag

SEQ ID NO: 7574682 - DNA, 22 bp, Homo sapiens
aactctttggtctcaggaaagg

SEQ ID NO: 7574683 - DNA, 22 bp, Homo sapiens
aactctttggtctcaggaaagg

SEQ ID NO: 7574684 - DNA, 22 bp, Homo sapiens
aactctttttttaagtgtagcc

SEQ ID NO: 7574685 - DNA, 22 bp, Homo sapiens
aactgaaaccaaacactttagg

SEQ ID NO: 7574686 - DNA, 22 bp, Homo sapiens
aactgaaaccaaacactttagg

SEQ ID NO: 7574687 - DNA, 22 bp, Homo sapiens
aactctttgtggacattaaatt

SEQ ID NO: 7574688 - DNA, 22 bp, Homo sapiens
aactcttaattttcatgaaatg

SEQ ID NO: 7574689 - DNA, 22 bp, Homo sapiens
aactcttaattttcatgaaatg

SEQ ID NO: 7574690 - DNA, 22 bp, Homo sapiens
aactctgtgtaggaaccaggtc

SEQ ID NO: 7574691 - DNA, 22 bp, Homo sapiens
aactcttaaaattttggcttgc

SEQ ID NO: 7574692 - DNA, 22 bp, Homo sapiens
aactcttgaattcccttgaaga

SEQ ID NO: 7574693 - DNA, 22 bp, Homo sapiens
aactcttcttataatgcgtgat

SEQ ID NO: 7574694 - DNA, 22 bp, Homo sapiens
aactcttcttataatgcgtgat

SEQ ID NO: 7574695 - DNA, 22 bp, Homo sapiens
aactctttcatctgtggcctgg

SEQ ID NO: 7574696 - DNA, 22 bp, Homo sapiens
aactctttacatgtttgattca

SEQ ID NO: 7574697 - DNA, 22 bp, Homo sapiens
aactctttccctttggtgccac

SEQ ID NO: 7574698 - DNA, 22 bp, Homo sapiens
acagagtcataagcggagctcg

SEQ ID NO: 7574699 - DNA, 22 bp, Homo sapiens
aagcacatttggaaaacatgga

SEQ ID NO: 7574700 - DNA, 22 bp, Homo sapiens
aagcacatttggaaaacatgga

SEQ ID NO: 7574701 - DNA, 22 bp, Homo sapiens
aagcacatttggaaaacatgga

SEQ ID NO: 7574702 - DNA, 22 bp, Homo sapiens
aagcacatttggaaaacatgga

SEQ ID NO: 7574703 - DNA, 20 bp, Homo sapiens
aagcacatttctacaataat

SEQ ID NO: 7574704 - DNA, 20 bp, Homo sapiens
aagcacatttctacaataat

SEQ ID NO: 7574705 - DNA, 22 bp, Homo sapiens
aagcacattgtacatttgtgct

SEQ ID NO: 7574706 - DNA, 20 bp, Homo sapiens
aagcacatttctacaataat

SEQ ID NO: 7574707 - DNA, 20 bp, Homo sapiens
aagcacatttctacaataat

SEQ ID NO: 7574708 - DNA, 20 bp, Homo sapiens
aagcacatttctacaataat

SEQ ID NO: 7574709 - DNA, 20 bp, Homo sapiens
aagcacatttctacaataat

SEQ ID NO: 7574710 - DNA, 22 bp, Homo sapiens
aagcacattatagctatctagg

SEQ ID NO: 7574711 - DNA, 22 bp, Homo sapiens
aagcacattatagctatctagg

SEQ ID NO: 7574712 - DNA, 22 bp, Homo sapiens
aagcacattatagctatctagg

SEQ ID NO: 7574713 - DNA, 22 bp, Homo sapiens
aagcacattgcctggcacatag

SEQ ID NO: 7574714 - DNA, 22 bp, Homo sapiens
aagcacattgcctggcacatag

SEQ ID NO: 7574715 - DNA, 22 bp, Homo sapiens
aagcacattgcctggcacatag

SEQ ID NO: 7574716 - DNA, 20 bp, Homo sapiens
aagcacatttctacaataat

SEQ ID NO: 7574717 - DNA, 22 bp, Homo sapiens
aagcacattgtacatttgtgct

SEQ ID NO: 7574718 - DNA, 22 bp, Homo sapiens
aagcacattgtacatttgtgct

SEQ ID NO: 7574719 - DNA, 22 bp, Homo sapiens
aagcacattaaggaacattgaa

SEQ ID NO: 7574720 - DNA, 22 bp, Homo sapiens
aagcacattaaggaacattgaa

SEQ ID NO: 7574721 - DNA, 22 bp, Homo sapiens
aagcacattaaggaacattgaa

SEQ ID NO: 7574722 - DNA, 22 bp, Homo sapiens
aagcacattaaggaacattgaa

SEQ ID NO: 7574723 - DNA, 22 bp, Homo sapiens
aagcacattaaggaacattgaa

SEQ ID NO: 7574724 - DNA, 22 bp, Homo sapiens
aagcacatgaaaatgtgaagct

SEQ ID NO: 7574725 - DNA, 22 bp, Homo sapiens
aagcacatgaaaatgtgaagct

SEQ ID NO: 7574726 - DNA, 22 bp, Homo sapiens
aagcacatgagctattcatgct

SEQ ID NO: 7574727 - DNA, 22 bp, Homo sapiens
aagcacatgagctattcatgct

SEQ ID NO: 7574728 - DNA, 22 bp, Homo sapiens
aagcacatgagctattcatgct

SEQ ID NO: 7574729 - DNA, 22 bp, Homo sapiens
aagcacatgaaaatgtgaagct

SEQ ID NO: 7574730 - DNA, 22 bp, Homo sapiens
aagcacatgagctattcatgct

SEQ ID NO: 7574731 - DNA, 22 bp, Homo sapiens
aagcacatcatgttgttcagac

SEQ ID NO: 7574732 - DNA, 22 bp, Homo sapiens
aagcacatctcctgtgcagaac

SEQ ID NO: 7574733 - DNA, 22 bp, Homo sapiens
aagcacatctcctgtgcagaac

SEQ ID NO: 7574734 - DNA, 22 bp, Homo sapiens
aagcacatgaaaatgtgaagct

SEQ ID NO: 7574735 - DNA, 22 bp, Homo sapiens
aagcacatctcctgtgcagaac

SEQ ID NO: 7574736 - DNA, 22 bp, Homo sapiens
aagcacatctcctgtgcagaac

SEQ ID NO: 7574737 - DNA, 22 bp, Homo sapiens
aagcacatctcaaacttcatct

SEQ ID NO: 7574738 - DNA, 22 bp, Homo sapiens
aagcacatctcaaacttcatct

SEQ ID NO: 7574739 - DNA, 22 bp, Homo sapiens
aagcacatcatgttgttcagac

SEQ ID NO: 7574740 - DNA, 22 bp, Homo sapiens
acagagtcatggtagtcaaagg

SEQ ID NO: 7574741 - DNA, 22 bp, Homo sapiens
acagagtcattcactgatgaag

SEQ ID NO: 7574742 - DNA, 22 bp, Homo sapiens
acagagtcattcactgatgaag

SEQ ID NO: 7574743 - DNA, 22 bp, Homo sapiens
acagagtcattcactgatgaag

SEQ ID NO: 7574744 - DNA, 22 bp, Homo sapiens
aagcacatttggaaaacatgga

SEQ ID NO: 7574745 - DNA, 22 bp, Homo sapiens
acagagtcatggtagtcaaagg

SEQ ID NO: 7574746 - DNA, 22 bp, Homo sapiens
acagagtcatggtagtcaaagg

SEQ ID NO: 7574747 - DNA, 23 bp, Homo sapiens
acagatcatctcgaaacaactat

SEQ ID NO: 7574748 - DNA, 22 bp, Homo sapiens
acagatgaaaaagcttgtggat

SEQ ID NO: 7574749 - DNA, 22 bp, Homo sapiens
acagatgaaacccagctagttg

SEQ ID NO: 7574750 - DNA, 22 bp, Homo sapiens
acagatctacattgtctgaccc

SEQ ID NO: 7574751 - DNA, 23 bp, Homo sapiens
acagatcatctcgaaacaactat

SEQ ID NO: 7574752 - DNA, 22 bp, Homo sapiens
acagatcctggttacagccatt

SEQ ID NO: 7574753 - DNA, 22 bp, Homo sapiens
acagatgaatttatggatggaa

SEQ ID NO: 7574754 - DNA, 22 bp, Homo sapiens
acagatgaatttatggatggaa

SEQ ID NO: 7574755 - DNA, 22 bp, Homo sapiens
acagatgaatttatggatggaa

SEQ ID NO: 7574756 - DNA, 23 bp, Homo sapiens
acagatgaaagtgtggctcagag

SEQ ID NO: 7574757 - DNA, 23 bp, Homo sapiens
acagatgaaagtgtggctcagag

SEQ ID NO: 7574758 - DNA, 23 bp, Homo sapiens
acagatgaaagtgtggctcagag

SEQ ID NO: 7574759 - DNA, 22 bp, Homo sapiens
acagatgaaacccagctagttg

SEQ ID NO: 7574760 - DNA, 22 bp, Homo sapiens
acagatgaaacccagctagttg

SEQ ID NO: 7574761 - DNA, 22 bp, Homo sapiens
acagatgagactccaggacctt

SEQ ID NO: 7574762 - DNA, 22 bp, Homo sapiens
acagatgagactccaggacctt

SEQ ID NO: 7574763 - DNA, 22 bp, Homo sapiens
acagatgagaaggctgaccagt

SEQ ID NO: 7574764 - DNA, 22 bp, Homo sapiens
acagatgagaaggctgaccagt

SEQ ID NO: 7574765 - DNA, 22 bp, Homo sapiens
acagatgagaaggctgaccagt

SEQ ID NO: 7574766 - DNA, 22 bp, Homo sapiens
acagatgagactccaggacctt

SEQ ID NO: 7574767 - DNA, 22 bp, Homo sapiens
acagatgagaagctgcattcaa

SEQ ID NO: 7574768 - DNA, 22 bp, Homo sapiens
acagatgaattttaattgtgtt

SEQ ID NO: 7574769 - DNA, 22 bp, Homo sapiens
aagcaaacaggagaagagctgt

SEQ ID NO: 7574770 - DNA, 22 bp, Homo sapiens
aagcaaacaggagaagagctgt

SEQ ID NO: 7574771 - DNA, 22 bp, Homo sapiens
aagcaaacaggagaagagctgt

SEQ ID NO: 7574772 - DNA, 22 bp, Homo sapiens
aagcaaacaggagaagagctgt

SEQ ID NO: 7574773 - DNA, 22 bp, Homo sapiens
aagcaaacaggagaagagctgt

SEQ ID NO: 7574774 - DNA, 22 bp, Homo sapiens
aagcaaaaggttacacttctgg

SEQ ID NO: 7574775 - DNA, 22 bp, Homo sapiens
aagcaaaaggttacacttctgg

SEQ ID NO: 7574776 - DNA, 22 bp, Homo sapiens
aagcaaagacagtttgagtgga

SEQ ID NO: 7574777 - DNA, 22 bp, Homo sapiens
aagcaaagacagtttgagtgga

SEQ ID NO: 7574778 - DNA, 22 bp, Homo sapiens
aagcaaagacagtttgagtgga

SEQ ID NO: 7574779 - DNA, 22 bp, Homo sapiens
acagagcacatagattggagtt

SEQ ID NO: 7574780 - DNA, 17 bp, Homo sapiens
acagagcacatcaagat

SEQ ID NO: 7574781 - DNA, 17 bp, Homo sapiens
acagagcacatcaagat

SEQ ID NO: 7574782 - DNA, 17 bp, Homo sapiens
acagagcacatcaagat

SEQ ID NO: 7574783 - DNA, 17 bp, Homo sapiens
acagagcacatcaagat

SEQ ID NO: 7574784 - DNA, 17 bp, Homo sapiens
acagagcacatcaagat

SEQ ID NO: 7574785 - DNA, 22 bp, Homo sapiens
acagagctgtacatgtgccatg

SEQ ID NO: 7574786 - DNA, 17 bp, Homo sapiens
acagagcacatcaagat

SEQ ID NO: 7574787 - DNA, 22 bp, Homo sapiens
acagagcacatagattggagtt

SEQ ID NO: 7574788 - DNA, 22 bp, Homo sapiens
acagagcacatagattggagtt

SEQ ID NO: 7574789 - DNA, 22 bp, Homo sapiens
acagagcacatagattggagtt

SEQ ID NO: 7574790 - DNA, 22 bp, Homo sapiens
acagaggaagcatatagcacaa

SEQ ID NO: 7574791 - DNA, 22 bp, Homo sapiens
acagaggaagcatatagcacaa

SEQ ID NO: 7574792 - DNA, 22 bp, Homo sapiens
acagagcttcccagcctgagca

SEQ ID NO: 7574793 - DNA, 22 bp, Homo sapiens
acagagcttcccagcctgagca

SEQ ID NO: 7574794 - DNA, 22 bp, Homo sapiens
acagaggaagcatatagcacaa

SEQ ID NO: 7574795 - DNA, 22 bp, Homo sapiens
acagaggaagcatatagcacaa

SEQ ID NO: 7574796 - DNA, 22 bp, Homo sapiens
acagagcttaggatgactccca

SEQ ID NO: 7574797 - DNA, 22 bp, Homo sapiens
acagagcttaggatgactccca

SEQ ID NO: 7574798 - DNA, 22 bp, Homo sapiens
acagagcttaggatgactccca

SEQ ID NO: 7574799 - DNA, 22 bp, Homo sapiens
acagagcttcccagcctgagca

SEQ ID NO: 7574800 - DNA, 22 bp, Homo sapiens
acagagcttaggatgactccca

SEQ ID NO: 7574801 - DNA, 22 bp, Homo sapiens
acagagcttaattcaggagctt

SEQ ID NO: 7574802 - DNA, 22 bp, Homo sapiens
acagagcttaattcaggagctt

SEQ ID NO: 7574803 - DNA, 22 bp, Homo sapiens
acagagctgtactacttactga

SEQ ID NO: 7574804 - DNA, 22 bp, Homo sapiens
acagagcttaattcaggagctt

SEQ ID NO: 7574805 - DNA, 22 bp, Homo sapiens
acagagcttaattcaggagctt

SEQ ID NO: 7574806 - DNA, 22 bp, Homo sapiens
acagagctgtactacttactga

SEQ ID NO: 7574807 - DNA, 22 bp, Homo sapiens
acagagctgtactacttactga

SEQ ID NO: 7574808 - DNA, 22 bp, Homo sapiens
acagaggaaggctgagctgccc

SEQ ID NO: 7574809 - DNA, 22 bp, Homo sapiens
acagaggaaggctgagctgccc

SEQ ID NO: 7574810 - DNA, 22 bp, Homo sapiens
acagaggaaggctgagctgccc

SEQ ID NO: 7574811 - DNA, 22 bp, Homo sapiens
acagaggaaggctgagctgccc

SEQ ID NO: 7574812 - DNA, 22 bp, Homo sapiens
acagaggaaggctgagctgccc

SEQ ID NO: 7574813 - DNA, 22 bp, Homo sapiens
acagaggaaggctgagctgccc

SEQ ID NO: 7574814 - DNA, 22 bp, Homo sapiens
acagaggaaggctgagctgccc

SEQ ID NO: 7574815 - DNA, 22 bp, Homo sapiens
acagaggaaggctgagctgccc

SEQ ID NO: 7574816 - DNA, 22 bp, Homo sapiens
acagaggaagcatatagcacaa

SEQ ID NO: 7574817 - DNA, 22 bp, Homo sapiens
acagaggaagcatatagcacaa

SEQ ID NO: 7574818 - DNA, 22 bp, Homo sapiens
acagaggaaggctgagctgccc

SEQ ID NO: 7574819 - DNA, 22 bp, Homo sapiens
acagaggaaggctgagctgccc

SEQ ID NO: 7574820 - DNA, 22 bp, Homo sapiens
acagaggacaactaggcgctca

SEQ ID NO: 7574821 - DNA, 22 bp, Homo sapiens
acagaggacaactaggcgctca

SEQ ID NO: 7574822 - DNA, 22 bp, Homo sapiens
acagaggacaactaggcgctca

SEQ ID NO: 7574823 - DNA, 22 bp, Homo sapiens
acagaggacaactaggcgctca

SEQ ID NO: 7574824 - DNA, 22 bp, Homo sapiens
acagaggacaactaggcgctca

SEQ ID NO: 7574825 - DNA, 22 bp, Homo sapiens
acagaggacaactaggcgctca

SEQ ID NO: 7574826 - DNA, 22 bp, Homo sapiens
acagaggacaactaggcgctca

SEQ ID NO: 7574827 - DNA, 22 bp, Homo sapiens
acagaggacaactaggcgctca

SEQ ID NO: 7574828 - DNA, 22 bp, Homo sapiens
acagaggacaactaggcgctca

SEQ ID NO: 7574829 - DNA, 18 bp, Homo sapiens
acagaggcagacatgtat

SEQ ID NO: 7574830 - DNA, 22 bp, Homo sapiens
acagaggacaactaggcgctca

SEQ ID NO: 7574831 - DNA, 18 bp, Homo sapiens
acagaggcagacatgtat

SEQ ID NO: 7574832 - DNA, 17 bp, Homo sapiens
acagaggcaggagtgga

SEQ ID NO: 7574833 - DNA, 17 bp, Homo sapiens
acagaggcaggagtgga

SEQ ID NO: 7574834 - DNA, 18 bp, Homo sapiens
acagaggcagacatgtat

SEQ ID NO: 7574835 - DNA, 18 bp, Homo sapiens
acagaggcagacatgtat

SEQ ID NO: 7574836 - DNA, 17 bp, Homo sapiens
acagaggcaggagtgga

SEQ ID NO: 7574837 - DNA, 22 bp, Homo sapiens
aagcacagttcttagagttaca

SEQ ID NO: 7574838 - DNA, 22 bp, Homo sapiens
aagcacagttcttagagttaca

SEQ ID NO: 7574839 - DNA, 22 bp, Homo sapiens
aagcacagttcttagagttaca

SEQ ID NO: 7574840 - DNA, 22 bp, Homo sapiens
aagcacatcatgttgttcagac

SEQ ID NO: 7574841 - DNA, 22 bp, Homo sapiens
aagcacatcatgttgttcagac

SEQ ID NO: 7574842 - DNA, 22 bp, Homo sapiens
aagcacatcatgttgttcagac

SEQ ID NO: 7574843 - DNA, 22 bp, Homo sapiens
aagcacatacataataaagtcc

SEQ ID NO: 7574844 - DNA, 22 bp, Homo sapiens
aagcacatacataataaagtcc

SEQ ID NO: 7574845 - DNA, 22 bp, Homo sapiens
aagcacatacataataaagtcc

SEQ ID NO: 7574846 - DNA, 22 bp, Homo sapiens
acagaagaaagggaggttttgc

SEQ ID NO: 7574847 - DNA, 22 bp, Homo sapiens
acagaagaaagggaggttttgc

SEQ ID NO: 7574848 - DNA, 22 bp, Homo sapiens
acagaagaagttcaaggtgaag

SEQ ID NO: 7574849 - DNA, 22 bp, Homo sapiens
acagaagaagttcaaggtgaag

SEQ ID NO: 7574850 - DNA, 22 bp, Homo sapiens
acagaagaagttcaaggtgaag

SEQ ID NO: 7574851 - DNA, 22 bp, Homo sapiens
acagaagaagttcaaggtgaag

SEQ ID NO: 7574852 - DNA, 22 bp, Homo sapiens
acagaagaagttcaaggtgaag

SEQ ID NO: 7574853 - DNA, 22 bp, Homo sapiens
acagaagaagttcaaggtgaag

SEQ ID NO: 7574854 - DNA, 22 bp, Homo sapiens
acagaagaagttcaaggtgaag

SEQ ID NO: 7574855 - DNA, 22 bp, Homo sapiens
acagaagaccaagaaagcttcc

SEQ ID NO: 7574856 - DNA, 22 bp, Homo sapiens
acagaagaccaagaaagcttcc

SEQ ID NO: 7574857 - DNA, 22 bp, Homo sapiens
acagaagaccaagaaagcttcc

SEQ ID NO: 7574858 - DNA, 22 bp, Homo sapiens
acagaagaccaagaaagcttcc

SEQ ID NO: 7574859 - DNA, 22 bp, Homo sapiens
acagaagacagagtgttcatct

SEQ ID NO: 7574860 - DNA, 22 bp, Homo sapiens
acagaagaccaagaaagcttcc

SEQ ID NO: 7574861 - DNA, 22 bp, Homo sapiens
acagaagaccaagaaagcttcc

SEQ ID NO: 7574862 - DNA, 22 bp, Homo sapiens
acagaagaccaagaaagcttcc

SEQ ID NO: 7574863 - DNA, 22 bp, Homo sapiens
acagaagacagagtgttcatct

SEQ ID NO: 7574864 - DNA, 22 bp, Homo sapiens
acagaagacagagtgttcatct

SEQ ID NO: 7574865 - DNA, 22 bp, Homo sapiens
acagaagacagagtgttcatct

SEQ ID NO: 7574866 - DNA, 22 bp, Homo sapiens
acagaagacagagtgttcatct

SEQ ID NO: 7574867 - DNA, 22 bp, Homo sapiens
acagaagacagagtgttcatct

SEQ ID NO: 7574868 - DNA, 19 bp, Homo sapiens
acagaaatgtaagtgagac

SEQ ID NO: 7574869 - DNA, 19 bp, Homo sapiens
acagaaatgtaagtgagac

SEQ ID NO: 7574870 - DNA, 19 bp, Homo sapiens
acagaaatgtaagtgagac

SEQ ID NO: 7574871 - DNA, 19 bp, Homo sapiens
acagaaatgtaagtgagac

SEQ ID NO: 7574872 - DNA, 19 bp, Homo sapiens
acagaaatgtaagtgagac

SEQ ID NO: 7574873 - DNA, 19 bp, Homo sapiens
acagaaatgtaagtgagac

SEQ ID NO: 7574874 - DNA, 19 bp, Homo sapiens
acagaaatgtaagtgagac

SEQ ID NO: 7574875 - DNA, 19 bp, Homo sapiens
acagaaatgtaagtgagac

SEQ ID NO: 7574876 - DNA, 22 bp, Homo sapiens
aagatatagataaaactatgca

SEQ ID NO: 7574877 - DNA, 22 bp, Homo sapiens
aagatatagataaaactatgca

SEQ ID NO: 7574878 - DNA, 22 bp, Homo sapiens
aagatatagataaaactatgca

SEQ ID NO: 7574879 - DNA, 22 bp, Homo sapiens
aagatatactattaagtaccat

SEQ ID NO: 7574880 - DNA, 22 bp, Homo sapiens
aagatatactattaagtaccat

SEQ ID NO: 7574881 - DNA, 22 bp, Homo sapiens
aagatatactattaagtaccat

SEQ ID NO: 7574882 - DNA, 22 bp, Homo sapiens
aagatatactattaagtaccat

SEQ ID NO: 7574883 - DNA, 22 bp, Homo sapiens
aagatatactattaagtaccat

SEQ ID NO: 7574884 - DNA, 20 bp, Homo sapiens
aagatagaatcctaactttg

SEQ ID NO: 7574885 - DNA, 20 bp, Homo sapiens
aagatagaatcctaactttg

SEQ ID NO: 7574886 - DNA, 22 bp, Homo sapiens
aagatactttgcatgcatgaag

SEQ ID NO: 7574887 - DNA, 22 bp, Homo sapiens
aagatactttgcatgcatgaag

SEQ ID NO: 7574888 - DNA, 22 bp, Homo sapiens
aagatactgatgatgtaggcta

SEQ ID NO: 7574889 - DNA, 22 bp, Homo sapiens
aagatacttcacttgccgaaat

SEQ ID NO: 7574890 - DNA, 22 bp, Homo sapiens
aagatagatgtcatcagcatat

SEQ ID NO: 7574891 - DNA, 22 bp, Homo sapiens
aagatagcttggaaaagtacag

SEQ ID NO: 7574892 - DNA, 22 bp, Homo sapiens
aagatactcagtggatatgcat

SEQ ID NO: 7574893 - DNA, 22 bp, Homo sapiens
aagatacattttcttcagagaa

SEQ ID NO: 7574894 - DNA, 20 bp, Homo sapiens
aagatactccagaaattaaa

SEQ ID NO: 7574895 - DNA, 20 bp, Homo sapiens
aagatactccagaaattaaa

SEQ ID NO: 7574896 - DNA, 22 bp, Homo sapiens
aagatactcagtggatatgcat

SEQ ID NO: 7574897 - DNA, 22 bp, Homo sapiens
aagatactgatgatgtaggcta

SEQ ID NO: 7574898 - DNA, 22 bp, Homo sapiens
aagatactgatgatgtaggcta

SEQ ID NO: 7574899 - DNA, 22 bp, Homo sapiens
aagatactgatgatgtaggcta

SEQ ID NO: 7574900 - DNA, 22 bp, Homo sapiens
aagatacatcaaagcaaattgg

SEQ ID NO: 7574901 - DNA, 22 bp, Homo sapiens
aagatacatcaaagcaaattgg

SEQ ID NO: 7574902 - DNA, 22 bp, Homo sapiens
aagatacatcattcaggagtga

SEQ ID NO: 7574903 - DNA, 22 bp, Homo sapiens
aagatacatcattcaggagtga

SEQ ID NO: 7574904 - DNA, 22 bp, Homo sapiens
aagatacatcattcaggagtga

SEQ ID NO: 7574905 - DNA, 22 bp, Homo sapiens
aagatacatgttaggagcaacc

SEQ ID NO: 7574906 - DNA, 22 bp, Homo sapiens
aagatacatcattcaggagtga

SEQ ID NO: 7574907 - DNA, 22 bp, Homo sapiens
aagatacattgtttttggtagt

SEQ ID NO: 7574908 - DNA, 22 bp, Homo sapiens
aagatacattgtttttggtagt

SEQ ID NO: 7574909 - DNA, 22 bp, Homo sapiens
aagatacattatgtctctctga

SEQ ID NO: 7574910 - DNA, 22 bp, Homo sapiens
aagatacattatgtctctctga

SEQ ID NO: 7574911 - DNA, 22 bp, Homo sapiens
aagatacattatgtctctctga

SEQ ID NO: 7574912 - DNA, 22 bp, Homo sapiens
aagatacatgttaggagcaacc

SEQ ID NO: 7574913 - DNA, 22 bp, Homo sapiens
aagatacattgtttttggtagt

SEQ ID NO: 7574914 - DNA, 22 bp, Homo sapiens
aagatacattttcttcagagaa

SEQ ID NO: 7574915 - DNA, 22 bp, Homo sapiens
aagatacattttcttcagagaa

SEQ ID NO: 7574916 - DNA, 22 bp, Homo sapiens
aagatacattttcttcagagaa

SEQ ID NO: 7574917 - DNA, 22 bp, Homo sapiens
aagattttcagtgcctaaaaca

SEQ ID NO: 7574918 - DNA, 22 bp, Homo sapiens
aagattttcagtgcctaaaaca

SEQ ID NO: 7574919 - DNA, 22 bp, Homo sapiens
aagattttcagtgcctaaaaca

SEQ ID NO: 7574920 - DNA, 22 bp, Homo sapiens
aagattttcagtgcctaaaaca

SEQ ID NO: 7574921 - DNA, 22 bp, Homo sapiens
aagattttcagtgcctaaaaca

SEQ ID NO: 7574922 - DNA, 22 bp, Homo sapiens
aagattttctcaactgtatttg

SEQ ID NO: 7574923 - DNA, 22 bp, Homo sapiens
aagattttctcaactgtatttg

SEQ ID NO: 7574924 - DNA, 22 bp, Homo sapiens
aagattttctcaactgtatttg

SEQ ID NO: 7574925 - DNA, 22 bp, Homo sapiens
aagattttctcaactgtatttg

SEQ ID NO: 7574926 - DNA, 22 bp, Homo sapiens
aagattttctcaactgtatttg

SEQ ID NO: 7574927 - DNA, 22 bp, Homo sapiens
acagaagcagcgcggctcttct

SEQ ID NO: 7574928 - DNA, 22 bp, Homo sapiens
aagattttctcaactgtatttg

SEQ ID NO: 7574929 - DNA, 22 bp, Homo sapiens
aagattttcagctaatggtgca

SEQ ID NO: 7574930 - DNA, 22 bp, Homo sapiens
aagattttcagctaatggtgca

SEQ ID NO: 7574931 - DNA, 22 bp, Homo sapiens
aagatttgtggatttaaggata

SEQ ID NO: 7574932 - DNA, 22 bp, Homo sapiens
aagattttcagctaatggtgca

SEQ ID NO: 7574933 - DNA, 22 bp, Homo sapiens
aagatttggtatcagaagacct

SEQ ID NO: 7574934 - DNA, 22 bp, Homo sapiens
aagatttgtggatttaaggata

SEQ ID NO: 7574935 - DNA, 19 bp, Homo sapiens
aagatttggtcattgataa

SEQ ID NO: 7574936 - DNA, 19 bp, Homo sapiens
aagatttggtcattgataa

SEQ ID NO: 7574937 - DNA, 22 bp, Homo sapiens
aagcaaaacgtgctctaggagg

SEQ ID NO: 7574938 - DNA, 22 bp, Homo sapiens
aagcaaaacgtgctctaggagg

SEQ ID NO: 7574939 - DNA, 22 bp, Homo sapiens
aagcaaaacgtgctctaggagg

SEQ ID NO: 7574940 - DNA, 22 bp, Homo sapiens
aagcaaaacgtgctctaggagg

SEQ ID NO: 7574941 - DNA, 22 bp, Homo sapiens
aagcaaaacgtgctctaggagg

SEQ ID NO: 7574942 - DNA, 22 bp, Homo sapiens
aagcaaaaggttacacttctgg

SEQ ID NO: 7574943 - DNA, 22 bp, Homo sapiens
aagcaaaaggttacacttctgg

SEQ ID NO: 7574944 - DNA, 22 bp, Homo sapiens
aagcaaaaggttacacttctgg

SEQ ID NO: 7574945 - DNA, 22 bp, Homo sapiens
aagcaaaaggttacacttctgg

SEQ ID NO: 7574946 - DNA, 22 bp, Homo sapiens
aagcaaaaggttacacttctgg

SEQ ID NO: 7574947 - DNA, 22 bp, Homo sapiens
aagatttttttccacagactca

SEQ ID NO: 7574948 - DNA, 22 bp, Homo sapiens
aagatttttttccacagactca

SEQ ID NO: 7574949 - DNA, 22 bp, Homo sapiens
aagatttttttccacagactca

SEQ ID NO: 7574950 - DNA, 22 bp, Homo sapiens
aagcaaaacgtgctctaggagg

SEQ ID NO: 7574951 - DNA, 22 bp, Homo sapiens
aagcaaaacgtgctctaggagg

SEQ ID NO: 7574952 - DNA, 22 bp, Homo sapiens
aagatttttttccacagactca

SEQ ID NO: 7574953 - DNA, 22 bp, Homo sapiens
aagatttttttccacagactca

SEQ ID NO: 7574954 - DNA, 22 bp, Homo sapiens
aagatttttttccacagactca

SEQ ID NO: 7574955 - DNA, 22 bp, Homo sapiens
aagattttctcaactgtatttg

SEQ ID NO: 7574956 - DNA, 22 bp, Homo sapiens
aagattttctcaactgtatttg

SEQ ID NO: 7574957 - DNA, 22 bp, Homo sapiens
acagaagataatgctgccttgg

SEQ ID NO: 7574958 - DNA, 22 bp, Homo sapiens
acagaagataatgctgccttgg

SEQ ID NO: 7574959 - DNA, 22 bp, Homo sapiens
acagaagcaaaagcaggatctt

SEQ ID NO: 7574960 - DNA, 22 bp, Homo sapiens
acagaagcaaaagcaggatctt

SEQ ID NO: 7574961 - DNA, 22 bp, Homo sapiens
acagaagcaaagactcaggcaa

SEQ ID NO: 7574962 - DNA, 22 bp, Homo sapiens
acagaagcagcgcggctcttct

SEQ ID NO: 7574963 - DNA, 22 bp, Homo sapiens
aagatttgactctgattagcat

SEQ ID NO: 7574964 - DNA, 22 bp, Homo sapiens
aagatttggtatcagaagacct

SEQ ID NO: 7574965 - DNA, 22 bp, Homo sapiens
acagaagcagccgtcacagata

SEQ ID NO: 7574966 - DNA, 22 bp, Homo sapiens
acagaagagcacatttagtatg

SEQ ID NO: 7574967 - DNA, 22 bp, Homo sapiens
acagaagaccagagagctaact

SEQ ID NO: 7574968 - DNA, 22 bp, Homo sapiens
acagaagaccagagagctaact

SEQ ID NO: 7574969 - DNA, 22 bp, Homo sapiens
acagaagaccaagaaagcttcc

SEQ ID NO: 7574970 - DNA, 22 bp, Homo sapiens
acagaagaccaagaaagcttcc

SEQ ID NO: 7574971 - DNA, 22 bp, Homo sapiens
acagaagaccagagagctaact

SEQ ID NO: 7574972 - DNA, 22 bp, Homo sapiens
acagaagaccagagagctaact

SEQ ID NO: 7574973 - DNA, 22 bp, Homo sapiens
acagaagagcacatttagtatg

SEQ ID NO: 7574974 - DNA, 22 bp, Homo sapiens
acagaagagctggctctgtgct

SEQ ID NO: 7574975 - DNA, 22 bp, Homo sapiens
acagaagagctggctctgtgct

SEQ ID NO: 7574976 - DNA, 22 bp, Homo sapiens
acagaagagctggctctgtgct

SEQ ID NO: 7574977 - DNA, 22 bp, Homo sapiens
acagaagataactgggaccaga

SEQ ID NO: 7574978 - DNA, 22 bp, Homo sapiens
acagaagataatgctgccttgg

SEQ ID NO: 7574979 - DNA, 22 bp, Homo sapiens
acagaagataatgctgccttgg

SEQ ID NO: 7574980 - DNA, 22 bp, Homo sapiens
acagaagataactgggaccaga

SEQ ID NO: 7574981 - DNA, 22 bp, Homo sapiens
acagaagagctggctctgtgct

SEQ ID NO: 7574982 - DNA, 22 bp, Homo sapiens
acagaagagctggctctgtgct

SEQ ID NO: 7574983 - DNA, 22 bp, Homo sapiens
acagaagataactgggaccaga

SEQ ID NO: 7574984 - DNA, 22 bp, Homo sapiens
acagaagataactgggaccaga

SEQ ID NO: 7574985 - DNA, 22 bp, Homo sapiens
acacctttgccccaagtcatag

SEQ ID NO: 7574986 - DNA, 22 bp, Homo sapiens
acacctttgtgaagtgatgatg

SEQ ID NO: 7574987 - DNA, 22 bp, Homo sapiens
acaccttttattcgccaggcac

SEQ ID NO: 7574988 - DNA, 22 bp, Homo sapiens
acacgcataaatacacagtcta

SEQ ID NO: 7574989 - DNA, 22 bp, Homo sapiens
acacgcataaatacacagtcta

SEQ ID NO: 7574990 - DNA, 22 bp, Homo sapiens
acacgcatagaaaattgcacta

SEQ ID NO: 7574991 - DNA, 22 bp, Homo sapiens
acacgcatgatgatgcacgtac

SEQ ID NO: 7574992 - DNA, 22 bp, Homo sapiens
acacgcatagaaaattgcacta

SEQ ID NO: 7574993 - DNA, 22 bp, Homo sapiens
acacctttcaggtccagacagt

SEQ ID NO: 7574994 - DNA, 22 bp, Homo sapiens
acaccttctgagaactgagcag

SEQ ID NO: 7574995 - DNA, 23 bp, Homo sapiens
acacctgtgctgtagtcactaca

SEQ ID NO: 7574996 - DNA, 23 bp, Homo sapiens
acacctgtgctgtagtcactaca

SEQ ID NO: 7574997 - DNA, 22 bp, Homo sapiens
acacccttgtccatagcagatg

SEQ ID NO: 7574998 - DNA, 22 bp, Homo sapiens
acacctgggtcagtgtgacagt

SEQ ID NO: 7574999 - DNA, 22 bp, Homo sapiens
acacctggtctttgcatgagca

SEQ ID NO: 7575000 - DNA, 22 bp, Homo sapiens
acacctggtctttgcatgagca

SEQ ID NO: 7575001 - DNA, 22 bp, Homo sapiens
aagagtttatgatataacatgt

SEQ ID NO: 7575002 - DNA, 22 bp, Homo sapiens
aagagtttatgatataacatgt

SEQ ID NO: 7575003 - DNA, 22 bp, Homo sapiens
aagagtttatgatataacatgt

SEQ ID NO: 7575004 - DNA, 22 bp, Homo sapiens
acacatttctcccagtctccat

SEQ ID NO: 7575005 - DNA, 22 bp, Homo sapiens
acacatttctaaatttttaccg

SEQ ID NO: 7575006 - DNA, 22 bp, Homo sapiens
acacatttctcccagtctccat

SEQ ID NO: 7575007 - DNA, 22 bp, Homo sapiens
acacatttctcccagtctccat

SEQ ID NO: 7575008 - DNA, 22 bp, Homo sapiens
acacatttctcccagtctccat

SEQ ID NO: 7575009 - DNA, 22 bp, Homo sapiens
acacatttctcccagtctccat

SEQ ID NO: 7575010 - DNA, 22 bp, Homo sapiens
aagagtttatgatataacatgt

SEQ ID NO: 7575011 - DNA, 23 bp, Homo sapiens
aagagtttagagtcttgcagagt

SEQ ID NO: 7575012 - DNA, 22 bp, Homo sapiens
acacatttctctttttgtaagt

SEQ ID NO: 7575013 - DNA, 22 bp, Homo sapiens
acacccaggctggcgtgcagtg

SEQ ID NO: 7575014 - DNA, 22 bp, Homo sapiens
acaccccaccagtaactgaggg

SEQ ID NO: 7575015 - DNA, 22 bp, Homo sapiens
acaccccaccagtaactgaggg

SEQ ID NO: 7575016 - DNA, 22 bp, Homo sapiens
acaccccaccagtaactgaggg

SEQ ID NO: 7575017 - DNA, 22 bp, Homo sapiens
acacatttctctttttgtaagt

SEQ ID NO: 7575018 - DNA, 22 bp, Homo sapiens
acacatttctctttttgtaagt

SEQ ID NO: 7575019 - DNA, 22 bp, Homo sapiens
acacatttctctttttgtaagt

SEQ ID NO: 7575020 - DNA, 22 bp, Homo sapiens
acacatttctctttttgtaagt

SEQ ID NO: 7575021 - DNA, 22 bp, Homo sapiens
acacatttctctttttgtaagt

SEQ ID NO: 7575022 - DNA, 22 bp, Homo sapiens
acacatttctctttttgtaagt

SEQ ID NO: 7575023 - DNA, 22 bp, Homo sapiens
acactaatcttttatttggttt

SEQ ID NO: 7575024 - DNA, 22 bp, Homo sapiens
acactaatgagaaaggaattaa

SEQ ID NO: 7575025 - DNA, 22 bp, Homo sapiens
acactaaggttggagtcacagt

SEQ ID NO: 7575026 - DNA, 23 bp, Homo sapiens
acactaaatgtgaaggagcaaag

SEQ ID NO: 7575027 - DNA, 22 bp, Homo sapiens
acactaaatgagtctacagtac

SEQ ID NO: 7575028 - DNA, 22 bp, Homo sapiens
acactaaatgagtctacagtac

SEQ ID NO: 7575029 - DNA, 22 bp, Homo sapiens
acacggcactttaggaaggggc

SEQ ID NO: 7575030 - DNA, 22 bp, Homo sapiens
acacggcactttaggaaggggc

SEQ ID NO: 7575031 - DNA, 22 bp, Homo sapiens
acacggcactttaggaaggggc

SEQ ID NO: 7575032 - DNA, 22 bp, Homo sapiens
acacggcactttaggaaggggc

SEQ ID NO: 7575033 - DNA, 22 bp, Homo sapiens
acacgcatgatgatgcacgtac

SEQ ID NO: 7575034 - DNA, 22 bp, Homo sapiens
acacggaaaaggagacagaggg

SEQ ID NO: 7575035 - DNA, 22 bp, Homo sapiens
acacggaaaaggagacagaggg

SEQ ID NO: 7575036 - DNA, 22 bp, Homo sapiens
acacggcactttaggaaggggc

SEQ ID NO: 7575037 - DNA, 22 bp, Homo sapiens
acacggcactttaggaaggggc

SEQ ID NO: 7575038 - DNA, 22 bp, Homo sapiens
acacggcactttaggaaggggc

SEQ ID NO: 7575039 - DNA, 22 bp, Homo sapiens
acactacagggccgggatggaa

SEQ ID NO: 7575040 - DNA, 22 bp, Homo sapiens
acactacagggccgggatggaa

SEQ ID NO: 7575041 - DNA, 22 bp, Homo sapiens
acactagagagcaggcattccc

SEQ ID NO: 7575042 - DNA, 22 bp, Homo sapiens
acactagatgccaatagcaccc

SEQ ID NO: 7575043 - DNA, 22 bp, Homo sapiens
acactagatgccaatagcaccc

SEQ ID NO: 7575044 - DNA, 22 bp, Homo sapiens
acactagatgccaatagcaccc

SEQ ID NO: 7575045 - DNA, 22 bp, Homo sapiens
acactacagggagaagactcac

SEQ ID NO: 7575046 - DNA, 22 bp, Homo sapiens
acactacagggagaagactcac

SEQ ID NO: 7575047 - DNA, 22 bp, Homo sapiens
acactacaatctcagaactata

SEQ ID NO: 7575048 - DNA, 22 bp, Homo sapiens
acactacaatctcagaactata

SEQ ID NO: 7575049 - DNA, 22 bp, Homo sapiens
acactacaatctcagaactata

SEQ ID NO: 7575050 - DNA, 22 bp, Homo sapiens
acactacaatctcagaactata

SEQ ID NO: 7575051 - DNA, 22 bp, Homo sapiens
acactacaatctcagaactata

SEQ ID NO: 7575052 - DNA, 22 bp, Homo sapiens
acactaatgagaaaggaattaa

SEQ ID NO: 7575053 - DNA, 22 bp, Homo sapiens
acactaattaagctgctttact

SEQ ID NO: 7575054 - DNA, 22 bp, Homo sapiens
acactaattaagctgctttact

SEQ ID NO: 7575055 - DNA, 22 bp, Homo sapiens
acactacaacagcagaggtgag

SEQ ID NO: 7575056 - DNA, 22 bp, Homo sapiens
aagagtaaatgtctaattagga

SEQ ID NO: 7575057 - DNA, 22 bp, Homo sapiens
aagagtaaattcaggactttaa

SEQ ID NO: 7575058 - DNA, 22 bp, Homo sapiens
aagagtaaattcaggactttaa

SEQ ID NO: 7575059 - DNA, 22 bp, Homo sapiens
aagagtatagctttaggattga

SEQ ID NO: 7575060 - DNA, 22 bp, Homo sapiens
aagagtatagctttaggattga

SEQ ID NO: 7575061 - DNA, 22 bp, Homo sapiens
aagagtacttgcagccagggcc

SEQ ID NO: 7575062 - DNA, 22 bp, Homo sapiens
aagagtatgcatgcatgtttgt

SEQ ID NO: 7575063 - DNA, 22 bp, Homo sapiens
aagagtatttggtatagaacac

SEQ ID NO: 7575064 - DNA, 22 bp, Homo sapiens
aagagtatttggtatagaacac

SEQ ID NO: 7575065 - DNA, 19 bp, Homo sapiens
aagagtcacaggcagccct

SEQ ID NO: 7575066 - DNA, 22 bp, Homo sapiens
aagagtatttggtatagaacac

SEQ ID NO: 7575067 - DNA, 19 bp, Homo sapiens
aagagtcacaggcagccct

SEQ ID NO: 7575068 - DNA, 22 bp, Homo sapiens
aagagtcactccataaatccca

SEQ ID NO: 7575069 - DNA, 22 bp, Homo sapiens
aagagtctattggaactagaca

SEQ ID NO: 7575070 - DNA, 22 bp, Homo sapiens
aagagtctattggaactagaca

SEQ ID NO: 7575071 - DNA, 22 bp, Homo sapiens
aagagtcatagagacattgatt

SEQ ID NO: 7575072 - DNA, 22 bp, Homo sapiens
aagagtcccaaaatgattctta

SEQ ID NO: 7575073 - DNA, 22 bp, Homo sapiens
aagagtcctgttacacatgagt

SEQ ID NO: 7575074 - DNA, 22 bp, Homo sapiens
aagagtcagcttctgtatgggt

SEQ ID NO: 7575075 - DNA, 22 bp, Homo sapiens
aagagtcagcttctgtatgggt

SEQ ID NO: 7575076 - DNA, 22 bp, Homo sapiens
aagagtcatagagacattgatt

SEQ ID NO: 7575077 - DNA, 22 bp, Homo sapiens
aagagtcatagagacattgatt

SEQ ID NO: 7575078 - DNA, 22 bp, Homo sapiens
aagagtcatagagacattgatt

SEQ ID NO: 7575079 - DNA, 22 bp, Homo sapiens
aagagtcatagagacattgatt

SEQ ID NO: 7575080 - DNA, 22 bp, Homo sapiens
aagagtaaagcaaagcacttgt

SEQ ID NO: 7575081 - DNA, 22 bp, Homo sapiens
aagagtaaagcaaagcacttgt

SEQ ID NO: 7575082 - DNA, 22 bp, Homo sapiens
aagagtaaatgtctaattagga

SEQ ID NO: 7575083 - DNA, 22 bp, Homo sapiens
aagagtaaagcaaagcacttgt

SEQ ID NO: 7575084 - DNA, 22 bp, Homo sapiens
aagaggtttcatgattttctta

SEQ ID NO: 7575085 - DNA, 22 bp, Homo sapiens
aagagtaaagcaaagcacttgt

SEQ ID NO: 7575086 - DNA, 22 bp, Homo sapiens
aagaggtttaactgactcacag

SEQ ID NO: 7575087 - DNA, 22 bp, Homo sapiens
aagaggtttaactgactcacag

SEQ ID NO: 7575088 - DNA, 22 bp, Homo sapiens
aagaggttgtctgtgatgagtt

SEQ ID NO: 7575089 - DNA, 22 bp, Homo sapiens
aagaggtttcatgattttctta

SEQ ID NO: 7575090 - DNA, 22 bp, Homo sapiens
aagaggttgtctgtgatgagtt

SEQ ID NO: 7575091 - DNA, 22 bp, Homo sapiens
aagaggttgtctgtgatgagtt

SEQ ID NO: 7575092 - DNA, 22 bp, Homo sapiens
aagaggttgtacctaaagtgtt

SEQ ID NO: 7575093 - DNA, 22 bp, Homo sapiens
aagaggttgtctgtgatgagtt

SEQ ID NO: 7575094 - DNA, 22 bp, Homo sapiens
aagaggttctaatttaactatc

SEQ ID NO: 7575095 - DNA, 22 bp, Homo sapiens
aagaggttgtctgtgatgagtt

SEQ ID NO: 7575096 - DNA, 22 bp, Homo sapiens
aagaggttgtctgtgatgagtt

SEQ ID NO: 7575097 - DNA, 22 bp, Homo sapiens
aagaggttgtctgtgatgagtt

SEQ ID NO: 7575098 - DNA, 22 bp, Homo sapiens
aagaggttgtctgtgatgagtt

SEQ ID NO: 7575099 - DNA, 22 bp, Homo sapiens
aagaggttgtctgtgatgagtt

SEQ ID NO: 7575100 - DNA, 22 bp, Homo sapiens
aagagttaagcaacagatacca

SEQ ID NO: 7575101 - DNA, 22 bp, Homo sapiens
aagagttaagcaacagatacca

SEQ ID NO: 7575102 - DNA, 22 bp, Homo sapiens
aagagttaagcaacagatacca

SEQ ID NO: 7575103 - DNA, 22 bp, Homo sapiens
aagagttagctcaataacttga

SEQ ID NO: 7575104 - DNA, 22 bp, Homo sapiens
aagagttagctcaataacttga

SEQ ID NO: 7575105 - DNA, 22 bp, Homo sapiens
aagagttatacctatttctaac

SEQ ID NO: 7575106 - DNA, 22 bp, Homo sapiens
aagagttagctcaataacttga

SEQ ID NO: 7575107 - DNA, 22 bp, Homo sapiens
aagagttatacctatttctaac

SEQ ID NO: 7575108 - DNA, 22 bp, Homo sapiens
aagagttatgaaagcaaggcat

SEQ ID NO: 7575109 - DNA, 22 bp, Homo sapiens
aagagttatagttggtatgtgg

SEQ ID NO: 7575110 - DNA, 22 bp, Homo sapiens
aagagtttaattttgtctagac

SEQ ID NO: 7575111 - DNA, 23 bp, Homo sapiens
aagagtttagagtcttgcagagt

SEQ ID NO: 7575112 - DNA, 23 bp, Homo sapiens
aagagtttagagtcttgcagagt

SEQ ID NO: 7575113 - DNA, 22 bp, Homo sapiens
aagagtttaccagtgctgcttc

SEQ ID NO: 7575114 - DNA, 20 bp, Homo sapiens
aagagtctttactgagctaa

SEQ ID NO: 7575115 - DNA, 20 bp, Homo sapiens
aagagtctttactgagctaa

SEQ ID NO: 7575116 - DNA, 22 bp, Homo sapiens
aagagtctattggaactagaca

SEQ ID NO: 7575117 - DNA, 22 bp, Homo sapiens
aagagtctattggaactagaca

SEQ ID NO: 7575118 - DNA, 22 bp, Homo sapiens
aagagtcttatagtgtaattaa

SEQ ID NO: 7575119 - DNA, 22 bp, Homo sapiens
aagagtggagctggaaagtggg

SEQ ID NO: 7575120 - DNA, 22 bp, Homo sapiens
aagagtggagaataaaatagga

SEQ ID NO: 7575121 - DNA, 22 bp, Homo sapiens
aagagtggagctggaaagtggg

SEQ ID NO: 7575122 - DNA, 22 bp, Homo sapiens
aagagtgagtatttcctgatta

SEQ ID NO: 7575123 - DNA, 22 bp, Homo sapiens
aagagtgacttttcagctgtga

SEQ ID NO: 7575124 - DNA, 22 bp, Homo sapiens
aagagtgacttttcagctgtga

SEQ ID NO: 7575125 - DNA, 22 bp, Homo sapiens
aagagtggagctggaaagtggg

SEQ ID NO: 7575126 - DNA, 21 bp, Homo sapiens
aagagtggctgaggaggtgat

SEQ ID NO: 7575127 - DNA, 22 bp, Homo sapiens
aagagttaaatgaatgagtggg

SEQ ID NO: 7575128 - DNA, 21 bp, Homo sapiens
aagagtggctgaggaggtgat

SEQ ID NO: 7575129 - DNA, 22 bp, Homo sapiens
aagagtgtgaggttgtgctttt

SEQ ID NO: 7575130 - DNA, 22 bp, Homo sapiens
aagagtggagctggaaagtggg

SEQ ID NO: 7575131 - DNA, 22 bp, Homo sapiens
aagagtggagctggaaagtggg

SEQ ID NO: 7575132 - DNA, 22 bp, Homo sapiens
aagagtggagctggaaagtggg

SEQ ID NO: 7575133 - DNA, 19 bp, Homo sapiens
aagagggaaagtgctatgc

SEQ ID NO: 7575134 - DNA, 22 bp, Homo sapiens
aagaggtcacactaggtcctag

SEQ ID NO: 7575135 - DNA, 22 bp, Homo sapiens
aagaggtagcagtcacaaaaga

SEQ ID NO: 7575136 - DNA, 21 bp, Homo sapiens
aagaggtcaaattataaatgg

SEQ ID NO: 7575137 - DNA, 22 bp, Homo sapiens
aagaggctttcagtgaacttgt

SEQ ID NO: 7575138 - DNA, 22 bp, Homo sapiens
aagaggctttcagtgaacttgt

SEQ ID NO: 7575139 - DNA, 22 bp, Homo sapiens
aagaggctttcagtgaacttgt

SEQ ID NO: 7575140 - DNA, 19 bp, Homo sapiens
aagagggaaagtgctatgc

SEQ ID NO: 7575141 - DNA, 19 bp, Homo sapiens
aagagggaaagtgctatgc

SEQ ID NO: 7575142 - DNA, 19 bp, Homo sapiens
aagagggaaagtgctatgc

SEQ ID NO: 7575143 - DNA, 22 bp, Homo sapiens
acacacatgcatgcttgccatt

SEQ ID NO: 7575144 - DNA, 22 bp, Homo sapiens
acacacatgcatgcttgccatt

SEQ ID NO: 7575145 - DNA, 22 bp, Homo sapiens
acacacatgcatgcttgccatt

SEQ ID NO: 7575146 - DNA, 22 bp, Homo sapiens
acacacatgcatgcttgccatt

SEQ ID NO: 7575147 - DNA, 22 bp, Homo sapiens
acacacaggtaaaggagcctgg

SEQ ID NO: 7575148 - DNA, 22 bp, Homo sapiens
acacacatgcatgcttgccatt

SEQ ID NO: 7575149 - DNA, 22 bp, Homo sapiens
aagaggttattgttcccagctt

SEQ ID NO: 7575150 - DNA, 22 bp, Homo sapiens
aagaggtgggttggacagatac

SEQ ID NO: 7575151 - DNA, 22 bp, Homo sapiens
aagaggtgggttggacagatac

SEQ ID NO: 7575152 - DNA, 22 bp, Homo sapiens
aagaggttctaatttaactatc

SEQ ID NO: 7575153 - DNA, 22 bp, Homo sapiens
aagaggttattgttcccagctt

SEQ ID NO: 7575154 - DNA, 22 bp, Homo sapiens
aagaggtgggttggacagatac

SEQ ID NO: 7575155 - DNA, 22 bp, Homo sapiens
aagaggtgccaggggttttgta

SEQ ID NO: 7575156 - DNA, 20 bp, Homo sapiens
aagaggtgataacaggtgag

SEQ ID NO: 7575157 - DNA, 22 bp, Homo sapiens
aagaggtggaacagcaattcgt

SEQ ID NO: 7575158 - DNA, 22 bp, Homo sapiens
aagaggtggaacagcaattcgt

SEQ ID NO: 7575159 - DNA, 22 bp, Homo sapiens
aagaggtgggttggacagatac

SEQ ID NO: 7575160 - DNA, 22 bp, Homo sapiens
aagaggtggaacagcaattcgt

SEQ ID NO: 7575161 - DNA, 20 bp, Homo sapiens
aagaggtgataacaggtgag

SEQ ID NO: 7575162 - DNA, 20 bp, Homo sapiens
aagaggtgataacaggtgag

SEQ ID NO: 7575163 - DNA, 20 bp, Homo sapiens
aagaggtgataacaggtgag

SEQ ID NO: 7575164 - DNA, 20 bp, Homo sapiens
aagaggtgataacaggtgag

SEQ ID NO: 7575165 - DNA, 20 bp, Homo sapiens
aagaggtgataacaggtgag

SEQ ID NO: 7575166 - DNA, 22 bp, Homo sapiens
aagaggtcataccagataaggg

SEQ ID NO: 7575167 - DNA, 22 bp, Homo sapiens
aagaggtgagaagctacactta

SEQ ID NO: 7575168 - DNA, 22 bp, Homo sapiens
aagaggtgagaagctacactta

SEQ ID NO: 7575169 - DNA, 22 bp, Homo sapiens
aagaggtcataccagataaggg

SEQ ID NO: 7575170 - DNA, 22 bp, Homo sapiens
aagaggtgagaagctacactta

SEQ ID NO: 7575171 - DNA, 22 bp, Homo sapiens
aagaggcatctcagcttcctct

SEQ ID NO: 7575172 - DNA, 22 bp, Homo sapiens
aagaggcatctcagcttcctct

SEQ ID NO: 7575173 - DNA, 22 bp, Homo sapiens
aagaggcatctcagcttcctct

SEQ ID NO: 7575174 - DNA, 22 bp, Homo sapiens
aagaggcatctcagcttcctct

SEQ ID NO: 7575175 - DNA, 22 bp, Homo sapiens
aagaggcatctcagcttcctct

SEQ ID NO: 7575176 - DNA, 20 bp, Homo sapiens
acacacagagacatgcgcat

SEQ ID NO: 7575177 - DNA, 22 bp, Homo sapiens
acacacagaaggaagccccact

SEQ ID NO: 7575178 - DNA, 22 bp, Homo sapiens
acacacagagtttatacaggca

SEQ ID NO: 7575179 - DNA, 22 bp, Homo sapiens
acacacagagtttatacaggca

SEQ ID NO: 7575180 - DNA, 22 bp, Homo sapiens
acacacagagtttatacaggca

SEQ ID NO: 7575181 - DNA, 22 bp, Homo sapiens
acacacagagtttatacaggca

SEQ ID NO: 7575182 - DNA, 22 bp, Homo sapiens
acacacagagtttatacaggca

SEQ ID NO: 7575183 - DNA, 22 bp, Homo sapiens
acacacagagtttatacaggca

SEQ ID NO: 7575184 - DNA, 20 bp, Homo sapiens
acacacagagacatgcgcat

SEQ ID NO: 7575185 - DNA, 20 bp, Homo sapiens
acacacagagacatgcgcat

SEQ ID NO: 7575186 - DNA, 20 bp, Homo sapiens
acacacagagacatgcgcat

SEQ ID NO: 7575187 - DNA, 22 bp, Homo sapiens
acacacagcgcctaccatgtgc

SEQ ID NO: 7575188 - DNA, 22 bp, Homo sapiens
acacacaggtaaaggagcctgg

SEQ ID NO: 7575189 - DNA, 22 bp, Homo sapiens
acacacaggtaaaggagcctgg

SEQ ID NO: 7575190 - DNA, 22 bp, Homo sapiens
acacacaggtaaaggagcctgg

SEQ ID NO: 7575191 - DNA, 22 bp, Homo sapiens
acacacaggtaaaggagcctgg

SEQ ID NO: 7575192 - DNA, 22 bp, Homo sapiens
acacacaggtaaaggagcctgg

SEQ ID NO: 7575193 - DNA, 22 bp, Homo sapiens
acacacagcgcctaccatgtgc

SEQ ID NO: 7575194 - DNA, 22 bp, Homo sapiens
acacacagcgcctaccatgtgc

SEQ ID NO: 7575195 - DNA, 22 bp, Homo sapiens
acacacagcgcctaccatgtgc

SEQ ID NO: 7575196 - DNA, 22 bp, Homo sapiens
acacacagcgcctaccatgtgc

SEQ ID NO: 7575197 - DNA, 21 bp, Homo sapiens
aagaggcatcactatttgtgt

SEQ ID NO: 7575198 - DNA, 21 bp, Homo sapiens
aagaggcatcactatttgtgt

SEQ ID NO: 7575199 - DNA, 22 bp, Homo sapiens
aagaggcataaaatttatatgg

SEQ ID NO: 7575200 - DNA, 22 bp, Homo sapiens
aagaggcagtggtgatgaatgg

SEQ ID NO: 7575201 - DNA, 22 bp, Homo sapiens
aagaggcataaaatttatatgg

SEQ ID NO: 7575202 - DNA, 22 bp, Homo sapiens
aagaggcagtggtgatgaatgg

SEQ ID NO: 7575203 - DNA, 22 bp, Homo sapiens
aagaggcagtggtgatgaatgg

SEQ ID NO: 7575204 - DNA, 22 bp, Homo sapiens
aagaggcagtggtgatgaatgg

SEQ ID NO: 7575205 - DNA, 22 bp, Homo sapiens
aagaggcagcccgctgaggctg

SEQ ID NO: 7575206 - DNA, 22 bp, Homo sapiens
aagaggcagcccgctgaggctg

SEQ ID NO: 7575207 - DNA, 22 bp, Homo sapiens
aagaggcagcccgctgaggctg

SEQ ID NO: 7575208 - DNA, 22 bp, Homo sapiens
aagaggcagcccgctgaggctg

SEQ ID NO: 7575209 - DNA, 22 bp, Homo sapiens
aagaggcagcccgctgaggctg

SEQ ID NO: 7575210 - DNA, 22 bp, Homo sapiens
aagaggcagcccgctgaggctg

SEQ ID NO: 7575211 - DNA, 22 bp, Homo sapiens
aagaggcagaaatatcgctgaa

SEQ ID NO: 7575212 - DNA, 22 bp, Homo sapiens
aagaggcagaaatatcgctgaa

SEQ ID NO: 7575213 - DNA, 22 bp, Homo sapiens
aagaggcagaaatatcgctgaa

SEQ ID NO: 7575214 - DNA, 22 bp, Homo sapiens
aagaggcagaaatatcgctgaa

SEQ ID NO: 7575215 - DNA, 22 bp, Homo sapiens
aagaggagggcagattcaaggc

SEQ ID NO: 7575216 - DNA, 22 bp, Homo sapiens
aagaggagtagatgtggttggt

SEQ ID NO: 7575217 - DNA, 23 bp, Homo sapiens
aagaggaggccctgctcccgtcc

SEQ ID NO: 7575218 - DNA, 22 bp, Homo sapiens
aagaggagggcagattcaaggc

SEQ ID NO: 7575219 - DNA, 22 bp, Homo sapiens
aagaggagggcagattcaaggc

SEQ ID NO: 7575220 - DNA, 22 bp, Homo sapiens
aagaggagggcagattcaaggc

SEQ ID NO: 7575221 - DNA, 19 bp, Homo sapiens
aagaggcaaccctcgagcc

SEQ ID NO: 7575222 - DNA, 19 bp, Homo sapiens
aagaggcaaccctcgagcc

SEQ ID NO: 7575223 - DNA, 19 bp, Homo sapiens
aagaggcaaccctcgagcc

SEQ ID NO: 7575224 - DNA, 19 bp, Homo sapiens
aagaggcaaccctcgagcc

SEQ ID NO: 7575225 - DNA, 19 bp, Homo sapiens
aagaggcaaccctcgagcc

SEQ ID NO: 7575226 - DNA, 22 bp, Homo sapiens
aagaggagtagatgtggttggt

SEQ ID NO: 7575227 - DNA, 22 bp, Homo sapiens
aagaggagtagatgtggttggt

SEQ ID NO: 7575228 - DNA, 22 bp, Homo sapiens
aagaggagtagatgtggttggt

SEQ ID NO: 7575229 - DNA, 22 bp, Homo sapiens
aagacatttatgaaaagtgctg

SEQ ID NO: 7575230 - DNA, 22 bp, Homo sapiens
aagacatttatgaaaagtgctg

SEQ ID NO: 7575231 - DNA, 22 bp, Homo sapiens
aagacatttatgaaaagtgctg

SEQ ID NO: 7575232 - DNA, 22 bp, Homo sapiens
aagacatttatgaaaagtgctg

SEQ ID NO: 7575233 - DNA, 22 bp, Homo sapiens
aagacattgtggagatgttgct

SEQ ID NO: 7575234 - DNA, 22 bp, Homo sapiens
aagacatttatttgaatcaatt

SEQ ID NO: 7575235 - DNA, 22 bp, Homo sapiens
aagacatttatttgaatcaatt

SEQ ID NO: 7575236 - DNA, 22 bp, Homo sapiens
aagacatttatttgaatcaatt

SEQ ID NO: 7575237 - DNA, 22 bp, Homo sapiens
aagacatttatttgaatcaatt

SEQ ID NO: 7575238 - DNA, 22 bp, Homo sapiens
aagaccagaggatataaccaga

SEQ ID NO: 7575239 - DNA, 22 bp, Homo sapiens
aagaccagggtgggtacgttcc

SEQ ID NO: 7575240 - DNA, 22 bp, Homo sapiens
aagaggaactgggggctgagtc

SEQ ID NO: 7575241 - DNA, 22 bp, Homo sapiens
aagacattttgaaattggaagc

SEQ ID NO: 7575242 - DNA, 22 bp, Homo sapiens
aagacattttagagatagggaa

SEQ ID NO: 7575243 - DNA, 22 bp, Homo sapiens
aagacattttgaaattggaagc

SEQ ID NO: 7575244 - DNA, 22 bp, Homo sapiens
aagacattttagagatagggaa

SEQ ID NO: 7575245 - DNA, 22 bp, Homo sapiens
aagaggaactgggggctgagtc

SEQ ID NO: 7575246 - DNA, 22 bp, Homo sapiens
aagaggaactgggggctgagtc

SEQ ID NO: 7575247 - DNA, 21 bp, Homo sapiens
aagaggaagcattatggcata

SEQ ID NO: 7575248 - DNA, 21 bp, Homo sapiens
aagaggaagcattatggcata

SEQ ID NO: 7575249 - DNA, 21 bp, Homo sapiens
aagaggaagcattatggcata

SEQ ID NO: 7575250 - DNA, 21 bp, Homo sapiens
aagaggaagcattatggcata

SEQ ID NO: 7575251 - DNA, 22 bp, Homo sapiens
aagaggaagtctccatggagag

SEQ ID NO: 7575252 - DNA, 22 bp, Homo sapiens
aagaggaagtctccatggagag

SEQ ID NO: 7575253 - DNA, 21 bp, Homo sapiens
aagaggaagcattatggcata

SEQ ID NO: 7575254 - DNA, 22 bp, Homo sapiens
aagaggaagtctccatggagag

SEQ ID NO: 7575255 - DNA, 22 bp, Homo sapiens
aagaggaagtctccatggagag

SEQ ID NO: 7575256 - DNA, 22 bp, Homo sapiens
aagaggaagtctccatggagag

SEQ ID NO: 7575257 - DNA, 22 bp, Homo sapiens
aagaggaggattgatgtgggag

SEQ ID NO: 7575258 - DNA, 22 bp, Homo sapiens
aagaggaggattgatgtgggag

SEQ ID NO: 7575259 - DNA, 22 bp, Homo sapiens
aagaggaggattgatgtgggag

SEQ ID NO: 7575260 - DNA, 22 bp, Homo sapiens
aagaggaagtctccatggagag

SEQ ID NO: 7575261 - DNA, 22 bp, Homo sapiens
aagaggaagtctccatggagag

SEQ ID NO: 7575262 - DNA, 22 bp, Homo sapiens
aagaggaggattgatgtgggag

SEQ ID NO: 7575263 - DNA, 23 bp, Homo sapiens
aagaggaggccctgctcccgtcc

SEQ ID NO: 7575264 - DNA, 23 bp, Homo sapiens
aagaggaggccctgctcccgtcc

SEQ ID NO: 7575265 - DNA, 22 bp, Homo sapiens
aagaggaggattgatgtgggag

SEQ ID NO: 7575266 - DNA, 20 bp, Homo sapiens
aactcagagatgaaaaagac

SEQ ID NO: 7575267 - DNA, 22 bp, Homo sapiens
aactcagacatgtataaagact

SEQ ID NO: 7575268 - DNA, 22 bp, Homo sapiens
aactcagacatgtataaagact

SEQ ID NO: 7575269 - DNA, 20 bp, Homo sapiens
aactcagagatgaaaaagac

SEQ ID NO: 7575270 - DNA, 20 bp, Homo sapiens
aactcagagatgaaaaagac

SEQ ID NO: 7575271 - DNA, 22 bp, Homo sapiens
aactcactttgtggcttctgaa

SEQ ID NO: 7575272 - DNA, 22 bp, Homo sapiens
aactcactttgtggcttctgaa

SEQ ID NO: 7575273 - DNA, 22 bp, Homo sapiens
aactcactttgtggcttctgaa

SEQ ID NO: 7575274 - DNA, 22 bp, Homo sapiens
aactcactttgtggcttctgaa

SEQ ID NO: 7575275 - DNA, 22 bp, Homo sapiens
aactcagaatagggtgcagggc

SEQ ID NO: 7575276 - DNA, 22 bp, Homo sapiens
aactcagaatagggtgcagggc

SEQ ID NO: 7575277 - DNA, 22 bp, Homo sapiens
aactcagaatagggtgcagggc

SEQ ID NO: 7575278 - DNA, 22 bp, Homo sapiens
aactcagaatagggtgcagggc

SEQ ID NO: 7575279 - DNA, 22 bp, Homo sapiens
aactcagaatagggtgcagggc

SEQ ID NO: 7575280 - DNA, 22 bp, Homo sapiens
aactcagatgtttggctacctt

SEQ ID NO: 7575281 - DNA, 22 bp, Homo sapiens
aactcagatatgatagcaggag

SEQ ID NO: 7575282 - DNA, 22 bp, Homo sapiens
aactcagatatgatagcaggag

SEQ ID NO: 7575283 - DNA, 22 bp, Homo sapiens
aactcagatgtttggctacctt

SEQ ID NO: 7575284 - DNA, 22 bp, Homo sapiens
aactcaggagaatggagggtat

SEQ ID NO: 7575285 - DNA, 22 bp, Homo sapiens
aactcaggagaatggagggtat

SEQ ID NO: 7575286 - DNA, 22 bp, Homo sapiens
aactcaggagtttaaggctgca

SEQ ID NO: 7575287 - DNA, 22 bp, Homo sapiens
aactcaggagtttaaggctgca

SEQ ID NO: 7575288 - DNA, 22 bp, Homo sapiens
aactcagtgtgtttcttagtat

SEQ ID NO: 7575289 - DNA, 22 bp, Homo sapiens
aactcagtcataaagcgaatgc

SEQ ID NO: 7575290 - DNA, 22 bp, Homo sapiens
aactgaaacttaggaagtaatc

SEQ ID NO: 7575291 - DNA, 22 bp, Homo sapiens
aactgagacacgaactatgatt

SEQ ID NO: 7575292 - DNA, 22 bp, Homo sapiens
aactgagacacgaactatgatt

SEQ ID NO: 7575293 - DNA, 22 bp, Homo sapiens
aactgacttagccagtggagct

SEQ ID NO: 7575294 - DNA, 21 bp, Homo sapiens
aactgagaccagctaaagtgg

SEQ ID NO: 7575295 - DNA, 21 bp, Homo sapiens
aactgagaccagctaaagtgg

SEQ ID NO: 7575296 - DNA, 22 bp, Homo sapiens
aactgactcccatgattaggtc

SEQ ID NO: 7575297 - DNA, 22 bp, Homo sapiens
aactgacagcaggaaccattcc

SEQ ID NO: 7575298 - DNA, 22 bp, Homo sapiens
aactgaattttaaatacaggcc

SEQ ID NO: 7575299 - DNA, 22 bp, Homo sapiens
aactgaactgataacatacacg

SEQ ID NO: 7575300 - DNA, 22 bp, Homo sapiens
aactgaacagaactcagagatt

SEQ ID NO: 7575301 - DNA, 22 bp, Homo sapiens
aactgaaatcaatcagtgattc

SEQ ID NO: 7575302 - DNA, 22 bp, Homo sapiens
aactgaaatcaatcagtgattc

SEQ ID NO: 7575303 - DNA, 22 bp, Homo sapiens
aactgaaatcaatcagtgattc

SEQ ID NO: 7575304 - DNA, 22 bp, Homo sapiens
aactgaaatcaatcagtgattc

SEQ ID NO: 7575305 - DNA, 22 bp, Homo sapiens
aactgaaatcaatcagtgattc

SEQ ID NO: 7575306 - DNA, 22 bp, Homo sapiens
aactgaaatcaatcagtgattc

SEQ ID NO: 7575307 - DNA, 22 bp, Homo sapiens
aactgaacagaactcagagatt

SEQ ID NO: 7575308 - DNA, 22 bp, Homo sapiens
aactgaaagtttcacctgaggt

SEQ ID NO: 7575309 - DNA, 22 bp, Homo sapiens
aactgaaagtttcacctgaggt

SEQ ID NO: 7575310 - DNA, 22 bp, Homo sapiens
aactgaaagtttcacctgaggt

SEQ ID NO: 7575311 - DNA, 22 bp, Homo sapiens
aactgaaacttaggaagtaatc

SEQ ID NO: 7575312 - DNA, 22 bp, Homo sapiens
aactcagtgtgtttcttagtat

SEQ ID NO: 7575313 - DNA, 22 bp, Homo sapiens
aacttgcagggatgttctgaat

SEQ ID NO: 7575314 - DNA, 22 bp, Homo sapiens
aacttgcagacacctgtctcaa

SEQ ID NO: 7575315 - DNA, 22 bp, Homo sapiens
aacttgcagggatgttctgaat

SEQ ID NO: 7575316 - DNA, 22 bp, Homo sapiens
aacttgccaagagctttgctag

SEQ ID NO: 7575317 - DNA, 22 bp, Homo sapiens
aacttgccaagagctttgctag

SEQ ID NO: 7575318 - DNA, 22 bp, Homo sapiens
aacttgccaagagctttgctag

SEQ ID NO: 7575319 - DNA, 22 bp, Homo sapiens
aacttgcttcaacttatttcac

SEQ ID NO: 7575320 - DNA, 22 bp, Homo sapiens
aacttgcagacacctgtctcaa

SEQ ID NO: 7575321 - DNA, 22 bp, Homo sapiens
aactgcaaaaatggtagtctta

SEQ ID NO: 7575322 - DNA, 22 bp, Homo sapiens
aacttgaattctgccattcaga

SEQ ID NO: 7575323 - DNA, 22 bp, Homo sapiens
aactgatttcaagttcagtttc

SEQ ID NO: 7575324 - DNA, 22 bp, Homo sapiens
aactgcaaaaatggtagtctta

SEQ ID NO: 7575325 - DNA, 22 bp, Homo sapiens
aactgattgttggatgatagtg

SEQ ID NO: 7575326 - DNA, 22 bp, Homo sapiens
aactgatgctagaagagacgtt

SEQ ID NO: 7575327 - DNA, 22 bp, Homo sapiens
aactgatttcaagttcagtttc

SEQ ID NO: 7575328 - DNA, 22 bp, Homo sapiens
aactgattgttggatgatagtg

SEQ ID NO: 7575329 - DNA, 22 bp, Homo sapiens
aactgataatggacacataaaa

SEQ ID NO: 7575330 - DNA, 22 bp, Homo sapiens
aactgaggtctccagtgcagaa

SEQ ID NO: 7575331 - DNA, 22 bp, Homo sapiens
aactgagattacaagagacatt

SEQ ID NO: 7575332 - DNA, 22 bp, Homo sapiens
aactgagattacaagagacatt

SEQ ID NO: 7575333 - DNA, 23 bp, Homo sapiens
aactgagataatgtatgtaaagc

SEQ ID NO: 7575334 - DNA, 23 bp, Homo sapiens
aactgagataatgtatgtaaagc

SEQ ID NO: 7575335 - DNA, 20 bp, Homo sapiens
aactgagagttcaggaggag

SEQ ID NO: 7575336 - DNA, 22 bp, Homo sapiens
aactgaggccaagtgaggaaag

SEQ ID NO: 7575337 - DNA, 22 bp, Homo sapiens
aactgaggccaagtgaggaaag

SEQ ID NO: 7575338 - DNA, 22 bp, Homo sapiens
aactgagggccctgctgaagca

SEQ ID NO: 7575339 - DNA, 22 bp, Homo sapiens
aactgagggccctgctgaagca

SEQ ID NO: 7575340 - DNA, 22 bp, Homo sapiens
aactgaggtatctgctgtgttt

SEQ ID NO: 7575341 - DNA, 22 bp, Homo sapiens
aactgagggccctgctgaagca

SEQ ID NO: 7575342 - DNA, 22 bp, Homo sapiens
aactgaggaataactgagttgc

SEQ ID NO: 7575343 - DNA, 22 bp, Homo sapiens
aactgagattacaagagacatt

SEQ ID NO: 7575344 - DNA, 22 bp, Homo sapiens
aactgagcccctgcacttgtga

SEQ ID NO: 7575345 - DNA, 22 bp, Homo sapiens
aactatgttaataagtttcatt

SEQ ID NO: 7575346 - DNA, 22 bp, Homo sapiens
aactatgttaataagtttcatt

SEQ ID NO: 7575347 - DNA, 22 bp, Homo sapiens
aactatgttaataagtttcatt

SEQ ID NO: 7575348 - DNA, 22 bp, Homo sapiens
aactatttttggagctaactct

SEQ ID NO: 7575349 - DNA, 22 bp, Homo sapiens
aactatttttggagctaactct

SEQ ID NO: 7575350 - DNA, 22 bp, Homo sapiens
aactattcaccaccttgtggta

SEQ ID NO: 7575351 - DNA, 22 bp, Homo sapiens
aactattctgtggactcttata

SEQ ID NO: 7575352 - DNA, 22 bp, Homo sapiens
aactatgttaataagtttcatt

SEQ ID NO: 7575353 - DNA, 22 bp, Homo sapiens
aactatgttaataagtttcatt

SEQ ID NO: 7575354 - DNA, 22 bp, Homo sapiens
aactatgttaataagtttcatt

SEQ ID NO: 7575355 - DNA, 22 bp, Homo sapiens
aactatgtgatatcatccttgc

SEQ ID NO: 7575356 - DNA, 22 bp, Homo sapiens
aactatggtattctgatgtttc

SEQ ID NO: 7575357 - DNA, 20 bp, Homo sapiens
aactatgaatagaagagatt

SEQ ID NO: 7575358 - DNA, 22 bp, Homo sapiens
aactatcacaaacagagtgtct

SEQ ID NO: 7575359 - DNA, 22 bp, Homo sapiens
aactatcacaaacagagtgtct

SEQ ID NO: 7575360 - DNA, 22 bp, Homo sapiens
aactatcacaaacagagtgtct

SEQ ID NO: 7575361 - DNA, 20 bp, Homo sapiens
aactatgaatagaagagatt

SEQ ID NO: 7575362 - DNA, 20 bp, Homo sapiens
aactatgaatagaagagatt

SEQ ID NO: 7575363 - DNA, 22 bp, Homo sapiens
aactcaaagatgcatgacgctt

SEQ ID NO: 7575364 - DNA, 22 bp, Homo sapiens
aactcaaagatgcatgacgctt

SEQ ID NO: 7575365 - DNA, 22 bp, Homo sapiens
aactatttttggagctaactct

SEQ ID NO: 7575366 - DNA, 22 bp, Homo sapiens
aactatttttggagctaactct

SEQ ID NO: 7575367 - DNA, 22 bp, Homo sapiens
aactatttttggagctaactct

SEQ ID NO: 7575368 - DNA, 22 bp, Homo sapiens
aactcaaagatgcatgacgctt

SEQ ID NO: 7575369 - DNA, 22 bp, Homo sapiens
aactcaaagatgcatgacgctt

SEQ ID NO: 7575370 - DNA, 22 bp, Homo sapiens
aactcaaagatgcatgacgctt

SEQ ID NO: 7575371 - DNA, 22 bp, Homo sapiens
aactcaaagatgcatgacgctt

SEQ ID NO: 7575372 - DNA, 22 bp, Homo sapiens
aactcactttgtggcttctgaa

SEQ ID NO: 7575373 - DNA, 22 bp, Homo sapiens
aactcactttgtggcttctgaa

SEQ ID NO: 7575374 - DNA, 22 bp, Homo sapiens
aactcactttgtggcttctgaa

SEQ ID NO: 7575375 - DNA, 22 bp, Homo sapiens
aactcacagctgtttggattag

SEQ ID NO: 7575376 - DNA, 22 bp, Homo sapiens
aactcacacaagtattgcctgc

SEQ ID NO: 7575377 - DNA, 22 bp, Homo sapiens
aacatttcttctgaaactgagt

SEQ ID NO: 7575378 - DNA, 22 bp, Homo sapiens
aacatttcttctgaaactgagt

SEQ ID NO: 7575379 - DNA, 22 bp, Homo sapiens
aacatttgaaaatcaagaatct

SEQ ID NO: 7575380 - DNA, 22 bp, Homo sapiens
aacatttgaaaatcaagaatct

SEQ ID NO: 7575381 - DNA, 22 bp, Homo sapiens
aacatttgaaaatcaagaatct

SEQ ID NO: 7575382 - DNA, 22 bp, Homo sapiens
aacatttgaaaatcaagaatct

SEQ ID NO: 7575383 - DNA, 22 bp, Homo sapiens
aacatttgaaaatcaagaatct

SEQ ID NO: 7575384 - DNA, 22 bp, Homo sapiens
aacatttgagaaaaatactctt

SEQ ID NO: 7575385 - DNA, 22 bp, Homo sapiens
aacatttgaaaatcaagaatct

SEQ ID NO: 7575386 - DNA, 22 bp, Homo sapiens
aacatttgcagaggaaagctat

SEQ ID NO: 7575387 - DNA, 22 bp, Homo sapiens
aacatttgcatgctttattaga

SEQ ID NO: 7575388 - DNA, 22 bp, Homo sapiens
aacatttgcatgctttattaga

SEQ ID NO: 7575389 - DNA, 22 bp, Homo sapiens
aacatttgcatgctttattaga

SEQ ID NO: 7575390 - DNA, 22 bp, Homo sapiens
aacatttgagaaaaatactctt

SEQ ID NO: 7575391 - DNA, 22 bp, Homo sapiens
aacatttgagaaaaatactctt

SEQ ID NO: 7575392 - DNA, 22 bp, Homo sapiens
aacatttgcagaggaaagctat

SEQ ID NO: 7575393 - DNA, 22 bp, Homo sapiens
aactaagttgcccagtccctgg

SEQ ID NO: 7575394 - DNA, 22 bp, Homo sapiens
aacatttgtgaagtacttagat

SEQ ID NO: 7575395 - DNA, 22 bp, Homo sapiens
aacatttgtgtttgctaaaaat

SEQ ID NO: 7575396 - DNA, 22 bp, Homo sapiens
aactaatacattaatacatgtg

SEQ ID NO: 7575397 - DNA, 22 bp, Homo sapiens
aactaatacattaatacatgtg

SEQ ID NO: 7575398 - DNA, 22 bp, Homo sapiens
aacatttgtgtttgctaaaaat

SEQ ID NO: 7575399 - DNA, 22 bp, Homo sapiens
aactaatacattaatacatgtg

SEQ ID NO: 7575400 - DNA, 22 bp, Homo sapiens
aactaatacattaatacatgtg

SEQ ID NO: 7575401 - DNA, 22 bp, Homo sapiens
aactacaatatgtatgtatgta

SEQ ID NO: 7575402 - DNA, 22 bp, Homo sapiens
aactacaatatgtatgtatgta

SEQ ID NO: 7575403 - DNA, 22 bp, Homo sapiens
aactatactctgtaaatgtgct

SEQ ID NO: 7575404 - DNA, 22 bp, Homo sapiens
aacatttgtactaaagaagttc

SEQ ID NO: 7575405 - DNA, 23 bp, Homo sapiens
aacatttgtaaggtgattttgtt

SEQ ID NO: 7575406 - DNA, 21 bp, Homo sapiens
aacatttggctggcttttgtg

SEQ ID NO: 7575407 - DNA, 22 bp, Homo sapiens
aacatttgtgaagtacttagat

SEQ ID NO: 7575408 - DNA, 22 bp, Homo sapiens
aacagtctgggagttccttata

SEQ ID NO: 7575409 - DNA, 22 bp, Homo sapiens
aacagtctgggagttccttata

SEQ ID NO: 7575410 - DNA, 19 bp, Homo sapiens
aacagtctgggaagcacag

SEQ ID NO: 7575411 - DNA, 22 bp, Homo sapiens
aacagtcttacagaagtagcca

SEQ ID NO: 7575412 - DNA, 22 bp, Homo sapiens
aacagtcttacagaagtagcca

SEQ ID NO: 7575413 - DNA, 22 bp, Homo sapiens
aacagtctaaattatacccttt

SEQ ID NO: 7575414 - DNA, 22 bp, Homo sapiens
aacagtctactgaatatctgcg

SEQ ID NO: 7575415 - DNA, 19 bp, Homo sapiens
aacagtctgggaagcacag

SEQ ID NO: 7575416 - DNA, 22 bp, Homo sapiens
aacagtcacattgttcaacttt

SEQ ID NO: 7575417 - DNA, 20 bp, Homo sapiens
aacagtcaaatgttgattgc

SEQ ID NO: 7575418 - DNA, 22 bp, Homo sapiens
aacagtcacattgttcaacttt

SEQ ID NO: 7575419 - DNA, 22 bp, Homo sapiens
aacagtcacattgttcaacttt

SEQ ID NO: 7575420 - DNA, 22 bp, Homo sapiens
aacagtcctgtgctctttcatt

SEQ ID NO: 7575421 - DNA, 22 bp, Homo sapiens
aacagtcctgtgctctttcatt

SEQ ID NO: 7575422 - DNA, 22 bp, Homo sapiens
aacagtcacattgttcaacttt

SEQ ID NO: 7575423 - DNA, 22 bp, Homo sapiens
aacagtcctgtgctctttcatt

SEQ ID NO: 7575424 - DNA, 22 bp, Homo sapiens
aacagtcttggaagtcttgtta

SEQ ID NO: 7575425 - DNA, 22 bp, Homo sapiens
aacagtcttggaagtcttgtta

SEQ ID NO: 7575426 - DNA, 22 bp, Homo sapiens
aacagtcttcctacggccatta

SEQ ID NO: 7575427 - DNA, 22 bp, Homo sapiens
aacagtcttacagaagtagcca

SEQ ID NO: 7575428 - DNA, 22 bp, Homo sapiens
aacagtcttacagaagtagcca

SEQ ID NO: 7575429 - DNA, 22 bp, Homo sapiens
aacagtctgggagttccttata

SEQ ID NO: 7575430 - DNA, 22 bp, Homo sapiens
aacagtgagaaggtggacagga

SEQ ID NO: 7575431 - DNA, 20 bp, Homo sapiens
aacagtgaatgaggccagag

SEQ ID NO: 7575432 - DNA, 20 bp, Homo sapiens
aacagtgaatgaggccagag

SEQ ID NO: 7575433 - DNA, 20 bp, Homo sapiens
aacagtgaatgaggccagag

SEQ ID NO: 7575434 - DNA, 22 bp, Homo sapiens
aacagtgagaaggtggacagga

SEQ ID NO: 7575435 - DNA, 22 bp, Homo sapiens
aacagtgagaaggtggacagga

SEQ ID NO: 7575436 - DNA, 20 bp, Homo sapiens
aacagtcaaatgttgattgc

SEQ ID NO: 7575437 - DNA, 22 bp, Homo sapiens
aacagtcaaagtttggttcctt

SEQ ID NO: 7575438 - DNA, 22 bp, Homo sapiens
aacagtattggttgaactcaag

SEQ ID NO: 7575439 - DNA, 22 bp, Homo sapiens
aacagtattggttgaactcaag

SEQ ID NO: 7575440 - DNA, 22 bp, Homo sapiens
aacagtatgtgagatttacaca

SEQ ID NO: 7575441 - DNA, 22 bp, Homo sapiens
aacagtatggaagccattagga

SEQ ID NO: 7575442 - DNA, 22 bp, Homo sapiens
aacagtatgtgagatttacaca

SEQ ID NO: 7575443 - DNA, 22 bp, Homo sapiens
aacagtatgtgagatttacaca

SEQ ID NO: 7575444 - DNA, 22 bp, Homo sapiens
aacagtatgtgagatttacaca

SEQ ID NO: 7575445 - DNA, 22 bp, Homo sapiens
aacagtatcttttatcagaaat

SEQ ID NO: 7575446 - DNA, 22 bp, Homo sapiens
aacagtatctacgggaactatt

SEQ ID NO: 7575447 - DNA, 22 bp, Homo sapiens
aacagtatatgaaatgttagga

SEQ ID NO: 7575448 - DNA, 22 bp, Homo sapiens
aacagtatatgaaatgttagga

SEQ ID NO: 7575449 - DNA, 22 bp, Homo sapiens
aacagtatcttttatcagaaat

SEQ ID NO: 7575450 - DNA, 22 bp, Homo sapiens
aacagtatcttttatcagaaat

SEQ ID NO: 7575451 - DNA, 22 bp, Homo sapiens
aacagtatcttttatcagaaat

SEQ ID NO: 7575452 - DNA, 22 bp, Homo sapiens
aacagtatcttttatcagaaat

SEQ ID NO: 7575453 - DNA, 22 bp, Homo sapiens
aacagtatcttttatcagaaat

SEQ ID NO: 7575454 - DNA, 20 bp, Homo sapiens
aacagtaccccccttgttct

SEQ ID NO: 7575455 - DNA, 20 bp, Homo sapiens
aacagtaccatttatctcag

SEQ ID NO: 7575456 - DNA, 20 bp, Homo sapiens
aacagtaccatttatctcag

SEQ ID NO: 7575457 - DNA, 22 bp, Homo sapiens
aacagtacaactccacaagact

SEQ ID NO: 7575458 - DNA, 22 bp, Homo sapiens
aacagtaatttgcggtttttgc

SEQ ID NO: 7575459 - DNA, 22 bp, Homo sapiens
aacagtagtggtcaatatgcca

SEQ ID NO: 7575460 - DNA, 22 bp, Homo sapiens
aacagtagtggtcaatatgcca

SEQ ID NO: 7575461 - DNA, 22 bp, Homo sapiens
aacagtatatgaaatgttagga

SEQ ID NO: 7575462 - DNA, 20 bp, Homo sapiens
aacagtaccccccttgttct

SEQ ID NO: 7575463 - DNA, 22 bp, Homo sapiens
aacagtagtggtcaatatgcca

SEQ ID NO: 7575464 - DNA, 22 bp, Homo sapiens
aacagtactggacaaggagtca

SEQ ID NO: 7575465 - DNA, 22 bp, Homo sapiens
aacagtacttgataatttgcac

SEQ ID NO: 7575466 - DNA, 22 bp, Homo sapiens
aacagtactggacaaggagtca

SEQ ID NO: 7575467 - DNA, 22 bp, Homo sapiens
aacagtagtatttaaactgaac

SEQ ID NO: 7575468 - DNA, 22 bp, Homo sapiens
aacagtagtatttaaactgaac

SEQ ID NO: 7575469 - DNA, 22 bp, Homo sapiens
aacagtaggtgtaaccaaacaa

SEQ ID NO: 7575470 - DNA, 22 bp, Homo sapiens
aacagtaggcatcacataatga

SEQ ID NO: 7575471 - DNA, 22 bp, Homo sapiens
aacaggaatgaggagaaaaggt

SEQ ID NO: 7575472 - DNA, 22 bp, Homo sapiens
aacaggaatgaggagaaaaggt

SEQ ID NO: 7575473 - DNA, 22 bp, Homo sapiens
aacaggaatgaggagaaaaggt

SEQ ID NO: 7575474 - DNA, 22 bp, Homo sapiens
aacaggaatgaggagaaaaggt

SEQ ID NO: 7575475 - DNA, 22 bp, Homo sapiens
aacaggaatgaggagaaaaggt

SEQ ID NO: 7575476 - DNA, 22 bp, Homo sapiens
aacaggaactatttgtattcca

SEQ ID NO: 7575477 - DNA, 22 bp, Homo sapiens
aacaggaactatttgtattcca

SEQ ID NO: 7575478 - DNA, 22 bp, Homo sapiens
aacagtaatggcattgccatga

SEQ ID NO: 7575479 - DNA, 22 bp, Homo sapiens
aacagtaatggcattgccatga

SEQ ID NO: 7575480 - DNA, 22 bp, Homo sapiens
aacagtaatggcattgccatga

SEQ ID NO: 7575481 - DNA, 22 bp, Homo sapiens
aacagtaatgtggtgttgggtt

SEQ ID NO: 7575482 - DNA, 22 bp, Homo sapiens
aacagtaatgtggtgttgggtt

SEQ ID NO: 7575483 - DNA, 22 bp, Homo sapiens
aacaggaaatacttatgaggta

SEQ ID NO: 7575484 - DNA, 22 bp, Homo sapiens
aacaggaaatacttatgaggta

SEQ ID NO: 7575485 - DNA, 22 bp, Homo sapiens
aacaggaaatacttatgaggta

SEQ ID NO: 7575486 - DNA, 22 bp, Homo sapiens
aacaggaaacaagttgttagga

SEQ ID NO: 7575487 - DNA, 22 bp, Homo sapiens
aacaggaaatacttatgaggta

SEQ ID NO: 7575488 - DNA, 22 bp, Homo sapiens
aacaggaaacaagttgttagga

SEQ ID NO: 7575489 - DNA, 22 bp, Homo sapiens
aacaggaaacaagttgttagga

SEQ ID NO: 7575490 - DNA, 22 bp, Homo sapiens
aacaggaaacaagttgttagga

SEQ ID NO: 7575491 - DNA, 22 bp, Homo sapiens
aacaggaaacaagttgttagga

SEQ ID NO: 7575492 - DNA, 22 bp, Homo sapiens
aacaggaaaacagcacaatagc

SEQ ID NO: 7575493 - DNA, 22 bp, Homo sapiens
aacaggaaaacagcacaatagc

SEQ ID NO: 7575494 - DNA, 22 bp, Homo sapiens
aacaggaaaacagcacaatagc

SEQ ID NO: 7575495 - DNA, 22 bp, Homo sapiens
aacaggaaaacagcacaatagc

SEQ ID NO: 7575496 - DNA, 22 bp, Homo sapiens
aacaggaaaacagcacaatagc

SEQ ID NO: 7575497 - DNA, 22 bp, Homo sapiens
aacaggaaaacagcacaatagc

SEQ ID NO: 7575498 - DNA, 22 bp, Homo sapiens
aacattcacctctacctccttc

SEQ ID NO: 7575499 - DNA, 22 bp, Homo sapiens
aacattcacctctacctccttc

SEQ ID NO: 7575500 - DNA, 22 bp, Homo sapiens
aacattcacctctacctccttc

SEQ ID NO: 7575501 - DNA, 22 bp, Homo sapiens
aacattcaattgaggaagttaa

SEQ ID NO: 7575502 - DNA, 22 bp, Homo sapiens
aacattcaattgaggaagttaa

SEQ ID NO: 7575503 - DNA, 22 bp, Homo sapiens
aacattcaattgaggaagttaa

SEQ ID NO: 7575504 - DNA, 22 bp, Homo sapiens
aacattcaattgaggaagttaa

SEQ ID NO: 7575505 - DNA, 22 bp, Homo sapiens
aacattcaagttctggtttatg

SEQ ID NO: 7575506 - DNA, 22 bp, Homo sapiens
aacattcaagttctggtttatg

SEQ ID NO: 7575507 - DNA, 22 bp, Homo sapiens
aacattcaagttctggtttatg

SEQ ID NO: 7575508 - DNA, 22 bp, Homo sapiens
aacattcaagttctggtttatg

SEQ ID NO: 7575509 - DNA, 22 bp, Homo sapiens
aacattcaaaacccagttcagt

SEQ ID NO: 7575510 - DNA, 22 bp, Homo sapiens
aacattcaaaacccagttcagt

SEQ ID NO: 7575511 - DNA, 22 bp, Homo sapiens
aacattcaaaacccagttcagt

SEQ ID NO: 7575512 - DNA, 22 bp, Homo sapiens
aacattcaaaacccagttcagt

SEQ ID NO: 7575513 - DNA, 22 bp, Homo sapiens
aacattcaaaacccagttcagt

SEQ ID NO: 7575514 - DNA, 22 bp, Homo sapiens
aacattcaaaacccagttcagt

SEQ ID NO: 7575515 - DNA, 22 bp, Homo sapiens
aacattagatttgtttttctag

SEQ ID NO: 7575516 - DNA, 21 bp, Homo sapiens
aacattagtaatttgactttt

SEQ ID NO: 7575517 - DNA, 22 bp, Homo sapiens
aacattagatttgtttttctag

SEQ ID NO: 7575518 - DNA, 22 bp, Homo sapiens
aacattaattacagtcaaacat

SEQ ID NO: 7575519 - DNA, 22 bp, Homo sapiens
aacattaattacagtcaaacat

SEQ ID NO: 7575520 - DNA, 22 bp, Homo sapiens
aacattaattacagtcaaacat

SEQ ID NO: 7575521 - DNA, 22 bp, Homo sapiens
aacattaattacagtcaaacat

SEQ ID NO: 7575522 - DNA, 22 bp, Homo sapiens
aacattaattacagtcaaacat

SEQ ID NO: 7575523 - DNA, 22 bp, Homo sapiens
aacattaattacagtcaaacat

SEQ ID NO: 7575524 - DNA, 22 bp, Homo sapiens
aacattaagatggcggaacagt

SEQ ID NO: 7575525 - DNA, 22 bp, Homo sapiens
aacattaattacagtcaaacat

SEQ ID NO: 7575526 - DNA, 22 bp, Homo sapiens
aacattaattacagtcaaacat

SEQ ID NO: 7575527 - DNA, 22 bp, Homo sapiens
aacattaattacagtcaaacat

SEQ ID NO: 7575528 - DNA, 22 bp, Homo sapiens
aacattaattacagtcaaacat

SEQ ID NO: 7575529 - DNA, 22 bp, Homo sapiens
aacattaagatggcggaacagt

SEQ ID NO: 7575530 - DNA, 22 bp, Homo sapiens
aacatgcaatgtctgaaaatcc

SEQ ID NO: 7575531 - DNA, 22 bp, Homo sapiens
aacatgcacaattttaggcctg

SEQ ID NO: 7575532 - DNA, 22 bp, Homo sapiens
aacagtgagaaggtggacagga

SEQ ID NO: 7575533 - DNA, 22 bp, Homo sapiens
aacatgcaatgtctgaaaatcc

SEQ ID NO: 7575534 - DNA, 22 bp, Homo sapiens
aacatgcaatgtctgaaaatcc

SEQ ID NO: 7575535 - DNA, 22 bp, Homo sapiens
aacatgcaaagctatgatgtat

SEQ ID NO: 7575536 - DNA, 22 bp, Homo sapiens
aacatgcaatgtctgaaaatcc

SEQ ID NO: 7575537 - DNA, 22 bp, Homo sapiens
aacatgcaatgtctgaaaatcc

SEQ ID NO: 7575538 - DNA, 22 bp, Homo sapiens
aacatgcaatgtctgaaaatcc

SEQ ID NO: 7575539 - DNA, 22 bp, Homo sapiens
aacatgcaaagctatgatgtat

SEQ ID NO: 7575540 - DNA, 22 bp, Homo sapiens
aacatgcaaagctatgatgtat

SEQ ID NO: 7575541 - DNA, 22 bp, Homo sapiens
aacatgcaaagctatgatgtat

SEQ ID NO: 7575542 - DNA, 22 bp, Homo sapiens
aacatttcattggaagctatgt

SEQ ID NO: 7575543 - DNA, 22 bp, Homo sapiens
aacatttcattggaagctatgt

SEQ ID NO: 7575544 - DNA, 22 bp, Homo sapiens
aacatttccggccttttgttct

SEQ ID NO: 7575545 - DNA, 22 bp, Homo sapiens
aacatttccggccttttgttct

SEQ ID NO: 7575546 - DNA, 22 bp, Homo sapiens
aacatttcataacttgactttt

SEQ ID NO: 7575547 - DNA, 22 bp, Homo sapiens
aacatttcattggaagctatgt

SEQ ID NO: 7575548 - DNA, 22 bp, Homo sapiens
aacattctcattgggatatgtg

SEQ ID NO: 7575549 - DNA, 22 bp, Homo sapiens
aacatttccggccttttgttct

SEQ ID NO: 7575550 - DNA, 22 bp, Homo sapiens
aacatttctgagaatatcagtt

SEQ ID NO: 7575551 - DNA, 22 bp, Homo sapiens
aacatttccggccttttgttct

SEQ ID NO: 7575552 - DNA, 22 bp, Homo sapiens
aacatttccggccttttgttct

SEQ ID NO: 7575553 - DNA, 22 bp, Homo sapiens
aacatttctgagaatatcagtt

SEQ ID NO: 7575554 - DNA, 22 bp, Homo sapiens
aacatttcttctgaaactgagt

SEQ ID NO: 7575555 - DNA, 22 bp, Homo sapiens
aacatttcttctgaaactgagt

SEQ ID NO: 7575556 - DNA, 21 bp, Homo sapiens
aacatttctgggagaactcac

SEQ ID NO: 7575557 - DNA, 21 bp, Homo sapiens
aacatttctgggagaactcac

SEQ ID NO: 7575558 - DNA, 21 bp, Homo sapiens
aacatttctgggagaactcac

SEQ ID NO: 7575559 - DNA, 21 bp, Homo sapiens
aacatttctgggagaactcac

SEQ ID NO: 7575560 - DNA, 22 bp, Homo sapiens
aacattctactgtactgcattg

SEQ ID NO: 7575561 - DNA, 16 bp, Homo sapiens
aacattcatatgagtg

SEQ ID NO: 7575562 - DNA, 22 bp, Homo sapiens
aacattctactgtactgcattg

SEQ ID NO: 7575563 - DNA, 22 bp, Homo sapiens
aacattctactgtactgcattg

SEQ ID NO: 7575564 - DNA, 22 bp, Homo sapiens
aacattcagctgggtggagcag

SEQ ID NO: 7575565 - DNA, 16 bp, Homo sapiens
aacattcatatgagtg

SEQ ID NO: 7575566 - DNA, 22 bp, Homo sapiens
aacattcagctgggtggagcag

SEQ ID NO: 7575567 - DNA, 22 bp, Homo sapiens
aacattcagctgggtggagcag

SEQ ID NO: 7575568 - DNA, 22 bp, Homo sapiens
aacattcacctctacctccttc

SEQ ID NO: 7575569 - DNA, 22 bp, Homo sapiens
aacattcagctgatgggtcata

SEQ ID NO: 7575570 - DNA, 22 bp, Homo sapiens
aacattcagctgggtggagcag

SEQ ID NO: 7575571 - DNA, 22 bp, Homo sapiens
aacattcagctgatgggtcata

SEQ ID NO: 7575572 - DNA, 22 bp, Homo sapiens
aacattctattttgctaaaaca

SEQ ID NO: 7575573 - DNA, 22 bp, Homo sapiens
aacattctatgtgcattcagaa

SEQ ID NO: 7575574 - DNA, 22 bp, Homo sapiens
aacattctatgtgcattcagaa

SEQ ID NO: 7575575 - DNA, 22 bp, Homo sapiens
aacattctactgtactgcattg

SEQ ID NO: 7575576 - DNA, 22 bp, Homo sapiens
aacattctatgtgcattcagaa

SEQ ID NO: 7575577 - DNA, 22 bp, Homo sapiens
aacattctatgtgcattcagaa

SEQ ID NO: 7575578 - DNA, 22 bp, Homo sapiens
aacattctggttctaaaaacct

SEQ ID NO: 7575579 - DNA, 22 bp, Homo sapiens
aacattctcattgggatatgtg

SEQ ID NO: 7575580 - DNA, 22 bp, Homo sapiens
aacattctattttgctaaaaca

SEQ ID NO: 7575581 - DNA, 22 bp, Homo sapiens
aacattctattttgctaaaaca

SEQ ID NO: 7575582 - DNA, 22 bp, Homo sapiens
aacaagaacacctacagttcta

SEQ ID NO: 7575583 - DNA, 22 bp, Homo sapiens
aacaagaacacctacagttcta

SEQ ID NO: 7575584 - DNA, 22 bp, Homo sapiens
aacaacttgcgttcagagatgt

SEQ ID NO: 7575585 - DNA, 22 bp, Homo sapiens
aacaacttgcgttcagagatgt

SEQ ID NO: 7575586 - DNA, 22 bp, Homo sapiens
aacaagaacacctacagttcta

SEQ ID NO: 7575587 - DNA, 22 bp, Homo sapiens
aacaagaacacctacagttcta

SEQ ID NO: 7575588 - DNA, 22 bp, Homo sapiens
aacaagaacacctacagttcta

SEQ ID NO: 7575589 - DNA, 22 bp, Homo sapiens
aacaagaacacctacagttcta

SEQ ID NO: 7575590 - DNA, 22 bp, Homo sapiens
aacaagaacacctacagttcta

SEQ ID NO: 7575591 - DNA, 22 bp, Homo sapiens
aacaagaagggaaggcatgatt

SEQ ID NO: 7575592 - DNA, 22 bp, Homo sapiens
aacaagaagggaaggcatgatt

SEQ ID NO: 7575593 - DNA, 22 bp, Homo sapiens
aacaagaagggaaggcatgatt

SEQ ID NO: 7575594 - DNA, 22 bp, Homo sapiens
aacaagaagggaaggcatgatt

SEQ ID NO: 7575595 - DNA, 22 bp, Homo sapiens
aacaagaagagagggacgtaat

SEQ ID NO: 7575596 - DNA, 22 bp, Homo sapiens
aacaagaataagtggtttctgg

SEQ ID NO: 7575597 - DNA, 22 bp, Homo sapiens
aacaagaataagtggtttctgg

SEQ ID NO: 7575598 - DNA, 22 bp, Homo sapiens
aacaagaataagtggtttctgg

SEQ ID NO: 7575599 - DNA, 22 bp, Homo sapiens
aacaagaataagtggtttctgg

SEQ ID NO: 7575600 - DNA, 22 bp, Homo sapiens
aacaagaagggaaggcatgatt

SEQ ID NO: 7575601 - DNA, 22 bp, Homo sapiens
aacaattactaccaaggcctgt

SEQ ID NO: 7575602 - DNA, 22 bp, Homo sapiens
aacaattactaccaaggcctgt

SEQ ID NO: 7575603 - DNA, 22 bp, Homo sapiens
aacaattagactgacggtatta

SEQ ID NO: 7575604 - DNA, 22 bp, Homo sapiens
aacaattagactgacggtatta

SEQ ID NO: 7575605 - DNA, 22 bp, Homo sapiens
aacaattagactgacggtatta

SEQ ID NO: 7575606 - DNA, 22 bp, Homo sapiens
aacaattatcatatacattgca

SEQ ID NO: 7575607 - DNA, 22 bp, Homo sapiens
aacaatgttcttttagcttgaa

SEQ ID NO: 7575608 - DNA, 22 bp, Homo sapiens
aacaatgttcttttagcttgaa

SEQ ID NO: 7575609 - DNA, 22 bp, Homo sapiens
aacaatgttcttttagcttgaa

SEQ ID NO: 7575610 - DNA, 22 bp, Homo sapiens
aacaatgttcttttagcttgaa

SEQ ID NO: 7575611 - DNA, 22 bp, Homo sapiens
aacaattactaccaaggcctgt

SEQ ID NO: 7575612 - DNA, 22 bp, Homo sapiens
aacaattactaccaaggcctgt

SEQ ID NO: 7575613 - DNA, 22 bp, Homo sapiens
aacaatgtgttcagcactgtgg

SEQ ID NO: 7575614 - DNA, 22 bp, Homo sapiens
aacaatgtgttcagcactgtgg

SEQ ID NO: 7575615 - DNA, 22 bp, Homo sapiens
aacaatgtgttcagcactgtgg

SEQ ID NO: 7575616 - DNA, 22 bp, Homo sapiens
aacaatgtgattgaagctagaa

SEQ ID NO: 7575617 - DNA, 22 bp, Homo sapiens
aacaatgtgttcagcactgtgg

SEQ ID NO: 7575618 - DNA, 22 bp, Homo sapiens
aacaatgtgaagtgctgttcag

SEQ ID NO: 7575619 - DNA, 22 bp, Homo sapiens
aacaatgtgattgaagctagaa

SEQ ID NO: 7575620 - DNA, 22 bp, Homo sapiens
aacaagagactctgttccagaa

SEQ ID NO: 7575621 - DNA, 22 bp, Homo sapiens
aacaagaataagtggtttctgg

SEQ ID NO: 7575622 - DNA, 22 bp, Homo sapiens
aacaagatagagctcttgcctt

SEQ ID NO: 7575623 - DNA, 22 bp, Homo sapiens
aacaattatcatatacattgca

SEQ ID NO: 7575624 - DNA, 22 bp, Homo sapiens
aacaattatcatatacattgca

SEQ ID NO: 7575625 - DNA, 22 bp, Homo sapiens
aacaattatcatatacattgca

SEQ ID NO: 7575626 - DNA, 22 bp, Homo sapiens
aacaattatcatatacattgca

SEQ ID NO: 7575627 - DNA, 22 bp, Homo sapiens
aacaattatcatatacattgca

SEQ ID NO: 7575628 - DNA, 22 bp, Homo sapiens
aacaattatcatatacattgca

SEQ ID NO: 7575629 - DNA, 22 bp, Homo sapiens
aacaattatcatatacattgca

SEQ ID NO: 7575630 - DNA, 22 bp, Homo sapiens
aacaattatcatatacattgca

SEQ ID NO: 7575631 - DNA, 22 bp, Homo sapiens
aacaattgacacttcattgtga

SEQ ID NO: 7575632 - DNA, 22 bp, Homo sapiens
aacacaaaaattctcaggggca

SEQ ID NO: 7575633 - DNA, 22 bp, Homo sapiens
aacaattgacacttcattgtga

SEQ ID NO: 7575634 - DNA, 22 bp, Homo sapiens
aacaattatcatatacattgca

SEQ ID NO: 7575635 - DNA, 22 bp, Homo sapiens
aacacaaagaagctgcaggatc

SEQ ID NO: 7575636 - DNA, 22 bp, Homo sapiens
aacacaaagaagctgcaggatc

SEQ ID NO: 7575637 - DNA, 22 bp, Homo sapiens
aacacaaagaagctgcaggatc

SEQ ID NO: 7575638 - DNA, 22 bp, Homo sapiens
aacacaaagaagctgcaggatc

SEQ ID NO: 7575639 - DNA, 22 bp, Homo sapiens
aacacaaagaagctgcaggatc

SEQ ID NO: 7575640 - DNA, 22 bp, Homo sapiens
aacacaaaaattctcaggggca

SEQ ID NO: 7575641 - DNA, 22 bp, Homo sapiens
aacacaaaaattctcaggggca

SEQ ID NO: 7575642 - DNA, 22 bp, Homo sapiens
aacacaaaaattctcaggggca

SEQ ID NO: 7575643 - DNA, 22 bp, Homo sapiens
aacacaaaaattctcaggggca

SEQ ID NO: 7575644 - DNA, 22 bp, Homo sapiens
aacacaaaaattctcaggggca

SEQ ID NO: 7575645 - DNA, 22 bp, Homo sapiens
aacacaaagaagctgcaggatc

SEQ ID NO: 7575646 - DNA, 22 bp, Homo sapiens
aacacaaagaagctgcaggatc

SEQ ID NO: 7575647 - DNA, 22 bp, Homo sapiens
aacacaaagaagctgcaggatc

SEQ ID NO: 7575648 - DNA, 22 bp, Homo sapiens
aacacaaagaagctgcaggatc

SEQ ID NO: 7575649 - DNA, 22 bp, Homo sapiens
aacacaaagaagctgcaggatc

SEQ ID NO: 7575650 - DNA, 22 bp, Homo sapiens
aacacaaagaagctgcaggatc

SEQ ID NO: 7575651 - DNA, 23 bp, Homo sapiens
aacacaaagctgattccagtggc

SEQ ID NO: 7575652 - DNA, 23 bp, Homo sapiens
aacacaaagctgattccagtggc

SEQ ID NO: 7575653 - DNA, 23 bp, Homo sapiens
aacacaaagctgattccagtggc

SEQ ID NO: 7575654 - DNA, 22 bp, Homo sapiens
aacacataggcagagcatgaca

SEQ ID NO: 7575655 - DNA, 22 bp, Homo sapiens
aacacataggcagagcatgaca

SEQ ID NO: 7575656 - DNA, 22 bp, Homo sapiens
aacacataggcagagcatgaca

SEQ ID NO: 7575657 - DNA, 23 bp, Homo sapiens
aacacaaagctgattccagtggc

SEQ ID NO: 7575658 - DNA, 23 bp, Homo sapiens
aacacaaagctgattccagtggc

SEQ ID NO: 7575659 - DNA, 23 bp, Homo sapiens
aacacaaagctgattccagtggc

SEQ ID NO: 7575660 - DNA, 23 bp, Homo sapiens
aacacaaagctgattccagtggc

SEQ ID NO: 7575661 - DNA, 23 bp, Homo sapiens
aacacaaagctgattccagtggc

SEQ ID NO: 7575662 - DNA, 23 bp, Homo sapiens
aacacaaagctgattccagtggc

SEQ ID NO: 7575663 - DNA, 22 bp, Homo sapiens
aacacatatttatatatgcaca

SEQ ID NO: 7575664 - DNA, 22 bp, Homo sapiens
aacacatatttatatatgcaca

SEQ ID NO: 7575665 - DNA, 22 bp, Homo sapiens
aacacatatttatatatgcaca

SEQ ID NO: 7575666 - DNA, 22 bp, Homo sapiens
aacacatatttatatatgcaca

SEQ ID NO: 7575667 - DNA, 22 bp, Homo sapiens
aacacatatttatatatgcaca

SEQ ID NO: 7575668 - DNA, 22 bp, Homo sapiens
aacacatatttatatatgcaca

SEQ ID NO: 7575669 - DNA, 22 bp, Homo sapiens
aacacatatttatatatgcaca

SEQ ID NO: 7575670 - DNA, 22 bp, Homo sapiens
aacacatatttatatatgcaca

SEQ ID NO: 7575671 - DNA, 22 bp, Homo sapiens
aacacatatttatatatgcaca

SEQ ID NO: 7575672 - DNA, 22 bp, Homo sapiens
aacacatatttatatatgcaca

SEQ ID NO: 7575673 - DNA, 22 bp, Homo sapiens
aacacatatttttgctgagcat

SEQ ID NO: 7575674 - DNA, 22 bp, Homo sapiens
aacacatgaaagttggtgagta

SEQ ID NO: 7575675 - DNA, 22 bp, Homo sapiens
aacacatgaaagttggtgagta

SEQ ID NO: 7575676 - DNA, 22 bp, Homo sapiens
aacacatgaaagttggtgagta

SEQ ID NO: 7575677 - DNA, 23 bp, Homo sapiens
aacacattgctaattacattcaa

SEQ ID NO: 7575678 - DNA, 23 bp, Homo sapiens
aacacattgctaattacattcaa

SEQ ID NO: 7575679 - DNA, 23 bp, Homo sapiens
aacacattgctaattacattcaa

SEQ ID NO: 7575680 - DNA, 23 bp, Homo sapiens
aacacattgctaattacattcaa

SEQ ID NO: 7575681 - DNA, 22 bp, Homo sapiens
aacacattgccagagatcagca

SEQ ID NO: 7575682 - DNA, 22 bp, Homo sapiens
aacacatgggtgtttattgtac

SEQ ID NO: 7575683 - DNA, 22 bp, Homo sapiens
aacacatgggtgtttattgtac

SEQ ID NO: 7575684 - DNA, 22 bp, Homo sapiens
aacacatgggtgtttattgtac

SEQ ID NO: 7575685 - DNA, 22 bp, Homo sapiens
aacacattgccagagatcagca

SEQ ID NO: 7575686 - DNA, 22 bp, Homo sapiens
aacacattgccagagatcagca

SEQ ID NO: 7575687 - DNA, 22 bp, Homo sapiens
aacacattgccagagatcagca

SEQ ID NO: 7575688 - DNA, 22 bp, Homo sapiens
aacacatgccttaagaataagt

SEQ ID NO: 7575689 - DNA, 22 bp, Homo sapiens
aacacatgccttaagaataagt

SEQ ID NO: 7575690 - DNA, 22 bp, Homo sapiens
aacacatgccttaagaataagt

SEQ ID NO: 7575691 - DNA, 22 bp, Homo sapiens
aacacatgggtgtttattgtac

SEQ ID NO: 7575692 - DNA, 22 bp, Homo sapiens
aacacatggcaagagcaggaaa

SEQ ID NO: 7575693 - DNA, 22 bp, Homo sapiens
aacacatggcaagagcaggaaa

SEQ ID NO: 7575694 - DNA, 22 bp, Homo sapiens
aacagctttgagcagttctgta

SEQ ID NO: 7575695 - DNA, 22 bp, Homo sapiens
aacagctttgagcagttctgta

SEQ ID NO: 7575696 - DNA, 22 bp, Homo sapiens
aacagcagctgaggagctgggc

SEQ ID NO: 7575697 - DNA, 22 bp, Homo sapiens
aacagcagctgaggagctgggc

SEQ ID NO: 7575698 - DNA, 22 bp, Homo sapiens
aacagcttgctgcaccttaata

SEQ ID NO: 7575699 - DNA, 22 bp, Homo sapiens
aacagctttagaggataatagt

SEQ ID NO: 7575700 - DNA, 22 bp, Homo sapiens
aacagcagctgaggagctgggc

SEQ ID NO: 7575701 - DNA, 23 bp, Homo sapiens
aacacattgctaattacattcaa

SEQ ID NO: 7575702 - DNA, 23 bp, Homo sapiens
aacacattgctaattacattcaa

SEQ ID NO: 7575703 - DNA, 23 bp, Homo sapiens
aacacattgctaattacattcaa

SEQ ID NO: 7575704 - DNA, 23 bp, Homo sapiens
aacacattgctaattacattcaa

SEQ ID NO: 7575705 - DNA, 22 bp, Homo sapiens
aacacattggaagccaagaatg

SEQ ID NO: 7575706 - DNA, 22 bp, Homo sapiens
aacacattggaagccaagaatg

SEQ ID NO: 7575707 - DNA, 22 bp, Homo sapiens
aacacattggaagccaagaatg

SEQ ID NO: 7575708 - DNA, 22 bp, Homo sapiens
aacacattggaagccaagaatg

SEQ ID NO: 7575709 - DNA, 22 bp, Homo sapiens
aacagcagcatgacagctgggt

SEQ ID NO: 7575710 - DNA, 22 bp, Homo sapiens
aacagcagctgaggagctgggc

SEQ ID NO: 7575711 - DNA, 22 bp, Homo sapiens
aacagcagcatgacagctgggt

SEQ ID NO: 7575712 - DNA, 22 bp, Homo sapiens
aacagcttttttggtcagcatt

SEQ ID NO: 7575713 - DNA, 22 bp, Homo sapiens
aacagctttgtatacagtaact

SEQ ID NO: 7575714 - DNA, 22 bp, Homo sapiens
aacagctttgtgctcagatttg

SEQ ID NO: 7575715 - DNA, 22 bp, Homo sapiens
aacagcttttttggtcagcatt

SEQ ID NO: 7575716 - DNA, 22 bp, Homo sapiens
aacagcttttttggtcagcatt

SEQ ID NO: 7575717 - DNA, 22 bp, Homo sapiens
aacagcttttttggtcagcatt

SEQ ID NO: 7575718 - DNA, 22 bp, Homo sapiens
aacagctttgcttctggagaca

SEQ ID NO: 7575719 - DNA, 22 bp, Homo sapiens
aacagctttgcttctggagaca

SEQ ID NO: 7575720 - DNA, 22 bp, Homo sapiens
aacagctttgagcagttctgta

SEQ ID NO: 7575721 - DNA, 22 bp, Homo sapiens
aacagctttgtatacagtaact

SEQ ID NO: 7575722 - DNA, 22 bp, Homo sapiens
aacagctttgtatacagtaact

SEQ ID NO: 7575723 - DNA, 22 bp, Homo sapiens
aacagctttgcttctggagaca

SEQ ID NO: 7575724 - DNA, 22 bp, Homo sapiens
aacagctttgtatacagtaact

SEQ ID NO: 7575725 - DNA, 22 bp, Homo sapiens
aacagctttgcttctggagaca

SEQ ID NO: 7575726 - DNA, 22 bp, Homo sapiens
aacaacaacggagaaagggttg

SEQ ID NO: 7575727 - DNA, 22 bp, Homo sapiens
aacaaatttagctctgagtgct

SEQ ID NO: 7575728 - DNA, 22 bp, Homo sapiens
aacaaatttagctctgagtgct

SEQ ID NO: 7575729 - DNA, 22 bp, Homo sapiens
aacaaattagttgcaagactgg

SEQ ID NO: 7575730 - DNA, 22 bp, Homo sapiens
aacaaattagttgcaagactgg

SEQ ID NO: 7575731 - DNA, 22 bp, Homo sapiens
aacaaatttagctctgagtgct

SEQ ID NO: 7575732 - DNA, 22 bp, Homo sapiens
aacaaattagttgcaagactgg

SEQ ID NO: 7575733 - DNA, 22 bp, Homo sapiens
aacaaattagttgcaagactgg

SEQ ID NO: 7575734 - DNA, 22 bp, Homo sapiens
aacaaattagttgcaagactgg

SEQ ID NO: 7575735 - DNA, 22 bp, Homo sapiens
aacaaattagttgcaagactgg

SEQ ID NO: 7575736 - DNA, 22 bp, Homo sapiens
aacaaattagttgcaagactgg

SEQ ID NO: 7575737 - DNA, 22 bp, Homo sapiens
aacaaattagttgcaagactgg

SEQ ID NO: 7575738 - DNA, 22 bp, Homo sapiens
aacaaattagttgcaagactgg

SEQ ID NO: 7575739 - DNA, 22 bp, Homo sapiens
aacaaatgtgttttgtaattaa

SEQ ID NO: 7575740 - DNA, 22 bp, Homo sapiens
aacaaatgtgttttgtaattaa

SEQ ID NO: 7575741 - DNA, 22 bp, Homo sapiens
aacaaatgtgttttgtaattaa

SEQ ID NO: 7575742 - DNA, 22 bp, Homo sapiens
aacaacagctgctaaagagttg

SEQ ID NO: 7575743 - DNA, 22 bp, Homo sapiens
aacaacaacggagaaagggttg

SEQ ID NO: 7575744 - DNA, 22 bp, Homo sapiens
aacaacaacggagaaagggttg

SEQ ID NO: 7575745 - DNA, 22 bp, Homo sapiens
aacaacaacggagaaagggttg

SEQ ID NO: 7575746 - DNA, 22 bp, Homo sapiens
aacaacagtgagtgctgggagg

SEQ ID NO: 7575747 - DNA, 22 bp, Homo sapiens
aacaacagctgctaaagagttg

SEQ ID NO: 7575748 - DNA, 22 bp, Homo sapiens
aacaacagctgctaaagagttg

SEQ ID NO: 7575749 - DNA, 22 bp, Homo sapiens
aacaaccaaaaagatgaatgta

SEQ ID NO: 7575750 - DNA, 22 bp, Homo sapiens
aacaactgaaaagctttttctg

SEQ ID NO: 7575751 - DNA, 22 bp, Homo sapiens
aacaactgaaaagctttttctg

SEQ ID NO: 7575752 - DNA, 22 bp, Homo sapiens
aacaactgaaaagctttttctg

SEQ ID NO: 7575753 - DNA, 22 bp, Homo sapiens
aacaactgaaaagctttttctg

SEQ ID NO: 7575754 - DNA, 22 bp, Homo sapiens
aacaactgagcaggagtgacag

SEQ ID NO: 7575755 - DNA, 22 bp, Homo sapiens
aacaactgagcaggagtgacag

SEQ ID NO: 7575756 - DNA, 22 bp, Homo sapiens
aacaacttgcgttcagagatgt

SEQ ID NO: 7575757 - DNA, 22 bp, Homo sapiens
aacaacttgcgttcagagatgt

SEQ ID NO: 7575758 - DNA, 22 bp, Homo sapiens
aacaacttgcgttcagagatgt

SEQ ID NO: 7575759 - DNA, 22 bp, Homo sapiens
aacaacttgcgttcagagatgt

SEQ ID NO: 7575760 - DNA, 22 bp, Homo sapiens
aacaactgcttattgagtgact

SEQ ID NO: 7575761 - DNA, 22 bp, Homo sapiens
aacaactgcttattgagtgact

SEQ ID NO: 7575762 - DNA, 22 bp, Homo sapiens
aacaactgagcaggagtgacag

SEQ ID NO: 7575763 - DNA, 22 bp, Homo sapiens
aacaactgctaaggtgtgtcct

SEQ ID NO: 7575764 - DNA, 22 bp, Homo sapiens
aacaactgctaaggtgtgtcct

SEQ ID NO: 7575765 - DNA, 22 bp, Homo sapiens
aaagcacatagtagaaggattt

SEQ ID NO: 7575766 - DNA, 22 bp, Homo sapiens
aaagcacatagtagaaggattt

SEQ ID NO: 7575767 - DNA, 22 bp, Homo sapiens
aaagcacatgagtagtgtagta

SEQ ID NO: 7575768 - DNA, 22 bp, Homo sapiens
aaagcacatgagtagtgtagta

SEQ ID NO: 7575769 - DNA, 22 bp, Homo sapiens
aaagcacatgagtagtgtagta

SEQ ID NO: 7575770 - DNA, 22 bp, Homo sapiens
aaagcacatgagtagtgtagta

SEQ ID NO: 7575771 - DNA, 22 bp, Homo sapiens
aaagcacatgagtagtgtagta

SEQ ID NO: 7575772 - DNA, 22 bp, Homo sapiens
aaagcacattacaagctcagtc

SEQ ID NO: 7575773 - DNA, 22 bp, Homo sapiens
aaagcacattacaagctcagtc

SEQ ID NO: 7575774 - DNA, 22 bp, Homo sapiens
aaagcaccggggagccttggga

SEQ ID NO: 7575775 - DNA, 22 bp, Homo sapiens
aaagcacattacaagctcagtc

SEQ ID NO: 7575776 - DNA, 22 bp, Homo sapiens
aaagcacctagcatagtgctta

SEQ ID NO: 7575777 - DNA, 22 bp, Homo sapiens
aaagcactatagccaaatagcc

SEQ ID NO: 7575778 - DNA, 22 bp, Homo sapiens
aaagcacctagcatagtgctta

SEQ ID NO: 7575779 - DNA, 22 bp, Homo sapiens
aaagcaatttaatggaccatga

SEQ ID NO: 7575780 - DNA, 22 bp, Homo sapiens
aaagcaatttaatggaccatga

SEQ ID NO: 7575781 - DNA, 22 bp, Homo sapiens
aaagcaattgtggtttttgtca

SEQ ID NO: 7575782 - DNA, 22 bp, Homo sapiens
aaagcaattgtggtttttgtca

SEQ ID NO: 7575783 - DNA, 22 bp, Homo sapiens
aaagcaatttaatggaccatga

SEQ ID NO: 7575784 - DNA, 22 bp, Homo sapiens
aaagcacagagctcccacagga

SEQ ID NO: 7575785 - DNA, 22 bp, Homo sapiens
aaagcacagagctcccacagga

SEQ ID NO: 7575786 - DNA, 22 bp, Homo sapiens
aaagcacaggagagttcagtaa

SEQ ID NO: 7575787 - DNA, 22 bp, Homo sapiens
aaagcacaggagagttcagtaa

SEQ ID NO: 7575788 - DNA, 22 bp, Homo sapiens
aaagcacagggtgctagagagt

SEQ ID NO: 7575789 - DNA, 22 bp, Homo sapiens
aaagcacatagtagaaggattt

SEQ ID NO: 7575790 - DNA, 22 bp, Homo sapiens
aaagcacatagtagaaggattt

SEQ ID NO: 7575791 - DNA, 22 bp, Homo sapiens
aaagcacaggagagttcagtaa

SEQ ID NO: 7575792 - DNA, 22 bp, Homo sapiens
aaagcacaggagagttcagtaa

SEQ ID NO: 7575793 - DNA, 22 bp, Homo sapiens
aaagcacaggagagttcagtaa

SEQ ID NO: 7575794 - DNA, 22 bp, Homo sapiens
aaagcacagggtgctagagagt

SEQ ID NO: 7575795 - DNA, 22 bp, Homo sapiens
aaagcacagggtgctagagagt

SEQ ID NO: 7575796 - DNA, 22 bp, Homo sapiens
aaagcacagggtgctagagagt

SEQ ID NO: 7575797 - DNA, 22 bp, Homo sapiens
aaatggctgactaaattaaatt

SEQ ID NO: 7575798 - DNA, 22 bp, Homo sapiens
aaatggctccagttgacttttt

SEQ ID NO: 7575799 - DNA, 22 bp, Homo sapiens
aaatggctgactaaattaaatt

SEQ ID NO: 7575800 - DNA, 22 bp, Homo sapiens
aaatggctgacttttcatggga

SEQ ID NO: 7575801 - DNA, 22 bp, Homo sapiens
aaatggctgcatttgtgtaaat

SEQ ID NO: 7575802 - DNA, 19 bp, Homo sapiens
aaatggctttctacttaat

SEQ ID NO: 7575803 - DNA, 19 bp, Homo sapiens
aaatggctttctacttaat

SEQ ID NO: 7575804 - DNA, 23 bp, Homo sapiens
aaatggcttgccctctcgtttgg

SEQ ID NO: 7575805 - DNA, 22 bp, Homo sapiens
aaatgggcctggaaagaggatg

SEQ ID NO: 7575806 - DNA, 22 bp, Homo sapiens
aaatgggtttgattctcagcca

SEQ ID NO: 7575807 - DNA, 22 bp, Homo sapiens
aaatggctttgagggtaggaca

SEQ ID NO: 7575808 - DNA, 22 bp, Homo sapiens
aaatggtccatcctaaagaagt

SEQ ID NO: 7575809 - DNA, 22 bp, Homo sapiens
aaatggtccatcctaaagaagt

SEQ ID NO: 7575810 - DNA, 22 bp, Homo sapiens
aaatggtatgaaaagagatttc

SEQ ID NO: 7575811 - DNA, 22 bp, Homo sapiens
aaatggtatttactctgtatta

SEQ ID NO: 7575812 - DNA, 22 bp, Homo sapiens
aaatggtatttactctgtatta

SEQ ID NO: 7575813 - DNA, 22 bp, Homo sapiens
aaatggtatgaaaagagatttc

SEQ ID NO: 7575814 - DNA, 22 bp, Homo sapiens
aaatggtataatgtcatgtatt

SEQ ID NO: 7575815 - DNA, 22 bp, Homo sapiens
aaatggtataatgtcatgtatt

SEQ ID NO: 7575816 - DNA, 22 bp, Homo sapiens
aaatggtataatgtcatgtatt

SEQ ID NO: 7575817 - DNA, 22 bp, Homo sapiens
aaatggtaatgtctttctgttt

SEQ ID NO: 7575818 - DNA, 22 bp, Homo sapiens
aaatggtaagacaacacattat

SEQ ID NO: 7575819 - DNA, 22 bp, Homo sapiens
aaatggtaagacaacacattat

SEQ ID NO: 7575820 - DNA, 22 bp, Homo sapiens
aaatggtaccctaatggccaga

SEQ ID NO: 7575821 - DNA, 22 bp, Homo sapiens
aaatggtaggttttcttaagaa

SEQ ID NO: 7575822 - DNA, 22 bp, Homo sapiens
aaatggtaggttttcttaagaa

SEQ ID NO: 7575823 - DNA, 22 bp, Homo sapiens
aaatggtagtagcattccatat

SEQ ID NO: 7575824 - DNA, 22 bp, Homo sapiens
aaatggtagtagcattccatat

SEQ ID NO: 7575825 - DNA, 22 bp, Homo sapiens
aaatggtaaattagtagtagct

SEQ ID NO: 7575826 - DNA, 22 bp, Homo sapiens
aaatggtaccctaatggccaga

SEQ ID NO: 7575827 - DNA, 22 bp, Homo sapiens
aaatggtgaagtgtaatttagc

SEQ ID NO: 7575828 - DNA, 17 bp, Homo sapiens
aaatggtcctagggatt

SEQ ID NO: 7575829 - DNA, 22 bp, Homo sapiens
aaagcaatagagggtaagactg

SEQ ID NO: 7575830 - DNA, 22 bp, Homo sapiens
aaagcaagtctctacaaagtac

SEQ ID NO: 7575831 - DNA, 22 bp, Homo sapiens
aaagcaagtctctacaaagtac

SEQ ID NO: 7575832 - DNA, 22 bp, Homo sapiens
aaagcaatgggtctaaggtaaa

SEQ ID NO: 7575833 - DNA, 22 bp, Homo sapiens
aaagcaatgggtctaaggtaaa

SEQ ID NO: 7575834 - DNA, 22 bp, Homo sapiens
aaagcaatggcacatgatggta

SEQ ID NO: 7575835 - DNA, 22 bp, Homo sapiens
aaagcaatggcacatgatggta

SEQ ID NO: 7575836 - DNA, 22 bp, Homo sapiens
aaagcaatagagggtaagactg

SEQ ID NO: 7575837 - DNA, 22 bp, Homo sapiens
aaagcaatagagggtaagactg

SEQ ID NO: 7575838 - DNA, 22 bp, Homo sapiens
aaagcaatagagggtaagactg

SEQ ID NO: 7575839 - DNA, 22 bp, Homo sapiens
aaagcaatagagggtaagactg

SEQ ID NO: 7575840 - DNA, 22 bp, Homo sapiens
aaagcaatagagggtaagactg

SEQ ID NO: 7575841 - DNA, 22 bp, Homo sapiens
aaagcaattgtggtttttgcca

SEQ ID NO: 7575842 - DNA, 22 bp, Homo sapiens
aaagcaattgtggtttttgcca

SEQ ID NO: 7575843 - DNA, 22 bp, Homo sapiens
aaagcaattgtggtttttgtca

SEQ ID NO: 7575844 - DNA, 22 bp, Homo sapiens
aaagcaattgtggtttttgtca

SEQ ID NO: 7575845 - DNA, 22 bp, Homo sapiens
aaagcaattgtggtttttgcca

SEQ ID NO: 7575846 - DNA, 22 bp, Homo sapiens
aaagcaattacaaaagggataa

SEQ ID NO: 7575847 - DNA, 22 bp, Homo sapiens
aaagcaattacaaaagggataa

SEQ ID NO: 7575848 - DNA, 22 bp, Homo sapiens
aaagcaattgtggtttttgcca

SEQ ID NO: 7575849 - DNA, 22 bp, Homo sapiens
aaagcaatgggtctaaggtaaa

SEQ ID NO: 7575850 - DNA, 22 bp, Homo sapiens
aaagcaatgggtctaaggtaaa

SEQ ID NO: 7575851 - DNA, 22 bp, Homo sapiens
aaagcaatgggtctaaggtaaa

SEQ ID NO: 7575852 - DNA, 22 bp, Homo sapiens
aaagcaatgtctctgcctggtt

SEQ ID NO: 7575853 - DNA, 22 bp, Homo sapiens
aaagcaatgtctctgcctggtt

SEQ ID NO: 7575854 - DNA, 22 bp, Homo sapiens
aaagcaatgtctctgcctggtt

SEQ ID NO: 7575855 - DNA, 22 bp, Homo sapiens
aaagcaatgtctctgcctggtt

SEQ ID NO: 7575856 - DNA, 22 bp, Homo sapiens
aaagcaattacaaaagggataa

SEQ ID NO: 7575857 - DNA, 22 bp, Homo sapiens
aaagcaattacaaaagggataa

SEQ ID NO: 7575858 - DNA, 22 bp, Homo sapiens
aagccaatgctagcccacatgc

SEQ ID NO: 7575859 - DNA, 22 bp, Homo sapiens
aagccaatgatacgggtgatct

SEQ ID NO: 7575860 - DNA, 23 bp, Homo sapiens
aagcatggttcacagttagtact

SEQ ID NO: 7575861 - DNA, 22 bp, Homo sapiens
aagcatggtggatgatacagtg

SEQ ID NO: 7575862 - DNA, 23 bp, Homo sapiens
aagcatggttcacagttagtact

SEQ ID NO: 7575863 - DNA, 22 bp, Homo sapiens
aagccaatgagagaggcctcag

SEQ ID NO: 7575864 - DNA, 22 bp, Homo sapiens
aagcatggtggatgatacagtg

SEQ ID NO: 7575865 - DNA, 22 bp, Homo sapiens
aagcagcagcaggattaaagag

SEQ ID NO: 7575866 - DNA, 22 bp, Homo sapiens
aagcagcagccatcccccaagg

SEQ ID NO: 7575867 - DNA, 22 bp, Homo sapiens
aagcagcagccatcccccaagg

SEQ ID NO: 7575868 - DNA, 22 bp, Homo sapiens
aagcagcagcctgaagtacgtc

SEQ ID NO: 7575869 - DNA, 22 bp, Homo sapiens
aagcagcagcctgaagtacgtc

SEQ ID NO: 7575870 - DNA, 22 bp, Homo sapiens
aagcagcataattgctatttta

SEQ ID NO: 7575871 - DNA, 22 bp, Homo sapiens
aagcagcataattgctatttta

SEQ ID NO: 7575872 - DNA, 22 bp, Homo sapiens
aagcatggtggatgatacagtg

SEQ ID NO: 7575873 - DNA, 19 bp, Homo sapiens
aagcatggtgcctcacctc

SEQ ID NO: 7575874 - DNA, 22 bp, Homo sapiens
aagcagcatagctcccttagtt

SEQ ID NO: 7575875 - DNA, 22 bp, Homo sapiens
aagcagcagcaggattaaagag

SEQ ID NO: 7575876 - DNA, 22 bp, Homo sapiens
aagcagcagcaggattaaagag

SEQ ID NO: 7575877 - DNA, 22 bp, Homo sapiens
aagcagcagcaggattaaagag

SEQ ID NO: 7575878 - DNA, 22 bp, Homo sapiens
aagcagcagacctgattttgaa

SEQ ID NO: 7575879 - DNA, 22 bp, Homo sapiens
aagcagcagacctgattttgaa

SEQ ID NO: 7575880 - DNA, 22 bp, Homo sapiens
aagcagcagcaggattaaagag

SEQ ID NO: 7575881 - DNA, 22 bp, Homo sapiens
aagcagcagacctgattttgaa

SEQ ID NO: 7575882 - DNA, 22 bp, Homo sapiens
aagcagcagacctgattttgaa

SEQ ID NO: 7575883 - DNA, 22 bp, Homo sapiens
aagcagcacgctttgccaacaa

SEQ ID NO: 7575884 - DNA, 22 bp, Homo sapiens
aagcagcacgctttgccaacaa

SEQ ID NO: 7575885 - DNA, 22 bp, Homo sapiens
aagcagcacagtaatattggtg

SEQ ID NO: 7575886 - DNA, 22 bp, Homo sapiens
aagcagcacgctttgccaacaa

SEQ ID NO: 7575887 - DNA, 22 bp, Homo sapiens
aagcagcacgctttgccaacaa

SEQ ID NO: 7575888 - DNA, 22 bp, Homo sapiens
aagcagcacagtaatattggtg

SEQ ID NO: 7575889 - DNA, 22 bp, Homo sapiens
aagcagcacagtaatattggtg

SEQ ID NO: 7575890 - DNA, 22 bp, Homo sapiens
aagcagcacagtaatattggtg

SEQ ID NO: 7575891 - DNA, 22 bp, Homo sapiens
aagcagcacagcaatgactcta

SEQ ID NO: 7575892 - DNA, 22 bp, Homo sapiens
aagcagcacagcaatgactcta

SEQ ID NO: 7575893 - DNA, 15 bp, Homo sapiens
aagcagcaatatata

SEQ ID NO: 7575894 - DNA, 22 bp, Homo sapiens
aagccagagtttttgagaactt

SEQ ID NO: 7575895 - DNA, 22 bp, Homo sapiens
aagccagagtttttgagaactt

SEQ ID NO: 7575896 - DNA, 22 bp, Homo sapiens
aagccagagtttttgagaactt

SEQ ID NO: 7575897 - DNA, 22 bp, Homo sapiens
aagccacttggggaaagatgga

SEQ ID NO: 7575898 - DNA, 22 bp, Homo sapiens
aagccactttcagctgtctcag

SEQ ID NO: 7575899 - DNA, 22 bp, Homo sapiens
aagccactttcagctgtctcag

SEQ ID NO: 7575900 - DNA, 18 bp, Homo sapiens
aagccagagaccactgcc

SEQ ID NO: 7575901 - DNA, 18 bp, Homo sapiens
aagccagagaccactgcc

SEQ ID NO: 7575902 - DNA, 22 bp, Homo sapiens
aagccacttggggaaagatgga

SEQ ID NO: 7575903 - DNA, 22 bp, Homo sapiens
aagccacttggggaaagatgga

SEQ ID NO: 7575904 - DNA, 22 bp, Homo sapiens
aagccagatagaagaactcatt

SEQ ID NO: 7575905 - DNA, 22 bp, Homo sapiens
aagccagagtttttgagaactt

SEQ ID NO: 7575906 - DNA, 22 bp, Homo sapiens
aagccagattccttaagcacag

SEQ ID NO: 7575907 - DNA, 22 bp, Homo sapiens
aagccagattccttaagcacag

SEQ ID NO: 7575908 - DNA, 22 bp, Homo sapiens
aagccagatcaaagtgtccagg

SEQ ID NO: 7575909 - DNA, 22 bp, Homo sapiens
aagccagatcaaagtgtccagg

SEQ ID NO: 7575910 - DNA, 22 bp, Homo sapiens
aagccagattccttaagcacag

SEQ ID NO: 7575911 - DNA, 22 bp, Homo sapiens
aagccaatggattggttgcttt

SEQ ID NO: 7575912 - DNA, 22 bp, Homo sapiens
aagccaatgttgcctgggtttc

SEQ ID NO: 7575913 - DNA, 22 bp, Homo sapiens
aagccactatggtgattctcaa

SEQ ID NO: 7575914 - DNA, 22 bp, Homo sapiens
aagccacagatcgttctgtcac

SEQ ID NO: 7575915 - DNA, 22 bp, Homo sapiens
aagccaccctggctgcacatgc

SEQ ID NO: 7575916 - DNA, 22 bp, Homo sapiens
aagccacagatcgttctgtcac

SEQ ID NO: 7575917 - DNA, 22 bp, Homo sapiens
aagccacagatcgttctgtcac

SEQ ID NO: 7575918 - DNA, 22 bp, Homo sapiens
aagccacaatctgcatcagcat

SEQ ID NO: 7575919 - DNA, 22 bp, Homo sapiens
aagccacaatctgcatcagcat

SEQ ID NO: 7575920 - DNA, 22 bp, Homo sapiens
aagccactgcagcaggagctgc

SEQ ID NO: 7575921 - DNA, 22 bp, Homo sapiens
aagccactgcagcaggagctgc

SEQ ID NO: 7575922 - DNA, 22 bp, Homo sapiens
aagccactgagatttcactgca

SEQ ID NO: 7575923 - DNA, 22 bp, Homo sapiens
aagccactgagatttcactgca

SEQ ID NO: 7575924 - DNA, 22 bp, Homo sapiens
aagccactgcagcaggagctgc

SEQ ID NO: 7575925 - DNA, 22 bp, Homo sapiens
aagccactgttttggagtgctt

SEQ ID NO: 7575926 - DNA, 22 bp, Homo sapiens
aagccactgttttggagtgctt

SEQ ID NO: 7575927 - DNA, 22 bp, Homo sapiens
aagccactgcggtttcccatcc

SEQ ID NO: 7575928 - DNA, 22 bp, Homo sapiens
aagccactgcggtttcccatcc

SEQ ID NO: 7575929 - DNA, 22 bp, Homo sapiens
aagccactattaaataatgatt

SEQ ID NO: 7575930 - DNA, 22 bp, Homo sapiens
aagccactattaaataatgatt

SEQ ID NO: 7575931 - DNA, 22 bp, Homo sapiens
aagccactatggtgattctcaa

SEQ ID NO: 7575932 - DNA, 22 bp, Homo sapiens
aagccactatggtgattctcaa

SEQ ID NO: 7575933 - DNA, 22 bp, Homo sapiens
aagccactgagatttcactgca

SEQ ID NO: 7575934 - DNA, 22 bp, Homo sapiens
aagccactcacaataactgtcc

SEQ ID NO: 7575935 - DNA, 22 bp, Homo sapiens
aagccactcacaataactgtcc

SEQ ID NO: 7575936 - DNA, 22 bp, Homo sapiens
aagccactcacaataactgtcc

SEQ ID NO: 7575937 - DNA, 22 bp, Homo sapiens
aagcagagttagcttgtcacct

SEQ ID NO: 7575938 - DNA, 22 bp, Homo sapiens
aagcagagttagcttgtcacct

SEQ ID NO: 7575939 - DNA, 22 bp, Homo sapiens
aagcagagttagcttgtcacct

SEQ ID NO: 7575940 - DNA, 22 bp, Homo sapiens
aagcagaactgggaagtagtgg

SEQ ID NO: 7575941 - DNA, 22 bp, Homo sapiens
aagcagagttagcttgtcacct

SEQ ID NO: 7575942 - DNA, 22 bp, Homo sapiens
aagcagaactgggaagtagtgg

SEQ ID NO: 7575943 - DNA, 22 bp, Homo sapiens
aagcagaactgggaagtagtgg

SEQ ID NO: 7575944 - DNA, 22 bp, Homo sapiens
aagcagaactgggaagtagtgg

SEQ ID NO: 7575945 - DNA, 22 bp, Homo sapiens
aagcagaactgggaagtagtgg

SEQ ID NO: 7575946 - DNA, 22 bp, Homo sapiens
aagcagaaagaacaactgagtg

SEQ ID NO: 7575947 - DNA, 22 bp, Homo sapiens
aagcagaaagaacaactgagtg

SEQ ID NO: 7575948 - DNA, 22 bp, Homo sapiens
aagcagaaagaacaactgagtg

SEQ ID NO: 7575949 - DNA, 22 bp, Homo sapiens
aagcagaaagaacaactgagtg

SEQ ID NO: 7575950 - DNA, 22 bp, Homo sapiens
aagcagaaagaacaactgagtg

SEQ ID NO: 7575951 - DNA, 22 bp, Homo sapiens
aagcagaaaaactgagctccaa

SEQ ID NO: 7575952 - DNA, 22 bp, Homo sapiens
aagcagaaagaacaactgagtg

SEQ ID NO: 7575953 - DNA, 22 bp, Homo sapiens
aagcagaaagaacaactgagtg

SEQ ID NO: 7575954 - DNA, 22 bp, Homo sapiens
aagcagaaagaacaactgagtg

SEQ ID NO: 7575955 - DNA, 22 bp, Homo sapiens
aagcagaaagaacaactgagtg

SEQ ID NO: 7575956 - DNA, 22 bp, Homo sapiens
aagcagaaagaacaactgagtg

SEQ ID NO: 7575957 - DNA, 22 bp, Homo sapiens
aagcagaaaaactgagctccaa

SEQ ID NO: 7575958 - DNA, 22 bp, Homo sapiens
aagcagaaaaactgagctccaa

SEQ ID NO: 7575959 - DNA, 22 bp, Homo sapiens
aagcactttatgtcaatgtcct

SEQ ID NO: 7575960 - DNA, 22 bp, Homo sapiens
aagcagaaaaactgagctccaa

SEQ ID NO: 7575961 - DNA, 22 bp, Homo sapiens
aagcagaaaaactgagctccaa

SEQ ID NO: 7575962 - DNA, 22 bp, Homo sapiens
aagcactttatgtcaatgtcct

SEQ ID NO: 7575963 - DNA, 22 bp, Homo sapiens
aagcactttatgtcaatgtcct

SEQ ID NO: 7575964 - DNA, 22 bp, Homo sapiens
aagcagatattgtgggagtggg

SEQ ID NO: 7575965 - DNA, 22 bp, Homo sapiens
aagcagatgcagctaataaagc

SEQ ID NO: 7575966 - DNA, 22 bp, Homo sapiens
aagcagatgcagctaataaagc

SEQ ID NO: 7575967 - DNA, 22 bp, Homo sapiens
aagcagatgggactccaaggca

SEQ ID NO: 7575968 - DNA, 22 bp, Homo sapiens
aagcagatgggactccaaggca

SEQ ID NO: 7575969 - DNA, 22 bp, Homo sapiens
aagcagatgccaagatttacca

SEQ ID NO: 7575970 - DNA, 22 bp, Homo sapiens
aagcagatgccaagatttacca

SEQ ID NO: 7575971 - DNA, 22 bp, Homo sapiens
aagcagcaacaaactggataaa

SEQ ID NO: 7575972 - DNA, 22 bp, Homo sapiens
aagcagcaacaaactggataaa

SEQ ID NO: 7575973 - DNA, 22 bp, Homo sapiens
aagcagcaagtttatttctatc

SEQ ID NO: 7575974 - DNA, 22 bp, Homo sapiens
aagcagcaagtttatttctatc

SEQ ID NO: 7575975 - DNA, 22 bp, Homo sapiens
aagcagcaagtttatttctatc

SEQ ID NO: 7575976 - DNA, 22 bp, Homo sapiens
aagcagcaacaaactggataaa

SEQ ID NO: 7575977 - DNA, 22 bp, Homo sapiens
aagcagcaacaaactggataaa

SEQ ID NO: 7575978 - DNA, 22 bp, Homo sapiens
aagcagcaacaaactggataaa

SEQ ID NO: 7575979 - DNA, 22 bp, Homo sapiens
aagcagattggggatttccatg

SEQ ID NO: 7575980 - DNA, 22 bp, Homo sapiens
aagcagattggggatttccatg

SEQ ID NO: 7575981 - DNA, 22 bp, Homo sapiens
aagcactgggtatagcaatgat

SEQ ID NO: 7575982 - DNA, 22 bp, Homo sapiens
aagcactggggccacagacacg

SEQ ID NO: 7575983 - DNA, 22 bp, Homo sapiens
aagcactgggtatagcaatgat

SEQ ID NO: 7575984 - DNA, 22 bp, Homo sapiens
aagcactgtacaaatgtcactt

SEQ ID NO: 7575985 - DNA, 22 bp, Homo sapiens
aagcactgtacaaatgtcactt

SEQ ID NO: 7575986 - DNA, 22 bp, Homo sapiens
aagcactgtgcctcatatctga

SEQ ID NO: 7575987 - DNA, 22 bp, Homo sapiens
aagcactgtacaaatgtcactt

SEQ ID NO: 7575988 - DNA, 22 bp, Homo sapiens
aagcactgtgcctcatatctga

SEQ ID NO: 7575989 - DNA, 22 bp, Homo sapiens
aagcactgtgcctcatatctga

SEQ ID NO: 7575990 - DNA, 22 bp, Homo sapiens
aagcactttagtgagaataagg

SEQ ID NO: 7575991 - DNA, 20 bp, Homo sapiens
aagcactgtggtggcatgga

SEQ ID NO: 7575992 - DNA, 20 bp, Homo sapiens
aagcactgtggtggcatgga

SEQ ID NO: 7575993 - DNA, 20 bp, Homo sapiens
aagcactgtggtggcatgga

SEQ ID NO: 7575994 - DNA, 20 bp, Homo sapiens
aagcactgtggtggcatgga

SEQ ID NO: 7575995 - DNA, 22 bp, Homo sapiens
aagcactgggaggaggctgaga

SEQ ID NO: 7575996 - DNA, 22 bp, Homo sapiens
aagcactgggaggaggctgaga

SEQ ID NO: 7575997 - DNA, 22 bp, Homo sapiens
aagcactgggaggaggctgaga

SEQ ID NO: 7575998 - DNA, 22 bp, Homo sapiens
aagcactggggccacagacacg

SEQ ID NO: 7575999 - DNA, 22 bp, Homo sapiens
aagcactggggccacagacacg

SEQ ID NO: 7576000 - DNA, 22 bp, Homo sapiens
aagcactgaggaaaaatttgat

SEQ ID NO: 7576001 - DNA, 22 bp, Homo sapiens
aagcactgaggaaaaatttgat

SEQ ID NO: 7576002 - DNA, 22 bp, Homo sapiens
aagcactggagatgccagagtg

SEQ ID NO: 7576003 - DNA, 22 bp, Homo sapiens
aagcactggagatgccagagtg

SEQ ID NO: 7576004 - DNA, 22 bp, Homo sapiens
aagcactggagatgccagagtg

SEQ ID NO: 7576005 - DNA, 22 bp, Homo sapiens
aagcactgagcacagtggctga

SEQ ID NO: 7576006 - DNA, 22 bp, Homo sapiens
aagcactgagcacagtggctga

SEQ ID NO: 7576007 - DNA, 22 bp, Homo sapiens
aagcactgagcacagtggctga

SEQ ID NO: 7576008 - DNA, 22 bp, Homo sapiens
aagcactaatattttggcacct

SEQ ID NO: 7576009 - DNA, 22 bp, Homo sapiens
aagcacctgggttatatcttag

SEQ ID NO: 7576010 - DNA, 22 bp, Homo sapiens
aagcactaggacttcagtctct

SEQ ID NO: 7576011 - DNA, 22 bp, Homo sapiens
aagcactgagcacagtggctga

SEQ ID NO: 7576012 - DNA, 22 bp, Homo sapiens
aagcactaggtcacacaagtta

SEQ ID NO: 7576013 - DNA, 22 bp, Homo sapiens
aaatatcatttataacttttaa

SEQ ID NO: 7576014 - DNA, 22 bp, Homo sapiens
aaatatcatttataacttttaa

SEQ ID NO: 7576015 - DNA, 22 bp, Homo sapiens
aaatatcatttataacttttaa

SEQ ID NO: 7576016 - DNA, 22 bp, Homo sapiens
aaatatcatttataacttttaa

SEQ ID NO: 7576017 - DNA, 22 bp, Homo sapiens
aaatatcatttataacttttaa

SEQ ID NO: 7576018 - DNA, 22 bp, Homo sapiens
aaatatcatttataacttttaa

SEQ ID NO: 7576019 - DNA, 22 bp, Homo sapiens
aaatatcatttataacttttaa

SEQ ID NO: 7576020 - DNA, 22 bp, Homo sapiens
aaatatcatttataacttttaa

SEQ ID NO: 7576021 - DNA, 22 bp, Homo sapiens
aaatatcattctggtgcacaga

SEQ ID NO: 7576022 - DNA, 22 bp, Homo sapiens
aaatatcattctggtgcacaga

SEQ ID NO: 7576023 - DNA, 22 bp, Homo sapiens
aaatatcattctggtgcacaga

SEQ ID NO: 7576024 - DNA, 22 bp, Homo sapiens
aaatatcattctggtgcacaga

SEQ ID NO: 7576025 - DNA, 22 bp, Homo sapiens
aaatatcattctggtgcacaga

SEQ ID NO: 7576026 - DNA, 22 bp, Homo sapiens
aaatatcattctggtgcacaga

SEQ ID NO: 7576027 - DNA, 22 bp, Homo sapiens
aaatatcattctggtgcacaga

SEQ ID NO: 7576028 - DNA, 22 bp, Homo sapiens
aaatatcattctggtgcacaga

SEQ ID NO: 7576029 - DNA, 22 bp, Homo sapiens
aaatatcattctggtgcacaga

SEQ ID NO: 7576030 - DNA, 19 bp, Homo sapiens
aaatatcagagagatgata

SEQ ID NO: 7576031 - DNA, 19 bp, Homo sapiens
aaatatcagagagatgata

SEQ ID NO: 7576032 - DNA, 22 bp, Homo sapiens
aagcaactgttgaattggacta

SEQ ID NO: 7576033 - DNA, 22 bp, Homo sapiens
aagcaactgttgaattggacta

SEQ ID NO: 7576034 - DNA, 19 bp, Homo sapiens
aaatatcagagagatgata

SEQ ID NO: 7576035 - DNA, 22 bp, Homo sapiens
aagcaactggctcattgtctca

SEQ ID NO: 7576036 - DNA, 22 bp, Homo sapiens
aagcaactgttgaattggacta

SEQ ID NO: 7576037 - DNA, 22 bp, Homo sapiens
aagcaactgttgaattggacta

SEQ ID NO: 7576038 - DNA, 22 bp, Homo sapiens
aagcaactgccttcaatattta

SEQ ID NO: 7576039 - DNA, 22 bp, Homo sapiens
aagcaactggctcattgtctca

SEQ ID NO: 7576040 - DNA, 22 bp, Homo sapiens
aagcaactggctcattgtctca

SEQ ID NO: 7576041 - DNA, 22 bp, Homo sapiens
aagcaacattctctgtggcatt

SEQ ID NO: 7576042 - DNA, 22 bp, Homo sapiens
aagcaacagaaacattctaata

SEQ ID NO: 7576043 - DNA, 22 bp, Homo sapiens
aagcaacattctctgtggcatt

SEQ ID NO: 7576044 - DNA, 22 bp, Homo sapiens
aagcaacattctctgtggcatt

SEQ ID NO: 7576045 - DNA, 22 bp, Homo sapiens
aagcaacattctctgtggcatt

SEQ ID NO: 7576046 - DNA, 22 bp, Homo sapiens
aagcaactaaggcaaggaaatg

SEQ ID NO: 7576047 - DNA, 22 bp, Homo sapiens
aagcaactaaggcaaggaaatg

SEQ ID NO: 7576048 - DNA, 22 bp, Homo sapiens
aagcaactgccttcaatattta

SEQ ID NO: 7576049 - DNA, 22 bp, Homo sapiens
aagcaactccctcctcattttt

SEQ ID NO: 7576050 - DNA, 22 bp, Homo sapiens
aagcaactcctaggaggaaagg

SEQ ID NO: 7576051 - DNA, 22 bp, Homo sapiens
aagcaactccctcctcattttt

SEQ ID NO: 7576052 - DNA, 22 bp, Homo sapiens
aagcaactccctcctcattttt

SEQ ID NO: 7576053 - DNA, 22 bp, Homo sapiens
aagcacctgggttatatcttag

SEQ ID NO: 7576054 - DNA, 22 bp, Homo sapiens
aagcaccttccagatttgcacg

SEQ ID NO: 7576055 - DNA, 22 bp, Homo sapiens
aagcacctgggttatatcttag

SEQ ID NO: 7576056 - DNA, 22 bp, Homo sapiens
aagcacctgcagttgacaaaaa

SEQ ID NO: 7576057 - DNA, 22 bp, Homo sapiens
aagcacctgcagttgacaaaaa

SEQ ID NO: 7576058 - DNA, 22 bp, Homo sapiens
aagcacagctggaacagcagga

SEQ ID NO: 7576059 - DNA, 22 bp, Homo sapiens
aagcacctgcaccggtcgcctt

SEQ ID NO: 7576060 - DNA, 22 bp, Homo sapiens
aagcacagctggaacagcagga

SEQ ID NO: 7576061 - DNA, 22 bp, Homo sapiens
aaatatgactagaatgccaggt

SEQ ID NO: 7576062 - DNA, 22 bp, Homo sapiens
aaatatgactagaatgccaggt

SEQ ID NO: 7576063 - DNA, 22 bp, Homo sapiens
aaatatgactagaatgccaggt

SEQ ID NO: 7576064 - DNA, 22 bp, Homo sapiens
aaatatgactagaatgccaggt

SEQ ID NO: 7576065 - DNA, 22 bp, Homo sapiens
aagcacagctggaacagcagga

SEQ ID NO: 7576066 - DNA, 22 bp, Homo sapiens
aagcacagctggaacagcagga

SEQ ID NO: 7576067 - DNA, 22 bp, Homo sapiens
aagcacagctggaacagcagga

SEQ ID NO: 7576068 - DNA, 22 bp, Homo sapiens
aagcacagctggaacagcagga

SEQ ID NO: 7576069 - DNA, 22 bp, Homo sapiens
aaatatgaatgataagagttat

SEQ ID NO: 7576070 - DNA, 22 bp, Homo sapiens
aaatatcttaggagtatatgag

SEQ ID NO: 7576071 - DNA, 22 bp, Homo sapiens
aaatatcttaggagtatatgag

SEQ ID NO: 7576072 - DNA, 22 bp, Homo sapiens
aaatatcttaggagtatatgag

SEQ ID NO: 7576073 - DNA, 22 bp, Homo sapiens
aaatatcttaggagtatatgag

SEQ ID NO: 7576074 - DNA, 22 bp, Homo sapiens
aaatatcttaggagtatatgag

SEQ ID NO: 7576075 - DNA, 22 bp, Homo sapiens
aaatatccataagcacatctat

SEQ ID NO: 7576076 - DNA, 22 bp, Homo sapiens
aaatatccataagcacatctat

SEQ ID NO: 7576077 - DNA, 22 bp, Homo sapiens
aaatatcctcagggcagaggtg

SEQ ID NO: 7576078 - DNA, 22 bp, Homo sapiens
aaatatcctcagggcagaggtg

SEQ ID NO: 7576079 - DNA, 22 bp, Homo sapiens
aaatatccataagcacatctat

SEQ ID NO: 7576080 - DNA, 22 bp, Homo sapiens
aaatatccataagcacatctat

SEQ ID NO: 7576081 - DNA, 22 bp, Homo sapiens
aaatatgaatgataagagttat

SEQ ID NO: 7576082 - DNA, 22 bp, Homo sapiens
aaatatgaatgataagagttat

SEQ ID NO: 7576083 - DNA, 17 bp, Homo sapiens
aaatatgacctcaaagt

SEQ ID NO: 7576084 - DNA, 17 bp, Homo sapiens
aaatatgacctcaaagt

SEQ ID NO: 7576085 - DNA, 17 bp, Homo sapiens
aaatatgacctcaaagt

SEQ ID NO: 7576086 - DNA, 17 bp, Homo sapiens
aaatatgacctcaaagt

SEQ ID NO: 7576087 - DNA, 22 bp, Homo sapiens
aaatatgaatgataagagttat

SEQ ID NO: 7576088 - DNA, 22 bp, Homo sapiens
aaatatgaatgataagagttat

SEQ ID NO: 7576089 - DNA, 22 bp, Homo sapiens
aaatatcttaggagtatatgag

SEQ ID NO: 7576090 - DNA, 22 bp, Homo sapiens
aaatatgaatgataagagttat

SEQ ID NO: 7576091 - DNA, 22 bp, Homo sapiens
aaatatgaatgataagagttat

SEQ ID NO: 7576092 - DNA, 22 bp, Homo sapiens
aagcaaatgtgggtgcagaatt

SEQ ID NO: 7576093 - DNA, 22 bp, Homo sapiens
aagcaaatgtgggtgcagaatt

SEQ ID NO: 7576094 - DNA, 22 bp, Homo sapiens
aagcaaatgtgggtgcagaatt

SEQ ID NO: 7576095 - DNA, 22 bp, Homo sapiens
aagcaaatgtgggtgcagaatt

SEQ ID NO: 7576096 - DNA, 22 bp, Homo sapiens
aagcaaatatttctagagactg

SEQ ID NO: 7576097 - DNA, 22 bp, Homo sapiens
aagcaaatatttctagagactg

SEQ ID NO: 7576098 - DNA, 22 bp, Homo sapiens
aagcaaatatttctagagactg

SEQ ID NO: 7576099 - DNA, 22 bp, Homo sapiens
aagcaaatgaaccagaggtaat

SEQ ID NO: 7576100 - DNA, 22 bp, Homo sapiens
aagcaaatgaaccagaggtaat

SEQ ID NO: 7576101 - DNA, 22 bp, Homo sapiens
aagcaaatgaaccagaggtaat

SEQ ID NO: 7576102 - DNA, 22 bp, Homo sapiens
aagcaaattctggaggtgaggt

SEQ ID NO: 7576103 - DNA, 22 bp, Homo sapiens
aagcaaattctggaggtgaggt

SEQ ID NO: 7576104 - DNA, 22 bp, Homo sapiens
aagcaaattctggaggtgaggt

SEQ ID NO: 7576105 - DNA, 22 bp, Homo sapiens
aagcaaatgtgggtgcagaatt

SEQ ID NO: 7576106 - DNA, 22 bp, Homo sapiens
aagcaacagaaacattctaata

SEQ ID NO: 7576107 - DNA, 22 bp, Homo sapiens
aagcaacagaaacattctaata

SEQ ID NO: 7576108 - DNA, 22 bp, Homo sapiens
aagcaacagaaacattctaata

SEQ ID NO: 7576109 - DNA, 22 bp, Homo sapiens
aagcaaagagtttagtgggtga

SEQ ID NO: 7576110 - DNA, 22 bp, Homo sapiens
aagcaaagagtttagtgggtga

SEQ ID NO: 7576111 - DNA, 22 bp, Homo sapiens
aagcaaagagataaccttttgg

SEQ ID NO: 7576112 - DNA, 22 bp, Homo sapiens
aagcaaagagtttagtgggtga

SEQ ID NO: 7576113 - DNA, 22 bp, Homo sapiens
aagcaaagagtttagtgggtga

SEQ ID NO: 7576114 - DNA, 22 bp, Homo sapiens
aagcaaaggcaggagcttgtga

SEQ ID NO: 7576115 - DNA, 22 bp, Homo sapiens
aagcaaaggaaagctgactttt

SEQ ID NO: 7576116 - DNA, 22 bp, Homo sapiens
aagcaaaggaaagctgactttt

SEQ ID NO: 7576117 - DNA, 22 bp, Homo sapiens
aagcaaaggaaagctgactttt

SEQ ID NO: 7576118 - DNA, 22 bp, Homo sapiens
aagcaaagtgaattttgccaag

SEQ ID NO: 7576119 - DNA, 22 bp, Homo sapiens
aagcaaagtgaattttgccaag

SEQ ID NO: 7576120 - DNA, 22 bp, Homo sapiens
aagcaaagtgaattttgccaag

SEQ ID NO: 7576121 - DNA, 22 bp, Homo sapiens
aagcaaagtgctttgcctccag

SEQ ID NO: 7576122 - DNA, 22 bp, Homo sapiens
aagcaaagtgctttgcctccag

SEQ ID NO: 7576123 - DNA, 22 bp, Homo sapiens
aagcaaagtgctttgcctccag

SEQ ID NO: 7576124 - DNA, 22 bp, Homo sapiens
aagcaaaggaaagctgactttt

SEQ ID NO: 7576125 - DNA, 22 bp, Homo sapiens
aagcaaaggcaggagcttgtga

SEQ ID NO: 7576126 - DNA, 22 bp, Homo sapiens
aagcaaaggcaggagcttgtga

SEQ ID NO: 7576127 - DNA, 22 bp, Homo sapiens
aagcaaaggcaggagcttgtga

SEQ ID NO: 7576128 - DNA, 22 bp, Homo sapiens
aagcaaaggcaggagcttgtga

SEQ ID NO: 7576129 - DNA, 22 bp, Homo sapiens
aagattctcagagtgaaagaat

SEQ ID NO: 7576130 - DNA, 22 bp, Homo sapiens
aagattctcagagtgaaagaat

SEQ ID NO: 7576131 - DNA, 22 bp, Homo sapiens
aagattctcagaaaaaggctat

SEQ ID NO: 7576132 - DNA, 22 bp, Homo sapiens
aagattctcagaaaaaggctat

SEQ ID NO: 7576133 - DNA, 22 bp, Homo sapiens
aagattctcagagtgaaagaat

SEQ ID NO: 7576134 - DNA, 22 bp, Homo sapiens
aagattctcagagtgaaagaat

SEQ ID NO: 7576135 - DNA, 22 bp, Homo sapiens
aagattctccctgagatattta

SEQ ID NO: 7576136 - DNA, 22 bp, Homo sapiens
aagattctccctgagatattta

SEQ ID NO: 7576137 - DNA, 22 bp, Homo sapiens
aagattctccctgagatattta

SEQ ID NO: 7576138 - DNA, 22 bp, Homo sapiens
aagcaaagagataaccttttgg

SEQ ID NO: 7576139 - DNA, 20 bp, Homo sapiens
aagattctgatttgtagcgt

SEQ ID NO: 7576140 - DNA, 22 bp, Homo sapiens
aagattctgaaaggggtggggc

SEQ ID NO: 7576141 - DNA, 20 bp, Homo sapiens
aagattctgatttgtagcgt

SEQ ID NO: 7576142 - DNA, 22 bp, Homo sapiens
aagattctgaaaggggtggggc

SEQ ID NO: 7576143 - DNA, 22 bp, Homo sapiens
aagattctccctgagatattta

SEQ ID NO: 7576144 - DNA, 22 bp, Homo sapiens
aagattctccctgagatattta

SEQ ID NO: 7576145 - DNA, 22 bp, Homo sapiens
aagattctccctgagatattta

SEQ ID NO: 7576146 - DNA, 18 bp, Homo sapiens
aagaggaggagcaggttg

SEQ ID NO: 7576147 - DNA, 18 bp, Homo sapiens
aagaggaggagcaggttg

SEQ ID NO: 7576148 - DNA, 18 bp, Homo sapiens
aagaggaggagcaggttg

SEQ ID NO: 7576149 - DNA, 18 bp, Homo sapiens
aagaggaggagcaggttg

SEQ ID NO: 7576150 - DNA, 18 bp, Homo sapiens
aagaggaggagcaggttg

SEQ ID NO: 7576151 - DNA, 22 bp, Homo sapiens
aagaggaggacggttcccagaa

SEQ ID NO: 7576152 - DNA, 18 bp, Homo sapiens
aagaggaggagcaggttg

SEQ ID NO: 7576153 - DNA, 18 bp, Homo sapiens
aagaggaggagcaggttg

SEQ ID NO: 7576154 - DNA, 18 bp, Homo sapiens
aagaggaggagcaggttg

SEQ ID NO: 7576155 - DNA, 18 bp, Homo sapiens
aagaggaggaaacccagg

SEQ ID NO: 7576156 - DNA, 22 bp, Homo sapiens
aagaggagacttcagcaacttg

SEQ ID NO: 7576157 - DNA, 18 bp, Homo sapiens
aagaggaggaaacccagg

SEQ ID NO: 7576158 - DNA, 22 bp, Homo sapiens
aagaggaggacggttcccagaa

SEQ ID NO: 7576159 - DNA, 22 bp, Homo sapiens
aagaggagacttcagcaacttg

SEQ ID NO: 7576160 - DNA, 22 bp, Homo sapiens
aagaggagacttcagcaacttg

SEQ ID NO: 7576161 - DNA, 22 bp, Homo sapiens
aagaggagacttcagcaacttg

SEQ ID NO: 7576162 - DNA, 22 bp, Homo sapiens
aagaggagacttcagcaacttg

SEQ ID NO: 7576163 - DNA, 22 bp, Homo sapiens
aagaggagaaaggctggctttg

SEQ ID NO: 7576164 - DNA, 22 bp, Homo sapiens
aagaggagacttcagcaacttg

SEQ ID NO: 7576165 - DNA, 22 bp, Homo sapiens
aagaggagacttcagcaacttg

SEQ ID NO: 7576166 - DNA, 22 bp, Homo sapiens
aagaggagacttcagcaacttg

SEQ ID NO: 7576167 - DNA, 20 bp, Homo sapiens
aactttgcattttattctcc

SEQ ID NO: 7576168 - DNA, 22 bp, Homo sapiens
aactttgcaagggggccctgcg

SEQ ID NO: 7576169 - DNA, 22 bp, Homo sapiens
aactttctttgcatctaagttt

SEQ ID NO: 7576170 - DNA, 22 bp, Homo sapiens
aactttctttgcatctaagttt

SEQ ID NO: 7576171 - DNA, 22 bp, Homo sapiens
aactttctttgcatctaagttt

SEQ ID NO: 7576172 - DNA, 22 bp, Homo sapiens
aactttgagtcattgcctcttt

SEQ ID NO: 7576173 - DNA, 22 bp, Homo sapiens
aactttctttgcatctaagttt

SEQ ID NO: 7576174 - DNA, 22 bp, Homo sapiens
aactttctttgcatctaagttt

SEQ ID NO: 7576175 - DNA, 22 bp, Homo sapiens
aactttctttcacagaagtatc

SEQ ID NO: 7576176 - DNA, 22 bp, Homo sapiens
aactttctttcacagaagtatc

SEQ ID NO: 7576177 - DNA, 22 bp, Homo sapiens
aactttcttgtgacatttgggg

SEQ ID NO: 7576178 - DNA, 22 bp, Homo sapiens
aacttggcttgcatggctgaaa

SEQ ID NO: 7576179 - DNA, 22 bp, Homo sapiens
aactttcttgtgacatttgggg

SEQ ID NO: 7576180 - DNA, 19 bp, Homo sapiens
aacttgctttaaaaccata

SEQ ID NO: 7576181 - DNA, 22 bp, Homo sapiens
aacttggctaccagcgttaaat

SEQ ID NO: 7576182 - DNA, 22 bp, Homo sapiens
aacttggctaccagcgttaaat

SEQ ID NO: 7576183 - DNA, 22 bp, Homo sapiens
aactttgggcctaagtactgtt

SEQ ID NO: 7576184 - DNA, 22 bp, Homo sapiens
aactttggggtggtttgttagt

SEQ ID NO: 7576185 - DNA, 22 bp, Homo sapiens
aactttggggtggtttgttagt

SEQ ID NO: 7576186 - DNA, 22 bp, Homo sapiens
aactttggccacaagtaccctg

SEQ ID NO: 7576187 - DNA, 22 bp, Homo sapiens
aactttgggcctaagtactgtt

SEQ ID NO: 7576188 - DNA, 21 bp, Homo sapiens
aactttggaaggcagcttggc

SEQ ID NO: 7576189 - DNA, 22 bp, Homo sapiens
aactttggcaagtcagacttct

SEQ ID NO: 7576190 - DNA, 22 bp, Homo sapiens
aactttggcaagtcagacttct

SEQ ID NO: 7576191 - DNA, 22 bp, Homo sapiens
aactttgtgtgtttaatatggc

SEQ ID NO: 7576192 - DNA, 22 bp, Homo sapiens
aactttgtgtgtttaatatggc

SEQ ID NO: 7576193 - DNA, 22 bp, Homo sapiens
aactttgttttattcactgctg

SEQ ID NO: 7576194 - DNA, 22 bp, Homo sapiens
aactttgttttattcactgctg

SEQ ID NO: 7576195 - DNA, 22 bp, Homo sapiens
aacttttaaaatacacagacaa

SEQ ID NO: 7576196 - DNA, 22 bp, Homo sapiens
aactttgtcttttatgcttaca

SEQ ID NO: 7576197 - DNA, 22 bp, Homo sapiens
aactttggtcagagaaattgtg

SEQ ID NO: 7576198 - DNA, 22 bp, Homo sapiens
aactttggtaatttactgggaa

SEQ ID NO: 7576199 - DNA, 22 bp, Homo sapiens
aactttggtattcgacagctct

SEQ ID NO: 7576200 - DNA, 22 bp, Homo sapiens
aactttggtattcgacagctct

SEQ ID NO: 7576201 - DNA, 22 bp, Homo sapiens
aactttggtaatttactgggaa

SEQ ID NO: 7576202 - DNA, 22 bp, Homo sapiens
aagaaagggagaaggatggtgt

SEQ ID NO: 7576203 - DNA, 22 bp, Homo sapiens
aagaaagggagaaggatggtgt

SEQ ID NO: 7576204 - DNA, 22 bp, Homo sapiens
aagaaaggatatatgggaggta

SEQ ID NO: 7576205 - DNA, 22 bp, Homo sapiens
aagaaaggatatatgggaggta

SEQ ID NO: 7576206 - DNA, 22 bp, Homo sapiens
aagaaaggatatatgggaggta

SEQ ID NO: 7576207 - DNA, 22 bp, Homo sapiens
aagaaagggctattgttctcca

SEQ ID NO: 7576208 - DNA, 22 bp, Homo sapiens
aagaaagggctattgttctcca

SEQ ID NO: 7576209 - DNA, 22 bp, Homo sapiens
aagaaagggagaaggatggtgt

SEQ ID NO: 7576210 - DNA, 22 bp, Homo sapiens
aagaaagggagaaggatggtgt

SEQ ID NO: 7576211 - DNA, 22 bp, Homo sapiens
aagaaagggagaaggatggtgt

SEQ ID NO: 7576212 - DNA, 22 bp, Homo sapiens
aactttttctgggatggagggt

SEQ ID NO: 7576213 - DNA, 22 bp, Homo sapiens
aagaaagccaaagttcatacct

SEQ ID NO: 7576214 - DNA, 22 bp, Homo sapiens
aagaaagccaaagttcatacct

SEQ ID NO: 7576215 - DNA, 22 bp, Homo sapiens
aacttttctgtgttgtccggga

SEQ ID NO: 7576216 - DNA, 22 bp, Homo sapiens
aacttttgtccgatctcctgga

SEQ ID NO: 7576217 - DNA, 22 bp, Homo sapiens
aagaaagctgaatattctgtgt

SEQ ID NO: 7576218 - DNA, 22 bp, Homo sapiens
aagaaagctgaatattctgtgt

SEQ ID NO: 7576219 - DNA, 23 bp, Homo sapiens
aacttttagagtttaacagtgtt

SEQ ID NO: 7576220 - DNA, 23 bp, Homo sapiens
aacttttagagtttaacagtgtt

SEQ ID NO: 7576221 - DNA, 22 bp, Homo sapiens
aacttttagacttgggtataaa

SEQ ID NO: 7576222 - DNA, 22 bp, Homo sapiens
aacttttacaaattgtcatcat

SEQ ID NO: 7576223 - DNA, 22 bp, Homo sapiens
aacttttacaaattgtcatcat

SEQ ID NO: 7576224 - DNA, 22 bp, Homo sapiens
aacttttacaaattgtcatcat

SEQ ID NO: 7576225 - DNA, 22 bp, Homo sapiens
aacttttaaaatacacagacaa

SEQ ID NO: 7576226 - DNA, 22 bp, Homo sapiens
aacttttaaaatacacagacaa

SEQ ID NO: 7576227 - DNA, 22 bp, Homo sapiens
aacttttaaaatacacagacaa

SEQ ID NO: 7576228 - DNA, 22 bp, Homo sapiens
aacttttacaaattgtcatcat

SEQ ID NO: 7576229 - DNA, 22 bp, Homo sapiens
aacttttcattgaatcatgtca

SEQ ID NO: 7576230 - DNA, 22 bp, Homo sapiens
aacttttcattccaaaggtgct

SEQ ID NO: 7576231 - DNA, 22 bp, Homo sapiens
aacttttcattccaaaggtgct

SEQ ID NO: 7576232 - DNA, 22 bp, Homo sapiens
aacttttcattgaatcatgtca

SEQ ID NO: 7576233 - DNA, 22 bp, Homo sapiens
aacttttcattgaatcatgtca

SEQ ID NO: 7576234 - DNA, 22 bp, Homo sapiens
aacttttcataagggcaaattt

SEQ ID NO: 7576235 - DNA, 22 bp, Homo sapiens
aacttttcattccaaaggtgct

SEQ ID NO: 7576236 - DNA, 22 bp, Homo sapiens
aacttttcataagggcaaattt

SEQ ID NO: 7576237 - DNA, 22 bp, Homo sapiens
aacttttcacaggctagctctt

SEQ ID NO: 7576238 - DNA, 22 bp, Homo sapiens
aacttttcacaggctagctctt

SEQ ID NO: 7576239 - DNA, 22 bp, Homo sapiens
aagaaagtgggtaatatgattt

SEQ ID NO: 7576240 - DNA, 22 bp, Homo sapiens
aagaaagtgtggagagcctagc

SEQ ID NO: 7576241 - DNA, 22 bp, Homo sapiens
aagaaagtgggtaatatgattt

SEQ ID NO: 7576242 - DNA, 22 bp, Homo sapiens
aagaaagtgtggagagcctagc

SEQ ID NO: 7576243 - DNA, 22 bp, Homo sapiens
aagaaagtgtggagagcctagc

SEQ ID NO: 7576244 - DNA, 22 bp, Homo sapiens
aagaaagtgggtaatatgattt

SEQ ID NO: 7576245 - DNA, 22 bp, Homo sapiens
aagaaagtgggtaatatgattt

SEQ ID NO: 7576246 - DNA, 22 bp, Homo sapiens
aagaaagtgggtaatatgattt

SEQ ID NO: 7576247 - DNA, 22 bp, Homo sapiens
aagaaagtgggtaatatgattt

SEQ ID NO: 7576248 - DNA, 22 bp, Homo sapiens
aagaaagtgggtaatatgattt

SEQ ID NO: 7576249 - DNA, 23 bp, Homo sapiens
aagaagttacctaaagttgtact

SEQ ID NO: 7576250 - DNA, 22 bp, Homo sapiens
aagaaataagacttctctgtcc

SEQ ID NO: 7576251 - DNA, 22 bp, Homo sapiens
aagaaataagacttctctgtcc

SEQ ID NO: 7576252 - DNA, 22 bp, Homo sapiens
aagaagttaataatggtgagaa

SEQ ID NO: 7576253 - DNA, 22 bp, Homo sapiens
aagaaataagacttctctgtcc

SEQ ID NO: 7576254 - DNA, 22 bp, Homo sapiens
aagaaataagacttctctgtcc

SEQ ID NO: 7576255 - DNA, 22 bp, Homo sapiens
aagaaataagacttctctgtcc

SEQ ID NO: 7576256 - DNA, 22 bp, Homo sapiens
aagaaagtgtggagagcctagc

SEQ ID NO: 7576257 - DNA, 22 bp, Homo sapiens
aagaaagtgtggagagcctagc

SEQ ID NO: 7576258 - DNA, 22 bp, Homo sapiens
aagaagttaggtgtaacaatat

SEQ ID NO: 7576259 - DNA, 22 bp, Homo sapiens
aagaagttaggtgtaacaatat

SEQ ID NO: 7576260 - DNA, 22 bp, Homo sapiens
aagaagttaggtgtaacaatat

SEQ ID NO: 7576261 - DNA, 23 bp, Homo sapiens
aagaagttacctaaagttgtact

SEQ ID NO: 7576262 - DNA, 22 bp, Homo sapiens
aagaagttctgcctaagggaca

SEQ ID NO: 7576263 - DNA, 22 bp, Homo sapiens
aagaagttctgcctaagggaca

SEQ ID NO: 7576264 - DNA, 22 bp, Homo sapiens
aagaagttaggtgtaacaatat

SEQ ID NO: 7576265 - DNA, 22 bp, Homo sapiens
aagaaaggtgtgtttgcagatg

SEQ ID NO: 7576266 - DNA, 22 bp, Homo sapiens
aagaaaggtgtgtttgcagatg

SEQ ID NO: 7576267 - DNA, 22 bp, Homo sapiens
aagaaaggtgtgtttgcagatg

SEQ ID NO: 7576268 - DNA, 22 bp, Homo sapiens
aagaaaggtctctgcccgctat

SEQ ID NO: 7576269 - DNA, 22 bp, Homo sapiens
aagaaaggtctctgcccgctat

SEQ ID NO: 7576270 - DNA, 22 bp, Homo sapiens
aagaaaggtctctgcccgctat

SEQ ID NO: 7576271 - DNA, 22 bp, Homo sapiens
aagaaagggctattgttctcca

SEQ ID NO: 7576272 - DNA, 22 bp, Homo sapiens
aagaaagtgatgagctacagat

SEQ ID NO: 7576273 - DNA, 22 bp, Homo sapiens
aagaaagtgatgagctacagat

SEQ ID NO: 7576274 - DNA, 22 bp, Homo sapiens
aagaaagtgatgagctacagat

SEQ ID NO: 7576275 - DNA, 22 bp, Homo sapiens
aagaaagtgatgagctacagat

SEQ ID NO: 7576276 - DNA, 22 bp, Homo sapiens
aagaaagtgatgagctacagat

SEQ ID NO: 7576277 - DNA, 22 bp, Homo sapiens
aagaaagtgctttgtaaattat

SEQ ID NO: 7576278 - DNA, 22 bp, Homo sapiens
aagaaagtgctttgtaaattat

SEQ ID NO: 7576279 - DNA, 22 bp, Homo sapiens
aagaaagtgctttgtaaattat

SEQ ID NO: 7576280 - DNA, 22 bp, Homo sapiens
aagaatgagctcaaagatctta

SEQ ID NO: 7576281 - DNA, 22 bp, Homo sapiens
aagaatgagctcaaagatctta

SEQ ID NO: 7576282 - DNA, 22 bp, Homo sapiens
aagaatgattacaaagcaacga

SEQ ID NO: 7576283 - DNA, 22 bp, Homo sapiens
aagaatgattacaaagcaacga

SEQ ID NO: 7576284 - DNA, 22 bp, Homo sapiens
aagaatgattacaaagcaacga

SEQ ID NO: 7576285 - DNA, 22 bp, Homo sapiens
aagaatgattacaaagcaacga

SEQ ID NO: 7576286 - DNA, 22 bp, Homo sapiens
aagaatgattacaaagcaacga

SEQ ID NO: 7576287 - DNA, 22 bp, Homo sapiens
aagaatgattacaaagcaacga

SEQ ID NO: 7576288 - DNA, 22 bp, Homo sapiens
aagaatgattacaaagcaacga

SEQ ID NO: 7576289 - DNA, 22 bp, Homo sapiens
aagaatgagctcaaagatctta

SEQ ID NO: 7576290 - DNA, 22 bp, Homo sapiens
aagaatgagctcaaagatctta

SEQ ID NO: 7576291 - DNA, 22 bp, Homo sapiens
aagaatgagctcaaagatctta

SEQ ID NO: 7576292 - DNA, 22 bp, Homo sapiens
aagaatgagctcaaagatctta

SEQ ID NO: 7576293 - DNA, 22 bp, Homo sapiens
aagaatgagctcaaagatctta

SEQ ID NO: 7576294 - DNA, 22 bp, Homo sapiens
aagaatgagctcaaagatctta

SEQ ID NO: 7576295 - DNA, 22 bp, Homo sapiens
aagaatgagctcaaagatctta

SEQ ID NO: 7576296 - DNA, 22 bp, Homo sapiens
aagaatgagctcaaagatctta

SEQ ID NO: 7576297 - DNA, 22 bp, Homo sapiens
aagaatgagctcaaagatctta

SEQ ID NO: 7576298 - DNA, 22 bp, Homo sapiens
aagaatgagctcaaagatctta

SEQ ID NO: 7576299 - DNA, 22 bp, Homo sapiens
aagaagttggaaatgattgaga

SEQ ID NO: 7576300 - DNA, 22 bp, Homo sapiens
aagaagttggaaatgattgaga

SEQ ID NO: 7576301 - DNA, 22 bp, Homo sapiens
aagaagttggaaatgattgaga

SEQ ID NO: 7576302 - DNA, 23 bp, Homo sapiens
aagaatgcttctgaagagctgcc

SEQ ID NO: 7576303 - DNA, 22 bp, Homo sapiens
aagaatgcatcaaaagtcagag

SEQ ID NO: 7576304 - DNA, 22 bp, Homo sapiens
aagaatgcatcaaaagtcagag

SEQ ID NO: 7576305 - DNA, 22 bp, Homo sapiens
aagaatgtcaagcagaaggtct

SEQ ID NO: 7576306 - DNA, 22 bp, Homo sapiens
aagaatggtggtggggccagca

SEQ ID NO: 7576307 - DNA, 22 bp, Homo sapiens
aagaatggtggtggggccagca

SEQ ID NO: 7576308 - DNA, 22 bp, Homo sapiens
aagaatgtcaagcagaaggtct

SEQ ID NO: 7576309 - DNA, 22 bp, Homo sapiens
aagaatgtcgttggtattttaa

SEQ ID NO: 7576310 - DNA, 22 bp, Homo sapiens
aagaatgtcgttggtattttaa

SEQ ID NO: 7576311 - DNA, 22 bp, Homo sapiens
aagaatgtctctggtgaggcgc

SEQ ID NO: 7576312 - DNA, 22 bp, Homo sapiens
aagaatgtcgttggtattttaa

SEQ ID NO: 7576313 - DNA, 22 bp, Homo sapiens
aagaatgtcgttggtattttaa

SEQ ID NO: 7576314 - DNA, 22 bp, Homo sapiens
aagaatgtcgttggtattttaa

SEQ ID NO: 7576315 - DNA, 22 bp, Homo sapiens
aagaatgtggcatttatttata

SEQ ID NO: 7576316 - DNA, 22 bp, Homo sapiens
aagaatgtggcatttatttata

SEQ ID NO: 7576317 - DNA, 22 bp, Homo sapiens
aagaatgtggcatttatttata

SEQ ID NO: 7576318 - DNA, 22 bp, Homo sapiens
aagaatgtggcatttatttata

SEQ ID NO: 7576319 - DNA, 22 bp, Homo sapiens
aagaatgtgctaatgaaaactt

SEQ ID NO: 7576320 - DNA, 22 bp, Homo sapiens
aagaatgtgggtggatatgatg

SEQ ID NO: 7576321 - DNA, 22 bp, Homo sapiens
aagaatgtggcatttatttata

SEQ ID NO: 7576322 - DNA, 22 bp, Homo sapiens
aagaatgtgggtggatatgatg

SEQ ID NO: 7576323 - DNA, 22 bp, Homo sapiens
aagaatgtgggtggatatgatg

SEQ ID NO: 7576324 - DNA, 22 bp, Homo sapiens
aagaatgtgggtggatatgatg

SEQ ID NO: 7576325 - DNA, 22 bp, Homo sapiens
aagaggaagtctccatggagag

SEQ ID NO: 7576326 - DNA, 22 bp, Homo sapiens
aagaggaatgggtgtgtttatg

SEQ ID NO: 7576327 - DNA, 22 bp, Homo sapiens
aagaggacagtattcaatatga

SEQ ID NO: 7576328 - DNA, 22 bp, Homo sapiens
aagaggaccagtagataaattt

SEQ ID NO: 7576329 - DNA, 22 bp, Homo sapiens
aagaggaatgggtgtgtttatg

SEQ ID NO: 7576330 - DNA, 22 bp, Homo sapiens
aagaggaagtctccatggagag

SEQ ID NO: 7576331 - DNA, 22 bp, Homo sapiens
aagaggaagtctccatggagag

SEQ ID NO: 7576332 - DNA, 22 bp, Homo sapiens
aagaggaagtctccatggagag

SEQ ID NO: 7576333 - DNA, 22 bp, Homo sapiens
aagaggaagtctccatggagag

SEQ ID NO: 7576334 - DNA, 22 bp, Homo sapiens
aagaggaagtctccatggagag

SEQ ID NO: 7576335 - DNA, 22 bp, Homo sapiens
aagaggacttgtgaagatgtac

SEQ ID NO: 7576336 - DNA, 22 bp, Homo sapiens
aagaggaccagtagataaattt

SEQ ID NO: 7576337 - DNA, 22 bp, Homo sapiens
aagaggacttgtgaagatgtac

SEQ ID NO: 7576338 - DNA, 22 bp, Homo sapiens
aagaggacttgtgaagatgtac

SEQ ID NO: 7576339 - DNA, 22 bp, Homo sapiens
aagaggagaaaggctggctttg

SEQ ID NO: 7576340 - DNA, 22 bp, Homo sapiens
aagaggagaaaggctggctttg

SEQ ID NO: 7576341 - DNA, 22 bp, Homo sapiens
aagaggagaaaggctggctttg

SEQ ID NO: 7576342 - DNA, 22 bp, Homo sapiens
aagaggagaaaggctggctttg

SEQ ID NO: 7576343 - DNA, 22 bp, Homo sapiens
aagagcccttttcagtctagtt

SEQ ID NO: 7576344 - DNA, 22 bp, Homo sapiens
aagagccctggttgaaaataac

SEQ ID NO: 7576345 - DNA, 22 bp, Homo sapiens
aagagcccttgttcataattat

SEQ ID NO: 7576346 - DNA, 22 bp, Homo sapiens
aagagcccttgttcataattat

SEQ ID NO: 7576347 - DNA, 22 bp, Homo sapiens
aagagcctccctagaggtgaag

SEQ ID NO: 7576348 - DNA, 22 bp, Homo sapiens
aagagcctccctagaggtgaag

SEQ ID NO: 7576349 - DNA, 22 bp, Homo sapiens
aagagcctggctgctaggctca

SEQ ID NO: 7576350 - DNA, 22 bp, Homo sapiens
aagagccttggcaatgagtcct

SEQ ID NO: 7576351 - DNA, 22 bp, Homo sapiens
aagagcccttttcagtctagtt

SEQ ID NO: 7576352 - DNA, 22 bp, Homo sapiens
aagagccatttcatatcatctc

SEQ ID NO: 7576353 - DNA, 22 bp, Homo sapiens
aagagcccagggcttgatgctg

SEQ ID NO: 7576354 - DNA, 22 bp, Homo sapiens
aagagccagtgggaaagtcttg

SEQ ID NO: 7576355 - DNA, 22 bp, Homo sapiens
aagagccatacaagtaaaagca

SEQ ID NO: 7576356 - DNA, 22 bp, Homo sapiens
aagagccctggttgaaaataac

SEQ ID NO: 7576357 - DNA, 22 bp, Homo sapiens
aagagccctcagtgcttgaaat

SEQ ID NO: 7576358 - DNA, 22 bp, Homo sapiens
aagagccctctgtgtttctgag

SEQ ID NO: 7576359 - DNA, 22 bp, Homo sapiens
aagagccctctgtgtttctgag

SEQ ID NO: 7576360 - DNA, 22 bp, Homo sapiens
aagagccctcagtgcttgaaat

SEQ ID NO: 7576361 - DNA, 20 bp, Homo sapiens
aagagcccgcagggcagtgc

SEQ ID NO: 7576362 - DNA, 20 bp, Homo sapiens
aagagcccgcagggcagtgc

SEQ ID NO: 7576363 - DNA, 22 bp, Homo sapiens
aagagcccagggcttgatgctg

SEQ ID NO: 7576364 - DNA, 22 bp, Homo sapiens
aagagcatctatttcacagtgg

SEQ ID NO: 7576365 - DNA, 22 bp, Homo sapiens
aagagcatctatttcacagtgg

SEQ ID NO: 7576366 - DNA, 22 bp, Homo sapiens
aagagcatctatttcacagtgg

SEQ ID NO: 7576367 - DNA, 22 bp, Homo sapiens
aagagcatctatttcacagtgg

SEQ ID NO: 7576368 - DNA, 22 bp, Homo sapiens
aagagcatcggtggagccccca

SEQ ID NO: 7576369 - DNA, 22 bp, Homo sapiens
aagagcatcggtggagccccca

SEQ ID NO: 7576370 - DNA, 22 bp, Homo sapiens
aagagcatatggttctcaaagc

SEQ ID NO: 7576371 - DNA, 22 bp, Homo sapiens
aagagcatattaatagtggaga

SEQ ID NO: 7576372 - DNA, 22 bp, Homo sapiens
aagagcatctatttcacagtgg

SEQ ID NO: 7576373 - DNA, 22 bp, Homo sapiens
aagagcatggagttcccctaaa

SEQ ID NO: 7576374 - DNA, 22 bp, Homo sapiens
aagagcattccgttctgattct

SEQ ID NO: 7576375 - DNA, 22 bp, Homo sapiens
aagagcatgttaattctaggac

SEQ ID NO: 7576376 - DNA, 22 bp, Homo sapiens
aagagcatgtaattggatttct

SEQ ID NO: 7576377 - DNA, 22 bp, Homo sapiens
aagagcatgtaattggatttct

SEQ ID NO: 7576378 - DNA, 22 bp, Homo sapiens
aagagcatgtaattggatttct

SEQ ID NO: 7576379 - DNA, 22 bp, Homo sapiens
aagagcattttgtaaaatcctt

SEQ ID NO: 7576380 - DNA, 22 bp, Homo sapiens
aagagcatttggtgagatttga

SEQ ID NO: 7576381 - DNA, 22 bp, Homo sapiens
aagagcattttagtctcccttt

SEQ ID NO: 7576382 - DNA, 22 bp, Homo sapiens
aagagcattccgttctgattct

SEQ ID NO: 7576383 - DNA, 22 bp, Homo sapiens
aagagcatttggtgagatttga

SEQ ID NO: 7576384 - DNA, 22 bp, Homo sapiens
aagagcatttccactggcactg

SEQ ID NO: 7576385 - DNA, 22 bp, Homo sapiens
aagagccagtgggaaagtcttg

SEQ ID NO: 7576386 - DNA, 22 bp, Homo sapiens
aagagccagtgggaaagtcttg

SEQ ID NO: 7576387 - DNA, 22 bp, Homo sapiens
aagagccaggacagatccagct

SEQ ID NO: 7576388 - DNA, 22 bp, Homo sapiens
aagagccagtgggaaagtcttg

SEQ ID NO: 7576389 - DNA, 22 bp, Homo sapiens
aagagccaggacagatccagct

SEQ ID NO: 7576390 - DNA, 22 bp, Homo sapiens
aagagccagctagtgaagaggc

SEQ ID NO: 7576391 - DNA, 22 bp, Homo sapiens
aagagccaagcagtcatcaata

SEQ ID NO: 7576392 - DNA, 22 bp, Homo sapiens
aagagccaagcagtcatcaata

SEQ ID NO: 7576393 - DNA, 22 bp, Homo sapiens
aagagccagctagtgaagaggc

SEQ ID NO: 7576394 - DNA, 22 bp, Homo sapiens
aagaattatctgaaagctgtgt

SEQ ID NO: 7576395 - DNA, 22 bp, Homo sapiens
aagaatgttcttgtagtcatga

SEQ ID NO: 7576396 - DNA, 22 bp, Homo sapiens
aagaattatctgaaagctgtgt

SEQ ID NO: 7576397 - DNA, 22 bp, Homo sapiens
aagacactaagctttcaggata

SEQ ID NO: 7576398 - DNA, 22 bp, Homo sapiens
aagacactaagctttcaggata

SEQ ID NO: 7576399 - DNA, 22 bp, Homo sapiens
aagaatgttcttgtagtcatga

SEQ ID NO: 7576400 - DNA, 22 bp, Homo sapiens
aagaatgttcttgtagtcatga

SEQ ID NO: 7576401 - DNA, 21 bp, Homo sapiens
aagaatgttccaggtcttgcc

SEQ ID NO: 7576402 - DNA, 22 bp, Homo sapiens
aagaatgttcttgtagtcatga

SEQ ID NO: 7576403 - DNA, 22 bp, Homo sapiens
aagaatgttagtttctgataca

SEQ ID NO: 7576404 - DNA, 22 bp, Homo sapiens
aagaatgttagtttctgataca

SEQ ID NO: 7576405 - DNA, 22 bp, Homo sapiens
aagaatgttagtttctgataca

SEQ ID NO: 7576406 - DNA, 22 bp, Homo sapiens
aagaatgttagtttctgataca

SEQ ID NO: 7576407 - DNA, 22 bp, Homo sapiens
aagaatgttagtttctgataca

SEQ ID NO: 7576408 - DNA, 22 bp, Homo sapiens
aagaatgttcattaaactgttg

SEQ ID NO: 7576409 - DNA, 22 bp, Homo sapiens
aagaatgttcattaaactgttg

SEQ ID NO: 7576410 - DNA, 22 bp, Homo sapiens
aagaatgttcaacgcttttttg

SEQ ID NO: 7576411 - DNA, 22 bp, Homo sapiens
aagaatgttcattaaactgttg

SEQ ID NO: 7576412 - DNA, 22 bp, Homo sapiens
aagaatgttcattaaactgttg

SEQ ID NO: 7576413 - DNA, 22 bp, Homo sapiens
aagaatgttcaacgcttttttg

SEQ ID NO: 7576414 - DNA, 22 bp, Homo sapiens
aagaatgttcaacgcttttttg

SEQ ID NO: 7576415 - DNA, 17 bp, Homo sapiens
aagacagaagccatgag

SEQ ID NO: 7576416 - DNA, 21 bp, Homo sapiens
aagacagaaaagcctattttc

SEQ ID NO: 7576417 - DNA, 17 bp, Homo sapiens
aagacagaagccatgag

SEQ ID NO: 7576418 - DNA, 22 bp, Homo sapiens
aagacactttctaaatagaagt

SEQ ID NO: 7576419 - DNA, 22 bp, Homo sapiens
aagacactttctaaatagaagt

SEQ ID NO: 7576420 - DNA, 22 bp, Homo sapiens
aagacactttctaaatagaagt

SEQ ID NO: 7576421 - DNA, 22 bp, Homo sapiens
aagacactgggttaggcacgtg

SEQ ID NO: 7576422 - DNA, 22 bp, Homo sapiens
aagacactgggttaggcacgtg

SEQ ID NO: 7576423 - DNA, 22 bp, Homo sapiens
aagacactgggggctgcagcca

SEQ ID NO: 7576424 - DNA, 22 bp, Homo sapiens
aagacactgggggctgcagcca

SEQ ID NO: 7576425 - DNA, 22 bp, Homo sapiens
aagacactgatactctgtgatt

SEQ ID NO: 7576426 - DNA, 22 bp, Homo sapiens
aagacactgatactctgtgatt

SEQ ID NO: 7576427 - DNA, 22 bp, Homo sapiens
aagacactgatactctgtgatt

SEQ ID NO: 7576428 - DNA, 22 bp, Homo sapiens
aagacactgatactctgtgatt

SEQ ID NO: 7576429 - DNA, 22 bp, Homo sapiens
aagacactgatactctgtgatt

SEQ ID NO: 7576430 - DNA, 22 bp, Homo sapiens
aagacactcattatcactggtt

SEQ ID NO: 7576431 - DNA, 22 bp, Homo sapiens
aagacactcattatcactggtt

SEQ ID NO: 7576432 - DNA, 22 bp, Homo sapiens
aagacagagggaagcaatgatg

SEQ ID NO: 7576433 - DNA, 22 bp, Homo sapiens
aagacagagggaagcaatgatg

SEQ ID NO: 7576434 - DNA, 22 bp, Homo sapiens
aagacagagactctgcaacagg

SEQ ID NO: 7576435 - DNA, 22 bp, Homo sapiens
aagacagagactctgcaacagg

SEQ ID NO: 7576436 - DNA, 22 bp, Homo sapiens
aagacagagactctgcaacagg

SEQ ID NO: 7576437 - DNA, 22 bp, Homo sapiens
aagagagagttcctaggcaaaa

SEQ ID NO: 7576438 - DNA, 22 bp, Homo sapiens
aagagcatatggttctcaaagc

SEQ ID NO: 7576439 - DNA, 22 bp, Homo sapiens
aagagcatatggttctcaaagc

SEQ ID NO: 7576440 - DNA, 22 bp, Homo sapiens
aagagcatatatgtatgtttgt

SEQ ID NO: 7576441 - DNA, 22 bp, Homo sapiens
aagagcatatatgtatgtttgt

SEQ ID NO: 7576442 - DNA, 20 bp, Homo sapiens
aagagcatagtacaggaaga

SEQ ID NO: 7576443 - DNA, 20 bp, Homo sapiens
aagagcatagtacaggaaga

SEQ ID NO: 7576444 - DNA, 20 bp, Homo sapiens
aagagaggaagttatactag

SEQ ID NO: 7576445 - DNA, 20 bp, Homo sapiens
aagagaggaagttatactag

SEQ ID NO: 7576446 - DNA, 20 bp, Homo sapiens
aagagaggaagttatactag

SEQ ID NO: 7576447 - DNA, 22 bp, Homo sapiens
aagagcagtgttttactcagct

SEQ ID NO: 7576448 - DNA, 22 bp, Homo sapiens
aagacagaccacgtgacagggc

SEQ ID NO: 7576449 - DNA, 22 bp, Homo sapiens
aagacagaccacgtgacagggc

SEQ ID NO: 7576450 - DNA, 22 bp, Homo sapiens
aagacagaccacgtgacagggc

SEQ ID NO: 7576451 - DNA, 22 bp, Homo sapiens
aagacagaccacgtgacagggc

SEQ ID NO: 7576452 - DNA, 22 bp, Homo sapiens
aagacagagactctgcaacagg

SEQ ID NO: 7576453 - DNA, 22 bp, Homo sapiens
aagacagagactctgcaacagg

SEQ ID NO: 7576454 - DNA, 22 bp, Homo sapiens
aagacagagactctgcaacagg

SEQ ID NO: 7576455 - DNA, 22 bp, Homo sapiens
aagacagagactctgcaacagg

SEQ ID NO: 7576456 - DNA, 22 bp, Homo sapiens
aagacagaccacgtgacagggc

SEQ ID NO: 7576457 - DNA, 22 bp, Homo sapiens
aagacagaccacgtgacagggc

SEQ ID NO: 7576458 - DNA, 22 bp, Homo sapiens
aagacagaccacgtgacagggc

SEQ ID NO: 7576459 - DNA, 22 bp, Homo sapiens
aagacagaagtgatttgatgtg

SEQ ID NO: 7576460 - DNA, 17 bp, Homo sapiens
aagacagaagccatgag

SEQ ID NO: 7576461 - DNA, 17 bp, Homo sapiens
aagacagaagccatgag

SEQ ID NO: 7576462 - DNA, 17 bp, Homo sapiens
aagacagaagccatgag

SEQ ID NO: 7576463 - DNA, 22 bp, Homo sapiens
aagacagaagtgatttgatgtg

SEQ ID NO: 7576464 - DNA, 22 bp, Homo sapiens
aaacacaggtactgcagaagtg

SEQ ID NO: 7576465 - DNA, 22 bp, Homo sapiens
aaacacaggtactgcagaagtg

SEQ ID NO: 7576466 - DNA, 22 bp, Homo sapiens
aaacagtcctctttatttagtc

SEQ ID NO: 7576467 - DNA, 22 bp, Homo sapiens
aaacagtcctctttatttagtc

SEQ ID NO: 7576468 - DNA, 22 bp, Homo sapiens
aaacacaggtactgcagaagtg

SEQ ID NO: 7576469 - DNA, 22 bp, Homo sapiens
aaacacagggatatatattcca

SEQ ID NO: 7576470 - DNA, 22 bp, Homo sapiens
aaacacagggatatatattcca

SEQ ID NO: 7576471 - DNA, 22 bp, Homo sapiens
aaacacagggatatatattcca

SEQ ID NO: 7576472 - DNA, 22 bp, Homo sapiens
aaacagtctgatgccatctgcc

SEQ ID NO: 7576473 - DNA, 22 bp, Homo sapiens
aaacagtcgtcttaatagtatt

SEQ ID NO: 7576474 - DNA, 22 bp, Homo sapiens
aaacagtcgtcttaatagtatt

SEQ ID NO: 7576475 - DNA, 22 bp, Homo sapiens
aaacagtctgatgccatctgcc

SEQ ID NO: 7576476 - DNA, 22 bp, Homo sapiens
aaacagtgactggtacataata

SEQ ID NO: 7576477 - DNA, 22 bp, Homo sapiens
aaacagtgactggtacataata

SEQ ID NO: 7576478 - DNA, 21 bp, Homo sapiens
aaacatctctgcttttgtgtc

SEQ ID NO: 7576479 - DNA, 21 bp, Homo sapiens
aaacatctctgcttttgtgtc

SEQ ID NO: 7576480 - DNA, 21 bp, Homo sapiens
aaacatctctgcttttgtgtc

SEQ ID NO: 7576481 - DNA, 22 bp, Homo sapiens
aaacatctgacttgctttttca

SEQ ID NO: 7576482 - DNA, 22 bp, Homo sapiens
aaacatctgacttgctttttca

SEQ ID NO: 7576483 - DNA, 22 bp, Homo sapiens
aaacatctgacttgctttttca

SEQ ID NO: 7576484 - DNA, 22 bp, Homo sapiens
aaacatctgacttgctttttca

SEQ ID NO: 7576485 - DNA, 22 bp, Homo sapiens
aaacatctgacttgctttttca

SEQ ID NO: 7576486 - DNA, 22 bp, Homo sapiens
aaacacagcatgtccttgggga

SEQ ID NO: 7576487 - DNA, 22 bp, Homo sapiens
aaacacagatttctttgtccca

SEQ ID NO: 7576488 - DNA, 22 bp, Homo sapiens
aaacacagatttctttgtccca

SEQ ID NO: 7576489 - DNA, 22 bp, Homo sapiens
aaacacagatttctttgtccca

SEQ ID NO: 7576490 - DNA, 19 bp, Homo sapiens
aaacacagatttcttacca

SEQ ID NO: 7576491 - DNA, 19 bp, Homo sapiens
aaacacagatttcttacca

SEQ ID NO: 7576492 - DNA, 19 bp, Homo sapiens
aaacacagatttcttacca

SEQ ID NO: 7576493 - DNA, 19 bp, Homo sapiens
aaacacagatttcttacca

SEQ ID NO: 7576494 - DNA, 19 bp, Homo sapiens
aaacacagatttcttacca

SEQ ID NO: 7576495 - DNA, 20 bp, Homo sapiens
aaacacagcctctctttaca

SEQ ID NO: 7576496 - DNA, 20 bp, Homo sapiens
aaacacagcctctctttaca

SEQ ID NO: 7576497 - DNA, 20 bp, Homo sapiens
aaacacagcctctctttaca

SEQ ID NO: 7576498 - DNA, 20 bp, Homo sapiens
aaacacagcctctctttaca

SEQ ID NO: 7576499 - DNA, 20 bp, Homo sapiens
aaacacagcctctctttaca

SEQ ID NO: 7576500 - DNA, 20 bp, Homo sapiens
aaacacagcctctctttaca

SEQ ID NO: 7576501 - DNA, 22 bp, Homo sapiens
aaacacagggatatatattcca

SEQ ID NO: 7576502 - DNA, 22 bp, Homo sapiens
aaacacagggatatatattcca

SEQ ID NO: 7576503 - DNA, 22 bp, Homo sapiens
aaacacagggatatatattcca

SEQ ID NO: 7576504 - DNA, 22 bp, Homo sapiens
aaacacagggatatatattcca

SEQ ID NO: 7576505 - DNA, 22 bp, Homo sapiens
aaacacagggatatatattcca

SEQ ID NO: 7576506 - DNA, 22 bp, Homo sapiens
aaacacagggatatatattcca

SEQ ID NO: 7576507 - DNA, 22 bp, Homo sapiens
aaacacagggatatatattcca

SEQ ID NO: 7576508 - DNA, 22 bp, Homo sapiens
aaacatcttctcttgattcttt

SEQ ID NO: 7576509 - DNA, 22 bp, Homo sapiens
aaacatcttctcttgattcttt

SEQ ID NO: 7576510 - DNA, 22 bp, Homo sapiens
aaacatcttctcttgattcttt

SEQ ID NO: 7576511 - DNA, 22 bp, Homo sapiens
aaacatcttctcttgattcttt

SEQ ID NO: 7576512 - DNA, 22 bp, Homo sapiens
aaacatcttctcttgattcttt

SEQ ID NO: 7576513 - DNA, 22 bp, Homo sapiens
aaacatcttctcttgattcttt

SEQ ID NO: 7576514 - DNA, 22 bp, Homo sapiens
aaacatcttctcttgattcttt

SEQ ID NO: 7576515 - DNA, 22 bp, Homo sapiens
aaacatcttctcttgattcttt

SEQ ID NO: 7576516 - DNA, 22 bp, Homo sapiens
aaacatcttctcttgattcttt

SEQ ID NO: 7576517 - DNA, 22 bp, Homo sapiens
aaacatctggttacctagggtc

SEQ ID NO: 7576518 - DNA, 22 bp, Homo sapiens
aaacatctggaggccccgtttg

SEQ ID NO: 7576519 - DNA, 22 bp, Homo sapiens
aaacatctggaggccccgtttg

SEQ ID NO: 7576520 - DNA, 22 bp, Homo sapiens
aaacatctgacttgctttttca

SEQ ID NO: 7576521 - DNA, 22 bp, Homo sapiens
aaacatcttctcttgattcttt

SEQ ID NO: 7576522 - DNA, 22 bp, Homo sapiens
aaacatctggttacctagggtc

SEQ ID NO: 7576523 - DNA, 22 bp, Homo sapiens
aaacatcttctcttgattcttt

SEQ ID NO: 7576524 - DNA, 22 bp, Homo sapiens
aaacatcttgctctgattggta

SEQ ID NO: 7576525 - DNA, 22 bp, Homo sapiens
aaacatctttctattgcaagtt

SEQ ID NO: 7576526 - DNA, 22 bp, Homo sapiens
aaacatctttctattgcaagtt

SEQ ID NO: 7576527 - DNA, 22 bp, Homo sapiens
aaacatctttctattgcaagtt

SEQ ID NO: 7576528 - DNA, 22 bp, Homo sapiens
aaacatcttgctctgattggta

SEQ ID NO: 7576529 - DNA, 22 bp, Homo sapiens
aaacatcttgctctgattggta

SEQ ID NO: 7576530 - DNA, 22 bp, Homo sapiens
aaacatcttgctctgattggta

SEQ ID NO: 7576531 - DNA, 22 bp, Homo sapiens
aaacatgaatagatattaaaca

SEQ ID NO: 7576532 - DNA, 22 bp, Homo sapiens
aaacatgaatagatattaaaca

SEQ ID NO: 7576533 - DNA, 22 bp, Homo sapiens
aaacatgaatagatattaaaca

SEQ ID NO: 7576534 - DNA, 22 bp, Homo sapiens
aaacatgaatagatattaaaca

SEQ ID NO: 7576535 - DNA, 22 bp, Homo sapiens
aaacatctttctattgcaagtt

SEQ ID NO: 7576536 - DNA, 22 bp, Homo sapiens
aaacatctttctattgcaagtt

SEQ ID NO: 7576537 - DNA, 22 bp, Homo sapiens
aaacatgaatagatattaaaca

SEQ ID NO: 7576538 - DNA, 22 bp, Homo sapiens
aaacatgaatagatattaaaca

SEQ ID NO: 7576539 - DNA, 22 bp, Homo sapiens
aaacatgaatagatattaaaca

SEQ ID NO: 7576540 - DNA, 22 bp, Homo sapiens
aaacatgagcacttgcttcata

SEQ ID NO: 7576541 - DNA, 22 bp, Homo sapiens
aaacatgaatagatattaaaca

SEQ ID NO: 7576542 - DNA, 22 bp, Homo sapiens
aaacatgaatagatattaaaca

SEQ ID NO: 7576543 - DNA, 22 bp, Homo sapiens
aaacatgaatagatattaaaca

SEQ ID NO: 7576544 - DNA, 22 bp, Homo sapiens
aaacatgagcatctcttcaagc

SEQ ID NO: 7576545 - DNA, 22 bp, Homo sapiens
aaacatgagcatctcttcaagc

SEQ ID NO: 7576546 - DNA, 22 bp, Homo sapiens
aaacatgagcatctcttcaagc

SEQ ID NO: 7576547 - DNA, 22 bp, Homo sapiens
aaacatgagcacttgcttcata

SEQ ID NO: 7576548 - DNA, 22 bp, Homo sapiens
aaacatgagcacttgcttcata

SEQ ID NO: 7576549 - DNA, 22 bp, Homo sapiens
aaacatgagcacttgcttcata

SEQ ID NO: 7576550 - DNA, 22 bp, Homo sapiens
aaacatgagttaaaagtaactg

SEQ ID NO: 7576551 - DNA, 22 bp, Homo sapiens
aaacatgagttaaaagtaactg

SEQ ID NO: 7576552 - DNA, 22 bp, Homo sapiens
aaacatgagttaaaagtaactg

SEQ ID NO: 7576553 - DNA, 22 bp, Homo sapiens
aaacatgagttaaaagtaactg

SEQ ID NO: 7576554 - DNA, 22 bp, Homo sapiens
aaacatgagttaaaagtaactg

SEQ ID NO: 7576555 - DNA, 22 bp, Homo sapiens
aaacatgagttaaaagtaactg

SEQ ID NO: 7576556 - DNA, 22 bp, Homo sapiens
aaacattgttatgataaattac

SEQ ID NO: 7576557 - DNA, 22 bp, Homo sapiens
aaacattgttatgataaattac

SEQ ID NO: 7576558 - DNA, 22 bp, Homo sapiens
aaacattgttatgataaattac

SEQ ID NO: 7576559 - DNA, 22 bp, Homo sapiens
aaacattgttatgataaattac

SEQ ID NO: 7576560 - DNA, 22 bp, Homo sapiens
aaacatgatgcctgtactaaga

SEQ ID NO: 7576561 - DNA, 22 bp, Homo sapiens
aaacatgagcatctcttcaagc

SEQ ID NO: 7576562 - DNA, 22 bp, Homo sapiens
aaacatgagcatctcttcaagc

SEQ ID NO: 7576563 - DNA, 22 bp, Homo sapiens
aaacatgagcatctcttcaagc

SEQ ID NO: 7576564 - DNA, 22 bp, Homo sapiens
aaacatgagcatctcttcaagc

SEQ ID NO: 7576565 - DNA, 22 bp, Homo sapiens
aaacatgagcatctcttcaagc

SEQ ID NO: 7576566 - DNA, 22 bp, Homo sapiens
aaacatgagcatttctgtttaa

SEQ ID NO: 7576567 - DNA, 22 bp, Homo sapiens
aaacatgagcatttctgtttaa

SEQ ID NO: 7576568 - DNA, 22 bp, Homo sapiens
aaacatgagcatttctgtttaa

SEQ ID NO: 7576569 - DNA, 22 bp, Homo sapiens
aaacatgagttaaaagtaactg

SEQ ID NO: 7576570 - DNA, 22 bp, Homo sapiens
aaacatttttcttcatcatcct

SEQ ID NO: 7576571 - DNA, 22 bp, Homo sapiens
aaacatttttcttcatcatcct

SEQ ID NO: 7576572 - DNA, 22 bp, Homo sapiens
aaacatttttctaggtcttggt

SEQ ID NO: 7576573 - DNA, 22 bp, Homo sapiens
aaacatttgcaactcggtttgg

SEQ ID NO: 7576574 - DNA, 22 bp, Homo sapiens
aaacatttttctaggtcttggt

SEQ ID NO: 7576575 - DNA, 22 bp, Homo sapiens
aaacatttttctaggtcttggt

SEQ ID NO: 7576576 - DNA, 22 bp, Homo sapiens
aaacatttgcaactcggtttgg

SEQ ID NO: 7576577 - DNA, 22 bp, Homo sapiens
aaacatttgcaactcggtttgg

SEQ ID NO: 7576578 - DNA, 23 bp, Homo sapiens
aaacatttctcttttcctgcctc

SEQ ID NO: 7576579 - DNA, 23 bp, Homo sapiens
aaacatttctcttttcctgcctc

SEQ ID NO: 7576580 - DNA, 23 bp, Homo sapiens
aaacatttctcttttcctgcctc

SEQ ID NO: 7576581 - DNA, 23 bp, Homo sapiens
aaacatttctcttttcctgcctc

SEQ ID NO: 7576582 - DNA, 23 bp, Homo sapiens
aaacatttctcttttcctgcctc

SEQ ID NO: 7576583 - DNA, 22 bp, Homo sapiens
aaacatttgcaactcggtttgg

SEQ ID NO: 7576584 - DNA, 22 bp, Homo sapiens
aaacatttgcaactcggtttgg

SEQ ID NO: 7576585 - DNA, 22 bp, Homo sapiens
aaacatttgcaactcggtttgg

SEQ ID NO: 7576586 - DNA, 22 bp, Homo sapiens
aaacatttgcaactcggtttgg

SEQ ID NO: 7576587 - DNA, 22 bp, Homo sapiens
aaaccacacttagcagtttcgt

SEQ ID NO: 7576588 - DNA, 22 bp, Homo sapiens
aaaccaaccctggctggcctag

SEQ ID NO: 7576589 - DNA, 22 bp, Homo sapiens
aaaccacacttagcagtttcgt

SEQ ID NO: 7576590 - DNA, 22 bp, Homo sapiens
aaaccacacttagcagtttcgt

SEQ ID NO: 7576591 - DNA, 22 bp, Homo sapiens
aaaccacacttagcagtttcgt

SEQ ID NO: 7576592 - DNA, 22 bp, Homo sapiens
aaaccacacttagcagtttcgt

SEQ ID NO: 7576593 - DNA, 22 bp, Homo sapiens
aaaccaaccctggctggcctag

SEQ ID NO: 7576594 - DNA, 22 bp, Homo sapiens
aaaccaaacatttgcggtggtg

SEQ ID NO: 7576595 - DNA, 22 bp, Homo sapiens
aaaccaaacatttgcggtggtg

SEQ ID NO: 7576596 - DNA, 22 bp, Homo sapiens
aaacatttttcttcatcatcct

SEQ ID NO: 7576597 - DNA, 22 bp, Homo sapiens
aaacatttttcttcatcatcct

SEQ ID NO: 7576598 - DNA, 22 bp, Homo sapiens
aaacatttttcttcatcatcct

SEQ ID NO: 7576599 - DNA, 22 bp, Homo sapiens
aaaccacagttcagtgcttttg

SEQ ID NO: 7576600 - DNA, 22 bp, Homo sapiens
aaaccacagttcagtgcttttg

SEQ ID NO: 7576601 - DNA, 22 bp, Homo sapiens
aaaccacagttcagtgcttttg

SEQ ID NO: 7576602 - DNA, 22 bp, Homo sapiens
aaaccacagttcagtgcttttg

SEQ ID NO: 7576603 - DNA, 22 bp, Homo sapiens
aaaccacagttcagtgcttttg

SEQ ID NO: 7576604 - DNA, 22 bp, Homo sapiens
aaaccacatgccttcaaatgct

SEQ ID NO: 7576605 - DNA, 22 bp, Homo sapiens
aaaccacatgccttcaaatgct

SEQ ID NO: 7576606 - DNA, 22 bp, Homo sapiens
aaaccacatgccttcaaatgct

SEQ ID NO: 7576607 - DNA, 22 bp, Homo sapiens
aaaccacagttcagtgcttttg

SEQ ID NO: 7576608 - DNA, 22 bp, Homo sapiens
aaaccacatgccttcaaatgct

SEQ ID NO: 7576609 - DNA, 22 bp, Homo sapiens
aaaccactcctgattcacttca

SEQ ID NO: 7576610 - DNA, 22 bp, Homo sapiens
aaaccacttatatcgtgatttg

SEQ ID NO: 7576611 - DNA, 22 bp, Homo sapiens
aaaccacctccccagctgctgt

SEQ ID NO: 7576612 - DNA, 22 bp, Homo sapiens
aaaccattaggttttatctact

SEQ ID NO: 7576613 - DNA, 22 bp, Homo sapiens
aaaccattgcatctttcttaat

SEQ ID NO: 7576614 - DNA, 22 bp, Homo sapiens
aaaccattgcatctttcttaat

SEQ ID NO: 7576615 - DNA, 22 bp, Homo sapiens
aaaccatttgaattattactga

SEQ ID NO: 7576616 - DNA, 22 bp, Homo sapiens
aaaccattgcatctttcttaat

SEQ ID NO: 7576617 - DNA, 22 bp, Homo sapiens
aaaccattgcatctttcttaat

SEQ ID NO: 7576618 - DNA, 22 bp, Homo sapiens
aaaccatttgaattattactga

SEQ ID NO: 7576619 - DNA, 22 bp, Homo sapiens
aaactgtaaacacagcagtaca

SEQ ID NO: 7576620 - DNA, 22 bp, Homo sapiens
aaactggtttctgagatggaac

SEQ ID NO: 7576621 - DNA, 22 bp, Homo sapiens
aaactggtgtcactgagggctg

SEQ ID NO: 7576622 - DNA, 22 bp, Homo sapiens
aaactggtgtcactgagggctg

SEQ ID NO: 7576623 - DNA, 22 bp, Homo sapiens
aaaccattaggttttatctact

SEQ ID NO: 7576624 - DNA, 22 bp, Homo sapiens
aaaccattaggttttatctact

SEQ ID NO: 7576625 - DNA, 22 bp, Homo sapiens
aaaccatgctttgatgatttta

SEQ ID NO: 7576626 - DNA, 22 bp, Homo sapiens
aaaccatggagtaagttcacat

SEQ ID NO: 7576627 - DNA, 22 bp, Homo sapiens
aaaccatggagtaagttcacat

SEQ ID NO: 7576628 - DNA, 22 bp, Homo sapiens
aaaccatcagataattcatact

SEQ ID NO: 7576629 - DNA, 22 bp, Homo sapiens
aaaccagtgatagactagacac

SEQ ID NO: 7576630 - DNA, 22 bp, Homo sapiens
aaaccatcagataattcatact

SEQ ID NO: 7576631 - DNA, 22 bp, Homo sapiens
aaagatctgtgttaactcaagg

SEQ ID NO: 7576632 - DNA, 22 bp, Homo sapiens
aaagatgaccgtatgtcagagc

SEQ ID NO: 7576633 - DNA, 22 bp, Homo sapiens
aaagatgaccgtatgtcagagc

SEQ ID NO: 7576634 - DNA, 19 bp, Homo sapiens
aaagatctgggattgagac

SEQ ID NO: 7576635 - DNA, 19 bp, Homo sapiens
aaagatctgggattgagac

SEQ ID NO: 7576636 - DNA, 22 bp, Homo sapiens
aaagatctgtgttaactcaagg

SEQ ID NO: 7576637 - DNA, 22 bp, Homo sapiens
aaagatctgtgttaactcaagg

SEQ ID NO: 7576638 - DNA, 22 bp, Homo sapiens
aaagatctgacttagacacaga

SEQ ID NO: 7576639 - DNA, 22 bp, Homo sapiens
aaagatctgacttagacacaga

SEQ ID NO: 7576640 - DNA, 22 bp, Homo sapiens
aaagatctccccttcaaagagt

SEQ ID NO: 7576641 - DNA, 22 bp, Homo sapiens
aaagatctccccttcaaagagt

SEQ ID NO: 7576642 - DNA, 22 bp, Homo sapiens
aaagatctccccttcaaagagt

SEQ ID NO: 7576643 - DNA, 22 bp, Homo sapiens
aaagatcattctctggtccaga

SEQ ID NO: 7576644 - DNA, 22 bp, Homo sapiens
aaagatctatgggcatttagct

SEQ ID NO: 7576645 - DNA, 22 bp, Homo sapiens
aaagatcattctctggtccaga

SEQ ID NO: 7576646 - DNA, 22 bp, Homo sapiens
aaagatcattctctggtccaga

SEQ ID NO: 7576647 - DNA, 22 bp, Homo sapiens
aaagagctttccacactagtca

SEQ ID NO: 7576648 - DNA, 22 bp, Homo sapiens
aaagagctttccacactagtca

SEQ ID NO: 7576649 - DNA, 22 bp, Homo sapiens
aaagagctttccacactagtca

SEQ ID NO: 7576650 - DNA, 22 bp, Homo sapiens
aaagagctttagaaatctcaga

SEQ ID NO: 7576651 - DNA, 22 bp, Homo sapiens
aaagagctttagaaatctcaga

SEQ ID NO: 7576652 - DNA, 22 bp, Homo sapiens
aaagatgagtccggcagacata

SEQ ID NO: 7576653 - DNA, 22 bp, Homo sapiens
aaagatgagtccggcagacata

SEQ ID NO: 7576654 - DNA, 22 bp, Homo sapiens
aaagatgaccgtatgtcagagc

SEQ ID NO: 7576655 - DNA, 22 bp, Homo sapiens
aaagatgatctacaagttcatt

SEQ ID NO: 7576656 - DNA, 22 bp, Homo sapiens
aaagatgagtccggcagacata

SEQ ID NO: 7576657 - DNA, 22 bp, Homo sapiens
aaagatgagtccggcagacata

SEQ ID NO: 7576658 - DNA, 22 bp, Homo sapiens
aaagatgagtccggcagacata

SEQ ID NO: 7576659 - DNA, 22 bp, Homo sapiens
aaagatgcctaactcagaagat

SEQ ID NO: 7576660 - DNA, 22 bp, Homo sapiens
aaagatggcccatgatctcttg

SEQ ID NO: 7576661 - DNA, 22 bp, Homo sapiens
aaagatgcctaactcagaagat

SEQ ID NO: 7576662 - DNA, 22 bp, Homo sapiens
aaagatgatctacaagttcatt

SEQ ID NO: 7576663 - DNA, 22 bp, Homo sapiens
aaagatgtcacaagatgtgatg

SEQ ID NO: 7576664 - DNA, 22 bp, Homo sapiens
aaagatgtcacaagatgtgatg

SEQ ID NO: 7576665 - DNA, 22 bp, Homo sapiens
aaagatgtcagtcagataggat

SEQ ID NO: 7576666 - DNA, 22 bp, Homo sapiens
aaagaaggacctggaggaggat

SEQ ID NO: 7576667 - DNA, 22 bp, Homo sapiens
aaagaaggacctggaggaggat

SEQ ID NO: 7576668 - DNA, 22 bp, Homo sapiens
aaagaaggacctggaggaggat

SEQ ID NO: 7576669 - DNA, 22 bp, Homo sapiens
aaagaaggatgggagaaatcct

SEQ ID NO: 7576670 - DNA, 22 bp, Homo sapiens
aaagaaggatgggagaaatcct

SEQ ID NO: 7576671 - DNA, 22 bp, Homo sapiens
aaagaaggacctggaggaggat

SEQ ID NO: 7576672 - DNA, 22 bp, Homo sapiens
aaagaaggacctggaggaggat

SEQ ID NO: 7576673 - DNA, 22 bp, Homo sapiens
aaagaagctgtggctctgggag

SEQ ID NO: 7576674 - DNA, 22 bp, Homo sapiens
aaagaagcataggctagacttc

SEQ ID NO: 7576675 - DNA, 22 bp, Homo sapiens
aaagaagcataggctagacttc

SEQ ID NO: 7576676 - DNA, 17 bp, Homo sapiens
aaagagcttggagtgtt

SEQ ID NO: 7576677 - DNA, 22 bp, Homo sapiens
aaagaagggacagactgcctct

SEQ ID NO: 7576678 - DNA, 18 bp, Homo sapiens
aaagaaggattggagagc

SEQ ID NO: 7576679 - DNA, 18 bp, Homo sapiens
aaagaaggattggagagc

SEQ ID NO: 7576680 - DNA, 18 bp, Homo sapiens
aaagaaggattggagagc

SEQ ID NO: 7576681 - DNA, 22 bp, Homo sapiens
aaagaaggatgggagaaatcct

SEQ ID NO: 7576682 - DNA, 22 bp, Homo sapiens
aaagaaggatgggagaaatcct

SEQ ID NO: 7576683 - DNA, 22 bp, Homo sapiens
aaagaaggatgggagaaatcct

SEQ ID NO: 7576684 - DNA, 22 bp, Homo sapiens
aaagaagagctggaaggagtct

SEQ ID NO: 7576685 - DNA, 22 bp, Homo sapiens
aaagaagagctggaaggagtct

SEQ ID NO: 7576686 - DNA, 22 bp, Homo sapiens
aaagaagagctggaaggagtct

SEQ ID NO: 7576687 - DNA, 22 bp, Homo sapiens
aaagaagatggagacctgacta

SEQ ID NO: 7576688 - DNA, 22 bp, Homo sapiens
aaagaagagctggaaggagtct

SEQ ID NO: 7576689 - DNA, 22 bp, Homo sapiens
aaagaagagctggaaggagtct

SEQ ID NO: 7576690 - DNA, 22 bp, Homo sapiens
aaagaagcataggctagacttc

SEQ ID NO: 7576691 - DNA, 22 bp, Homo sapiens
aaagaagagctggaaggagtct

SEQ ID NO: 7576692 - DNA, 22 bp, Homo sapiens
aaagaagagctggaaggagtct

SEQ ID NO: 7576693 - DNA, 22 bp, Homo sapiens
aaagaagagctggaaggagtct

SEQ ID NO: 7576694 - DNA, 22 bp, Homo sapiens
aaagaagagctggaaggagtct

SEQ ID NO: 7576695 - DNA, 22 bp, Homo sapiens
aaagaagagctggaaggagtct

SEQ ID NO: 7576696 - DNA, 22 bp, Homo sapiens
aaagaagacagacatttctttc

SEQ ID NO: 7576697 - DNA, 19 bp, Homo sapiens
aaagaactttgggctaggc

SEQ ID NO: 7576698 - DNA, 22 bp, Homo sapiens
aaagaagacagacatttctttc

SEQ ID NO: 7576699 - DNA, 22 bp, Homo sapiens
aaacttgaggcaatgaaggtgt

SEQ ID NO: 7576700 - DNA, 22 bp, Homo sapiens
aaacttgagccaagggcttggg

SEQ ID NO: 7576701 - DNA, 22 bp, Homo sapiens
aaacttgagccaagggcttggg

SEQ ID NO: 7576702 - DNA, 22 bp, Homo sapiens
aaacttgagccaagggcttggg

SEQ ID NO: 7576703 - DNA, 22 bp, Homo sapiens
aaacttgacagtagacagatta

SEQ ID NO: 7576704 - DNA, 22 bp, Homo sapiens
aaacttgacagtagacagatta

SEQ ID NO: 7576705 - DNA, 22 bp, Homo sapiens
aaacttgacagtagacagatta

SEQ ID NO: 7576706 - DNA, 22 bp, Homo sapiens
aaacttgacagtgagacagttt

SEQ ID NO: 7576707 - DNA, 22 bp, Homo sapiens
aaacttgacagtgagacagttt

SEQ ID NO: 7576708 - DNA, 22 bp, Homo sapiens
aaacttctggctacaagcaata

SEQ ID NO: 7576709 - DNA, 22 bp, Homo sapiens
aaacttctggctacaagcaata

SEQ ID NO: 7576710 - DNA, 22 bp, Homo sapiens
aaacttcttgctgcattttctg

SEQ ID NO: 7576711 - DNA, 22 bp, Homo sapiens
aaacttggggctttcttacatt

SEQ ID NO: 7576712 - DNA, 23 bp, Homo sapiens
aaacttgctatggctgaaatcat

SEQ ID NO: 7576713 - DNA, 23 bp, Homo sapiens
aaacttgctatggctgaaatcat

SEQ ID NO: 7576714 - DNA, 23 bp, Homo sapiens
aaacttgctatggctgaaatcat

SEQ ID NO: 7576715 - DNA, 23 bp, Homo sapiens
aaacttgctatggctgaaatcat

SEQ ID NO: 7576716 - DNA, 23 bp, Homo sapiens
aaacttgctatggctgaaatcat

SEQ ID NO: 7576717 - DNA, 23 bp, Homo sapiens
aaacttgctatggctgaaatcat

SEQ ID NO: 7576718 - DNA, 23 bp, Homo sapiens
aaacttgctatggctgaaatcat

SEQ ID NO: 7576719 - DNA, 23 bp, Homo sapiens
aaacttgctatggctgaaatcat

SEQ ID NO: 7576720 - DNA, 20 bp, Homo sapiens
aaacttgatggcatagaata

SEQ ID NO: 7576721 - DNA, 20 bp, Homo sapiens
aaacttgatggcatagaata

SEQ ID NO: 7576722 - DNA, 22 bp, Homo sapiens
aaacttgatttagaactaaggc

SEQ ID NO: 7576723 - DNA, 22 bp, Homo sapiens
aaacttgatttagaactaaggc

SEQ ID NO: 7576724 - DNA, 22 bp, Homo sapiens
aaacttgagtcacttctcttcc

SEQ ID NO: 7576725 - DNA, 22 bp, Homo sapiens
aaacttgaggcaatgaaggtgt

SEQ ID NO: 7576726 - DNA, 22 bp, Homo sapiens
aaacttgatctgtgaccttgct

SEQ ID NO: 7576727 - DNA, 22 bp, Homo sapiens
aaactttaggaaggaatttaca

SEQ ID NO: 7576728 - DNA, 22 bp, Homo sapiens
aaactttaggaaggaatttaca

SEQ ID NO: 7576729 - DNA, 22 bp, Homo sapiens
aaactttaggaaggaatttaca

SEQ ID NO: 7576730 - DNA, 22 bp, Homo sapiens
aaactttaggaaggaatttaca

SEQ ID NO: 7576731 - DNA, 22 bp, Homo sapiens
aaagaactacctgtatgatatt

SEQ ID NO: 7576732 - DNA, 22 bp, Homo sapiens
aaagaactattaacgaggaagc

SEQ ID NO: 7576733 - DNA, 22 bp, Homo sapiens
aaagaactattaacgaggaagc

SEQ ID NO: 7576734 - DNA, 22 bp, Homo sapiens
aaagaactacctgtatgatatt

SEQ ID NO: 7576735 - DNA, 22 bp, Homo sapiens
aaagaactacctgtatgatatt

SEQ ID NO: 7576736 - DNA, 22 bp, Homo sapiens
aaagaacttatcctagaatttg

SEQ ID NO: 7576737 - DNA, 22 bp, Homo sapiens
aaagaacttaagaaattaggct

SEQ ID NO: 7576738 - DNA, 22 bp, Homo sapiens
aaagaacttatcctagaatttg

SEQ ID NO: 7576739 - DNA, 22 bp, Homo sapiens
aaagaacttatcctagaatttg

SEQ ID NO: 7576740 - DNA, 22 bp, Homo sapiens
aaagaacttaagaaattaggct

SEQ ID NO: 7576741 - DNA, 22 bp, Homo sapiens
aaagaacttaagaaattaggct

SEQ ID NO: 7576742 - DNA, 22 bp, Homo sapiens
aaagaactcagagaggatttta

SEQ ID NO: 7576743 - DNA, 22 bp, Homo sapiens
aaagaactcagagaggatttta

SEQ ID NO: 7576744 - DNA, 22 bp, Homo sapiens
aaagaagacagacatttctttc

SEQ ID NO: 7576745 - DNA, 22 bp, Homo sapiens
aaagaagacagacatttctttc

SEQ ID NO: 7576746 - DNA, 19 bp, Homo sapiens
aaagaactttgggctaggc

SEQ ID NO: 7576747 - DNA, 22 bp, Homo sapiens
aaagaacttatcctagaatttg

SEQ ID NO: 7576748 - DNA, 22 bp, Homo sapiens
aaagaacttatcctagaatttg

SEQ ID NO: 7576749 - DNA, 22 bp, Homo sapiens
aaacttgtgagctaaataaatg

SEQ ID NO: 7576750 - DNA, 22 bp, Homo sapiens
aaacttgtgagctaaataaatg

SEQ ID NO: 7576751 - DNA, 22 bp, Homo sapiens
aaacttgggtgaccctgagcaa

SEQ ID NO: 7576752 - DNA, 22 bp, Homo sapiens
aaacttgttctcatgttgcaga

SEQ ID NO: 7576753 - DNA, 22 bp, Homo sapiens
aaacttgtggtggagaagccta

SEQ ID NO: 7576754 - DNA, 22 bp, Homo sapiens
aaacttgttctcttgtgcctat

SEQ ID NO: 7576755 - DNA, 22 bp, Homo sapiens
aaactttaaatttgtacctctg

SEQ ID NO: 7576756 - DNA, 22 bp, Homo sapiens
aaactttaaatttgtacctctg

SEQ ID NO: 7576757 - DNA, 22 bp, Homo sapiens
aaactttaaatttgtacctctg

SEQ ID NO: 7576758 - DNA, 22 bp, Homo sapiens
aaactttaagacagtcctcaag

SEQ ID NO: 7576759 - DNA, 22 bp, Homo sapiens
aaactttaagacagtcctcaag

SEQ ID NO: 7576760 - DNA, 22 bp, Homo sapiens
aaactttaggaaggaatttaca

SEQ ID NO: 7576761 - DNA, 22 bp, Homo sapiens
aaactttaggaaggaatttaca

SEQ ID NO: 7576762 - DNA, 22 bp, Homo sapiens
aaactttaggaaggaatttaca

SEQ ID NO: 7576763 - DNA, 20 bp, Homo sapiens
aaaaagacaaaacgagttgg

SEQ ID NO: 7576764 - DNA, 20 bp, Homo sapiens
aaaaagacaaaacgagttgg

SEQ ID NO: 7576765 - DNA, 22 bp, Homo sapiens
aaaaagacagaggatgaggcag

SEQ ID NO: 7576766 - DNA, 22 bp, Homo sapiens
aaaaagacagaggatgaggcag

SEQ ID NO: 7576767 - DNA, 22 bp, Homo sapiens
aaaaagacagaggatgaggcag

SEQ ID NO: 7576768 - DNA, 22 bp, Homo sapiens
aaaaagacagaggatgaggcag

SEQ ID NO: 7576769 - DNA, 22 bp, Homo sapiens
aaaaagacagaggatgaggcag

SEQ ID NO: 7576770 - DNA, 22 bp, Homo sapiens
aaaaagacagaggatgaggcag

SEQ ID NO: 7576771 - DNA, 22 bp, Homo sapiens
aaaaagacagaggatgaggcag

SEQ ID NO: 7576772 - DNA, 22 bp, Homo sapiens
aaaaagacagaggatgaggcag

SEQ ID NO: 7576773 - DNA, 22 bp, Homo sapiens
aaaaagacagaggatgaggcag

SEQ ID NO: 7576774 - DNA, 22 bp, Homo sapiens
aaaaagactagtcgagtgcagt

SEQ ID NO: 7576775 - DNA, 22 bp, Homo sapiens
aaaaagactagtcgagtgcagt

SEQ ID NO: 7576776 - DNA, 22 bp, Homo sapiens
aaaaagactagtcgagtgcagt

SEQ ID NO: 7576777 - DNA, 22 bp, Homo sapiens
aaaaagactagtcgagtgcagt

SEQ ID NO: 7576778 - DNA, 22 bp, Homo sapiens
aaaaagagaaatgctctagtcc

SEQ ID NO: 7576779 - DNA, 22 bp, Homo sapiens
aaaaagacttccaactcaggag

SEQ ID NO: 7576780 - DNA, 22 bp, Homo sapiens
aaaaagacttccaactcaggag

SEQ ID NO: 7576781 - DNA, 22 bp, Homo sapiens
aaaaagacttccaactcaggag

SEQ ID NO: 7576782 - DNA, 22 bp, Homo sapiens
aaaaagacttccaactcaggag

SEQ ID NO: 7576783 - DNA, 22 bp, Homo sapiens
aaaaagacttccaactcaggag

SEQ ID NO: 7576784 - DNA, 22 bp, Homo sapiens
aaaaagactagtcgagtgcagt

SEQ ID NO: 7576785 - DNA, 22 bp, Homo sapiens
aaaaagacttccaactcaggag

SEQ ID NO: 7576786 - DNA, 22 bp, Homo sapiens
aaaaagacttccaactcaggag

SEQ ID NO: 7576787 - DNA, 22 bp, Homo sapiens
aaaaagactagtcgagtgcagt

SEQ ID NO: 7576788 - DNA, 22 bp, Homo sapiens
aaaaagactagtcgagtgcagt

SEQ ID NO: 7576789 - DNA, 20 bp, Homo sapiens
aaaaagacaaaacgagttgg

SEQ ID NO: 7576790 - DNA, 20 bp, Homo sapiens
aaaaagacaaaacgagttgg

SEQ ID NO: 7576791 - DNA, 20 bp, Homo sapiens
aaaaagacaaaacgagttgg

SEQ ID NO: 7576792 - DNA, 19 bp, Homo sapiens
aaaaacttagtccagaaag

SEQ ID NO: 7576793 - DNA, 20 bp, Homo sapiens
aaaaagacaaaacgagttgg

SEQ ID NO: 7576794 - DNA, 20 bp, Homo sapiens
aaaaagacaaaacgagttgg

SEQ ID NO: 7576795 - DNA, 20 bp, Homo sapiens
aaaaagacaaaacgagttgg

SEQ ID NO: 7576796 - DNA, 19 bp, Homo sapiens
aaaaacttagtccagaaag

SEQ ID NO: 7576797 - DNA, 19 bp, Homo sapiens
aaaaacttagtccagaaag

SEQ ID NO: 7576798 - DNA, 19 bp, Homo sapiens
aaaaacttagtccagaaag

SEQ ID NO: 7576799 - DNA, 19 bp, Homo sapiens
aaaaacttagtccagaaag

SEQ ID NO: 7576800 - DNA, 22 bp, Homo sapiens
aaaaactgtaattacttttgca

SEQ ID NO: 7576801 - DNA, 22 bp, Homo sapiens
aaaaactgtaattacttttgca

SEQ ID NO: 7576802 - DNA, 22 bp, Homo sapiens
aaaaactgtaattacttttgca

SEQ ID NO: 7576803 - DNA, 22 bp, Homo sapiens
aaaaactgtaattacttttgca

SEQ ID NO: 7576804 - DNA, 22 bp, Homo sapiens
aaaaactggtaactattcccca

SEQ ID NO: 7576805 - DNA, 22 bp, Homo sapiens
aaaaactggtaactattcccca

SEQ ID NO: 7576806 - DNA, 22 bp, Homo sapiens
aaaaactgtaattacttttgca

SEQ ID NO: 7576807 - DNA, 22 bp, Homo sapiens
aaaaactgtaattacttttgca

SEQ ID NO: 7576808 - DNA, 22 bp, Homo sapiens
aaaaactgtaattacttttgca

SEQ ID NO: 7576809 - DNA, 22 bp, Homo sapiens
aaaaactgtaattacttttgca

SEQ ID NO: 7576810 - DNA, 22 bp, Homo sapiens
aaaaatgaattcttcagtggca

SEQ ID NO: 7576811 - DNA, 21 bp, Homo sapiens
aaaaatgaagttgttcaggaa

SEQ ID NO: 7576812 - DNA, 21 bp, Homo sapiens
aaaaatgaagttgttcaggaa

SEQ ID NO: 7576813 - DNA, 22 bp, Homo sapiens
aaaaatgaattcttcagtggca

SEQ ID NO: 7576814 - DNA, 22 bp, Homo sapiens
aaaaatgaattcttcagtggca

SEQ ID NO: 7576815 - DNA, 21 bp, Homo sapiens
aaaaatgaagttgttcaggaa

SEQ ID NO: 7576816 - DNA, 21 bp, Homo sapiens
aaaaatgaagttgttcaggaa

SEQ ID NO: 7576817 - DNA, 22 bp, Homo sapiens
aaaaatgaaacggctggttggc

SEQ ID NO: 7576818 - DNA, 22 bp, Homo sapiens
aaaaatgaaacggctggttggc

SEQ ID NO: 7576819 - DNA, 21 bp, Homo sapiens
aaaaatgaagttgttcaggaa

SEQ ID NO: 7576820 - DNA, 21 bp, Homo sapiens
aaaaatgaagttgttcaggaa

SEQ ID NO: 7576821 - DNA, 21 bp, Homo sapiens
aaaaatgaagttgttcaggaa

SEQ ID NO: 7576822 - DNA, 21 bp, Homo sapiens
aaaaatgaagttgttcaggaa

SEQ ID NO: 7576823 - DNA, 21 bp, Homo sapiens
aaaaatgaagttgttcaggaa

SEQ ID NO: 7576824 - DNA, 22 bp, Homo sapiens
aaaaagatgtcctgaagtttag

SEQ ID NO: 7576825 - DNA, 22 bp, Homo sapiens
aaaaagatgtcctgaagtttag

SEQ ID NO: 7576826 - DNA, 22 bp, Homo sapiens
aaaaagatgtcctgaagtttag

SEQ ID NO: 7576827 - DNA, 22 bp, Homo sapiens
aaaaagatagcattgtgctcct

SEQ ID NO: 7576828 - DNA, 22 bp, Homo sapiens
aaaaagatgtcctgaagtttag

SEQ ID NO: 7576829 - DNA, 22 bp, Homo sapiens
aaaaagatgtcctgaagtttag

SEQ ID NO: 7576830 - DNA, 22 bp, Homo sapiens
aaaaagatgtcctgaagtttag

SEQ ID NO: 7576831 - DNA, 22 bp, Homo sapiens
aaaaagatgtcctgaagtttag

SEQ ID NO: 7576832 - DNA, 22 bp, Homo sapiens
aaaaagatagcattgtgctcct

SEQ ID NO: 7576833 - DNA, 22 bp, Homo sapiens
aaaaagatagcattgtgctcct

SEQ ID NO: 7576834 - DNA, 22 bp, Homo sapiens
aaaaagatagcattgtgctcct

SEQ ID NO: 7576835 - DNA, 22 bp, Homo sapiens
aaaaagatagcattgtgctcct

SEQ ID NO: 7576836 - DNA, 19 bp, Homo sapiens
aaaaagaggctataatatt

SEQ ID NO: 7576837 - DNA, 22 bp, Homo sapiens
aaaaagacttccaactcaggag

SEQ ID NO: 7576838 - DNA, 19 bp, Homo sapiens
aaaaagaggctataatatt

SEQ ID NO: 7576839 - DNA, 19 bp, Homo sapiens
aaaaagaggctataatatt

SEQ ID NO: 7576840 - DNA, 19 bp, Homo sapiens
aaaaagaggctataatatt

SEQ ID NO: 7576841 - DNA, 19 bp, Homo sapiens
aaaaagaggctataatatt

SEQ ID NO: 7576842 - DNA, 19 bp, Homo sapiens
aaaaagaggctataatatt

SEQ ID NO: 7576843 - DNA, 22 bp, Homo sapiens
aaaaggcttggaacctttccct

SEQ ID NO: 7576844 - DNA, 22 bp, Homo sapiens
aaaaggcttggaacctttccct

SEQ ID NO: 7576845 - DNA, 22 bp, Homo sapiens
aaaaggcttggaacctttccct

SEQ ID NO: 7576846 - DNA, 22 bp, Homo sapiens
aaaagggaaagcagaatgactt

SEQ ID NO: 7576847 - DNA, 22 bp, Homo sapiens
aaaagggaaagcagaatgactt

SEQ ID NO: 7576848 - DNA, 22 bp, Homo sapiens
aaaaggctcttcaaaatggaag

SEQ ID NO: 7576849 - DNA, 22 bp, Homo sapiens
aaaaggctcttcaaaatggaag

SEQ ID NO: 7576850 - DNA, 22 bp, Homo sapiens
aaaaggctcttcaaaatggaag

SEQ ID NO: 7576851 - DNA, 22 bp, Homo sapiens
aaaaatgtgaccacagggtgtt

SEQ ID NO: 7576852 - DNA, 22 bp, Homo sapiens
aaaaatgtgaccacagggtgtt

SEQ ID NO: 7576853 - DNA, 22 bp, Homo sapiens
aaaaatgtcattatggaactga

SEQ ID NO: 7576854 - DNA, 22 bp, Homo sapiens
aaaaatgtcattatggaactga

SEQ ID NO: 7576855 - DNA, 22 bp, Homo sapiens
aaaaatgtcattatggaactga

SEQ ID NO: 7576856 - DNA, 22 bp, Homo sapiens
aaaaatgtcattatggaactga

SEQ ID NO: 7576857 - DNA, 22 bp, Homo sapiens
aaaaatgtcattatggaactga

SEQ ID NO: 7576858 - DNA, 22 bp, Homo sapiens
aaaaatgtcattatggaactga

SEQ ID NO: 7576859 - DNA, 22 bp, Homo sapiens
aaaaatgtcattatggaactga

SEQ ID NO: 7576860 - DNA, 22 bp, Homo sapiens
aaaaatgtcattatggaactga

SEQ ID NO: 7576861 - DNA, 22 bp, Homo sapiens
aaaaatgtcattatggaactga

SEQ ID NO: 7576862 - DNA, 22 bp, Homo sapiens
aaaaatgcttggacttaataaa

SEQ ID NO: 7576863 - DNA, 22 bp, Homo sapiens
aaaaatgcttggacttaataaa

SEQ ID NO: 7576864 - DNA, 22 bp, Homo sapiens
aaaaatgcttggacttaataaa

SEQ ID NO: 7576865 - DNA, 22 bp, Homo sapiens
aaaaatgcttggacttaataaa

SEQ ID NO: 7576866 - DNA, 22 bp, Homo sapiens
aaaaatgcttggacttaataaa

SEQ ID NO: 7576867 - DNA, 22 bp, Homo sapiens
aaaaatgctgtggtagctgtgt

SEQ ID NO: 7576868 - DNA, 22 bp, Homo sapiens
aaaaatgctgtggtagctgtgt

SEQ ID NO: 7576869 - DNA, 22 bp, Homo sapiens
aaaaatgctgtggtagctgtgt

SEQ ID NO: 7576870 - DNA, 22 bp, Homo sapiens
aaaaatgctgtggtagctgtgt

SEQ ID NO: 7576871 - DNA, 22 bp, Homo sapiens
aaaaatgaattcttcagtggca

SEQ ID NO: 7576872 - DNA, 22 bp, Homo sapiens
aaaaatgaattcttcagtggca

SEQ ID NO: 7576873 - DNA, 22 bp, Homo sapiens
aaaaatgcttggacttaataaa

SEQ ID NO: 7576874 - DNA, 22 bp, Homo sapiens
aaaaatgcttggacttaataaa

SEQ ID NO: 7576875 - DNA, 22 bp, Homo sapiens
aaaaatgcttggacttaataaa

SEQ ID NO: 7576876 - DNA, 22 bp, Homo sapiens
aaaaatgcttggacttaataaa

SEQ ID NO: 7576877 - DNA, 22 bp, Homo sapiens
aaaaatgcttggacttaataaa

SEQ ID NO: 7576878 - DNA, 22 bp, Homo sapiens
aaaaatgtcattatggaactga

SEQ ID NO: 7576879 - DNA, 22 bp, Homo sapiens
aaaaatgcttggacttaataaa

SEQ ID NO: 7576880 - DNA, 22 bp, Homo sapiens
aaaaatgcttggacttaataaa

SEQ ID NO: 7576881 - DNA, 22 bp, Homo sapiens
aaaaatgcttggacttaataaa

SEQ ID NO: 7576882 - DNA, 22 bp, Homo sapiens
aaaaatgcttggacttaataaa

SEQ ID NO: 7576883 - DNA, 22 bp, Homo sapiens
aaaagtattttggatctcagat

SEQ ID NO: 7576884 - DNA, 22 bp, Homo sapiens
aaaagtattttggatctcagat

SEQ ID NO: 7576885 - DNA, 22 bp, Homo sapiens
aaaagtattttggatctcagat

SEQ ID NO: 7576886 - DNA, 22 bp, Homo sapiens
aaaagtattttggatctcagat

SEQ ID NO: 7576887 - DNA, 22 bp, Homo sapiens
aaaagtattttggatctcagat

SEQ ID NO: 7576888 - DNA, 22 bp, Homo sapiens
aaaagtattttggatctcagat

SEQ ID NO: 7576889 - DNA, 22 bp, Homo sapiens
aaaagggacgacaacaggccac

SEQ ID NO: 7576890 - DNA, 22 bp, Homo sapiens
aaaagggactactctcagctcc

SEQ ID NO: 7576891 - DNA, 22 bp, Homo sapiens
aaaagggaaagcagaatgactt

SEQ ID NO: 7576892 - DNA, 22 bp, Homo sapiens
aaaagggaaagcagaatgactt

SEQ ID NO: 7576893 - DNA, 22 bp, Homo sapiens
aaaagggaaagcagaatgactt

SEQ ID NO: 7576894 - DNA, 22 bp, Homo sapiens
aaaagtattttggatctcagat

SEQ ID NO: 7576895 - DNA, 22 bp, Homo sapiens
aaaagtattttggatctcagat

SEQ ID NO: 7576896 - DNA, 22 bp, Homo sapiens
aaaagtcagtctctcctagctc

SEQ ID NO: 7576897 - DNA, 22 bp, Homo sapiens
aaaagtcagtctctcctagctc

SEQ ID NO: 7576898 - DNA, 22 bp, Homo sapiens
aaaagtctacaagcttcaacaa

SEQ ID NO: 7576899 - DNA, 22 bp, Homo sapiens
aaaagtctacaagcttcaacaa

SEQ ID NO: 7576900 - DNA, 22 bp, Homo sapiens
aaaagtctacaagcttcaacaa

SEQ ID NO: 7576901 - DNA, 19 bp, Homo sapiens
aaaagtctattcaattaca

SEQ ID NO: 7576902 - DNA, 22 bp, Homo sapiens
aaaagtctacaagcttcaacaa

SEQ ID NO: 7576903 - DNA, 22 bp, Homo sapiens
aaaagtctgctctcatttcaga

SEQ ID NO: 7576904 - DNA, 22 bp, Homo sapiens
aaaagtctctctgagtaaaagt

SEQ ID NO: 7576905 - DNA, 22 bp, Homo sapiens
aaaagtctgctctcatttcaga

SEQ ID NO: 7576906 - DNA, 22 bp, Homo sapiens
aaaagtctgctctcatttcaga

SEQ ID NO: 7576907 - DNA, 22 bp, Homo sapiens
aaaagtctgctctcatttcaga

SEQ ID NO: 7576908 - DNA, 22 bp, Homo sapiens
aaaagtctgctctcatttcaga

SEQ ID NO: 7576909 - DNA, 22 bp, Homo sapiens
aaaagtctgctttctattatca

SEQ ID NO: 7576910 - DNA, 22 bp, Homo sapiens
aaaagtctgctttctattatca

SEQ ID NO: 7576911 - DNA, 22 bp, Homo sapiens
aaaagtctgctttctattatca

SEQ ID NO: 7576912 - DNA, 22 bp, Homo sapiens
aaaagtctgctttctattatca

SEQ ID NO: 7576913 - DNA, 22 bp, Homo sapiens
aaaagtctgctttctattatca

SEQ ID NO: 7576914 - DNA, 22 bp, Homo sapiens
aaaagtctgctctcatttcaga

SEQ ID NO: 7576915 - DNA, 22 bp, Homo sapiens
aaaagtctgctctcatttcaga

SEQ ID NO: 7576916 - DNA, 22 bp, Homo sapiens
aaaagtctctctgagtaaaagt

SEQ ID NO: 7576917 - DNA, 22 bp, Homo sapiens
aaaagtctctctgagtaaaagt

SEQ ID NO: 7576918 - DNA, 22 bp, Homo sapiens
aaaagtctctctgagtaaaagt

SEQ ID NO: 7576919 - DNA, 22 bp, Homo sapiens
aaaagtctctctgagtaaaagt

SEQ ID NO: 7576920 - DNA, 22 bp, Homo sapiens
aaaagtctctctgagtaaaagt

SEQ ID NO: 7576921 - DNA, 19 bp, Homo sapiens
aaaagtctattcaattaca

SEQ ID NO: 7576922 - DNA, 19 bp, Homo sapiens
aaaagtctattcaattaca

SEQ ID NO: 7576923 - DNA, 19 bp, Homo sapiens
aaaagtctattcaattaca

SEQ ID NO: 7576924 - DNA, 19 bp, Homo sapiens
aaaagtctattcaattaca

SEQ ID NO: 7576925 - DNA, 22 bp, Homo sapiens
aaaagtctctctgagtaaaagt

SEQ ID NO: 7576926 - DNA, 22 bp, Homo sapiens
aaaagtctctctgagtaaaagt

SEQ ID NO: 7576927 - DNA, 22 bp, Homo sapiens
aaaagtcttggggaaggccagg

SEQ ID NO: 7576928 - DNA, 22 bp, Homo sapiens
aaaagtctgctttctattatca

SEQ ID NO: 7576929 - DNA, 22 bp, Homo sapiens
aaaagtcttggggaaggccagg

SEQ ID NO: 7576930 - DNA, 22 bp, Homo sapiens
aaaagtcttggggaaggccagg

SEQ ID NO: 7576931 - DNA, 22 bp, Homo sapiens
aaaagtcttgtcaaggttccca

SEQ ID NO: 7576932 - DNA, 22 bp, Homo sapiens
aaaagtcttgtcaaggttccca

SEQ ID NO: 7576933 - DNA, 22 bp, Homo sapiens
aaaagtcttgtcaaggttccca

SEQ ID NO: 7576934 - DNA, 22 bp, Homo sapiens
aaaagtcttggggaaggccagg

SEQ ID NO: 7576935 - DNA, 22 bp, Homo sapiens
aaaagtgtccagattatgaaga

SEQ ID NO: 7576936 - DNA, 22 bp, Homo sapiens
aaaagtgatgggatggcacttc

SEQ ID NO: 7576937 - DNA, 22 bp, Homo sapiens
aaaagtgatgggatggcacttc

SEQ ID NO: 7576938 - DNA, 22 bp, Homo sapiens
aaaagtgaggcagcccaaggga

SEQ ID NO: 7576939 - DNA, 22 bp, Homo sapiens
aaaagtgatgggatggcacttc

SEQ ID NO: 7576940 - DNA, 22 bp, Homo sapiens
aaaagtgtccagattatgaaga

SEQ ID NO: 7576941 - DNA, 22 bp, Homo sapiens
aaaatagataatgccagggtca

SEQ ID NO: 7576942 - DNA, 22 bp, Homo sapiens
aaaagtgtccagattatgaaga

SEQ ID NO: 7576943 - DNA, 22 bp, Homo sapiens
aaaagtgtccagattatgaaga

SEQ ID NO: 7576944 - DNA, 22 bp, Homo sapiens
aaaatagatgaaaggaagtctg

SEQ ID NO: 7576945 - DNA, 22 bp, Homo sapiens
aaaatagatgaaaggaagtctg

SEQ ID NO: 7576946 - DNA, 22 bp, Homo sapiens
aaaatagataatgccagggtca

SEQ ID NO: 7576947 - DNA, 22 bp, Homo sapiens
aaaatagatgaaaggaagtctg

SEQ ID NO: 7576948 - DNA, 22 bp, Homo sapiens
aaaatagataatgccagggtca

SEQ ID NO: 7576949 - DNA, 22 bp, Homo sapiens
aaaatagataatgccagggtca

SEQ ID NO: 7576950 - DNA, 22 bp, Homo sapiens
aaaatagatgaaaggaagtctg

SEQ ID NO: 7576951 - DNA, 22 bp, Homo sapiens
aaaatagatgaaaggaagtctg

SEQ ID NO: 7576952 - DNA, 22 bp, Homo sapiens
aaaatagatgaaaggaagtctg

SEQ ID NO: 7576953 - DNA, 22 bp, Homo sapiens
aaaatagatgaaaggaagtctg

SEQ ID NO: 7576954 - DNA, 22 bp, Homo sapiens
aaaatagattctaggatgtctt

SEQ ID NO: 7576955 - DNA, 22 bp, Homo sapiens
aaaatagattctaggatgtctt

SEQ ID NO: 7576956 - DNA, 22 bp, Homo sapiens
aaaatagattctaggatgtctt

SEQ ID NO: 7576957 - DNA, 22 bp, Homo sapiens
aaaatagattctaggatgtctt

SEQ ID NO: 7576958 - DNA, 22 bp, Homo sapiens
aaaatagattctaggatgtctt

SEQ ID NO: 7576959 - DNA, 22 bp, Homo sapiens
aaaatagattctaggatgtctt

SEQ ID NO: 7576960 - DNA, 22 bp, Homo sapiens
aaaatagattctaggatgtctt

SEQ ID NO: 7576961 - DNA, 22 bp, Homo sapiens
aaaatagcctcacataattgct

SEQ ID NO: 7576962 - DNA, 22 bp, Homo sapiens
aaaatagctatggaatgtcact

SEQ ID NO: 7576963 - DNA, 22 bp, Homo sapiens
aaaatagctatggaatgtcact

SEQ ID NO: 7576964 - DNA, 22 bp, Homo sapiens
aaaatagctatggaatgtcact

SEQ ID NO: 7576965 - DNA, 22 bp, Homo sapiens
aaaatagctatggaatgtcact

SEQ ID NO: 7576966 - DNA, 22 bp, Homo sapiens
aaaatagcctcacataattgct

SEQ ID NO: 7576967 - DNA, 22 bp, Homo sapiens
aaaatagcctcacataattgct

SEQ ID NO: 7576968 - DNA, 22 bp, Homo sapiens
aaaatagcctcacataattgct

SEQ ID NO: 7576969 - DNA, 22 bp, Homo sapiens
aaaatagcctcacataattgct

SEQ ID NO: 7576970 - DNA, 22 bp, Homo sapiens
aaaatagcctcacataattgct

SEQ ID NO: 7576971 - DNA, 20 bp, Homo sapiens
aaaatagccccaggctcatt

SEQ ID NO: 7576972 - DNA, 22 bp, Homo sapiens
aaaatagcatgaaaggcctttg

SEQ ID NO: 7576973 - DNA, 22 bp, Homo sapiens
aaaatagcatgaaaggcctttg

SEQ ID NO: 7576974 - DNA, 22 bp, Homo sapiens
aaaatagcagggatgtgggaaa

SEQ ID NO: 7576975 - DNA, 22 bp, Homo sapiens
aaaatagcagggatgtgggaaa

SEQ ID NO: 7576976 - DNA, 22 bp, Homo sapiens
aaaatagcatattgctttcttt

SEQ ID NO: 7576977 - DNA, 22 bp, Homo sapiens
aaaatagcatattgctttcttt

SEQ ID NO: 7576978 - DNA, 22 bp, Homo sapiens
aaaatagcatattgctttcttt

SEQ ID NO: 7576979 - DNA, 22 bp, Homo sapiens
aaaatagctatggaatgtcact

SEQ ID NO: 7576980 - DNA, 22 bp, Homo sapiens
aaaatagctatggaatgtcact

SEQ ID NO: 7576981 - DNA, 22 bp, Homo sapiens
aaaatagctatggaatgtcact

SEQ ID NO: 7576982 - DNA, 22 bp, Homo sapiens
aaaatagctatggaatgtcact

SEQ ID NO: 7576983 - DNA, 22 bp, Homo sapiens
aaaatagctatggaatgtcact

SEQ ID NO: 7576984 - DNA, 22 bp, Homo sapiens
aaaattcattcctcagactgcc

SEQ ID NO: 7576985 - DNA, 22 bp, Homo sapiens
aaaattcattcctcagactgcc

SEQ ID NO: 7576986 - DNA, 22 bp, Homo sapiens
aaaattcattcctcagactgcc

SEQ ID NO: 7576987 - DNA, 22 bp, Homo sapiens
aaaattcattcctcagactgcc

SEQ ID NO: 7576988 - DNA, 22 bp, Homo sapiens
aaaattcattcctcagactgcc

SEQ ID NO: 7576989 - DNA, 22 bp, Homo sapiens
aaaataggtacggattagaatg

SEQ ID NO: 7576990 - DNA, 22 bp, Homo sapiens
aaaataggtacggattagaatg

SEQ ID NO: 7576991 - DNA, 22 bp, Homo sapiens
aaaataggtacggattagaatg

SEQ ID NO: 7576992 - DNA, 22 bp, Homo sapiens
aaaattcatggcttgggaaaag

SEQ ID NO: 7576993 - DNA, 22 bp, Homo sapiens
aaaataggtacggattagaatg

SEQ ID NO: 7576994 - DNA, 22 bp, Homo sapiens
aaaatagttaacgttcagagta

SEQ ID NO: 7576995 - DNA, 22 bp, Homo sapiens
aaaattcatggcttgggaaaag

SEQ ID NO: 7576996 - DNA, 22 bp, Homo sapiens
aaacacacagaaatgaatgagg

SEQ ID NO: 7576997 - DNA, 22 bp, Homo sapiens
aaacacacagaaatgaatgagg

SEQ ID NO: 7576998 - DNA, 22 bp, Homo sapiens
aaacacacagaaatgaatgagg

SEQ ID NO: 7576999 - DNA, 22 bp, Homo sapiens
aaacacacagaaatgaatgagg

SEQ ID NO: 7577000 - DNA, 22 bp, Homo sapiens
aaacacaatgtttctttgttct

SEQ ID NO: 7577001 - DNA, 22 bp, Homo sapiens
aaacacaatgtttctttgttct

SEQ ID NO: 7577002 - DNA, 22 bp, Homo sapiens
aaacacaatgtttctttgttct

SEQ ID NO: 7577003 - DNA, 22 bp, Homo sapiens
aaacacaatgtttctttgttct

SEQ ID NO: 7577004 - DNA, 22 bp, Homo sapiens
aaacacacctttggaactgtga

SEQ ID NO: 7577005 - DNA, 22 bp, Homo sapiens
aaacacacagaaatgaatgagg

SEQ ID NO: 7577006 - DNA, 22 bp, Homo sapiens
aaacacacctttggaactgtga

SEQ ID NO: 7577007 - DNA, 22 bp, Homo sapiens
aaacacacctttggaactgtga

SEQ ID NO: 7577008 - DNA, 22 bp, Homo sapiens
aaacacacctttggaactgtga

SEQ ID NO: 7577009 - DNA, 22 bp, Homo sapiens
aaacacacctttggaactgtga

SEQ ID NO: 7577010 - DNA, 22 bp, Homo sapiens
aaacacacctttggaactgtga

SEQ ID NO: 7577011 - DNA, 19 bp, Homo sapiens
aaacacagatttcttacca

SEQ ID NO: 7577012 - DNA, 19 bp, Homo sapiens
aaacacagatttcttacca

SEQ ID NO: 7577013 - DNA, 19 bp, Homo sapiens
aaacacagatttcttacca

SEQ ID NO: 7577014 - DNA, 19 bp, Homo sapiens
aaacacagatttcttacca

SEQ ID NO: 7577015 - DNA, 22 bp, Homo sapiens
aaacaacttctgcactatgggt

SEQ ID NO: 7577016 - DNA, 22 bp, Homo sapiens
aaacaacttctgcactatgggt

SEQ ID NO: 7577017 - DNA, 22 bp, Homo sapiens
aaacaacttctgcactatgggt

SEQ ID NO: 7577018 - DNA, 22 bp, Homo sapiens
aaacaagagcttacatggctgc

SEQ ID NO: 7577019 - DNA, 22 bp, Homo sapiens
aaacaagagcttacatggctgc

SEQ ID NO: 7577020 - DNA, 22 bp, Homo sapiens
aaacacaagatggcctcttctg

SEQ ID NO: 7577021 - DNA, 22 bp, Homo sapiens
aaacaagagcttacatggctgc

SEQ ID NO: 7577022 - DNA, 22 bp, Homo sapiens
aaacaactcggcaactgctttt

SEQ ID NO: 7577023 - DNA, 22 bp, Homo sapiens
aaacaactcggcaactgctttt

SEQ ID NO: 7577024 - DNA, 22 bp, Homo sapiens
aaacaactcggcaactgctttt

SEQ ID NO: 7577025 - DNA, 22 bp, Homo sapiens
aaacaactcggcaactgctttt

SEQ ID NO: 7577026 - DNA, 22 bp, Homo sapiens
aaacaactcggcaactgctttt

SEQ ID NO: 7577027 - DNA, 22 bp, Homo sapiens
aaacaactcggcaactgctttt

SEQ ID NO: 7577028 - DNA, 22 bp, Homo sapiens
aaacaacctaaagttactgatc

SEQ ID NO: 7577029 - DNA, 22 bp, Homo sapiens
aaacaactcggcaactgctttt

SEQ ID NO: 7577030 - DNA, 22 bp, Homo sapiens
aaacaacatggtgggtgtgtag

SEQ ID NO: 7577031 - DNA, 22 bp, Homo sapiens
aaacaacatggtgggtgtgtag

SEQ ID NO: 7577032 - DNA, 22 bp, Homo sapiens
aaacaacatggtgggtgtgtag

SEQ ID NO: 7577033 - DNA, 22 bp, Homo sapiens
aaacaaatttcaagctgtgaca

SEQ ID NO: 7577034 - DNA, 22 bp, Homo sapiens
aaacaaatttcaagctgtgaca

SEQ ID NO: 7577035 - DNA, 22 bp, Homo sapiens
aaacaaatttcaagctgtgaca

SEQ ID NO: 7577036 - DNA, 22 bp, Homo sapiens
aaacaaatttcaagctgtgaca

SEQ ID NO: 7577037 - DNA, 22 bp, Homo sapiens
aaacaaatttcaagctgtgaca

SEQ ID NO: 7577038 - DNA, 22 bp, Homo sapiens
aaacaaatttcaagctgtgaca

SEQ ID NO: 7577039 - DNA, 22 bp, Homo sapiens
aaacaaatttcaagctgtgaca

SEQ ID NO: 7577040 - DNA, 22 bp, Homo sapiens
aaacaaatttcaagctgtgaca

SEQ ID NO: 7577041 - DNA, 22 bp, Homo sapiens
aaacaaatttcaagctgtgaca

SEQ ID NO: 7577042 - DNA, 22 bp, Homo sapiens
aaacaaatagtgcatgggaatt

SEQ ID NO: 7577043 - DNA, 22 bp, Homo sapiens
aaacaaatagtgcatgggaatt

SEQ ID NO: 7577044 - DNA, 22 bp, Homo sapiens
aaacaaatagtgcatgggaatt

SEQ ID NO: 7577045 - DNA, 22 bp, Homo sapiens
aaacaaatagtgcatgggaatt

SEQ ID NO: 7577046 - DNA, 22 bp, Homo sapiens
aaacaaatagtgcatgggaatt

SEQ ID NO: 7577047 - DNA, 22 bp, Homo sapiens
aaacaaatagtgcatgggaatt

SEQ ID NO: 7577048 - DNA, 22 bp, Homo sapiens
aaacaaatagtgcatgggaatt

SEQ ID NO: 7577049 - DNA, 22 bp, Homo sapiens
aaacaaatagtgcatgggaatt

SEQ ID NO: 7577050 - DNA, 22 bp, Homo sapiens
aaacaaagccagggaagttatg

SEQ ID NO: 7577051 - DNA, 22 bp, Homo sapiens
aaacaaagccagggaagttatg

SEQ ID NO: 7577052 - DNA, 22 bp, Homo sapiens
aaacaaagccagggaagttatg

SEQ ID NO: 7577053 - DNA, 22 bp, Homo sapiens
aaacaaacataggtttgaaagt

SEQ ID NO: 7577054 - DNA, 22 bp, Homo sapiens
aaacaaacataggtttgaaagt

SEQ ID NO: 7577055 - DNA, 22 bp, Homo sapiens
aaacaaacataggtttgaaagt

SEQ ID NO: 7577056 - DNA, 22 bp, Homo sapiens
aaacaaacataggtttgaaagt

SEQ ID NO: 7577057 - DNA, 22 bp, Homo sapiens
aaacaaacataggtttgaaagt

SEQ ID NO: 7577058 - DNA, 22 bp, Homo sapiens
aaaattcattcctcagactgcc

SEQ ID NO: 7577059 - DNA, 22 bp, Homo sapiens
aaacaaacaattagttgtgtgg

SEQ ID NO: 7577060 - DNA, 22 bp, Homo sapiens
aaacaaacataggtttgaaagt

SEQ ID NO: 7577061 - DNA, 22 bp, Homo sapiens
aaacaaacataggtttgaaagt

SEQ ID NO: 7577062 - DNA, 22 bp, Homo sapiens
aaacaaacataggtttgaaagt

SEQ ID NO: 7577063 - DNA, 22 bp, Homo sapiens
aaacaaacataggtttgaaagt

SEQ ID NO: 7577064 - DNA, 22 bp, Homo sapiens
aaacaaacataggtttgaaagt

SEQ ID NO: 7577065 - DNA, 22 bp, Homo sapiens
aaacaaagcatcttgctatgca

SEQ ID NO: 7577066 - DNA, 22 bp, Homo sapiens
aaacaaagcatcttgctatgca

SEQ ID NO: 7577067 - DNA, 22 bp, Homo sapiens
aaacaaagcatcttgctatgca

SEQ ID NO: 7577068 - DNA, 22 bp, Homo sapiens
aaacaaagcatcttgctatgca

SEQ ID NO: 7577069 - DNA, 22 bp, Homo sapiens
aaacaaacataggtttgaaagt

SEQ ID NO: 7577070 - DNA, 22 bp, Homo sapiens
aaacaaagccagggaagttatg

SEQ ID NO: 7577071 - DNA, 22 bp, Homo sapiens
aaacaaagccagggaagttatg

SEQ ID NO: 7577072 - DNA, 22 bp, Homo sapiens
aaacaaagccagggaagttatg

SEQ ID NO: 7577073 - DNA, 22 bp, Homo sapiens
aaacaaagccagggaagttatg

SEQ ID NO: 7577074 - DNA, 22 bp, Homo sapiens
aaatagaattaactagctactg

SEQ ID NO: 7577075 - DNA, 22 bp, Homo sapiens
aaatagaattaactagctactg

SEQ ID NO: 7577076 - DNA, 22 bp, Homo sapiens
aaatagaattaactagctactg

SEQ ID NO: 7577077 - DNA, 22 bp, Homo sapiens
aaatagaattggaagcagagtt

SEQ ID NO: 7577078 - DNA, 22 bp, Homo sapiens
aaatagaattggaagcagagtt

SEQ ID NO: 7577079 - DNA, 22 bp, Homo sapiens
aaatagaattaactagctactg

SEQ ID NO: 7577080 - DNA, 22 bp, Homo sapiens
aaatagaattggaagcagagtt

SEQ ID NO: 7577081 - DNA, 22 bp, Homo sapiens
aaatagaattggaagcagagtt

SEQ ID NO: 7577082 - DNA, 22 bp, Homo sapiens
aaatagaattggaagcagagtt

SEQ ID NO: 7577083 - DNA, 22 bp, Homo sapiens
aaatagaattggaagcagagtt

SEQ ID NO: 7577084 - DNA, 22 bp, Homo sapiens
aaatagaattggaagcagagtt

SEQ ID NO: 7577085 - DNA, 22 bp, Homo sapiens
aaatagaattaactagctactg

SEQ ID NO: 7577086 - DNA, 22 bp, Homo sapiens
aaatagaattaactagctactg

SEQ ID NO: 7577087 - DNA, 22 bp, Homo sapiens
aaatagaattaactagctactg

SEQ ID NO: 7577088 - DNA, 22 bp, Homo sapiens
aaatagaattaactagctactg

SEQ ID NO: 7577089 - DNA, 22 bp, Homo sapiens
aaatagaaaccaacaaggtcag

SEQ ID NO: 7577090 - DNA, 22 bp, Homo sapiens
aaatagaaaccaacaaggtcag

SEQ ID NO: 7577091 - DNA, 22 bp, Homo sapiens
aaatagaattaactagctactg

SEQ ID NO: 7577092 - DNA, 22 bp, Homo sapiens
aaatagaattaactagctactg

SEQ ID NO: 7577093 - DNA, 22 bp, Homo sapiens
aaatagaattaactagctactg

SEQ ID NO: 7577094 - DNA, 20 bp, Homo sapiens
aaacgagccatcattctggt

SEQ ID NO: 7577095 - DNA, 23 bp, Homo sapiens
aaaccttttgtagaacaattgct

SEQ ID NO: 7577096 - DNA, 20 bp, Homo sapiens
aaacgagccatcattctggt

SEQ ID NO: 7577097 - DNA, 20 bp, Homo sapiens
aaacgagccatcattctggt

SEQ ID NO: 7577098 - DNA, 23 bp, Homo sapiens
aaaccttttgtagaacaattgct

SEQ ID NO: 7577099 - DNA, 22 bp, Homo sapiens
aaatagaattggaagcagagtt

SEQ ID NO: 7577100 - DNA, 22 bp, Homo sapiens
aaatagaattggaagcagagtt

SEQ ID NO: 7577101 - DNA, 22 bp, Homo sapiens
aaatagaattggaagcagagtt

SEQ ID NO: 7577102 - DNA, 22 bp, Homo sapiens
aaatagaattggaagcagagtt

SEQ ID NO: 7577103 - DNA, 22 bp, Homo sapiens
aaacggaatgagtaagagtatc

SEQ ID NO: 7577104 - DNA, 22 bp, Homo sapiens
aaacggaatgagtaagagtatc

SEQ ID NO: 7577105 - DNA, 22 bp, Homo sapiens
aaacggaatgagtaagagtatc

SEQ ID NO: 7577106 - DNA, 22 bp, Homo sapiens
aaacggaatgagtaagagtatc

SEQ ID NO: 7577107 - DNA, 22 bp, Homo sapiens
aaacggagggcaaatgctgtta

SEQ ID NO: 7577108 - DNA, 20 bp, Homo sapiens
aaacgagccatcattctggt

SEQ ID NO: 7577109 - DNA, 22 bp, Homo sapiens
aaacggttgctcatagttacat

SEQ ID NO: 7577110 - DNA, 22 bp, Homo sapiens
aaactaaacctggcttagtaag

SEQ ID NO: 7577111 - DNA, 22 bp, Homo sapiens
aaactaaacctggcttagtaag

SEQ ID NO: 7577112 - DNA, 22 bp, Homo sapiens
aaatacagattccagggtctta

SEQ ID NO: 7577113 - DNA, 22 bp, Homo sapiens
aaatactgtccaccatggagca

SEQ ID NO: 7577114 - DNA, 22 bp, Homo sapiens
aaatactgtccaccatggagca

SEQ ID NO: 7577115 - DNA, 22 bp, Homo sapiens
aaatactgtccaccatggagca

SEQ ID NO: 7577116 - DNA, 22 bp, Homo sapiens
aaatacagattctgactcagag

SEQ ID NO: 7577117 - DNA, 22 bp, Homo sapiens
aaatactgtagataatagagtt

SEQ ID NO: 7577118 - DNA, 21 bp, Homo sapiens
aaatactgtcaaatggtgggt

SEQ ID NO: 7577119 - DNA, 21 bp, Homo sapiens
aaatactgtcaaatggtgggt

SEQ ID NO: 7577120 - DNA, 22 bp, Homo sapiens
aaatactgtccaccatggagca

SEQ ID NO: 7577121 - DNA, 22 bp, Homo sapiens
aaatactgtctctgagagagcc

SEQ ID NO: 7577122 - DNA, 22 bp, Homo sapiens
aaatactgtctctgagagagcc

SEQ ID NO: 7577123 - DNA, 22 bp, Homo sapiens
aaatactgtgaataaaggtttt

SEQ ID NO: 7577124 - DNA, 22 bp, Homo sapiens
aaatactgtgaataaaggtttt

SEQ ID NO: 7577125 - DNA, 22 bp, Homo sapiens
aaatactgtctctgagagagcc

SEQ ID NO: 7577126 - DNA, 22 bp, Homo sapiens
aaatactgtgaataaaggtttt

SEQ ID NO: 7577127 - DNA, 22 bp, Homo sapiens
aaatagaaaccaacaaggtcag

SEQ ID NO: 7577128 - DNA, 22 bp, Homo sapiens
aaatagaaaccaacaaggtcag

SEQ ID NO: 7577129 - DNA, 22 bp, Homo sapiens
aaatagaaaccaacaaggtcag

SEQ ID NO: 7577130 - DNA, 22 bp, Homo sapiens
aaatagaaaccaacaaggtcag

SEQ ID NO: 7577131 - DNA, 22 bp, Homo sapiens
aaatactgttttattccatgat

SEQ ID NO: 7577132 - DNA, 22 bp, Homo sapiens
aaatagaaaccaacaaggtcag

SEQ ID NO: 7577133 - DNA, 22 bp, Homo sapiens
aaatagaaaccaacaaggtcag

SEQ ID NO: 7577134 - DNA, 22 bp, Homo sapiens
aaatagaaaccaacaaggtcag

SEQ ID NO: 7577135 - DNA, 22 bp, Homo sapiens
aaatagaaaccaacaaggtcag

SEQ ID NO: 7577136 - DNA, 22 bp, Homo sapiens
aaatactgttgaatgaagtaag

SEQ ID NO: 7577137 - DNA, 22 bp, Homo sapiens
aaatactgttgaatgaagtaag

SEQ ID NO: 7577138 - DNA, 22 bp, Homo sapiens
aaatactgttgaatgaagtaag

SEQ ID NO: 7577139 - DNA, 22 bp, Homo sapiens
aaatactgttgaatgaagtaag

SEQ ID NO: 7577140 - DNA, 22 bp, Homo sapiens
aaatactgttgaatgaagtaag

SEQ ID NO: 7577141 - DNA, 22 bp, Homo sapiens
aaatactgttttattccatgat

SEQ ID NO: 7577142 - DNA, 22 bp, Homo sapiens
aaatactgttttattccatgat

SEQ ID NO: 7577143 - DNA, 22 bp, Homo sapiens
aaatactgttttattccatgat

SEQ ID NO: 7577144 - DNA, 22 bp, Homo sapiens
aaatactgttgaatgaagtaag

SEQ ID NO: 7577145 - DNA, 22 bp, Homo sapiens
aaatatgtaaccaaggtgaagt

SEQ ID NO: 7577146 - DNA, 22 bp, Homo sapiens
aaatatgtaagattagcactag

SEQ ID NO: 7577147 - DNA, 22 bp, Homo sapiens
aaatatgtaagattagcactag

SEQ ID NO: 7577148 - DNA, 22 bp, Homo sapiens
aaatatgtaagattagcactag

SEQ ID NO: 7577149 - DNA, 22 bp, Homo sapiens
aaatatgtaaccaaggtgaagt

SEQ ID NO: 7577150 - DNA, 22 bp, Homo sapiens
aaatatgtaaccaaggtgaagt

SEQ ID NO: 7577151 - DNA, 22 bp, Homo sapiens
aaatatgtaaccaaggtgaagt

SEQ ID NO: 7577152 - DNA, 22 bp, Homo sapiens
aaatatgagggtgatgcccaga

SEQ ID NO: 7577153 - DNA, 22 bp, Homo sapiens
aaatatgagggtgatgcccaga

SEQ ID NO: 7577154 - DNA, 22 bp, Homo sapiens
aaatatgagggtgatgcccaga

SEQ ID NO: 7577155 - DNA, 22 bp, Homo sapiens
aaatataatttctgcctcaata

SEQ ID NO: 7577156 - DNA, 22 bp, Homo sapiens
aaatataatttctgcctcaata

SEQ ID NO: 7577157 - DNA, 22 bp, Homo sapiens
aaatatgagggtgatgcccaga

SEQ ID NO: 7577158 - DNA, 22 bp, Homo sapiens
aaatataatttctgcctcaata

SEQ ID NO: 7577159 - DNA, 22 bp, Homo sapiens
aaatatgatactcccttttagt

SEQ ID NO: 7577160 - DNA, 22 bp, Homo sapiens
aaatatgatactcccttttagt

SEQ ID NO: 7577161 - DNA, 22 bp, Homo sapiens
aaatatgatactcccttttagt

SEQ ID NO: 7577162 - DNA, 22 bp, Homo sapiens
aaatatgtatggagttcatgaa

SEQ ID NO: 7577163 - DNA, 23 bp, Homo sapiens
aaatatgtctgagggcaaagaat

SEQ ID NO: 7577164 - DNA, 22 bp, Homo sapiens
aaatatgtatggagttcatgaa

SEQ ID NO: 7577165 - DNA, 23 bp, Homo sapiens
aaatatgtctgagggcaaagaat

SEQ ID NO: 7577166 - DNA, 22 bp, Homo sapiens
aaatatgtatggagttcatgaa

SEQ ID NO: 7577167 - DNA, 22 bp, Homo sapiens
aaatatgtaagattagcactag

SEQ ID NO: 7577168 - DNA, 22 bp, Homo sapiens
aaatatgtatggagttcatgaa

SEQ ID NO: 7577169 - DNA, 22 bp, Homo sapiens
aaatatgtaagattagcactag

SEQ ID NO: 7577170 - DNA, 22 bp, Homo sapiens
aaatatgtaagattagcactag

SEQ ID NO: 7577171 - DNA, 22 bp, Homo sapiens
aaatatgtaagattagcactag

SEQ ID NO: 7577172 - DNA, 22 bp, Homo sapiens
aaatatgtgatcagtgaataaa

SEQ ID NO: 7577173 - DNA, 22 bp, Homo sapiens
aaatatgtgatcagtgaataaa

SEQ ID NO: 7577174 - DNA, 22 bp, Homo sapiens
aaatatgtgatcagtgaataaa

SEQ ID NO: 7577175 - DNA, 22 bp, Homo sapiens
aaatatgtgatcagtgaataaa

SEQ ID NO: 7577176 - DNA, 22 bp, Homo sapiens
aaatatgtgatcagtgaataaa

SEQ ID NO: 7577177 - DNA, 23 bp, Homo sapiens
aaatatgtctgagggcaaagaat

SEQ ID NO: 7577178 - DNA, 23 bp, Homo sapiens
aaatatgtctgagggcaaagaat

SEQ ID NO: 7577179 - DNA, 22 bp, Homo sapiens
aaactacactttgggaccagca

SEQ ID NO: 7577180 - DNA, 22 bp, Homo sapiens
aaactacatctcatggatgagg

SEQ ID NO: 7577181 - DNA, 22 bp, Homo sapiens
aaactacatctcatggatgagg

SEQ ID NO: 7577182 - DNA, 22 bp, Homo sapiens
aaactactatgggaatgtactt

SEQ ID NO: 7577183 - DNA, 23 bp, Homo sapiens
aaactacatttatagtttttctc

SEQ ID NO: 7577184 - DNA, 22 bp, Homo sapiens
aaactactttatagtgccttca

SEQ ID NO: 7577185 - DNA, 22 bp, Homo sapiens
aaatataatttctgcctcaata

SEQ ID NO: 7577186 - DNA, 22 bp, Homo sapiens
aaatataatttctgcctcaata

SEQ ID NO: 7577187 - DNA, 22 bp, Homo sapiens
aaatataatttctgcctcaata

SEQ ID NO: 7577188 - DNA, 22 bp, Homo sapiens
aaatataatttctgcctcaata

SEQ ID NO: 7577189 - DNA, 22 bp, Homo sapiens
aaactactgatttgtgaattga

SEQ ID NO: 7577190 - DNA, 22 bp, Homo sapiens
aaactactgatttgtgaattga

SEQ ID NO: 7577191 - DNA, 22 bp, Homo sapiens
aaactactatgggaatgtactt

SEQ ID NO: 7577192 - DNA, 22 bp, Homo sapiens
aaactactatgggaatgtactt

SEQ ID NO: 7577193 - DNA, 22 bp, Homo sapiens
aaactactgatgcctgggccct

SEQ ID NO: 7577194 - DNA, 22 bp, Homo sapiens
aaactactggattagtaactta

SEQ ID NO: 7577195 - DNA, 22 bp, Homo sapiens
aaactactggattagtaactta

SEQ ID NO: 7577196 - DNA, 22 bp, Homo sapiens
aaactactggattagtaactta

SEQ ID NO: 7577197 - DNA, 23 bp, Homo sapiens
aaactacaacgccaggcactgag

SEQ ID NO: 7577198 - DNA, 22 bp, Homo sapiens
aaactaatgaagtgaagacgct

SEQ ID NO: 7577199 - DNA, 22 bp, Homo sapiens
aaactacactttgggaccagca

SEQ ID NO: 7577200 - DNA, 23 bp, Homo sapiens
aaactacaacgccaggcactgag

SEQ ID NO: 7577201 - DNA, 22 bp, Homo sapiens
aaactaatgaagtgaagacgct

SEQ ID NO: 7577202 - DNA, 23 bp, Homo sapiens
aaactacaacgccaggcactgag

SEQ ID NO: 7577203 - DNA, 19 bp, Homo sapiens
aaactaaggggaaatgttt

SEQ ID NO: 7577204 - DNA, 22 bp, Homo sapiens
aaactaaggtgctgtggactga

SEQ ID NO: 7577205 - DNA, 19 bp, Homo sapiens
aaactaaggggaaatgttt

SEQ ID NO: 7577206 - DNA, 22 bp, Homo sapiens
aaactaagactaatgaagaact

SEQ ID NO: 7577207 - DNA, 20 bp, Homo sapiens
aaactaaaggtgtttggttt

SEQ ID NO: 7577208 - DNA, 22 bp, Homo sapiens
aaactaaacctggcttagtaag

SEQ ID NO: 7577209 - DNA, 20 bp, Homo sapiens
aaactaaaggtgtttggttt

SEQ ID NO: 7577210 - DNA, 22 bp, Homo sapiens
aaactaaacctggcttagtaag

SEQ ID NO: 7577211 - DNA, 22 bp, Homo sapiens
aaatcatggtggaagaaacaga

SEQ ID NO: 7577212 - DNA, 22 bp, Homo sapiens
aaatcatggtggaagaaacaga

SEQ ID NO: 7577213 - DNA, 22 bp, Homo sapiens
aaatcatggtggaagaaacaga

SEQ ID NO: 7577214 - DNA, 22 bp, Homo sapiens
aaatcatggtggaagaaacaga

SEQ ID NO: 7577215 - DNA, 22 bp, Homo sapiens
aaatcatgaggacattatgcca

SEQ ID NO: 7577216 - DNA, 22 bp, Homo sapiens
aaatcatgaggacattatgcca

SEQ ID NO: 7577217 - DNA, 22 bp, Homo sapiens
aaatcatctctgcatccttagc

SEQ ID NO: 7577218 - DNA, 22 bp, Homo sapiens
aaatcatagcccccatccgatt

SEQ ID NO: 7577219 - DNA, 22 bp, Homo sapiens
aaatcatctctgcatccttagc

SEQ ID NO: 7577220 - DNA, 22 bp, Homo sapiens
aaatcatgtgcagagatcagga

SEQ ID NO: 7577221 - DNA, 22 bp, Homo sapiens
aaatcatgtgcagagatcagga

SEQ ID NO: 7577222 - DNA, 22 bp, Homo sapiens
aaatcatgttggcacaataaaa

SEQ ID NO: 7577223 - DNA, 22 bp, Homo sapiens
aaatcatgttggcacaataaaa

SEQ ID NO: 7577224 - DNA, 22 bp, Homo sapiens
aaatcatgttggcacaataaaa

SEQ ID NO: 7577225 - DNA, 22 bp, Homo sapiens
aaatcattatttacagttctga

SEQ ID NO: 7577226 - DNA, 22 bp, Homo sapiens
aaatcattatttacagttctga

SEQ ID NO: 7577227 - DNA, 22 bp, Homo sapiens
aaatcattatttacagttctga

SEQ ID NO: 7577228 - DNA, 21 bp, Homo sapiens
aaatccaaacactagtccaca

SEQ ID NO: 7577229 - DNA, 21 bp, Homo sapiens
aaatccaaacactagtccaca

SEQ ID NO: 7577230 - DNA, 21 bp, Homo sapiens
aaatccaaacactagtccaca

SEQ ID NO: 7577231 - DNA, 22 bp, Homo sapiens
aaatccagctacggggcaacat

SEQ ID NO: 7577232 - DNA, 22 bp, Homo sapiens
aaatccaacgacaggtgtactt

SEQ ID NO: 7577233 - DNA, 22 bp, Homo sapiens
aaatccaacgacaggtgtactt

SEQ ID NO: 7577234 - DNA, 22 bp, Homo sapiens
aaatccaggaagcagtggtgta

SEQ ID NO: 7577235 - DNA, 22 bp, Homo sapiens
aaatccagatgagggtaccaga

SEQ ID NO: 7577236 - DNA, 22 bp, Homo sapiens
aaatccaggagaatttccactt

SEQ ID NO: 7577237 - DNA, 22 bp, Homo sapiens
aaatccaggagaatttccactt

SEQ ID NO: 7577238 - DNA, 22 bp, Homo sapiens
aaatccaggtagtttggtttga

SEQ ID NO: 7577239 - DNA, 22 bp, Homo sapiens
aaatgcagctgggcatgagagg

SEQ ID NO: 7577240 - DNA, 22 bp, Homo sapiens
aaatccagtgggtcctcatgag

SEQ ID NO: 7577241 - DNA, 22 bp, Homo sapiens
aaatgcagcctagctcagtttt

SEQ ID NO: 7577242 - DNA, 22 bp, Homo sapiens
aaatccagtgggtcctcatgag

SEQ ID NO: 7577243 - DNA, 22 bp, Homo sapiens
aaatattattgcttaaggggag

SEQ ID NO: 7577244 - DNA, 22 bp, Homo sapiens
aaatattattgcttaaggggag

SEQ ID NO: 7577245 - DNA, 22 bp, Homo sapiens
aaatattagggagaacagggac

SEQ ID NO: 7577246 - DNA, 22 bp, Homo sapiens
aaatattagggagaacagggac

SEQ ID NO: 7577247 - DNA, 22 bp, Homo sapiens
aaatattagggagaacagggac

SEQ ID NO: 7577248 - DNA, 22 bp, Homo sapiens
aaatattagggagaacagggac

SEQ ID NO: 7577249 - DNA, 22 bp, Homo sapiens
aaatatgtgatcagtgaataaa

SEQ ID NO: 7577250 - DNA, 22 bp, Homo sapiens
aaatatgtgatcagtgaataaa

SEQ ID NO: 7577251 - DNA, 22 bp, Homo sapiens
aaatatgttttccagttgtcat

SEQ ID NO: 7577252 - DNA, 22 bp, Homo sapiens
aaatatgttttccagttgtcat

SEQ ID NO: 7577253 - DNA, 22 bp, Homo sapiens
aaatatgttttccagttgtcat

SEQ ID NO: 7577254 - DNA, 22 bp, Homo sapiens
aaatatgttttccagttgtcat

SEQ ID NO: 7577255 - DNA, 22 bp, Homo sapiens
aaatatgttttccagttgtcat

SEQ ID NO: 7577256 - DNA, 22 bp, Homo sapiens
aaatatgttttccagttgtcat

SEQ ID NO: 7577257 - DNA, 22 bp, Homo sapiens
aaatcagttcacgttctgaggt

SEQ ID NO: 7577258 - DNA, 22 bp, Homo sapiens
aaatcagttcacgttctgaggt

SEQ ID NO: 7577259 - DNA, 22 bp, Homo sapiens
aaatcagttcacgttctgaggt

SEQ ID NO: 7577260 - DNA, 22 bp, Homo sapiens
aaatcagttagtggtaggattg

SEQ ID NO: 7577261 - DNA, 22 bp, Homo sapiens
aaatcagtccctcttggaattt

SEQ ID NO: 7577262 - DNA, 22 bp, Homo sapiens
aaatcagtccctcttggaattt

SEQ ID NO: 7577263 - DNA, 22 bp, Homo sapiens
aaatcagtgctcatttgaaagg

SEQ ID NO: 7577264 - DNA, 22 bp, Homo sapiens
aaatattattgcttaaggggag

SEQ ID NO: 7577265 - DNA, 22 bp, Homo sapiens
aaatcagtaaatgttcattaac

SEQ ID NO: 7577266 - DNA, 22 bp, Homo sapiens
aaatcagttctccctttcttca

SEQ ID NO: 7577267 - DNA, 22 bp, Homo sapiens
aaatcagttctccctttcttca

SEQ ID NO: 7577268 - DNA, 22 bp, Homo sapiens
aaatcagttctccctttcttca

SEQ ID NO: 7577269 - DNA, 22 bp, Homo sapiens
aaatcagttggaacacaagcag

SEQ ID NO: 7577270 - DNA, 22 bp, Homo sapiens
aaatcagttggaacacaagcag

SEQ ID NO: 7577271 - DNA, 22 bp, Homo sapiens
aaatcagttgttatattaaaga

SEQ ID NO: 7577272 - DNA, 22 bp, Homo sapiens
aaatcagttgttatattaaaga

SEQ ID NO: 7577273 - DNA, 22 bp, Homo sapiens
aaatcagttgttatattaaaga

SEQ ID NO: 7577274 - DNA, 22 bp, Homo sapiens
aaatgcctctgggttattctag

SEQ ID NO: 7577275 - DNA, 22 bp, Homo sapiens
aaatgcctctgctgtacacaat

SEQ ID NO: 7577276 - DNA, 22 bp, Homo sapiens
aaatgcctctgggttattctag

SEQ ID NO: 7577277 - DNA, 22 bp, Homo sapiens
aaatgcctcccattctactgac

SEQ ID NO: 7577278 - DNA, 22 bp, Homo sapiens
aaatgcctcccaaacagcacaa

SEQ ID NO: 7577279 - DNA, 22 bp, Homo sapiens
aaatgcctcccattctactgac

SEQ ID NO: 7577280 - DNA, 20 bp, Homo sapiens
aaatgccagtgattctgctt

SEQ ID NO: 7577281 - DNA, 22 bp, Homo sapiens
aaatgcctcattttctctcact

SEQ ID NO: 7577282 - DNA, 22 bp, Homo sapiens
aaatgcctcattttctctcact

SEQ ID NO: 7577283 - DNA, 22 bp, Homo sapiens
aaatgcctcccaaacagcacaa

SEQ ID NO: 7577284 - DNA, 22 bp, Homo sapiens
aaatgcctcccaaacagcacaa

SEQ ID NO: 7577285 - DNA, 22 bp, Homo sapiens
aaatgcagctgggcatgagagg

SEQ ID NO: 7577286 - DNA, 22 bp, Homo sapiens
aaatccagtgggtcctcatgag

SEQ ID NO: 7577287 - DNA, 22 bp, Homo sapiens
aaatgcagctgggcatgagagg

SEQ ID NO: 7577288 - DNA, 22 bp, Homo sapiens
aaatgccttcaaacacttaagg

SEQ ID NO: 7577289 - DNA, 22 bp, Homo sapiens
aaatgctaaatgcagcaagtag

SEQ ID NO: 7577290 - DNA, 22 bp, Homo sapiens
aaatgctaaatgcagcaagtag

SEQ ID NO: 7577291 - DNA, 22 bp, Homo sapiens
aaatgctaaatgcagcaagtag

SEQ ID NO: 7577292 - DNA, 22 bp, Homo sapiens
aaatgctaaatgcagcaagtag

SEQ ID NO: 7577293 - DNA, 22 bp, Homo sapiens
aaatgctaaatgcagcaagtag

SEQ ID NO: 7577294 - DNA, 22 bp, Homo sapiens
aaatgctaacaaggaatgctgc

SEQ ID NO: 7577295 - DNA, 22 bp, Homo sapiens
aaatgcctgtgtaaattctagc

SEQ ID NO: 7577296 - DNA, 22 bp, Homo sapiens
aaatgcctgaatggtatttggt

SEQ ID NO: 7577297 - DNA, 22 bp, Homo sapiens
aaatgcctctgctgtacacaat

SEQ ID NO: 7577298 - DNA, 18 bp, Homo sapiens
aaatgctaggctacatga

SEQ ID NO: 7577299 - DNA, 22 bp, Homo sapiens
aaatgctacatacacatcaggg

SEQ ID NO: 7577300 - DNA, 22 bp, Homo sapiens
aaatgctagaacattttaaagg

SEQ ID NO: 7577301 - DNA, 22 bp, Homo sapiens
aaatgctagaacattttaaagg

SEQ ID NO: 7577302 - DNA, 22 bp, Homo sapiens
aaatgctagaacattttaaagg

SEQ ID NO: 7577303 - DNA, 22 bp, Homo sapiens
aaatgctacacaggaattctca

SEQ ID NO: 7577304 - DNA, 22 bp, Homo sapiens
aaatgctacacaggaattctca

SEQ ID NO: 7577305 - DNA, 22 bp, Homo sapiens
aaatgctacacaggaattctca

SEQ ID NO: 7577306 - DNA, 22 bp, Homo sapiens
aaatgctacacaggaattctca

SEQ ID NO: 7577307 - DNA, 22 bp, Homo sapiens
aaatgctacatacacatcaggg

SEQ ID NO: 7577308 - DNA, 22 bp, Homo sapiens
aaatgctgagtgtttagagatc

SEQ ID NO: 7577309 - DNA, 22 bp, Homo sapiens
aaatgctgagtgtttagagatc

SEQ ID NO: 7577310 - DNA, 22 bp, Homo sapiens
aaatgctgagtgtttagagatc

SEQ ID NO: 7577311 - DNA, 22 bp, Homo sapiens
aaatggcagtagaaaagaatcc

SEQ ID NO: 7577312 - DNA, 22 bp, Homo sapiens
aaatggcaggctctttgctagt

SEQ ID NO: 7577313 - DNA, 22 bp, Homo sapiens
aaatgctgagtgtttagagatc

SEQ ID NO: 7577314 - DNA, 23 bp, Homo sapiens
aaatgctgaatctttactgttta

SEQ ID NO: 7577315 - DNA, 22 bp, Homo sapiens
aaatgctctggggataagactg

SEQ ID NO: 7577316 - DNA, 22 bp, Homo sapiens
aaatggcagtgtcataaggctc

SEQ ID NO: 7577317 - DNA, 22 bp, Homo sapiens
aaatggcagtagaaaagaatcc

SEQ ID NO: 7577318 - DNA, 22 bp, Homo sapiens
aaatggcagtagaaaagaatcc

SEQ ID NO: 7577319 - DNA, 22 bp, Homo sapiens
aaatggcagtagaaaagaatcc

SEQ ID NO: 7577320 - DNA, 22 bp, Homo sapiens
aaatggcagtagaaaagaatcc

SEQ ID NO: 7577321 - DNA, 23 bp, Homo sapiens
aaatggccaaggttaaaaataca

SEQ ID NO: 7577322 - DNA, 23 bp, Homo sapiens
aaatggccaaaaccaggtggtta

SEQ ID NO: 7577323 - DNA, 22 bp, Homo sapiens
aaatggcatagaggtgaaggta

SEQ ID NO: 7577324 - DNA, 22 bp, Homo sapiens
aaatgctcaccacagggatgtg

SEQ ID NO: 7577325 - DNA, 22 bp, Homo sapiens
aaatgctctccaaaatgaaagt

SEQ ID NO: 7577326 - DNA, 22 bp, Homo sapiens
aaatgctctccaaaatgaaagt

SEQ ID NO: 7577327 - DNA, 22 bp, Homo sapiens
aaatgctctccaaaatgaaagt

SEQ ID NO: 7577328 - DNA, 22 bp, Homo sapiens
aaatgctctctaatgtaataca

SEQ ID NO: 7577329 - DNA, 22 bp, Homo sapiens
aaatgctctggggataagactg

SEQ ID NO: 7577330 - DNA, 22 bp, Homo sapiens
aaatgctctggggataagactg

SEQ ID NO: 7577331 - DNA, 18 bp, Homo sapiens
aaatgctaggctacatga

SEQ ID NO: 7577332 - DNA, 18 bp, Homo sapiens
aaatgctaggctacatga

SEQ ID NO: 7577333 - DNA, 18 bp, Homo sapiens
aaatgctaggctacatga

SEQ ID NO: 7577334 - DNA, 18 bp, Homo sapiens
aaatgctaggctacatga

SEQ ID NO: 7577335 - DNA, 22 bp, Homo sapiens
aaatgctagggagaaactctcc

SEQ ID NO: 7577336 - DNA, 22 bp, Homo sapiens
aaatgctagggagaaactctcc

SEQ ID NO: 7577337 - DNA, 22 bp, Homo sapiens
aaatgctagggagaaactctcc

SEQ ID NO: 7577338 - DNA, 22 bp, Homo sapiens
aaatgctatttgggaacaacat

SEQ ID NO: 7577339 - DNA, 22 bp, Homo sapiens
aaatgctatttgggaacaacat

SEQ ID NO: 7577340 - DNA, 22 bp, Homo sapiens
aaagatgtcagtttgaaataac

SEQ ID NO: 7577341 - DNA, 22 bp, Homo sapiens
aaagatgtcagtttgaaataac

SEQ ID NO: 7577342 - DNA, 22 bp, Homo sapiens
aaagatgtcagtttgaaataac

SEQ ID NO: 7577343 - DNA, 22 bp, Homo sapiens
aaagatgtcagtcagataggat

SEQ ID NO: 7577344 - DNA, 22 bp, Homo sapiens
aaagatgtcagtttgaaataac

SEQ ID NO: 7577345 - DNA, 22 bp, Homo sapiens
aaagatgtcagtttgaaataac

SEQ ID NO: 7577346 - DNA, 22 bp, Homo sapiens
aaagatgtcatacacattaaga

SEQ ID NO: 7577347 - DNA, 22 bp, Homo sapiens
aaagatgtcatacacattaaga

SEQ ID NO: 7577348 - DNA, 22 bp, Homo sapiens
aaagatgtcatacacattaaga

SEQ ID NO: 7577349 - DNA, 22 bp, Homo sapiens
aaagatgtcatacacattaaga

SEQ ID NO: 7577350 - DNA, 22 bp, Homo sapiens
aaagatgtccaagtaaagttaa

SEQ ID NO: 7577351 - DNA, 22 bp, Homo sapiens
aaagatgtccaagtaaagttaa

SEQ ID NO: 7577352 - DNA, 22 bp, Homo sapiens
aaagatgtccaagtaaagttaa

SEQ ID NO: 7577353 - DNA, 22 bp, Homo sapiens
aaagatgtgcctgtttcatagt

SEQ ID NO: 7577354 - DNA, 22 bp, Homo sapiens
aaagatgtgcctgtttcatagt

SEQ ID NO: 7577355 - DNA, 22 bp, Homo sapiens
aaagatgtgcctgtttcatagt

SEQ ID NO: 7577356 - DNA, 22 bp, Homo sapiens
aaagatgtgcctgtttcatagt

SEQ ID NO: 7577357 - DNA, 22 bp, Homo sapiens
aaagatgtgcctgtttcatagt

SEQ ID NO: 7577358 - DNA, 23 bp, Homo sapiens
aaagatgtgagtattcatatggc

SEQ ID NO: 7577359 - DNA, 23 bp, Homo sapiens
aaagatgtgagtattcatatggc

SEQ ID NO: 7577360 - DNA, 19 bp, Homo sapiens
aaagatgtccttttgggct

SEQ ID NO: 7577361 - DNA, 23 bp, Homo sapiens
aaagatgtgagtattcatatggc

SEQ ID NO: 7577362 - DNA, 23 bp, Homo sapiens
aaagatgtgagtattcatatggc

SEQ ID NO: 7577363 - DNA, 22 bp, Homo sapiens
aaagcaataggttaggtcaaga

SEQ ID NO: 7577364 - DNA, 22 bp, Homo sapiens
aaagcaataggttaggtcaaga

SEQ ID NO: 7577365 - DNA, 22 bp, Homo sapiens
aaagcaataggttaggtcaaga

SEQ ID NO: 7577366 - DNA, 22 bp, Homo sapiens
aaagcaataggttaggtcaaga

SEQ ID NO: 7577367 - DNA, 22 bp, Homo sapiens
aaagcaataggttaggtcaaga

SEQ ID NO: 7577368 - DNA, 22 bp, Homo sapiens
aaagatgtgtaagaaataaaca

SEQ ID NO: 7577369 - DNA, 22 bp, Homo sapiens
aaagatgtgtaagaaataaaca

SEQ ID NO: 7577370 - DNA, 22 bp, Homo sapiens
aaagatgtgtaagaaataaaca

SEQ ID NO: 7577371 - DNA, 22 bp, Homo sapiens
aaagatgtgtaagaaataaaca

SEQ ID NO: 7577372 - DNA, 22 bp, Homo sapiens
aaagatgtgtaagaaataaaca

SEQ ID NO: 7577373 - DNA, 22 bp, Homo sapiens
aaagcaataggttaggtcaaga

SEQ ID NO: 7577374 - DNA, 22 bp, Homo sapiens
aaagcaatgcttgtggaatgta

SEQ ID NO: 7577375 - DNA, 22 bp, Homo sapiens
aaagcaatgcttgtggaatgta

SEQ ID NO: 7577376 - DNA, 22 bp, Homo sapiens
aaagcaatgcttgtggaatgta

SEQ ID NO: 7577377 - DNA, 22 bp, Homo sapiens
aaagcaatgcccgttcattatc

SEQ ID NO: 7577378 - DNA, 22 bp, Homo sapiens
aaagcaatgcccgttcattatc

SEQ ID NO: 7577379 - DNA, 22 bp, Homo sapiens
aaagcaatgcccgttcattatc

SEQ ID NO: 7577380 - DNA, 22 bp, Homo sapiens
aaagcaatgcccgttcattatc

SEQ ID NO: 7577381 - DNA, 22 bp, Homo sapiens
aaagcaatgatggtagacacgt

SEQ ID NO: 7577382 - DNA, 22 bp, Homo sapiens
aaagcaatctagttccaattct

SEQ ID NO: 7577383 - DNA, 22 bp, Homo sapiens
aaagcaatgatggtagacacgt

SEQ ID NO: 7577384 - DNA, 22 bp, Homo sapiens
aaagcaatgatggtagacacgt

SEQ ID NO: 7577385 - DNA, 22 bp, Homo sapiens
aaagcaatgcccgttcattatc

SEQ ID NO: 7577386 - DNA, 22 bp, Homo sapiens
aaagcaatgcccgttcattatc

SEQ ID NO: 7577387 - DNA, 22 bp, Homo sapiens
aaagcaatgcccgttcattatc

SEQ ID NO: 7577388 - DNA, 22 bp, Homo sapiens
aaagcaatgatggtagacacgt

SEQ ID NO: 7577389 - DNA, 22 bp, Homo sapiens
aaagcaatgatggtagacacgt

SEQ ID NO: 7577390 - DNA, 22 bp, Homo sapiens
aaagcaatgcccgttcattatc

SEQ ID NO: 7577391 - DNA, 22 bp, Homo sapiens
aaagcaatgcccgttcattatc

SEQ ID NO: 7577392 - DNA, 22 bp, Homo sapiens
aaagcaatgcccgttcattatc

SEQ ID NO: 7577393 - DNA, 22 bp, Homo sapiens
aaagcaatcagattcagatgtc

SEQ ID NO: 7577394 - DNA, 22 bp, Homo sapiens
aaagcaatcagattcagatgtc

SEQ ID NO: 7577395 - DNA, 22 bp, Homo sapiens
aaagcaatcagattcagatgtc

SEQ ID NO: 7577396 - DNA, 22 bp, Homo sapiens
aaagcaatcagattcagatgtc

SEQ ID NO: 7577397 - DNA, 22 bp, Homo sapiens
aaagcaatcagattcagatgtc

SEQ ID NO: 7577398 - DNA, 22 bp, Homo sapiens
aaagcaatcagattcagatgtc

SEQ ID NO: 7577399 - DNA, 22 bp, Homo sapiens
aaagcaatctagttccaattct

SEQ ID NO: 7577400 - DNA, 22 bp, Homo sapiens
aaagcaatctagttccaattct

SEQ ID NO: 7577401 - DNA, 22 bp, Homo sapiens
aaagcaatctagttccaattct

SEQ ID NO: 7577402 - DNA, 22 bp, Homo sapiens
aaagcaatcagattcagatgtc

SEQ ID NO: 7577403 - DNA, 22 bp, Homo sapiens
aaagcaatctagttccaattct

SEQ ID NO: 7577404 - DNA, 22 bp, Homo sapiens
aaagcaatagtaatggtaatag

SEQ ID NO: 7577405 - DNA, 22 bp, Homo sapiens
aaagcaatagtaatggtaatag

SEQ ID NO: 7577406 - DNA, 22 bp, Homo sapiens
aaagcaatagtaatggtaatag

SEQ ID NO: 7577407 - DNA, 22 bp, Homo sapiens
aaagcaatagtaatggtaatag

SEQ ID NO: 7577408 - DNA, 22 bp, Homo sapiens
aaagcaatcagattcagatgtc

SEQ ID NO: 7577409 - DNA, 22 bp, Homo sapiens
aaagcaatcagattcagatgtc

SEQ ID NO: 7577410 - DNA, 22 bp, Homo sapiens
aaagcaatcagattcagatgtc

SEQ ID NO: 7577411 - DNA, 22 bp, Homo sapiens
aaagcaatcagattcagatgtc

SEQ ID NO: 7577412 - DNA, 22 bp, Homo sapiens
aaagcaatcagattcagatgtc

SEQ ID NO: 7577413 - DNA, 22 bp, Homo sapiens
aaagcaatcagattcagatgtc

SEQ ID NO: 7577414 - DNA, 22 bp, Homo sapiens
aaaggccacttgaaggattttt

SEQ ID NO: 7577415 - DNA, 22 bp, Homo sapiens
aaaggccactgcaagggaaggt

SEQ ID NO: 7577416 - DNA, 22 bp, Homo sapiens
aaaggccactgcaagggaaggt

SEQ ID NO: 7577417 - DNA, 22 bp, Homo sapiens
aaaggccactgcaagggaaggt

SEQ ID NO: 7577418 - DNA, 22 bp, Homo sapiens
aaaggccaccaacatgaagcat

SEQ ID NO: 7577419 - DNA, 22 bp, Homo sapiens
aaaggccacactgctctttctc

SEQ ID NO: 7577420 - DNA, 22 bp, Homo sapiens
aaaggccacactgctctttctc

SEQ ID NO: 7577421 - DNA, 22 bp, Homo sapiens
aaaggccaccaacatgaagcat

SEQ ID NO: 7577422 - DNA, 22 bp, Homo sapiens
aaaggccaccaacatgaagcat

SEQ ID NO: 7577423 - DNA, 22 bp, Homo sapiens
aaaggccaccaacatgaagcat

SEQ ID NO: 7577424 - DNA, 22 bp, Homo sapiens
aaaggccaggttggctggtatt

SEQ ID NO: 7577425 - DNA, 22 bp, Homo sapiens
aaaggccacttgaaggattttt

SEQ ID NO: 7577426 - DNA, 22 bp, Homo sapiens
aaaggccaggttggctggtatt

SEQ ID NO: 7577427 - DNA, 21 bp, Homo sapiens
aaaggccataatcacggagca

SEQ ID NO: 7577428 - DNA, 22 bp, Homo sapiens
aaaggccaggttggctggtatt

SEQ ID NO: 7577429 - DNA, 21 bp, Homo sapiens
aaaggccataatcacggagca

SEQ ID NO: 7577430 - DNA, 21 bp, Homo sapiens
aaaggccataatcacggagca

SEQ ID NO: 7577431 - DNA, 22 bp, Homo sapiens
aaaggccatggttggagtgttt

SEQ ID NO: 7577432 - DNA, 22 bp, Homo sapiens
aaaggcctctgtcctagtgcct

SEQ ID NO: 7577433 - DNA, 22 bp, Homo sapiens
aaaggcctctgtcctagtgcct

SEQ ID NO: 7577434 - DNA, 22 bp, Homo sapiens
aaaggcccacagtcagtctacc

SEQ ID NO: 7577435 - DNA, 22 bp, Homo sapiens
aaaggcccacagtcagtctacc

SEQ ID NO: 7577436 - DNA, 22 bp, Homo sapiens
aaaggccatggttggagtgttt

SEQ ID NO: 7577437 - DNA, 22 bp, Homo sapiens
aaaggccatggttggagtgttt

SEQ ID NO: 7577438 - DNA, 22 bp, Homo sapiens
aaaggccattacttgcttttag

SEQ ID NO: 7577439 - DNA, 22 bp, Homo sapiens
aaaggccattacttgcttttag

SEQ ID NO: 7577440 - DNA, 22 bp, Homo sapiens
aaaggccttaaagagcatgcct

SEQ ID NO: 7577441 - DNA, 22 bp, Homo sapiens
aaaggccttaaagagcatgcct

SEQ ID NO: 7577442 - DNA, 22 bp, Homo sapiens
aaaggccttgagctgggtgcca

SEQ ID NO: 7577443 - DNA, 22 bp, Homo sapiens
aaaggcctctgtcctagtgcct

SEQ ID NO: 7577444 - DNA, 22 bp, Homo sapiens
aaaggcctgtgcttctaatgtg

SEQ ID NO: 7577445 - DNA, 22 bp, Homo sapiens
aaaggcctgtgcttctaatgtg

SEQ ID NO: 7577446 - DNA, 22 bp, Homo sapiens
aaaggccttttccccacttctt

SEQ ID NO: 7577447 - DNA, 22 bp, Homo sapiens
aaaggccttttccccacttctt

SEQ ID NO: 7577448 - DNA, 22 bp, Homo sapiens
aaaggccttttccccacttctt

SEQ ID NO: 7577449 - DNA, 22 bp, Homo sapiens
aaaggccttaaagagcatgcct

SEQ ID NO: 7577450 - DNA, 22 bp, Homo sapiens
aaaggctacgggggccgtgtgc

SEQ ID NO: 7577451 - DNA, 22 bp, Homo sapiens
aaaggctacgggggccgtgtgc

SEQ ID NO: 7577452 - DNA, 22 bp, Homo sapiens
aaaggctacgggggccgtgtgc

SEQ ID NO: 7577453 - DNA, 22 bp, Homo sapiens
aaaggctaattaaccacctggt

SEQ ID NO: 7577454 - DNA, 22 bp, Homo sapiens
aaaggctaattaaccacctggt

SEQ ID NO: 7577455 - DNA, 22 bp, Homo sapiens
aaaggccttttccccacttctt

SEQ ID NO: 7577456 - DNA, 22 bp, Homo sapiens
aaacactgatggatatttttcc

SEQ ID NO: 7577457 - DNA, 22 bp, Homo sapiens
aaacactgatggatatttttcc

SEQ ID NO: 7577458 - DNA, 22 bp, Homo sapiens
aaaggctacgggggccgtgtgc

SEQ ID NO: 7577459 - DNA, 22 bp, Homo sapiens
aaaggctagtggattcattgat

SEQ ID NO: 7577460 - DNA, 23 bp, Homo sapiens
aaaggctatcaaagttttgctga

SEQ ID NO: 7577461 - DNA, 23 bp, Homo sapiens
aaaggctatcaaagttttgctga

SEQ ID NO: 7577462 - DNA, 22 bp, Homo sapiens
aaaggccacactgctctttctc

SEQ ID NO: 7577463 - DNA, 22 bp, Homo sapiens
aaaggccacacagagcagggag

SEQ ID NO: 7577464 - DNA, 22 bp, Homo sapiens
aaaggccacacagagcagggag

SEQ ID NO: 7577465 - DNA, 22 bp, Homo sapiens
aaaggccacacagagcagggag

SEQ ID NO: 7577466 - DNA, 22 bp, Homo sapiens
aaaggccaagcatgaggtggac

SEQ ID NO: 7577467 - DNA, 22 bp, Homo sapiens
aaaggccaataaagacaagctg

SEQ ID NO: 7577468 - DNA, 22 bp, Homo sapiens
aaaggccaataaagacaagctg

SEQ ID NO: 7577469 - DNA, 22 bp, Homo sapiens
aaaggccaataaagacaagctg

SEQ ID NO: 7577470 - DNA, 22 bp, Homo sapiens
aaaggccaataaagacaagctg

SEQ ID NO: 7577471 - DNA, 22 bp, Homo sapiens
aaaggccaataaagacaagctg

SEQ ID NO: 7577472 - DNA, 22 bp, Homo sapiens
aaaggcatgtgcaactacaaat

SEQ ID NO: 7577473 - DNA, 22 bp, Homo sapiens
aaaggcatgtgcaactacaaat

SEQ ID NO: 7577474 - DNA, 22 bp, Homo sapiens
aaaggcatgggtgcctgcatgt

SEQ ID NO: 7577475 - DNA, 22 bp, Homo sapiens
aaaggcatgggtgcctgcatgt

SEQ ID NO: 7577476 - DNA, 22 bp, Homo sapiens
aaaggcatgtgggctggttgta

SEQ ID NO: 7577477 - DNA, 22 bp, Homo sapiens
aaaggcattttaattctaaaga

SEQ ID NO: 7577478 - DNA, 22 bp, Homo sapiens
aaaggcattttaattctaaaga

SEQ ID NO: 7577479 - DNA, 22 bp, Homo sapiens
aaaggcatgtggtcaaggctca

SEQ ID NO: 7577480 - DNA, 22 bp, Homo sapiens
aaaggcatgtggtcaaggctca

SEQ ID NO: 7577481 - DNA, 22 bp, Homo sapiens
aaaggcattggagaccctggct

SEQ ID NO: 7577482 - DNA, 22 bp, Homo sapiens
aaaggccaagcatgaggtggac

SEQ ID NO: 7577483 - DNA, 22 bp, Homo sapiens
aaaggccaagcatgaggtggac

SEQ ID NO: 7577484 - DNA, 22 bp, Homo sapiens
aaaggaggaatggagagatgct

SEQ ID NO: 7577485 - DNA, 22 bp, Homo sapiens
aaaggaggaatggagagatgct

SEQ ID NO: 7577486 - DNA, 22 bp, Homo sapiens
aaaggcatggaacagattctcc

SEQ ID NO: 7577487 - DNA, 22 bp, Homo sapiens
aaaggcatggaacagattctcc

SEQ ID NO: 7577488 - DNA, 22 bp, Homo sapiens
aaaggcatggatagtgaattca

SEQ ID NO: 7577489 - DNA, 22 bp, Homo sapiens
aaaggaggaatggagagatgct

SEQ ID NO: 7577490 - DNA, 22 bp, Homo sapiens
aaaggaggaatggagagatgct

SEQ ID NO: 7577491 - DNA, 22 bp, Homo sapiens
aaaggaggaatggagagatgct

SEQ ID NO: 7577492 - DNA, 22 bp, Homo sapiens
aaagcaatgcttgtggaatgta

SEQ ID NO: 7577493 - DNA, 22 bp, Homo sapiens
aaagcaatgcttgtggaatgta

SEQ ID NO: 7577494 - DNA, 22 bp, Homo sapiens
aaagcaatgcttgtggaatgta

SEQ ID NO: 7577495 - DNA, 22 bp, Homo sapiens
aaagcaatggatgagaatctgt

SEQ ID NO: 7577496 - DNA, 22 bp, Homo sapiens
aaagcaatggatgagaatctgt

SEQ ID NO: 7577497 - DNA, 22 bp, Homo sapiens
aaagcaatgcttgtggaatgta

SEQ ID NO: 7577498 - DNA, 22 bp, Homo sapiens
aaagcaatggatgagaatctgt

SEQ ID NO: 7577499 - DNA, 22 bp, Homo sapiens
aaagcaatggatgagaatctgt

SEQ ID NO: 7577500 - DNA, 22 bp, Homo sapiens
aaagcaatggatgagaatctgt

SEQ ID NO: 7577501 - DNA, 22 bp, Homo sapiens
aaagcaatggatgagaatctgt

SEQ ID NO: 7577502 - DNA, 22 bp, Homo sapiens
aaagtgcattgtttgtgttcct

SEQ ID NO: 7577503 - DNA, 22 bp, Homo sapiens
aaagtgcattcgaaagtccatc

SEQ ID NO: 7577504 - DNA, 22 bp, Homo sapiens
aaagtgcattgtttgtgttcct

SEQ ID NO: 7577505 - DNA, 22 bp, Homo sapiens
aaagtgccacaactggacaacc

SEQ ID NO: 7577506 - DNA, 22 bp, Homo sapiens
aaagtgcctgactcatagttag

SEQ ID NO: 7577507 - DNA, 22 bp, Homo sapiens
aaagtgccccagacaagacccc

SEQ ID NO: 7577508 - DNA, 22 bp, Homo sapiens
aaagtgccttctattttagtga

SEQ ID NO: 7577509 - DNA, 22 bp, Homo sapiens
aaagtgcctgactcatagttag

SEQ ID NO: 7577510 - DNA, 22 bp, Homo sapiens
aaagtgcctgactcatagttag

SEQ ID NO: 7577511 - DNA, 22 bp, Homo sapiens
aaagtgctaaataagccctgaa

SEQ ID NO: 7577512 - DNA, 22 bp, Homo sapiens
aaagtgctaaataagccctgaa

SEQ ID NO: 7577513 - DNA, 22 bp, Homo sapiens
aaagtgcatcaaatgacttccc

SEQ ID NO: 7577514 - DNA, 22 bp, Homo sapiens
aaagtgcatcaaatgacttccc

SEQ ID NO: 7577515 - DNA, 22 bp, Homo sapiens
aaagtgcatcaaatgacttccc

SEQ ID NO: 7577516 - DNA, 22 bp, Homo sapiens
aaagtgcattcgaaagtccatc

SEQ ID NO: 7577517 - DNA, 22 bp, Homo sapiens
aaagtgcattcgaaagtccatc

SEQ ID NO: 7577518 - DNA, 22 bp, Homo sapiens
aaagtgcattcgaaagtccatc

SEQ ID NO: 7577519 - DNA, 22 bp, Homo sapiens
aaagtgcatagagtagtgccta

SEQ ID NO: 7577520 - DNA, 22 bp, Homo sapiens
aaagtgcatagagtagtgccta

SEQ ID NO: 7577521 - DNA, 23 bp, Homo sapiens
aaagtgcagttgaggaatcatag

SEQ ID NO: 7577522 - DNA, 22 bp, Homo sapiens
aaagtgcatagagtagtgccta

SEQ ID NO: 7577523 - DNA, 22 bp, Homo sapiens
aaagtgcatagagtagtgccta

SEQ ID NO: 7577524 - DNA, 23 bp, Homo sapiens
aaagtgcagttgaggaatcatag

SEQ ID NO: 7577525 - DNA, 23 bp, Homo sapiens
aaagtgcagttgaggaatcatag

SEQ ID NO: 7577526 - DNA, 22 bp, Homo sapiens
aaagtgcagtccatgaaattaa

SEQ ID NO: 7577527 - DNA, 22 bp, Homo sapiens
aaagtgcagtccatgaaattaa

SEQ ID NO: 7577528 - DNA, 22 bp, Homo sapiens
aaagtgcagtccatgaaattaa

SEQ ID NO: 7577529 - DNA, 22 bp, Homo sapiens
aaagtgcagtccatgaaattaa

SEQ ID NO: 7577530 - DNA, 22 bp, Homo sapiens
aaagtgcagtccatgaaattaa

SEQ ID NO: 7577531 - DNA, 23 bp, Homo sapiens
aaagtgcagttgaggaatcatag

SEQ ID NO: 7577532 - DNA, 23 bp, Homo sapiens
aaagtgcagttgaggaatcatag

SEQ ID NO: 7577533 - DNA, 23 bp, Homo sapiens
aaagtgcagttgaggaatcatag

SEQ ID NO: 7577534 - DNA, 23 bp, Homo sapiens
aaagtgcagttgaggaatcatag

SEQ ID NO: 7577535 - DNA, 23 bp, Homo sapiens
aaagtgcagttgaggaatcatag

SEQ ID NO: 7577536 - DNA, 23 bp, Homo sapiens
aaagtgcagttgaggaatcatag

SEQ ID NO: 7577537 - DNA, 22 bp, Homo sapiens
aaagtgcagtccatgaaattaa

SEQ ID NO: 7577538 - DNA, 22 bp, Homo sapiens
aaagtcattttccagaccagta

SEQ ID NO: 7577539 - DNA, 22 bp, Homo sapiens
aaagtcatttgtatataccctt

SEQ ID NO: 7577540 - DNA, 22 bp, Homo sapiens
aaagtcatttgtatataccctt

SEQ ID NO: 7577541 - DNA, 22 bp, Homo sapiens
aaagtcatttagccttatctcc

SEQ ID NO: 7577542 - DNA, 22 bp, Homo sapiens
aaagtcatttagccttatctcc

SEQ ID NO: 7577543 - DNA, 22 bp, Homo sapiens
aaacactgtctctggtattgaa

SEQ ID NO: 7577544 - DNA, 22 bp, Homo sapiens
aaacactgtctctggtattgaa

SEQ ID NO: 7577545 - DNA, 22 bp, Homo sapiens
aaagtcatttagccttatctcc

SEQ ID NO: 7577546 - DNA, 22 bp, Homo sapiens
aaacactgtacaatctgcaggg

SEQ ID NO: 7577547 - DNA, 22 bp, Homo sapiens
aaacactgtacaatctgcaggg

SEQ ID NO: 7577548 - DNA, 22 bp, Homo sapiens
aaacactgtacaatctgcaggg

SEQ ID NO: 7577549 - DNA, 22 bp, Homo sapiens
aaacactggtatgatgtatagt

SEQ ID NO: 7577550 - DNA, 20 bp, Homo sapiens
aaacactggctggggcacag

SEQ ID NO: 7577551 - DNA, 22 bp, Homo sapiens
aaacactggtatgatgtatagt

SEQ ID NO: 7577552 - DNA, 22 bp, Homo sapiens
aaacactggtatgatgtatagt

SEQ ID NO: 7577553 - DNA, 22 bp, Homo sapiens
aaacactggtatgatgtatagt

SEQ ID NO: 7577554 - DNA, 22 bp, Homo sapiens
aaacactggtatgatgtatagt

SEQ ID NO: 7577555 - DNA, 22 bp, Homo sapiens
aaacactggtatgatgtatagt

SEQ ID NO: 7577556 - DNA, 22 bp, Homo sapiens
aaacactggtatgatgtatagt

SEQ ID NO: 7577557 - DNA, 22 bp, Homo sapiens
aaacactggtatgatgtatagt

SEQ ID NO: 7577558 - DNA, 22 bp, Homo sapiens
aaacactggtatgatgtatagt

SEQ ID NO: 7577559 - DNA, 22 bp, Homo sapiens
aaacactgcagggtttacttga

SEQ ID NO: 7577560 - DNA, 22 bp, Homo sapiens
aaacactgcagggtttacttga

SEQ ID NO: 7577561 - DNA, 22 bp, Homo sapiens
aaacactgcagggtttacttga

SEQ ID NO: 7577562 - DNA, 22 bp, Homo sapiens
aaacactgatggatatttttcc

SEQ ID NO: 7577563 - DNA, 22 bp, Homo sapiens
aaacactgcgtggtggcaactc

SEQ ID NO: 7577564 - DNA, 22 bp, Homo sapiens
aaacactgcagggtttacttga

SEQ ID NO: 7577565 - DNA, 22 bp, Homo sapiens
aaacactgcgtggtggcaactc

SEQ ID NO: 7577566 - DNA, 22 bp, Homo sapiens
aaacactgcgtggtggcaactc

SEQ ID NO: 7577567 - DNA, 22 bp, Homo sapiens
aaacactggcaatttcatgcac

SEQ ID NO: 7577568 - DNA, 22 bp, Homo sapiens
aaacactggcaatttcatgcac

SEQ ID NO: 7577569 - DNA, 22 bp, Homo sapiens
aaacactggcaatttcatgcac

SEQ ID NO: 7577570 - DNA, 22 bp, Homo sapiens
aaacactggcaatttcatgcac

SEQ ID NO: 7577571 - DNA, 22 bp, Homo sapiens
aaacactggcaatttcatgcac

SEQ ID NO: 7577572 - DNA, 22 bp, Homo sapiens
aaacactggcaatttcatgcac

SEQ ID NO: 7577573 - DNA, 22 bp, Homo sapiens
aaacactggcaatttcatgcac

SEQ ID NO: 7577574 - DNA, 22 bp, Homo sapiens
aaacactggcaatttcatgcac

SEQ ID NO: 7577575 - DNA, 22 bp, Homo sapiens
aaacatctactgtaggctggag

SEQ ID NO: 7577576 - DNA, 22 bp, Homo sapiens
aaacatctactgtaggctggag

SEQ ID NO: 7577577 - DNA, 22 bp, Homo sapiens
aaacatctatcagcatttttta

SEQ ID NO: 7577578 - DNA, 22 bp, Homo sapiens
aaacatctatcagcatttttta

SEQ ID NO: 7577579 - DNA, 22 bp, Homo sapiens
aaacatctatcagcatttttta

SEQ ID NO: 7577580 - DNA, 22 bp, Homo sapiens
aaacatctatcagcatttttta

SEQ ID NO: 7577581 - DNA, 22 bp, Homo sapiens
aaacatctatcagcatttttta

SEQ ID NO: 7577582 - DNA, 22 bp, Homo sapiens
aaacatctatcagcatttttta

SEQ ID NO: 7577583 - DNA, 22 bp, Homo sapiens
aaacatctatcagcatttttta

SEQ ID NO: 7577584 - DNA, 22 bp, Homo sapiens
aaacatctattatgtgctgagc

SEQ ID NO: 7577585 - DNA, 22 bp, Homo sapiens
aaatacagattccagggtctta

SEQ ID NO: 7577586 - DNA, 22 bp, Homo sapiens
aaacatcataggcatgcatgat

SEQ ID NO: 7577587 - DNA, 22 bp, Homo sapiens
aaacatcataggcatgcatgat

SEQ ID NO: 7577588 - DNA, 22 bp, Homo sapiens
aaacatcataggcatgcatgat

SEQ ID NO: 7577589 - DNA, 22 bp, Homo sapiens
aaacatcataggcatgcatgat

SEQ ID NO: 7577590 - DNA, 22 bp, Homo sapiens
aaacatcataggcatgcatgat

SEQ ID NO: 7577591 - DNA, 22 bp, Homo sapiens
aaacatcataggcatgcatgat

SEQ ID NO: 7577592 - DNA, 22 bp, Homo sapiens
aaacatcataggcatgcatgat

SEQ ID NO: 7577593 - DNA, 22 bp, Homo sapiens
aaacatcataggcatgcatgat

SEQ ID NO: 7577594 - DNA, 22 bp, Homo sapiens
aaacatctactgtaggctggag

SEQ ID NO: 7577595 - DNA, 22 bp, Homo sapiens
aaacatagataatagatagatg

SEQ ID NO: 7577596 - DNA, 22 bp, Homo sapiens
aaacatagcacacacagctctt

SEQ ID NO: 7577597 - DNA, 22 bp, Homo sapiens
aaacatagcacacacagctctt

SEQ ID NO: 7577598 - DNA, 22 bp, Homo sapiens
aaacatagataatagatagatg

SEQ ID NO: 7577599 - DNA, 20 bp, Homo sapiens
aaacatagtggataccacag

SEQ ID NO: 7577600 - DNA, 20 bp, Homo sapiens
aaacatagtggataccacag

SEQ ID NO: 7577601 - DNA, 22 bp, Homo sapiens
aaacatagataatagatagatg

SEQ ID NO: 7577602 - DNA, 22 bp, Homo sapiens
aaacatagataatagatagatg

SEQ ID NO: 7577603 - DNA, 22 bp, Homo sapiens
aaacatagcacacacagctctt

SEQ ID NO: 7577604 - DNA, 22 bp, Homo sapiens
aaacagttttttaagtctctag

SEQ ID NO: 7577605 - DNA, 22 bp, Homo sapiens
aaacagttttttaagtctctag

SEQ ID NO: 7577606 - DNA, 22 bp, Homo sapiens
aaacatagataatagatagatg

SEQ ID NO: 7577607 - DNA, 22 bp, Homo sapiens
aaacatagataatagatagatg

SEQ ID NO: 7577608 - DNA, 22 bp, Homo sapiens
aaacatagataatagatagatg

SEQ ID NO: 7577609 - DNA, 22 bp, Homo sapiens
aaacatcaccattttacctaat

SEQ ID NO: 7577610 - DNA, 22 bp, Homo sapiens
aaacatcaccattttacctaat

SEQ ID NO: 7577611 - DNA, 22 bp, Homo sapiens
aaacatcaccattttacctaat

SEQ ID NO: 7577612 - DNA, 22 bp, Homo sapiens
aaacatcaccattttacctaat

SEQ ID NO: 7577613 - DNA, 22 bp, Homo sapiens
aaacatcaccattttacctaat

SEQ ID NO: 7577614 - DNA, 22 bp, Homo sapiens
aaacatcaccattttacctaat

SEQ ID NO: 7577615 - DNA, 22 bp, Homo sapiens
aaacatcaccattttacctaat

SEQ ID NO: 7577616 - DNA, 22 bp, Homo sapiens
aaacatcaattgcatctcccaa

SEQ ID NO: 7577617 - DNA, 20 bp, Homo sapiens
aaacatagtggataccacag

SEQ ID NO: 7577618 - DNA, 20 bp, Homo sapiens
aaacatagtggataccacag

SEQ ID NO: 7577619 - DNA, 22 bp, Homo sapiens
aaacagttttctcatttagtgt

SEQ ID NO: 7577620 - DNA, 22 bp, Homo sapiens
aaacagttttctcatttagtgt

SEQ ID NO: 7577621 - DNA, 22 bp, Homo sapiens
aaacagttttctcatttagtgt

SEQ ID NO: 7577622 - DNA, 22 bp, Homo sapiens
aaacagttttctcatttagtgt

SEQ ID NO: 7577623 - DNA, 22 bp, Homo sapiens
aaacagttttctcatttagtgt

SEQ ID NO: 7577624 - DNA, 22 bp, Homo sapiens
aaacagttttctcatttagtgt

SEQ ID NO: 7577625 - DNA, 22 bp, Homo sapiens
aaacagttttctcatttagtgt

SEQ ID NO: 7577626 - DNA, 22 bp, Homo sapiens
aaacagttttttaagtctctag

SEQ ID NO: 7577627 - DNA, 22 bp, Homo sapiens
aaacagttttgccaaaaggaca

SEQ ID NO: 7577628 - DNA, 22 bp, Homo sapiens
aaacagttttgccaaaaggaca

SEQ ID NO: 7577629 - DNA, 22 bp, Homo sapiens
aaacagttttgccaaaaggaca

SEQ ID NO: 7577630 - DNA, 22 bp, Homo sapiens
aaacagttttgccaaaaggaca

SEQ ID NO: 7577631 - DNA, 22 bp, Homo sapiens
aaacagttttctcatttagtgt

SEQ ID NO: 7577632 - DNA, 22 bp, Homo sapiens
aaacagttttgccaaaaggaca

SEQ ID NO: 7577633 - DNA, 22 bp, Homo sapiens
aaacagttttgccaaaaggaca

SEQ ID NO: 7577634 - DNA, 22 bp, Homo sapiens
aaagtgctgggattacaggtgt

SEQ ID NO: 7577635 - DNA, 22 bp, Homo sapiens
aaagtgctgggattataggcat

SEQ ID NO: 7577636 - DNA, 22 bp, Homo sapiens
aaagtgctgggattataggcat

SEQ ID NO: 7577637 - DNA, 22 bp, Homo sapiens
aaagtgctgggattccaggcgt

SEQ ID NO: 7577638 - DNA, 22 bp, Homo sapiens
aaagtgctgggattccaggcgt

SEQ ID NO: 7577639 - DNA, 22 bp, Homo sapiens
aaagtgctgggattacaggcat

SEQ ID NO: 7577640 - DNA, 22 bp, Homo sapiens
aaagtgctgggattacaggcat

SEQ ID NO: 7577641 - DNA, 22 bp, Homo sapiens
aaagtgctgggattacaggcct

SEQ ID NO: 7577642 - DNA, 22 bp, Homo sapiens
aaagtgctgggattacaggcct

SEQ ID NO: 7577643 - DNA, 22 bp, Homo sapiens
aaagtgctgggattacaggcgt

SEQ ID NO: 7577644 - DNA, 22 bp, Homo sapiens
aaagtgctgggattacaggcgt

SEQ ID NO: 7577645 - DNA, 22 bp, Homo sapiens
aaagtgctgggattacaggctt

SEQ ID NO: 7577646 - DNA, 22 bp, Homo sapiens
aaagtgctgggattacaggctt

SEQ ID NO: 7577647 - DNA, 22 bp, Homo sapiens
aaagtgctgaaattacaggggt

SEQ ID NO: 7577648 - DNA, 22 bp, Homo sapiens
aaagtgctcggcgctggtccca

SEQ ID NO: 7577649 - DNA, 22 bp, Homo sapiens
aaagtgctgaaattacaggtgt

SEQ ID NO: 7577650 - DNA, 22 bp, Homo sapiens
aaagtgctgaagacctagctgt

SEQ ID NO: 7577651 - DNA, 22 bp, Homo sapiens
aaagtgctcggattacaggtat

SEQ ID NO: 7577652 - DNA, 22 bp, Homo sapiens
aaagtgctaggattacaagcgt

SEQ ID NO: 7577653 - DNA, 22 bp, Homo sapiens
aaagtgctaggattacaagcgt

SEQ ID NO: 7577654 - DNA, 22 bp, Homo sapiens
aaagtgctaagtcacccagcta

SEQ ID NO: 7577655 - DNA, 22 bp, Homo sapiens
aaagtgctaggattacaagcgt

SEQ ID NO: 7577656 - DNA, 22 bp, Homo sapiens
aaagtgctgagattacaagcgt

SEQ ID NO: 7577657 - DNA, 22 bp, Homo sapiens
aaagtgctgagattacaagcgt

SEQ ID NO: 7577658 - DNA, 22 bp, Homo sapiens
aaagtgctgaagacctagctgt

SEQ ID NO: 7577659 - DNA, 22 bp, Homo sapiens
aaagtgctgaagacctagctgt

SEQ ID NO: 7577660 - DNA, 22 bp, Homo sapiens
aaagtgctgaagacctagctgt

SEQ ID NO: 7577661 - DNA, 22 bp, Homo sapiens
aaagtgctgagattacaagcgt

SEQ ID NO: 7577662 - DNA, 22 bp, Homo sapiens
aaagtgctgggattacaagcgt

SEQ ID NO: 7577663 - DNA, 22 bp, Homo sapiens
aaagtgctgcgacatttgagcg

SEQ ID NO: 7577664 - DNA, 22 bp, Homo sapiens
aaagtgctgcgacatttgagcg

SEQ ID NO: 7577665 - DNA, 22 bp, Homo sapiens
aaagtgctgggattacaagcgt

SEQ ID NO: 7577666 - DNA, 22 bp, Homo sapiens
aaagtgctgggattacaagcgt

SEQ ID NO: 7577667 - DNA, 22 bp, Homo sapiens
aaagtgctgggattacaagtgt

SEQ ID NO: 7577668 - DNA, 22 bp, Homo sapiens
aaagtgctgggattacaagtgt

SEQ ID NO: 7577669 - DNA, 22 bp, Homo sapiens
aaagtgctgggattacaagtgt

SEQ ID NO: 7577670 - DNA, 22 bp, Homo sapiens
aaagtgctgggattacaagtgt

SEQ ID NO: 7577671 - DNA, 22 bp, Homo sapiens
aatctattccctttctgtaaaa

SEQ ID NO: 7577672 - DNA, 22 bp, Homo sapiens
aatctattccctttctgtaaaa

SEQ ID NO: 7577673 - DNA, 22 bp, Homo sapiens
aatctattccctttctgtaaaa

SEQ ID NO: 7577674 - DNA, 22 bp, Homo sapiens
aatctattccctttctgtaaaa

SEQ ID NO: 7577675 - DNA, 22 bp, Homo sapiens
aatctatatgcttttcacatac

SEQ ID NO: 7577676 - DNA, 22 bp, Homo sapiens
aatctatatgcttttcacatac

SEQ ID NO: 7577677 - DNA, 22 bp, Homo sapiens
agaaactgaacacaagagtcgg

SEQ ID NO: 7577678 - DNA, 22 bp, Homo sapiens
agaaactgaacacaagagtcgg

SEQ ID NO: 7577679 - DNA, 22 bp, Homo sapiens
agaaactctggaagaactttta

SEQ ID NO: 7577680 - DNA, 22 bp, Homo sapiens
agaaactgaacacaagagtcgg

SEQ ID NO: 7577681 - DNA, 22 bp, Homo sapiens
aatctatatgcttttcacatac

SEQ ID NO: 7577682 - DNA, 22 bp, Homo sapiens
agaaactcatcctggagatgac

SEQ ID NO: 7577683 - DNA, 22 bp, Homo sapiens
agaaactcacctttccagccat

SEQ ID NO: 7577684 - DNA, 22 bp, Homo sapiens
agaaactcatcctggagatgac

SEQ ID NO: 7577685 - DNA, 22 bp, Homo sapiens
agaaactctaggtcaattgagg

SEQ ID NO: 7577686 - DNA, 22 bp, Homo sapiens
agaaactcatgccatctcgttg

SEQ ID NO: 7577687 - DNA, 22 bp, Homo sapiens
agaaactctggaagaactttta

SEQ ID NO: 7577688 - DNA, 22 bp, Homo sapiens
agaaactattatggtaaacaaa

SEQ ID NO: 7577689 - DNA, 22 bp, Homo sapiens
agaaactattatggtaaacaaa

SEQ ID NO: 7577690 - DNA, 22 bp, Homo sapiens
agaaactattatggtaaacaaa

SEQ ID NO: 7577691 - DNA, 22 bp, Homo sapiens
agaaactattatggtaaacaaa

SEQ ID NO: 7577692 - DNA, 22 bp, Homo sapiens
agaaactacttggaggaaagat

SEQ ID NO: 7577693 - DNA, 22 bp, Homo sapiens
agaaactaagtcataactcttt

SEQ ID NO: 7577694 - DNA, 22 bp, Homo sapiens
agaaactatcctgagtagcaaa

SEQ ID NO: 7577695 - DNA, 22 bp, Homo sapiens
agaaactacttggaggaaagat

SEQ ID NO: 7577696 - DNA, 22 bp, Homo sapiens
agaaactatcctgagtagcaaa

SEQ ID NO: 7577697 - DNA, 22 bp, Homo sapiens
agaaactatcctgagtagcaaa

SEQ ID NO: 7577698 - DNA, 22 bp, Homo sapiens
agaaactatcctgagtagcaaa

SEQ ID NO: 7577699 - DNA, 22 bp, Homo sapiens
agaaactaaagccaagggctct

SEQ ID NO: 7577700 - DNA, 22 bp, Homo sapiens
agaaactaacctggtagggttc

SEQ ID NO: 7577701 - DNA, 22 bp, Homo sapiens
agaaacgcctgtgaaattatct

SEQ ID NO: 7577702 - DNA, 22 bp, Homo sapiens
agaaacgcctgtgaaattatct

SEQ ID NO: 7577703 - DNA, 22 bp, Homo sapiens
agaaactaaagccaagggctct

SEQ ID NO: 7577704 - DNA, 22 bp, Homo sapiens
agaaacgcctgtgaaattatct

SEQ ID NO: 7577705 - DNA, 22 bp, Homo sapiens
agaaacgcctgtgaaattatct

SEQ ID NO: 7577706 - DNA, 22 bp, Homo sapiens
agaaacctgggggttgtacata

SEQ ID NO: 7577707 - DNA, 22 bp, Homo sapiens
agaaacctgtgtgctgtgatga

SEQ ID NO: 7577708 - DNA, 22 bp, Homo sapiens
agaaacctgtgtgctgtgatga

SEQ ID NO: 7577709 - DNA, 22 bp, Homo sapiens
agaaacctccatttattcactc

SEQ ID NO: 7577710 - DNA, 22 bp, Homo sapiens
agaaacctgtgtgctgtgatga

SEQ ID NO: 7577711 - DNA, 22 bp, Homo sapiens
aatctgtttaacagatttctgt

SEQ ID NO: 7577712 - DNA, 17 bp, Homo sapiens
aatctgtttacagtcag

SEQ ID NO: 7577713 - DNA, 17 bp, Homo sapiens
aatctgtttacagtcag

SEQ ID NO: 7577714 - DNA, 22 bp, Homo sapiens
aatctgtcttcttttgtggttt

SEQ ID NO: 7577715 - DNA, 22 bp, Homo sapiens
aatctgttaagaacagaaatgt

SEQ ID NO: 7577716 - DNA, 22 bp, Homo sapiens
aatctgttaagaacagaaatgt

SEQ ID NO: 7577717 - DNA, 22 bp, Homo sapiens
aatctgtattgttaacaagtaa

SEQ ID NO: 7577718 - DNA, 22 bp, Homo sapiens
aatctgttaggatgaggatacg

SEQ ID NO: 7577719 - DNA, 22 bp, Homo sapiens
aatctgttctactctattcaga

SEQ ID NO: 7577720 - DNA, 22 bp, Homo sapiens
aatctgttctactctattcaga

SEQ ID NO: 7577721 - DNA, 22 bp, Homo sapiens
aatctcaagctgtaaatacctc

SEQ ID NO: 7577722 - DNA, 22 bp, Homo sapiens
aatctcaagctgtaaatacctc

SEQ ID NO: 7577723 - DNA, 22 bp, Homo sapiens
aatctgtgctccctgcatttgt

SEQ ID NO: 7577724 - DNA, 22 bp, Homo sapiens
aatctgtcgtgttgatagttct

SEQ ID NO: 7577725 - DNA, 22 bp, Homo sapiens
aatctgtcgtagtaaaaagcag

SEQ ID NO: 7577726 - DNA, 22 bp, Homo sapiens
aatctgtcgtagtaaaaagcag

SEQ ID NO: 7577727 - DNA, 22 bp, Homo sapiens
aatctgtcccttaactagtcat

SEQ ID NO: 7577728 - DNA, 22 bp, Homo sapiens
aatctgtcccttaactagtcat

SEQ ID NO: 7577729 - DNA, 22 bp, Homo sapiens
aatctgtcagaatttctaagtt

SEQ ID NO: 7577730 - DNA, 22 bp, Homo sapiens
aatctgtcccttaactagtcat

SEQ ID NO: 7577731 - DNA, 22 bp, Homo sapiens
aatcttaaagaatattctacca

SEQ ID NO: 7577732 - DNA, 22 bp, Homo sapiens
aatcttaagctgaattctctcc

SEQ ID NO: 7577733 - DNA, 22 bp, Homo sapiens
aatcttaaagaatattctacca

SEQ ID NO: 7577734 - DNA, 22 bp, Homo sapiens
aatcttaaagaatattctacca

SEQ ID NO: 7577735 - DNA, 22 bp, Homo sapiens
aatctgtttttgaaactttgta

SEQ ID NO: 7577736 - DNA, 22 bp, Homo sapiens
aatctgttttatcatttgttac

SEQ ID NO: 7577737 - DNA, 22 bp, Homo sapiens
aatctgttttatcatttgttac

SEQ ID NO: 7577738 - DNA, 22 bp, Homo sapiens
aatctgtttttgaaactttgta

SEQ ID NO: 7577739 - DNA, 22 bp, Homo sapiens
aatcttaaagaatattctacca

SEQ ID NO: 7577740 - DNA, 22 bp, Homo sapiens
aatcttaaagaatattctacca

SEQ ID NO: 7577741 - DNA, 22 bp, Homo sapiens
aatctgtttccatgttttattg

SEQ ID NO: 7577742 - DNA, 22 bp, Homo sapiens
aatctgtttccattagagtcat

SEQ ID NO: 7577743 - DNA, 22 bp, Homo sapiens
aatctgtttgatgcttgtgata

SEQ ID NO: 7577744 - DNA, 22 bp, Homo sapiens
aatctgtttgatgcttgtgata

SEQ ID NO: 7577745 - DNA, 22 bp, Homo sapiens
aatctgtttgatgcttgtgata

SEQ ID NO: 7577746 - DNA, 22 bp, Homo sapiens
aatctgttttaaagtttgtgcc

SEQ ID NO: 7577747 - DNA, 22 bp, Homo sapiens
aatctgttttatcatttgttac

SEQ ID NO: 7577748 - DNA, 17 bp, Homo sapiens
aatctgtttacagtcag

SEQ ID NO: 7577749 - DNA, 22 bp, Homo sapiens
aatctgtttagttctgcgtatg

SEQ ID NO: 7577750 - DNA, 22 bp, Homo sapiens
aatctgtttccaatacttgcta

SEQ ID NO: 7577751 - DNA, 22 bp, Homo sapiens
aatctgtttccatgttttattg

SEQ ID NO: 7577752 - DNA, 22 bp, Homo sapiens
aatctgtttccatgttttattg

SEQ ID NO: 7577753 - DNA, 22 bp, Homo sapiens
aatctgtttccaatacttgcta

SEQ ID NO: 7577754 - DNA, 22 bp, Homo sapiens
aatcttaagctgaattctctcc

SEQ ID NO: 7577755 - DNA, 22 bp, Homo sapiens
aatcttaagctgaattctctcc

SEQ ID NO: 7577756 - DNA, 22 bp, Homo sapiens
aatcttacaccgaatttaaact

SEQ ID NO: 7577757 - DNA, 22 bp, Homo sapiens
aatcttcaaaaacaattgaggg

SEQ ID NO: 7577758 - DNA, 22 bp, Homo sapiens
aatcttcaaaaacaattgaggg

SEQ ID NO: 7577759 - DNA, 22 bp, Homo sapiens
aatcttcaacagaatggtagga

SEQ ID NO: 7577760 - DNA, 22 bp, Homo sapiens
aatcttcaacagaatggtagga

SEQ ID NO: 7577761 - DNA, 22 bp, Homo sapiens
aatcttcaacagaatggtagga

SEQ ID NO: 7577762 - DNA, 22 bp, Homo sapiens
aatcttcaaaatgttctgcttg

SEQ ID NO: 7577763 - DNA, 22 bp, Homo sapiens
aatcttcaaaatgttctgcttg

SEQ ID NO: 7577764 - DNA, 22 bp, Homo sapiens
aatcttcacagaaaaatgtctg

SEQ ID NO: 7577765 - DNA, 22 bp, Homo sapiens
aatcttcacagaaaaatgtctg

SEQ ID NO: 7577766 - DNA, 22 bp, Homo sapiens
aatcttcacagaaaaatgtctg

SEQ ID NO: 7577767 - DNA, 22 bp, Homo sapiens
aatcttcacagagaaaattagg

SEQ ID NO: 7577768 - DNA, 22 bp, Homo sapiens
aatcttcacagagaaaattagg

SEQ ID NO: 7577769 - DNA, 22 bp, Homo sapiens
aatcttcacagagaaaattagg

SEQ ID NO: 7577770 - DNA, 22 bp, Homo sapiens
aatcttcactaaaatggacaag

SEQ ID NO: 7577771 - DNA, 22 bp, Homo sapiens
aatcttcactaaaatggacaag

SEQ ID NO: 7577772 - DNA, 22 bp, Homo sapiens
aatcttcactcattcagagttg

SEQ ID NO: 7577773 - DNA, 22 bp, Homo sapiens
aatcttcactcattcagagttg

SEQ ID NO: 7577774 - DNA, 22 bp, Homo sapiens
aatcttcactcattcagagttg

SEQ ID NO: 7577775 - DNA, 22 bp, Homo sapiens
aatcttcactaaaatggacaag

SEQ ID NO: 7577776 - DNA, 22 bp, Homo sapiens
aatcttcactcttaactgtgca

SEQ ID NO: 7577777 - DNA, 22 bp, Homo sapiens
aatcttcactcttaactgtgca

SEQ ID NO: 7577778 - DNA, 22 bp, Homo sapiens
aatcttcagagaccatggagcc

SEQ ID NO: 7577779 - DNA, 22 bp, Homo sapiens
aatcttcagagaccatggagcc

SEQ ID NO: 7577780 - DNA, 22 bp, Homo sapiens
aatcttcatgtcctctctaatt

SEQ ID NO: 7577781 - DNA, 22 bp, Homo sapiens
aatcttcatgtcctctctaatt

SEQ ID NO: 7577782 - DNA, 22 bp, Homo sapiens
aatcttcagtgtctaaaaagca

SEQ ID NO: 7577783 - DNA, 22 bp, Homo sapiens
aatcttcataaaaatctagtag

SEQ ID NO: 7577784 - DNA, 22 bp, Homo sapiens
aatcttcagcactccagagact

SEQ ID NO: 7577785 - DNA, 22 bp, Homo sapiens
aatcttcagcactccagagact

SEQ ID NO: 7577786 - DNA, 22 bp, Homo sapiens
aatcttcagggtcctggggctc

SEQ ID NO: 7577787 - DNA, 22 bp, Homo sapiens
aatcttcagggtcctggggctc

SEQ ID NO: 7577788 - DNA, 22 bp, Homo sapiens
aatcttcagtgtctaaaaagca

SEQ ID NO: 7577789 - DNA, 22 bp, Homo sapiens
aatcttcagtgtctaaaaagca

SEQ ID NO: 7577790 - DNA, 22 bp, Homo sapiens
aatcttcagtgtctaaaaagca

SEQ ID NO: 7577791 - DNA, 22 bp, Homo sapiens
aatcttcattttgacaagattc

SEQ ID NO: 7577792 - DNA, 22 bp, Homo sapiens
aatcttcattttgacaagattc

SEQ ID NO: 7577793 - DNA, 22 bp, Homo sapiens
aatcttcatgtcctctctaatt

SEQ ID NO: 7577794 - DNA, 22 bp, Homo sapiens
aatcttcattttgacaagattc

SEQ ID NO: 7577795 - DNA, 22 bp, Homo sapiens
aatcttcattttgacaagattc

SEQ ID NO: 7577796 - DNA, 22 bp, Homo sapiens
aatcttggaagtgtccactggt

SEQ ID NO: 7577797 - DNA, 22 bp, Homo sapiens
aatcttggcaaatgtagcttcc

SEQ ID NO: 7577798 - DNA, 22 bp, Homo sapiens
aatcttggttgcagtatatccg

SEQ ID NO: 7577799 - DNA, 22 bp, Homo sapiens
aatcttggttgcagtatatccg

SEQ ID NO: 7577800 - DNA, 22 bp, Homo sapiens
aatctttaaggactcagtctct

SEQ ID NO: 7577801 - DNA, 22 bp, Homo sapiens
aatgaaaattggaccctagaac

SEQ ID NO: 7577802 - DNA, 22 bp, Homo sapiens
aatgaaaattggaccctagaac

SEQ ID NO: 7577803 - DNA, 22 bp, Homo sapiens
aatgaaaattggaccctagaac

SEQ ID NO: 7577804 - DNA, 22 bp, Homo sapiens
aatcttttgattctagggctgt

SEQ ID NO: 7577805 - DNA, 22 bp, Homo sapiens
aatctttttcacaagaaagcac

SEQ ID NO: 7577806 - DNA, 22 bp, Homo sapiens
aatctttttcacaagaaagcac

SEQ ID NO: 7577807 - DNA, 22 bp, Homo sapiens
aatcttttaggggatcctgagg

SEQ ID NO: 7577808 - DNA, 22 bp, Homo sapiens
aatcttttaggggatcctgagg

SEQ ID NO: 7577809 - DNA, 22 bp, Homo sapiens
aatctttccctattaaatgtgg

SEQ ID NO: 7577810 - DNA, 22 bp, Homo sapiens
aatctttcattcattcatacat

SEQ ID NO: 7577811 - DNA, 22 bp, Homo sapiens
aatatgttcaaaatagatcact

SEQ ID NO: 7577812 - DNA, 22 bp, Homo sapiens
aatatgttccacttaaagctgg

SEQ ID NO: 7577813 - DNA, 22 bp, Homo sapiens
aatatgttccacttaaagctgg

SEQ ID NO: 7577814 - DNA, 22 bp, Homo sapiens
aatatgttcaaaatagatcact

SEQ ID NO: 7577815 - DNA, 22 bp, Homo sapiens
aatatgttcaaaatagatcact

SEQ ID NO: 7577816 - DNA, 22 bp, Homo sapiens
aatatgttcaaaatagatcact

SEQ ID NO: 7577817 - DNA, 22 bp, Homo sapiens
aatatgttcaaaatagatcact

SEQ ID NO: 7577818 - DNA, 22 bp, Homo sapiens
aatatgttcaaaatagatcact

SEQ ID NO: 7577819 - DNA, 22 bp, Homo sapiens
aatatgttcaaaatagatcact

SEQ ID NO: 7577820 - DNA, 22 bp, Homo sapiens
aatatgtgggtgctaatcaaaa

SEQ ID NO: 7577821 - DNA, 22 bp, Homo sapiens
aatatgttccacttaaagctgg

SEQ ID NO: 7577822 - DNA, 22 bp, Homo sapiens
aatatgttccacttaaagctgg

SEQ ID NO: 7577823 - DNA, 22 bp, Homo sapiens
aatatgttccacttaaagctgg

SEQ ID NO: 7577824 - DNA, 22 bp, Homo sapiens
aatatgttccacttaaagctgg

SEQ ID NO: 7577825 - DNA, 22 bp, Homo sapiens
aatatgttccacttaaagctgg

SEQ ID NO: 7577826 - DNA, 22 bp, Homo sapiens
aatatgttccacttaaagctgg

SEQ ID NO: 7577827 - DNA, 22 bp, Homo sapiens
aatatgttccacttaaagctgg

SEQ ID NO: 7577828 - DNA, 22 bp, Homo sapiens
aatatgttgagtctatctttat

SEQ ID NO: 7577829 - DNA, 22 bp, Homo sapiens
aatatgttgagtctatctttat

SEQ ID NO: 7577830 - DNA, 22 bp, Homo sapiens
aatatgttgagtctatctttat

SEQ ID NO: 7577831 - DNA, 22 bp, Homo sapiens
aatatgttgagtctatctttat

SEQ ID NO: 7577832 - DNA, 22 bp, Homo sapiens
aatatgttgagtctatctttat

SEQ ID NO: 7577833 - DNA, 22 bp, Homo sapiens
aatatgtttataagatatcttc

SEQ ID NO: 7577834 - DNA, 22 bp, Homo sapiens
aatattatcaaaagctttttca

SEQ ID NO: 7577835 - DNA, 22 bp, Homo sapiens
aatattatcaaaagctttttca

SEQ ID NO: 7577836 - DNA, 22 bp, Homo sapiens
aatattatcaaaagctttttca

SEQ ID NO: 7577837 - DNA, 22 bp, Homo sapiens
aatattcaagttattctttctt

SEQ ID NO: 7577838 - DNA, 22 bp, Homo sapiens
aatattcaagttattctttctt

SEQ ID NO: 7577839 - DNA, 22 bp, Homo sapiens
aatattatcaaaagctttttca

SEQ ID NO: 7577840 - DNA, 22 bp, Homo sapiens
aatattatcaaaagctttttca

SEQ ID NO: 7577841 - DNA, 22 bp, Homo sapiens
aatattatcaaaagctttttca

SEQ ID NO: 7577842 - DNA, 22 bp, Homo sapiens
aatattatacagtcaacctctt

SEQ ID NO: 7577843 - DNA, 22 bp, Homo sapiens
aatattagtttctcaagagaga

SEQ ID NO: 7577844 - DNA, 22 bp, Homo sapiens
aatattagtttctcaagagaga

SEQ ID NO: 7577845 - DNA, 22 bp, Homo sapiens
aatattaatagaaggggttcta

SEQ ID NO: 7577846 - DNA, 22 bp, Homo sapiens
aatattaatagaaggggttcta

SEQ ID NO: 7577847 - DNA, 22 bp, Homo sapiens
aatattaatagaaggggttcta

SEQ ID NO: 7577848 - DNA, 22 bp, Homo sapiens
aatattagtttctcaagagaga

SEQ ID NO: 7577849 - DNA, 22 bp, Homo sapiens
aatattaatagaaggggttcta

SEQ ID NO: 7577850 - DNA, 22 bp, Homo sapiens
aatattagtttctcaagagaga

SEQ ID NO: 7577851 - DNA, 22 bp, Homo sapiens
aatatgtttataagatatcttc

SEQ ID NO: 7577852 - DNA, 22 bp, Homo sapiens
aatatgcagcttatcttctagg

SEQ ID NO: 7577853 - DNA, 22 bp, Homo sapiens
aatatgcagcttatcttctagg

SEQ ID NO: 7577854 - DNA, 22 bp, Homo sapiens
aatatgcagcttatcttctagg

SEQ ID NO: 7577855 - DNA, 22 bp, Homo sapiens
aatatgcatgtatacatgtgta

SEQ ID NO: 7577856 - DNA, 22 bp, Homo sapiens
aatatgcagcttatcttctagg

SEQ ID NO: 7577857 - DNA, 22 bp, Homo sapiens
aatatgcatgtatacatgtgta

SEQ ID NO: 7577858 - DNA, 22 bp, Homo sapiens
aatatgcatgtatacatgtgta

SEQ ID NO: 7577859 - DNA, 22 bp, Homo sapiens
aatatgcatgtatacatgtgta

SEQ ID NO: 7577860 - DNA, 22 bp, Homo sapiens
aatatgcattatacagactgat

SEQ ID NO: 7577861 - DNA, 22 bp, Homo sapiens
aatatgcattatacagactgat

SEQ ID NO: 7577862 - DNA, 22 bp, Homo sapiens
aatatgcattaactgtgtacat

SEQ ID NO: 7577863 - DNA, 20 bp, Homo sapiens
aatatgctgggagtttatat

SEQ ID NO: 7577864 - DNA, 22 bp, Homo sapiens
aatatggctccattcctttagg

SEQ ID NO: 7577865 - DNA, 22 bp, Homo sapiens
aatatgcatgtatacatgtgta

SEQ ID NO: 7577866 - DNA, 22 bp, Homo sapiens
aatatgcatgtatacatgtgta

SEQ ID NO: 7577867 - DNA, 22 bp, Homo sapiens
aatatgcattaactgtgtacat

SEQ ID NO: 7577868 - DNA, 22 bp, Homo sapiens
aatatgtctctggctagacatt

SEQ ID NO: 7577869 - DNA, 18 bp, Homo sapiens
aatatgtctagttacagc

SEQ ID NO: 7577870 - DNA, 22 bp, Homo sapiens
aatatgtctctggctagacatt

SEQ ID NO: 7577871 - DNA, 22 bp, Homo sapiens
aatatgtgaggtatgttcagtg

SEQ ID NO: 7577872 - DNA, 22 bp, Homo sapiens
aatatgtgaggtatgttcagtg

SEQ ID NO: 7577873 - DNA, 22 bp, Homo sapiens
aatatgcagcatgatgaagtaa

SEQ ID NO: 7577874 - DNA, 22 bp, Homo sapiens
aatatgcagcttatcttctagg

SEQ ID NO: 7577875 - DNA, 22 bp, Homo sapiens
aatatgcagcatgatgaagtaa

SEQ ID NO: 7577876 - DNA, 22 bp, Homo sapiens
aatatgcagcatgatgaagtaa

SEQ ID NO: 7577877 - DNA, 22 bp, Homo sapiens
aatatgcagcatgatgaagtaa

SEQ ID NO: 7577878 - DNA, 22 bp, Homo sapiens
aatatgcagcatgatgaagtaa

SEQ ID NO: 7577879 - DNA, 22 bp, Homo sapiens
aatatgcactctgatttagcag

SEQ ID NO: 7577880 - DNA, 22 bp, Homo sapiens
aatatgcactctgatttagcag

SEQ ID NO: 7577881 - DNA, 22 bp, Homo sapiens
aatatgatccttaaccttcatg

SEQ ID NO: 7577882 - DNA, 22 bp, Homo sapiens
aatatgatgccaaattgctaca

SEQ ID NO: 7577883 - DNA, 22 bp, Homo sapiens
aatatgcaaataggtgtaatga

SEQ ID NO: 7577884 - DNA, 22 bp, Homo sapiens
aatatgcaaagcgtgttatctg

SEQ ID NO: 7577885 - DNA, 22 bp, Homo sapiens
aatatgcaaagcgtgttatctg

SEQ ID NO: 7577886 - DNA, 22 bp, Homo sapiens
aatatgcaaagcgtgttatctg

SEQ ID NO: 7577887 - DNA, 22 bp, Homo sapiens
agaaaatgtgaacttgtgaatt

SEQ ID NO: 7577888 - DNA, 22 bp, Homo sapiens
agaaaatgtgaacttgtgaatt

SEQ ID NO: 7577889 - DNA, 22 bp, Homo sapiens
agaaaatgtgaacttgtgaatt

SEQ ID NO: 7577890 - DNA, 21 bp, Homo sapiens
agaaaatggcgttttagattt

SEQ ID NO: 7577891 - DNA, 22 bp, Homo sapiens
agaaaatgtgaacttgtgaatt

SEQ ID NO: 7577892 - DNA, 22 bp, Homo sapiens
agaaaatgtgaacttgtgaatt

SEQ ID NO: 7577893 - DNA, 21 bp, Homo sapiens
agaaaatggcgttttagattt

SEQ ID NO: 7577894 - DNA, 21 bp, Homo sapiens
agaaaatggcgttttagattt

SEQ ID NO: 7577895 - DNA, 21 bp, Homo sapiens
agaaaatggcgttttagattt

SEQ ID NO: 7577896 - DNA, 22 bp, Homo sapiens
agaaaattactccagagacaag

SEQ ID NO: 7577897 - DNA, 22 bp, Homo sapiens
agaaaattactccagagacaag

SEQ ID NO: 7577898 - DNA, 22 bp, Homo sapiens
agaaaattactccagagacaag

SEQ ID NO: 7577899 - DNA, 20 bp, Homo sapiens
agaaaatgttttcagctgga

SEQ ID NO: 7577900 - DNA, 20 bp, Homo sapiens
agaaaatgttttcagctgga

SEQ ID NO: 7577901 - DNA, 20 bp, Homo sapiens
agaaaatgttttcagctgga

SEQ ID NO: 7577902 - DNA, 20 bp, Homo sapiens
agaaaatgttttcagctgga

SEQ ID NO: 7577903 - DNA, 20 bp, Homo sapiens
agaaaatgttttcagctgga

SEQ ID NO: 7577904 - DNA, 22 bp, Homo sapiens
agaaaattactccagagacaag

SEQ ID NO: 7577905 - DNA, 22 bp, Homo sapiens
agaaaattactccagagacaag

SEQ ID NO: 7577906 - DNA, 22 bp, Homo sapiens
agaaaattactccagagacaag

SEQ ID NO: 7577907 - DNA, 23 bp, Homo sapiens
agaaaccactgaagagatccagt

SEQ ID NO: 7577908 - DNA, 22 bp, Homo sapiens
agaaaccagacttggcccattt

SEQ ID NO: 7577909 - DNA, 22 bp, Homo sapiens
agaaaccagacttggcccattt

SEQ ID NO: 7577910 - DNA, 23 bp, Homo sapiens
agaaaccactgaagagatccagt

SEQ ID NO: 7577911 - DNA, 23 bp, Homo sapiens
agaaaccactgaagagatccagt

SEQ ID NO: 7577912 - DNA, 23 bp, Homo sapiens
agaaaccactgaagagatccagt

SEQ ID NO: 7577913 - DNA, 22 bp, Homo sapiens
agaaacctccatttattcactc

SEQ ID NO: 7577914 - DNA, 22 bp, Homo sapiens
agaaaccatctttatatatctg

SEQ ID NO: 7577915 - DNA, 22 bp, Homo sapiens
agaaacctcacagcaattctga

SEQ ID NO: 7577916 - DNA, 22 bp, Homo sapiens
agaaaccatctttatatatctg

SEQ ID NO: 7577917 - DNA, 22 bp, Homo sapiens
agaaaccatctttatatatctg

SEQ ID NO: 7577918 - DNA, 22 bp, Homo sapiens
agaaaccatctttatatatctg

SEQ ID NO: 7577919 - DNA, 22 bp, Homo sapiens
agaaaccagggcttaccagtgc

SEQ ID NO: 7577920 - DNA, 22 bp, Homo sapiens
agaaaccagggcttaccagtgc

SEQ ID NO: 7577921 - DNA, 22 bp, Homo sapiens
agaaaccagggcttaccagtgc

SEQ ID NO: 7577922 - DNA, 22 bp, Homo sapiens
agaaaccagggcttaccagtgc

SEQ ID NO: 7577923 - DNA, 22 bp, Homo sapiens
agaaaccagggcttaccagtgc

SEQ ID NO: 7577924 - DNA, 22 bp, Homo sapiens
agaaaccagggcttaccagtgc

SEQ ID NO: 7577925 - DNA, 22 bp, Homo sapiens
agaaaatattcattgagaggct

SEQ ID NO: 7577926 - DNA, 22 bp, Homo sapiens
agaaaatattcattgagaggct

SEQ ID NO: 7577927 - DNA, 22 bp, Homo sapiens
agaaaatattcattgagaggct

SEQ ID NO: 7577928 - DNA, 22 bp, Homo sapiens
agaaaatattcattgagaggct

SEQ ID NO: 7577929 - DNA, 21 bp, Homo sapiens
agaaaatggcgttttagattt

SEQ ID NO: 7577930 - DNA, 21 bp, Homo sapiens
agaaaatggcgttttagattt

SEQ ID NO: 7577931 - DNA, 21 bp, Homo sapiens
agaaaatggcgttttagattt

SEQ ID NO: 7577932 - DNA, 21 bp, Homo sapiens
agaaaatggcgttttagattt

SEQ ID NO: 7577933 - DNA, 21 bp, Homo sapiens
agaaaatggcgttttagattt

SEQ ID NO: 7577934 - DNA, 21 bp, Homo sapiens
agaaaatggcgttttagattt

SEQ ID NO: 7577935 - DNA, 22 bp, Homo sapiens
agaaaatattcattgagaggct

SEQ ID NO: 7577936 - DNA, 22 bp, Homo sapiens
agaaaatattcattgagaggct

SEQ ID NO: 7577937 - DNA, 22 bp, Homo sapiens
agaaaatattcattgagaggct

SEQ ID NO: 7577938 - DNA, 22 bp, Homo sapiens
agaaaatattcattgagaggct

SEQ ID NO: 7577939 - DNA, 22 bp, Homo sapiens
agaaaatattcattgagaggct

SEQ ID NO: 7577940 - DNA, 22 bp, Homo sapiens
agaaaatattcattgagaggct

SEQ ID NO: 7577941 - DNA, 22 bp, Homo sapiens
agaaaatattcattgagaggct

SEQ ID NO: 7577942 - DNA, 22 bp, Homo sapiens
agaaaataatttcttggctggt

SEQ ID NO: 7577943 - DNA, 22 bp, Homo sapiens
agaaaataatttcttggctggt

SEQ ID NO: 7577944 - DNA, 22 bp, Homo sapiens
agaaaataatttcttggctggt

SEQ ID NO: 7577945 - DNA, 22 bp, Homo sapiens
agaaaataatttcttggctggt

SEQ ID NO: 7577946 - DNA, 22 bp, Homo sapiens
agaaaataatttcttggctggt

SEQ ID NO: 7577947 - DNA, 22 bp, Homo sapiens
agaaaataatttcttggctggt

SEQ ID NO: 7577948 - DNA, 22 bp, Homo sapiens
agaaaataatttcttggctggt

SEQ ID NO: 7577949 - DNA, 22 bp, Homo sapiens
agaaaataatttcttggctggt

SEQ ID NO: 7577950 - DNA, 22 bp, Homo sapiens
agaaaactgggaggagagcttc

SEQ ID NO: 7577951 - DNA, 22 bp, Homo sapiens
agaaaactgggaggagagcttc

SEQ ID NO: 7577952 - DNA, 22 bp, Homo sapiens
agaaaactgggaggagagcttc

SEQ ID NO: 7577953 - DNA, 22 bp, Homo sapiens
aatattcatttgcagaagaagt

SEQ ID NO: 7577954 - DNA, 22 bp, Homo sapiens
aatattcatttgcagaagaagt

SEQ ID NO: 7577955 - DNA, 22 bp, Homo sapiens
aatattcatttgcagaagaagt

SEQ ID NO: 7577956 - DNA, 22 bp, Homo sapiens
aatattcatttgcagaagaagt

SEQ ID NO: 7577957 - DNA, 22 bp, Homo sapiens
agaaaactggagcctggggttg

SEQ ID NO: 7577958 - DNA, 22 bp, Homo sapiens
agaaaactggagcctggggttg

SEQ ID NO: 7577959 - DNA, 22 bp, Homo sapiens
agaaaactgggaggagagcttc

SEQ ID NO: 7577960 - DNA, 22 bp, Homo sapiens
agaaaactgggaggagagcttc

SEQ ID NO: 7577961 - DNA, 22 bp, Homo sapiens
aatattcatttgcagaagaagt

SEQ ID NO: 7577962 - DNA, 22 bp, Homo sapiens
acttatgtagtacctcttatgt

SEQ ID NO: 7577963 - DNA, 22 bp, Homo sapiens
acttattagctgtgtgaccttg

SEQ ID NO: 7577964 - DNA, 22 bp, Homo sapiens
acttatcttagttcatttgtat

SEQ ID NO: 7577965 - DNA, 22 bp, Homo sapiens
acttatgaggagaaaatatata

SEQ ID NO: 7577966 - DNA, 22 bp, Homo sapiens
acttatgaggagaaaatatata

SEQ ID NO: 7577967 - DNA, 22 bp, Homo sapiens
acttatttattcattcagctca

SEQ ID NO: 7577968 - DNA, 22 bp, Homo sapiens
acttatctgcaattagtacata

SEQ ID NO: 7577969 - DNA, 22 bp, Homo sapiens
acttatttattcattcagctca

SEQ ID NO: 7577970 - DNA, 22 bp, Homo sapiens
acttattctgagattatgatca

SEQ ID NO: 7577971 - DNA, 22 bp, Homo sapiens
acttatctgcaattagtacata

SEQ ID NO: 7577972 - DNA, 22 bp, Homo sapiens
acttatccatgtctatatgttg

SEQ ID NO: 7577973 - DNA, 22 bp, Homo sapiens
acttatgaatgtcattataatg

SEQ ID NO: 7577974 - DNA, 22 bp, Homo sapiens
acttatctgcaattagtacata

SEQ ID NO: 7577975 - DNA, 22 bp, Homo sapiens
acttatcacacactaaattagg

SEQ ID NO: 7577976 - DNA, 22 bp, Homo sapiens
acttatatttgctttatgcttc

SEQ ID NO: 7577977 - DNA, 22 bp, Homo sapiens
acttatatttgctttatgcttc

SEQ ID NO: 7577978 - DNA, 22 bp, Homo sapiens
acttatatttgctttatgcttc

SEQ ID NO: 7577979 - DNA, 22 bp, Homo sapiens
acttccagctttataattcagt

SEQ ID NO: 7577980 - DNA, 22 bp, Homo sapiens
acttccagctttataattcagt

SEQ ID NO: 7577981 - DNA, 22 bp, Homo sapiens
acttccagctgccctgtgtgct

SEQ ID NO: 7577982 - DNA, 22 bp, Homo sapiens
acttccagctgccctgtgtgct

SEQ ID NO: 7577983 - DNA, 22 bp, Homo sapiens
acttccagctgccctgtgtgct

SEQ ID NO: 7577984 - DNA, 22 bp, Homo sapiens
acttccagctgccctgtgtgct

SEQ ID NO: 7577985 - DNA, 22 bp, Homo sapiens
acttccagctgccctgtgtgct

SEQ ID NO: 7577986 - DNA, 22 bp, Homo sapiens
acttatttcatggatcataatg

SEQ ID NO: 7577987 - DNA, 22 bp, Homo sapiens
acttatttcatggatcataatg

SEQ ID NO: 7577988 - DNA, 22 bp, Homo sapiens
acttatttcatggatcataatg

SEQ ID NO: 7577989 - DNA, 22 bp, Homo sapiens
acttatttcatggatcataatg

SEQ ID NO: 7577990 - DNA, 22 bp, Homo sapiens
acttatttcatggatcataatg

SEQ ID NO: 7577991 - DNA, 22 bp, Homo sapiens
acttccaggaactgccgctaac

SEQ ID NO: 7577992 - DNA, 22 bp, Homo sapiens
acttccaggaggtgtcactgaa

SEQ ID NO: 7577993 - DNA, 22 bp, Homo sapiens
acttccaggaggtgtcactgaa

SEQ ID NO: 7577994 - DNA, 22 bp, Homo sapiens
acttccaggaggtgtcactgaa

SEQ ID NO: 7577995 - DNA, 16 bp, Homo sapiens
acttccaggggagccc

SEQ ID NO: 7577996 - DNA, 16 bp, Homo sapiens
acttccaggggagccc

SEQ ID NO: 7577997 - DNA, 16 bp, Homo sapiens
acttccaggggagccc

SEQ ID NO: 7577998 - DNA, 22 bp, Homo sapiens
acttccagggtagaggggaaga

SEQ ID NO: 7577999 - DNA, 22 bp, Homo sapiens
acttccagggtagaggggaaga

SEQ ID NO: 7578000 - DNA, 22 bp, Homo sapiens
acttccaggttccacccaagac

SEQ ID NO: 7578001 - DNA, 22 bp, Homo sapiens
acttccagtgtctgctgctagc

SEQ ID NO: 7578002 - DNA, 22 bp, Homo sapiens
acttccagtgtctgctgctagc

SEQ ID NO: 7578003 - DNA, 22 bp, Homo sapiens
aatagaacaataattgtaaact

SEQ ID NO: 7578004 - DNA, 22 bp, Homo sapiens
aatagaacaataattgtaaact

SEQ ID NO: 7578005 - DNA, 22 bp, Homo sapiens
actgttgaagtgccagcttgat

SEQ ID NO: 7578006 - DNA, 22 bp, Homo sapiens
aatagaaaggaggggctcttgt

SEQ ID NO: 7578007 - DNA, 22 bp, Homo sapiens
aatagaacaataattgtaaact

SEQ ID NO: 7578008 - DNA, 22 bp, Homo sapiens
aatagaacaataattgtaaact

SEQ ID NO: 7578009 - DNA, 22 bp, Homo sapiens
actgttggcttctggtagtgac

SEQ ID NO: 7578010 - DNA, 20 bp, Homo sapiens
actgttggaagtggagaatg

SEQ ID NO: 7578011 - DNA, 22 bp, Homo sapiens
actgttggcttctggtagtgac

SEQ ID NO: 7578012 - DNA, 22 bp, Homo sapiens
actgttggtcagggatattgtg

SEQ ID NO: 7578013 - DNA, 22 bp, Homo sapiens
actgttggagtcttgagtttct

SEQ ID NO: 7578014 - DNA, 22 bp, Homo sapiens
acttagaattagtgtagaatga

SEQ ID NO: 7578015 - DNA, 22 bp, Homo sapiens
acttagaattagtgtagaatga

SEQ ID NO: 7578016 - DNA, 22 bp, Homo sapiens
acttagcaatttgattaaaaga

SEQ ID NO: 7578017 - DNA, 22 bp, Homo sapiens
acttagcacgaacatttacttt

SEQ ID NO: 7578018 - DNA, 22 bp, Homo sapiens
acttagcacagagccaggtagg

SEQ ID NO: 7578019 - DNA, 22 bp, Homo sapiens
acttagcacctatggcattttt

SEQ ID NO: 7578020 - DNA, 22 bp, Homo sapiens
acttagcagagtgagttgacta

SEQ ID NO: 7578021 - DNA, 22 bp, Homo sapiens
acttagcagagttgaatgtact

SEQ ID NO: 7578022 - DNA, 22 bp, Homo sapiens
acttataggccaagtagactgt

SEQ ID NO: 7578023 - DNA, 22 bp, Homo sapiens
acttataggccaagtagactgt

SEQ ID NO: 7578024 - DNA, 22 bp, Homo sapiens
acttatagtttctctgactcat

SEQ ID NO: 7578025 - DNA, 22 bp, Homo sapiens
acttatagaataatgtttttag

SEQ ID NO: 7578026 - DNA, 22 bp, Homo sapiens
acttatagagtgttctgattgc

SEQ ID NO: 7578027 - DNA, 22 bp, Homo sapiens
acttatagccagaattaattat

SEQ ID NO: 7578028 - DNA, 22 bp, Homo sapiens
acttatagccagaattaattat

SEQ ID NO: 7578029 - DNA, 22 bp, Homo sapiens
acttatactaaagtattatttg

SEQ ID NO: 7578030 - DNA, 20 bp, Homo sapiens
acttagtttttctcacagga

SEQ ID NO: 7578031 - DNA, 22 bp, Homo sapiens
acttagtggctatgtgacctta

SEQ ID NO: 7578032 - DNA, 20 bp, Homo sapiens
acttagtgtagggttcctag

SEQ ID NO: 7578033 - DNA, 22 bp, Homo sapiens
acttataagagtgctatgggga

SEQ ID NO: 7578034 - DNA, 22 bp, Homo sapiens
acttataagagtgctatgggga

SEQ ID NO: 7578035 - DNA, 22 bp, Homo sapiens
acttagcagtttagaatatgtc

SEQ ID NO: 7578036 - DNA, 22 bp, Homo sapiens
acttagcattatgtaattacta

SEQ ID NO: 7578037 - DNA, 22 bp, Homo sapiens
acttagtatttttcagctttga

SEQ ID NO: 7578038 - DNA, 22 bp, Homo sapiens
acttagctgtgtgatttccatt

SEQ ID NO: 7578039 - DNA, 22 bp, Homo sapiens
acttagtgccctggcccttaca

SEQ ID NO: 7578040 - DNA, 22 bp, Homo sapiens
acttagtgccctggcccttaca

SEQ ID NO: 7578041 - DNA, 22 bp, Homo sapiens
aatatcttctaaggatagaact

SEQ ID NO: 7578042 - DNA, 22 bp, Homo sapiens
aatatcttctaaggatagaact

SEQ ID NO: 7578043 - DNA, 22 bp, Homo sapiens
aatatcttctaaggatagaact

SEQ ID NO: 7578044 - DNA, 22 bp, Homo sapiens
aatatgaattattgttacaagt

SEQ ID NO: 7578045 - DNA, 22 bp, Homo sapiens
aatatgaattattgttacaagt

SEQ ID NO: 7578046 - DNA, 22 bp, Homo sapiens
aatatcttggcccaactccaga

SEQ ID NO: 7578047 - DNA, 22 bp, Homo sapiens
aatatgaattattgttacaagt

SEQ ID NO: 7578048 - DNA, 22 bp, Homo sapiens
aatatgacatagaattgagatg

SEQ ID NO: 7578049 - DNA, 22 bp, Homo sapiens
aatatgagtttgcctttcctgc

SEQ ID NO: 7578050 - DNA, 22 bp, Homo sapiens
aatatgagtttgcctttcctgc

SEQ ID NO: 7578051 - DNA, 22 bp, Homo sapiens
aatatgaattattgttacaagt

SEQ ID NO: 7578052 - DNA, 22 bp, Homo sapiens
aatatgaattattgttacaagt

SEQ ID NO: 7578053 - DNA, 22 bp, Homo sapiens
aatatgaattattgttacaagt

SEQ ID NO: 7578054 - DNA, 22 bp, Homo sapiens
aatatgaattattgttacaagt

SEQ ID NO: 7578055 - DNA, 22 bp, Homo sapiens
aatatgaattattgttacaagt

SEQ ID NO: 7578056 - DNA, 22 bp, Homo sapiens
aatatcttctaaggatagaact

SEQ ID NO: 7578057 - DNA, 22 bp, Homo sapiens
aatatcttctaaggatagaact

SEQ ID NO: 7578058 - DNA, 22 bp, Homo sapiens
aatatcttctaaggatagaact

SEQ ID NO: 7578059 - DNA, 22 bp, Homo sapiens
aatatcttctaaggatagaact

SEQ ID NO: 7578060 - DNA, 22 bp, Homo sapiens
aatatcagtatattgtatcagt

SEQ ID NO: 7578061 - DNA, 22 bp, Homo sapiens
aatatcagctctgtcacttact

SEQ ID NO: 7578062 - DNA, 22 bp, Homo sapiens
aatatcaggatgcaaagctgtg

SEQ ID NO: 7578063 - DNA, 22 bp, Homo sapiens
aatatcagctctgtcacttact

SEQ ID NO: 7578064 - DNA, 19 bp, Homo sapiens
acttcctgcccgctccttt

SEQ ID NO: 7578065 - DNA, 22 bp, Homo sapiens
aatatcagctctgtcacttact

SEQ ID NO: 7578066 - DNA, 22 bp, Homo sapiens
aatatcagctctgtcacttact

SEQ ID NO: 7578067 - DNA, 22 bp, Homo sapiens
aatatcagcacttttgtggtat

SEQ ID NO: 7578068 - DNA, 17 bp, Homo sapiens
acttcccacccctccag

SEQ ID NO: 7578069 - DNA, 22 bp, Homo sapiens
acttcccacaccctgttttctc

SEQ ID NO: 7578070 - DNA, 17 bp, Homo sapiens
acttcccacccctccag

SEQ ID NO: 7578071 - DNA, 17 bp, Homo sapiens
acttcccacccctccag

SEQ ID NO: 7578072 - DNA, 17 bp, Homo sapiens
acttcccacccctccag

SEQ ID NO: 7578073 - DNA, 22 bp, Homo sapiens
acttcccactgcagtgactgag

SEQ ID NO: 7578074 - DNA, 22 bp, Homo sapiens
acttcccactgcagtgactgag

SEQ ID NO: 7578075 - DNA, 22 bp, Homo sapiens
acttcccactgcagtgactgag

SEQ ID NO: 7578076 - DNA, 22 bp, Homo sapiens
acttcccactgcagtgactgag

SEQ ID NO: 7578077 - DNA, 18 bp, Homo sapiens
acttcccagatgagggga

SEQ ID NO: 7578078 - DNA, 22 bp, Homo sapiens
acttcccacaccctgttttctc

SEQ ID NO: 7578079 - DNA, 22 bp, Homo sapiens
acttcccacaccctgttttctc

SEQ ID NO: 7578080 - DNA, 22 bp, Homo sapiens
acttcccacaccctgttttctc

SEQ ID NO: 7578081 - DNA, 22 bp, Homo sapiens
acttcccaacgtgggcctccca

SEQ ID NO: 7578082 - DNA, 22 bp, Homo sapiens
acttcccaacgtgggcctccca

SEQ ID NO: 7578083 - DNA, 22 bp, Homo sapiens
acttcccaacacttttgagatg

SEQ ID NO: 7578084 - DNA, 22 bp, Homo sapiens
acttcccaacgtgggcctccca

SEQ ID NO: 7578085 - DNA, 22 bp, Homo sapiens
acttcccaacgtgggcctccca

SEQ ID NO: 7578086 - DNA, 22 bp, Homo sapiens
acttcccaacgtgggcctccca

SEQ ID NO: 7578087 - DNA, 22 bp, Homo sapiens
acttcccaacacttttgagatg

SEQ ID NO: 7578088 - DNA, 22 bp, Homo sapiens
acttccagttttaattaaattg

SEQ ID NO: 7578089 - DNA, 23 bp, Homo sapiens
acttccagttataggaactcttc

SEQ ID NO: 7578090 - DNA, 23 bp, Homo sapiens
acttccagttgcttcagcatatg

SEQ ID NO: 7578091 - DNA, 23 bp, Homo sapiens
acttccagttataggaactcttc

SEQ ID NO: 7578092 - DNA, 23 bp, Homo sapiens
acttccagttataggaactcttc

SEQ ID NO: 7578093 - DNA, 22 bp, Homo sapiens
acttccagtgtctgctgctagc

SEQ ID NO: 7578094 - DNA, 23 bp, Homo sapiens
acttccagttataggaactcttc

SEQ ID NO: 7578095 - DNA, 23 bp, Homo sapiens
acttccagttataggaactcttc

SEQ ID NO: 7578096 - DNA, 22 bp, Homo sapiens
acttcccatttctctgctttag

SEQ ID NO: 7578097 - DNA, 22 bp, Homo sapiens
acttcccaggtggtgtggagtt

SEQ ID NO: 7578098 - DNA, 22 bp, Homo sapiens
acttcccatttctctgctttag

SEQ ID NO: 7578099 - DNA, 22 bp, Homo sapiens
acttcccatttctctgctttag

SEQ ID NO: 7578100 - DNA, 22 bp, Homo sapiens
acttcccatttctctgctttag

SEQ ID NO: 7578101 - DNA, 22 bp, Homo sapiens
acttcccatttctctgctttag

SEQ ID NO: 7578102 - DNA, 22 bp, Homo sapiens
acttcccaggtggtgtggagtt

SEQ ID NO: 7578103 - DNA, 22 bp, Homo sapiens
acttcccaggtggtgtggagtt

SEQ ID NO: 7578104 - DNA, 22 bp, Homo sapiens
acttcccaggtggtgtggagtt

SEQ ID NO: 7578105 - DNA, 21 bp, Homo sapiens
acttcccaggacctactcaga

SEQ ID NO: 7578106 - DNA, 21 bp, Homo sapiens
acttcccaggacctactcaga

SEQ ID NO: 7578107 - DNA, 18 bp, Homo sapiens
acttcccagatgagggga

SEQ ID NO: 7578108 - DNA, 21 bp, Homo sapiens
acttcccaggacctactcaga

SEQ ID NO: 7578109 - DNA, 21 bp, Homo sapiens
acttcccaggacctactcaga

SEQ ID NO: 7578110 - DNA, 21 bp, Homo sapiens
acttcccaggacctactcaga

SEQ ID NO: 7578111 - DNA, 22 bp, Homo sapiens
acttccctgtgggcaggtagtg

SEQ ID NO: 7578112 - DNA, 22 bp, Homo sapiens
acttccctgtgggcaggtagtg

SEQ ID NO: 7578113 - DNA, 22 bp, Homo sapiens
acttccccgaagctggaaatag

SEQ ID NO: 7578114 - DNA, 22 bp, Homo sapiens
acttccctgtgggcaggtagtg

SEQ ID NO: 7578115 - DNA, 22 bp, Homo sapiens
acttcctgaatggggctaatta

SEQ ID NO: 7578116 - DNA, 22 bp, Homo sapiens
acttcccttgctttacgatgtt

SEQ ID NO: 7578117 - DNA, 22 bp, Homo sapiens
acttcctgacttctgggttgga

SEQ ID NO: 7578118 - DNA, 22 bp, Homo sapiens
acttcctgaatggggctaatta

SEQ ID NO: 7578119 - DNA, 22 bp, Homo sapiens
aatactgctgctgctgaaatca

SEQ ID NO: 7578120 - DNA, 17 bp, Homo sapiens
aatactgcttatccagg

SEQ ID NO: 7578121 - DNA, 17 bp, Homo sapiens
aatactgcttatccagg

SEQ ID NO: 7578122 - DNA, 22 bp, Homo sapiens
aatactggactctcactattta

SEQ ID NO: 7578123 - DNA, 22 bp, Homo sapiens
aatactggctgtcaaagatgga

SEQ ID NO: 7578124 - DNA, 22 bp, Homo sapiens
aatactgtctttcacagatatt

SEQ ID NO: 7578125 - DNA, 22 bp, Homo sapiens
aatactgtctttcacagatatt

SEQ ID NO: 7578126 - DNA, 22 bp, Homo sapiens
aatactggctgtcaaagatgga

SEQ ID NO: 7578127 - DNA, 22 bp, Homo sapiens
aatactgtaaatggagcagcca

SEQ ID NO: 7578128 - DNA, 22 bp, Homo sapiens
aatactgtctttcacagatatt

SEQ ID NO: 7578129 - DNA, 22 bp, Homo sapiens
aatactgtctttcacagatatt

SEQ ID NO: 7578130 - DNA, 22 bp, Homo sapiens
aatactgtctttcacagatatt

SEQ ID NO: 7578131 - DNA, 22 bp, Homo sapiens
actgtggggtgaggcccaagaa

SEQ ID NO: 7578132 - DNA, 22 bp, Homo sapiens
actgtgggggagccagtcccat

SEQ ID NO: 7578133 - DNA, 23 bp, Homo sapiens
actgtgggcaccacagagagtgt

SEQ ID NO: 7578134 - DNA, 22 bp, Homo sapiens
actgtgggagcttatcatttca

SEQ ID NO: 7578135 - DNA, 22 bp, Homo sapiens
actgtgggagcgcagtggcagc

SEQ ID NO: 7578136 - DNA, 22 bp, Homo sapiens
actgtgggagcgcagtggcagc

SEQ ID NO: 7578137 - DNA, 22 bp, Homo sapiens
aatacttgggctgagatttttg

SEQ ID NO: 7578138 - DNA, 22 bp, Homo sapiens
aatacttgtcagatgaataaga

SEQ ID NO: 7578139 - DNA, 22 bp, Homo sapiens
aatacttgtcagatgaataaga

SEQ ID NO: 7578140 - DNA, 22 bp, Homo sapiens
aatacttgtcagatgaataaga

SEQ ID NO: 7578141 - DNA, 22 bp, Homo sapiens
aatacttgtgaattcaaagtct

SEQ ID NO: 7578142 - DNA, 22 bp, Homo sapiens
aatactttcctatataaggtgc

SEQ ID NO: 7578143 - DNA, 22 bp, Homo sapiens
aatactttcctatataaggtgc

SEQ ID NO: 7578144 - DNA, 22 bp, Homo sapiens
aatactttcctatataaggtgc

SEQ ID NO: 7578145 - DNA, 22 bp, Homo sapiens
aatactttcctatataaggtgc

SEQ ID NO: 7578146 - DNA, 17 bp, Homo sapiens
aatacttccaactagtg

SEQ ID NO: 7578147 - DNA, 22 bp, Homo sapiens
aatacttgaatttcatgtcagg

SEQ ID NO: 7578148 - DNA, 22 bp, Homo sapiens
aatacttgggctgagatttttg

SEQ ID NO: 7578149 - DNA, 22 bp, Homo sapiens
aatacttatgtgacctcatttt

SEQ ID NO: 7578150 - DNA, 17 bp, Homo sapiens
aatacttccaactagtg

SEQ ID NO: 7578151 - DNA, 17 bp, Homo sapiens
aatacttccaactagtg

SEQ ID NO: 7578152 - DNA, 22 bp, Homo sapiens
aatacttatgtgacctcatttt

SEQ ID NO: 7578153 - DNA, 22 bp, Homo sapiens
aatacttatgtgacctcatttt

SEQ ID NO: 7578154 - DNA, 22 bp, Homo sapiens
aatagaaaggaggggctcttgt

SEQ ID NO: 7578155 - DNA, 22 bp, Homo sapiens
aatagaaaggaggggctcttgt

SEQ ID NO: 7578156 - DNA, 22 bp, Homo sapiens
aatacttttgaactgaaaggca

SEQ ID NO: 7578157 - DNA, 22 bp, Homo sapiens
aatagaaaggaggggctcttgt

SEQ ID NO: 7578158 - DNA, 22 bp, Homo sapiens
aatacttttgaactgaaaggca

SEQ ID NO: 7578159 - DNA, 22 bp, Homo sapiens
aatacttttgaactgaaaggca

SEQ ID NO: 7578160 - DNA, 22 bp, Homo sapiens
aatactttgccaagttcgaaga

SEQ ID NO: 7578161 - DNA, 22 bp, Homo sapiens
aatactttgccaagttcgaaga

SEQ ID NO: 7578162 - DNA, 22 bp, Homo sapiens
aatacttttgaactgaaaggca

SEQ ID NO: 7578163 - DNA, 22 bp, Homo sapiens
aatacttttgaactgaaaggca

SEQ ID NO: 7578164 - DNA, 22 bp, Homo sapiens
aatactttgccaagttcgaaga

SEQ ID NO: 7578165 - DNA, 22 bp, Homo sapiens
aatactttgccaagttcgaaga

SEQ ID NO: 7578166 - DNA, 22 bp, Homo sapiens
aatactttgccaagttcgaaga

SEQ ID NO: 7578167 - DNA, 22 bp, Homo sapiens
aatactttgccaagttcgaaga

SEQ ID NO: 7578168 - DNA, 22 bp, Homo sapiens
aatactttgccaagttcgaaga

SEQ ID NO: 7578169 - DNA, 22 bp, Homo sapiens
aatactttgccaagttcgaaga

SEQ ID NO: 7578170 - DNA, 22 bp, Homo sapiens
aatactttcctatataaggtgc

SEQ ID NO: 7578171 - DNA, 22 bp, Homo sapiens
aatactttcctatataaggtgc

SEQ ID NO: 7578172 - DNA, 22 bp, Homo sapiens
aatactttcctatataaggtgc

SEQ ID NO: 7578173 - DNA, 22 bp, Homo sapiens
aatactttcctatataaggtgc

SEQ ID NO: 7578174 - DNA, 22 bp, Homo sapiens
aatactttcctatataaggtgc

SEQ ID NO: 7578175 - DNA, 22 bp, Homo sapiens
aataactggcacatatcacata

SEQ ID NO: 7578176 - DNA, 22 bp, Homo sapiens
aataactggcacatatcacata

SEQ ID NO: 7578177 - DNA, 22 bp, Homo sapiens
aataactggcacatatcacata

SEQ ID NO: 7578178 - DNA, 22 bp, Homo sapiens
aataactggcacatatcacata

SEQ ID NO: 7578179 - DNA, 22 bp, Homo sapiens
aataactggcacatatcacata

SEQ ID NO: 7578180 - DNA, 22 bp, Homo sapiens
aataactggcacatatcacata

SEQ ID NO: 7578181 - DNA, 22 bp, Homo sapiens
aataactggcacatatcacata

SEQ ID NO: 7578182 - DNA, 22 bp, Homo sapiens
aataactggcacatatcacata

SEQ ID NO: 7578183 - DNA, 22 bp, Homo sapiens
aataactgcacttgttgaatgc

SEQ ID NO: 7578184 - DNA, 22 bp, Homo sapiens
actgtctgcaaaactcatactc

SEQ ID NO: 7578185 - DNA, 22 bp, Homo sapiens
aataactggcacatatcacata

SEQ ID NO: 7578186 - DNA, 22 bp, Homo sapiens
actgtctgcaaaactcatactc

SEQ ID NO: 7578187 - DNA, 22 bp, Homo sapiens
aataacttaagaaatttcccca

SEQ ID NO: 7578188 - DNA, 22 bp, Homo sapiens
aataacttaagaaatttcccca

SEQ ID NO: 7578189 - DNA, 22 bp, Homo sapiens
actgtgctatctactgaattat

SEQ ID NO: 7578190 - DNA, 22 bp, Homo sapiens
actgtctgctggcccctggtta

SEQ ID NO: 7578191 - DNA, 22 bp, Homo sapiens
actgtgctatctactgaattat

SEQ ID NO: 7578192 - DNA, 19 bp, Homo sapiens
actgtgctcgggaaccact

SEQ ID NO: 7578193 - DNA, 22 bp, Homo sapiens
actgtgctgctctccgcagccc

SEQ ID NO: 7578194 - DNA, 22 bp, Homo sapiens
actgtgctgctctccgcagccc

SEQ ID NO: 7578195 - DNA, 22 bp, Homo sapiens
actgtctgcacccgaggaggcc

SEQ ID NO: 7578196 - DNA, 22 bp, Homo sapiens
actgtctgcacccgaggaggcc

SEQ ID NO: 7578197 - DNA, 18 bp, Homo sapiens
actgtctgccagattggg

SEQ ID NO: 7578198 - DNA, 18 bp, Homo sapiens
actgtctgccagattggg

SEQ ID NO: 7578199 - DNA, 22 bp, Homo sapiens
actgtctgccctgagatgccag

SEQ ID NO: 7578200 - DNA, 18 bp, Homo sapiens
actgtctgccagattggg

SEQ ID NO: 7578201 - DNA, 22 bp, Homo sapiens
actgtctgccctgagatgccag

SEQ ID NO: 7578202 - DNA, 22 bp, Homo sapiens
actgtctgccctgagatgccag

SEQ ID NO: 7578203 - DNA, 22 bp, Homo sapiens
aataactgcacttgttgaatgc

SEQ ID NO: 7578204 - DNA, 22 bp, Homo sapiens
aataacctttatttcaaagtgt

SEQ ID NO: 7578205 - DNA, 22 bp, Homo sapiens
aataactgcacttgttgaatgc

SEQ ID NO: 7578206 - DNA, 21 bp, Homo sapiens
aataaccactaatatagtggc

SEQ ID NO: 7578207 - DNA, 22 bp, Homo sapiens
aataacagggttgatttgcaat

SEQ ID NO: 7578208 - DNA, 22 bp, Homo sapiens
aataacagtgccatgaaattga

SEQ ID NO: 7578209 - DNA, 22 bp, Homo sapiens
aataacagtgccatgaaattga

SEQ ID NO: 7578210 - DNA, 22 bp, Homo sapiens
aataacagtgccatgaaattga

SEQ ID NO: 7578211 - DNA, 22 bp, Homo sapiens
aataacagtgccatgaaattga

SEQ ID NO: 7578212 - DNA, 22 bp, Homo sapiens
aataacagtgccatgaaattga

SEQ ID NO: 7578213 - DNA, 22 bp, Homo sapiens
aataacagtgccatgaaattga

SEQ ID NO: 7578214 - DNA, 21 bp, Homo sapiens
aataaccactaatatagtggc

SEQ ID NO: 7578215 - DNA, 22 bp, Homo sapiens
aataacagattttcaagctgtg

SEQ ID NO: 7578216 - DNA, 22 bp, Homo sapiens
aataacaggctcatcagatgct

SEQ ID NO: 7578217 - DNA, 22 bp, Homo sapiens
aataacaggctcatcagatgct

SEQ ID NO: 7578218 - DNA, 22 bp, Homo sapiens
aataacagggttgatttgcaat

SEQ ID NO: 7578219 - DNA, 22 bp, Homo sapiens
aataacagggttgatttgcaat

SEQ ID NO: 7578220 - DNA, 22 bp, Homo sapiens
aataacagggttgatttgcaat

SEQ ID NO: 7578221 - DNA, 22 bp, Homo sapiens
aataacaggctcatcagatgct

SEQ ID NO: 7578222 - DNA, 22 bp, Homo sapiens
aataacaggctcatcagatgct

SEQ ID NO: 7578223 - DNA, 22 bp, Homo sapiens
aataacagggttgatttgcaat

SEQ ID NO: 7578224 - DNA, 22 bp, Homo sapiens
aataacagggttgatttgcaat

SEQ ID NO: 7578225 - DNA, 22 bp, Homo sapiens
aataacagggttgatttgcaat

SEQ ID NO: 7578226 - DNA, 22 bp, Homo sapiens
aataacagggttgatttgcaat

SEQ ID NO: 7578227 - DNA, 22 bp, Homo sapiens
actgtggctcatcaggctggtg

SEQ ID NO: 7578228 - DNA, 22 bp, Homo sapiens
actgtggctcatcaggctggtg

SEQ ID NO: 7578229 - DNA, 22 bp, Homo sapiens
actgtggctcatcaggctggtg

SEQ ID NO: 7578230 - DNA, 18 bp, Homo sapiens
actgtggctcagagttgc

SEQ ID NO: 7578231 - DNA, 22 bp, Homo sapiens
actgtggctcagggaatgcatg

SEQ ID NO: 7578232 - DNA, 22 bp, Homo sapiens
actgtggctcatcaggctggtg

SEQ ID NO: 7578233 - DNA, 22 bp, Homo sapiens
actgtgggaaccactgaatcag

SEQ ID NO: 7578234 - DNA, 22 bp, Homo sapiens
actgtggcctgctgtatgggct

SEQ ID NO: 7578235 - DNA, 22 bp, Homo sapiens
actgtggccggaacagtgggac

SEQ ID NO: 7578236 - DNA, 22 bp, Homo sapiens
actgtggccaaagcctctggga

SEQ ID NO: 7578237 - DNA, 22 bp, Homo sapiens
actgtggccaaagcctctggga

SEQ ID NO: 7578238 - DNA, 22 bp, Homo sapiens
actgtggccggaacagtgggac

SEQ ID NO: 7578239 - DNA, 22 bp, Homo sapiens
actgtggcctgctgtatgggct

SEQ ID NO: 7578240 - DNA, 22 bp, Homo sapiens
actgtggccttgtgggttcagg

SEQ ID NO: 7578241 - DNA, 22 bp, Homo sapiens
actgtggcgtcaggaagaaatt

SEQ ID NO: 7578242 - DNA, 22 bp, Homo sapiens
actgtgcttgccaaaccattga

SEQ ID NO: 7578243 - DNA, 22 bp, Homo sapiens
actgtgctggcaatgactcagg

SEQ ID NO: 7578244 - DNA, 22 bp, Homo sapiens
actgtgctggcaatgactcagg

SEQ ID NO: 7578245 - DNA, 22 bp, Homo sapiens
actgtgctggcaatgactcagg

SEQ ID NO: 7578246 - DNA, 22 bp, Homo sapiens
actgtgctggagccctctggag

SEQ ID NO: 7578247 - DNA, 22 bp, Homo sapiens
actgtgctgctctccgcagccc

SEQ ID NO: 7578248 - DNA, 22 bp, Homo sapiens
actgtggataagtcagagatgt

SEQ ID NO: 7578249 - DNA, 22 bp, Homo sapiens
actgtgcttgccaaaccattga

SEQ ID NO: 7578250 - DNA, 22 bp, Homo sapiens
actgtggccaaagcctctggga

SEQ ID NO: 7578251 - DNA, 22 bp, Homo sapiens
actgtggcactaggcaccttac

SEQ ID NO: 7578252 - DNA, 22 bp, Homo sapiens
actgtggcaaagaagcaggctc

SEQ ID NO: 7578253 - DNA, 22 bp, Homo sapiens
actgtggcaaagaagcaggctc

SEQ ID NO: 7578254 - DNA, 22 bp, Homo sapiens
actgtggcaaagaagcaggctc

SEQ ID NO: 7578255 - DNA, 22 bp, Homo sapiens
actgtggatgccaaaggggagg

SEQ ID NO: 7578256 - DNA, 22 bp, Homo sapiens
actgtggatgccaaaggggagg

SEQ ID NO: 7578257 - DNA, 22 bp, Homo sapiens
actgtggcaaaagaacattgga

SEQ ID NO: 7578258 - DNA, 22 bp, Homo sapiens
actgtggataagtcagagatgt

SEQ ID NO: 7578259 - DNA, 22 bp, Homo sapiens
actgtggataagtcagagatgt

SEQ ID NO: 7578260 - DNA, 22 bp, Homo sapiens
actgtggatcaaagacttgggg

SEQ ID NO: 7578261 - DNA, 22 bp, Homo sapiens
actgagaagctcgcagtgatgc

SEQ ID NO: 7578262 - DNA, 22 bp, Homo sapiens
actgagaagctcgcagtgatgc

SEQ ID NO: 7578263 - DNA, 22 bp, Homo sapiens
actgagaagattctcactctta

SEQ ID NO: 7578264 - DNA, 22 bp, Homo sapiens
actgagaagattctcactctta

SEQ ID NO: 7578265 - DNA, 22 bp, Homo sapiens
actgagaagattctcactctta

SEQ ID NO: 7578266 - DNA, 22 bp, Homo sapiens
actgagaagctcgcagtgatgc

SEQ ID NO: 7578267 - DNA, 22 bp, Homo sapiens
actgagaagctcgcagtgatgc

SEQ ID NO: 7578268 - DNA, 22 bp, Homo sapiens
actgagaactcaagagaaaagg

SEQ ID NO: 7578269 - DNA, 22 bp, Homo sapiens
actgagaacttgccaaggactg

SEQ ID NO: 7578270 - DNA, 22 bp, Homo sapiens
actgagaacttgccaaggactg

SEQ ID NO: 7578271 - DNA, 22 bp, Homo sapiens
actgagaactcaagagaaaagg

SEQ ID NO: 7578272 - DNA, 22 bp, Homo sapiens
actgagaagattctcactctta

SEQ ID NO: 7578273 - DNA, 22 bp, Homo sapiens
actgagaacttggggacagagg

SEQ ID NO: 7578274 - DNA, 22 bp, Homo sapiens
actgagaagattctcactctta

SEQ ID NO: 7578275 - DNA, 22 bp, Homo sapiens
actgagaagattctcactctta

SEQ ID NO: 7578276 - DNA, 22 bp, Homo sapiens
actgagaacttggggacagagg

SEQ ID NO: 7578277 - DNA, 22 bp, Homo sapiens
actgagaacttgccaaggactg

SEQ ID NO: 7578278 - DNA, 22 bp, Homo sapiens
actgagaacttggggacagagg

SEQ ID NO: 7578279 - DNA, 22 bp, Homo sapiens
aataaaatggtcagttttctca

SEQ ID NO: 7578280 - DNA, 22 bp, Homo sapiens
aataaaatggtcagttttctca

SEQ ID NO: 7578281 - DNA, 22 bp, Homo sapiens
aataaaatggtcagttttctca

SEQ ID NO: 7578282 - DNA, 22 bp, Homo sapiens
aataaaatggtcagttttctca

SEQ ID NO: 7578283 - DNA, 22 bp, Homo sapiens
aataaaatggtcagttttctca

SEQ ID NO: 7578284 - DNA, 22 bp, Homo sapiens
aataaaatggtcagttttctca

SEQ ID NO: 7578285 - DNA, 22 bp, Homo sapiens
aataaaatggtcagttttctca

SEQ ID NO: 7578286 - DNA, 22 bp, Homo sapiens
aataaaatggtcagttttctca

SEQ ID NO: 7578287 - DNA, 22 bp, Homo sapiens
aataaagaatggatgagatcgt

SEQ ID NO: 7578288 - DNA, 22 bp, Homo sapiens
aataaacttccactgtgttttt

SEQ ID NO: 7578289 - DNA, 22 bp, Homo sapiens
aataaacttccactgtgttttt

SEQ ID NO: 7578290 - DNA, 20 bp, Homo sapiens
actgagaccaataagtagaa

SEQ ID NO: 7578291 - DNA, 22 bp, Homo sapiens
actgagacaactgtgtttctaa

SEQ ID NO: 7578292 - DNA, 22 bp, Homo sapiens
actgagaatacaatgttgcagg

SEQ ID NO: 7578293 - DNA, 22 bp, Homo sapiens
actgagactgaatctgaatgat

SEQ ID NO: 7578294 - DNA, 19 bp, Homo sapiens
actgagaccacagacaagt

SEQ ID NO: 7578295 - DNA, 22 bp, Homo sapiens
actgagactgcccctgtaacaa

SEQ ID NO: 7578296 - DNA, 22 bp, Homo sapiens
actgagactttgttgagttctt

SEQ ID NO: 7578297 - DNA, 21 bp, Homo sapiens
aagttttatgttgccatttgt

SEQ ID NO: 7578298 - DNA, 21 bp, Homo sapiens
aagttttatgttgccatttgt

SEQ ID NO: 7578299 - DNA, 22 bp, Homo sapiens
aagttttatgggaagatgtgca

SEQ ID NO: 7578300 - DNA, 22 bp, Homo sapiens
aagttttatgggaagatgtgca

SEQ ID NO: 7578301 - DNA, 22 bp, Homo sapiens
aagttttatgggaagatgtgca

SEQ ID NO: 7578302 - DNA, 22 bp, Homo sapiens
aagttttattggaacatagcca

SEQ ID NO: 7578303 - DNA, 22 bp, Homo sapiens
aagttttattggaacatagcca

SEQ ID NO: 7578304 - DNA, 21 bp, Homo sapiens
aagttttatgttgccatttgt

SEQ ID NO: 7578305 - DNA, 22 bp, Homo sapiens
aagttttattggaacatagcca

SEQ ID NO: 7578306 - DNA, 22 bp, Homo sapiens
aagttttattggaacatagcca

SEQ ID NO: 7578307 - DNA, 22 bp, Homo sapiens
aagttttattggaacatagcca

SEQ ID NO: 7578308 - DNA, 22 bp, Homo sapiens
aagttttattggctatagcact

SEQ ID NO: 7578309 - DNA, 22 bp, Homo sapiens
aagttttattggctatagcact

SEQ ID NO: 7578310 - DNA, 22 bp, Homo sapiens
aagttttattggctatagcact

SEQ ID NO: 7578311 - DNA, 22 bp, Homo sapiens
actgacactgactaagacagca

SEQ ID NO: 7578312 - DNA, 22 bp, Homo sapiens
actgacactgactaagacagca

SEQ ID NO: 7578313 - DNA, 22 bp, Homo sapiens
aagttttattggaacatagcca

SEQ ID NO: 7578314 - DNA, 22 bp, Homo sapiens
aagttttattggctatagcact

SEQ ID NO: 7578315 - DNA, 22 bp, Homo sapiens
aagttttattggctatagcact

SEQ ID NO: 7578316 - DNA, 22 bp, Homo sapiens
aagttttattggctatagcact

SEQ ID NO: 7578317 - DNA, 22 bp, Homo sapiens
aagttttattggctatagcact

SEQ ID NO: 7578318 - DNA, 22 bp, Homo sapiens
aagttttattggctatagcact

SEQ ID NO: 7578319 - DNA, 22 bp, Homo sapiens
aagttttattggctatagcact

SEQ ID NO: 7578320 - DNA, 22 bp, Homo sapiens
actgactcttgttaacttcagc

SEQ ID NO: 7578321 - DNA, 21 bp, Homo sapiens
actgaccacttctgcctgtct

SEQ ID NO: 7578322 - DNA, 20 bp, Homo sapiens
actgacagggaactaaggct

SEQ ID NO: 7578323 - DNA, 22 bp, Homo sapiens
actgaccttctcagctaactca

SEQ ID NO: 7578324 - DNA, 22 bp, Homo sapiens
actgagaaagaccacatggaga

SEQ ID NO: 7578325 - DNA, 22 bp, Homo sapiens
actgagaaagaccacatggaga

SEQ ID NO: 7578326 - DNA, 22 bp, Homo sapiens
actgagaaagaccacatggaga

SEQ ID NO: 7578327 - DNA, 22 bp, Homo sapiens
actgactttggaatatttctag

SEQ ID NO: 7578328 - DNA, 22 bp, Homo sapiens
actgactttggaatatttctag

SEQ ID NO: 7578329 - DNA, 22 bp, Homo sapiens
actgagaaatttccagacttgc

SEQ ID NO: 7578330 - DNA, 22 bp, Homo sapiens
actgagaaatagcaagtgtctc

SEQ ID NO: 7578331 - DNA, 22 bp, Homo sapiens
actgagaaatagcaagtgtctc

SEQ ID NO: 7578332 - DNA, 22 bp, Homo sapiens
actgagaaatagcaagtgtctc

SEQ ID NO: 7578333 - DNA, 22 bp, Homo sapiens
actgagaaatttccagacttgc

SEQ ID NO: 7578334 - DNA, 22 bp, Homo sapiens
actgagaaatttccagacttgc

SEQ ID NO: 7578335 - DNA, 22 bp, Homo sapiens
aataaatgttaagattgtctca

SEQ ID NO: 7578336 - DNA, 22 bp, Homo sapiens
aataaatgttaagattgtctca

SEQ ID NO: 7578337 - DNA, 22 bp, Homo sapiens
aataaatgtttgttggatgttt

SEQ ID NO: 7578338 - DNA, 22 bp, Homo sapiens
aataaatgttaagattgtctca

SEQ ID NO: 7578339 - DNA, 22 bp, Homo sapiens
aataaatgttaagattgtctca

SEQ ID NO: 7578340 - DNA, 22 bp, Homo sapiens
aataaatgttaagattgtctca

SEQ ID NO: 7578341 - DNA, 22 bp, Homo sapiens
aataaatgttaagattgtctca

SEQ ID NO: 7578342 - DNA, 22 bp, Homo sapiens
aataaatgaacaaagcaggttg

SEQ ID NO: 7578343 - DNA, 22 bp, Homo sapiens
aataaatgttaagattgtctca

SEQ ID NO: 7578344 - DNA, 22 bp, Homo sapiens
aataaatgttaagattgtctca

SEQ ID NO: 7578345 - DNA, 22 bp, Homo sapiens
aataaatgaacaaagcaggttg

SEQ ID NO: 7578346 - DNA, 22 bp, Homo sapiens
aataaatgaacaaagcaggttg

SEQ ID NO: 7578347 - DNA, 22 bp, Homo sapiens
aataaatcaatcctattggtag

SEQ ID NO: 7578348 - DNA, 22 bp, Homo sapiens
aataaatgaacaaagcaggttg

SEQ ID NO: 7578349 - DNA, 22 bp, Homo sapiens
aataaatgaacaaagcaggttg

SEQ ID NO: 7578350 - DNA, 22 bp, Homo sapiens
aataacagagtcttcaagatag

SEQ ID NO: 7578351 - DNA, 22 bp, Homo sapiens
aataacagagtcttcaagatag

SEQ ID NO: 7578352 - DNA, 22 bp, Homo sapiens
aataacagaaacttgagcatca

SEQ ID NO: 7578353 - DNA, 22 bp, Homo sapiens
aataacagagaagggtggcttc

SEQ ID NO: 7578354 - DNA, 22 bp, Homo sapiens
aataacagagtcttcaagatag

SEQ ID NO: 7578355 - DNA, 22 bp, Homo sapiens
aataacagagtcttcaagatag

SEQ ID NO: 7578356 - DNA, 22 bp, Homo sapiens
aataacagagtcttcaagatag

SEQ ID NO: 7578357 - DNA, 22 bp, Homo sapiens
aataacagagtcttcaagatag

SEQ ID NO: 7578358 - DNA, 22 bp, Homo sapiens
aataacagaaacttgagcatca

SEQ ID NO: 7578359 - DNA, 22 bp, Homo sapiens
aataacagaaacttgagcatca

SEQ ID NO: 7578360 - DNA, 22 bp, Homo sapiens
aataacagaaacttgagcatca

SEQ ID NO: 7578361 - DNA, 22 bp, Homo sapiens
aataacagaaacttgagcatca

SEQ ID NO: 7578362 - DNA, 22 bp, Homo sapiens
aataaatgtttgttggatgttt

SEQ ID NO: 7578363 - DNA, 22 bp, Homo sapiens
aataaatgtttgttggatgttt

SEQ ID NO: 7578364 - DNA, 22 bp, Homo sapiens
aataaatgtttgttggatgttt

SEQ ID NO: 7578365 - DNA, 22 bp, Homo sapiens
aataaagccttattgattttac

SEQ ID NO: 7578366 - DNA, 22 bp, Homo sapiens
aataaaggcaccataaggcaaa

SEQ ID NO: 7578367 - DNA, 22 bp, Homo sapiens
aataaagccttattgattttac

SEQ ID NO: 7578368 - DNA, 22 bp, Homo sapiens
aataaagcctgtctctttagag

SEQ ID NO: 7578369 - DNA, 22 bp, Homo sapiens
aataaagcctgtctctttagag

SEQ ID NO: 7578370 - DNA, 22 bp, Homo sapiens
aataaagcctgtctctttagag

SEQ ID NO: 7578371 - DNA, 22 bp, Homo sapiens
aataaagtagcgtttaaggtgc

SEQ ID NO: 7578372 - DNA, 22 bp, Homo sapiens
aataaagtagcgtttaaggtgc

SEQ ID NO: 7578373 - DNA, 22 bp, Homo sapiens
aataaagtagcgtttaaggtgc

SEQ ID NO: 7578374 - DNA, 22 bp, Homo sapiens
aataaaggcaccataaggcaaa

SEQ ID NO: 7578375 - DNA, 22 bp, Homo sapiens
aataaagtagcgtttaaggtgc

SEQ ID NO: 7578376 - DNA, 22 bp, Homo sapiens
aataaagtagcgtttaaggtgc

SEQ ID NO: 7578377 - DNA, 22 bp, Homo sapiens
aataaagtgtattctttgtcat

SEQ ID NO: 7578378 - DNA, 22 bp, Homo sapiens
aataaagtgtattctttgtcat

SEQ ID NO: 7578379 - DNA, 22 bp, Homo sapiens
aataaagtgtattctttgtcat

SEQ ID NO: 7578380 - DNA, 22 bp, Homo sapiens
aataaagtagcgtttaaggtgc

SEQ ID NO: 7578381 - DNA, 22 bp, Homo sapiens
aataaagtagcgtttaaggtgc

SEQ ID NO: 7578382 - DNA, 22 bp, Homo sapiens
aataaagtgtattctttgtcat

SEQ ID NO: 7578383 - DNA, 22 bp, Homo sapiens
aataaagtgtattctttgtcat

SEQ ID NO: 7578384 - DNA, 22 bp, Homo sapiens
aataaatcaatcctattggtag

SEQ ID NO: 7578385 - DNA, 22 bp, Homo sapiens
aataaatcaatcctattggtag

SEQ ID NO: 7578386 - DNA, 22 bp, Homo sapiens
aataaagtgtattctttgtcat

SEQ ID NO: 7578387 - DNA, 22 bp, Homo sapiens
aataaagtgtattctttgtcat

SEQ ID NO: 7578388 - DNA, 22 bp, Homo sapiens
aataaagtgtattctttgtcat

SEQ ID NO: 7578389 - DNA, 22 bp, Homo sapiens
aataaagcacttgggttggtaa

SEQ ID NO: 7578390 - DNA, 22 bp, Homo sapiens
aataaagactcagaggcccagg

SEQ ID NO: 7578391 - DNA, 20 bp, Homo sapiens
aataaagcaacgagcgagct

SEQ ID NO: 7578392 - DNA, 18 bp, Homo sapiens
aataaagcaggatttctc

SEQ ID NO: 7578393 - DNA, 22 bp, Homo sapiens
aataaagcagggtccttgcact

SEQ ID NO: 7578394 - DNA, 22 bp, Homo sapiens
aataaagcagggtccttgcact

SEQ ID NO: 7578395 - DNA, 22 bp, Homo sapiens
aataaagcagggtccttgcact

SEQ ID NO: 7578396 - DNA, 22 bp, Homo sapiens
aataaagcatgaggcatttatc

SEQ ID NO: 7578397 - DNA, 22 bp, Homo sapiens
aataaagcatgaggcatttatc

SEQ ID NO: 7578398 - DNA, 22 bp, Homo sapiens
aataaagcatgaggcatttatc

SEQ ID NO: 7578399 - DNA, 22 bp, Homo sapiens
aataaagcatgaggcatttatc

SEQ ID NO: 7578400 - DNA, 22 bp, Homo sapiens
aataaagactcagaggcccagg

SEQ ID NO: 7578401 - DNA, 22 bp, Homo sapiens
aataaagacaaacaggggagcc

SEQ ID NO: 7578402 - DNA, 22 bp, Homo sapiens
aataaagacaaacaggggagcc

SEQ ID NO: 7578403 - DNA, 22 bp, Homo sapiens
actgagactgagaatgtttctt

SEQ ID NO: 7578404 - DNA, 22 bp, Homo sapiens
aataaagaatggatgagatcgt

SEQ ID NO: 7578405 - DNA, 22 bp, Homo sapiens
aataaagaatggatgagatcgt

SEQ ID NO: 7578406 - DNA, 22 bp, Homo sapiens
aataaagaatggatgagatcgt

SEQ ID NO: 7578407 - DNA, 22 bp, Homo sapiens
aagtggcagaatagtggcagga

SEQ ID NO: 7578408 - DNA, 22 bp, Homo sapiens
aagtggcagaatagtggcagga

SEQ ID NO: 7578409 - DNA, 22 bp, Homo sapiens
aagtggcagccttagaaggaga

SEQ ID NO: 7578410 - DNA, 22 bp, Homo sapiens
aagtggcagaatagtggcagga

SEQ ID NO: 7578411 - DNA, 22 bp, Homo sapiens
aagtggcagccttagaaggaga

SEQ ID NO: 7578412 - DNA, 22 bp, Homo sapiens
aagtggcagccttagaaggaga

SEQ ID NO: 7578413 - DNA, 22 bp, Homo sapiens
aagtggcagccttagaaggaga

SEQ ID NO: 7578414 - DNA, 22 bp, Homo sapiens
aagtggcagttcaggaagcaga

SEQ ID NO: 7578415 - DNA, 22 bp, Homo sapiens
aagtggcagttcaggaagcaga

SEQ ID NO: 7578416 - DNA, 22 bp, Homo sapiens
aagtggcagttcaggaagcaga

SEQ ID NO: 7578417 - DNA, 22 bp, Homo sapiens
aagtggcagttcaggaagcaga

SEQ ID NO: 7578418 - DNA, 22 bp, Homo sapiens
aagtggcagttcaggaagcaga

SEQ ID NO: 7578419 - DNA, 22 bp, Homo sapiens
aagtggcagttcaggaagcaga

SEQ ID NO: 7578420 - DNA, 22 bp, Homo sapiens
aagtggcatgtataagaaagaa

SEQ ID NO: 7578421 - DNA, 22 bp, Homo sapiens
aagtggccctaggccaagggga

SEQ ID NO: 7578422 - DNA, 22 bp, Homo sapiens
aagtggctaacagtccttgcct

SEQ ID NO: 7578423 - DNA, 22 bp, Homo sapiens
aagtggctgctatcaactcctt

SEQ ID NO: 7578424 - DNA, 22 bp, Homo sapiens
aagtggctcatgtggcttctgc

SEQ ID NO: 7578425 - DNA, 21 bp, Homo sapiens
aagtttctccctaattgttgc

SEQ ID NO: 7578426 - DNA, 21 bp, Homo sapiens
aagtttctccctaattgttgc

SEQ ID NO: 7578427 - DNA, 22 bp, Homo sapiens
aagtttctgaatttgaaaggat

SEQ ID NO: 7578428 - DNA, 22 bp, Homo sapiens
aagtttctcagggttgattggg

SEQ ID NO: 7578429 - DNA, 22 bp, Homo sapiens
aagtttctcaatggcaactggg

SEQ ID NO: 7578430 - DNA, 22 bp, Homo sapiens
aagtttctcagggttgattggg

SEQ ID NO: 7578431 - DNA, 22 bp, Homo sapiens
aagtttggtccttctaagaaga

SEQ ID NO: 7578432 - DNA, 22 bp, Homo sapiens
aagtttctgaatttgaaaggat

SEQ ID NO: 7578433 - DNA, 22 bp, Homo sapiens
aagtttggggagaatttcattt

SEQ ID NO: 7578434 - DNA, 22 bp, Homo sapiens
aagtttggtccttctaagaaga

SEQ ID NO: 7578435 - DNA, 22 bp, Homo sapiens
aagtttgtagctggatgtctgt

SEQ ID NO: 7578436 - DNA, 22 bp, Homo sapiens
aagtttgtagctggatgtctgt

SEQ ID NO: 7578437 - DNA, 22 bp, Homo sapiens
aagtttggtccttctaagaaga

SEQ ID NO: 7578438 - DNA, 22 bp, Homo sapiens
aagtggggcctggtggtacagt

SEQ ID NO: 7578439 - DNA, 22 bp, Homo sapiens
aagtggggcctggtggtacagt

SEQ ID NO: 7578440 - DNA, 22 bp, Homo sapiens
aagtgggcggtttatgattctg

SEQ ID NO: 7578441 - DNA, 18 bp, Homo sapiens
aagtgggaaaagcaagca

SEQ ID NO: 7578442 - DNA, 22 bp, Homo sapiens
aagtggctttgagcttctgcca

SEQ ID NO: 7578443 - DNA, 18 bp, Homo sapiens
aagtgggaaaagcaagca

SEQ ID NO: 7578444 - DNA, 22 bp, Homo sapiens
aagtgggaatagaaatgaaggt

SEQ ID NO: 7578445 - DNA, 22 bp, Homo sapiens
aagtgggaatagaaatgaaggt

SEQ ID NO: 7578446 - DNA, 22 bp, Homo sapiens
aagtttgttcagggcttacatt

SEQ ID NO: 7578447 - DNA, 22 bp, Homo sapiens
aagtttgttcagggcttacatt

SEQ ID NO: 7578448 - DNA, 22 bp, Homo sapiens
aagtttgttcagggcttacatt

SEQ ID NO: 7578449 - DNA, 22 bp, Homo sapiens
aagtttgtgtcagagctgttac

SEQ ID NO: 7578450 - DNA, 22 bp, Homo sapiens
aagtttgtgtcagagctgttac

SEQ ID NO: 7578451 - DNA, 22 bp, Homo sapiens
aagtttgttcattcattcatcc

SEQ ID NO: 7578452 - DNA, 22 bp, Homo sapiens
aagtttgttcattcattcatcc

SEQ ID NO: 7578453 - DNA, 22 bp, Homo sapiens
aagtttgttcattcattcatcc

SEQ ID NO: 7578454 - DNA, 22 bp, Homo sapiens
aagtttgtggttatacttgatt

SEQ ID NO: 7578455 - DNA, 22 bp, Homo sapiens
aagtttgtggttatacttgatt

SEQ ID NO: 7578456 - DNA, 22 bp, Homo sapiens
aagtttgtgtagtttagcatcc

SEQ ID NO: 7578457 - DNA, 22 bp, Homo sapiens
aagtttgtgtagtttagcatcc

SEQ ID NO: 7578458 - DNA, 22 bp, Homo sapiens
aagtttgtggtcatttattata

SEQ ID NO: 7578459 - DNA, 22 bp, Homo sapiens
aagtttgtcgaaattatcagca

SEQ ID NO: 7578460 - DNA, 22 bp, Homo sapiens
aagtttgtcgaaattatcagca

SEQ ID NO: 7578461 - DNA, 22 bp, Homo sapiens
aagtttggtttcagaggtcagt

SEQ ID NO: 7578462 - DNA, 22 bp, Homo sapiens
aagtttgtcgaaattatcagca

SEQ ID NO: 7578463 - DNA, 22 bp, Homo sapiens
aagtttgtcgaaattatcagca

SEQ ID NO: 7578464 - DNA, 22 bp, Homo sapiens
aagtttgtggtcatttattata

SEQ ID NO: 7578465 - DNA, 22 bp, Homo sapiens
aagtttgtggtcatttattata

SEQ ID NO: 7578466 - DNA, 22 bp, Homo sapiens
aagtttgtctcatttgatcttc

SEQ ID NO: 7578467 - DNA, 22 bp, Homo sapiens
aagtttgtgaggttaatccctt

SEQ ID NO: 7578468 - DNA, 22 bp, Homo sapiens
aagtttgtctcatttgatcttc

SEQ ID NO: 7578469 - DNA, 22 bp, Homo sapiens
aagtttgtctcatttgatcttc

SEQ ID NO: 7578470 - DNA, 22 bp, Homo sapiens
aagtttgtctcatttgatcttc

SEQ ID NO: 7578471 - DNA, 22 bp, Homo sapiens
aagttttaacaagtacttacta

SEQ ID NO: 7578472 - DNA, 22 bp, Homo sapiens
aagttttaacaagtacttacta

SEQ ID NO: 7578473 - DNA, 22 bp, Homo sapiens
aagttttactgaggacacatgt

SEQ ID NO: 7578474 - DNA, 22 bp, Homo sapiens
aagttttactgaggacacatgt

SEQ ID NO: 7578475 - DNA, 22 bp, Homo sapiens
aagttttactgaggacacatgt

SEQ ID NO: 7578476 - DNA, 22 bp, Homo sapiens
aagttttactgaggacacatgt

SEQ ID NO: 7578477 - DNA, 22 bp, Homo sapiens
aagttttatgggaagatgtgca

SEQ ID NO: 7578478 - DNA, 22 bp, Homo sapiens
aagttttactgaggacacatgt

SEQ ID NO: 7578479 - DNA, 22 bp, Homo sapiens
aagttttactgaggacacatgt

SEQ ID NO: 7578480 - DNA, 22 bp, Homo sapiens
aagttttactgaggacacatgt

SEQ ID NO: 7578481 - DNA, 22 bp, Homo sapiens
aagttttactgaggacacatgt

SEQ ID NO: 7578482 - DNA, 22 bp, Homo sapiens
aagttttactgaggacacatgt

SEQ ID NO: 7578483 - DNA, 22 bp, Homo sapiens
aagtttgttttagtctaatgat

SEQ ID NO: 7578484 - DNA, 22 bp, Homo sapiens
aagtttgttttagtctaatgat

SEQ ID NO: 7578485 - DNA, 21 bp, Homo sapiens
aagtttgttcttgtatagtct

SEQ ID NO: 7578486 - DNA, 21 bp, Homo sapiens
aagtttgttcttgtatagtct

SEQ ID NO: 7578487 - DNA, 22 bp, Homo sapiens
aagtttgttgtacatgttagta

SEQ ID NO: 7578488 - DNA, 22 bp, Homo sapiens
aagtttgttttagtctaatgat

SEQ ID NO: 7578489 - DNA, 22 bp, Homo sapiens
aagttttaacaagtacttacta

SEQ ID NO: 7578490 - DNA, 22 bp, Homo sapiens
aagttttaacaagtacttacta

SEQ ID NO: 7578491 - DNA, 22 bp, Homo sapiens
aagttttaacaagtacttacta

SEQ ID NO: 7578492 - DNA, 22 bp, Homo sapiens
aagttttaacaagtacttacta

SEQ ID NO: 7578493 - DNA, 22 bp, Homo sapiens
aagttttaacaagtacttacta

SEQ ID NO: 7578494 - DNA, 22 bp, Homo sapiens
aagtggagtccctacaaccagc

SEQ ID NO: 7578495 - DNA, 22 bp, Homo sapiens
aagtggaggccgagttcacgca

SEQ ID NO: 7578496 - DNA, 22 bp, Homo sapiens
aagtggagtccctacaaccagc

SEQ ID NO: 7578497 - DNA, 22 bp, Homo sapiens
aagtggagtccctacaaccagc

SEQ ID NO: 7578498 - DNA, 18 bp, Homo sapiens
aagtggcacaggagtgca

SEQ ID NO: 7578499 - DNA, 20 bp, Homo sapiens
aagtggatccctaagaacag

SEQ ID NO: 7578500 - DNA, 18 bp, Homo sapiens
aagtggcacaggagtgca

SEQ ID NO: 7578501 - DNA, 18 bp, Homo sapiens
aagtggcacaggagtgca

SEQ ID NO: 7578502 - DNA, 18 bp, Homo sapiens
aagtggcacaggagtgca

SEQ ID NO: 7578503 - DNA, 22 bp, Homo sapiens
aagtggcacgctttttggagtt

SEQ ID NO: 7578504 - DNA, 22 bp, Homo sapiens
aagtggcagaatagtggcagga

SEQ ID NO: 7578505 - DNA, 22 bp, Homo sapiens
aagtggcagaatagtggcagga

SEQ ID NO: 7578506 - DNA, 22 bp, Homo sapiens
aagtggcacgctttttggagtt

SEQ ID NO: 7578507 - DNA, 22 bp, Homo sapiens
aagtggagctataggctcagat

SEQ ID NO: 7578508 - DNA, 22 bp, Homo sapiens
actcatgtcctaggagtaaagc

SEQ ID NO: 7578509 - DNA, 22 bp, Homo sapiens
actcatgtcctaggagtaaagc

SEQ ID NO: 7578510 - DNA, 22 bp, Homo sapiens
aagtggagctataggctcagat

SEQ ID NO: 7578511 - DNA, 22 bp, Homo sapiens
aagtggagctataggctcagat

SEQ ID NO: 7578512 - DNA, 22 bp, Homo sapiens
aagtggagctataggctcagat

SEQ ID NO: 7578513 - DNA, 22 bp, Homo sapiens
aagtggaggccgagttcacgca

SEQ ID NO: 7578514 - DNA, 22 bp, Homo sapiens
aagtggagtccctacaaccagc

SEQ ID NO: 7578515 - DNA, 22 bp, Homo sapiens
aagtggaggccgagttcacgca

SEQ ID NO: 7578516 - DNA, 22 bp, Homo sapiens
aagtggaggccgagttcacgca

SEQ ID NO: 7578517 - DNA, 22 bp, Homo sapiens
actcatgtaagcggaatgtagt

SEQ ID NO: 7578518 - DNA, 22 bp, Homo sapiens
actcatgtaagcggaatgtagt

SEQ ID NO: 7578519 - DNA, 22 bp, Homo sapiens
actcatggtagcacaggctgtg

SEQ ID NO: 7578520 - DNA, 22 bp, Homo sapiens
actcatgatatgcctataagat

SEQ ID NO: 7578521 - DNA, 22 bp, Homo sapiens
actcatgtcctaggagtaaagc

SEQ ID NO: 7578522 - DNA, 22 bp, Homo sapiens
actcatgtcatgtgttctttac

SEQ ID NO: 7578523 - DNA, 22 bp, Homo sapiens
actcatgtaagcggaatgtagt

SEQ ID NO: 7578524 - DNA, 22 bp, Homo sapiens
actcatcttccctcctggaggg

SEQ ID NO: 7578525 - DNA, 22 bp, Homo sapiens
actcatctgccattcctgtacc

SEQ ID NO: 7578526 - DNA, 23 bp, Homo sapiens
actcatcttctggtatccacagt

SEQ ID NO: 7578527 - DNA, 22 bp, Homo sapiens
actcatcttccctcctggaggg

SEQ ID NO: 7578528 - DNA, 23 bp, Homo sapiens
actcatcttctggtatccacagt

SEQ ID NO: 7578529 - DNA, 23 bp, Homo sapiens
actcatcttctggtatccacagt

SEQ ID NO: 7578530 - DNA, 22 bp, Homo sapiens
actcatctttgaattttcagta

SEQ ID NO: 7578531 - DNA, 22 bp, Homo sapiens
actcatctttgaattttcagta

SEQ ID NO: 7578532 - DNA, 19 bp, Homo sapiens
actcatctttccagaatat

SEQ ID NO: 7578533 - DNA, 19 bp, Homo sapiens
actcatctttccagaatat

SEQ ID NO: 7578534 - DNA, 21 bp, Homo sapiens
actcatctttttggagaccag

SEQ ID NO: 7578535 - DNA, 22 bp, Homo sapiens
actcatctttgaattttcagta

SEQ ID NO: 7578536 - DNA, 21 bp, Homo sapiens
actcatctttttggagaccag

SEQ ID NO: 7578537 - DNA, 22 bp, Homo sapiens
aagtgcagtggcgtgatcttgg

SEQ ID NO: 7578538 - DNA, 22 bp, Homo sapiens
aagtgcagtggcgtgatcttgg

SEQ ID NO: 7578539 - DNA, 22 bp, Homo sapiens
aagtgcataagtatgattattt

SEQ ID NO: 7578540 - DNA, 23 bp, Homo sapiens
actcagagaccccgggaagtgac

SEQ ID NO: 7578541 - DNA, 22 bp, Homo sapiens
actcagagatatggtggttgat

SEQ ID NO: 7578542 - DNA, 22 bp, Homo sapiens
actcagagatatggtggttgat

SEQ ID NO: 7578543 - DNA, 22 bp, Homo sapiens
actcagagatatggtggttgat

SEQ ID NO: 7578544 - DNA, 22 bp, Homo sapiens
actcagagcagagcagcctgag

SEQ ID NO: 7578545 - DNA, 22 bp, Homo sapiens
actcagtacatctggagttggc

SEQ ID NO: 7578546 - DNA, 23 bp, Homo sapiens
actcagtgagggccttgggctgc

SEQ ID NO: 7578547 - DNA, 22 bp, Homo sapiens
actcagtgaattttcatcaaat

SEQ ID NO: 7578548 - DNA, 22 bp, Homo sapiens
actcagtatacaccagtatagg

SEQ ID NO: 7578549 - DNA, 22 bp, Homo sapiens
actcagtcatttggggaacagt

SEQ ID NO: 7578550 - DNA, 22 bp, Homo sapiens
actcagtatacaccagtatagg

SEQ ID NO: 7578551 - DNA, 22 bp, Homo sapiens
actcagtacatctggagttggc

SEQ ID NO: 7578552 - DNA, 22 bp, Homo sapiens
actcagtacatctggagttggc

SEQ ID NO: 7578553 - DNA, 22 bp, Homo sapiens
actcagtacatctggagttggc

SEQ ID NO: 7578554 - DNA, 22 bp, Homo sapiens
actcagagcagagcagcctgag

SEQ ID NO: 7578555 - DNA, 22 bp, Homo sapiens
actcatcagtggttttaatcaa

SEQ ID NO: 7578556 - DNA, 23 bp, Homo sapiens
actcatccttgatttgcagatgt

SEQ ID NO: 7578557 - DNA, 22 bp, Homo sapiens
actcatctattagatatctgtt

SEQ ID NO: 7578558 - DNA, 20 bp, Homo sapiens
actcatctactccagaccct

SEQ ID NO: 7578559 - DNA, 20 bp, Homo sapiens
actcatctactccagaccct

SEQ ID NO: 7578560 - DNA, 19 bp, Homo sapiens
actcatctgccacctctgt

SEQ ID NO: 7578561 - DNA, 22 bp, Homo sapiens
actcatctgccattcctgtacc

SEQ ID NO: 7578562 - DNA, 19 bp, Homo sapiens
actcatctgccacctctgt

SEQ ID NO: 7578563 - DNA, 22 bp, Homo sapiens
actcatctgactggtgggaatg

SEQ ID NO: 7578564 - DNA, 22 bp, Homo sapiens
actcatctgaaaaatgaggaga

SEQ ID NO: 7578565 - DNA, 22 bp, Homo sapiens
actcatctgaaaaatgaggaga

SEQ ID NO: 7578566 - DNA, 22 bp, Homo sapiens
actcatctgactggtgggaatg

SEQ ID NO: 7578567 - DNA, 22 bp, Homo sapiens
actcatctattagatatctgtt

SEQ ID NO: 7578568 - DNA, 22 bp, Homo sapiens
actcatctgaaaaatgaggaga

SEQ ID NO: 7578569 - DNA, 22 bp, Homo sapiens
actcagttccatattggtaagt

SEQ ID NO: 7578570 - DNA, 22 bp, Homo sapiens
actcatcaactgttacaaatgt

SEQ ID NO: 7578571 - DNA, 22 bp, Homo sapiens
actcagttccatattggtaagt

SEQ ID NO: 7578572 - DNA, 22 bp, Homo sapiens
actcagttatcatgtgtccaca

SEQ ID NO: 7578573 - DNA, 22 bp, Homo sapiens
actcagttatcatgtgtccaca

SEQ ID NO: 7578574 - DNA, 22 bp, Homo sapiens
actcagtggcactttggaattt

SEQ ID NO: 7578575 - DNA, 21 bp, Homo sapiens
aagtaaatcagagaaataacc

SEQ ID NO: 7578576 - DNA, 21 bp, Homo sapiens
aagtaaatcagagaaataacc

SEQ ID NO: 7578577 - DNA, 21 bp, Homo sapiens
aagtaaatcagagaaataacc

SEQ ID NO: 7578578 - DNA, 21 bp, Homo sapiens
aagtaaatcagagaaataacc

SEQ ID NO: 7578579 - DNA, 21 bp, Homo sapiens
aagtaaatcagagaaataacc

SEQ ID NO: 7578580 - DNA, 21 bp, Homo sapiens
aagtaaatcagagaaataacc

SEQ ID NO: 7578581 - DNA, 21 bp, Homo sapiens
aagtaaatcagagaaataacc

SEQ ID NO: 7578582 - DNA, 21 bp, Homo sapiens
aagtaaatcagagaaataacc

SEQ ID NO: 7578583 - DNA, 21 bp, Homo sapiens
aagtaaatcagagaaataacc

SEQ ID NO: 7578584 - DNA, 21 bp, Homo sapiens
aagtaaatcagagaaataacc

SEQ ID NO: 7578585 - DNA, 22 bp, Homo sapiens
aagtaaatatctgtttatagca

SEQ ID NO: 7578586 - DNA, 21 bp, Homo sapiens
aagtaaatcagagaaataacc

SEQ ID NO: 7578587 - DNA, 22 bp, Homo sapiens
aagtaaatgttggagctcaaat

SEQ ID NO: 7578588 - DNA, 22 bp, Homo sapiens
aagtaaatgttggagctcaaat

SEQ ID NO: 7578589 - DNA, 22 bp, Homo sapiens
aagtaaatgttggagctcaaat

SEQ ID NO: 7578590 - DNA, 22 bp, Homo sapiens
aagtaaatgttggagctcaaat

SEQ ID NO: 7578591 - DNA, 22 bp, Homo sapiens
aagtaaatgttggagctcaaat

SEQ ID NO: 7578592 - DNA, 21 bp, Homo sapiens
aagtaaatcagagaaataacc

SEQ ID NO: 7578593 - DNA, 21 bp, Homo sapiens
aagtaaatcagagaaataacc

SEQ ID NO: 7578594 - DNA, 22 bp, Homo sapiens
aagtaaatatctgtagtcttta

SEQ ID NO: 7578595 - DNA, 22 bp, Homo sapiens
aagtaaatatctgtagtcttta

SEQ ID NO: 7578596 - DNA, 22 bp, Homo sapiens
aagtaaacttacacatagtaaa

SEQ ID NO: 7578597 - DNA, 22 bp, Homo sapiens
aagtaaacttacacatagtaaa

SEQ ID NO: 7578598 - DNA, 22 bp, Homo sapiens
aagtaaacttacacatagtaaa

SEQ ID NO: 7578599 - DNA, 22 bp, Homo sapiens
aagtaaatatctgtttatagca

SEQ ID NO: 7578600 - DNA, 22 bp, Homo sapiens
aagtaaatatctgtttatagca

SEQ ID NO: 7578601 - DNA, 22 bp, Homo sapiens
aagtaaatatctgtttatagca

SEQ ID NO: 7578602 - DNA, 22 bp, Homo sapiens
aagtaaatatctgtttatagca

SEQ ID NO: 7578603 - DNA, 22 bp, Homo sapiens
aagtaaatatctgtttatagca

SEQ ID NO: 7578604 - DNA, 22 bp, Homo sapiens
aagtaaatatctgtttatagca

SEQ ID NO: 7578605 - DNA, 22 bp, Homo sapiens
aagtaaatatctgtttatagca

SEQ ID NO: 7578606 - DNA, 22 bp, Homo sapiens
aagtaaacttacacatagtaaa

SEQ ID NO: 7578607 - DNA, 22 bp, Homo sapiens
aagtaaacttacacatagtaaa

SEQ ID NO: 7578608 - DNA, 22 bp, Homo sapiens
aagtaaacattgagagacaaga

SEQ ID NO: 7578609 - DNA, 22 bp, Homo sapiens
aagtaaacagataagaaatctg

SEQ ID NO: 7578610 - DNA, 22 bp, Homo sapiens
aagtaaacagataagaaatctg

SEQ ID NO: 7578611 - DNA, 20 bp, Homo sapiens
acctggcttcctcttggcat

SEQ ID NO: 7578612 - DNA, 22 bp, Homo sapiens
acctggcttcagagtctggcca

SEQ ID NO: 7578613 - DNA, 22 bp, Homo sapiens
acctggcttcagagtctggcca

SEQ ID NO: 7578614 - DNA, 22 bp, Homo sapiens
acctggcttcaaccatcatttg

SEQ ID NO: 7578615 - DNA, 22 bp, Homo sapiens
acctggcttcaaccatcatttg

SEQ ID NO: 7578616 - DNA, 22 bp, Homo sapiens
acctggctgttctcatttctag

SEQ ID NO: 7578617 - DNA, 22 bp, Homo sapiens
acctggctgttctcatttctag

SEQ ID NO: 7578618 - DNA, 18 bp, Homo sapiens
acctgcctgttcttctct

SEQ ID NO: 7578619 - DNA, 18 bp, Homo sapiens
acctgcctgttcttctct

SEQ ID NO: 7578620 - DNA, 22 bp, Homo sapiens
aagtaacagagggggtgttgct

SEQ ID NO: 7578621 - DNA, 22 bp, Homo sapiens
aagtaacagcatcaagtctcaa

SEQ ID NO: 7578622 - DNA, 22 bp, Homo sapiens
aagtaacagcatcaagtctcaa

SEQ ID NO: 7578623 - DNA, 22 bp, Homo sapiens
acctggctgttctcatttctag

SEQ ID NO: 7578624 - DNA, 18 bp, Homo sapiens
acctggctgtgtgagctg

SEQ ID NO: 7578625 - DNA, 18 bp, Homo sapiens
acctggctgtgtgagctg

SEQ ID NO: 7578626 - DNA, 18 bp, Homo sapiens
acctgcctgttcttctct

SEQ ID NO: 7578627 - DNA, 18 bp, Homo sapiens
acctgcctgttcttctct

SEQ ID NO: 7578628 - DNA, 22 bp, Homo sapiens
acctggctggttgtgattccca

SEQ ID NO: 7578629 - DNA, 18 bp, Homo sapiens
aagtaacagaagagcaca

SEQ ID NO: 7578630 - DNA, 18 bp, Homo sapiens
aagtaacagaagagcaca

SEQ ID NO: 7578631 - DNA, 22 bp, Homo sapiens
aagtaacacggaacttgaagca

SEQ ID NO: 7578632 - DNA, 18 bp, Homo sapiens
aagtaacagaagagcaca

SEQ ID NO: 7578633 - DNA, 18 bp, Homo sapiens
aagtaacagaagagcaca

SEQ ID NO: 7578634 - DNA, 18 bp, Homo sapiens
aagtaacagaagagcaca

SEQ ID NO: 7578635 - DNA, 18 bp, Homo sapiens
aagtaacagaagagcaca

SEQ ID NO: 7578636 - DNA, 18 bp, Homo sapiens
aagtaacagaagagcaca

SEQ ID NO: 7578637 - DNA, 18 bp, Homo sapiens
aagtaacagaagagcaca

SEQ ID NO: 7578638 - DNA, 18 bp, Homo sapiens
aagtaacagaagagcaca

SEQ ID NO: 7578639 - DNA, 22 bp, Homo sapiens
aagtaacagagggggtgttgct

SEQ ID NO: 7578640 - DNA, 22 bp, Homo sapiens
aagtaacacggaacttgaagca

SEQ ID NO: 7578641 - DNA, 22 bp, Homo sapiens
aagtaacacggaacttgaagca

SEQ ID NO: 7578642 - DNA, 21 bp, Homo sapiens
aagtaacaccactcctggagt

SEQ ID NO: 7578643 - DNA, 21 bp, Homo sapiens
aagtaacaccactcctggagt

SEQ ID NO: 7578644 - DNA, 22 bp, Homo sapiens
aagtaacacatgttacttctgc

SEQ ID NO: 7578645 - DNA, 22 bp, Homo sapiens
aagtaacacatgttacttctgc

SEQ ID NO: 7578646 - DNA, 22 bp, Homo sapiens
aagtaacacatgttacttctgc

SEQ ID NO: 7578647 - DNA, 22 bp, Homo sapiens
aagtaacacatgttacttctgc

SEQ ID NO: 7578648 - DNA, 22 bp, Homo sapiens
aagtaacacatgttacttctgc

SEQ ID NO: 7578649 - DNA, 22 bp, Homo sapiens
aagtaacaatgctgttgaattg

SEQ ID NO: 7578650 - DNA, 22 bp, Homo sapiens
aagtaacaatgctgttgaattg

SEQ ID NO: 7578651 - DNA, 22 bp, Homo sapiens
aagtaacaatgctgttgaattg

SEQ ID NO: 7578652 - DNA, 22 bp, Homo sapiens
aagtaacaatgctgttgaattg

SEQ ID NO: 7578653 - DNA, 22 bp, Homo sapiens
acctgggatggggccaggttta

SEQ ID NO: 7578654 - DNA, 22 bp, Homo sapiens
acctgggatggggccaggttta

SEQ ID NO: 7578655 - DNA, 22 bp, Homo sapiens
acctgggagtcacacctgagaa

SEQ ID NO: 7578656 - DNA, 22 bp, Homo sapiens
acctgggatggggccaggttta

SEQ ID NO: 7578657 - DNA, 22 bp, Homo sapiens
acctgggagtatgcagtggtga

SEQ ID NO: 7578658 - DNA, 22 bp, Homo sapiens
acctgggaggcggaggttgcag

SEQ ID NO: 7578659 - DNA, 22 bp, Homo sapiens
acctgggaggcggaggttgcag

SEQ ID NO: 7578660 - DNA, 22 bp, Homo sapiens
acctgggaggcagaggttgcag

SEQ ID NO: 7578661 - DNA, 22 bp, Homo sapiens
acctgggagagaggagccggcg

SEQ ID NO: 7578662 - DNA, 22 bp, Homo sapiens
acctgggaggcagaggttgcag

SEQ ID NO: 7578663 - DNA, 20 bp, Homo sapiens
acctgggaaaaccttttcct

SEQ ID NO: 7578664 - DNA, 22 bp, Homo sapiens
acctgggaaaaggagtggccat

SEQ ID NO: 7578665 - DNA, 22 bp, Homo sapiens
acctggcttgtttctacctcct

SEQ ID NO: 7578666 - DNA, 20 bp, Homo sapiens
acctggcttgggggaggagt

SEQ ID NO: 7578667 - DNA, 22 bp, Homo sapiens
acctggcttctaatcatggctc

SEQ ID NO: 7578668 - DNA, 22 bp, Homo sapiens
acctggcttctaatcatggctc

SEQ ID NO: 7578669 - DNA, 22 bp, Homo sapiens
acctggcttgtttctacctcct

SEQ ID NO: 7578670 - DNA, 22 bp, Homo sapiens
acctgggagagaggagccggcg

SEQ ID NO: 7578671 - DNA, 22 bp, Homo sapiens
acctgggaagatctttgaagct

SEQ ID NO: 7578672 - DNA, 22 bp, Homo sapiens
acctgggaaaaggagtggccat

SEQ ID NO: 7578673 - DNA, 22 bp, Homo sapiens
acctgggaaagccgtggaaagg

SEQ ID NO: 7578674 - DNA, 22 bp, Homo sapiens
acctgggaaagccgtggaaagg

SEQ ID NO: 7578675 - DNA, 22 bp, Homo sapiens
accttcttccaccaaaaacgtc

SEQ ID NO: 7578676 - DNA, 19 bp, Homo sapiens
accttctgggaaacattcc

SEQ ID NO: 7578677 - DNA, 22 bp, Homo sapiens
accttctggtctgcctgacagc

SEQ ID NO: 7578678 - DNA, 22 bp, Homo sapiens
accttctgaccagttatcttga

SEQ ID NO: 7578679 - DNA, 22 bp, Homo sapiens
acctgggttgctggcgtgaggg

SEQ ID NO: 7578680 - DNA, 22 bp, Homo sapiens
accttctgaccagttatcttga

SEQ ID NO: 7578681 - DNA, 22 bp, Homo sapiens
acctgggtctggtgttgggacg

SEQ ID NO: 7578682 - DNA, 20 bp, Homo sapiens
acctggggttgcctgtgctc

SEQ ID NO: 7578683 - DNA, 22 bp, Homo sapiens
acctgggcattttggatgatta

SEQ ID NO: 7578684 - DNA, 20 bp, Homo sapiens
acctggggttgcctgtgctc

SEQ ID NO: 7578685 - DNA, 22 bp, Homo sapiens
acctgggcattttggatgatta

SEQ ID NO: 7578686 - DNA, 22 bp, Homo sapiens
acctgggcattttggatgatta

SEQ ID NO: 7578687 - DNA, 22 bp, Homo sapiens
accttgaaggcagaggacacct

SEQ ID NO: 7578688 - DNA, 22 bp, Homo sapiens
accttgatgcctttccaagatg

SEQ ID NO: 7578689 - DNA, 18 bp, Homo sapiens
accttgatggcagcttgc

SEQ ID NO: 7578690 - DNA, 22 bp, Homo sapiens
accttgatggggctgttggagt

SEQ ID NO: 7578691 - DNA, 22 bp, Homo sapiens
accttgatggggctgttggagt

SEQ ID NO: 7578692 - DNA, 22 bp, Homo sapiens
accttgcagtggaggtttagtg

SEQ ID NO: 7578693 - DNA, 22 bp, Homo sapiens
accttggaaagtttaattgagg

SEQ ID NO: 7578694 - DNA, 22 bp, Homo sapiens
accttggaaatgcccattgcct

SEQ ID NO: 7578695 - DNA, 22 bp, Homo sapiens
accttggaactgaagtgttttt

SEQ ID NO: 7578696 - DNA, 19 bp, Homo sapiens
accttgggcaagtgccttc

SEQ ID NO: 7578697 - DNA, 19 bp, Homo sapiens
accttgggcaagtgccttc

SEQ ID NO: 7578698 - DNA, 22 bp, Homo sapiens
accttggcagtttctacctttt

SEQ ID NO: 7578699 - DNA, 22 bp, Homo sapiens
accttggaactgaagtgttttt

SEQ ID NO: 7578700 - DNA, 23 bp, Homo sapiens
accttggacttcccagcttccag

SEQ ID NO: 7578701 - DNA, 23 bp, Homo sapiens
accttggacttcccagcttccag

SEQ ID NO: 7578702 - DNA, 22 bp, Homo sapiens
accttgggcaacctgctcctgc

SEQ ID NO: 7578703 - DNA, 22 bp, Homo sapiens
aagtgaatttcattccaattct

SEQ ID NO: 7578704 - DNA, 22 bp, Homo sapiens
aagtgaatttcattccaattct

SEQ ID NO: 7578705 - DNA, 22 bp, Homo sapiens
aagtgaatgtagcaaacttgaa

SEQ ID NO: 7578706 - DNA, 22 bp, Homo sapiens
aagtgaatgtagcaaacttgaa

SEQ ID NO: 7578707 - DNA, 22 bp, Homo sapiens
aagtgaatggggcagacttcag

SEQ ID NO: 7578708 - DNA, 22 bp, Homo sapiens
aagtgaatggggcagacttcag

SEQ ID NO: 7578709 - DNA, 22 bp, Homo sapiens
aagtgaatggggcagacttcag

SEQ ID NO: 7578710 - DNA, 22 bp, Homo sapiens
aagtgaatctcctttctttatt

SEQ ID NO: 7578711 - DNA, 22 bp, Homo sapiens
aagtgaatagcctatttactag

SEQ ID NO: 7578712 - DNA, 22 bp, Homo sapiens
aagtgaatagcctatttactag

SEQ ID NO: 7578713 - DNA, 22 bp, Homo sapiens
aagtgaatagcctatttactag

SEQ ID NO: 7578714 - DNA, 22 bp, Homo sapiens
aagtgaatagcctatttactag

SEQ ID NO: 7578715 - DNA, 22 bp, Homo sapiens
aagtgaatagcctatttactag

SEQ ID NO: 7578716 - DNA, 22 bp, Homo sapiens
aagtgaataccatcaagagctt

SEQ ID NO: 7578717 - DNA, 22 bp, Homo sapiens
aagtgaataccatcaagagctt

SEQ ID NO: 7578718 - DNA, 22 bp, Homo sapiens
aagtgaataaaattgtgttctt

SEQ ID NO: 7578719 - DNA, 22 bp, Homo sapiens
aagtgacacatttgtgatgaat

SEQ ID NO: 7578720 - DNA, 22 bp, Homo sapiens
aagtgacacctcttccctttcc

SEQ ID NO: 7578721 - DNA, 22 bp, Homo sapiens
aagtgacagtgaactgggactc

SEQ ID NO: 7578722 - DNA, 22 bp, Homo sapiens
aagtgacagtgaactgggactc

SEQ ID NO: 7578723 - DNA, 22 bp, Homo sapiens
aagtgacagtttacaattctta

SEQ ID NO: 7578724 - DNA, 22 bp, Homo sapiens
aagtgacagtttacaattctta

SEQ ID NO: 7578725 - DNA, 22 bp, Homo sapiens
aagtgacagtttacaattctta

SEQ ID NO: 7578726 - DNA, 22 bp, Homo sapiens
aagtgacagtttacaattctta

SEQ ID NO: 7578727 - DNA, 22 bp, Homo sapiens
aagtgacagtttacaattctta

SEQ ID NO: 7578728 - DNA, 22 bp, Homo sapiens
aagtgacacatttgtgatgaat

SEQ ID NO: 7578729 - DNA, 22 bp, Homo sapiens
aagtgacacatttgtgatgaat

SEQ ID NO: 7578730 - DNA, 22 bp, Homo sapiens
aagtgacacatggcacttctat

SEQ ID NO: 7578731 - DNA, 22 bp, Homo sapiens
aagtgacaaaagggtatccaaa

SEQ ID NO: 7578732 - DNA, 22 bp, Homo sapiens
aagtgacacatggcacttctat

SEQ ID NO: 7578733 - DNA, 22 bp, Homo sapiens
aagtgacacatggcacttctat

SEQ ID NO: 7578734 - DNA, 22 bp, Homo sapiens
aagtgacaaaagggtatccaaa

SEQ ID NO: 7578735 - DNA, 22 bp, Homo sapiens
aagtgacaaaagggtatccaaa

SEQ ID NO: 7578736 - DNA, 22 bp, Homo sapiens
aagtgacaaaagggtatccaaa

SEQ ID NO: 7578737 - DNA, 22 bp, Homo sapiens
aagtgacataaaatctcccagg

SEQ ID NO: 7578738 - DNA, 22 bp, Homo sapiens
aagtgacataaaatctcccagg

SEQ ID NO: 7578739 - DNA, 22 bp, Homo sapiens
aagtgacataaaatctcccagg

SEQ ID NO: 7578740 - DNA, 22 bp, Homo sapiens
aagtgacataccttacatatgt

SEQ ID NO: 7578741 - DNA, 22 bp, Homo sapiens
aagtgacataccttacatatgt

SEQ ID NO: 7578742 - DNA, 22 bp, Homo sapiens
aagtgacataccttacatatgt

SEQ ID NO: 7578743 - DNA, 22 bp, Homo sapiens
aagtgacataccttacatatgt

SEQ ID NO: 7578744 - DNA, 22 bp, Homo sapiens
aagtgacataccttacatatgt

SEQ ID NO: 7578745 - DNA, 22 bp, Homo sapiens
aagtgacataccttacatatgt

SEQ ID NO: 7578746 - DNA, 22 bp, Homo sapiens
aagtgacataccttacatatgt

SEQ ID NO: 7578747 - DNA, 17 bp, Homo sapiens
aagtgacatcaggctgc

SEQ ID NO: 7578748 - DNA, 22 bp, Homo sapiens
aagtgacataccttacatatgt

SEQ ID NO: 7578749 - DNA, 22 bp, Homo sapiens
aagtgacctcatggtttctcct

SEQ ID NO: 7578750 - DNA, 22 bp, Homo sapiens
aagtgacctcatggtttctcct

SEQ ID NO: 7578751 - DNA, 22 bp, Homo sapiens
accttgtgaggttacataatgt

SEQ ID NO: 7578752 - DNA, 22 bp, Homo sapiens
accttgggcaagttggaaactg

SEQ ID NO: 7578753 - DNA, 20 bp, Homo sapiens
accttgggtgagtgacggtc

SEQ ID NO: 7578754 - DNA, 20 bp, Homo sapiens
accttgggtgagtgacggtc

SEQ ID NO: 7578755 - DNA, 22 bp, Homo sapiens
accttgtccatcccaggccctc

SEQ ID NO: 7578756 - DNA, 22 bp, Homo sapiens
accttgtcttttatagaacaag

SEQ ID NO: 7578757 - DNA, 22 bp, Homo sapiens
accttgttgtaggtacaaaaga

SEQ ID NO: 7578758 - DNA, 21 bp, Homo sapiens
acctttaattcaagcatcagg

SEQ ID NO: 7578759 - DNA, 21 bp, Homo sapiens
acctttaattcaagcatcagg

SEQ ID NO: 7578760 - DNA, 21 bp, Homo sapiens
acctttaattcaagcatcagg

SEQ ID NO: 7578761 - DNA, 22 bp, Homo sapiens
acctttatatatcaacttctcc

SEQ ID NO: 7578762 - DNA, 22 bp, Homo sapiens
acctttatatgaaagatgacat

SEQ ID NO: 7578763 - DNA, 22 bp, Homo sapiens
acctttatatgaaagatgacat

SEQ ID NO: 7578764 - DNA, 22 bp, Homo sapiens
acctttatcgccatcattgtgc

SEQ ID NO: 7578765 - DNA, 22 bp, Homo sapiens
acctttatagctgattatgaca

SEQ ID NO: 7578766 - DNA, 22 bp, Homo sapiens
acctttatagcaacctggtgaa

SEQ ID NO: 7578767 - DNA, 22 bp, Homo sapiens
acctttatagcaacctggtgaa

SEQ ID NO: 7578768 - DNA, 22 bp, Homo sapiens
acctttatcgccatcattgtgc

SEQ ID NO: 7578769 - DNA, 22 bp, Homo sapiens
aagtctctttgggtactttatt

SEQ ID NO: 7578770 - DNA, 22 bp, Homo sapiens
aagtctcttttcttcctgtatt

SEQ ID NO: 7578771 - DNA, 22 bp, Homo sapiens
aagtctcttttcttcctgtatt

SEQ ID NO: 7578772 - DNA, 22 bp, Homo sapiens
aagtctgactagaatctctccc

SEQ ID NO: 7578773 - DNA, 22 bp, Homo sapiens
aagtctcttttcttcctgtatt

SEQ ID NO: 7578774 - DNA, 22 bp, Homo sapiens
aagtctgagagaaactctctca

SEQ ID NO: 7578775 - DNA, 22 bp, Homo sapiens
aagtgaaattgccattcttata

SEQ ID NO: 7578776 - DNA, 22 bp, Homo sapiens
aagtgaaattgccattcttata

SEQ ID NO: 7578777 - DNA, 22 bp, Homo sapiens
aagtgaaattgccattcttata

SEQ ID NO: 7578778 - DNA, 22 bp, Homo sapiens
aagtgaagaaatacatgagaat

SEQ ID NO: 7578779 - DNA, 22 bp, Homo sapiens
aagtgaagaaatacatgagaat

SEQ ID NO: 7578780 - DNA, 22 bp, Homo sapiens
aagtgaagaaatacatgagaat

SEQ ID NO: 7578781 - DNA, 22 bp, Homo sapiens
aagtgaagaaatacatgagaat

SEQ ID NO: 7578782 - DNA, 22 bp, Homo sapiens
aagtgaagaaatacatgagaat

SEQ ID NO: 7578783 - DNA, 22 bp, Homo sapiens
aagtgaagaaatacatgagaat

SEQ ID NO: 7578784 - DNA, 23 bp, Homo sapiens
aagtgaacaggagctagatggtc

SEQ ID NO: 7578785 - DNA, 22 bp, Homo sapiens
aagtgaaattgccattcttata

SEQ ID NO: 7578786 - DNA, 22 bp, Homo sapiens
aagtgactatttgagtacatca

SEQ ID NO: 7578787 - DNA, 22 bp, Homo sapiens
aagtgactatttgagtacatca

SEQ ID NO: 7578788 - DNA, 22 bp, Homo sapiens
aagtgactatttgagtacatca

SEQ ID NO: 7578789 - DNA, 18 bp, Homo sapiens
aagtgactggcaggccaa

SEQ ID NO: 7578790 - DNA, 22 bp, Homo sapiens
aagtgaggcctaggcactgggt

SEQ ID NO: 7578791 - DNA, 22 bp, Homo sapiens
aagtgaggcctaggcactgggt

SEQ ID NO: 7578792 - DNA, 22 bp, Homo sapiens
aagtgaggcctaggcactgggt

SEQ ID NO: 7578793 - DNA, 22 bp, Homo sapiens
aagtgaggcctaggcactgggt

SEQ ID NO: 7578794 - DNA, 22 bp, Homo sapiens
aagtgaggtttctgctttcaga

SEQ ID NO: 7578795 - DNA, 22 bp, Homo sapiens
aagtgagtggcctggagaggtg

SEQ ID NO: 7578796 - DNA, 22 bp, Homo sapiens
aagtgagtggcctggagaggtg

SEQ ID NO: 7578797 - DNA, 22 bp, Homo sapiens
aagtgagttgtctgaccctttc

SEQ ID NO: 7578798 - DNA, 22 bp, Homo sapiens
aagtgagttcagcattcactcg

SEQ ID NO: 7578799 - DNA, 22 bp, Homo sapiens
aagtgattctagtcatgattct

SEQ ID NO: 7578800 - DNA, 22 bp, Homo sapiens
aagtgattctagtcatgattct

SEQ ID NO: 7578801 - DNA, 18 bp, Homo sapiens
aagtgattcctttccctt

SEQ ID NO: 7578802 - DNA, 22 bp, Homo sapiens
aagtgattcattgatgatgagg

SEQ ID NO: 7578803 - DNA, 17 bp, Homo sapiens
aagtgattcagccctca

SEQ ID NO: 7578804 - DNA, 17 bp, Homo sapiens
aagtgattcagccctca

SEQ ID NO: 7578805 - DNA, 22 bp, Homo sapiens
aagtgattccttgcagacacac

SEQ ID NO: 7578806 - DNA, 22 bp, Homo sapiens
aagtgattatttaatgcggttt

SEQ ID NO: 7578807 - DNA, 22 bp, Homo sapiens
aagtgattatgtccaggagaac

SEQ ID NO: 7578808 - DNA, 22 bp, Homo sapiens
aagtgattattgttttcaggtt

SEQ ID NO: 7578809 - DNA, 22 bp, Homo sapiens
aagtgattattgttttcaggtt

SEQ ID NO: 7578810 - DNA, 22 bp, Homo sapiens
aagtgattaacatggagctttt

SEQ ID NO: 7578811 - DNA, 22 bp, Homo sapiens
aagtgattaaccatgctctgct

SEQ ID NO: 7578812 - DNA, 22 bp, Homo sapiens
aagtgattaagtaacctaatat

SEQ ID NO: 7578813 - DNA, 22 bp, Homo sapiens
aagtgatacgtgtttatttcca

SEQ ID NO: 7578814 - DNA, 22 bp, Homo sapiens
aagtgatctaaagaatattgaa

SEQ ID NO: 7578815 - DNA, 22 bp, Homo sapiens
aagtgatacatctagtctataa

SEQ ID NO: 7578816 - DNA, 22 bp, Homo sapiens
aagtgatacctaggaaatcaag

SEQ ID NO: 7578817 - DNA, 22 bp, Homo sapiens
aagtgatgctacgactttgaca

SEQ ID NO: 7578818 - DNA, 22 bp, Homo sapiens
aagtgatgctacgactttgaca

SEQ ID NO: 7578819 - DNA, 22 bp, Homo sapiens
aagtgatgctacgactttgaca

SEQ ID NO: 7578820 - DNA, 22 bp, Homo sapiens
aagtgatgctacgactttgaca

SEQ ID NO: 7578821 - DNA, 22 bp, Homo sapiens
aagtgcaatgaatagctgcaat

SEQ ID NO: 7578822 - DNA, 22 bp, Homo sapiens
aagtgcaagcaggacttagttt

SEQ ID NO: 7578823 - DNA, 23 bp, Homo sapiens
aagtgcaagtgaaaggcacagtt

SEQ ID NO: 7578824 - DNA, 22 bp, Homo sapiens
aagtgcaagcaggacttagttt

SEQ ID NO: 7578825 - DNA, 22 bp, Homo sapiens
aagtgcaatgaatagctgcaat

SEQ ID NO: 7578826 - DNA, 22 bp, Homo sapiens
aagtgcaagcaggacttagttt

SEQ ID NO: 7578827 - DNA, 22 bp, Homo sapiens
aagtgcaagcaggacttagttt

SEQ ID NO: 7578828 - DNA, 21 bp, Homo sapiens
aagtgcaagatgcgcgcttgc

SEQ ID NO: 7578829 - DNA, 22 bp, Homo sapiens
aagtgcaaatttaagaaggcat

SEQ ID NO: 7578830 - DNA, 22 bp, Homo sapiens
aagtgcaagcaggacttagttt

SEQ ID NO: 7578831 - DNA, 22 bp, Homo sapiens
aagtgcaaatttaagaaggcat

SEQ ID NO: 7578832 - DNA, 22 bp, Homo sapiens
aagtgcaagatcaaggtgtcag

SEQ ID NO: 7578833 - DNA, 22 bp, Homo sapiens
aagtgcaaatttaagaaggcat

SEQ ID NO: 7578834 - DNA, 22 bp, Homo sapiens
aagtgcaggtctcagctactct

SEQ ID NO: 7578835 - DNA, 22 bp, Homo sapiens
aagtgcaggtctcagctactct

SEQ ID NO: 7578836 - DNA, 22 bp, Homo sapiens
aagtgcaggtctcagctactct

SEQ ID NO: 7578837 - DNA, 22 bp, Homo sapiens
aagtgcaggagtggggaaagta

SEQ ID NO: 7578838 - DNA, 22 bp, Homo sapiens
aagtgcaggagtggggaaagta

SEQ ID NO: 7578839 - DNA, 22 bp, Homo sapiens
aagtgcagagagctgacgaact

SEQ ID NO: 7578840 - DNA, 22 bp, Homo sapiens
aagtgcagagagctgacgaact

SEQ ID NO: 7578841 - DNA, 22 bp, Homo sapiens
aagtgcacttatagtaatatgt

SEQ ID NO: 7578842 - DNA, 22 bp, Homo sapiens
aagtgcacttatagtaatatgt

SEQ ID NO: 7578843 - DNA, 22 bp, Homo sapiens
aagtgcagagagctgacgaact

SEQ ID NO: 7578844 - DNA, 22 bp, Homo sapiens
aagtgcaatgaatagctgcaat

SEQ ID NO: 7578845 - DNA, 22 bp, Homo sapiens
aagtgcaatttgaaattctgca

SEQ ID NO: 7578846 - DNA, 22 bp, Homo sapiens
aagtgcaatttgaaattctgca

SEQ ID NO: 7578847 - DNA, 22 bp, Homo sapiens
aagtgcaatttgaaattctgca

SEQ ID NO: 7578848 - DNA, 22 bp, Homo sapiens
aagtgattttcctacttgctaa

SEQ ID NO: 7578849 - DNA, 22 bp, Homo sapiens
aagtgattttcctacttgctaa

SEQ ID NO: 7578850 - DNA, 22 bp, Homo sapiens
aagtgattttcccaccatctac

SEQ ID NO: 7578851 - DNA, 22 bp, Homo sapiens
aagtgatttgtacaaaatgtcg

SEQ ID NO: 7578852 - DNA, 22 bp, Homo sapiens
aagtgatttgtacaaaatgtcg

SEQ ID NO: 7578853 - DNA, 22 bp, Homo sapiens
aagtgattttcttcttagttat

SEQ ID NO: 7578854 - DNA, 22 bp, Homo sapiens
aagtgattttcttcttagttat

SEQ ID NO: 7578855 - DNA, 22 bp, Homo sapiens
aagtgcaaatctgtggctgaaa

SEQ ID NO: 7578856 - DNA, 22 bp, Homo sapiens
aagtgcaaatctgtggctgaaa

SEQ ID NO: 7578857 - DNA, 22 bp, Homo sapiens
aagtgcaaatctgtggctgaaa

SEQ ID NO: 7578858 - DNA, 22 bp, Homo sapiens
aagtgatttgcatgcttaattc

SEQ ID NO: 7578859 - DNA, 22 bp, Homo sapiens
aagtgatttgcatgcttaattc

SEQ ID NO: 7578860 - DNA, 22 bp, Homo sapiens
aagtgatttctgcctgcatgtt

SEQ ID NO: 7578861 - DNA, 22 bp, Homo sapiens
aagtgatttagtcttataaagg

SEQ ID NO: 7578862 - DNA, 22 bp, Homo sapiens
aagtgattgctggttttgccat

SEQ ID NO: 7578863 - DNA, 22 bp, Homo sapiens
aagtgattgttccgttgagtgt

SEQ ID NO: 7578864 - DNA, 22 bp, Homo sapiens
aagtgattgttccgttgagtgt

SEQ ID NO: 7578865 - DNA, 22 bp, Homo sapiens
aagtgatttagtcttataaagg

SEQ ID NO: 7578866 - DNA, 22 bp, Homo sapiens
aagtgatttagtcttataaagg

SEQ ID NO: 7578867 - DNA, 22 bp, Homo sapiens
aagtgatttagtcttataaagg

SEQ ID NO: 7578868 - DNA, 22 bp, Homo sapiens
aagtgattctccctacgcggga

SEQ ID NO: 7578869 - DNA, 22 bp, Homo sapiens
aagtgattctgatgtgtttctt

SEQ ID NO: 7578870 - DNA, 22 bp, Homo sapiens
acagctttttactaatagattg

SEQ ID NO: 7578871 - DNA, 22 bp, Homo sapiens
acagctttttactaatagattg

SEQ ID NO: 7578872 - DNA, 22 bp, Homo sapiens
acagctttttactaatagattg

SEQ ID NO: 7578873 - DNA, 22 bp, Homo sapiens
acaggaaagagctaggcatagg

SEQ ID NO: 7578874 - DNA, 22 bp, Homo sapiens
acaggaaagagctaggcatagg

SEQ ID NO: 7578875 - DNA, 22 bp, Homo sapiens
acaggaaagagctaggcatagg

SEQ ID NO: 7578876 - DNA, 22 bp, Homo sapiens
acaggaaagagctaggcatagg

SEQ ID NO: 7578877 - DNA, 22 bp, Homo sapiens
acaggaaagagctaggcatagg

SEQ ID NO: 7578878 - DNA, 22 bp, Homo sapiens
acaggaaagagctaggcatagg

SEQ ID NO: 7578879 - DNA, 22 bp, Homo sapiens
acaggaaagagctaggcatagg

SEQ ID NO: 7578880 - DNA, 22 bp, Homo sapiens
acagcttttgaaaaattactgg

SEQ ID NO: 7578881 - DNA, 22 bp, Homo sapiens
acagctttttactaatagattg

SEQ ID NO: 7578882 - DNA, 22 bp, Homo sapiens
acagctttttactaatagattg

SEQ ID NO: 7578883 - DNA, 22 bp, Homo sapiens
acagcttttgaaaaattactgg

SEQ ID NO: 7578884 - DNA, 22 bp, Homo sapiens
acagcttttgaaaaattactgg

SEQ ID NO: 7578885 - DNA, 22 bp, Homo sapiens
acagcttttgaaaaattactgg

SEQ ID NO: 7578886 - DNA, 22 bp, Homo sapiens
acagcttttgaaaaattactgg

SEQ ID NO: 7578887 - DNA, 22 bp, Homo sapiens
acagcttttcaattctgctgag

SEQ ID NO: 7578888 - DNA, 22 bp, Homo sapiens
acagcttttcaattctgctgag

SEQ ID NO: 7578889 - DNA, 22 bp, Homo sapiens
acagctttgggcaatgctatga

SEQ ID NO: 7578890 - DNA, 22 bp, Homo sapiens
acagctttgtgttaatgggaag

SEQ ID NO: 7578891 - DNA, 22 bp, Homo sapiens
acagctttgtgttaatgggaag

SEQ ID NO: 7578892 - DNA, 22 bp, Homo sapiens
acagcttttatgggaccagcca

SEQ ID NO: 7578893 - DNA, 23 bp, Homo sapiens
acagcttgccaattagccttccg

SEQ ID NO: 7578894 - DNA, 23 bp, Homo sapiens
acagcttgccaattagccttccg

SEQ ID NO: 7578895 - DNA, 22 bp, Homo sapiens
acagcttgtagaggccctggca

SEQ ID NO: 7578896 - DNA, 22 bp, Homo sapiens
acagcttggggaggccctggga

SEQ ID NO: 7578897 - DNA, 22 bp, Homo sapiens
acagcttggggaggccctggga

SEQ ID NO: 7578898 - DNA, 22 bp, Homo sapiens
acagcttgggatgctttatttc

SEQ ID NO: 7578899 - DNA, 22 bp, Homo sapiens
acagcttgtctaccccagaggt

SEQ ID NO: 7578900 - DNA, 22 bp, Homo sapiens
acagcttgtctggtttcaggtc

SEQ ID NO: 7578901 - DNA, 22 bp, Homo sapiens
acagcttgtctggtttcaggtc

SEQ ID NO: 7578902 - DNA, 22 bp, Homo sapiens
acagcttgtatcccaatggagc

SEQ ID NO: 7578903 - DNA, 22 bp, Homo sapiens
acagcttgtagaggccctggca

SEQ ID NO: 7578904 - DNA, 22 bp, Homo sapiens
acagcttgtatcccaatggagc

SEQ ID NO: 7578905 - DNA, 22 bp, Homo sapiens
acagcttgtctaccccagaggt

SEQ ID NO: 7578906 - DNA, 22 bp, Homo sapiens
acagcttgtctaccccagaggt

SEQ ID NO: 7578907 - DNA, 22 bp, Homo sapiens
acaggaaatgaaatggtatcta

SEQ ID NO: 7578908 - DNA, 22 bp, Homo sapiens
acaggaaattggcatatcagtt

SEQ ID NO: 7578909 - DNA, 22 bp, Homo sapiens
acaggaaattggcatatcagtt

SEQ ID NO: 7578910 - DNA, 22 bp, Homo sapiens
acaggaaattggcatatcagtt

SEQ ID NO: 7578911 - DNA, 22 bp, Homo sapiens
acaggaaagagctaggcatagg

SEQ ID NO: 7578912 - DNA, 22 bp, Homo sapiens
acaggaaagagctaggcatagg

SEQ ID NO: 7578913 - DNA, 22 bp, Homo sapiens
acaggaaatgaaatggtatcta

SEQ ID NO: 7578914 - DNA, 22 bp, Homo sapiens
acaggaaatgaaatggtatcta

SEQ ID NO: 7578915 - DNA, 22 bp, Homo sapiens
acaggaaatgaaatggtatcta

SEQ ID NO: 7578916 - DNA, 22 bp, Homo sapiens
acaggaacagcttgatggcatc

SEQ ID NO: 7578917 - DNA, 22 bp, Homo sapiens
acaggaacagcttgatggcatc

SEQ ID NO: 7578918 - DNA, 22 bp, Homo sapiens
acaggaacagcttgatggcatc

SEQ ID NO: 7578919 - DNA, 22 bp, Homo sapiens
acaggaaattggcatatcagtt

SEQ ID NO: 7578920 - DNA, 22 bp, Homo sapiens
acaggaaccaggcaggtcgatt

SEQ ID NO: 7578921 - DNA, 22 bp, Homo sapiens
acaggaaccaggcaggtcgatt

SEQ ID NO: 7578922 - DNA, 22 bp, Homo sapiens
acaggaaccaggcaggtcgatt

SEQ ID NO: 7578923 - DNA, 22 bp, Homo sapiens
acaggaaattggcatatcagtt

SEQ ID NO: 7578924 - DNA, 22 bp, Homo sapiens
acaggaaattggcatatcagtt

SEQ ID NO: 7578925 - DNA, 22 bp, Homo sapiens
acaggaaattggcatatcagtt

SEQ ID NO: 7578926 - DNA, 22 bp, Homo sapiens
acaggaaattggcatatcagtt

SEQ ID NO: 7578927 - DNA, 20 bp, Homo sapiens
acaggagatctgaggaaagg

SEQ ID NO: 7578928 - DNA, 21 bp, Homo sapiens
acaggagaccgcctggcagtc

SEQ ID NO: 7578929 - DNA, 21 bp, Homo sapiens
acaggagaccgcctggcagtc

SEQ ID NO: 7578930 - DNA, 21 bp, Homo sapiens
acaggagaccgcctggcagtc

SEQ ID NO: 7578931 - DNA, 21 bp, Homo sapiens
acaggagaccgcctggcagtc

SEQ ID NO: 7578932 - DNA, 21 bp, Homo sapiens
acaggagaccgcctggcagtc

SEQ ID NO: 7578933 - DNA, 21 bp, Homo sapiens
acaggagaccgcctggcagtc

SEQ ID NO: 7578934 - DNA, 22 bp, Homo sapiens
acaggagaccctgctggttctg

SEQ ID NO: 7578935 - DNA, 22 bp, Homo sapiens
acaggagaccctgctggttctg

SEQ ID NO: 7578936 - DNA, 22 bp, Homo sapiens
acaggaacccagaaacatttct

SEQ ID NO: 7578937 - DNA, 22 bp, Homo sapiens
acaggaacccagaaacatttct

SEQ ID NO: 7578938 - DNA, 22 bp, Homo sapiens
acaggagaccctgctggttctg

SEQ ID NO: 7578939 - DNA, 21 bp, Homo sapiens
acaggagaccgcctggcagtc

SEQ ID NO: 7578940 - DNA, 21 bp, Homo sapiens
acaggagaccgcctggcagtc

SEQ ID NO: 7578941 - DNA, 21 bp, Homo sapiens
acaggagaccgcctggcagtc

SEQ ID NO: 7578942 - DNA, 21 bp, Homo sapiens
acaggagaccgcctggcagtc

SEQ ID NO: 7578943 - DNA, 21 bp, Homo sapiens
acaggagaccgcctggcagtc

SEQ ID NO: 7578944 - DNA, 22 bp, Homo sapiens
acagatgaggaatttatttggt

SEQ ID NO: 7578945 - DNA, 22 bp, Homo sapiens
acagatgaggaagagtcagcca

SEQ ID NO: 7578946 - DNA, 22 bp, Homo sapiens
acagatttaggactgtagcgat

SEQ ID NO: 7578947 - DNA, 22 bp, Homo sapiens
acagatgaggaagagtcagcca

SEQ ID NO: 7578948 - DNA, 22 bp, Homo sapiens
acagatgaggaagagtcagcca

SEQ ID NO: 7578949 - DNA, 20 bp, Homo sapiens
acagatgaggaaaatgaagt

SEQ ID NO: 7578950 - DNA, 20 bp, Homo sapiens
acagatgaggaaaatgaagt

SEQ ID NO: 7578951 - DNA, 20 bp, Homo sapiens
acagatgaggaaaatgaagt

SEQ ID NO: 7578952 - DNA, 22 bp, Homo sapiens
acagatgaggaaacagggtcag

SEQ ID NO: 7578953 - DNA, 20 bp, Homo sapiens
acagatgaggaaaatgaagt

SEQ ID NO: 7578954 - DNA, 22 bp, Homo sapiens
acagatgagactccaggacctt

SEQ ID NO: 7578955 - DNA, 20 bp, Homo sapiens
acagatgaggaaaatgaagt

SEQ ID NO: 7578956 - DNA, 22 bp, Homo sapiens
acagatgagagacaatgtgcta

SEQ ID NO: 7578957 - DNA, 22 bp, Homo sapiens
acagatttattgaagctgctgc

SEQ ID NO: 7578958 - DNA, 22 bp, Homo sapiens
acagatttattgaagctgctgc

SEQ ID NO: 7578959 - DNA, 22 bp, Homo sapiens
acagatttgactggtacctggc

SEQ ID NO: 7578960 - DNA, 22 bp, Homo sapiens
acagatttgactggtacctggc

SEQ ID NO: 7578961 - DNA, 22 bp, Homo sapiens
acagatttgatctgagaacaaa

SEQ ID NO: 7578962 - DNA, 22 bp, Homo sapiens
acagatttggaggcctcacccc

SEQ ID NO: 7578963 - DNA, 22 bp, Homo sapiens
acagatttggaggcctcacccc

SEQ ID NO: 7578964 - DNA, 22 bp, Homo sapiens
acagatttgatctgagaacaaa

SEQ ID NO: 7578965 - DNA, 22 bp, Homo sapiens
acagatttgactggtacctggc

SEQ ID NO: 7578966 - DNA, 22 bp, Homo sapiens
acagattttaaatgacactccc

SEQ ID NO: 7578967 - DNA, 22 bp, Homo sapiens
acagattttaaatttgtagttg

SEQ ID NO: 7578968 - DNA, 22 bp, Homo sapiens
acagattttaaatgacactccc

SEQ ID NO: 7578969 - DNA, 22 bp, Homo sapiens
acagatttgttcttttgggcta

SEQ ID NO: 7578970 - DNA, 22 bp, Homo sapiens
acagatttggcccagccaatgc

SEQ ID NO: 7578971 - DNA, 22 bp, Homo sapiens
acagatttggcccagccaatgc

SEQ ID NO: 7578972 - DNA, 22 bp, Homo sapiens
acagatttggcccagccaatgc

SEQ ID NO: 7578973 - DNA, 22 bp, Homo sapiens
acagatttggcccagccaatgc

SEQ ID NO: 7578974 - DNA, 22 bp, Homo sapiens
acagattttggtatttgcaatg

SEQ ID NO: 7578975 - DNA, 22 bp, Homo sapiens
acagatttttcagctcctgtgt

SEQ ID NO: 7578976 - DNA, 22 bp, Homo sapiens
acagatttttggtaaataattt

SEQ ID NO: 7578977 - DNA, 22 bp, Homo sapiens
acagatttttcagctcctgtgt

SEQ ID NO: 7578978 - DNA, 22 bp, Homo sapiens
acagattttggtatttgcaatg

SEQ ID NO: 7578979 - DNA, 22 bp, Homo sapiens
acagattttggtatttgcaatg

SEQ ID NO: 7578980 - DNA, 22 bp, Homo sapiens
acagattttattattcaggtat

SEQ ID NO: 7578981 - DNA, 22 bp, Homo sapiens
acagattttattattcaggtat

SEQ ID NO: 7578982 - DNA, 22 bp, Homo sapiens
acagattttggtatttgcaatg

SEQ ID NO: 7578983 - DNA, 22 bp, Homo sapiens
acagattttggtatttgcaatg

SEQ ID NO: 7578984 - DNA, 22 bp, Homo sapiens
acagattttaaatttgtagttg

SEQ ID NO: 7578985 - DNA, 21 bp, Homo sapiens
acagattttatatctctgctg

SEQ ID NO: 7578986 - DNA, 22 bp, Homo sapiens
acagattttaaatttgtagttg

SEQ ID NO: 7578987 - DNA, 22 bp, Homo sapiens
acagattttattattcaggtat

SEQ ID NO: 7578988 - DNA, 22 bp, Homo sapiens
acagattttattattcaggtat

SEQ ID NO: 7578989 - DNA, 21 bp, Homo sapiens
acagattttatatctctgctg

SEQ ID NO: 7578990 - DNA, 16 bp, Homo sapiens
acagcttgaagctagg

SEQ ID NO: 7578991 - DNA, 22 bp, Homo sapiens
acagcttgaatcttaagctctt

SEQ ID NO: 7578992 - DNA, 22 bp, Homo sapiens
acagctggagtgttggtgaggt

SEQ ID NO: 7578993 - DNA, 22 bp, Homo sapiens
acagcttgcatgcagaggcact

SEQ ID NO: 7578994 - DNA, 22 bp, Homo sapiens
acagcttgcatgcagaggcact

SEQ ID NO: 7578995 - DNA, 22 bp, Homo sapiens
acagcttgcaatggctttcaac

SEQ ID NO: 7578996 - DNA, 22 bp, Homo sapiens
acagcttgcatgcagaggcact

SEQ ID NO: 7578997 - DNA, 22 bp, Homo sapiens
acagcttgcatgcagaggcact

SEQ ID NO: 7578998 - DNA, 22 bp, Homo sapiens
acagcttgcatgcagaggcact

SEQ ID NO: 7578999 - DNA, 22 bp, Homo sapiens
acagcttgcacaagggaactca

SEQ ID NO: 7579000 - DNA, 22 bp, Homo sapiens
acagcttgcaatggctttcaac

SEQ ID NO: 7579001 - DNA, 22 bp, Homo sapiens
acagcttgaatcttaagctctt

SEQ ID NO: 7579002 - DNA, 22 bp, Homo sapiens
acagctggagtgttggtgaggt

SEQ ID NO: 7579003 - DNA, 22 bp, Homo sapiens
acagctggagtgttggtgaggt

SEQ ID NO: 7579004 - DNA, 22 bp, Homo sapiens
acagatttttggtaaataattt

SEQ ID NO: 7579005 - DNA, 22 bp, Homo sapiens
acagatttttggtaaataattt

SEQ ID NO: 7579006 - DNA, 22 bp, Homo sapiens
acagatttttggtaaataattt

SEQ ID NO: 7579007 - DNA, 22 bp, Homo sapiens
acagatttttggtaaataattt

SEQ ID NO: 7579008 - DNA, 22 bp, Homo sapiens
acagatttttggtaaataattt

SEQ ID NO: 7579009 - DNA, 22 bp, Homo sapiens
acaggccagcctggggtaaggt

SEQ ID NO: 7579010 - DNA, 22 bp, Homo sapiens
acaggccagcctggggtaaggt

SEQ ID NO: 7579011 - DNA, 22 bp, Homo sapiens
acaggccagcctggggtaaggt

SEQ ID NO: 7579012 - DNA, 22 bp, Homo sapiens
acaggctctggggcaggatggc

SEQ ID NO: 7579013 - DNA, 22 bp, Homo sapiens
acaggctctggggcaggatggc

SEQ ID NO: 7579014 - DNA, 22 bp, Homo sapiens
acaggccagaggtggggcagcc

SEQ ID NO: 7579015 - DNA, 22 bp, Homo sapiens
aagccctggctcagctcaccag

SEQ ID NO: 7579016 - DNA, 22 bp, Homo sapiens
aagccctggctcagctcaccag

SEQ ID NO: 7579017 - DNA, 22 bp, Homo sapiens
acaggccagaggtggggcagcc

SEQ ID NO: 7579018 - DNA, 22 bp, Homo sapiens
acaggccagaggtggggcagcc

SEQ ID NO: 7579019 - DNA, 22 bp, Homo sapiens
aagccctggctcagctcaccag

SEQ ID NO: 7579020 - DNA, 22 bp, Homo sapiens
aagccctggcgggtggagggcc

SEQ ID NO: 7579021 - DNA, 22 bp, Homo sapiens
aagccctggctcagctcaccag

SEQ ID NO: 7579022 - DNA, 22 bp, Homo sapiens
aagccctggcgggtggagggcc

SEQ ID NO: 7579023 - DNA, 22 bp, Homo sapiens
aagccctggcgggtggagggcc

SEQ ID NO: 7579024 - DNA, 22 bp, Homo sapiens
aagccctggcgggtggagggcc

SEQ ID NO: 7579025 - DNA, 22 bp, Homo sapiens
aagccctggcgggtggagggcc

SEQ ID NO: 7579026 - DNA, 22 bp, Homo sapiens
aagccctggcgggtggagggcc

SEQ ID NO: 7579027 - DNA, 22 bp, Homo sapiens
aagccctggcccaaccttgatt

SEQ ID NO: 7579028 - DNA, 22 bp, Homo sapiens
aagccctggcccaaccttgatt

SEQ ID NO: 7579029 - DNA, 22 bp, Homo sapiens
aagccctggcaatgtcagatga

SEQ ID NO: 7579030 - DNA, 22 bp, Homo sapiens
aagccctggcaatgtcagatga

SEQ ID NO: 7579031 - DNA, 22 bp, Homo sapiens
aagccctggcccaaccttgatt

SEQ ID NO: 7579032 - DNA, 22 bp, Homo sapiens
aagccctggcccaaccttgatt

SEQ ID NO: 7579033 - DNA, 22 bp, Homo sapiens
aagccctggcccaaccttgatt

SEQ ID NO: 7579034 - DNA, 22 bp, Homo sapiens
aagccctggacggcccttcccc

SEQ ID NO: 7579035 - DNA, 22 bp, Homo sapiens
aagccctggatagagagaactg

SEQ ID NO: 7579036 - DNA, 22 bp, Homo sapiens
aagccctggacggcccttcccc

SEQ ID NO: 7579037 - DNA, 22 bp, Homo sapiens
aagccctggaactttcctagcc

SEQ ID NO: 7579038 - DNA, 22 bp, Homo sapiens
aagccctggacggcccttcccc

SEQ ID NO: 7579039 - DNA, 22 bp, Homo sapiens
aagccctgccacccattcactg

SEQ ID NO: 7579040 - DNA, 22 bp, Homo sapiens
aagccctggaactttcctagcc

SEQ ID NO: 7579041 - DNA, 22 bp, Homo sapiens
aagccctggaactttcctagcc

SEQ ID NO: 7579042 - DNA, 22 bp, Homo sapiens
aagccctgccacccattcactg

SEQ ID NO: 7579043 - DNA, 22 bp, Homo sapiens
aagccctgccacccattcactg

SEQ ID NO: 7579044 - DNA, 22 bp, Homo sapiens
aagccctggaactttcctagcc

SEQ ID NO: 7579045 - DNA, 22 bp, Homo sapiens
aagccctggaactttcctagcc

SEQ ID NO: 7579046 - DNA, 22 bp, Homo sapiens
aagccctggaactttcctagcc

SEQ ID NO: 7579047 - DNA, 22 bp, Homo sapiens
aagccctggattaaagatgcca

SEQ ID NO: 7579048 - DNA, 22 bp, Homo sapiens
aagccctggattaaagatgcca

SEQ ID NO: 7579049 - DNA, 22 bp, Homo sapiens
aagccctggatagagagaactg

SEQ ID NO: 7579050 - DNA, 22 bp, Homo sapiens
aagccctggattaaagatgcca

SEQ ID NO: 7579051 - DNA, 22 bp, Homo sapiens
aagccctggattaaagatgcca

SEQ ID NO: 7579052 - DNA, 22 bp, Homo sapiens
aagccctggattaaagatgcca

SEQ ID NO: 7579053 - DNA, 22 bp, Homo sapiens
aagccctggcaatgtcagatga

SEQ ID NO: 7579054 - DNA, 22 bp, Homo sapiens
aagccctggattaaagatgcca

SEQ ID NO: 7579055 - DNA, 22 bp, Homo sapiens
aagccctggattaaagatgcca

SEQ ID NO: 7579056 - DNA, 22 bp, Homo sapiens
aagccctggcaatgtcagatga

SEQ ID NO: 7579057 - DNA, 22 bp, Homo sapiens
aagccctggcaatgtcagatga

SEQ ID NO: 7579058 - DNA, 22 bp, Homo sapiens
aagccctggcaatgtcagatga

SEQ ID NO: 7579059 - DNA, 22 bp, Homo sapiens
aagccctgccacccattcactg

SEQ ID NO: 7579060 - DNA, 22 bp, Homo sapiens
aagccctgccacccattcactg

SEQ ID NO: 7579061 - DNA, 22 bp, Homo sapiens
aagccctgcagtctctgccaca

SEQ ID NO: 7579062 - DNA, 22 bp, Homo sapiens
aagccctgccacccattcactg

SEQ ID NO: 7579063 - DNA, 22 bp, Homo sapiens
aagccctgcagtctctgccaca

SEQ ID NO: 7579064 - DNA, 22 bp, Homo sapiens
aagccctgcagtctctgccaca

SEQ ID NO: 7579065 - DNA, 22 bp, Homo sapiens
aagccctgcagtctctgccaca

SEQ ID NO: 7579066 - DNA, 22 bp, Homo sapiens
aagccctgcagtctctgccaca

SEQ ID NO: 7579067 - DNA, 22 bp, Homo sapiens
aagccctgcagtctctgccaca

SEQ ID NO: 7579068 - DNA, 22 bp, Homo sapiens
aagccctgcagtctctgccaca

SEQ ID NO: 7579069 - DNA, 22 bp, Homo sapiens
aagccctgcagtctctgccaca

SEQ ID NO: 7579070 - DNA, 22 bp, Homo sapiens
aagccctgcagtctctgccaca

SEQ ID NO: 7579071 - DNA, 22 bp, Homo sapiens
aagccctgagcactgcagagaa

SEQ ID NO: 7579072 - DNA, 22 bp, Homo sapiens
aagccctgagcactgcagagaa

SEQ ID NO: 7579073 - DNA, 22 bp, Homo sapiens
aagccctgataggaaaatgctg

SEQ ID NO: 7579074 - DNA, 22 bp, Homo sapiens
aagccctgataggaaaatgctg

SEQ ID NO: 7579075 - DNA, 22 bp, Homo sapiens
aagccctgataggaaaatgctg

SEQ ID NO: 7579076 - DNA, 22 bp, Homo sapiens
aagccctgagcactgcagagaa

SEQ ID NO: 7579077 - DNA, 22 bp, Homo sapiens
aagccctgagcactgcagagaa

SEQ ID NO: 7579078 - DNA, 22 bp, Homo sapiens
aagccctgagcactgcagagaa

SEQ ID NO: 7579079 - DNA, 22 bp, Homo sapiens
aagccctgagcactgcagagaa

SEQ ID NO: 7579080 - DNA, 22 bp, Homo sapiens
aagccctgagcactgcagagaa

SEQ ID NO: 7579081 - DNA, 22 bp, Homo sapiens
aagccctgactatgaagacata

SEQ ID NO: 7579082 - DNA, 22 bp, Homo sapiens
aagccctgacctgagagtccgt

SEQ ID NO: 7579083 - DNA, 22 bp, Homo sapiens
aagccctgactatgaagacata

SEQ ID NO: 7579084 - DNA, 22 bp, Homo sapiens
aagccctgactatgaagacata

SEQ ID NO: 7579085 - DNA, 22 bp, Homo sapiens
aagccctgactatgaagacata

SEQ ID NO: 7579086 - DNA, 22 bp, Homo sapiens
acaggcagagtcaggttgggtt

SEQ ID NO: 7579087 - DNA, 22 bp, Homo sapiens
acaggcagagtcaggttgggtt

SEQ ID NO: 7579088 - DNA, 22 bp, Homo sapiens
acaggcagagtcaggttgggtt

SEQ ID NO: 7579089 - DNA, 22 bp, Homo sapiens
acaggcagagagtggcggactc

SEQ ID NO: 7579090 - DNA, 22 bp, Homo sapiens
acaggcagagtcaggttgggtt

SEQ ID NO: 7579091 - DNA, 22 bp, Homo sapiens
acaggcagagtcaggttgggtt

SEQ ID NO: 7579092 - DNA, 22 bp, Homo sapiens
acaggcagagtcaggttgggtt

SEQ ID NO: 7579093 - DNA, 22 bp, Homo sapiens
acaggcagagagtggcggactc

SEQ ID NO: 7579094 - DNA, 22 bp, Homo sapiens
acaggcagagagtggcggactc

SEQ ID NO: 7579095 - DNA, 22 bp, Homo sapiens
acaggcagagagtggcggactc

SEQ ID NO: 7579096 - DNA, 22 bp, Homo sapiens
acaggcagagagtggcggactc

SEQ ID NO: 7579097 - DNA, 22 bp, Homo sapiens
acaggcagagagtggcggactc

SEQ ID NO: 7579098 - DNA, 22 bp, Homo sapiens
acaggcagagagtggcggactc

SEQ ID NO: 7579099 - DNA, 22 bp, Homo sapiens
acaggcagagagtggcggactc

SEQ ID NO: 7579100 - DNA, 22 bp, Homo sapiens
acaggcagagagtggcggactc

SEQ ID NO: 7579101 - DNA, 22 bp, Homo sapiens
acaggcagagagtggcggactc

SEQ ID NO: 7579102 - DNA, 22 bp, Homo sapiens
acaggcagagagtggcggactc

SEQ ID NO: 7579103 - DNA, 22 bp, Homo sapiens
acaggcagagagtggcggactc

SEQ ID NO: 7579104 - DNA, 22 bp, Homo sapiens
acaggcagagaactcagccaga

SEQ ID NO: 7579105 - DNA, 22 bp, Homo sapiens
acaggcagagaactcagccaga

SEQ ID NO: 7579106 - DNA, 22 bp, Homo sapiens
acaggcagagaactcagccaga

SEQ ID NO: 7579107 - DNA, 22 bp, Homo sapiens
acaggcagagaactcagccaga

SEQ ID NO: 7579108 - DNA, 22 bp, Homo sapiens
acaggcagagaactcagccaga

SEQ ID NO: 7579109 - DNA, 22 bp, Homo sapiens
acaggcagagaactcagccaga

SEQ ID NO: 7579110 - DNA, 22 bp, Homo sapiens
acaggcagagaactcagccaga

SEQ ID NO: 7579111 - DNA, 22 bp, Homo sapiens
acaggaggagcagctgtgtgcc

SEQ ID NO: 7579112 - DNA, 22 bp, Homo sapiens
acaggagctctagggacagcac

SEQ ID NO: 7579113 - DNA, 22 bp, Homo sapiens
acaggagctctagggacagcac

SEQ ID NO: 7579114 - DNA, 22 bp, Homo sapiens
acaggaggagcagctgtgtgcc

SEQ ID NO: 7579115 - DNA, 22 bp, Homo sapiens
acaggaggagcagctgtgtgcc

SEQ ID NO: 7579116 - DNA, 22 bp, Homo sapiens
acaggaggagcagctgtgtgcc

SEQ ID NO: 7579117 - DNA, 22 bp, Homo sapiens
acaggaggagcagctgtgtgcc

SEQ ID NO: 7579118 - DNA, 22 bp, Homo sapiens
acaggagcccaggatgggcgga

SEQ ID NO: 7579119 - DNA, 22 bp, Homo sapiens
acaggagctctagggacagcac

SEQ ID NO: 7579120 - DNA, 22 bp, Homo sapiens
acaggagctctagggacagcac

SEQ ID NO: 7579121 - DNA, 22 bp, Homo sapiens
acaggaggagctgtttcaggga

SEQ ID NO: 7579122 - DNA, 22 bp, Homo sapiens
acaggaggagctgtttcaggga

SEQ ID NO: 7579123 - DNA, 22 bp, Homo sapiens
acaggaggagctgtttcaggga

SEQ ID NO: 7579124 - DNA, 22 bp, Homo sapiens
acaggaggagcagctgtgtgcc

SEQ ID NO: 7579125 - DNA, 22 bp, Homo sapiens
acaggaggagctgtttcaggga

SEQ ID NO: 7579126 - DNA, 22 bp, Homo sapiens
acaggaggagctgtttcaggga

SEQ ID NO: 7579127 - DNA, 22 bp, Homo sapiens
acaggaggagcagctgtgtgcc

SEQ ID NO: 7579128 - DNA, 22 bp, Homo sapiens
acaggaggagcagctgtgtgcc

SEQ ID NO: 7579129 - DNA, 22 bp, Homo sapiens
acaggaggagcagctgtgtgcc

SEQ ID NO: 7579130 - DNA, 22 bp, Homo sapiens
acaggaggagcagctgtgtgcc

SEQ ID NO: 7579131 - DNA, 22 bp, Homo sapiens
acaggaggagcagctgtgtgcc

SEQ ID NO: 7579132 - DNA, 20 bp, Homo sapiens
acaggagatctgaggaaagg

SEQ ID NO: 7579133 - DNA, 20 bp, Homo sapiens
acaggagatctgaggaaagg

SEQ ID NO: 7579134 - DNA, 20 bp, Homo sapiens
acaggagatctgaggaaagg

SEQ ID NO: 7579135 - DNA, 20 bp, Homo sapiens
acaggagatctgaggaaagg

SEQ ID NO: 7579136 - DNA, 20 bp, Homo sapiens
acaggagatctgaggaaagg

SEQ ID NO: 7579137 - DNA, 20 bp, Homo sapiens
acaggagatctgaggaaagg

SEQ ID NO: 7579138 - DNA, 20 bp, Homo sapiens
acaggagatctgaggaaagg

SEQ ID NO: 7579139 - DNA, 20 bp, Homo sapiens
acaggagatctgaggaaagg

SEQ ID NO: 7579140 - DNA, 22 bp, Homo sapiens
acaggagcaacagactaagaca

SEQ ID NO: 7579141 - DNA, 22 bp, Homo sapiens
acaggagcaacagactaagaca

SEQ ID NO: 7579142 - DNA, 22 bp, Homo sapiens
acaggagccaaacacatgccag

SEQ ID NO: 7579143 - DNA, 22 bp, Homo sapiens
acaggagccaaacacatgccag

SEQ ID NO: 7579144 - DNA, 22 bp, Homo sapiens
acaggagcccaggatgggcgga

SEQ ID NO: 7579145 - DNA, 22 bp, Homo sapiens
acaggagccaaacacatgccag

SEQ ID NO: 7579146 - DNA, 22 bp, Homo sapiens
acaggagcccaggatgggcgga

SEQ ID NO: 7579147 - DNA, 22 bp, Homo sapiens
acaggagccaaacacatgccag

SEQ ID NO: 7579148 - DNA, 22 bp, Homo sapiens
acaggagccaaacacatgccag

SEQ ID NO: 7579149 - DNA, 19 bp, Homo sapiens
acaggcagaattgggtgtg

SEQ ID NO: 7579150 - DNA, 19 bp, Homo sapiens
acaggcagaattgggtgtg

SEQ ID NO: 7579151 - DNA, 19 bp, Homo sapiens
acaggcagaattgggtgtg

SEQ ID NO: 7579152 - DNA, 19 bp, Homo sapiens
acaggcagaattgggtgtg

SEQ ID NO: 7579153 - DNA, 19 bp, Homo sapiens
acaggcagaattgggtgtg

SEQ ID NO: 7579154 - DNA, 19 bp, Homo sapiens
acaggcagaattgggtgtg

SEQ ID NO: 7579155 - DNA, 19 bp, Homo sapiens
acaggcagaattgggtgtg

SEQ ID NO: 7579156 - DNA, 22 bp, Homo sapiens
acaggcactttgacatgccatc

SEQ ID NO: 7579157 - DNA, 22 bp, Homo sapiens
acaggcagagaactcagccaga

SEQ ID NO: 7579158 - DNA, 22 bp, Homo sapiens
acaggcagagaactcagccaga

SEQ ID NO: 7579159 - DNA, 22 bp, Homo sapiens
acaggcagagaactcagccaga

SEQ ID NO: 7579160 - DNA, 22 bp, Homo sapiens
acaggcagagaactcagccaga

SEQ ID NO: 7579161 - DNA, 19 bp, Homo sapiens
acaggcagaattgggtgtg

SEQ ID NO: 7579162 - DNA, 19 bp, Homo sapiens
acaggcagaattgggtgtg

SEQ ID NO: 7579163 - DNA, 22 bp, Homo sapiens
acaggcagagaactcagccaga

SEQ ID NO: 7579164 - DNA, 22 bp, Homo sapiens
acaggcagagaactcagccaga

SEQ ID NO: 7579165 - DNA, 22 bp, Homo sapiens
acaggcagagaactcagccaga

SEQ ID NO: 7579166 - DNA, 22 bp, Homo sapiens
acaggcactttgacatgccatc

SEQ ID NO: 7579167 - DNA, 22 bp, Homo sapiens
acaggcactttgacatgccatc

SEQ ID NO: 7579168 - DNA, 22 bp, Homo sapiens
acaggcactttgacatgccatc

SEQ ID NO: 7579169 - DNA, 22 bp, Homo sapiens
acaggcactttgacatgccatc

SEQ ID NO: 7579170 - DNA, 22 bp, Homo sapiens
acaggcactttgacatgccatc

SEQ ID NO: 7579171 - DNA, 22 bp, Homo sapiens
acaggcactgtcaagtcatgaa

SEQ ID NO: 7579172 - DNA, 22 bp, Homo sapiens
acaggcactgtcaagtcatgaa

SEQ ID NO: 7579173 - DNA, 22 bp, Homo sapiens
acaggcactgtcaagtcatgaa

SEQ ID NO: 7579174 - DNA, 22 bp, Homo sapiens
acaggcactgtcaagtcatgaa

SEQ ID NO: 7579175 - DNA, 22 bp, Homo sapiens
acaggcacctgccaccacatct

SEQ ID NO: 7579176 - DNA, 22 bp, Homo sapiens
acaggcacctgccaccacatct

SEQ ID NO: 7579177 - DNA, 22 bp, Homo sapiens
acaggaggagctgtttcaggga

SEQ ID NO: 7579178 - DNA, 22 bp, Homo sapiens
acaggcactctcattaaaatag

SEQ ID NO: 7579179 - DNA, 22 bp, Homo sapiens
acaggcactctcattaaaatag

SEQ ID NO: 7579180 - DNA, 22 bp, Homo sapiens
acaggcactgtcaagtcatgaa

SEQ ID NO: 7579181 - DNA, 22 bp, Homo sapiens
acaggcactgtcaagtcatgaa

SEQ ID NO: 7579182 - DNA, 22 bp, Homo sapiens
acaggcactgtcaagtcatgaa

SEQ ID NO: 7579183 - DNA, 22 bp, Homo sapiens
acagtgcagtgtgatgagtatt

SEQ ID NO: 7579184 - DNA, 22 bp, Homo sapiens
acagtgcagtgtgatgagtatt

SEQ ID NO: 7579185 - DNA, 22 bp, Homo sapiens
acagtgcagtgtgatgagtatt

SEQ ID NO: 7579186 - DNA, 22 bp, Homo sapiens
acagtgcagtgtgatgagtatt

SEQ ID NO: 7579187 - DNA, 22 bp, Homo sapiens
acagtgcataaaaacaactttt

SEQ ID NO: 7579188 - DNA, 22 bp, Homo sapiens
acagtgcataaaaacaactttt

SEQ ID NO: 7579189 - DNA, 22 bp, Homo sapiens
acagtgcataaaaacaactttt

SEQ ID NO: 7579190 - DNA, 22 bp, Homo sapiens
acagtctttgcaggagaaagga

SEQ ID NO: 7579191 - DNA, 22 bp, Homo sapiens
acagtgcaggtctcaacaatta

SEQ ID NO: 7579192 - DNA, 22 bp, Homo sapiens
acagtgcaggtctcaacaatta

SEQ ID NO: 7579193 - DNA, 22 bp, Homo sapiens
acagtgcaggtctcaacaatta

SEQ ID NO: 7579194 - DNA, 22 bp, Homo sapiens
acagtctttgcagaagcaatat

SEQ ID NO: 7579195 - DNA, 22 bp, Homo sapiens
acagtctttgcagaagcaatat

SEQ ID NO: 7579196 - DNA, 22 bp, Homo sapiens
acagtctttgcagaagcaatat

SEQ ID NO: 7579197 - DNA, 22 bp, Homo sapiens
acagtctttgcaggagaaagga

SEQ ID NO: 7579198 - DNA, 22 bp, Homo sapiens
acagtctttgcaaagtcctggt

SEQ ID NO: 7579199 - DNA, 22 bp, Homo sapiens
acagtctttctacattctgtgc

SEQ ID NO: 7579200 - DNA, 22 bp, Homo sapiens
acagtctttctacattctgtgc

SEQ ID NO: 7579201 - DNA, 22 bp, Homo sapiens
acagtgctaaacacttcttgaa

SEQ ID NO: 7579202 - DNA, 22 bp, Homo sapiens
acagtgctaaacacttcttgaa

SEQ ID NO: 7579203 - DNA, 22 bp, Homo sapiens
acagtgcattattgctgaatgc

SEQ ID NO: 7579204 - DNA, 22 bp, Homo sapiens
acagtgcattattgctgaatgc

SEQ ID NO: 7579205 - DNA, 22 bp, Homo sapiens
acagtgcattattgctgaatgc

SEQ ID NO: 7579206 - DNA, 22 bp, Homo sapiens
acagtgcattattgctgaatgc

SEQ ID NO: 7579207 - DNA, 22 bp, Homo sapiens
acagtgccctatgaacagctct

SEQ ID NO: 7579208 - DNA, 22 bp, Homo sapiens
acagtgccctatgaacagctct

SEQ ID NO: 7579209 - DNA, 19 bp, Homo sapiens
acagtgcatgggacctggt

SEQ ID NO: 7579210 - DNA, 19 bp, Homo sapiens
acagtgcatgggacctggt

SEQ ID NO: 7579211 - DNA, 20 bp, Homo sapiens
acagtgcatggggggacagc

SEQ ID NO: 7579212 - DNA, 20 bp, Homo sapiens
acagtgcatggggggacagc

SEQ ID NO: 7579213 - DNA, 19 bp, Homo sapiens
acagtgcatgggacctggt

SEQ ID NO: 7579214 - DNA, 20 bp, Homo sapiens
acagtgcatggggggacagc

SEQ ID NO: 7579215 - DNA, 22 bp, Homo sapiens
acaggtgtatgaatatgttcca

SEQ ID NO: 7579216 - DNA, 22 bp, Homo sapiens
acaggtgtctgcaagttactgg

SEQ ID NO: 7579217 - DNA, 22 bp, Homo sapiens
acaggtgtctaaggcagacagc

SEQ ID NO: 7579218 - DNA, 22 bp, Homo sapiens
acaggtgtcctcacagggggtg

SEQ ID NO: 7579219 - DNA, 22 bp, Homo sapiens
acagtctttctacattctgtgc

SEQ ID NO: 7579220 - DNA, 22 bp, Homo sapiens
acagtctttctacattctgtgc

SEQ ID NO: 7579221 - DNA, 22 bp, Homo sapiens
acagtctttctacattctgtgc

SEQ ID NO: 7579222 - DNA, 22 bp, Homo sapiens
acagtctttctacattctgtgc

SEQ ID NO: 7579223 - DNA, 22 bp, Homo sapiens
acaggtgtgagaacatgccttg

SEQ ID NO: 7579224 - DNA, 22 bp, Homo sapiens
acaggtgtgagaacatgccttg

SEQ ID NO: 7579225 - DNA, 22 bp, Homo sapiens
acaggtgattcaggctctggga

SEQ ID NO: 7579226 - DNA, 22 bp, Homo sapiens
acaggtgataagaaaactcgct

SEQ ID NO: 7579227 - DNA, 18 bp, Homo sapiens
acaggtgatatcttgaga

SEQ ID NO: 7579228 - DNA, 18 bp, Homo sapiens
acaggtgatatcttgaga

SEQ ID NO: 7579229 - DNA, 22 bp, Homo sapiens
acaggtgtagaaaacagattat

SEQ ID NO: 7579230 - DNA, 22 bp, Homo sapiens
acaggtgtagcaggagcatcaa

SEQ ID NO: 7579231 - DNA, 22 bp, Homo sapiens
acaggtgtagcaggagcatcaa

SEQ ID NO: 7579232 - DNA, 22 bp, Homo sapiens
acaggtgtaggtacatttgcat

SEQ ID NO: 7579233 - DNA, 22 bp, Homo sapiens
acagtgtccccagctctgtgag

SEQ ID NO: 7579234 - DNA, 22 bp, Homo sapiens
acagtttactggccttgccgtt

SEQ ID NO: 7579235 - DNA, 22 bp, Homo sapiens
acagtttactggccttgccgtt

SEQ ID NO: 7579236 - DNA, 22 bp, Homo sapiens
acagtttagaatgccacatagt

SEQ ID NO: 7579237 - DNA, 22 bp, Homo sapiens
acagtttagaatgccacatagt

SEQ ID NO: 7579238 - DNA, 22 bp, Homo sapiens
acataacaatcataggacatag

SEQ ID NO: 7579239 - DNA, 22 bp, Homo sapiens
acagtttagaatgccacatagt

SEQ ID NO: 7579240 - DNA, 22 bp, Homo sapiens
acagtttacagggatttgagct

SEQ ID NO: 7579241 - DNA, 22 bp, Homo sapiens
acagtgtccttgtggtccctgt

SEQ ID NO: 7579242 - DNA, 22 bp, Homo sapiens
acagtgtccccagctctgtgag

SEQ ID NO: 7579243 - DNA, 22 bp, Homo sapiens
acagtgtccttgtggtccctgt

SEQ ID NO: 7579244 - DNA, 22 bp, Homo sapiens
acagtgtccccagctctgtgag

SEQ ID NO: 7579245 - DNA, 22 bp, Homo sapiens
acagtgtcatcagtttctcaac

SEQ ID NO: 7579246 - DNA, 22 bp, Homo sapiens
acagtgtcatgtcgtgttcccc

SEQ ID NO: 7579247 - DNA, 22 bp, Homo sapiens
acagtgtccccagctctgtgag

SEQ ID NO: 7579248 - DNA, 22 bp, Homo sapiens
acagtgtccccagctctgtgag

SEQ ID NO: 7579249 - DNA, 22 bp, Homo sapiens
acagtgtcatcagtttctcaac

SEQ ID NO: 7579250 - DNA, 22 bp, Homo sapiens
acagtgtcatcagtttctcaac

SEQ ID NO: 7579251 - DNA, 22 bp, Homo sapiens
acagtgtcatcagtttctcaac

SEQ ID NO: 7579252 - DNA, 22 bp, Homo sapiens
acagtgtcatgtcgtgttcccc

SEQ ID NO: 7579253 - DNA, 22 bp, Homo sapiens
acagtgtatgatatttcacagt

SEQ ID NO: 7579254 - DNA, 22 bp, Homo sapiens
acagtgtatgatatttcacagt

SEQ ID NO: 7579255 - DNA, 22 bp, Homo sapiens
acagtgtataaaatcttaaaga

SEQ ID NO: 7579256 - DNA, 22 bp, Homo sapiens
acagtgtagcatggtagcaatg

SEQ ID NO: 7579257 - DNA, 22 bp, Homo sapiens
acagtgtagcatggtagcaatg

SEQ ID NO: 7579258 - DNA, 22 bp, Homo sapiens
acagtgtagcatggtagcaatg

SEQ ID NO: 7579259 - DNA, 22 bp, Homo sapiens
acagtgtagtgtgatgtcaaaa

SEQ ID NO: 7579260 - DNA, 22 bp, Homo sapiens
acagtgtagtgtgatgtcaaaa

SEQ ID NO: 7579261 - DNA, 22 bp, Homo sapiens
acagtgtagtgtgatgtcaaaa

SEQ ID NO: 7579262 - DNA, 22 bp, Homo sapiens
acagtgtagcatggtagcaatg

SEQ ID NO: 7579263 - DNA, 22 bp, Homo sapiens
acagtgtactaggtacatgttc

SEQ ID NO: 7579264 - DNA, 22 bp, Homo sapiens
acagtgtactcctttaccggag

SEQ ID NO: 7579265 - DNA, 22 bp, Homo sapiens
acagtgtagaatcctgtactta

SEQ ID NO: 7579266 - DNA, 22 bp, Homo sapiens
acagtgtactaggtacatgttc

SEQ ID NO: 7579267 - DNA, 20 bp, Homo sapiens
acagtgtaatattcacattc

SEQ ID NO: 7579268 - DNA, 22 bp, Homo sapiens
acagtgtaattcatggctgaaa

SEQ ID NO: 7579269 - DNA, 22 bp, Homo sapiens
acagtgctatcaatagctagaa

SEQ ID NO: 7579270 - DNA, 22 bp, Homo sapiens
acagtgctcatgtgacatggtg

SEQ ID NO: 7579271 - DNA, 22 bp, Homo sapiens
acagtgctcatgtgacatggtg

SEQ ID NO: 7579272 - DNA, 22 bp, Homo sapiens
acagtgctatcaatagctagaa

SEQ ID NO: 7579273 - DNA, 22 bp, Homo sapiens
acagtgctaatgatgccaagat

SEQ ID NO: 7579274 - DNA, 22 bp, Homo sapiens
acagtgctgaacgacatggaag

SEQ ID NO: 7579275 - DNA, 22 bp, Homo sapiens
acagtgctgaacgacatggaag

SEQ ID NO: 7579276 - DNA, 22 bp, Homo sapiens
acagtgctgaacgacatggaag

SEQ ID NO: 7579277 - DNA, 22 bp, Homo sapiens
acagtgctgaacgacatggaag

SEQ ID NO: 7579278 - DNA, 22 bp, Homo sapiens
acagtgctcatgtgacatggtg

SEQ ID NO: 7579279 - DNA, 22 bp, Homo sapiens
acagtgctgatctagactgacc

SEQ ID NO: 7579280 - DNA, 22 bp, Homo sapiens
acagtgctgatctagactgacc

SEQ ID NO: 7579281 - DNA, 22 bp, Homo sapiens
acagtgctgtcaaatatgtttt

SEQ ID NO: 7579282 - DNA, 18 bp, Homo sapiens
acagtgctgtcactgctt

SEQ ID NO: 7579283 - DNA, 18 bp, Homo sapiens
acagtgctgtcactgctt

SEQ ID NO: 7579284 - DNA, 22 bp, Homo sapiens
acagtgctgtctatctcactaa

SEQ ID NO: 7579285 - DNA, 22 bp, Homo sapiens
acagtgctgtctatctcactaa

SEQ ID NO: 7579286 - DNA, 20 bp, Homo sapiens
acagtgggtggggagcactg

SEQ ID NO: 7579287 - DNA, 22 bp, Homo sapiens
acagtgctgtcaaatatgtttt

SEQ ID NO: 7579288 - DNA, 22 bp, Homo sapiens
acagtggtaggataactgtttt

SEQ ID NO: 7579289 - DNA, 22 bp, Homo sapiens
acagtggtaggataactgtttt

SEQ ID NO: 7579290 - DNA, 20 bp, Homo sapiens
acagtgggtggggagcactg

SEQ ID NO: 7579291 - DNA, 20 bp, Homo sapiens
acagtgtaatattcacattc

SEQ ID NO: 7579292 - DNA, 22 bp, Homo sapiens
acagtgtaatatgggagtcagt

SEQ ID NO: 7579293 - DNA, 18 bp, Homo sapiens
acagtggtttgatgtgct

SEQ ID NO: 7579294 - DNA, 22 bp, Homo sapiens
acagtgtaatatgggagtcagt

SEQ ID NO: 7579295 - DNA, 18 bp, Homo sapiens
acagtggtttgatgtgct

SEQ ID NO: 7579296 - DNA, 22 bp, Homo sapiens
acagtggtggctttgctatgct

SEQ ID NO: 7579297 - DNA, 22 bp, Homo sapiens
acagtggtggctttgctatgct

SEQ ID NO: 7579298 - DNA, 22 bp, Homo sapiens
acagtggtaggataactgtttt

SEQ ID NO: 7579299 - DNA, 22 bp, Homo sapiens
acagtggtgagtgactgatagg

SEQ ID NO: 7579300 - DNA, 22 bp, Homo sapiens
acaggcttcattacttcagcgt

SEQ ID NO: 7579301 - DNA, 22 bp, Homo sapiens
acaggcttcattacttcagcgt

SEQ ID NO: 7579302 - DNA, 22 bp, Homo sapiens
acaggcttctcacagaaaaggg

SEQ ID NO: 7579303 - DNA, 22 bp, Homo sapiens
acaggcttctcacagaaaaggg

SEQ ID NO: 7579304 - DNA, 22 bp, Homo sapiens
acaggcttcagatgtattaact

SEQ ID NO: 7579305 - DNA, 22 bp, Homo sapiens
acaggcttagggcttgggcccg

SEQ ID NO: 7579306 - DNA, 22 bp, Homo sapiens
acaggcttcagatgtattaact

SEQ ID NO: 7579307 - DNA, 22 bp, Homo sapiens
acaggcttagggcaggctgacc

SEQ ID NO: 7579308 - DNA, 22 bp, Homo sapiens
acaggcttagggcaggctgacc

SEQ ID NO: 7579309 - DNA, 22 bp, Homo sapiens
acaggcttagggcaggctgacc

SEQ ID NO: 7579310 - DNA, 22 bp, Homo sapiens
acaggcttagggcaggctgacc

SEQ ID NO: 7579311 - DNA, 18 bp, Homo sapiens
acaggcttaggaaatgtg

SEQ ID NO: 7579312 - DNA, 18 bp, Homo sapiens
acaggcttaggaaatgtg

SEQ ID NO: 7579313 - DNA, 22 bp, Homo sapiens
acaggcttggggctcagacaga

SEQ ID NO: 7579314 - DNA, 22 bp, Homo sapiens
acaggcttggcagctatcattt

SEQ ID NO: 7579315 - DNA, 22 bp, Homo sapiens
acaggctttaaatttaaaacca

SEQ ID NO: 7579316 - DNA, 22 bp, Homo sapiens
acaggctttaaatttaaaacca

SEQ ID NO: 7579317 - DNA, 22 bp, Homo sapiens
acaggcttgcactagggtggca

SEQ ID NO: 7579318 - DNA, 22 bp, Homo sapiens
acaggcttggggctcagacaga

SEQ ID NO: 7579319 - DNA, 22 bp, Homo sapiens
acaggcttggggctcagacaga

SEQ ID NO: 7579320 - DNA, 22 bp, Homo sapiens
acaggcttgcactagggtggca

SEQ ID NO: 7579321 - DNA, 22 bp, Homo sapiens
acaggcttgcactagggtggca

SEQ ID NO: 7579322 - DNA, 22 bp, Homo sapiens
acaggcttctcacagaaaaggg

SEQ ID NO: 7579323 - DNA, 22 bp, Homo sapiens
acaggcttcttttgaaatcaga

SEQ ID NO: 7579324 - DNA, 22 bp, Homo sapiens
acaggcttacaggctgcaagta

SEQ ID NO: 7579325 - DNA, 22 bp, Homo sapiens
acaggcttactgtttcataggg

SEQ ID NO: 7579326 - DNA, 22 bp, Homo sapiens
acaggcttacaggctgcaagta

SEQ ID NO: 7579327 - DNA, 22 bp, Homo sapiens
acaggcttacaggctgcaagta

SEQ ID NO: 7579328 - DNA, 22 bp, Homo sapiens
acaggctgttggggtccagggt

SEQ ID NO: 7579329 - DNA, 22 bp, Homo sapiens
acaggctgttggggtccagggt

SEQ ID NO: 7579330 - DNA, 22 bp, Homo sapiens
acaggctgccacttgcatccaa

SEQ ID NO: 7579331 - DNA, 22 bp, Homo sapiens
acaggctgccacttgcatccaa

SEQ ID NO: 7579332 - DNA, 22 bp, Homo sapiens
acaggctgccacttgcatccaa

SEQ ID NO: 7579333 - DNA, 22 bp, Homo sapiens
acaggctgccacttgcatccaa

SEQ ID NO: 7579334 - DNA, 22 bp, Homo sapiens
acaggctgccacttgcatccaa

SEQ ID NO: 7579335 - DNA, 22 bp, Homo sapiens
acaggctgccacttgcatccaa

SEQ ID NO: 7579336 - DNA, 22 bp, Homo sapiens
acaggctgatagaccataaata

SEQ ID NO: 7579337 - DNA, 22 bp, Homo sapiens
acaggctgatagaccataaata

SEQ ID NO: 7579338 - DNA, 22 bp, Homo sapiens
acaggctgccacttgcatccaa

SEQ ID NO: 7579339 - DNA, 23 bp, Homo sapiens
acaggctcttaatcagtgctcct

SEQ ID NO: 7579340 - DNA, 23 bp, Homo sapiens
acaggctcttaatcagtgctcct

SEQ ID NO: 7579341 - DNA, 23 bp, Homo sapiens
acaggctcttaatcagtgctcct

SEQ ID NO: 7579342 - DNA, 23 bp, Homo sapiens
acaggctcttaatcagtgctcct

SEQ ID NO: 7579343 - DNA, 22 bp, Homo sapiens
acaggctgaaagttaagttctg

SEQ ID NO: 7579344 - DNA, 22 bp, Homo sapiens
acaggctgaaagttaagttctg

SEQ ID NO: 7579345 - DNA, 22 bp, Homo sapiens
acaggctgaaagttaagttctg

SEQ ID NO: 7579346 - DNA, 22 bp, Homo sapiens
acaggctgaaagttaagttctg

SEQ ID NO: 7579347 - DNA, 22 bp, Homo sapiens
acaggctgaaagttaagttctg

SEQ ID NO: 7579348 - DNA, 22 bp, Homo sapiens
acaggctgaaagttaagttctg

SEQ ID NO: 7579349 - DNA, 22 bp, Homo sapiens
acaggctgacttcctgccatgt

SEQ ID NO: 7579350 - DNA, 22 bp, Homo sapiens
acaggctgacttcctgccatgt

SEQ ID NO: 7579351 - DNA, 22 bp, Homo sapiens
acaggctgacttcctgccatgt

SEQ ID NO: 7579352 - DNA, 22 bp, Homo sapiens
acaggctgacttcctgccatgt

SEQ ID NO: 7579353 - DNA, 22 bp, Homo sapiens
acaggctgacttcctgccatgt

SEQ ID NO: 7579354 - DNA, 22 bp, Homo sapiens
acaggctgacttcctgccatgt

SEQ ID NO: 7579355 - DNA, 22 bp, Homo sapiens
acaggctgacttcctgccatgt

SEQ ID NO: 7579356 - DNA, 22 bp, Homo sapiens
acaggctgacttcctgccatgt

SEQ ID NO: 7579357 - DNA, 22 bp, Homo sapiens
acaggctgacttcctgccatgt

SEQ ID NO: 7579358 - DNA, 22 bp, Homo sapiens
acaggctgagcgtccatcttca

SEQ ID NO: 7579359 - DNA, 22 bp, Homo sapiens
acaggctgagcgtccatcttca

SEQ ID NO: 7579360 - DNA, 22 bp, Homo sapiens
acaggctgagcgtccatcttca

SEQ ID NO: 7579361 - DNA, 22 bp, Homo sapiens
acaggctgacttcctgccatgt

SEQ ID NO: 7579362 - DNA, 22 bp, Homo sapiens
acaggctgacttcctgccatgt

SEQ ID NO: 7579363 - DNA, 22 bp, Homo sapiens
acaggctgatagaccataaata

SEQ ID NO: 7579364 - DNA, 22 bp, Homo sapiens
acaggctgaggatgattgcatc

SEQ ID NO: 7579365 - DNA, 22 bp, Homo sapiens
acaggctgaggatgattgcatc

SEQ ID NO: 7579366 - DNA, 22 bp, Homo sapiens
acaggctgaggatgattgcatc

SEQ ID NO: 7579367 - DNA, 22 bp, Homo sapiens
acaggctgagcgtccatcttca

SEQ ID NO: 7579368 - DNA, 22 bp, Homo sapiens
acaggctgaggatgattgcatc

SEQ ID NO: 7579369 - DNA, 22 bp, Homo sapiens
acaggctgaggatgattgcatc

SEQ ID NO: 7579370 - DNA, 22 bp, Homo sapiens
acaggtagatacatacttctaa

SEQ ID NO: 7579371 - DNA, 22 bp, Homo sapiens
acaggtaggttaaaatgtgtca

SEQ ID NO: 7579372 - DNA, 23 bp, Homo sapiens
acagggcttatctgtcactcatc

SEQ ID NO: 7579373 - DNA, 23 bp, Homo sapiens
acagggaaaagtcatcagtgtga

SEQ ID NO: 7579374 - DNA, 23 bp, Homo sapiens
acagggcttatctgtcactcatc

SEQ ID NO: 7579375 - DNA, 23 bp, Homo sapiens
acagggaaaagtcatcagtgtga

SEQ ID NO: 7579376 - DNA, 23 bp, Homo sapiens
acagggaaaagtcatcagtgtga

SEQ ID NO: 7579377 - DNA, 23 bp, Homo sapiens
acagggcttatctgtcactcatc

SEQ ID NO: 7579378 - DNA, 22 bp, Homo sapiens
acagggttttttatgagaacag

SEQ ID NO: 7579379 - DNA, 22 bp, Homo sapiens
acaggtacaagggattaggatg

SEQ ID NO: 7579380 - DNA, 22 bp, Homo sapiens
acagggttttttatgagaacag

SEQ ID NO: 7579381 - DNA, 21 bp, Homo sapiens
acagggcttcagggagggtta

SEQ ID NO: 7579382 - DNA, 21 bp, Homo sapiens
acagggcttcagggagggtta

SEQ ID NO: 7579383 - DNA, 23 bp, Homo sapiens
acagggcttatctgtcactcatc

SEQ ID NO: 7579384 - DNA, 22 bp, Homo sapiens
acaggcttttacggatatcttt

SEQ ID NO: 7579385 - DNA, 22 bp, Homo sapiens
acaggctttggcgaggcccatc

SEQ ID NO: 7579386 - DNA, 22 bp, Homo sapiens
acaggcttttttagaatgacat

SEQ ID NO: 7579387 - DNA, 22 bp, Homo sapiens
acaggctttggcgaggcccatc

SEQ ID NO: 7579388 - DNA, 22 bp, Homo sapiens
acaggctttggcgaggcccatc

SEQ ID NO: 7579389 - DNA, 22 bp, Homo sapiens
acaggcttttttagaatgacat

SEQ ID NO: 7579390 - DNA, 22 bp, Homo sapiens
acaggcttttttagaatgacat

SEQ ID NO: 7579391 - DNA, 22 bp, Homo sapiens
acaggcttttttgctctcgaat

SEQ ID NO: 7579392 - DNA, 23 bp, Homo sapiens
acagggaaaagtcatcagtgtga

SEQ ID NO: 7579393 - DNA, 20 bp, Homo sapiens
acaggctttggagtctgaat

SEQ ID NO: 7579394 - DNA, 20 bp, Homo sapiens
acaggctttctgaggctggc

SEQ ID NO: 7579395 - DNA, 20 bp, Homo sapiens
acaggctttggagtctgaat

SEQ ID NO: 7579396 - DNA, 20 bp, Homo sapiens
acaggctttctgaggctggc

SEQ ID NO: 7579397 - DNA, 20 bp, Homo sapiens
acaggctttctgaggctggc

SEQ ID NO: 7579398 - DNA, 20 bp, Homo sapiens
acaggctttctgaggctggc

SEQ ID NO: 7579399 - DNA, 22 bp, Homo sapiens
acaggctttattattggttagt

SEQ ID NO: 7579400 - DNA, 22 bp, Homo sapiens
acaggctttatgtagtgactta

SEQ ID NO: 7579401 - DNA, 22 bp, Homo sapiens
acaggctttatgtagtgactta

SEQ ID NO: 7579402 - DNA, 21 bp, Homo sapiens
acaggctttagaaaatgactc

SEQ ID NO: 7579403 - DNA, 21 bp, Homo sapiens
acaggctttagaaaatgactc

SEQ ID NO: 7579404 - DNA, 21 bp, Homo sapiens
acaggctttagaaaatgactc

SEQ ID NO: 7579405 - DNA, 21 bp, Homo sapiens
acaggctttagaaaatgactc

SEQ ID NO: 7579406 - DNA, 22 bp, Homo sapiens
acaggtagtctgaacactgggt

SEQ ID NO: 7579407 - DNA, 22 bp, Homo sapiens
acaggtcagataaaggctggtg

SEQ ID NO: 7579408 - DNA, 22 bp, Homo sapiens
acaggtcagataaaggctggtg

SEQ ID NO: 7579409 - DNA, 22 bp, Homo sapiens
acaggtcctcaagtcagctggg

SEQ ID NO: 7579410 - DNA, 22 bp, Homo sapiens
acaggtcctcaagtcagctggg

SEQ ID NO: 7579411 - DNA, 22 bp, Homo sapiens
acaggtagtctgaacactgggt

SEQ ID NO: 7579412 - DNA, 22 bp, Homo sapiens
acaggtcaacgagagcaggcaa

SEQ ID NO: 7579413 - DNA, 22 bp, Homo sapiens
acaggtcaacgagagcaggcaa

SEQ ID NO: 7579414 - DNA, 22 bp, Homo sapiens
acaggtcagataaaggctggtg

SEQ ID NO: 7579415 - DNA, 22 bp, Homo sapiens
acaggtccttataagagcactc

SEQ ID NO: 7579416 - DNA, 22 bp, Homo sapiens
acaggtccttataagagcactc

SEQ ID NO: 7579417 - DNA, 22 bp, Homo sapiens
acaggtccttataagagcactc

SEQ ID NO: 7579418 - DNA, 22 bp, Homo sapiens
acaggtccttataagagcactc

SEQ ID NO: 7579419 - DNA, 22 bp, Homo sapiens
acaggtctactggcaagcagtg

SEQ ID NO: 7579420 - DNA, 22 bp, Homo sapiens
acaggtctccagagtgagagga

SEQ ID NO: 7579421 - DNA, 22 bp, Homo sapiens
acaggtgaggatctgagcctca

SEQ ID NO: 7579422 - DNA, 22 bp, Homo sapiens
acaggtgacttgcattttcaca

SEQ ID NO: 7579423 - DNA, 22 bp, Homo sapiens
acaggtgacttgcattttcaca

SEQ ID NO: 7579424 - DNA, 22 bp, Homo sapiens
acaggtgagggagctttgtgcc

SEQ ID NO: 7579425 - DNA, 22 bp, Homo sapiens
acaggtgagggagctttgtgcc

SEQ ID NO: 7579426 - DNA, 22 bp, Homo sapiens
acaggtgagggagctttgtgcc

SEQ ID NO: 7579427 - DNA, 22 bp, Homo sapiens
acaggtgaagtattacactaag

SEQ ID NO: 7579428 - DNA, 22 bp, Homo sapiens
acaggtgaagtattacactaag

SEQ ID NO: 7579429 - DNA, 22 bp, Homo sapiens
acaggtgaagtattacactaag

SEQ ID NO: 7579430 - DNA, 22 bp, Homo sapiens
acaggtgacctgctcatatgaa

SEQ ID NO: 7579431 - DNA, 22 bp, Homo sapiens
acaggtctgtgtgcacagtgct

SEQ ID NO: 7579432 - DNA, 22 bp, Homo sapiens
acaggtctgtgtgcacagtgct

SEQ ID NO: 7579433 - DNA, 22 bp, Homo sapiens
aaggttccctctctggaagcct

SEQ ID NO: 7579434 - DNA, 22 bp, Homo sapiens
aaggttcctctctccacccagc

SEQ ID NO: 7579435 - DNA, 22 bp, Homo sapiens
aaggttccctctctggaagcct

SEQ ID NO: 7579436 - DNA, 22 bp, Homo sapiens
aaggttagtaatatttctatat

SEQ ID NO: 7579437 - DNA, 22 bp, Homo sapiens
aaggttagtgcatcttttgttt

SEQ ID NO: 7579438 - DNA, 22 bp, Homo sapiens
aaggtttattaaatgttgcatg

SEQ ID NO: 7579439 - DNA, 22 bp, Homo sapiens
aaggtttattaaaagttgatgg

SEQ ID NO: 7579440 - DNA, 22 bp, Homo sapiens
aaggtttattaaaagttgatgg

SEQ ID NO: 7579441 - DNA, 22 bp, Homo sapiens
aaggttgttaagatttggtggt

SEQ ID NO: 7579442 - DNA, 22 bp, Homo sapiens
aaggttgttaagatttggtggt

SEQ ID NO: 7579443 - DNA, 22 bp, Homo sapiens
aaggttgtctctttattatctt

SEQ ID NO: 7579444 - DNA, 22 bp, Homo sapiens
aaggttgtctctttattatctt

SEQ ID NO: 7579445 - DNA, 22 bp, Homo sapiens
accaggcatgatgtggagcaca

SEQ ID NO: 7579446 - DNA, 22 bp, Homo sapiens
accaggcatgatgtggagcaca

SEQ ID NO: 7579447 - DNA, 22 bp, Homo sapiens
accaggcatgatgtggagcaca

SEQ ID NO: 7579448 - DNA, 22 bp, Homo sapiens
accaggcatgatgtggagcaca

SEQ ID NO: 7579449 - DNA, 22 bp, Homo sapiens
accaggccaaaatcatatttac

SEQ ID NO: 7579450 - DNA, 22 bp, Homo sapiens
accaggccaaaatcatatttac

SEQ ID NO: 7579451 - DNA, 22 bp, Homo sapiens
accaggccaaaatcatatttac

SEQ ID NO: 7579452 - DNA, 22 bp, Homo sapiens
accaggccaacagctaagttaa

SEQ ID NO: 7579453 - DNA, 21 bp, Homo sapiens
accaggccaggaggctggcac

SEQ ID NO: 7579454 - DNA, 21 bp, Homo sapiens
accaggccaggaggctggcac

SEQ ID NO: 7579455 - DNA, 22 bp, Homo sapiens
aaggtgtcactgggacaggaaa

SEQ ID NO: 7579456 - DNA, 21 bp, Homo sapiens
accaggccaggaggctggcac

SEQ ID NO: 7579457 - DNA, 21 bp, Homo sapiens
accaggccaggaggctggcac

SEQ ID NO: 7579458 - DNA, 21 bp, Homo sapiens
accaggccaggaggctggcac

SEQ ID NO: 7579459 - DNA, 22 bp, Homo sapiens
aagtaaaacacacagtccaccg

SEQ ID NO: 7579460 - DNA, 22 bp, Homo sapiens
aagtaaaacacacagtccaccg

SEQ ID NO: 7579461 - DNA, 22 bp, Homo sapiens
aagtaaaacacacagtccaccg

SEQ ID NO: 7579462 - DNA, 22 bp, Homo sapiens
aagtaaaacacacagtccaccg

SEQ ID NO: 7579463 - DNA, 22 bp, Homo sapiens
aagtaaaagcaggtgtgctggg

SEQ ID NO: 7579464 - DNA, 22 bp, Homo sapiens
aagtaaaagcaggtgtgctggg

SEQ ID NO: 7579465 - DNA, 22 bp, Homo sapiens
aagtaaaagcaggtgtgctggg

SEQ ID NO: 7579466 - DNA, 22 bp, Homo sapiens
aagtaaaagcaggtgtgctggg

SEQ ID NO: 7579467 - DNA, 22 bp, Homo sapiens
aaggtttttttccagtatctct

SEQ ID NO: 7579468 - DNA, 22 bp, Homo sapiens
aagtaaaacacacagtccaccg

SEQ ID NO: 7579469 - DNA, 22 bp, Homo sapiens
aagtaaaacacacagtccaccg

SEQ ID NO: 7579470 - DNA, 22 bp, Homo sapiens
aagtaaaacacacagtccaccg

SEQ ID NO: 7579471 - DNA, 22 bp, Homo sapiens
aaggtttcgggagcgggtctgg

SEQ ID NO: 7579472 - DNA, 22 bp, Homo sapiens
aaggtttccagtgatattgtgg

SEQ ID NO: 7579473 - DNA, 22 bp, Homo sapiens
aaggtttttttccagtatctct

SEQ ID NO: 7579474 - DNA, 22 bp, Homo sapiens
aaggtttctccgaggctatttt

SEQ ID NO: 7579475 - DNA, 22 bp, Homo sapiens
aagtaaaattcaatcttcactg

SEQ ID NO: 7579476 - DNA, 22 bp, Homo sapiens
aagtaaaattcaatcttcactg

SEQ ID NO: 7579477 - DNA, 22 bp, Homo sapiens
aagtaaaattcaatcttcactg

SEQ ID NO: 7579478 - DNA, 22 bp, Homo sapiens
aagtaaaatgtttcctttatta

SEQ ID NO: 7579479 - DNA, 22 bp, Homo sapiens
aagtaaaatgtttcctttatta

SEQ ID NO: 7579480 - DNA, 22 bp, Homo sapiens
aagtaaaattcaatcttcactg

SEQ ID NO: 7579481 - DNA, 22 bp, Homo sapiens
aagtaaaattcaatcttcactg

SEQ ID NO: 7579482 - DNA, 22 bp, Homo sapiens
aagtaaaattcaatcttcactg

SEQ ID NO: 7579483 - DNA, 22 bp, Homo sapiens
aagtaaaattcaatcttcactg

SEQ ID NO: 7579484 - DNA, 22 bp, Homo sapiens
aagtaaaattcaatcttcactg

SEQ ID NO: 7579485 - DNA, 22 bp, Homo sapiens
aagtaaaattcaatcttcactg

SEQ ID NO: 7579486 - DNA, 22 bp, Homo sapiens
aagtaaaattcaatcttcactg

SEQ ID NO: 7579487 - DNA, 22 bp, Homo sapiens
aagtaaaagctttaccatgcgc

SEQ ID NO: 7579488 - DNA, 22 bp, Homo sapiens
aagtaaaagctttaccatgcgc

SEQ ID NO: 7579489 - DNA, 22 bp, Homo sapiens
aagtaaaagctttaccatgcgc

SEQ ID NO: 7579490 - DNA, 22 bp, Homo sapiens
aagtaaaagctttaccatgcgc

SEQ ID NO: 7579491 - DNA, 22 bp, Homo sapiens
aagtaaaagctttaccatgcgc

SEQ ID NO: 7579492 - DNA, 22 bp, Homo sapiens
aagtaaaagctttaccatgcgc

SEQ ID NO: 7579493 - DNA, 22 bp, Homo sapiens
aagtaaaatgtttcctttatta

SEQ ID NO: 7579494 - DNA, 22 bp, Homo sapiens
aagtaaaatgtttcctttatta

SEQ ID NO: 7579495 - DNA, 22 bp, Homo sapiens
aagtaaaatgtttcctttatta

SEQ ID NO: 7579496 - DNA, 22 bp, Homo sapiens
aagtaaaatgtttcctttatta

SEQ ID NO: 7579497 - DNA, 22 bp, Homo sapiens
accagctggcccatgagcacgt

SEQ ID NO: 7579498 - DNA, 22 bp, Homo sapiens
accagctggcccatgagcacgt

SEQ ID NO: 7579499 - DNA, 22 bp, Homo sapiens
accagctggcccatgagcacgt

SEQ ID NO: 7579500 - DNA, 22 bp, Homo sapiens
accagctggtcacctgggcact

SEQ ID NO: 7579501 - DNA, 22 bp, Homo sapiens
accagctggcccatgagcacgt

SEQ ID NO: 7579502 - DNA, 22 bp, Homo sapiens
accagctggtcacctgggcact

SEQ ID NO: 7579503 - DNA, 22 bp, Homo sapiens
accagctggcccatgagcacgt

SEQ ID NO: 7579504 - DNA, 22 bp, Homo sapiens
accagctggtcacctgggcact

SEQ ID NO: 7579505 - DNA, 22 bp, Homo sapiens
accagctggtcacctgggcact

SEQ ID NO: 7579506 - DNA, 22 bp, Homo sapiens
accagctggtcacctgggcact

SEQ ID NO: 7579507 - DNA, 22 bp, Homo sapiens
accagctggtcacctgggcact

SEQ ID NO: 7579508 - DNA, 22 bp, Homo sapiens
accagctgtgtcctggctgcag

SEQ ID NO: 7579509 - DNA, 22 bp, Homo sapiens
accagctgtgtcctggctgcag

SEQ ID NO: 7579510 - DNA, 22 bp, Homo sapiens
accagctgtgtcctggctgcag

SEQ ID NO: 7579511 - DNA, 22 bp, Homo sapiens
accagctggtcagggcttttct

SEQ ID NO: 7579512 - DNA, 22 bp, Homo sapiens
accagctggtcagggcttttct

SEQ ID NO: 7579513 - DNA, 22 bp, Homo sapiens
accagctgtgtcctggctgcag

SEQ ID NO: 7579514 - DNA, 22 bp, Homo sapiens
accagctggtcagttgaagatt

SEQ ID NO: 7579515 - DNA, 22 bp, Homo sapiens
accagctggtcagttgaagatt

SEQ ID NO: 7579516 - DNA, 22 bp, Homo sapiens
accaggaaactctcgtctagtt

SEQ ID NO: 7579517 - DNA, 22 bp, Homo sapiens
accaggaaatttggcaacaaag

SEQ ID NO: 7579518 - DNA, 22 bp, Homo sapiens
accaggaaatttggcaacaaag

SEQ ID NO: 7579519 - DNA, 22 bp, Homo sapiens
accaggaaatttggcaacaaag

SEQ ID NO: 7579520 - DNA, 22 bp, Homo sapiens
accaggaaatttggcaacaaag

SEQ ID NO: 7579521 - DNA, 22 bp, Homo sapiens
accaggaaaaacactgtgttgg

SEQ ID NO: 7579522 - DNA, 22 bp, Homo sapiens
accagctgttatctgtagtatc

SEQ ID NO: 7579523 - DNA, 22 bp, Homo sapiens
accagctgtgtgacctgaggca

SEQ ID NO: 7579524 - DNA, 22 bp, Homo sapiens
accagctgttaggcttggtgct

SEQ ID NO: 7579525 - DNA, 22 bp, Homo sapiens
accagctgttaggcttggtgct

SEQ ID NO: 7579526 - DNA, 22 bp, Homo sapiens
accagctgttaggcttggtgct

SEQ ID NO: 7579527 - DNA, 22 bp, Homo sapiens
accagctgttaggcttggtgct

SEQ ID NO: 7579528 - DNA, 22 bp, Homo sapiens
accagctgtgtgacttttaatg

SEQ ID NO: 7579529 - DNA, 22 bp, Homo sapiens
accagctgtgtgacttttaatg

SEQ ID NO: 7579530 - DNA, 22 bp, Homo sapiens
accagctgtgtgacctgaggca

SEQ ID NO: 7579531 - DNA, 22 bp, Homo sapiens
accagctgtgtgacctgaggca

SEQ ID NO: 7579532 - DNA, 22 bp, Homo sapiens
accagctgtgtgacctgaggca

SEQ ID NO: 7579533 - DNA, 22 bp, Homo sapiens
accaggcagagctgggccttaa

SEQ ID NO: 7579534 - DNA, 22 bp, Homo sapiens
accaggcagagctgggccttaa

SEQ ID NO: 7579535 - DNA, 22 bp, Homo sapiens
accaggcagagctgggccttaa

SEQ ID NO: 7579536 - DNA, 22 bp, Homo sapiens
accaggcagagctgggccttaa

SEQ ID NO: 7579537 - DNA, 22 bp, Homo sapiens
accaggcagagctgggccttaa

SEQ ID NO: 7579538 - DNA, 22 bp, Homo sapiens
accaggcagcactttccttgca

SEQ ID NO: 7579539 - DNA, 22 bp, Homo sapiens
accaggcagcactttccttgca

SEQ ID NO: 7579540 - DNA, 22 bp, Homo sapiens
accaggcagcaccaaagccggt

SEQ ID NO: 7579541 - DNA, 22 bp, Homo sapiens
accaggcagcaccaaagccggt

SEQ ID NO: 7579542 - DNA, 22 bp, Homo sapiens
accaggcagcaccaaagccggt

SEQ ID NO: 7579543 - DNA, 22 bp, Homo sapiens
accaggcagctgggggtgatgt

SEQ ID NO: 7579544 - DNA, 22 bp, Homo sapiens
accaggcagctgggggtgatgt

SEQ ID NO: 7579545 - DNA, 22 bp, Homo sapiens
accaggcagctgggggtgatgt

SEQ ID NO: 7579546 - DNA, 22 bp, Homo sapiens
accaggcagcactttccttgca

SEQ ID NO: 7579547 - DNA, 22 bp, Homo sapiens
accaggcagtatggtgctgcaa

SEQ ID NO: 7579548 - DNA, 22 bp, Homo sapiens
accaggcagtatggtgctgcaa

SEQ ID NO: 7579549 - DNA, 22 bp, Homo sapiens
accaggcagtatggtgctgcaa

SEQ ID NO: 7579550 - DNA, 22 bp, Homo sapiens
accaggcatgatgtggagcaca

SEQ ID NO: 7579551 - DNA, 22 bp, Homo sapiens
accaggcagtcaccgtccagga

SEQ ID NO: 7579552 - DNA, 22 bp, Homo sapiens
accaggcagtcaccgtccagga

SEQ ID NO: 7579553 - DNA, 22 bp, Homo sapiens
accaggcagtcaccgtccagga

SEQ ID NO: 7579554 - DNA, 22 bp, Homo sapiens
accaggcagtcaccgtccagga

SEQ ID NO: 7579555 - DNA, 22 bp, Homo sapiens
accaggcagtcaccgtccagga

SEQ ID NO: 7579556 - DNA, 22 bp, Homo sapiens
accaggcaactgtgaatgggct

SEQ ID NO: 7579557 - DNA, 22 bp, Homo sapiens
accaggcactcctgaggtctga

SEQ ID NO: 7579558 - DNA, 22 bp, Homo sapiens
accaggcactcctgaggtctga

SEQ ID NO: 7579559 - DNA, 22 bp, Homo sapiens
accaggcactcctgaggtctga

SEQ ID NO: 7579560 - DNA, 22 bp, Homo sapiens
accaggcactcctgaggtctga

SEQ ID NO: 7579561 - DNA, 22 bp, Homo sapiens
accaggcactcctgaggtctga

SEQ ID NO: 7579562 - DNA, 22 bp, Homo sapiens
accaggcactcttgtggcagtg

SEQ ID NO: 7579563 - DNA, 22 bp, Homo sapiens
accaggcactcttgtggcagtg

SEQ ID NO: 7579564 - DNA, 22 bp, Homo sapiens
accaggcactcttgtggcagtg

SEQ ID NO: 7579565 - DNA, 22 bp, Homo sapiens
accaggcactcttgtggcagtg

SEQ ID NO: 7579566 - DNA, 22 bp, Homo sapiens
accaggcaaaaccacaggagca

SEQ ID NO: 7579567 - DNA, 22 bp, Homo sapiens
accaggcaaaaccacaggagca

SEQ ID NO: 7579568 - DNA, 22 bp, Homo sapiens
accaggcaaaaccacaggagca

SEQ ID NO: 7579569 - DNA, 22 bp, Homo sapiens
accaggcaaaaccacaggagca

SEQ ID NO: 7579570 - DNA, 17 bp, Homo sapiens
accaggcaacacgccca

SEQ ID NO: 7579571 - DNA, 17 bp, Homo sapiens
accaggcaacacgccca

SEQ ID NO: 7579572 - DNA, 17 bp, Homo sapiens
accaggcaacacgccca

SEQ ID NO: 7579573 - DNA, 17 bp, Homo sapiens
accaggcaacacgccca

SEQ ID NO: 7579574 - DNA, 22 bp, Homo sapiens
accaggcaactgtgaatgggct

SEQ ID NO: 7579575 - DNA, 22 bp, Homo sapiens
accaggcaactgtgaatgggct

SEQ ID NO: 7579576 - DNA, 17 bp, Homo sapiens
accaggcaacacgccca

SEQ ID NO: 7579577 - DNA, 22 bp, Homo sapiens
aagggcagctattatcgtcatc

SEQ ID NO: 7579578 - DNA, 22 bp, Homo sapiens
aagggcagctgacagatgctta

SEQ ID NO: 7579579 - DNA, 22 bp, Homo sapiens
aagggcagctattatcgtcatc

SEQ ID NO: 7579580 - DNA, 22 bp, Homo sapiens
aagggcagctattatcgtcatc

SEQ ID NO: 7579581 - DNA, 22 bp, Homo sapiens
aagggcagctattatcgtcatc

SEQ ID NO: 7579582 - DNA, 22 bp, Homo sapiens
aagggcagctattatcgtcatc

SEQ ID NO: 7579583 - DNA, 22 bp, Homo sapiens
aagggcagctgacagatgctta

SEQ ID NO: 7579584 - DNA, 22 bp, Homo sapiens
aagggcagctgacagatgctta

SEQ ID NO: 7579585 - DNA, 22 bp, Homo sapiens
aagggcagctgacagatgctta

SEQ ID NO: 7579586 - DNA, 22 bp, Homo sapiens
aagggcagctgacagatgctta

SEQ ID NO: 7579587 - DNA, 22 bp, Homo sapiens
aagggcagctattatcgtcatc

SEQ ID NO: 7579588 - DNA, 22 bp, Homo sapiens
aagggcagctgacagatgctta

SEQ ID NO: 7579589 - DNA, 22 bp, Homo sapiens
aagggcagctattatcgtcatc

SEQ ID NO: 7579590 - DNA, 22 bp, Homo sapiens
aagggcagcctgactcacggtc

SEQ ID NO: 7579591 - DNA, 22 bp, Homo sapiens
aagggcagcctgactcacggtc

SEQ ID NO: 7579592 - DNA, 22 bp, Homo sapiens
aagggcagcctgactcacggtc

SEQ ID NO: 7579593 - DNA, 22 bp, Homo sapiens
aagggcagcctgactcacggtc

SEQ ID NO: 7579594 - DNA, 22 bp, Homo sapiens
aagggcagcctgactcacggtc

SEQ ID NO: 7579595 - DNA, 22 bp, Homo sapiens
aagggcagcctgactcacggtc

SEQ ID NO: 7579596 - DNA, 22 bp, Homo sapiens
aagggcagcctgactcacggtc

SEQ ID NO: 7579597 - DNA, 22 bp, Homo sapiens
accactgcccatggtgaaaact

SEQ ID NO: 7579598 - DNA, 22 bp, Homo sapiens
accactgcccatggtgaaaact

SEQ ID NO: 7579599 - DNA, 22 bp, Homo sapiens
accactgcccatggtgaaaact

SEQ ID NO: 7579600 - DNA, 22 bp, Homo sapiens
aagggcagagggaatcccacat

SEQ ID NO: 7579601 - DNA, 22 bp, Homo sapiens
aagggcagagggaatcccacat

SEQ ID NO: 7579602 - DNA, 22 bp, Homo sapiens
aagggcagagggaatcccacat

SEQ ID NO: 7579603 - DNA, 22 bp, Homo sapiens
aagggcagagggaatcccacat

SEQ ID NO: 7579604 - DNA, 22 bp, Homo sapiens
aagggcagcctgactcacggtc

SEQ ID NO: 7579605 - DNA, 22 bp, Homo sapiens
aagggcagcctgactcacggtc

SEQ ID NO: 7579606 - DNA, 22 bp, Homo sapiens
aagggcagcctgactcacggtc

SEQ ID NO: 7579607 - DNA, 22 bp, Homo sapiens
aagggcagcctgactcacggtc

SEQ ID NO: 7579608 - DNA, 22 bp, Homo sapiens
aagggcagagggaatcccacat

SEQ ID NO: 7579609 - DNA, 22 bp, Homo sapiens
aagggcagcctgactcacggtc

SEQ ID NO: 7579610 - DNA, 22 bp, Homo sapiens
accactgcactccagtctgggc

SEQ ID NO: 7579611 - DNA, 22 bp, Homo sapiens
accactataattagtttgttaa

SEQ ID NO: 7579612 - DNA, 17 bp, Homo sapiens
accacctctcaccagca

SEQ ID NO: 7579613 - DNA, 17 bp, Homo sapiens
accacctctcaccagca

SEQ ID NO: 7579614 - DNA, 17 bp, Homo sapiens
accacctctcaccagca

SEQ ID NO: 7579615 - DNA, 17 bp, Homo sapiens
accacctctcaccagca

SEQ ID NO: 7579616 - DNA, 22 bp, Homo sapiens
accacctcatcaagctggattg

SEQ ID NO: 7579617 - DNA, 21 bp, Homo sapiens
accaccctgtttatccagagg

SEQ ID NO: 7579618 - DNA, 22 bp, Homo sapiens
accacctcatcaagctggattg

SEQ ID NO: 7579619 - DNA, 22 bp, Homo sapiens
aagggcagcttaaattggtagc

SEQ ID NO: 7579620 - DNA, 22 bp, Homo sapiens
aagggcagcttaaattggtagc

SEQ ID NO: 7579621 - DNA, 22 bp, Homo sapiens
aagggcagcttaaattggtagc

SEQ ID NO: 7579622 - DNA, 22 bp, Homo sapiens
aagggcagctgacagatgctta

SEQ ID NO: 7579623 - DNA, 22 bp, Homo sapiens
aagggcagctgacagatgctta

SEQ ID NO: 7579624 - DNA, 22 bp, Homo sapiens
aagggcagctgacagatgctta

SEQ ID NO: 7579625 - DNA, 22 bp, Homo sapiens
aagggcagctgacagatgctta

SEQ ID NO: 7579626 - DNA, 22 bp, Homo sapiens
aagggcagctgacagatgctta

SEQ ID NO: 7579627 - DNA, 22 bp, Homo sapiens
aagggcaggaaaagatggatgt

SEQ ID NO: 7579628 - DNA, 22 bp, Homo sapiens
aagggcagcttaaattggtagc

SEQ ID NO: 7579629 - DNA, 22 bp, Homo sapiens
aagggcagctgacagatgctta

SEQ ID NO: 7579630 - DNA, 22 bp, Homo sapiens
aagggcagcttaaattggtagc

SEQ ID NO: 7579631 - DNA, 22 bp, Homo sapiens
aagggcagcttaaattggtagc

SEQ ID NO: 7579632 - DNA, 22 bp, Homo sapiens
accagcacggattagaatgctt

SEQ ID NO: 7579633 - DNA, 22 bp, Homo sapiens
accagcacggattagaatgctt

SEQ ID NO: 7579634 - DNA, 22 bp, Homo sapiens
accagcacggattagaatgctt

SEQ ID NO: 7579635 - DNA, 22 bp, Homo sapiens
accagcacttccagaggtcagg

SEQ ID NO: 7579636 - DNA, 22 bp, Homo sapiens
accagcacttccagaggtcagg

SEQ ID NO: 7579637 - DNA, 22 bp, Homo sapiens
accagcacttccagaggtcagg

SEQ ID NO: 7579638 - DNA, 22 bp, Homo sapiens
accagcacttccagaggtcagg

SEQ ID NO: 7579639 - DNA, 22 bp, Homo sapiens
accagctgctgattgctaaatg

SEQ ID NO: 7579640 - DNA, 22 bp, Homo sapiens
accagctgctgattgctaaatg

SEQ ID NO: 7579641 - DNA, 23 bp, Homo sapiens
accagctgccctgaactttgtgc

SEQ ID NO: 7579642 - DNA, 22 bp, Homo sapiens
accagctgccttttcttagtag

SEQ ID NO: 7579643 - DNA, 23 bp, Homo sapiens
accagctgccctgaactttgtgc

SEQ ID NO: 7579644 - DNA, 22 bp, Homo sapiens
accagctgccaagggctacact

SEQ ID NO: 7579645 - DNA, 22 bp, Homo sapiens
accagctgcctggtctatctgc

SEQ ID NO: 7579646 - DNA, 22 bp, Homo sapiens
accagctgagtaggggagggcc

SEQ ID NO: 7579647 - DNA, 22 bp, Homo sapiens
accagcagagttgaggaggaca

SEQ ID NO: 7579648 - DNA, 22 bp, Homo sapiens
accagctgagttctcggatggt

SEQ ID NO: 7579649 - DNA, 22 bp, Homo sapiens
accagctgccaagggctacact

SEQ ID NO: 7579650 - DNA, 22 bp, Homo sapiens
accagctgatttaagaataaag

SEQ ID NO: 7579651 - DNA, 22 bp, Homo sapiens
accagctgccaagggctacact

SEQ ID NO: 7579652 - DNA, 22 bp, Homo sapiens
accagctgccaagggctacact

SEQ ID NO: 7579653 - DNA, 22 bp, Homo sapiens
accagctgatttaagaataaag

SEQ ID NO: 7579654 - DNA, 22 bp, Homo sapiens
accagctgatttaagaataaag

SEQ ID NO: 7579655 - DNA, 22 bp, Homo sapiens
accagctgagttctcggatggt

SEQ ID NO: 7579656 - DNA, 22 bp, Homo sapiens
acattcttcagctttgtcaggc

SEQ ID NO: 7579657 - DNA, 22 bp, Homo sapiens
acattttgcccttatttgctga

SEQ ID NO: 7579658 - DNA, 22 bp, Homo sapiens
acattcttccagctggctgttg

SEQ ID NO: 7579659 - DNA, 22 bp, Homo sapiens
acattttgcccttatttgctga

SEQ ID NO: 7579660 - DNA, 22 bp, Homo sapiens
accacaggaggatggctgctgg

SEQ ID NO: 7579661 - DNA, 22 bp, Homo sapiens
accacaggaggatggctgctgg

SEQ ID NO: 7579662 - DNA, 22 bp, Homo sapiens
accacaggaggatggctgctgg

SEQ ID NO: 7579663 - DNA, 22 bp, Homo sapiens
accacaggggaggaatgatgcc

SEQ ID NO: 7579664 - DNA, 22 bp, Homo sapiens
accacaggaggatggctgctgg

SEQ ID NO: 7579665 - DNA, 22 bp, Homo sapiens
accacaggaggatggctgctgg

SEQ ID NO: 7579666 - DNA, 20 bp, Homo sapiens
acattttggcatactctcaa

SEQ ID NO: 7579667 - DNA, 20 bp, Homo sapiens
acattttggcatactctcaa

SEQ ID NO: 7579668 - DNA, 22 bp, Homo sapiens
accacaggacccatgagtcagt

SEQ ID NO: 7579669 - DNA, 22 bp, Homo sapiens
accacaggacccatgagtcagt

SEQ ID NO: 7579670 - DNA, 22 bp, Homo sapiens
acattcttaacagttaaaaact

SEQ ID NO: 7579671 - DNA, 22 bp, Homo sapiens
acattcttaacagttaaaaact

SEQ ID NO: 7579672 - DNA, 22 bp, Homo sapiens
acattctgtttccccaaagaga

SEQ ID NO: 7579673 - DNA, 22 bp, Homo sapiens
acattcttaacagttaaaaact

SEQ ID NO: 7579674 - DNA, 22 bp, Homo sapiens
acattcttaacagttaaaaact

SEQ ID NO: 7579675 - DNA, 22 bp, Homo sapiens
acattcttaacagttaaaaact

SEQ ID NO: 7579676 - DNA, 22 bp, Homo sapiens
acattctgtttccccaaagaga

SEQ ID NO: 7579677 - DNA, 22 bp, Homo sapiens
acattctgtttccccaaagaga

SEQ ID NO: 7579678 - DNA, 22 bp, Homo sapiens
acattctgttgaggctgggtca

SEQ ID NO: 7579679 - DNA, 22 bp, Homo sapiens
acattctgtttccccaaagaga

SEQ ID NO: 7579680 - DNA, 22 bp, Homo sapiens
acattctgtgatgctgtcccaa

SEQ ID NO: 7579681 - DNA, 22 bp, Homo sapiens
acattctgtgatgctgtcccaa

SEQ ID NO: 7579682 - DNA, 22 bp, Homo sapiens
acattctgtgagtcatgtttta

SEQ ID NO: 7579683 - DNA, 22 bp, Homo sapiens
acattctgtcaacagtgagcag

SEQ ID NO: 7579684 - DNA, 22 bp, Homo sapiens
acattctgtgagtcatgtttta

SEQ ID NO: 7579685 - DNA, 22 bp, Homo sapiens
acattctgtatcatctgtctca

SEQ ID NO: 7579686 - DNA, 22 bp, Homo sapiens
acattctgtcaacagtgagcag

SEQ ID NO: 7579687 - DNA, 22 bp, Homo sapiens
acattctgtcaacagtgagcag

SEQ ID NO: 7579688 - DNA, 22 bp, Homo sapiens
acattctgtcaacagtgagcag

SEQ ID NO: 7579689 - DNA, 22 bp, Homo sapiens
accacagggtaaagttagatat

SEQ ID NO: 7579690 - DNA, 22 bp, Homo sapiens
accacaggggaggaatgatgcc

SEQ ID NO: 7579691 - DNA, 22 bp, Homo sapiens
accacaggggaggaatgatgcc

SEQ ID NO: 7579692 - DNA, 22 bp, Homo sapiens
accacaggggaggaatgatgcc

SEQ ID NO: 7579693 - DNA, 22 bp, Homo sapiens
accacagtctcgaagcactgca

SEQ ID NO: 7579694 - DNA, 22 bp, Homo sapiens
accacagtatgaaatctgaaat

SEQ ID NO: 7579695 - DNA, 22 bp, Homo sapiens
accacagtctcgaagcactgca

SEQ ID NO: 7579696 - DNA, 22 bp, Homo sapiens
accacagtatgaaatctgaaat

SEQ ID NO: 7579697 - DNA, 22 bp, Homo sapiens
accacagtatgaaatctgaaat

SEQ ID NO: 7579698 - DNA, 22 bp, Homo sapiens
accacagtatgaaatctgaaat

SEQ ID NO: 7579699 - DNA, 22 bp, Homo sapiens
accacagggtaaagttagatat

SEQ ID NO: 7579700 - DNA, 22 bp, Homo sapiens
accacagtttagtccaatgaca

SEQ ID NO: 7579701 - DNA, 22 bp, Homo sapiens
accacagtgggccacaagaagt

SEQ ID NO: 7579702 - DNA, 22 bp, Homo sapiens
accacagtttagtccaatgaca

SEQ ID NO: 7579703 - DNA, 22 bp, Homo sapiens
accacagtgggccacaagaagt

SEQ ID NO: 7579704 - DNA, 18 bp, Homo sapiens
accacagtgcttaatatg

SEQ ID NO: 7579705 - DNA, 18 bp, Homo sapiens
accacagtgcttaatatg

SEQ ID NO: 7579706 - DNA, 22 bp, Homo sapiens
accacagtctcgaagcactgca

SEQ ID NO: 7579707 - DNA, 22 bp, Homo sapiens
accacagtttcattcatgcagg

SEQ ID NO: 7579708 - DNA, 22 bp, Homo sapiens
accacagtttcattcatgcagg

SEQ ID NO: 7579709 - DNA, 22 bp, Homo sapiens
accacagtttcattcatgcagg

SEQ ID NO: 7579710 - DNA, 22 bp, Homo sapiens
accacagtttcattcatgcagg

SEQ ID NO: 7579711 - DNA, 22 bp, Homo sapiens
accacatagctttgctttttgt

SEQ ID NO: 7579712 - DNA, 22 bp, Homo sapiens
accacatagctttgctttttgt

SEQ ID NO: 7579713 - DNA, 22 bp, Homo sapiens
accacatcgggcggacactggg

SEQ ID NO: 7579714 - DNA, 22 bp, Homo sapiens
accacatctagattgcagccct

SEQ ID NO: 7579715 - DNA, 22 bp, Homo sapiens
accacatttctgaatagcataa

SEQ ID NO: 7579716 - DNA, 22 bp, Homo sapiens
accaccccagaatttttcaagg

SEQ ID NO: 7579717 - DNA, 22 bp, Homo sapiens
accacccattcagaaacactga

SEQ ID NO: 7579718 - DNA, 22 bp, Homo sapiens
accacccccttgggtgtggaag

SEQ ID NO: 7579719 - DNA, 22 bp, Homo sapiens
accacccccttgggtgtggaag

SEQ ID NO: 7579720 - DNA, 22 bp, Homo sapiens
accacccccttgggtgtggaag

SEQ ID NO: 7579721 - DNA, 22 bp, Homo sapiens
accacccccttgggtgtggaag

SEQ ID NO: 7579722 - DNA, 22 bp, Homo sapiens
accaccctcagcagagctgaaa

SEQ ID NO: 7579723 - DNA, 22 bp, Homo sapiens
accaccctcagcagagctgaaa

SEQ ID NO: 7579724 - DNA, 21 bp, Homo sapiens
accaccctgtttatccagagg

SEQ ID NO: 7579725 - DNA, 22 bp, Homo sapiens
accaccccaaatgaacctctgt

SEQ ID NO: 7579726 - DNA, 22 bp, Homo sapiens
accacccattcagaaacactga

SEQ ID NO: 7579727 - DNA, 22 bp, Homo sapiens
accacccattcagaaacactga

SEQ ID NO: 7579728 - DNA, 22 bp, Homo sapiens
accacccacctcacagcatagt

SEQ ID NO: 7579729 - DNA, 22 bp, Homo sapiens
accacccagccagcttctccct

SEQ ID NO: 7579730 - DNA, 22 bp, Homo sapiens
accaccaggggattttcagaac

SEQ ID NO: 7579731 - DNA, 22 bp, Homo sapiens
accacatttctgaatagcataa

SEQ ID NO: 7579732 - DNA, 22 bp, Homo sapiens
accacccacctcacagcatagt

SEQ ID NO: 7579733 - DNA, 22 bp, Homo sapiens
accacccacctcacagcatagt

SEQ ID NO: 7579734 - DNA, 19 bp, Homo sapiens
acatggctctccagtctgg

SEQ ID NO: 7579735 - DNA, 22 bp, Homo sapiens
acatggctcagtctcatgacag

SEQ ID NO: 7579736 - DNA, 19 bp, Homo sapiens
acatggctctccagtctgg

SEQ ID NO: 7579737 - DNA, 19 bp, Homo sapiens
acatggctctccagtctgg

SEQ ID NO: 7579738 - DNA, 22 bp, Homo sapiens
acatggctcagtctcatgacag

SEQ ID NO: 7579739 - DNA, 22 bp, Homo sapiens
acatggctcagtctcatgacag

SEQ ID NO: 7579740 - DNA, 23 bp, Homo sapiens
acatgggaaatgcaaagagaagt

SEQ ID NO: 7579741 - DNA, 22 bp, Homo sapiens
acatggctggcaccttaaattt

SEQ ID NO: 7579742 - DNA, 22 bp, Homo sapiens
acatgggacagagaaagaggcc

SEQ ID NO: 7579743 - DNA, 22 bp, Homo sapiens
acatgggacagagaaagaggcc

SEQ ID NO: 7579744 - DNA, 23 bp, Homo sapiens
acatgggaaatgcaaagagaagt

SEQ ID NO: 7579745 - DNA, 21 bp, Homo sapiens
acatgggacctgcgaaaggaa

SEQ ID NO: 7579746 - DNA, 23 bp, Homo sapiens
acatgggaaatgcaaagagaagt

SEQ ID NO: 7579747 - DNA, 22 bp, Homo sapiens
acatgggagagaaataaatgta

SEQ ID NO: 7579748 - DNA, 21 bp, Homo sapiens
acatgggacctgcgaaaggaa

SEQ ID NO: 7579749 - DNA, 23 bp, Homo sapiens
acatgggagggacatggaggctg

SEQ ID NO: 7579750 - DNA, 23 bp, Homo sapiens
acatgggagggacatggaggctg

SEQ ID NO: 7579751 - DNA, 23 bp, Homo sapiens
acatgggagggacatggaggctg

SEQ ID NO: 7579752 - DNA, 22 bp, Homo sapiens
acatgggggctgctgccagcga

SEQ ID NO: 7579753 - DNA, 22 bp, Homo sapiens
acatgggggctgctgccagcga

SEQ ID NO: 7579754 - DNA, 22 bp, Homo sapiens
acatgggggctgctgccagcga

SEQ ID NO: 7579755 - DNA, 22 bp, Homo sapiens
acatgggatcaatgaggcaggc

SEQ ID NO: 7579756 - DNA, 22 bp, Homo sapiens
acatggggcccaaagagaggtc

SEQ ID NO: 7579757 - DNA, 22 bp, Homo sapiens
acatggggcccaaagagaggtc

SEQ ID NO: 7579758 - DNA, 17 bp, Homo sapiens
acatgggctgagactcc

SEQ ID NO: 7579759 - DNA, 22 bp, Homo sapiens
acatggggcccaaagagaggtc

SEQ ID NO: 7579760 - DNA, 22 bp, Homo sapiens
acatgggttattgtgaggttaa

SEQ ID NO: 7579761 - DNA, 22 bp, Homo sapiens
acatggtaaaagttttggcaat

SEQ ID NO: 7579762 - DNA, 22 bp, Homo sapiens
acatggtaaattggtaaaggac

SEQ ID NO: 7579763 - DNA, 22 bp, Homo sapiens
acatggtaaattggtaaaggac

SEQ ID NO: 7579764 - DNA, 22 bp, Homo sapiens
acatggtatgtattttaagaga

SEQ ID NO: 7579765 - DNA, 22 bp, Homo sapiens
acatggtatgtattttaagaga

SEQ ID NO: 7579766 - DNA, 22 bp, Homo sapiens
acatggggcccaaagagaggtc

SEQ ID NO: 7579767 - DNA, 22 bp, Homo sapiens
acatgggcatctatgaggctct

SEQ ID NO: 7579768 - DNA, 22 bp, Homo sapiens
acatgggatcaatgaggcaggc

SEQ ID NO: 7579769 - DNA, 22 bp, Homo sapiens
acatgggatgacctccgatggt

SEQ ID NO: 7579770 - DNA, 22 bp, Homo sapiens
acatgggatcaatgaggcaggc

SEQ ID NO: 7579771 - DNA, 22 bp, Homo sapiens
acatgggatcaatgaggcaggc

SEQ ID NO: 7579772 - DNA, 22 bp, Homo sapiens
acatgggatcaatgaggcaggc

SEQ ID NO: 7579773 - DNA, 22 bp, Homo sapiens
acatgggatcaatgaggcaggc

SEQ ID NO: 7579774 - DNA, 22 bp, Homo sapiens
acatgggatcaatgaggcaggc

SEQ ID NO: 7579775 - DNA, 22 bp, Homo sapiens
acatgggatcaatgaggcaggc

SEQ ID NO: 7579776 - DNA, 22 bp, Homo sapiens
acatacttaacattaaagtcat

SEQ ID NO: 7579777 - DNA, 22 bp, Homo sapiens
acatacttaacattaaagtcat

SEQ ID NO: 7579778 - DNA, 22 bp, Homo sapiens
acatacttaacattaaagtcat

SEQ ID NO: 7579779 - DNA, 22 bp, Homo sapiens
acatacttagagtaaacaagta

SEQ ID NO: 7579780 - DNA, 22 bp, Homo sapiens
acatacttatgctaaaaatata

SEQ ID NO: 7579781 - DNA, 22 bp, Homo sapiens
acatacttatgctaaaaatata

SEQ ID NO: 7579782 - DNA, 22 bp, Homo sapiens
acatacttatgctaaaaatata

SEQ ID NO: 7579783 - DNA, 22 bp, Homo sapiens
acatacttagagtaaacaagta

SEQ ID NO: 7579784 - DNA, 22 bp, Homo sapiens
acatacttatgctaaaaatata

SEQ ID NO: 7579785 - DNA, 22 bp, Homo sapiens
acatactttgtccttaacgtac

SEQ ID NO: 7579786 - DNA, 22 bp, Homo sapiens
acatactttagcactgcattgt

SEQ ID NO: 7579787 - DNA, 22 bp, Homo sapiens
acatacttgaagcaagtgatca

SEQ ID NO: 7579788 - DNA, 22 bp, Homo sapiens
acatacttgaagcaagtgatca

SEQ ID NO: 7579789 - DNA, 22 bp, Homo sapiens
acatacttgaagcaagtgatca

SEQ ID NO: 7579790 - DNA, 22 bp, Homo sapiens
acatacttgaagcaagtgatca

SEQ ID NO: 7579791 - DNA, 22 bp, Homo sapiens
acatacttgaagcaagtgatca

SEQ ID NO: 7579792 - DNA, 22 bp, Homo sapiens
acatacttatgtgtatatgtgt

SEQ ID NO: 7579793 - DNA, 22 bp, Homo sapiens
acatacttatgtgtatatgtgt

SEQ ID NO: 7579794 - DNA, 22 bp, Homo sapiens
acatacttatgtgtatatgtgt

SEQ ID NO: 7579795 - DNA, 22 bp, Homo sapiens
acatacttatgtgtatatgtgt

SEQ ID NO: 7579796 - DNA, 22 bp, Homo sapiens
acatacttatgtgtatatgtgt

SEQ ID NO: 7579797 - DNA, 22 bp, Homo sapiens
acatgcattaaaaatacttgtg

SEQ ID NO: 7579798 - DNA, 23 bp, Homo sapiens
acatagaacagaatatatttgtg

SEQ ID NO: 7579799 - DNA, 23 bp, Homo sapiens
acatagaacagaatatatttgtg

SEQ ID NO: 7579800 - DNA, 22 bp, Homo sapiens
acatgcattctctaaaagcaaa

SEQ ID NO: 7579801 - DNA, 22 bp, Homo sapiens
acatgcattaaaaatacttgtg

SEQ ID NO: 7579802 - DNA, 22 bp, Homo sapiens
acatgcattctctaaaagcaaa

SEQ ID NO: 7579803 - DNA, 22 bp, Homo sapiens
acatgccaagatcctcgtcttt

SEQ ID NO: 7579804 - DNA, 22 bp, Homo sapiens
acatactttttaaaagattgct

SEQ ID NO: 7579805 - DNA, 22 bp, Homo sapiens
acatactttttaaaagattgct

SEQ ID NO: 7579806 - DNA, 22 bp, Homo sapiens
acatactttttaaaagattgct

SEQ ID NO: 7579807 - DNA, 22 bp, Homo sapiens
acatactttagcactgcattgt

SEQ ID NO: 7579808 - DNA, 22 bp, Homo sapiens
acatactttgtccttaacgtac

SEQ ID NO: 7579809 - DNA, 22 bp, Homo sapiens
acatactttttaaaagattgct

SEQ ID NO: 7579810 - DNA, 22 bp, Homo sapiens
acatactttttaaaagattgct

SEQ ID NO: 7579811 - DNA, 22 bp, Homo sapiens
acataatagcatttctaatttg

SEQ ID NO: 7579812 - DNA, 22 bp, Homo sapiens
acataataggtacctgaataat

SEQ ID NO: 7579813 - DNA, 22 bp, Homo sapiens
acataatagcatttctaatttg

SEQ ID NO: 7579814 - DNA, 22 bp, Homo sapiens
acataatagcatttctaatttg

SEQ ID NO: 7579815 - DNA, 22 bp, Homo sapiens
acataatacctaggacagtttg

SEQ ID NO: 7579816 - DNA, 22 bp, Homo sapiens
acataatagcatttctaatttg

SEQ ID NO: 7579817 - DNA, 22 bp, Homo sapiens
acataatagcatttctaatttg

SEQ ID NO: 7579818 - DNA, 22 bp, Homo sapiens
acataataggtacctgaataat

SEQ ID NO: 7579819 - DNA, 22 bp, Homo sapiens
acataataggtacctgaataat

SEQ ID NO: 7579820 - DNA, 22 bp, Homo sapiens
acataataggtacctgaataat

SEQ ID NO: 7579821 - DNA, 22 bp, Homo sapiens
acataataggtacctgaataat

SEQ ID NO: 7579822 - DNA, 22 bp, Homo sapiens
acataataggtacctgaataat

SEQ ID NO: 7579823 - DNA, 22 bp, Homo sapiens
acataataggtacctgaataat

SEQ ID NO: 7579824 - DNA, 22 bp, Homo sapiens
acataagttatggataaaatgt

SEQ ID NO: 7579825 - DNA, 22 bp, Homo sapiens
acataagttatggataaaatgt

SEQ ID NO: 7579826 - DNA, 22 bp, Homo sapiens
acataataaaaataacagctca

SEQ ID NO: 7579827 - DNA, 22 bp, Homo sapiens
acataataaaaataacagctca

SEQ ID NO: 7579828 - DNA, 22 bp, Homo sapiens
acataataaaaataacagctca

SEQ ID NO: 7579829 - DNA, 22 bp, Homo sapiens
acataatacctaggacagtttg

SEQ ID NO: 7579830 - DNA, 22 bp, Homo sapiens
acataatacctaggacagtttg

SEQ ID NO: 7579831 - DNA, 22 bp, Homo sapiens
acataataaaaataacagctca

SEQ ID NO: 7579832 - DNA, 22 bp, Homo sapiens
acataataaaaataacagctca

SEQ ID NO: 7579833 - DNA, 22 bp, Homo sapiens
acataacatagttgacattttt

SEQ ID NO: 7579834 - DNA, 22 bp, Homo sapiens
acataacatagttgacattttt

SEQ ID NO: 7579835 - DNA, 22 bp, Homo sapiens
acataacatagttgacattttt

SEQ ID NO: 7579836 - DNA, 22 bp, Homo sapiens
acataacatagttgacattttt

SEQ ID NO: 7579837 - DNA, 22 bp, Homo sapiens
acataacatagttgacattttt

SEQ ID NO: 7579838 - DNA, 22 bp, Homo sapiens
acataacatagttgacattttt

SEQ ID NO: 7579839 - DNA, 22 bp, Homo sapiens
acataacactcttctctagtga

SEQ ID NO: 7579840 - DNA, 22 bp, Homo sapiens
acataacactcttctctagtga

SEQ ID NO: 7579841 - DNA, 22 bp, Homo sapiens
acataacaatcataggacatag

SEQ ID NO: 7579842 - DNA, 22 bp, Homo sapiens
acataagtgcacaataaatatt

SEQ ID NO: 7579843 - DNA, 22 bp, Homo sapiens
acataagcttctgaagggatgg

SEQ ID NO: 7579844 - DNA, 22 bp, Homo sapiens
acataagcttctgaagggatgg

SEQ ID NO: 7579845 - DNA, 22 bp, Homo sapiens
acataacatgtcaatcacccga

SEQ ID NO: 7579846 - DNA, 21 bp, Homo sapiens
acataactgtcaagtaacgtt

SEQ ID NO: 7579847 - DNA, 21 bp, Homo sapiens
acataactgtcaagtaacgtt

SEQ ID NO: 7579848 - DNA, 22 bp, Homo sapiens
acataagtgcacaataaatatt

SEQ ID NO: 7579849 - DNA, 22 bp, Homo sapiens
acataagtgcacaataaatatt

SEQ ID NO: 7579850 - DNA, 22 bp, Homo sapiens
acataagtgcacaataaatatt

SEQ ID NO: 7579851 - DNA, 22 bp, Homo sapiens
acataagtgcacaataaatatt

SEQ ID NO: 7579852 - DNA, 22 bp, Homo sapiens
acataagttatggataaaatgt

SEQ ID NO: 7579853 - DNA, 22 bp, Homo sapiens
acataatggacaataatgcatc

SEQ ID NO: 7579854 - DNA, 22 bp, Homo sapiens
acataatggacaataatgcatc

SEQ ID NO: 7579855 - DNA, 22 bp, Homo sapiens
acataatggacaataatgcatc

SEQ ID NO: 7579856 - DNA, 22 bp, Homo sapiens
acataatggacaataatgcatc

SEQ ID NO: 7579857 - DNA, 22 bp, Homo sapiens
acataatggacaataatgcatc

SEQ ID NO: 7579858 - DNA, 22 bp, Homo sapiens
acataattataaatggtgggct

SEQ ID NO: 7579859 - DNA, 22 bp, Homo sapiens
acataattataaatggtgggct

SEQ ID NO: 7579860 - DNA, 22 bp, Homo sapiens
acatacaaatagagctgtagta

SEQ ID NO: 7579861 - DNA, 22 bp, Homo sapiens
acataatgagctctttataaat

SEQ ID NO: 7579862 - DNA, 22 bp, Homo sapiens
acataatgagctctttataaat

SEQ ID NO: 7579863 - DNA, 22 bp, Homo sapiens
acataatgaaatgcagaaatca

SEQ ID NO: 7579864 - DNA, 22 bp, Homo sapiens
acataatgaaatgcagaaatca

SEQ ID NO: 7579865 - DNA, 22 bp, Homo sapiens
acataataggtgcctgaatatt

SEQ ID NO: 7579866 - DNA, 22 bp, Homo sapiens
acataataggtgcctgaatatt

SEQ ID NO: 7579867 - DNA, 22 bp, Homo sapiens
acataataggtgcctgaatatt

SEQ ID NO: 7579868 - DNA, 22 bp, Homo sapiens
acataataggtgcctgaatatt

SEQ ID NO: 7579869 - DNA, 22 bp, Homo sapiens
acataataggtgcctgaatatt

SEQ ID NO: 7579870 - DNA, 22 bp, Homo sapiens
acataataggtacctgaataat

SEQ ID NO: 7579871 - DNA, 22 bp, Homo sapiens
acataataggtgcctgaatatt

SEQ ID NO: 7579872 - DNA, 22 bp, Homo sapiens
acataataggtgcctgaatatt

SEQ ID NO: 7579873 - DNA, 22 bp, Homo sapiens
acataataggtgcctgaatatt

SEQ ID NO: 7579874 - DNA, 22 bp, Homo sapiens
acatacattgcctcattggtaa

SEQ ID NO: 7579875 - DNA, 22 bp, Homo sapiens
acatacattgcctcattggtaa

SEQ ID NO: 7579876 - DNA, 22 bp, Homo sapiens
acatacattgcctcattggtaa

SEQ ID NO: 7579877 - DNA, 22 bp, Homo sapiens
acatacattgcctcattggtaa

SEQ ID NO: 7579878 - DNA, 22 bp, Homo sapiens
acatacattgcctcattggtaa

SEQ ID NO: 7579879 - DNA, 22 bp, Homo sapiens
acataccatctcctggaaagct

SEQ ID NO: 7579880 - DNA, 22 bp, Homo sapiens
acataccatctcctggaaagct

SEQ ID NO: 7579881 - DNA, 22 bp, Homo sapiens
acataccatacatggtgagatg

SEQ ID NO: 7579882 - DNA, 22 bp, Homo sapiens
acatacttaacattaaagtcat

SEQ ID NO: 7579883 - DNA, 22 bp, Homo sapiens
acatacttaacattaaagtcat

SEQ ID NO: 7579884 - DNA, 22 bp, Homo sapiens
acatactatgaatacatgtgtc

SEQ ID NO: 7579885 - DNA, 22 bp, Homo sapiens
acatactatgaatacatgtgtc

SEQ ID NO: 7579886 - DNA, 22 bp, Homo sapiens
acatactatgaatacatgtgtc

SEQ ID NO: 7579887 - DNA, 22 bp, Homo sapiens
acatacaaatagagctgtagta

SEQ ID NO: 7579888 - DNA, 22 bp, Homo sapiens
acatacaaatagagctgtagta

SEQ ID NO: 7579889 - DNA, 18 bp, Homo sapiens
acatacattctgtctgca

SEQ ID NO: 7579890 - DNA, 18 bp, Homo sapiens
acatacattctgtctgca

SEQ ID NO: 7579891 - DNA, 22 bp, Homo sapiens
acatacattgcctcattggtaa

SEQ ID NO: 7579892 - DNA, 18 bp, Homo sapiens
acatacattctgtctgca

SEQ ID NO: 7579893 - DNA, 18 bp, Homo sapiens
acatacattctgtctgca

SEQ ID NO: 7579894 - DNA, 18 bp, Homo sapiens
acatacattctgtctgca

SEQ ID NO: 7579895 - DNA, 22 bp, Homo sapiens
acattctctccatgtcttcttt

SEQ ID NO: 7579896 - DNA, 22 bp, Homo sapiens
acattctctccatgtcttcttt

SEQ ID NO: 7579897 - DNA, 22 bp, Homo sapiens
acattctctccatgtcttcttt

SEQ ID NO: 7579898 - DNA, 22 bp, Homo sapiens
acattctctccatgtcttcttt

SEQ ID NO: 7579899 - DNA, 22 bp, Homo sapiens
acattctctccatgtcttcttt

SEQ ID NO: 7579900 - DNA, 22 bp, Homo sapiens
acattctcttcctaaatatact

SEQ ID NO: 7579901 - DNA, 22 bp, Homo sapiens
acattctcttcctaaatatact

SEQ ID NO: 7579902 - DNA, 22 bp, Homo sapiens
acattctcttcctaaatatact

SEQ ID NO: 7579903 - DNA, 22 bp, Homo sapiens
acattctcttttagaaagctgt

SEQ ID NO: 7579904 - DNA, 22 bp, Homo sapiens
acattctgaaatccatgtgggt

SEQ ID NO: 7579905 - DNA, 22 bp, Homo sapiens
acattctgaaatccatgtgggt

SEQ ID NO: 7579906 - DNA, 22 bp, Homo sapiens
acattctgaaaaacagtgtttt

SEQ ID NO: 7579907 - DNA, 22 bp, Homo sapiens
acattctgtatcatctgtctca

SEQ ID NO: 7579908 - DNA, 22 bp, Homo sapiens
acattctgtatcatctgtctca

SEQ ID NO: 7579909 - DNA, 22 bp, Homo sapiens
acattctgtatcatctgtctca

SEQ ID NO: 7579910 - DNA, 22 bp, Homo sapiens
acattctgggtgatgttcttca

SEQ ID NO: 7579911 - DNA, 22 bp, Homo sapiens
acattctgggtgatgttcttca

SEQ ID NO: 7579912 - DNA, 22 bp, Homo sapiens
acattctggatgtctgatgaga

SEQ ID NO: 7579913 - DNA, 22 bp, Homo sapiens
acattctggatgtctgatgaga

SEQ ID NO: 7579914 - DNA, 22 bp, Homo sapiens
acattctgaataggcattttat

SEQ ID NO: 7579915 - DNA, 22 bp, Homo sapiens
acattctgaatgcctgacagta

SEQ ID NO: 7579916 - DNA, 22 bp, Homo sapiens
acattctgaatgcctgacagta

SEQ ID NO: 7579917 - DNA, 22 bp, Homo sapiens
acattctgaatgcctgacagta

SEQ ID NO: 7579918 - DNA, 22 bp, Homo sapiens
acattctggatgtctgatgaga

SEQ ID NO: 7579919 - DNA, 22 bp, Homo sapiens
acattctgaatgcctgacagta

SEQ ID NO: 7579920 - DNA, 22 bp, Homo sapiens
acattctggatgtctgatgaga

SEQ ID NO: 7579921 - DNA, 22 bp, Homo sapiens
acattcaacatggctggtctag

SEQ ID NO: 7579922 - DNA, 22 bp, Homo sapiens
acattcaacatggctggtctag

SEQ ID NO: 7579923 - DNA, 22 bp, Homo sapiens
acattcaaaatatttctgatgt

SEQ ID NO: 7579924 - DNA, 22 bp, Homo sapiens
acattcaagatgcattcactta

SEQ ID NO: 7579925 - DNA, 22 bp, Homo sapiens
acattctattctgcaggacaag

SEQ ID NO: 7579926 - DNA, 22 bp, Homo sapiens
acattctattctgcaggacaag

SEQ ID NO: 7579927 - DNA, 22 bp, Homo sapiens
acattctattctgcaggacaag

SEQ ID NO: 7579928 - DNA, 22 bp, Homo sapiens
acattctatttcatcatgtcta

SEQ ID NO: 7579929 - DNA, 22 bp, Homo sapiens
acattctatttcatcatgtcta

SEQ ID NO: 7579930 - DNA, 22 bp, Homo sapiens
acattctatttcatcatgtcta

SEQ ID NO: 7579931 - DNA, 22 bp, Homo sapiens
acattctcatttggtgatcatt

SEQ ID NO: 7579932 - DNA, 22 bp, Homo sapiens
acattctcatttggtgatcatt

SEQ ID NO: 7579933 - DNA, 22 bp, Homo sapiens
acattctcaaatatttgtggaa

SEQ ID NO: 7579934 - DNA, 22 bp, Homo sapiens
acattctcaaatatttgtggaa

SEQ ID NO: 7579935 - DNA, 22 bp, Homo sapiens
acattacttaccttgggttcta

SEQ ID NO: 7579936 - DNA, 22 bp, Homo sapiens
acattacctggcatttgatctt

SEQ ID NO: 7579937 - DNA, 22 bp, Homo sapiens
acattacctggcatttgatctt

SEQ ID NO: 7579938 - DNA, 22 bp, Homo sapiens
acattagaacattaatattggg

SEQ ID NO: 7579939 - DNA, 22 bp, Homo sapiens
acattagaacattaatattggg

SEQ ID NO: 7579940 - DNA, 22 bp, Homo sapiens
acattagaacattaatattggg

SEQ ID NO: 7579941 - DNA, 22 bp, Homo sapiens
acattagatgtgtggccacagt

SEQ ID NO: 7579942 - DNA, 22 bp, Homo sapiens
acattagcaggtgcataaacac

SEQ ID NO: 7579943 - DNA, 22 bp, Homo sapiens
acattagcttgtggcttaacag

SEQ ID NO: 7579944 - DNA, 22 bp, Homo sapiens
acattagcaggtgcataaacac

SEQ ID NO: 7579945 - DNA, 22 bp, Homo sapiens
acattagcccatctggtatttg

SEQ ID NO: 7579946 - DNA, 22 bp, Homo sapiens
acattagatgactctttctttc

SEQ ID NO: 7579947 - DNA, 22 bp, Homo sapiens
acattagataactcagaaagga

SEQ ID NO: 7579948 - DNA, 22 bp, Homo sapiens
acattagagaagcttggagatg

SEQ ID NO: 7579949 - DNA, 22 bp, Homo sapiens
acattagagaagcttggagatg

SEQ ID NO: 7579950 - DNA, 22 bp, Homo sapiens
acattagagaagcttggagatg

SEQ ID NO: 7579951 - DNA, 22 bp, Homo sapiens
acattagataactcagaaagga

SEQ ID NO: 7579952 - DNA, 22 bp, Homo sapiens
acattagataactcagaaagga

SEQ ID NO: 7579953 - DNA, 21 bp, Homo sapiens
acattataattcatattccac

SEQ ID NO: 7579954 - DNA, 21 bp, Homo sapiens
acattataattcatattccac

SEQ ID NO: 7579955 - DNA, 21 bp, Homo sapiens
acattataattcatattccac

SEQ ID NO: 7579956 - DNA, 22 bp, Homo sapiens
acattatagttgctacagagta

SEQ ID NO: 7579957 - DNA, 22 bp, Homo sapiens
acattatagttgctacagagta

SEQ ID NO: 7579958 - DNA, 22 bp, Homo sapiens
acattatagttgctacagagta

SEQ ID NO: 7579959 - DNA, 22 bp, Homo sapiens
acattatagctttgagtttgga

SEQ ID NO: 7579960 - DNA, 22 bp, Homo sapiens
acattatagctttgagtttgga

SEQ ID NO: 7579961 - DNA, 21 bp, Homo sapiens
acattataattcatattccac

SEQ ID NO: 7579962 - DNA, 21 bp, Homo sapiens
acattataattcatattccac

SEQ ID NO: 7579963 - DNA, 22 bp, Homo sapiens
acattcaaaaagcatctgtcac

SEQ ID NO: 7579964 - DNA, 22 bp, Homo sapiens
acattatgagcccactggtgaa

SEQ ID NO: 7579965 - DNA, 22 bp, Homo sapiens
acattatgagcccactggtgaa

SEQ ID NO: 7579966 - DNA, 22 bp, Homo sapiens
acattcaaaaagcatctgtcac

SEQ ID NO: 7579967 - DNA, 22 bp, Homo sapiens
acattcaaaaagcatctgtcac

SEQ ID NO: 7579968 - DNA, 22 bp, Homo sapiens
acattatagttgctacagagta

SEQ ID NO: 7579969 - DNA, 22 bp, Homo sapiens
acattatagttgctacagagta

SEQ ID NO: 7579970 - DNA, 22 bp, Homo sapiens
acattatccctggcacaactgc

SEQ ID NO: 7579971 - DNA, 22 bp, Homo sapiens
acattatccctggcacaactgc

SEQ ID NO: 7579972 - DNA, 22 bp, Homo sapiens
acattatagttgctacagagta

SEQ ID NO: 7579973 - DNA, 22 bp, Homo sapiens
aaggccagctggagggatgagg

SEQ ID NO: 7579974 - DNA, 22 bp, Homo sapiens
aaggccagctggagggatgagg

SEQ ID NO: 7579975 - DNA, 22 bp, Homo sapiens
aaggccagctggagggatgagg

SEQ ID NO: 7579976 - DNA, 22 bp, Homo sapiens
aaggccagctggagggatgagg

SEQ ID NO: 7579977 - DNA, 22 bp, Homo sapiens
acatgtaaaagataaattaaca

SEQ ID NO: 7579978 - DNA, 22 bp, Homo sapiens
aaggccagcgcagaccattgtc

SEQ ID NO: 7579979 - DNA, 22 bp, Homo sapiens
acatgtaaaagataaattaaca

SEQ ID NO: 7579980 - DNA, 22 bp, Homo sapiens
acatgtaaaagataaattaaca

SEQ ID NO: 7579981 - DNA, 22 bp, Homo sapiens
acatgtaaaaattaaggtaaga

SEQ ID NO: 7579982 - DNA, 22 bp, Homo sapiens
acatgtaaaaattaaggtaaga

SEQ ID NO: 7579983 - DNA, 22 bp, Homo sapiens
acatgtaaaaattaaggtaaga

SEQ ID NO: 7579984 - DNA, 22 bp, Homo sapiens
acatgtaaaagataaattaaca

SEQ ID NO: 7579985 - DNA, 22 bp, Homo sapiens
acatgtaaaagataaattaaca

SEQ ID NO: 7579986 - DNA, 22 bp, Homo sapiens
acatggtatttctattataatt

SEQ ID NO: 7579987 - DNA, 22 bp, Homo sapiens
acatggtatttctattataatt

SEQ ID NO: 7579988 - DNA, 22 bp, Homo sapiens
acatggtatttctattataatt

SEQ ID NO: 7579989 - DNA, 22 bp, Homo sapiens
acatggtgagcggcaggcctat

SEQ ID NO: 7579990 - DNA, 22 bp, Homo sapiens
acatggtgagcggcaggcctat

SEQ ID NO: 7579991 - DNA, 20 bp, Homo sapiens
acatggtggggactcagagc

SEQ ID NO: 7579992 - DNA, 20 bp, Homo sapiens
acatggtggggactcagagc

SEQ ID NO: 7579993 - DNA, 22 bp, Homo sapiens
acatggtgtgctgagaatgaca

SEQ ID NO: 7579994 - DNA, 22 bp, Homo sapiens
acatggtgtgctgagaatgaca

SEQ ID NO: 7579995 - DNA, 22 bp, Homo sapiens
acatggtgtgctgagaatgaca

SEQ ID NO: 7579996 - DNA, 22 bp, Homo sapiens
acatggttgaatgctttatttg

SEQ ID NO: 7579997 - DNA, 22 bp, Homo sapiens
acatgtaaaaattaaggtaaga

SEQ ID NO: 7579998 - DNA, 22 bp, Homo sapiens
acatgtaaaaattaaggtaaga

SEQ ID NO: 7579999 - DNA, 22 bp, Homo sapiens
acatgtaaaaattaaggtaaga

SEQ ID NO: 7580000 - DNA, 22 bp, Homo sapiens
aaggccagcttgtagggctggt

SEQ ID NO: 7580001 - DNA, 22 bp, Homo sapiens
aaggccagcttgtagggctggt

SEQ ID NO: 7580002 - DNA, 22 bp, Homo sapiens
aaggccagcttgtagggctggt

SEQ ID NO: 7580003 - DNA, 22 bp, Homo sapiens
aaggccagcttgtagggctggt

SEQ ID NO: 7580004 - DNA, 22 bp, Homo sapiens
aaggccagcttgtagggctggt

SEQ ID NO: 7580005 - DNA, 22 bp, Homo sapiens
aaggccagctggagggatgagg

SEQ ID NO: 7580006 - DNA, 22 bp, Homo sapiens
aaggccagcttgtagggctggt

SEQ ID NO: 7580007 - DNA, 22 bp, Homo sapiens
aaggccagcttgtagggctggt

SEQ ID NO: 7580008 - DNA, 22 bp, Homo sapiens
aaggccaggacaccaggggact

SEQ ID NO: 7580009 - DNA, 22 bp, Homo sapiens
aaggccaggacaccaggggact

SEQ ID NO: 7580010 - DNA, 22 bp, Homo sapiens
aaggccaggacaccaggggact

SEQ ID NO: 7580011 - DNA, 22 bp, Homo sapiens
aaggccaggacaccaggggact

SEQ ID NO: 7580012 - DNA, 22 bp, Homo sapiens
aaggccaggacaccaggggact

SEQ ID NO: 7580013 - DNA, 22 bp, Homo sapiens
aaggccagcttgtagggctggt

SEQ ID NO: 7580014 - DNA, 22 bp, Homo sapiens
aaggccagcttgtagggctggt

SEQ ID NO: 7580015 - DNA, 22 bp, Homo sapiens
aaggccaggaaattatccctat

SEQ ID NO: 7580016 - DNA, 22 bp, Homo sapiens
aaggccagcttgtagggctggt

SEQ ID NO: 7580017 - DNA, 22 bp, Homo sapiens
aaggccagcttgtagggctggt

SEQ ID NO: 7580018 - DNA, 22 bp, Homo sapiens
aaggccaggccagatgacagtc

SEQ ID NO: 7580019 - DNA, 22 bp, Homo sapiens
aaggccaggcctagcacggagg

SEQ ID NO: 7580020 - DNA, 22 bp, Homo sapiens
aaggccaggcctagcacggagg

SEQ ID NO: 7580021 - DNA, 22 bp, Homo sapiens
aaggccaggcctagcacggagg

SEQ ID NO: 7580022 - DNA, 22 bp, Homo sapiens
aaggccaggcctagcacggagg

SEQ ID NO: 7580023 - DNA, 22 bp, Homo sapiens
aaggccaggcctagcacggagg

SEQ ID NO: 7580024 - DNA, 22 bp, Homo sapiens
aaggccaggccagatgacagtc

SEQ ID NO: 7580025 - DNA, 22 bp, Homo sapiens
aaggccaggccagatgacagtc

SEQ ID NO: 7580026 - DNA, 22 bp, Homo sapiens
aaggccaggccagatgacagtc

SEQ ID NO: 7580027 - DNA, 22 bp, Homo sapiens
aaggccaggccagatgacagtc

SEQ ID NO: 7580028 - DNA, 22 bp, Homo sapiens
aaggccaggcagggagctgtga

SEQ ID NO: 7580029 - DNA, 22 bp, Homo sapiens
aaggccaggccagatgacagtc

SEQ ID NO: 7580030 - DNA, 22 bp, Homo sapiens
aaggccaggccagatgacagtc

SEQ ID NO: 7580031 - DNA, 22 bp, Homo sapiens
aaggccaggcagggagctgtga

SEQ ID NO: 7580032 - DNA, 22 bp, Homo sapiens
aaggccaggcagggagctgtga

SEQ ID NO: 7580033 - DNA, 22 bp, Homo sapiens
aaggccaggcagggagctgtga

SEQ ID NO: 7580034 - DNA, 22 bp, Homo sapiens
aaggccaggcagggagctgtga

SEQ ID NO: 7580035 - DNA, 22 bp, Homo sapiens
aaggccaggacaccaggggact

SEQ ID NO: 7580036 - DNA, 22 bp, Homo sapiens
aaggccaggacaccaggggact

SEQ ID NO: 7580037 - DNA, 22 bp, Homo sapiens
aaggccaggagacttggagtca

SEQ ID NO: 7580038 - DNA, 22 bp, Homo sapiens
aaggccagggatgccagctcgg

SEQ ID NO: 7580039 - DNA, 22 bp, Homo sapiens
aaggccagggatgccagctcgg

SEQ ID NO: 7580040 - DNA, 22 bp, Homo sapiens
aaggccaggcctagcacggagg

SEQ ID NO: 7580041 - DNA, 22 bp, Homo sapiens
aaggccagggatgccagctcgg

SEQ ID NO: 7580042 - DNA, 22 bp, Homo sapiens
acattacagcaagtttacgtta

SEQ ID NO: 7580043 - DNA, 22 bp, Homo sapiens
acatgtgttaaaattctcacca

SEQ ID NO: 7580044 - DNA, 22 bp, Homo sapiens
acattacagcaagtttacgtta

SEQ ID NO: 7580045 - DNA, 22 bp, Homo sapiens
acattacagcaagtttacgtta

SEQ ID NO: 7580046 - DNA, 21 bp, Homo sapiens
acattacagggtgatgtgtct

SEQ ID NO: 7580047 - DNA, 21 bp, Homo sapiens
acattacagggtgatgtgtct

SEQ ID NO: 7580048 - DNA, 22 bp, Homo sapiens
acattacataagattgtaacct

SEQ ID NO: 7580049 - DNA, 22 bp, Homo sapiens
acattacctggcatttgatctt

SEQ ID NO: 7580050 - DNA, 22 bp, Homo sapiens
acattacataagattgtaacct

SEQ ID NO: 7580051 - DNA, 22 bp, Homo sapiens
acattacataagattgtaacct

SEQ ID NO: 7580052 - DNA, 21 bp, Homo sapiens
acattacagggtgatgtgtct

SEQ ID NO: 7580053 - DNA, 22 bp, Homo sapiens
acaaaaaccgtggattcagcat

SEQ ID NO: 7580054 - DNA, 22 bp, Homo sapiens
acaaaaaccgtggattcagcat

SEQ ID NO: 7580055 - DNA, 22 bp, Homo sapiens
acaaaaaccgtggattcagcat

SEQ ID NO: 7580056 - DNA, 22 bp, Homo sapiens
acaaaaaccgtggattcagcat

SEQ ID NO: 7580057 - DNA, 22 bp, Homo sapiens
acaaaaaccgtggattcagcat

SEQ ID NO: 7580058 - DNA, 22 bp, Homo sapiens
acaaaaaccgtggattcagcat

SEQ ID NO: 7580059 - DNA, 22 bp, Homo sapiens
acaaaaaccgtggattcagcat

SEQ ID NO: 7580060 - DNA, 22 bp, Homo sapiens
acaaaaaccgtggattcagcat

SEQ ID NO: 7580061 - DNA, 22 bp, Homo sapiens
acaaaaaccgtggattcagcat

SEQ ID NO: 7580062 - DNA, 22 bp, Homo sapiens
acaaaaaccgtggattcagcat

SEQ ID NO: 7580063 - DNA, 22 bp, Homo sapiens
acaaaaaccgtggattcagcat

SEQ ID NO: 7580064 - DNA, 22 bp, Homo sapiens
aattttgtttaagtgatctgct

SEQ ID NO: 7580065 - DNA, 22 bp, Homo sapiens
aattttgttcttggaaatcagg

SEQ ID NO: 7580066 - DNA, 22 bp, Homo sapiens
aattttgtttaagtgatctgct

SEQ ID NO: 7580067 - DNA, 22 bp, Homo sapiens
aattttgtttaagtgatctgct

SEQ ID NO: 7580068 - DNA, 22 bp, Homo sapiens
aattttgttttagtggaggctg

SEQ ID NO: 7580069 - DNA, 22 bp, Homo sapiens
aattttgtttaagtgatctgct

SEQ ID NO: 7580070 - DNA, 22 bp, Homo sapiens
agaggtggccatgggcgctgga

SEQ ID NO: 7580071 - DNA, 22 bp, Homo sapiens
agaggtggccatgggcgctgga

SEQ ID NO: 7580072 - DNA, 22 bp, Homo sapiens
agaggtggccatgggcgctgga

SEQ ID NO: 7580073 - DNA, 22 bp, Homo sapiens
agaggtggccatgggcgctgga

SEQ ID NO: 7580074 - DNA, 22 bp, Homo sapiens
agaggtggccatgggcgctgga

SEQ ID NO: 7580075 - DNA, 22 bp, Homo sapiens
agaggtggagctcttggcatca

SEQ ID NO: 7580076 - DNA, 22 bp, Homo sapiens
agaggtggagctcttggcatca

SEQ ID NO: 7580077 - DNA, 22 bp, Homo sapiens
agagggtaacaagaggcctgga

SEQ ID NO: 7580078 - DNA, 22 bp, Homo sapiens
agagggtaacaagaggcctgga

SEQ ID NO: 7580079 - DNA, 22 bp, Homo sapiens
agagggtaacaagaggcctgga

SEQ ID NO: 7580080 - DNA, 22 bp, Homo sapiens
agagggtaacaagaggcctgga

SEQ ID NO: 7580081 - DNA, 22 bp, Homo sapiens
agaggggttatgcttgacattt

SEQ ID NO: 7580082 - DNA, 22 bp, Homo sapiens
acaaaaagctccattactgtcc

SEQ ID NO: 7580083 - DNA, 22 bp, Homo sapiens
acaaaaagctccattactgtcc

SEQ ID NO: 7580084 - DNA, 22 bp, Homo sapiens
agaggggttaagtgctagtccg

SEQ ID NO: 7580085 - DNA, 22 bp, Homo sapiens
acaaaaagctccattactgtcc

SEQ ID NO: 7580086 - DNA, 22 bp, Homo sapiens
acaaaaagctccattactgtcc

SEQ ID NO: 7580087 - DNA, 22 bp, Homo sapiens
acaaaaagctccattactgtcc

SEQ ID NO: 7580088 - DNA, 22 bp, Homo sapiens
acaaaaagctccattactgtcc

SEQ ID NO: 7580089 - DNA, 22 bp, Homo sapiens
acaaaaagctccattactgtcc

SEQ ID NO: 7580090 - DNA, 22 bp, Homo sapiens
acaaaaagctccattactgtcc

SEQ ID NO: 7580091 - DNA, 22 bp, Homo sapiens
acaaaaagctccattactgtcc

SEQ ID NO: 7580092 - DNA, 22 bp, Homo sapiens
acaaaaagctccattactgtcc

SEQ ID NO: 7580093 - DNA, 22 bp, Homo sapiens
agaggtggccatgggcgctgga

SEQ ID NO: 7580094 - DNA, 22 bp, Homo sapiens
agaggtggccatgggcgctgga

SEQ ID NO: 7580095 - DNA, 22 bp, Homo sapiens
agaggtggccatgggcgctgga

SEQ ID NO: 7580096 - DNA, 22 bp, Homo sapiens
agaggtggccatgggcgctgga

SEQ ID NO: 7580097 - DNA, 22 bp, Homo sapiens
agaggtggccatgggcgctgga

SEQ ID NO: 7580098 - DNA, 22 bp, Homo sapiens
agaggtggccatgggcgctgga

SEQ ID NO: 7580099 - DNA, 22 bp, Homo sapiens
agaggtgggagcctggtcacat

SEQ ID NO: 7580100 - DNA, 22 bp, Homo sapiens
agaggtgggagcctggtcacat

SEQ ID NO: 7580101 - DNA, 22 bp, Homo sapiens
agaggtgggagcctggtcacat

SEQ ID NO: 7580102 - DNA, 23 bp, Homo sapiens
agaggtgtagtgtctcatctact

SEQ ID NO: 7580103 - DNA, 23 bp, Homo sapiens
agaggtgtagtgtctcatctact

SEQ ID NO: 7580104 - DNA, 22 bp, Homo sapiens
agaggtgtcttgcttattgtta

SEQ ID NO: 7580105 - DNA, 22 bp, Homo sapiens
agaggtgtcttgcttattgtta

SEQ ID NO: 7580106 - DNA, 22 bp, Homo sapiens
agaggtgggagcctggtcacat

SEQ ID NO: 7580107 - DNA, 22 bp, Homo sapiens
agaggtgtggccaggactcaag

SEQ ID NO: 7580108 - DNA, 22 bp, Homo sapiens
agaggtgtggccaggactcaag

SEQ ID NO: 7580109 - DNA, 20 bp, Homo sapiens
agaggttcagtctggagaag

SEQ ID NO: 7580110 - DNA, 22 bp, Homo sapiens
agaggttgggtctgaggtgaga

SEQ ID NO: 7580111 - DNA, 22 bp, Homo sapiens
agaggttgggtctgaggtgaga

SEQ ID NO: 7580112 - DNA, 22 bp, Homo sapiens
agaggttcagagaaggcgatct

SEQ ID NO: 7580113 - DNA, 22 bp, Homo sapiens
agaggttcagagaaggcgatct

SEQ ID NO: 7580114 - DNA, 22 bp, Homo sapiens
agaggtgtggccaggactcaag

SEQ ID NO: 7580115 - DNA, 22 bp, Homo sapiens
agaggttcagagaaggcgatct

SEQ ID NO: 7580116 - DNA, 22 bp, Homo sapiens
agaggttcagagaaggcgatct

SEQ ID NO: 7580117 - DNA, 22 bp, Homo sapiens
agaggttgggtctgaggtgaga

SEQ ID NO: 7580118 - DNA, 22 bp, Homo sapiens
agaggttgttagaatagtggag

SEQ ID NO: 7580119 - DNA, 22 bp, Homo sapiens
agaggtttcttaggggcttcct

SEQ ID NO: 7580120 - DNA, 22 bp, Homo sapiens
agagtaaagtacttggaatacc

SEQ ID NO: 7580121 - DNA, 20 bp, Homo sapiens
agagtaactggcacataggg

SEQ ID NO: 7580122 - DNA, 22 bp, Homo sapiens
agagtaaagtacttggaatacc

SEQ ID NO: 7580123 - DNA, 22 bp, Homo sapiens
agagtaaataggagatgacagc

SEQ ID NO: 7580124 - DNA, 22 bp, Homo sapiens
agagtaaataggagatgacagc

SEQ ID NO: 7580125 - DNA, 22 bp, Homo sapiens
agagtaaagtacttggaatacc

SEQ ID NO: 7580126 - DNA, 22 bp, Homo sapiens
agataatgttctgatccatttc

SEQ ID NO: 7580127 - DNA, 22 bp, Homo sapiens
agataatgttctgatccatttc

SEQ ID NO: 7580128 - DNA, 22 bp, Homo sapiens
agataatgttctgatccatttc

SEQ ID NO: 7580129 - DNA, 22 bp, Homo sapiens
agagtgaaggttgacacttcac

SEQ ID NO: 7580130 - DNA, 22 bp, Homo sapiens
agataatgtcaaattctgtctg

SEQ ID NO: 7580131 - DNA, 22 bp, Homo sapiens
agagtgaaggttgacacttcac

SEQ ID NO: 7580132 - DNA, 22 bp, Homo sapiens
agagtgaaggccaggttacagt

SEQ ID NO: 7580133 - DNA, 22 bp, Homo sapiens
agagtgaaaagctagagcagta

SEQ ID NO: 7580134 - DNA, 22 bp, Homo sapiens
agatataataatttacaagtgt

SEQ ID NO: 7580135 - DNA, 22 bp, Homo sapiens
agatataataatttacaagtgt

SEQ ID NO: 7580136 - DNA, 22 bp, Homo sapiens
agataattatgtcaatttcttg

SEQ ID NO: 7580137 - DNA, 22 bp, Homo sapiens
agatatacacccatatcacata

SEQ ID NO: 7580138 - DNA, 22 bp, Homo sapiens
agatatacacccatatcacata

SEQ ID NO: 7580139 - DNA, 22 bp, Homo sapiens
agatatacacccatatcacata

SEQ ID NO: 7580140 - DNA, 22 bp, Homo sapiens
agatatacacccatatcacata

SEQ ID NO: 7580141 - DNA, 22 bp, Homo sapiens
agataattatgtcaatttcttg

SEQ ID NO: 7580142 - DNA, 22 bp, Homo sapiens
agatataataatttacaagtgt

SEQ ID NO: 7580143 - DNA, 22 bp, Homo sapiens
agagtgaaaagctagagcagta

SEQ ID NO: 7580144 - DNA, 22 bp, Homo sapiens
agagtgaaaagctagagcagta

SEQ ID NO: 7580145 - DNA, 22 bp, Homo sapiens
agagtcttttgtcagtaatgtt

SEQ ID NO: 7580146 - DNA, 22 bp, Homo sapiens
agagtcttggctgagaacaaga

SEQ ID NO: 7580147 - DNA, 22 bp, Homo sapiens
agagtcttgttaacttgctaag

SEQ ID NO: 7580148 - DNA, 22 bp, Homo sapiens
agagtcttatcttttacaagta

SEQ ID NO: 7580149 - DNA, 22 bp, Homo sapiens
agagtcttagcctcattagtca

SEQ ID NO: 7580150 - DNA, 22 bp, Homo sapiens
agagtctgtgctttcatcagga

SEQ ID NO: 7580151 - DNA, 22 bp, Homo sapiens
agagtctgttacttgtccccta

SEQ ID NO: 7580152 - DNA, 22 bp, Homo sapiens
agagtctgttacttgtccccta

SEQ ID NO: 7580153 - DNA, 22 bp, Homo sapiens
agagtctgtgctggggccagct

SEQ ID NO: 7580154 - DNA, 22 bp, Homo sapiens
agagtctgtgctggggccagct

SEQ ID NO: 7580155 - DNA, 22 bp, Homo sapiens
agagtctgtgctttcatcagga

SEQ ID NO: 7580156 - DNA, 22 bp, Homo sapiens
agagtctgtgctttcatcagga

SEQ ID NO: 7580157 - DNA, 22 bp, Homo sapiens
agagtctgtgctttcatcagga

SEQ ID NO: 7580158 - DNA, 22 bp, Homo sapiens
agagtctgtgctttcatcagga

SEQ ID NO: 7580159 - DNA, 22 bp, Homo sapiens
agagtacactgtacacacaatt

SEQ ID NO: 7580160 - DNA, 22 bp, Homo sapiens
agagtacattcagagctaccta

SEQ ID NO: 7580161 - DNA, 22 bp, Homo sapiens
agagtactgcctcagttatgaa

SEQ ID NO: 7580162 - DNA, 22 bp, Homo sapiens
agagtactgcctcagttatgaa

SEQ ID NO: 7580163 - DNA, 22 bp, Homo sapiens
agagtactgcctcagttatgaa

SEQ ID NO: 7580164 - DNA, 22 bp, Homo sapiens
agagtaatttttggacaatgcc

SEQ ID NO: 7580165 - DNA, 22 bp, Homo sapiens
agagtacactgtacacacaatt

SEQ ID NO: 7580166 - DNA, 23 bp, Homo sapiens
agagtaatgtttttactgtattc

SEQ ID NO: 7580167 - DNA, 23 bp, Homo sapiens
agagtaatgtttttactgtattc

SEQ ID NO: 7580168 - DNA, 21 bp, Homo sapiens
agagtctgcatttctgacaag

SEQ ID NO: 7580169 - DNA, 22 bp, Homo sapiens
agagtctgcatttctacaagct

SEQ ID NO: 7580170 - DNA, 22 bp, Homo sapiens
agagtctgcatttctacaagct

SEQ ID NO: 7580171 - DNA, 22 bp, Homo sapiens
agagtctgcatttctacaagct

SEQ ID NO: 7580172 - DNA, 22 bp, Homo sapiens
agagtctgcattgtaacaagat

SEQ ID NO: 7580173 - DNA, 22 bp, Homo sapiens
agagtctgcattgtaacaagat

SEQ ID NO: 7580174 - DNA, 22 bp, Homo sapiens
agagtctgatttggtaagacca

SEQ ID NO: 7580175 - DNA, 22 bp, Homo sapiens
agagtctgcattgtaacaagat

SEQ ID NO: 7580176 - DNA, 22 bp, Homo sapiens
agagtctgatgtcaacagttct

SEQ ID NO: 7580177 - DNA, 22 bp, Homo sapiens
agagtctgatgtcaacagttct

SEQ ID NO: 7580178 - DNA, 22 bp, Homo sapiens
agagtctgatgtcaacagttct

SEQ ID NO: 7580179 - DNA, 22 bp, Homo sapiens
agagtctgatttggtaagacca

SEQ ID NO: 7580180 - DNA, 22 bp, Homo sapiens
agagtctggtgcatgataagca

SEQ ID NO: 7580181 - DNA, 22 bp, Homo sapiens
agagtctggtgcatgataagca

SEQ ID NO: 7580182 - DNA, 22 bp, Homo sapiens
agagtctggtgcatgataagca

SEQ ID NO: 7580183 - DNA, 22 bp, Homo sapiens
agagtctgtgagtccctgagca

SEQ ID NO: 7580184 - DNA, 22 bp, Homo sapiens
agagtctgtgctggggccagct

SEQ ID NO: 7580185 - DNA, 19 bp, Homo sapiens
agagtctgtgctcttccta

SEQ ID NO: 7580186 - DNA, 19 bp, Homo sapiens
agagtctgtgctcttccta

SEQ ID NO: 7580187 - DNA, 22 bp, Homo sapiens
agagtctgtgagtccctgagca

SEQ ID NO: 7580188 - DNA, 22 bp, Homo sapiens
agagtctgtgagtccctgagca

SEQ ID NO: 7580189 - DNA, 19 bp, Homo sapiens
agagtctgtgctcttccta

SEQ ID NO: 7580190 - DNA, 19 bp, Homo sapiens
agagtctgtgctcttccta

SEQ ID NO: 7580191 - DNA, 22 bp, Homo sapiens
agagtctggaagcgcttctaaa

SEQ ID NO: 7580192 - DNA, 22 bp, Homo sapiens
agagtctggcgctgagatgaca

SEQ ID NO: 7580193 - DNA, 22 bp, Homo sapiens
agagtctggcgctgagatgaca

SEQ ID NO: 7580194 - DNA, 22 bp, Homo sapiens
agagtctggaagcgcttctaaa

SEQ ID NO: 7580195 - DNA, 22 bp, Homo sapiens
agagtctggaagcgcttctaaa

SEQ ID NO: 7580196 - DNA, 22 bp, Homo sapiens
agagtctgcctttttctcctgc

SEQ ID NO: 7580197 - DNA, 21 bp, Homo sapiens
agagtctgcatttctgacaag

SEQ ID NO: 7580198 - DNA, 21 bp, Homo sapiens
agagtctgcatttctgacaag

SEQ ID NO: 7580199 - DNA, 21 bp, Homo sapiens
agagtctgcatttctgacaag

SEQ ID NO: 7580200 - DNA, 22 bp, Homo sapiens
agagtctgcctttttctcctgc

SEQ ID NO: 7580201 - DNA, 22 bp, Homo sapiens
agagtctgcctttttctcctgc

SEQ ID NO: 7580202 - DNA, 21 bp, Homo sapiens
agagtctgcatttctgacaag

SEQ ID NO: 7580203 - DNA, 22 bp, Homo sapiens
agagtctgcctttttctcctgc

SEQ ID NO: 7580204 - DNA, 20 bp, Homo sapiens
agattcactgaaggatttta

SEQ ID NO: 7580205 - DNA, 20 bp, Homo sapiens
agattcactgaaggatttta

SEQ ID NO: 7580206 - DNA, 22 bp, Homo sapiens
agattcagaaaattctctgttc

SEQ ID NO: 7580207 - DNA, 22 bp, Homo sapiens
agattcagaaaattctctgttc

SEQ ID NO: 7580208 - DNA, 22 bp, Homo sapiens
agattcagaaatgaggagggcc

SEQ ID NO: 7580209 - DNA, 22 bp, Homo sapiens
agattcagaaatgaggagggcc

SEQ ID NO: 7580210 - DNA, 22 bp, Homo sapiens
agattcagaaatgaggagggcc

SEQ ID NO: 7580211 - DNA, 21 bp, Homo sapiens
agattcaggacagcagtcact

SEQ ID NO: 7580212 - DNA, 21 bp, Homo sapiens
agattcaggacagcagtcact

SEQ ID NO: 7580213 - DNA, 22 bp, Homo sapiens
agattatttccagactaatgaa

SEQ ID NO: 7580214 - DNA, 22 bp, Homo sapiens
agattcaaagtgaagaacttaa

SEQ ID NO: 7580215 - DNA, 22 bp, Homo sapiens
agattatttccagactaatgaa

SEQ ID NO: 7580216 - DNA, 22 bp, Homo sapiens
agattcaaagtgaagaacttaa

SEQ ID NO: 7580217 - DNA, 22 bp, Homo sapiens
agattatgctggctgctacaag

SEQ ID NO: 7580218 - DNA, 22 bp, Homo sapiens
agattatgctggctgctacaag

SEQ ID NO: 7580219 - DNA, 22 bp, Homo sapiens
agattatctcctgattttaagg

SEQ ID NO: 7580220 - DNA, 22 bp, Homo sapiens
agattatctcctgattttaagg

SEQ ID NO: 7580221 - DNA, 22 bp, Homo sapiens
agattatgctggctgctacaag

SEQ ID NO: 7580222 - DNA, 19 bp, Homo sapiens
agattattgcacattcatg

SEQ ID NO: 7580223 - DNA, 19 bp, Homo sapiens
agattattgcacattcatg

SEQ ID NO: 7580224 - DNA, 22 bp, Homo sapiens
agattatttaagacaggaacca

SEQ ID NO: 7580225 - DNA, 19 bp, Homo sapiens
agattattgcacattcatg

SEQ ID NO: 7580226 - DNA, 20 bp, Homo sapiens
agattattcctaagatttct

SEQ ID NO: 7580227 - DNA, 20 bp, Homo sapiens
agattaggggctttcttctt

SEQ ID NO: 7580228 - DNA, 22 bp, Homo sapiens
agattagcttgtgtacaaaggt

SEQ ID NO: 7580229 - DNA, 22 bp, Homo sapiens
agattagggtctgtgtctggcg

SEQ ID NO: 7580230 - DNA, 22 bp, Homo sapiens
agattaggtatggtttaagtag

SEQ ID NO: 7580231 - DNA, 21 bp, Homo sapiens
agattacaggtgtgatccacc

SEQ ID NO: 7580232 - DNA, 22 bp, Homo sapiens
agattagcctaaaaatgtatag

SEQ ID NO: 7580233 - DNA, 22 bp, Homo sapiens
agattacaacatgggacgcata

SEQ ID NO: 7580234 - DNA, 22 bp, Homo sapiens
agattacagaagaataagtaga

SEQ ID NO: 7580235 - DNA, 22 bp, Homo sapiens
agattacagaagaataagtaga

SEQ ID NO: 7580236 - DNA, 22 bp, Homo sapiens
agattacagaagaataagtaga

SEQ ID NO: 7580237 - DNA, 22 bp, Homo sapiens
agattacagcatgggaatggga

SEQ ID NO: 7580238 - DNA, 22 bp, Homo sapiens
agattacagcatgggaatggga

SEQ ID NO: 7580239 - DNA, 22 bp, Homo sapiens
agatgtttttccaggtctaatt

SEQ ID NO: 7580240 - DNA, 22 bp, Homo sapiens
agattaactctcagaaaagagg

SEQ ID NO: 7580241 - DNA, 22 bp, Homo sapiens
agattacaaatcctctgtgttt

SEQ ID NO: 7580242 - DNA, 20 bp, Homo sapiens
agatgttttgaagtcttgga

SEQ ID NO: 7580243 - DNA, 22 bp, Homo sapiens
agatgttttgtgtatttcatca

SEQ ID NO: 7580244 - DNA, 21 bp, Homo sapiens
agattaaaatctgtgagaagg

SEQ ID NO: 7580245 - DNA, 22 bp, Homo sapiens
agatgttttgtgtatttcatca

SEQ ID NO: 7580246 - DNA, 22 bp, Homo sapiens
agatgttttctaattctatatt

SEQ ID NO: 7580247 - DNA, 22 bp, Homo sapiens
agatgttttctaattctatatt

SEQ ID NO: 7580248 - DNA, 22 bp, Homo sapiens
agatgttttctaattctatatt

SEQ ID NO: 7580249 - DNA, 22 bp, Homo sapiens
agatgttttagagtttgacttg

SEQ ID NO: 7580250 - DNA, 22 bp, Homo sapiens
agatgttttagagtttgacttg

SEQ ID NO: 7580251 - DNA, 22 bp, Homo sapiens
agatggtaatcacatttatctg

SEQ ID NO: 7580252 - DNA, 22 bp, Homo sapiens
agatggtaatcacatttatctg

SEQ ID NO: 7580253 - DNA, 22 bp, Homo sapiens
agatgttttgtgtatttcatca

SEQ ID NO: 7580254 - DNA, 22 bp, Homo sapiens
agatgttttgtgtatttcatca

SEQ ID NO: 7580255 - DNA, 22 bp, Homo sapiens
agatgttttggagacactaacc

SEQ ID NO: 7580256 - DNA, 22 bp, Homo sapiens
agatgttttctaattctatatt

SEQ ID NO: 7580257 - DNA, 22 bp, Homo sapiens
agatgttttggagacactaacc

SEQ ID NO: 7580258 - DNA, 22 bp, Homo sapiens
agatgttttggagacactaacc

SEQ ID NO: 7580259 - DNA, 22 bp, Homo sapiens
agatgttttggagacactaacc

SEQ ID NO: 7580260 - DNA, 22 bp, Homo sapiens
agatctttaaaagttattatta

SEQ ID NO: 7580261 - DNA, 22 bp, Homo sapiens
agatctttaaaagttattatta

SEQ ID NO: 7580262 - DNA, 22 bp, Homo sapiens
agatctggccctcagcttgatt

SEQ ID NO: 7580263 - DNA, 22 bp, Homo sapiens
agatctggttggagtcctgaca

SEQ ID NO: 7580264 - DNA, 20 bp, Homo sapiens
agatgggttaaagctatggg

SEQ ID NO: 7580265 - DNA, 22 bp, Homo sapiens
agatctggccctcagcttgatt

SEQ ID NO: 7580266 - DNA, 22 bp, Homo sapiens
agatctggaaaatcacaggtgc

SEQ ID NO: 7580267 - DNA, 22 bp, Homo sapiens
agatctggaaaatcacaggtgc

SEQ ID NO: 7580268 - DNA, 22 bp, Homo sapiens
agatctggccctcagcttgatt

SEQ ID NO: 7580269 - DNA, 22 bp, Homo sapiens
agatctggttggagtcctgaca

SEQ ID NO: 7580270 - DNA, 23 bp, Homo sapiens
agatctgatgttaccaagaattg

SEQ ID NO: 7580271 - DNA, 23 bp, Homo sapiens
agatctgatgttaccaagaattg

SEQ ID NO: 7580272 - DNA, 22 bp, Homo sapiens
agatctggaactgaggtttatt

SEQ ID NO: 7580273 - DNA, 22 bp, Homo sapiens
agatctggaactgaggtttatt

SEQ ID NO: 7580274 - DNA, 22 bp, Homo sapiens
agatctgagtggctgcatgtaa

SEQ ID NO: 7580275 - DNA, 22 bp, Homo sapiens
agatctgagtggctgcatgtaa

SEQ ID NO: 7580276 - DNA, 22 bp, Homo sapiens
agatctgagtggctgcatgtaa

SEQ ID NO: 7580277 - DNA, 22 bp, Homo sapiens
agatctgagtatgatttgcctg

SEQ ID NO: 7580278 - DNA, 22 bp, Homo sapiens
agatctcacctctgtgtattat

SEQ ID NO: 7580279 - DNA, 22 bp, Homo sapiens
agatcggctttgcagacctcat

SEQ ID NO: 7580280 - DNA, 22 bp, Homo sapiens
agatcggctttgcagacctcat

SEQ ID NO: 7580281 - DNA, 21 bp, Homo sapiens
agatccctgaggagagcatcc

SEQ ID NO: 7580282 - DNA, 22 bp, Homo sapiens
agatcctgccaatggaagcagg

SEQ ID NO: 7580283 - DNA, 22 bp, Homo sapiens
agatcctgccaatggaagcagg

SEQ ID NO: 7580284 - DNA, 21 bp, Homo sapiens
agatcctggggtctggggagg

SEQ ID NO: 7580285 - DNA, 20 bp, Homo sapiens
agatcctgtctccaccttgg

SEQ ID NO: 7580286 - DNA, 21 bp, Homo sapiens
agatcctgtggctgagaagta

SEQ ID NO: 7580287 - DNA, 21 bp, Homo sapiens
agatcctgtggctgagaagta

SEQ ID NO: 7580288 - DNA, 22 bp, Homo sapiens
agatcctgccaatggaagcagg

SEQ ID NO: 7580289 - DNA, 22 bp, Homo sapiens
agatatgtttgtatatatttgt

SEQ ID NO: 7580290 - DNA, 21 bp, Homo sapiens
agatccagtgccataaggccc

SEQ ID NO: 7580291 - DNA, 22 bp, Homo sapiens
agatccagttaatagcttcatt

SEQ ID NO: 7580292 - DNA, 22 bp, Homo sapiens
agatccagttaatagcttcatt

SEQ ID NO: 7580293 - DNA, 22 bp, Homo sapiens
agatccagtggtgaacaaaaga

SEQ ID NO: 7580294 - DNA, 22 bp, Homo sapiens
agatatgtgcgtcttagattga

SEQ ID NO: 7580295 - DNA, 22 bp, Homo sapiens
agatatgttactgcatcatggg

SEQ ID NO: 7580296 - DNA, 22 bp, Homo sapiens
agatatgttactgcatcatggg

SEQ ID NO: 7580297 - DNA, 22 bp, Homo sapiens
agatatgttaggcttgttccct

SEQ ID NO: 7580298 - DNA, 22 bp, Homo sapiens
agatatgtttgtatatatttgt

SEQ ID NO: 7580299 - DNA, 22 bp, Homo sapiens
agatatgtttgtatatatttgt

SEQ ID NO: 7580300 - DNA, 22 bp, Homo sapiens
agatccatgtgatttggagttc

SEQ ID NO: 7580301 - DNA, 22 bp, Homo sapiens
agatccattttggtgtcaactc

SEQ ID NO: 7580302 - DNA, 22 bp, Homo sapiens
agatcccaaatcacctgcttat

SEQ ID NO: 7580303 - DNA, 22 bp, Homo sapiens
agatcccaaatcacctgcttat

SEQ ID NO: 7580304 - DNA, 22 bp, Homo sapiens
agatcccaggatactggcctat

SEQ ID NO: 7580305 - DNA, 22 bp, Homo sapiens
agatcccaggatactggcctat

SEQ ID NO: 7580306 - DNA, 22 bp, Homo sapiens
agatccagttaatagcttcatt

SEQ ID NO: 7580307 - DNA, 22 bp, Homo sapiens
agatccatcatcatattttcta

SEQ ID NO: 7580308 - DNA, 22 bp, Homo sapiens
agatccatgtgatttggagttc

SEQ ID NO: 7580309 - DNA, 22 bp, Homo sapiens
agatccagttaatagcttcatt

SEQ ID NO: 7580310 - DNA, 22 bp, Homo sapiens
agatccagttaatagcttcatt

SEQ ID NO: 7580311 - DNA, 22 bp, Homo sapiens
agatccagttaatagcttcatt

SEQ ID NO: 7580312 - DNA, 22 bp, Homo sapiens
agatatacagagaattattcac

SEQ ID NO: 7580313 - DNA, 22 bp, Homo sapiens
agatatagttgttgagaagaac

SEQ ID NO: 7580314 - DNA, 22 bp, Homo sapiens
agatatacagagaattattcac

SEQ ID NO: 7580315 - DNA, 22 bp, Homo sapiens
agatatatttaaggtaataagt

SEQ ID NO: 7580316 - DNA, 22 bp, Homo sapiens
agatatatttaaggtaataagt

SEQ ID NO: 7580317 - DNA, 22 bp, Homo sapiens
agatatatttaaggtaataagt

SEQ ID NO: 7580318 - DNA, 22 bp, Homo sapiens
agatatatttaaggtaataagt

SEQ ID NO: 7580319 - DNA, 22 bp, Homo sapiens
agatatcaccagttttacatac

SEQ ID NO: 7580320 - DNA, 22 bp, Homo sapiens
agatatcaccagttttacatac

SEQ ID NO: 7580321 - DNA, 22 bp, Homo sapiens
agatatcaccagttttacatac

SEQ ID NO: 7580322 - DNA, 22 bp, Homo sapiens
agatatatttcctgcccaaggc

SEQ ID NO: 7580323 - DNA, 22 bp, Homo sapiens
agatatctccagtgatgctcgt

SEQ ID NO: 7580324 - DNA, 22 bp, Homo sapiens
agatatcacctctaggctggtg

SEQ ID NO: 7580325 - DNA, 22 bp, Homo sapiens
agatatatttaaggtaataagt

SEQ ID NO: 7580326 - DNA, 22 bp, Homo sapiens
agatatatttaaggtaataagt

SEQ ID NO: 7580327 - DNA, 22 bp, Homo sapiens
agatatatttcctgcccaaggc

SEQ ID NO: 7580328 - DNA, 22 bp, Homo sapiens
agatatatttaaggtaataagt

SEQ ID NO: 7580329 - DNA, 22 bp, Homo sapiens
agatatcttacactttgaagtt

SEQ ID NO: 7580330 - DNA, 22 bp, Homo sapiens
agatatgactagaagctcattt

SEQ ID NO: 7580331 - DNA, 22 bp, Homo sapiens
agatatctgtattgtttccaat

SEQ ID NO: 7580332 - DNA, 22 bp, Homo sapiens
agatatctgcaatataatttaa

SEQ ID NO: 7580333 - DNA, 22 bp, Homo sapiens
agatatctgatgaaaatactct

SEQ ID NO: 7580334 - DNA, 22 bp, Homo sapiens
agatatgatgcatgtaaacatt

SEQ ID NO: 7580335 - DNA, 22 bp, Homo sapiens
agatatgatctatgattttgac

SEQ ID NO: 7580336 - DNA, 22 bp, Homo sapiens
agatatgagattttcaaacaag

SEQ ID NO: 7580337 - DNA, 22 bp, Homo sapiens
agatatgactagaagctcattt

SEQ ID NO: 7580338 - DNA, 22 bp, Homo sapiens
agatatgtgccaattgttataa

SEQ ID NO: 7580339 - DNA, 22 bp, Homo sapiens
aatttatttcctgccagtacac

SEQ ID NO: 7580340 - DNA, 22 bp, Homo sapiens
aatttatttcctgccagtacac

SEQ ID NO: 7580341 - DNA, 22 bp, Homo sapiens
aatttatttcctgccagtacac

SEQ ID NO: 7580342 - DNA, 22 bp, Homo sapiens
aatttattcccgtctctgggct

SEQ ID NO: 7580343 - DNA, 22 bp, Homo sapiens
aatttatttcctgccagtacac

SEQ ID NO: 7580344 - DNA, 22 bp, Homo sapiens
aatttatttcctgccagtacac

SEQ ID NO: 7580345 - DNA, 22 bp, Homo sapiens
aatttatttcctgccagtacac

SEQ ID NO: 7580346 - DNA, 22 bp, Homo sapiens
aatttattcccgtctctgggct

SEQ ID NO: 7580347 - DNA, 22 bp, Homo sapiens
aatttattcccgtctctgggct

SEQ ID NO: 7580348 - DNA, 22 bp, Homo sapiens
aatttattcccgtctctgggct

SEQ ID NO: 7580349 - DNA, 22 bp, Homo sapiens
aatttattcccgtctctgggct

SEQ ID NO: 7580350 - DNA, 22 bp, Homo sapiens
aatttattcccgtctctgggct

SEQ ID NO: 7580351 - DNA, 22 bp, Homo sapiens
aatttattatatcctaggggaa

SEQ ID NO: 7580352 - DNA, 22 bp, Homo sapiens
aatttattatatcctaggggaa

SEQ ID NO: 7580353 - DNA, 22 bp, Homo sapiens
agaggccacaccagcctcccgt

SEQ ID NO: 7580354 - DNA, 22 bp, Homo sapiens
agaggccacaccagcctcccgt

SEQ ID NO: 7580355 - DNA, 22 bp, Homo sapiens
agaggccacaccagcctcccgt

SEQ ID NO: 7580356 - DNA, 22 bp, Homo sapiens
agaggccaatagtaggtggcat

SEQ ID NO: 7580357 - DNA, 22 bp, Homo sapiens
agaggccaatagtaggtggcat

SEQ ID NO: 7580358 - DNA, 22 bp, Homo sapiens
agaggccacaccagcctcccgt

SEQ ID NO: 7580359 - DNA, 22 bp, Homo sapiens
aatttattatatcctaggggaa

SEQ ID NO: 7580360 - DNA, 22 bp, Homo sapiens
aatttattatatcctaggggaa

SEQ ID NO: 7580361 - DNA, 22 bp, Homo sapiens
aatttattatatcctaggggaa

SEQ ID NO: 7580362 - DNA, 22 bp, Homo sapiens
aatttatgacaaacaggtaggt

SEQ ID NO: 7580363 - DNA, 22 bp, Homo sapiens
aatttatatgtaattaggcaca

SEQ ID NO: 7580364 - DNA, 22 bp, Homo sapiens
aatttatctttagtaagcttct

SEQ ID NO: 7580365 - DNA, 22 bp, Homo sapiens
aatttatctttagtaagcttct

SEQ ID NO: 7580366 - DNA, 22 bp, Homo sapiens
agaggccaatagtaggtggcat

SEQ ID NO: 7580367 - DNA, 22 bp, Homo sapiens
agaggccaatagtaggtggcat

SEQ ID NO: 7580368 - DNA, 22 bp, Homo sapiens
agaggccaatagtaggtggcat

SEQ ID NO: 7580369 - DNA, 22 bp, Homo sapiens
agaggccaatagtaggtggcat

SEQ ID NO: 7580370 - DNA, 22 bp, Homo sapiens
agaggccaatagtaggtggcat

SEQ ID NO: 7580371 - DNA, 22 bp, Homo sapiens
agaggccaatagtaggtggcat

SEQ ID NO: 7580372 - DNA, 21 bp, Homo sapiens
agaggccaagtcatcatttcc

SEQ ID NO: 7580373 - DNA, 21 bp, Homo sapiens
agaggccaagtcatcatttcc

SEQ ID NO: 7580374 - DNA, 22 bp, Homo sapiens
agaggccaagccagactgtgca

SEQ ID NO: 7580375 - DNA, 22 bp, Homo sapiens
aatttcaaactaataggaacca

SEQ ID NO: 7580376 - DNA, 22 bp, Homo sapiens
aatttcaaactaataggaacca

SEQ ID NO: 7580377 - DNA, 22 bp, Homo sapiens
aatttcaaactaataggaacca

SEQ ID NO: 7580378 - DNA, 22 bp, Homo sapiens
aatttcaaactaataggaacca

SEQ ID NO: 7580379 - DNA, 22 bp, Homo sapiens
aatttatttcctgccagtacac

SEQ ID NO: 7580380 - DNA, 22 bp, Homo sapiens
aatttatttcctgccagtacac

SEQ ID NO: 7580381 - DNA, 22 bp, Homo sapiens
aatttcaaactcttgccctcag

SEQ ID NO: 7580382 - DNA, 22 bp, Homo sapiens
aatttcaaactaataggaacca

SEQ ID NO: 7580383 - DNA, 22 bp, Homo sapiens
aatttcaaagctcactggcata

SEQ ID NO: 7580384 - DNA, 22 bp, Homo sapiens
aatttcaaagctcactggcata

SEQ ID NO: 7580385 - DNA, 22 bp, Homo sapiens
aatttcaaagctcactggcata

SEQ ID NO: 7580386 - DNA, 22 bp, Homo sapiens
aatttcaaagctcactggcata

SEQ ID NO: 7580387 - DNA, 22 bp, Homo sapiens
aatttcaaagctcactggcata

SEQ ID NO: 7580388 - DNA, 22 bp, Homo sapiens
aatttcaaagctcactggcata

SEQ ID NO: 7580389 - DNA, 22 bp, Homo sapiens
aatttcaagtggcatctttgat

SEQ ID NO: 7580390 - DNA, 22 bp, Homo sapiens
aatttcaagtggcatctttgat

SEQ ID NO: 7580391 - DNA, 22 bp, Homo sapiens
aatttcaagtggcatctttgat

SEQ ID NO: 7580392 - DNA, 22 bp, Homo sapiens
aatttcaagtcttgaagaagta

SEQ ID NO: 7580393 - DNA, 22 bp, Homo sapiens
aatttcaagtggcatctttgat

SEQ ID NO: 7580394 - DNA, 22 bp, Homo sapiens
aatttcaagtggcatctttgat

SEQ ID NO: 7580395 - DNA, 22 bp, Homo sapiens
aatttcaagtcttgaagaagta

SEQ ID NO: 7580396 - DNA, 22 bp, Homo sapiens
aatttcaagtcttgaagaagta

SEQ ID NO: 7580397 - DNA, 22 bp, Homo sapiens
aatttcaagtcttgaagaagta

SEQ ID NO: 7580398 - DNA, 22 bp, Homo sapiens
aatttcaatgcactcatggttg

SEQ ID NO: 7580399 - DNA, 22 bp, Homo sapiens
aatttcaatgcactcatggttg

SEQ ID NO: 7580400 - DNA, 22 bp, Homo sapiens
aatttcaagtggcatctttgat

SEQ ID NO: 7580401 - DNA, 22 bp, Homo sapiens
agagggaaaaactcatgtcatt

SEQ ID NO: 7580402 - DNA, 22 bp, Homo sapiens
agagggaaaaactcatgtcatt

SEQ ID NO: 7580403 - DNA, 22 bp, Homo sapiens
agagggaaaaactcatgtcatt

SEQ ID NO: 7580404 - DNA, 22 bp, Homo sapiens
agagggcataaaatagagcacg

SEQ ID NO: 7580405 - DNA, 22 bp, Homo sapiens
agagggcataaaatagagcacg

SEQ ID NO: 7580406 - DNA, 20 bp, Homo sapiens
agaggctttcttgtagtcag

SEQ ID NO: 7580407 - DNA, 22 bp, Homo sapiens
agaggcttttctggtctttggc

SEQ ID NO: 7580408 - DNA, 22 bp, Homo sapiens
agaggcttttctggtctttggc

SEQ ID NO: 7580409 - DNA, 22 bp, Homo sapiens
agaggcttttctggtctttggc

SEQ ID NO: 7580410 - DNA, 22 bp, Homo sapiens
agaggcttggcctcagttctgt

SEQ ID NO: 7580411 - DNA, 22 bp, Homo sapiens
agaggcttggcctcagttctgt

SEQ ID NO: 7580412 - DNA, 22 bp, Homo sapiens
agaggcttggcctcagttctgt

SEQ ID NO: 7580413 - DNA, 22 bp, Homo sapiens
agaggctttctctgcttaggca

SEQ ID NO: 7580414 - DNA, 22 bp, Homo sapiens
agaggctttctctgcttaggca

SEQ ID NO: 7580415 - DNA, 20 bp, Homo sapiens
agaggctttcttgtagtcag

SEQ ID NO: 7580416 - DNA, 21 bp, Homo sapiens
aattttgaaggaagattaagg

SEQ ID NO: 7580417 - DNA, 21 bp, Homo sapiens
aattttgaaggaagattaagg

SEQ ID NO: 7580418 - DNA, 21 bp, Homo sapiens
aattttgaaggaagattaagg

SEQ ID NO: 7580419 - DNA, 22 bp, Homo sapiens
aattttctggtgtgtaatgaag

SEQ ID NO: 7580420 - DNA, 22 bp, Homo sapiens
aattttctggtgtgtaatgaag

SEQ ID NO: 7580421 - DNA, 21 bp, Homo sapiens
aattttgaaggaagattaagg

SEQ ID NO: 7580422 - DNA, 21 bp, Homo sapiens
aattttgaaggaagattaagg

SEQ ID NO: 7580423 - DNA, 22 bp, Homo sapiens
aattttgtgtgggatcaaagga

SEQ ID NO: 7580424 - DNA, 22 bp, Homo sapiens
aattttgtgtgggatcaaagga

SEQ ID NO: 7580425 - DNA, 22 bp, Homo sapiens
aattttgtgtgggatcaaagga

SEQ ID NO: 7580426 - DNA, 22 bp, Homo sapiens
aattttgtgtgggatcaaagga

SEQ ID NO: 7580427 - DNA, 22 bp, Homo sapiens
aattttgttcttggaaatcagg

SEQ ID NO: 7580428 - DNA, 22 bp, Homo sapiens
aattttgttcttggaaatcagg

SEQ ID NO: 7580429 - DNA, 22 bp, Homo sapiens
aattttgttcttggaaatcagg

SEQ ID NO: 7580430 - DNA, 22 bp, Homo sapiens
aattttgttcttggaaatcagg

SEQ ID NO: 7580431 - DNA, 22 bp, Homo sapiens
aattttgtgtgggatcaaagga

SEQ ID NO: 7580432 - DNA, 22 bp, Homo sapiens
aattttgtgtgggatcaaagga

SEQ ID NO: 7580433 - DNA, 22 bp, Homo sapiens
agagggctgcctcagtcagcta

SEQ ID NO: 7580434 - DNA, 22 bp, Homo sapiens
agagggctgcctcagtcagcta

SEQ ID NO: 7580435 - DNA, 22 bp, Homo sapiens
agagggctgcctcagtcagcta

SEQ ID NO: 7580436 - DNA, 22 bp, Homo sapiens
agagggctgctgcacagtgctc

SEQ ID NO: 7580437 - DNA, 22 bp, Homo sapiens
agagggctgctgcacagtgctc

SEQ ID NO: 7580438 - DNA, 22 bp, Homo sapiens
agagggctgctgcacagtgctc

SEQ ID NO: 7580439 - DNA, 22 bp, Homo sapiens
agagggctgctgcacagtgctc

SEQ ID NO: 7580440 - DNA, 22 bp, Homo sapiens
agagggctggacgcaggttgga

SEQ ID NO: 7580441 - DNA, 17 bp, Homo sapiens
agagggctcaaggcatc

SEQ ID NO: 7580442 - DNA, 17 bp, Homo sapiens
agagggctcaaggcatc

SEQ ID NO: 7580443 - DNA, 17 bp, Homo sapiens
agagggctcaaggcatc

SEQ ID NO: 7580444 - DNA, 17 bp, Homo sapiens
agagggctcaaggcatc

SEQ ID NO: 7580445 - DNA, 17 bp, Homo sapiens
agagggctcaaggcatc

SEQ ID NO: 7580446 - DNA, 22 bp, Homo sapiens
agagggctgcctcagtcagcta

SEQ ID NO: 7580447 - DNA, 22 bp, Homo sapiens
agagggctgcctcagtcagcta

SEQ ID NO: 7580448 - DNA, 22 bp, Homo sapiens
agagggctgcctcagtcagcta

SEQ ID NO: 7580449 - DNA, 22 bp, Homo sapiens
agagggctgcctcagtcagcta

SEQ ID NO: 7580450 - DNA, 22 bp, Homo sapiens
agagggcataaaatagagcacg

SEQ ID NO: 7580451 - DNA, 22 bp, Homo sapiens
agagggcataaaatagagcacg

SEQ ID NO: 7580452 - DNA, 22 bp, Homo sapiens
agagggcataaaatagagcacg

SEQ ID NO: 7580453 - DNA, 22 bp, Homo sapiens
agagggcataaaatagagcacg

SEQ ID NO: 7580454 - DNA, 22 bp, Homo sapiens
agagggcatgcttggtggcctg

SEQ ID NO: 7580455 - DNA, 22 bp, Homo sapiens
agagggcatgcttggtggcctg

SEQ ID NO: 7580456 - DNA, 22 bp, Homo sapiens
agagggcatgcttggtggcctg

SEQ ID NO: 7580457 - DNA, 22 bp, Homo sapiens
agagggcatgcttggtggcctg

SEQ ID NO: 7580458 - DNA, 22 bp, Homo sapiens
agagggcataaaatagagcacg

SEQ ID NO: 7580459 - DNA, 22 bp, Homo sapiens
agagggcatgcttggtggcctg

SEQ ID NO: 7580460 - DNA, 22 bp, Homo sapiens
agagggcattaactctgtcttg

SEQ ID NO: 7580461 - DNA, 22 bp, Homo sapiens
agagggcattaactctgtcttg

SEQ ID NO: 7580462 - DNA, 22 bp, Homo sapiens
agagggccataggtgcatagtt

SEQ ID NO: 7580463 - DNA, 22 bp, Homo sapiens
agagggccataggtgcatagtt

SEQ ID NO: 7580464 - DNA, 22 bp, Homo sapiens
agagggcccatgttgggctgct

SEQ ID NO: 7580465 - DNA, 22 bp, Homo sapiens
agagggcccatgttgggctgct

SEQ ID NO: 7580466 - DNA, 22 bp, Homo sapiens
agagggcccatgttgggctgct

SEQ ID NO: 7580467 - DNA, 22 bp, Homo sapiens
agagggccataggtgcatagtt

SEQ ID NO: 7580468 - DNA, 22 bp, Homo sapiens
agagggccataggtgcatagtt

SEQ ID NO: 7580469 - DNA, 22 bp, Homo sapiens
agagggccataggtgcatagtt

SEQ ID NO: 7580470 - DNA, 22 bp, Homo sapiens
agagggcgcccaggcccacgcc

SEQ ID NO: 7580471 - DNA, 22 bp, Homo sapiens
agagggctaactgggaagcagg

SEQ ID NO: 7580472 - DNA, 22 bp, Homo sapiens
agagggctaactgggaagcagg

SEQ ID NO: 7580473 - DNA, 22 bp, Homo sapiens
agagggccccagctgatctgag

SEQ ID NO: 7580474 - DNA, 21 bp, Homo sapiens
agagggcgaaggcggggtccg

SEQ ID NO: 7580475 - DNA, 21 bp, Homo sapiens
agagggcgaaggcggggtccg

SEQ ID NO: 7580476 - DNA, 22 bp, Homo sapiens
agagggccccagctgatctgag

SEQ ID NO: 7580477 - DNA, 22 bp, Homo sapiens
agagggcccatgttgggctgct

SEQ ID NO: 7580478 - DNA, 22 bp, Homo sapiens
agagggcccatgttgggctgct

SEQ ID NO: 7580479 - DNA, 22 bp, Homo sapiens
agagggctaaggtttgggagat

SEQ ID NO: 7580480 - DNA, 22 bp, Homo sapiens
agagggctaactgggaagcagg

SEQ ID NO: 7580481 - DNA, 22 bp, Homo sapiens
agagggctaactgggaagcagg

SEQ ID NO: 7580482 - DNA, 22 bp, Homo sapiens
agagggctaaggtttgggagat

SEQ ID NO: 7580483 - DNA, 22 bp, Homo sapiens
agagggctaaggtttgggagat

SEQ ID NO: 7580484 - DNA, 22 bp, Homo sapiens
agagggctaaggtttgggagat

SEQ ID NO: 7580485 - DNA, 22 bp, Homo sapiens
agagggctaactgggaagcagg

SEQ ID NO: 7580486 - DNA, 22 bp, Homo sapiens
agagggctaactgggaagcagg

SEQ ID NO: 7580487 - DNA, 22 bp, Homo sapiens
agagggctaactgggaagcagg

SEQ ID NO: 7580488 - DNA, 22 bp, Homo sapiens
agaggcatgatcttataattta

SEQ ID NO: 7580489 - DNA, 22 bp, Homo sapiens
agaggcatgcacagatgtgctg

SEQ ID NO: 7580490 - DNA, 22 bp, Homo sapiens
agaggccaaagaatctacaaga

SEQ ID NO: 7580491 - DNA, 22 bp, Homo sapiens
agaggccaaagaatctacaaga

SEQ ID NO: 7580492 - DNA, 22 bp, Homo sapiens
agaggccaaagaatctacaaga

SEQ ID NO: 7580493 - DNA, 23 bp, Homo sapiens
agaggccaacttcttgcccctcc

SEQ ID NO: 7580494 - DNA, 23 bp, Homo sapiens
agaggccaacttcttgcccctcc

SEQ ID NO: 7580495 - DNA, 23 bp, Homo sapiens
agaggccaacttcttgcccctcc

SEQ ID NO: 7580496 - DNA, 23 bp, Homo sapiens
agaggccaacttcttgcccctcc

SEQ ID NO: 7580497 - DNA, 23 bp, Homo sapiens
agaggccaacttcttgcccctcc

SEQ ID NO: 7580498 - DNA, 22 bp, Homo sapiens
agaggccaagccagactgtgca

SEQ ID NO: 7580499 - DNA, 22 bp, Homo sapiens
agaggccaagccagactgtgca

SEQ ID NO: 7580500 - DNA, 22 bp, Homo sapiens
agaggccaagccagactgtgca

SEQ ID NO: 7580501 - DNA, 22 bp, Homo sapiens
agaggccaagccagactgtgca

SEQ ID NO: 7580502 - DNA, 22 bp, Homo sapiens
agaggccaagccagactgtgca

SEQ ID NO: 7580503 - DNA, 22 bp, Homo sapiens
agaggccaagccagactgtgca

SEQ ID NO: 7580504 - DNA, 22 bp, Homo sapiens
agaggccaagccagactgtgca

SEQ ID NO: 7580505 - DNA, 22 bp, Homo sapiens
agaggccaagccagactgtgca

SEQ ID NO: 7580506 - DNA, 23 bp, Homo sapiens
agaggccaacttcttgcccctcc

SEQ ID NO: 7580507 - DNA, 22 bp, Homo sapiens
agaggcagtatacaatccgagc

SEQ ID NO: 7580508 - DNA, 22 bp, Homo sapiens
agaggcagtatacaatccgagc

SEQ ID NO: 7580509 - DNA, 19 bp, Homo sapiens
agaggcagtctccaacagg

SEQ ID NO: 7580510 - DNA, 19 bp, Homo sapiens
agaggcagtctccaacagg

SEQ ID NO: 7580511 - DNA, 22 bp, Homo sapiens
agaggcagtatacaatccgagc

SEQ ID NO: 7580512 - DNA, 19 bp, Homo sapiens
agaggcagtctccaacagg

SEQ ID NO: 7580513 - DNA, 19 bp, Homo sapiens
agaggcagtctccaacagg

SEQ ID NO: 7580514 - DNA, 19 bp, Homo sapiens
agaggcagtctccaacagg

SEQ ID NO: 7580515 - DNA, 19 bp, Homo sapiens
agaggcagtctccaacagg

SEQ ID NO: 7580516 - DNA, 19 bp, Homo sapiens
agaggcagtctccaacagg

SEQ ID NO: 7580517 - DNA, 19 bp, Homo sapiens
agaggcagtctccaacagg

SEQ ID NO: 7580518 - DNA, 19 bp, Homo sapiens
agaggcagtctccaacagg

SEQ ID NO: 7580519 - DNA, 21 bp, Homo sapiens
agaggcaggcattaagtacac

SEQ ID NO: 7580520 - DNA, 21 bp, Homo sapiens
agaggcaggcattaagtacac

SEQ ID NO: 7580521 - DNA, 21 bp, Homo sapiens
agaggcaggcattaagtacac

SEQ ID NO: 7580522 - DNA, 21 bp, Homo sapiens
agaggcaggcattaagtacac

SEQ ID NO: 7580523 - DNA, 21 bp, Homo sapiens
agaggcaggcattaagtacac

SEQ ID NO: 7580524 - DNA, 21 bp, Homo sapiens
agaggcaggcattaagtacac

SEQ ID NO: 7580525 - DNA, 21 bp, Homo sapiens
agaggcaggcattaagtacac

SEQ ID NO: 7580526 - DNA, 22 bp, Homo sapiens
agaggcagtatacaatccgagc

SEQ ID NO: 7580527 - DNA, 22 bp, Homo sapiens
agaggcagtatacaatccgagc

SEQ ID NO: 7580528 - DNA, 21 bp, Homo sapiens
agaggcaggcattaagtacac

SEQ ID NO: 7580529 - DNA, 21 bp, Homo sapiens
agaggcaggcattaagtacac

SEQ ID NO: 7580530 - DNA, 22 bp, Homo sapiens
agaggcagtatacaatccgagc

SEQ ID NO: 7580531 - DNA, 22 bp, Homo sapiens
agaggcagtatacaatccgagc

SEQ ID NO: 7580532 - DNA, 21 bp, Homo sapiens
agaggcaggcattaagtacac

SEQ ID NO: 7580533 - DNA, 21 bp, Homo sapiens
agaggcaggcattaagtacac

SEQ ID NO: 7580534 - DNA, 22 bp, Homo sapiens
agaggcaacatggggaacagat

SEQ ID NO: 7580535 - DNA, 22 bp, Homo sapiens
agaggcaactgatttctgccag

SEQ ID NO: 7580536 - DNA, 22 bp, Homo sapiens
agaggcaactgatttctgccag

SEQ ID NO: 7580537 - DNA, 22 bp, Homo sapiens
agagcaggtggcaactctggga

SEQ ID NO: 7580538 - DNA, 22 bp, Homo sapiens
agagcaggtggcaactctggga

SEQ ID NO: 7580539 - DNA, 22 bp, Homo sapiens
agaggcaacatggggaacagat

SEQ ID NO: 7580540 - DNA, 22 bp, Homo sapiens
agaggcaacatggggaacagat

SEQ ID NO: 7580541 - DNA, 22 bp, Homo sapiens
agagcaggcataaagctttgaa

SEQ ID NO: 7580542 - DNA, 22 bp, Homo sapiens
agagcaggcataaagctttgaa

SEQ ID NO: 7580543 - DNA, 22 bp, Homo sapiens
agagcaggcataaagctttgaa

SEQ ID NO: 7580544 - DNA, 22 bp, Homo sapiens
agagcaggcataaagctttgaa

SEQ ID NO: 7580545 - DNA, 22 bp, Homo sapiens
agagcaggggcaatgtgttgca

SEQ ID NO: 7580546 - DNA, 22 bp, Homo sapiens
agagcaggggcaatgtgttgca

SEQ ID NO: 7580547 - DNA, 22 bp, Homo sapiens
agagcaggggcaatgtgttgca

SEQ ID NO: 7580548 - DNA, 22 bp, Homo sapiens
agagcaggggcaatgtgttgca

SEQ ID NO: 7580549 - DNA, 22 bp, Homo sapiens
agagcaggggcaatgtgttgca

SEQ ID NO: 7580550 - DNA, 22 bp, Homo sapiens
agagcaggcataaagctttgaa

SEQ ID NO: 7580551 - DNA, 22 bp, Homo sapiens
agagcagctggctgcatctaga

SEQ ID NO: 7580552 - DNA, 22 bp, Homo sapiens
agagcagctggctgcatctaga

SEQ ID NO: 7580553 - DNA, 22 bp, Homo sapiens
agagcagctgcattcagcacct

SEQ ID NO: 7580554 - DNA, 22 bp, Homo sapiens
agagcagctggctgcatctaga

SEQ ID NO: 7580555 - DNA, 22 bp, Homo sapiens
agagcagctggggcagagacca

SEQ ID NO: 7580556 - DNA, 22 bp, Homo sapiens
agagcagctgtgacatggacag

SEQ ID NO: 7580557 - DNA, 22 bp, Homo sapiens
agagcagctggggcagagacca

SEQ ID NO: 7580558 - DNA, 22 bp, Homo sapiens
agagcagctggggcagagacca

SEQ ID NO: 7580559 - DNA, 22 bp, Homo sapiens
agagcagctggggcagagacca

SEQ ID NO: 7580560 - DNA, 22 bp, Homo sapiens
agagcagctggggcagagacca

SEQ ID NO: 7580561 - DNA, 22 bp, Homo sapiens
agagcagcttttcggaaccact

SEQ ID NO: 7580562 - DNA, 22 bp, Homo sapiens
agagcagcttttcggaaccact

SEQ ID NO: 7580563 - DNA, 22 bp, Homo sapiens
agagcagcttttcggaaccact

SEQ ID NO: 7580564 - DNA, 22 bp, Homo sapiens
agagcagcttttcggaaccact

SEQ ID NO: 7580565 - DNA, 22 bp, Homo sapiens
agagcagcttttcggaaccact

SEQ ID NO: 7580566 - DNA, 22 bp, Homo sapiens
agagcagcttttcggaaccact

SEQ ID NO: 7580567 - DNA, 22 bp, Homo sapiens
agagcagctgtgacatggacag

SEQ ID NO: 7580568 - DNA, 22 bp, Homo sapiens
agagcagctgtgacatggacag

SEQ ID NO: 7580569 - DNA, 22 bp, Homo sapiens
agagcagctgtgacatggacag

SEQ ID NO: 7580570 - DNA, 22 bp, Homo sapiens
agagcagctgtgacatggacag

SEQ ID NO: 7580571 - DNA, 22 bp, Homo sapiens
agagcagctgtgacatggacag

SEQ ID NO: 7580572 - DNA, 22 bp, Homo sapiens
agagcagctgtgacatggacag

SEQ ID NO: 7580573 - DNA, 22 bp, Homo sapiens
aattcatactctatattgcttt

SEQ ID NO: 7580574 - DNA, 22 bp, Homo sapiens
aattcatactctatattgcttt

SEQ ID NO: 7580575 - DNA, 22 bp, Homo sapiens
aattcatactctatattgcttt

SEQ ID NO: 7580576 - DNA, 22 bp, Homo sapiens
aattcatactctatattgcttt

SEQ ID NO: 7580577 - DNA, 22 bp, Homo sapiens
aattcagttgacagctaatgcc

SEQ ID NO: 7580578 - DNA, 22 bp, Homo sapiens
aattcagtgtctggcactgctg

SEQ ID NO: 7580579 - DNA, 22 bp, Homo sapiens
aattcagtggtttctgcaacaa

SEQ ID NO: 7580580 - DNA, 20 bp, Homo sapiens
aattcagctgccttcatgct

SEQ ID NO: 7580581 - DNA, 20 bp, Homo sapiens
aattcagctgccttcatgct

SEQ ID NO: 7580582 - DNA, 20 bp, Homo sapiens
aattcagctgccttcatgct

SEQ ID NO: 7580583 - DNA, 22 bp, Homo sapiens
aattcagcaaaaagatacagga

SEQ ID NO: 7580584 - DNA, 22 bp, Homo sapiens
aattcagagactcattctggag

SEQ ID NO: 7580585 - DNA, 22 bp, Homo sapiens
aattcagagactcattctggag

SEQ ID NO: 7580586 - DNA, 22 bp, Homo sapiens
aattcagagacatgaagtgaca

SEQ ID NO: 7580587 - DNA, 22 bp, Homo sapiens
aattcagagacatgaagtgaca

SEQ ID NO: 7580588 - DNA, 22 bp, Homo sapiens
aattcagatggaagattctggc

SEQ ID NO: 7580589 - DNA, 22 bp, Homo sapiens
agagcagcgtttgtggaacact

SEQ ID NO: 7580590 - DNA, 22 bp, Homo sapiens
agagcagcgtttgtggaacact

SEQ ID NO: 7580591 - DNA, 22 bp, Homo sapiens
agagcagcgtttgtggaacact

SEQ ID NO: 7580592 - DNA, 22 bp, Homo sapiens
agagcagcgtttgtggaacact

SEQ ID NO: 7580593 - DNA, 22 bp, Homo sapiens
agagcagcgtttgtggaacact

SEQ ID NO: 7580594 - DNA, 22 bp, Homo sapiens
agagcagcgtttgtggaacact

SEQ ID NO: 7580595 - DNA, 18 bp, Homo sapiens
agagcagcggcatcacac

SEQ ID NO: 7580596 - DNA, 22 bp, Homo sapiens
aattcatactctatattgcttt

SEQ ID NO: 7580597 - DNA, 22 bp, Homo sapiens
agagcagctgcattcagcacct

SEQ ID NO: 7580598 - DNA, 22 bp, Homo sapiens
agagcagctgcattcagcacct

SEQ ID NO: 7580599 - DNA, 22 bp, Homo sapiens
agagcagctgacagcctgccat

SEQ ID NO: 7580600 - DNA, 22 bp, Homo sapiens
agagcagctgacagcctgccat

SEQ ID NO: 7580601 - DNA, 22 bp, Homo sapiens
agagcagctgacagcctgccat

SEQ ID NO: 7580602 - DNA, 22 bp, Homo sapiens
agagcagctgacagcctgccat

SEQ ID NO: 7580603 - DNA, 22 bp, Homo sapiens
agagcagctgacagcctgccat

SEQ ID NO: 7580604 - DNA, 22 bp, Homo sapiens
agagcagctgacagcctgccat

SEQ ID NO: 7580605 - DNA, 22 bp, Homo sapiens
agagcagctgacagcctgccat

SEQ ID NO: 7580606 - DNA, 22 bp, Homo sapiens
agagcagctcgctacctctcta

SEQ ID NO: 7580607 - DNA, 22 bp, Homo sapiens
aattcacatgcatgtctgtgca

SEQ ID NO: 7580608 - DNA, 22 bp, Homo sapiens
aattcacatgcatgtctgtgca

SEQ ID NO: 7580609 - DNA, 22 bp, Homo sapiens
aattcacatgcatgtctgtgca

SEQ ID NO: 7580610 - DNA, 22 bp, Homo sapiens
aattcacatccgaccaggtcaa

SEQ ID NO: 7580611 - DNA, 22 bp, Homo sapiens
aattcacatccgaccaggtcaa

SEQ ID NO: 7580612 - DNA, 22 bp, Homo sapiens
aattcacatgttgaagtcctaa

SEQ ID NO: 7580613 - DNA, 22 bp, Homo sapiens
aattcacatgttgaagtcctaa

SEQ ID NO: 7580614 - DNA, 22 bp, Homo sapiens
aattcacatgcatgtctgtgca

SEQ ID NO: 7580615 - DNA, 22 bp, Homo sapiens
aattcacatgttgaagtcctaa

SEQ ID NO: 7580616 - DNA, 22 bp, Homo sapiens
aattcactgaacttctctgaga

SEQ ID NO: 7580617 - DNA, 22 bp, Homo sapiens
aattcactgttccttctgcttt

SEQ ID NO: 7580618 - DNA, 22 bp, Homo sapiens
aattcactgaacttctctgaga

SEQ ID NO: 7580619 - DNA, 22 bp, Homo sapiens
aattcactgaacttctctgaga

SEQ ID NO: 7580620 - DNA, 22 bp, Homo sapiens
aattcactgttccttctgcttt

SEQ ID NO: 7580621 - DNA, 22 bp, Homo sapiens
aattcactgttccttctgcttt

SEQ ID NO: 7580622 - DNA, 22 bp, Homo sapiens
aattcactgaacttctctgaga

SEQ ID NO: 7580623 - DNA, 22 bp, Homo sapiens
aattcactgaacttctctgaga

SEQ ID NO: 7580624 - DNA, 22 bp, Homo sapiens
aattcactccacttctgtgtct

SEQ ID NO: 7580625 - DNA, 22 bp, Homo sapiens
aattcacatgttgaagtcctaa

SEQ ID NO: 7580626 - DNA, 22 bp, Homo sapiens
aattcacatatacattattcct

SEQ ID NO: 7580627 - DNA, 22 bp, Homo sapiens
aattcacatatacattattcct

SEQ ID NO: 7580628 - DNA, 22 bp, Homo sapiens
aattcacatatacattattcct

SEQ ID NO: 7580629 - DNA, 22 bp, Homo sapiens
aattcacatatacattattcct

SEQ ID NO: 7580630 - DNA, 22 bp, Homo sapiens
aattcacatatacattattcct

SEQ ID NO: 7580631 - DNA, 22 bp, Homo sapiens
aattcacatatacattattcct

SEQ ID NO: 7580632 - DNA, 22 bp, Homo sapiens
aattcacagttctgcaccttac

SEQ ID NO: 7580633 - DNA, 22 bp, Homo sapiens
aattcacaggatcacaggagag

SEQ ID NO: 7580634 - DNA, 22 bp, Homo sapiens
aattcacaggatcacaggagag

SEQ ID NO: 7580635 - DNA, 22 bp, Homo sapiens
aattcacagttctgcaccttac

SEQ ID NO: 7580636 - DNA, 22 bp, Homo sapiens
aattcacagttctgcaccttac

SEQ ID NO: 7580637 - DNA, 22 bp, Homo sapiens
aattcacaggatcacaggagag

SEQ ID NO: 7580638 - DNA, 22 bp, Homo sapiens
aattcacaggatcacaggagag

SEQ ID NO: 7580639 - DNA, 22 bp, Homo sapiens
aattcacaggatcacaggagag

SEQ ID NO: 7580640 - DNA, 22 bp, Homo sapiens
aattcacaggatcacaggagag

SEQ ID NO: 7580641 - DNA, 22 bp, Homo sapiens
aattcacaggaggtatttgtcc

SEQ ID NO: 7580642 - DNA, 22 bp, Homo sapiens
aattcacaggaggtatttgtcc

SEQ ID NO: 7580643 - DNA, 22 bp, Homo sapiens
aattcacaggaggtatttgtcc

SEQ ID NO: 7580644 - DNA, 22 bp, Homo sapiens
aattcacaggaggtatttgtcc

SEQ ID NO: 7580645 - DNA, 22 bp, Homo sapiens
aattcacaggaggtatttgtcc

SEQ ID NO: 7580646 - DNA, 22 bp, Homo sapiens
aattcacaggaggtatttgtcc

SEQ ID NO: 7580647 - DNA, 22 bp, Homo sapiens
aattcacaggaggtatttgtcc

SEQ ID NO: 7580648 - DNA, 22 bp, Homo sapiens
aattcacagcatttgcccatct

SEQ ID NO: 7580649 - DNA, 22 bp, Homo sapiens
aattcacagcatttgcccatct

SEQ ID NO: 7580650 - DNA, 22 bp, Homo sapiens
aattcacagcatttgcccatct

SEQ ID NO: 7580651 - DNA, 22 bp, Homo sapiens
agaatcattatatttattaagc

SEQ ID NO: 7580652 - DNA, 22 bp, Homo sapiens
agaatcattatatttattaagc

SEQ ID NO: 7580653 - DNA, 22 bp, Homo sapiens
agaatcattatatttattaagc

SEQ ID NO: 7580654 - DNA, 22 bp, Homo sapiens
agaatcattatatttattaagc

SEQ ID NO: 7580655 - DNA, 21 bp, Homo sapiens
agaatccattcagaccttctc

SEQ ID NO: 7580656 - DNA, 21 bp, Homo sapiens
agaatccaagatgccattggc

SEQ ID NO: 7580657 - DNA, 22 bp, Homo sapiens
agaatcattagagagaaaactt

SEQ ID NO: 7580658 - DNA, 22 bp, Homo sapiens
agaatcattagagagaaaactt

SEQ ID NO: 7580659 - DNA, 22 bp, Homo sapiens
agaatcattagagagaaaactt

SEQ ID NO: 7580660 - DNA, 19 bp, Homo sapiens
agaatcatcttgaagtgat

SEQ ID NO: 7580661 - DNA, 22 bp, Homo sapiens
agaatcaggacctgtggctgtc

SEQ ID NO: 7580662 - DNA, 21 bp, Homo sapiens
agaataatggtatcatttgct

SEQ ID NO: 7580663 - DNA, 21 bp, Homo sapiens
agaataatggtatcatttgct

SEQ ID NO: 7580664 - DNA, 21 bp, Homo sapiens
agaataatggtatcatttgct

SEQ ID NO: 7580665 - DNA, 22 bp, Homo sapiens
agaatcagtgagcagttgtgat

SEQ ID NO: 7580666 - DNA, 22 bp, Homo sapiens
agaatcagtgctggctattagc

SEQ ID NO: 7580667 - DNA, 22 bp, Homo sapiens
agaatcagtgctggctattagc

SEQ ID NO: 7580668 - DNA, 22 bp, Homo sapiens
agaatcagtgagcagttgtgat

SEQ ID NO: 7580669 - DNA, 22 bp, Homo sapiens
agaataatcactgaagttcaaa

SEQ ID NO: 7580670 - DNA, 22 bp, Homo sapiens
agaataatcactgaagttcaaa

SEQ ID NO: 7580671 - DNA, 22 bp, Homo sapiens
agaataatcactgaagttcaaa

SEQ ID NO: 7580672 - DNA, 22 bp, Homo sapiens
agaataatcactgaagttcaaa

SEQ ID NO: 7580673 - DNA, 22 bp, Homo sapiens
agaataatcactgaagttcaaa

SEQ ID NO: 7580674 - DNA, 22 bp, Homo sapiens
agaataatcactgaagttcaaa

SEQ ID NO: 7580675 - DNA, 22 bp, Homo sapiens
agaataatactgaaatgctgaa

SEQ ID NO: 7580676 - DNA, 22 bp, Homo sapiens
agaataatactgaaatgctgaa

SEQ ID NO: 7580677 - DNA, 22 bp, Homo sapiens
agaataatactgaaatgctgaa

SEQ ID NO: 7580678 - DNA, 22 bp, Homo sapiens
agaataatactgaaatgctgaa

SEQ ID NO: 7580679 - DNA, 22 bp, Homo sapiens
agaataaatgttggacttagga

SEQ ID NO: 7580680 - DNA, 22 bp, Homo sapiens
agaataaatgttggacttagga

SEQ ID NO: 7580681 - DNA, 22 bp, Homo sapiens
agaataaatgttggacttagga

SEQ ID NO: 7580682 - DNA, 22 bp, Homo sapiens
agaataaatgttggacttagga

SEQ ID NO: 7580683 - DNA, 22 bp, Homo sapiens
agaataaatgttggacttagga

SEQ ID NO: 7580684 - DNA, 22 bp, Homo sapiens
agaataaatgttggacttagga

SEQ ID NO: 7580685 - DNA, 22 bp, Homo sapiens
agaataagcctgacgaaaccta

SEQ ID NO: 7580686 - DNA, 22 bp, Homo sapiens
agaataaatgttggacttagga

SEQ ID NO: 7580687 - DNA, 22 bp, Homo sapiens
agaagttttgttgaatgtgtga

SEQ ID NO: 7580688 - DNA, 22 bp, Homo sapiens
agaagttttgttgaatgtgtga

SEQ ID NO: 7580689 - DNA, 22 bp, Homo sapiens
agaagttttgggaaatactgat

SEQ ID NO: 7580690 - DNA, 22 bp, Homo sapiens
agaagttttgggaaatactgat

SEQ ID NO: 7580691 - DNA, 22 bp, Homo sapiens
agaagttttgggaaatactgat

SEQ ID NO: 7580692 - DNA, 22 bp, Homo sapiens
agaagttttgggaaatactgat

SEQ ID NO: 7580693 - DNA, 22 bp, Homo sapiens
agaagtttgttatgtaaacaaa

SEQ ID NO: 7580694 - DNA, 22 bp, Homo sapiens
agaagttttcattacctataca

SEQ ID NO: 7580695 - DNA, 22 bp, Homo sapiens
agaagtttgttatgtaaacaaa

SEQ ID NO: 7580696 - DNA, 22 bp, Homo sapiens
agaataaaatagtctgaagatg

SEQ ID NO: 7580697 - DNA, 22 bp, Homo sapiens
agaataaaatagtctgaagatg

SEQ ID NO: 7580698 - DNA, 22 bp, Homo sapiens
agaataaaatagtctgaagatg

SEQ ID NO: 7580699 - DNA, 22 bp, Homo sapiens
agaataaaatagtctgaagatg

SEQ ID NO: 7580700 - DNA, 22 bp, Homo sapiens
agaataaaatagtctgaagatg

SEQ ID NO: 7580701 - DNA, 22 bp, Homo sapiens
agaataaaatagtctgaagatg

SEQ ID NO: 7580702 - DNA, 22 bp, Homo sapiens
agaataaaatagtctgaagatg

SEQ ID NO: 7580703 - DNA, 22 bp, Homo sapiens
agaataaactgctttagggcag

SEQ ID NO: 7580704 - DNA, 22 bp, Homo sapiens
agaataaatgctacctatcaca

SEQ ID NO: 7580705 - DNA, 22 bp, Homo sapiens
agaataaatgctacctatcaca

SEQ ID NO: 7580706 - DNA, 22 bp, Homo sapiens
agaataaatcaaatgtcctgag

SEQ ID NO: 7580707 - DNA, 22 bp, Homo sapiens
agaataaatcaaatgtcctgag

SEQ ID NO: 7580708 - DNA, 22 bp, Homo sapiens
agaataaatcaaatgtcctgag

SEQ ID NO: 7580709 - DNA, 22 bp, Homo sapiens
agaataaactgctttagggcag

SEQ ID NO: 7580710 - DNA, 22 bp, Homo sapiens
agaataaatcaaatgtcctgag

SEQ ID NO: 7580711 - DNA, 22 bp, Homo sapiens
agaataaatcaaatgtcctgag

SEQ ID NO: 7580712 - DNA, 22 bp, Homo sapiens
agaataaactgctttagggcag

SEQ ID NO: 7580713 - DNA, 22 bp, Homo sapiens
agaataaatgctacctatcaca

SEQ ID NO: 7580714 - DNA, 22 bp, Homo sapiens
agaataaatgctacctatcaca

SEQ ID NO: 7580715 - DNA, 22 bp, Homo sapiens
agaataaatgctacctatcaca

SEQ ID NO: 7580716 - DNA, 22 bp, Homo sapiens
agaataaatgctacctatcaca

SEQ ID NO: 7580717 - DNA, 22 bp, Homo sapiens
agaataaatgctacctatcaca

SEQ ID NO: 7580718 - DNA, 22 bp, Homo sapiens
agaataaatgctacctatcaca

SEQ ID NO: 7580719 - DNA, 22 bp, Homo sapiens
agaataaatgctacctatcaca

SEQ ID NO: 7580720 - DNA, 22 bp, Homo sapiens
agaataaatgctacctatcaca

SEQ ID NO: 7580721 - DNA, 21 bp, Homo sapiens
aatggaagtttaaaggtatcc

SEQ ID NO: 7580722 - DNA, 22 bp, Homo sapiens
aatggaatacctaggtggccca

SEQ ID NO: 7580723 - DNA, 22 bp, Homo sapiens
aatggaatacctaggtggccca

SEQ ID NO: 7580724 - DNA, 22 bp, Homo sapiens
aatggaatacctaggtggccca

SEQ ID NO: 7580725 - DNA, 22 bp, Homo sapiens
aatggaatacctaggtggccca

SEQ ID NO: 7580726 - DNA, 22 bp, Homo sapiens
aatggaatacctaggtggccca

SEQ ID NO: 7580727 - DNA, 22 bp, Homo sapiens
aatggaatgcctcacatgtatt

SEQ ID NO: 7580728 - DNA, 22 bp, Homo sapiens
aatggaatgcctcacatgtatt

SEQ ID NO: 7580729 - DNA, 22 bp, Homo sapiens
aatggaatgcctcacatgtatt

SEQ ID NO: 7580730 - DNA, 22 bp, Homo sapiens
aatggaatgcctcacatgtatt

SEQ ID NO: 7580731 - DNA, 22 bp, Homo sapiens
aatggaattctccattagatgt

SEQ ID NO: 7580732 - DNA, 22 bp, Homo sapiens
aatggacaaacttgggaagtat

SEQ ID NO: 7580733 - DNA, 22 bp, Homo sapiens
aatggagaccctaaggaagagg

SEQ ID NO: 7580734 - DNA, 22 bp, Homo sapiens
aatggactcataaacagagtga

SEQ ID NO: 7580735 - DNA, 19 bp, Homo sapiens
aatggacaggcaatagtct

SEQ ID NO: 7580736 - DNA, 19 bp, Homo sapiens
aatggacaggcaatagtct

SEQ ID NO: 7580737 - DNA, 19 bp, Homo sapiens
aatggacaggcaatagtct

SEQ ID NO: 7580738 - DNA, 22 bp, Homo sapiens
aatgctttttgcgaaatgtgca

SEQ ID NO: 7580739 - DNA, 22 bp, Homo sapiens
aatgctttttgcgaaatgtgca

SEQ ID NO: 7580740 - DNA, 22 bp, Homo sapiens
aatgcttttgctgtcattgctt

SEQ ID NO: 7580741 - DNA, 22 bp, Homo sapiens
aatgcttttgctgtcattgctt

SEQ ID NO: 7580742 - DNA, 22 bp, Homo sapiens
aatgcttttgctgtcattgctt

SEQ ID NO: 7580743 - DNA, 22 bp, Homo sapiens
aatgcttttacgacatgtacct

SEQ ID NO: 7580744 - DNA, 22 bp, Homo sapiens
aatgcttttacgacatgtacct

SEQ ID NO: 7580745 - DNA, 22 bp, Homo sapiens
aatgcttttacgacatgtacct

SEQ ID NO: 7580746 - DNA, 22 bp, Homo sapiens
aatggaacttgtaattatgtcc

SEQ ID NO: 7580747 - DNA, 18 bp, Homo sapiens
aatggaaggggtgctgtt

SEQ ID NO: 7580748 - DNA, 21 bp, Homo sapiens
aatggaagtttaaaggtatcc

SEQ ID NO: 7580749 - DNA, 18 bp, Homo sapiens
aatggaaggggtgctgtt

SEQ ID NO: 7580750 - DNA, 22 bp, Homo sapiens
aatggaacctagttatccacat

SEQ ID NO: 7580751 - DNA, 22 bp, Homo sapiens
aatgctttttgcgaaatgtgca

SEQ ID NO: 7580752 - DNA, 22 bp, Homo sapiens
aatgctttttgcgaaatgtgca

SEQ ID NO: 7580753 - DNA, 22 bp, Homo sapiens
aatgctttttgcgaaatgtgca

SEQ ID NO: 7580754 - DNA, 22 bp, Homo sapiens
aatgctttgattgattaaaaca

SEQ ID NO: 7580755 - DNA, 22 bp, Homo sapiens
aatgctttgattgattaaaaca

SEQ ID NO: 7580756 - DNA, 22 bp, Homo sapiens
aatgctttgagggaagatgaaa

SEQ ID NO: 7580757 - DNA, 22 bp, Homo sapiens
aatgctttgattgattaaaaca

SEQ ID NO: 7580758 - DNA, 22 bp, Homo sapiens
aatgctttgattgattaaaaca

SEQ ID NO: 7580759 - DNA, 22 bp, Homo sapiens
aatgctttgattgattaaaaca

SEQ ID NO: 7580760 - DNA, 22 bp, Homo sapiens
aatgctttgccaacagctattg

SEQ ID NO: 7580761 - DNA, 22 bp, Homo sapiens
aatgctttgccaacagctattg

SEQ ID NO: 7580762 - DNA, 22 bp, Homo sapiens
aatgctttggggttggtactgt

SEQ ID NO: 7580763 - DNA, 22 bp, Homo sapiens
aatgctttgtctgctccagact

SEQ ID NO: 7580764 - DNA, 22 bp, Homo sapiens
aatgctttgactatatctataa

SEQ ID NO: 7580765 - DNA, 22 bp, Homo sapiens
aatgctttgactatatctataa

SEQ ID NO: 7580766 - DNA, 22 bp, Homo sapiens
aatgctttgactatatctataa

SEQ ID NO: 7580767 - DNA, 22 bp, Homo sapiens
aatgctttgactatatctataa

SEQ ID NO: 7580768 - DNA, 22 bp, Homo sapiens
aatgctttgactatatctataa

SEQ ID NO: 7580769 - DNA, 22 bp, Homo sapiens
aatgctttgactatatctataa

SEQ ID NO: 7580770 - DNA, 22 bp, Homo sapiens
aatgctgtatatcttagctaat

SEQ ID NO: 7580771 - DNA, 22 bp, Homo sapiens
aatgctttgagggaagatgaaa

SEQ ID NO: 7580772 - DNA, 22 bp, Homo sapiens
aatgctttgagggaagatgaaa

SEQ ID NO: 7580773 - DNA, 22 bp, Homo sapiens
aatgctttgagggaagatgaaa

SEQ ID NO: 7580774 - DNA, 22 bp, Homo sapiens
aatgaaacaattagctgtaata

SEQ ID NO: 7580775 - DNA, 22 bp, Homo sapiens
aatgaaaattggaccctagaac

SEQ ID NO: 7580776 - DNA, 22 bp, Homo sapiens
aatgaaacatatttaggaataa

SEQ ID NO: 7580777 - DNA, 22 bp, Homo sapiens
aatgaaacaattagctgtaata

SEQ ID NO: 7580778 - DNA, 22 bp, Homo sapiens
aatgaaacatatttaggaataa

SEQ ID NO: 7580779 - DNA, 22 bp, Homo sapiens
aatgaaacatatttaggaataa

SEQ ID NO: 7580780 - DNA, 22 bp, Homo sapiens
aatgaaacatatttaggaataa

SEQ ID NO: 7580781 - DNA, 22 bp, Homo sapiens
aatgaaaattggaccctagaac

SEQ ID NO: 7580782 - DNA, 22 bp, Homo sapiens
aatgaaaattggaccctagaac

SEQ ID NO: 7580783 - DNA, 22 bp, Homo sapiens
aatgaaaattggaccctagaac

SEQ ID NO: 7580784 - DNA, 22 bp, Homo sapiens
aatgctggaagcctcagtagat

SEQ ID NO: 7580785 - DNA, 22 bp, Homo sapiens
aatgctggaagcctcagtagat

SEQ ID NO: 7580786 - DNA, 22 bp, Homo sapiens
aatgctgtaaagatgctatctg

SEQ ID NO: 7580787 - DNA, 22 bp, Homo sapiens
aatgctgtaaagatgctatctg

SEQ ID NO: 7580788 - DNA, 22 bp, Homo sapiens
aatgctgtaatgaacgtgagag

SEQ ID NO: 7580789 - DNA, 22 bp, Homo sapiens
aatgctgtatatcttagctaat

SEQ ID NO: 7580790 - DNA, 22 bp, Homo sapiens
aatgctgtatatcttagctaat

SEQ ID NO: 7580791 - DNA, 23 bp, Homo sapiens
aatgctggaaattcaggcatgat

SEQ ID NO: 7580792 - DNA, 23 bp, Homo sapiens
aatgctggaaattcaggcatgat

SEQ ID NO: 7580793 - DNA, 22 bp, Homo sapiens
aatgaaacatatttaggaataa

SEQ ID NO: 7580794 - DNA, 22 bp, Homo sapiens
aatgaaactagtagaatctttg

SEQ ID NO: 7580795 - DNA, 22 bp, Homo sapiens
aatgtataaagtgttaataact

SEQ ID NO: 7580796 - DNA, 22 bp, Homo sapiens
aatgtataaagtgttaataact

SEQ ID NO: 7580797 - DNA, 22 bp, Homo sapiens
aatgtataaagtgttaataact

SEQ ID NO: 7580798 - DNA, 22 bp, Homo sapiens
aatgtataaagtgttaataact

SEQ ID NO: 7580799 - DNA, 22 bp, Homo sapiens
aatgtataaagtgttaataact

SEQ ID NO: 7580800 - DNA, 22 bp, Homo sapiens
aatgtataaagtgttaataact

SEQ ID NO: 7580801 - DNA, 22 bp, Homo sapiens
aatgtataaagtgttaataact

SEQ ID NO: 7580802 - DNA, 22 bp, Homo sapiens
aatgtagaatgatccttaggat

SEQ ID NO: 7580803 - DNA, 22 bp, Homo sapiens
aatgtagatgagatattttttg

SEQ ID NO: 7580804 - DNA, 22 bp, Homo sapiens
aatgtagttcacaattggtact

SEQ ID NO: 7580805 - DNA, 22 bp, Homo sapiens
aatgtagttcacaattggtact

SEQ ID NO: 7580806 - DNA, 19 bp, Homo sapiens
aatgtagtgttatgtcaac

SEQ ID NO: 7580807 - DNA, 19 bp, Homo sapiens
aatgtagtgttatgtcaac

SEQ ID NO: 7580808 - DNA, 22 bp, Homo sapiens
aatgtacagctgctgctgaagg

SEQ ID NO: 7580809 - DNA, 22 bp, Homo sapiens
aatgtacactgaaagcctatca

SEQ ID NO: 7580810 - DNA, 22 bp, Homo sapiens
aatgtacagctgctgctgaagg

SEQ ID NO: 7580811 - DNA, 22 bp, Homo sapiens
aatgtacagctgctgctgaagg

SEQ ID NO: 7580812 - DNA, 22 bp, Homo sapiens
aatgtacagctgctgctgaagg

SEQ ID NO: 7580813 - DNA, 22 bp, Homo sapiens
aatgtacagctgtctttcctcc

SEQ ID NO: 7580814 - DNA, 22 bp, Homo sapiens
aatgtacagctgtctttcctcc

SEQ ID NO: 7580815 - DNA, 22 bp, Homo sapiens
aatgtacagctgctgctgaagg

SEQ ID NO: 7580816 - DNA, 22 bp, Homo sapiens
aatgtacagctgtctttcctcc

SEQ ID NO: 7580817 - DNA, 22 bp, Homo sapiens
aatgtacagctgtctttcctcc

SEQ ID NO: 7580818 - DNA, 22 bp, Homo sapiens
aatgtacagctgtctttcctcc

SEQ ID NO: 7580819 - DNA, 22 bp, Homo sapiens
aatgtacatctcagtgtagtac

SEQ ID NO: 7580820 - DNA, 22 bp, Homo sapiens
aatgtacatctcagtgtagtac

SEQ ID NO: 7580821 - DNA, 22 bp, Homo sapiens
aatgtacatctcagtgtagtac

SEQ ID NO: 7580822 - DNA, 22 bp, Homo sapiens
aatgtacatctcagtgtagtac

SEQ ID NO: 7580823 - DNA, 22 bp, Homo sapiens
aatgtacatctcagtgtagtac

SEQ ID NO: 7580824 - DNA, 22 bp, Homo sapiens
aatgtacatctcagtgtagtac

SEQ ID NO: 7580825 - DNA, 22 bp, Homo sapiens
aatgtacaggctggctatgggg

SEQ ID NO: 7580826 - DNA, 22 bp, Homo sapiens
aatgtacagctgtctttcctcc

SEQ ID NO: 7580827 - DNA, 22 bp, Homo sapiens
aatgtacaggctggctatgggg

SEQ ID NO: 7580828 - DNA, 22 bp, Homo sapiens
aatgtacaggctggctatgggg

SEQ ID NO: 7580829 - DNA, 22 bp, Homo sapiens
aatgtacaggctggctatgggg

SEQ ID NO: 7580830 - DNA, 23 bp, Homo sapiens
agacaaaagcctcagtcttaggc

SEQ ID NO: 7580831 - DNA, 22 bp, Homo sapiens
agaatttttgcagtttagccat

SEQ ID NO: 7580832 - DNA, 23 bp, Homo sapiens
agacaaaagcctcagtcttaggc

SEQ ID NO: 7580833 - DNA, 23 bp, Homo sapiens
agacaaaagcctcagtcttaggc

SEQ ID NO: 7580834 - DNA, 23 bp, Homo sapiens
agacaaaagcctcagtcttaggc

SEQ ID NO: 7580835 - DNA, 23 bp, Homo sapiens
agacaaaagcctcagtcttaggc

SEQ ID NO: 7580836 - DNA, 22 bp, Homo sapiens
aatgtaaacagcaagagaaggg

SEQ ID NO: 7580837 - DNA, 22 bp, Homo sapiens
aatgtaaaatatcttgtacttg

SEQ ID NO: 7580838 - DNA, 22 bp, Homo sapiens
aatgtaaaatatcttgtacttg

SEQ ID NO: 7580839 - DNA, 22 bp, Homo sapiens
aatgtaaacagcaagagaaggg

SEQ ID NO: 7580840 - DNA, 22 bp, Homo sapiens
aatgtaaacagcaagagaaggg

SEQ ID NO: 7580841 - DNA, 22 bp, Homo sapiens
aatgtaaacagcaagagaaggg

SEQ ID NO: 7580842 - DNA, 22 bp, Homo sapiens
aatgtacactgaaagcctatca

SEQ ID NO: 7580843 - DNA, 22 bp, Homo sapiens
aatgtacactgaaagcctatca

SEQ ID NO: 7580844 - DNA, 22 bp, Homo sapiens
aatgtacactgaaagcctatca

SEQ ID NO: 7580845 - DNA, 22 bp, Homo sapiens
aatgtacactgaaagcctatca

SEQ ID NO: 7580846 - DNA, 22 bp, Homo sapiens
aatgtacaccgtgggtttttta

SEQ ID NO: 7580847 - DNA, 22 bp, Homo sapiens
aatgtacaccgtgggtttttta

SEQ ID NO: 7580848 - DNA, 22 bp, Homo sapiens
agaatttgagtgctttctgtgt

SEQ ID NO: 7580849 - DNA, 22 bp, Homo sapiens
agaatttgagtgctttctgtgt

SEQ ID NO: 7580850 - DNA, 22 bp, Homo sapiens
agaatttgagtgctttctgtgt

SEQ ID NO: 7580851 - DNA, 22 bp, Homo sapiens
agaatttgtaaaagataagaca

SEQ ID NO: 7580852 - DNA, 23 bp, Homo sapiens
agaatttctaactctagctctgt

SEQ ID NO: 7580853 - DNA, 23 bp, Homo sapiens
agaatttctaactctagctctgt

SEQ ID NO: 7580854 - DNA, 22 bp, Homo sapiens
agaatttcctatgagagattcc

SEQ ID NO: 7580855 - DNA, 23 bp, Homo sapiens
agaatttctaactctagctctgt

SEQ ID NO: 7580856 - DNA, 22 bp, Homo sapiens
agaatttctggaagattgcaag

SEQ ID NO: 7580857 - DNA, 23 bp, Homo sapiens
agacaaaagcctcagtcttaggc

SEQ ID NO: 7580858 - DNA, 23 bp, Homo sapiens
agacaaaagcctcagtcttaggc

SEQ ID NO: 7580859 - DNA, 23 bp, Homo sapiens
agacaaaagcctcagtcttaggc

SEQ ID NO: 7580860 - DNA, 22 bp, Homo sapiens
agaatttttgcagtttagccat

SEQ ID NO: 7580861 - DNA, 22 bp, Homo sapiens
agaatttttgcagtttagccat

SEQ ID NO: 7580862 - DNA, 22 bp, Homo sapiens
agaatttttgattatctactcg

SEQ ID NO: 7580863 - DNA, 22 bp, Homo sapiens
agaatttttgattatctactcg

SEQ ID NO: 7580864 - DNA, 22 bp, Homo sapiens
agaatttttgattatctactcg

SEQ ID NO: 7580865 - DNA, 22 bp, Homo sapiens
agaatttttgattatctactcg

SEQ ID NO: 7580866 - DNA, 22 bp, Homo sapiens
agaatttttgattatctactcg

SEQ ID NO: 7580867 - DNA, 22 bp, Homo sapiens
agaatttttgattatctactcg

SEQ ID NO: 7580868 - DNA, 22 bp, Homo sapiens
agaatttttgattatctactcg

SEQ ID NO: 7580869 - DNA, 22 bp, Homo sapiens
agaatttttgattatctactcg

SEQ ID NO: 7580870 - DNA, 22 bp, Homo sapiens
agaatctgcatttttaataaca

SEQ ID NO: 7580871 - DNA, 22 bp, Homo sapiens
agaatctgctttttaacaagat

SEQ ID NO: 7580872 - DNA, 22 bp, Homo sapiens
agaatctgctttttaacaagat

SEQ ID NO: 7580873 - DNA, 22 bp, Homo sapiens
agaatctgcatttttaataaca

SEQ ID NO: 7580874 - DNA, 22 bp, Homo sapiens
agaatcttcagatgatttgtca

SEQ ID NO: 7580875 - DNA, 22 bp, Homo sapiens
agaatctgcattttaacaagct

SEQ ID NO: 7580876 - DNA, 22 bp, Homo sapiens
agaatctgcattttaacaagct

SEQ ID NO: 7580877 - DNA, 22 bp, Homo sapiens
agaatctgcattttaacaagcc

SEQ ID NO: 7580878 - DNA, 22 bp, Homo sapiens
agaatctgcattttaacaagcc

SEQ ID NO: 7580879 - DNA, 22 bp, Homo sapiens
agaatctgcattttaacaagat

SEQ ID NO: 7580880 - DNA, 22 bp, Homo sapiens
agaatctgcattttaacaagat

SEQ ID NO: 7580881 - DNA, 22 bp, Homo sapiens
agaatctgaaggcacctctggt

SEQ ID NO: 7580882 - DNA, 22 bp, Homo sapiens
agaatctacattttaacaagat

SEQ ID NO: 7580883 - DNA, 22 bp, Homo sapiens
agaatctacattttaacaagat

SEQ ID NO: 7580884 - DNA, 22 bp, Homo sapiens
agaatctacattttaacaagat

SEQ ID NO: 7580885 - DNA, 22 bp, Homo sapiens
agaatctctactcaagtacttg

SEQ ID NO: 7580886 - DNA, 22 bp, Homo sapiens
agaatctctactcaagtacttg

SEQ ID NO: 7580887 - DNA, 22 bp, Homo sapiens
agaatctaaatatgcaatttga

SEQ ID NO: 7580888 - DNA, 22 bp, Homo sapiens
agaatctaagtacacagacaga

SEQ ID NO: 7580889 - DNA, 19 bp, Homo sapiens
agaatctaaattatttctg

SEQ ID NO: 7580890 - DNA, 19 bp, Homo sapiens
agaatctaaattatttctg

SEQ ID NO: 7580891 - DNA, 22 bp, Homo sapiens
agaatccttgactcaggctgag

SEQ ID NO: 7580892 - DNA, 22 bp, Homo sapiens
agaatccttgactcaggctgag

SEQ ID NO: 7580893 - DNA, 22 bp, Homo sapiens
agaatcctggccaggtcagagc

SEQ ID NO: 7580894 - DNA, 22 bp, Homo sapiens
agaatccctggggagctgcagc

SEQ ID NO: 7580895 - DNA, 21 bp, Homo sapiens
agaatccattcagaccttctc

SEQ ID NO: 7580896 - DNA, 21 bp, Homo sapiens
agaatccattcagaccttctc

SEQ ID NO: 7580897 - DNA, 22 bp, Homo sapiens
agaatttcaaatggaagtttta

SEQ ID NO: 7580898 - DNA, 23 bp, Homo sapiens
agaatttcaaagtccagcacatt

SEQ ID NO: 7580899 - DNA, 22 bp, Homo sapiens
agaatttatgacaacgatagcc

SEQ ID NO: 7580900 - DNA, 22 bp, Homo sapiens
agaatttcaaaaggaagccagc

SEQ ID NO: 7580901 - DNA, 22 bp, Homo sapiens
agaatttatgacaacgatagcc

SEQ ID NO: 7580902 - DNA, 22 bp, Homo sapiens
agaatttatgacaacgatagcc

SEQ ID NO: 7580903 - DNA, 22 bp, Homo sapiens
agaatttaggatgcatgtgaat

SEQ ID NO: 7580904 - DNA, 22 bp, Homo sapiens
agaatttaggatgcatgtgaat

SEQ ID NO: 7580905 - DNA, 22 bp, Homo sapiens
agaatttaggatgcatgtgaat

SEQ ID NO: 7580906 - DNA, 19 bp, Homo sapiens
agaattgttttatgtcttc

SEQ ID NO: 7580907 - DNA, 19 bp, Homo sapiens
agaattgttttgagacccc

SEQ ID NO: 7580908 - DNA, 19 bp, Homo sapiens
agaattgttttatgtcttc

SEQ ID NO: 7580909 - DNA, 22 bp, Homo sapiens
agaatttagctccttggtcata

SEQ ID NO: 7580910 - DNA, 22 bp, Homo sapiens
agaatttagctccttggtcata

SEQ ID NO: 7580911 - DNA, 22 bp, Homo sapiens
agaattgtaagcaatttgatta

SEQ ID NO: 7580912 - DNA, 22 bp, Homo sapiens
agaattgttggggtaataaaag

SEQ ID NO: 7580913 - DNA, 19 bp, Homo sapiens
agaattgttttatgtcttc

SEQ ID NO: 7580914 - DNA, 23 bp, Homo sapiens
agaattgttgttagggaaaagta

SEQ ID NO: 7580915 - DNA, 22 bp, Homo sapiens
agaattgttggggtaataaaag

SEQ ID NO: 7580916 - DNA, 22 bp, Homo sapiens
agaattgtaataataatagcat

SEQ ID NO: 7580917 - DNA, 22 bp, Homo sapiens
agaattgttctgtagcttggct

SEQ ID NO: 7580918 - DNA, 22 bp, Homo sapiens
agaattgttctgtagcttggct

SEQ ID NO: 7580919 - DNA, 22 bp, Homo sapiens
agaattgttctgtagcttggct

SEQ ID NO: 7580920 - DNA, 22 bp, Homo sapiens
agaattgtaagcaatttgatta

SEQ ID NO: 7580921 - DNA, 22 bp, Homo sapiens
agaattgtaataataatagcat

SEQ ID NO: 7580922 - DNA, 22 bp, Homo sapiens
agaattgtaagcaatttgatta

SEQ ID NO: 7580923 - DNA, 22 bp, Homo sapiens
agaattgtaataataatagcat

SEQ ID NO: 7580924 - DNA, 22 bp, Homo sapiens
agaattgtaataataatagcat

SEQ ID NO: 7580925 - DNA, 22 bp, Homo sapiens
agaatcttgggcaaattcatct

SEQ ID NO: 7580926 - DNA, 22 bp, Homo sapiens
agaatcttcagtctaattccta

SEQ ID NO: 7580927 - DNA, 22 bp, Homo sapiens
agaatcttcggtaactggaaga

SEQ ID NO: 7580928 - DNA, 22 bp, Homo sapiens
agaatcttggaactcagatcac

SEQ ID NO: 7580929 - DNA, 22 bp, Homo sapiens
agaatcttggaactcagatcac

SEQ ID NO: 7580930 - DNA, 23 bp, Homo sapiens
agaattgtaaatagaatatacct

SEQ ID NO: 7580931 - DNA, 23 bp, Homo sapiens
agaattgtaaatagaatatacct

SEQ ID NO: 7580932 - DNA, 22 bp, Homo sapiens
agaattggttggggaatgtgga

SEQ ID NO: 7580933 - DNA, 23 bp, Homo sapiens
agaattgtaaatagaatatacct

SEQ ID NO: 7580934 - DNA, 23 bp, Homo sapiens
agaattgtaaatagaatatacct

SEQ ID NO: 7580935 - DNA, 22 bp, Homo sapiens
agaattgtaagcaatttgatta

SEQ ID NO: 7580936 - DNA, 22 bp, Homo sapiens
agaattgtaagcaatttgatta

SEQ ID NO: 7580937 - DNA, 20 bp, Homo sapiens
agagagaggtaaattgagca

SEQ ID NO: 7580938 - DNA, 20 bp, Homo sapiens
agagagaggtaaattgagca

SEQ ID NO: 7580939 - DNA, 20 bp, Homo sapiens
agagagaggtaaattgagca

SEQ ID NO: 7580940 - DNA, 23 bp, Homo sapiens
agagagagtttgtgtcaggtacc

SEQ ID NO: 7580941 - DNA, 20 bp, Homo sapiens
agagagaggtaaattgagca

SEQ ID NO: 7580942 - DNA, 20 bp, Homo sapiens
agagagaggtaaattgagca

SEQ ID NO: 7580943 - DNA, 20 bp, Homo sapiens
agagagaggtaaattgagca

SEQ ID NO: 7580944 - DNA, 22 bp, Homo sapiens
agagagaggggcgagcaaacac

SEQ ID NO: 7580945 - DNA, 20 bp, Homo sapiens
agagagaggtaaattgagca

SEQ ID NO: 7580946 - DNA, 22 bp, Homo sapiens
agagagaggcagcagtgctcac

SEQ ID NO: 7580947 - DNA, 22 bp, Homo sapiens
agagagagggaaactgctaaac

SEQ ID NO: 7580948 - DNA, 22 bp, Homo sapiens
agagagagggaaactgctaaac

SEQ ID NO: 7580949 - DNA, 22 bp, Homo sapiens
agagagagggaaactgctaaac

SEQ ID NO: 7580950 - DNA, 22 bp, Homo sapiens
agagagaggggcgagcaaacac

SEQ ID NO: 7580951 - DNA, 22 bp, Homo sapiens
agagagaggggcgagcaaacac

SEQ ID NO: 7580952 - DNA, 22 bp, Homo sapiens
agagagagggaaactgctaaac

SEQ ID NO: 7580953 - DNA, 22 bp, Homo sapiens
agagagaggggcgagcaaacac

SEQ ID NO: 7580954 - DNA, 22 bp, Homo sapiens
agagagaggggcgagcaaacac

SEQ ID NO: 7580955 - DNA, 22 bp, Homo sapiens
agagagaggcagcagtgctcac

SEQ ID NO: 7580956 - DNA, 22 bp, Homo sapiens
agagagaggcagcagtgctcac

SEQ ID NO: 7580957 - DNA, 22 bp, Homo sapiens
agagagaggcagcagtgctcac

SEQ ID NO: 7580958 - DNA, 22 bp, Homo sapiens
agagagaggcagcagtgctcac

SEQ ID NO: 7580959 - DNA, 17 bp, Homo sapiens
agagagagcatgccacc

SEQ ID NO: 7580960 - DNA, 17 bp, Homo sapiens
agagagagcatgccacc

SEQ ID NO: 7580961 - DNA, 22 bp, Homo sapiens
agagagagaaatgaaatgtgct

SEQ ID NO: 7580962 - DNA, 17 bp, Homo sapiens
agagagagcatgccacc

SEQ ID NO: 7580963 - DNA, 17 bp, Homo sapiens
agagagagcatgccacc

SEQ ID NO: 7580964 - DNA, 17 bp, Homo sapiens
agagagagcatgccacc

SEQ ID NO: 7580965 - DNA, 22 bp, Homo sapiens
agagagagaaatgaaatgtgct

SEQ ID NO: 7580966 - DNA, 22 bp, Homo sapiens
agagagagaaatgaaatgtgct

SEQ ID NO: 7580967 - DNA, 22 bp, Homo sapiens
agagagagaaatgaaatgtgct

SEQ ID NO: 7580968 - DNA, 22 bp, Homo sapiens
agagagagaaatgaaatgtgct

SEQ ID NO: 7580969 - DNA, 22 bp, Homo sapiens
agagagacgggggctgctgctt

SEQ ID NO: 7580970 - DNA, 21 bp, Homo sapiens
agagaaagtcatggctgtggc

SEQ ID NO: 7580971 - DNA, 21 bp, Homo sapiens
agagaaagtcatggctgtggc

SEQ ID NO: 7580972 - DNA, 21 bp, Homo sapiens
agagaaagtcatggctgtggc

SEQ ID NO: 7580973 - DNA, 22 bp, Homo sapiens
agagaaagtcctgatctctcta

SEQ ID NO: 7580974 - DNA, 22 bp, Homo sapiens
agagaaagtcctgatctctcta

SEQ ID NO: 7580975 - DNA, 22 bp, Homo sapiens
agagaaagtcctgatctctcta

SEQ ID NO: 7580976 - DNA, 22 bp, Homo sapiens
agagaaagtcctgatctctcta

SEQ ID NO: 7580977 - DNA, 22 bp, Homo sapiens
agagaaagtcctgatctctcta

SEQ ID NO: 7580978 - DNA, 22 bp, Homo sapiens
agagaaagtcctgatctctcta

SEQ ID NO: 7580979 - DNA, 22 bp, Homo sapiens
agagaaagtcctgatctctcta

SEQ ID NO: 7580980 - DNA, 22 bp, Homo sapiens
agagaaagtcctgatctctcta

SEQ ID NO: 7580981 - DNA, 21 bp, Homo sapiens
agagaaagtcatggctgtggc

SEQ ID NO: 7580982 - DNA, 21 bp, Homo sapiens
agagaaagtcatggctgtggc

SEQ ID NO: 7580983 - DNA, 22 bp, Homo sapiens
agagaaagtaaagattctacct

SEQ ID NO: 7580984 - DNA, 21 bp, Homo sapiens
agagaaagtcatggctgtggc

SEQ ID NO: 7580985 - DNA, 21 bp, Homo sapiens
agagaaagtcatggctgtggc

SEQ ID NO: 7580986 - DNA, 21 bp, Homo sapiens
agagaaagtcatggctgtggc

SEQ ID NO: 7580987 - DNA, 21 bp, Homo sapiens
agagaaagtcatggctgtggc

SEQ ID NO: 7580988 - DNA, 21 bp, Homo sapiens
agagaaagtcatggctgtggc

SEQ ID NO: 7580989 - DNA, 22 bp, Homo sapiens
agagaaagtaaagattctacct

SEQ ID NO: 7580990 - DNA, 22 bp, Homo sapiens
agagaaagtaaagattctacct

SEQ ID NO: 7580991 - DNA, 22 bp, Homo sapiens
agagaaagtaaagattctacct

SEQ ID NO: 7580992 - DNA, 22 bp, Homo sapiens
agagaaatatttaggaaaggag

SEQ ID NO: 7580993 - DNA, 22 bp, Homo sapiens
agagaaatagattggtccagaa

SEQ ID NO: 7580994 - DNA, 22 bp, Homo sapiens
agagaaatatttaggaaaggag

SEQ ID NO: 7580995 - DNA, 22 bp, Homo sapiens
agagaaatatttaggaaaggag

SEQ ID NO: 7580996 - DNA, 22 bp, Homo sapiens
agagaaatgattcctgggcaga

SEQ ID NO: 7580997 - DNA, 22 bp, Homo sapiens
agagacagggttttgccatgtt

SEQ ID NO: 7580998 - DNA, 22 bp, Homo sapiens
agagaaatatttaggaaaggag

SEQ ID NO: 7580999 - DNA, 22 bp, Homo sapiens
agagacagggttttgccatgtt

SEQ ID NO: 7581000 - DNA, 22 bp, Homo sapiens
agagacagggttttgccatgtt

SEQ ID NO: 7581001 - DNA, 22 bp, Homo sapiens
agagacagggttttgccatgtt

SEQ ID NO: 7581002 - DNA, 22 bp, Homo sapiens
agagagacgggggctgctgctt

SEQ ID NO: 7581003 - DNA, 22 bp, Homo sapiens
agagagaattggataaattggt

SEQ ID NO: 7581004 - DNA, 22 bp, Homo sapiens
agagagaattggataaattggt

SEQ ID NO: 7581005 - DNA, 21 bp, Homo sapiens
agagagaaggccatatggtcc

SEQ ID NO: 7581006 - DNA, 22 bp, Homo sapiens
agagagaattggataaattggt

SEQ ID NO: 7581007 - DNA, 21 bp, Homo sapiens
agagagaaggccatatggtcc

SEQ ID NO: 7581008 - DNA, 23 bp, Homo sapiens
agagagagtttgtgtcaggtacc

SEQ ID NO: 7581009 - DNA, 20 bp, Homo sapiens
agagagcacaggcaggaaag

SEQ ID NO: 7581010 - DNA, 20 bp, Homo sapiens
agagagcacaggcaggaaag

SEQ ID NO: 7581011 - DNA, 20 bp, Homo sapiens
agagagcacaggcaggaaag

SEQ ID NO: 7581012 - DNA, 20 bp, Homo sapiens
agagagcacaggcaggaaag

SEQ ID NO: 7581013 - DNA, 20 bp, Homo sapiens
agagagcacaggcaggaaag

SEQ ID NO: 7581014 - DNA, 23 bp, Homo sapiens
agagagagtttgtgtcaggtacc

SEQ ID NO: 7581015 - DNA, 23 bp, Homo sapiens
agagagagtttgtgtcaggtacc

SEQ ID NO: 7581016 - DNA, 20 bp, Homo sapiens
agagagcacaggcaggaaag

SEQ ID NO: 7581017 - DNA, 22 bp, Homo sapiens
agagagcaggacttcactgagc

SEQ ID NO: 7581018 - DNA, 22 bp, Homo sapiens
agagagcaggacttcactgagc

SEQ ID NO: 7581019 - DNA, 22 bp, Homo sapiens
agagagcaggacttcactgagc

SEQ ID NO: 7581020 - DNA, 22 bp, Homo sapiens
agagagcaggacttcactgagc

SEQ ID NO: 7581021 - DNA, 22 bp, Homo sapiens
agagagcagtggatcacctagc

SEQ ID NO: 7581022 - DNA, 22 bp, Homo sapiens
agagagcagtctggaagaaaca

SEQ ID NO: 7581023 - DNA, 22 bp, Homo sapiens
agagagcagtctggaagaaaca

SEQ ID NO: 7581024 - DNA, 22 bp, Homo sapiens
agagagcagtctggaagaaaca

SEQ ID NO: 7581025 - DNA, 22 bp, Homo sapiens
agagagcagtctggaagaaaca

SEQ ID NO: 7581026 - DNA, 22 bp, Homo sapiens
agagatagtgtattagttgggc

SEQ ID NO: 7581027 - DNA, 22 bp, Homo sapiens
agagatatatatttgtttacca

SEQ ID NO: 7581028 - DNA, 22 bp, Homo sapiens
agagatataagtataaataggg

SEQ ID NO: 7581029 - DNA, 22 bp, Homo sapiens
agagatataagtataaataggg

SEQ ID NO: 7581030 - DNA, 22 bp, Homo sapiens
agagatatggatgtcagaaact

SEQ ID NO: 7581031 - DNA, 22 bp, Homo sapiens
agagatatgctgcctaaattta

SEQ ID NO: 7581032 - DNA, 22 bp, Homo sapiens
agagatatgctgcctaaattta

SEQ ID NO: 7581033 - DNA, 22 bp, Homo sapiens
agagatattatttaccaagtta

SEQ ID NO: 7581034 - DNA, 22 bp, Homo sapiens
agagatataagtataaataggg

SEQ ID NO: 7581035 - DNA, 22 bp, Homo sapiens
agagatatggatgtcagaaact

SEQ ID NO: 7581036 - DNA, 22 bp, Homo sapiens
agagatatgagtagttgtgaca

SEQ ID NO: 7581037 - DNA, 22 bp, Homo sapiens
agagatatgctgcctaaattta

SEQ ID NO: 7581038 - DNA, 22 bp, Homo sapiens
agagatatgctgcctaaattta

SEQ ID NO: 7581039 - DNA, 22 bp, Homo sapiens
agagatatgctgcctaaattta

SEQ ID NO: 7581040 - DNA, 22 bp, Homo sapiens
agagataattaggttaaatgag

SEQ ID NO: 7581041 - DNA, 22 bp, Homo sapiens
agagataattaggttaaatgag

SEQ ID NO: 7581042 - DNA, 22 bp, Homo sapiens
agagataccaaataggcagtta

SEQ ID NO: 7581043 - DNA, 22 bp, Homo sapiens
agagatacttttctttggatgc

SEQ ID NO: 7581044 - DNA, 21 bp, Homo sapiens
agagatagactagaattgatg

SEQ ID NO: 7581045 - DNA, 21 bp, Homo sapiens
agagatagactagaattgatg

SEQ ID NO: 7581046 - DNA, 22 bp, Homo sapiens
agagataaagctatgatttatg

SEQ ID NO: 7581047 - DNA, 20 bp, Homo sapiens
agagagttgtcagtagcttc

SEQ ID NO: 7581048 - DNA, 20 bp, Homo sapiens
agagagttgtcagtagcttc

SEQ ID NO: 7581049 - DNA, 22 bp, Homo sapiens
agagagtttaagtgacttgccg

SEQ ID NO: 7581050 - DNA, 22 bp, Homo sapiens
agagagtttaagtgacttgccg

SEQ ID NO: 7581051 - DNA, 22 bp, Homo sapiens
agagataaagctatgatttatg

SEQ ID NO: 7581052 - DNA, 22 bp, Homo sapiens
agagataaagctatgatttatg

SEQ ID NO: 7581053 - DNA, 22 bp, Homo sapiens
agagataaagctatgatttatg

SEQ ID NO: 7581054 - DNA, 17 bp, Homo sapiens
agagataaggcggagaa

SEQ ID NO: 7581055 - DNA, 22 bp, Homo sapiens
agagatattatttaccaagtta

SEQ ID NO: 7581056 - DNA, 22 bp, Homo sapiens
agagatcaaagcttgccaagta

SEQ ID NO: 7581057 - DNA, 22 bp, Homo sapiens
agagatattatttaccaagtta

SEQ ID NO: 7581058 - DNA, 22 bp, Homo sapiens
agagatattatttaccaagtta

SEQ ID NO: 7581059 - DNA, 22 bp, Homo sapiens
agagatcaaagcttgccaagta

SEQ ID NO: 7581060 - DNA, 19 bp, Homo sapiens
agagatccagcttctagct

SEQ ID NO: 7581061 - DNA, 22 bp, Homo sapiens
agagatcagttaaaatcttttt

SEQ ID NO: 7581062 - DNA, 22 bp, Homo sapiens
agagatcccttctgcctgggga

SEQ ID NO: 7581063 - DNA, 19 bp, Homo sapiens
agagatccagcttctagct

SEQ ID NO: 7581064 - DNA, 22 bp, Homo sapiens
agagatctctgaagctgctgct

SEQ ID NO: 7581065 - DNA, 22 bp, Homo sapiens
agagatctctgaagctgctgct

SEQ ID NO: 7581066 - DNA, 22 bp, Homo sapiens
agagatctagcacctgctggtc

SEQ ID NO: 7581067 - DNA, 22 bp, Homo sapiens
agagatcactacatttgtaaaa

SEQ ID NO: 7581068 - DNA, 22 bp, Homo sapiens
agagatccttcaatctagtttt

SEQ ID NO: 7581069 - DNA, 22 bp, Homo sapiens
aattatgtgcttgcttgtttcc

SEQ ID NO: 7581070 - DNA, 22 bp, Homo sapiens
aattatgtgcttgcttgtttcc

SEQ ID NO: 7581071 - DNA, 22 bp, Homo sapiens
aattatgtagccatatgaaaca

SEQ ID NO: 7581072 - DNA, 22 bp, Homo sapiens
aattatgtagccatatgaaaca

SEQ ID NO: 7581073 - DNA, 21 bp, Homo sapiens
agagatctgaagaaccattag

SEQ ID NO: 7581074 - DNA, 22 bp, Homo sapiens
aattatgtttgctttagatgga

SEQ ID NO: 7581075 - DNA, 22 bp, Homo sapiens
aattatgtttgctttagatgga

SEQ ID NO: 7581076 - DNA, 22 bp, Homo sapiens
aattatgtttgctttagatgga

SEQ ID NO: 7581077 - DNA, 22 bp, Homo sapiens
aattattgagcatctactgtgt

SEQ ID NO: 7581078 - DNA, 22 bp, Homo sapiens
aattcacacctccggtttttct

SEQ ID NO: 7581079 - DNA, 22 bp, Homo sapiens
aattcacagaaccatggtgctc

SEQ ID NO: 7581080 - DNA, 22 bp, Homo sapiens
aattcacagaaccatggtgctc

SEQ ID NO: 7581081 - DNA, 22 bp, Homo sapiens
aattcacagaaccatggtgctc

SEQ ID NO: 7581082 - DNA, 22 bp, Homo sapiens
aattcacacctccggtttttct

SEQ ID NO: 7581083 - DNA, 21 bp, Homo sapiens
agactgccatctttgggccac

SEQ ID NO: 7581084 - DNA, 22 bp, Homo sapiens
agactgcatattgtcctttaga

SEQ ID NO: 7581085 - DNA, 21 bp, Homo sapiens
agactgccattgttcttttgg

SEQ ID NO: 7581086 - DNA, 22 bp, Homo sapiens
agactggaagcctgccaagcaa

SEQ ID NO: 7581087 - DNA, 22 bp, Homo sapiens
agactggaagcctgccaagcaa

SEQ ID NO: 7581088 - DNA, 22 bp, Homo sapiens
agactggaagcctgccaagcaa

SEQ ID NO: 7581089 - DNA, 22 bp, Homo sapiens
agactggcttgctttacaagga

SEQ ID NO: 7581090 - DNA, 22 bp, Homo sapiens
agactggcttgctttacaagga

SEQ ID NO: 7581091 - DNA, 22 bp, Homo sapiens
agactgggccatttccccagct

SEQ ID NO: 7581092 - DNA, 22 bp, Homo sapiens
agactgcatattgtcctttaga

SEQ ID NO: 7581093 - DNA, 23 bp, Homo sapiens
agactgaggctgccagggtcaga

SEQ ID NO: 7581094 - DNA, 22 bp, Homo sapiens
agactgatattaactttagtgt

SEQ ID NO: 7581095 - DNA, 17 bp, Homo sapiens
agactgaggacacagga

SEQ ID NO: 7581096 - DNA, 23 bp, Homo sapiens
agactgaggctgccagggtcaga

SEQ ID NO: 7581097 - DNA, 23 bp, Homo sapiens
agactgaggctgccagggtcaga

SEQ ID NO: 7581098 - DNA, 22 bp, Homo sapiens
agactgaagtaagaatgcagct

SEQ ID NO: 7581099 - DNA, 22 bp, Homo sapiens
agactgaataacaagcaaataa

SEQ ID NO: 7581100 - DNA, 22 bp, Homo sapiens
agactgaataggaaagagggaa

SEQ ID NO: 7581101 - DNA, 22 bp, Homo sapiens
agactgaataacaagcaaataa

SEQ ID NO: 7581102 - DNA, 22 bp, Homo sapiens
agactgaagctccttgaggaca

SEQ ID NO: 7581103 - DNA, 22 bp, Homo sapiens
agactgaagctccttgaggaca

SEQ ID NO: 7581104 - DNA, 22 bp, Homo sapiens
agactgaagtaagaatgcagct

SEQ ID NO: 7581105 - DNA, 22 bp, Homo sapiens
agactgaagcaattcaaccagt

SEQ ID NO: 7581106 - DNA, 20 bp, Homo sapiens
agactgaagccatgtgacta

SEQ ID NO: 7581107 - DNA, 22 bp, Homo sapiens
agactgaaatagtgcacaccaa

SEQ ID NO: 7581108 - DNA, 22 bp, Homo sapiens
agactgaaacaatctgcaggca

SEQ ID NO: 7581109 - DNA, 22 bp, Homo sapiens
agactgaaacaatctgcaggca

SEQ ID NO: 7581110 - DNA, 19 bp, Homo sapiens
agactctgtgtgagacttt

SEQ ID NO: 7581111 - DNA, 22 bp, Homo sapiens
agactctgttgaactattttgg

SEQ ID NO: 7581112 - DNA, 19 bp, Homo sapiens
agactctgtgtgagacttt

SEQ ID NO: 7581113 - DNA, 19 bp, Homo sapiens
agactctgtgtgagacttt

SEQ ID NO: 7581114 - DNA, 19 bp, Homo sapiens
agactctgtgtgagacttt

SEQ ID NO: 7581115 - DNA, 23 bp, Homo sapiens
agagaaagggataacacgttgaa

SEQ ID NO: 7581116 - DNA, 23 bp, Homo sapiens
agagaaagggataacacgttgaa

SEQ ID NO: 7581117 - DNA, 23 bp, Homo sapiens
agagaaagggataacacgttgaa

SEQ ID NO: 7581118 - DNA, 18 bp, Homo sapiens
agagaaagaccaaagcat

SEQ ID NO: 7581119 - DNA, 22 bp, Homo sapiens
agagaaagtaaagattctacct

SEQ ID NO: 7581120 - DNA, 22 bp, Homo sapiens
agagaaagtaaagattctacct

SEQ ID NO: 7581121 - DNA, 23 bp, Homo sapiens
agagaaagggataacacgttgaa

SEQ ID NO: 7581122 - DNA, 23 bp, Homo sapiens
agagaaagggataacacgttgaa

SEQ ID NO: 7581123 - DNA, 23 bp, Homo sapiens
agagaaagggataacacgttgaa

SEQ ID NO: 7581124 - DNA, 23 bp, Homo sapiens
agagaaagggataacacgttgaa

SEQ ID NO: 7581125 - DNA, 19 bp, Homo sapiens
agagaaagaattgagtcta

SEQ ID NO: 7581126 - DNA, 19 bp, Homo sapiens
agagaaagaattgagtcta

SEQ ID NO: 7581127 - DNA, 19 bp, Homo sapiens
agagaaagaattgagtcta

SEQ ID NO: 7581128 - DNA, 19 bp, Homo sapiens
agagaaagaattgagtcta

SEQ ID NO: 7581129 - DNA, 19 bp, Homo sapiens
agagaaagaattgagtcta

SEQ ID NO: 7581130 - DNA, 19 bp, Homo sapiens
agagaaagaattgagtcta

SEQ ID NO: 7581131 - DNA, 22 bp, Homo sapiens
agagaaactgatgtcctttgaa

SEQ ID NO: 7581132 - DNA, 18 bp, Homo sapiens
agagaaagaccaaagcat

SEQ ID NO: 7581133 - DNA, 18 bp, Homo sapiens
agagaaagaccaaagcat

SEQ ID NO: 7581134 - DNA, 18 bp, Homo sapiens
agagaaagaccaaagcat

SEQ ID NO: 7581135 - DNA, 18 bp, Homo sapiens
agagaaagaccaaagcat

SEQ ID NO: 7581136 - DNA, 18 bp, Homo sapiens
agagaaagaccaaagcat

SEQ ID NO: 7581137 - DNA, 22 bp, Homo sapiens
agagaaacccttcagtgttttg

SEQ ID NO: 7581138 - DNA, 22 bp, Homo sapiens
agagaaactgatgtcctttgaa

SEQ ID NO: 7581139 - DNA, 22 bp, Homo sapiens
agagaaactgatgtcctttgaa

SEQ ID NO: 7581140 - DNA, 22 bp, Homo sapiens
agagaaactgatgtcctttgaa

SEQ ID NO: 7581141 - DNA, 22 bp, Homo sapiens
agagaaactgatgtcctttgaa

SEQ ID NO: 7581142 - DNA, 22 bp, Homo sapiens
agagaaactgatgtcctttgaa

SEQ ID NO: 7581143 - DNA, 22 bp, Homo sapiens
agagaaacaggtcagctgggag

SEQ ID NO: 7581144 - DNA, 22 bp, Homo sapiens
agagaaacaggtcagctgggag

SEQ ID NO: 7581145 - DNA, 22 bp, Homo sapiens
agagaaacccttcagtgttttg

SEQ ID NO: 7581146 - DNA, 22 bp, Homo sapiens
agagaaacccttcagtgttttg

SEQ ID NO: 7581147 - DNA, 22 bp, Homo sapiens
agagaaacccttcagtgttttg

SEQ ID NO: 7581148 - DNA, 23 bp, Homo sapiens
agactggggcataagaagatggc

SEQ ID NO: 7581149 - DNA, 23 bp, Homo sapiens
agactggggcataagaagatggc

SEQ ID NO: 7581150 - DNA, 22 bp, Homo sapiens
agactggggttctggcaaggag

SEQ ID NO: 7581151 - DNA, 22 bp, Homo sapiens
agactggggttctggcaaggag

SEQ ID NO: 7581152 - DNA, 17 bp, Homo sapiens
agacactgagccaagta

SEQ ID NO: 7581153 - DNA, 17 bp, Homo sapiens
agacactgagccaagta

SEQ ID NO: 7581154 - DNA, 22 bp, Homo sapiens
agacactgagcattttcctagc

SEQ ID NO: 7581155 - DNA, 22 bp, Homo sapiens
agacactgaatcagagggacat

SEQ ID NO: 7581156 - DNA, 22 bp, Homo sapiens
agacactgatgttcagctcaat

SEQ ID NO: 7581157 - DNA, 17 bp, Homo sapiens
agacactgagccaagta

SEQ ID NO: 7581158 - DNA, 17 bp, Homo sapiens
agacactgagccaagta

SEQ ID NO: 7581159 - DNA, 22 bp, Homo sapiens
agacactgccacttctgttccc

SEQ ID NO: 7581160 - DNA, 22 bp, Homo sapiens
agacactgatgttcagctcaat

SEQ ID NO: 7581161 - DNA, 22 bp, Homo sapiens
agacactgatgttcagctcaat

SEQ ID NO: 7581162 - DNA, 19 bp, Homo sapiens
agacactggatggaaaatg

SEQ ID NO: 7581163 - DNA, 22 bp, Homo sapiens
agacactgcggaggtcgggtgg

SEQ ID NO: 7581164 - DNA, 19 bp, Homo sapiens
agacactggatggaaaatg

SEQ ID NO: 7581165 - DNA, 19 bp, Homo sapiens
agacactggatggaaaatg

SEQ ID NO: 7581166 - DNA, 22 bp, Homo sapiens
agacactgcggaggtcgggtgg

SEQ ID NO: 7581167 - DNA, 17 bp, Homo sapiens
agacactgagccaagta

SEQ ID NO: 7581168 - DNA, 22 bp, Homo sapiens
aatgtataaccataggaaattt

SEQ ID NO: 7581169 - DNA, 22 bp, Homo sapiens
aatgtataaccataggaaattt

SEQ ID NO: 7581170 - DNA, 21 bp, Homo sapiens
aatgtataacagagcccatca

SEQ ID NO: 7581171 - DNA, 22 bp, Homo sapiens
aatgtataaccataggaaattt

SEQ ID NO: 7581172 - DNA, 22 bp, Homo sapiens
aatgtataaccataggaaattt

SEQ ID NO: 7581173 - DNA, 22 bp, Homo sapiens
aatgtataaccataggaaattt

SEQ ID NO: 7581174 - DNA, 20 bp, Homo sapiens
agacaccccctgacagggaa

SEQ ID NO: 7581175 - DNA, 22 bp, Homo sapiens
agacacctaatagatgaattca

SEQ ID NO: 7581176 - DNA, 22 bp, Homo sapiens
aatgtataaccataggaaattt

SEQ ID NO: 7581177 - DNA, 22 bp, Homo sapiens
agacactgaatgtttggtggtc

SEQ ID NO: 7581178 - DNA, 22 bp, Homo sapiens
agacactgaatcagagggacat

SEQ ID NO: 7581179 - DNA, 22 bp, Homo sapiens
agacactgaatcagagggacat

SEQ ID NO: 7581180 - DNA, 22 bp, Homo sapiens
agacactgaaatgtattgaaga

SEQ ID NO: 7581181 - DNA, 22 bp, Homo sapiens
agacactgaaatgtattgaaga

SEQ ID NO: 7581182 - DNA, 22 bp, Homo sapiens
agacactgaaatgtattgaaga

SEQ ID NO: 7581183 - DNA, 22 bp, Homo sapiens
agacactgaaatgtattgaaga

SEQ ID NO: 7581184 - DNA, 22 bp, Homo sapiens
agacactgaaatgtattgaaga

SEQ ID NO: 7581185 - DNA, 22 bp, Homo sapiens
agacactgaaatgtattgaaga

SEQ ID NO: 7581186 - DNA, 21 bp, Homo sapiens
agactctggggatctctgtcc

SEQ ID NO: 7581187 - DNA, 21 bp, Homo sapiens
agactctggggatctctgtcc

SEQ ID NO: 7581188 - DNA, 22 bp, Homo sapiens
agactctgggattttgaaagca

SEQ ID NO: 7581189 - DNA, 22 bp, Homo sapiens
agactctggccacccccgcagt

SEQ ID NO: 7581190 - DNA, 22 bp, Homo sapiens
agactctggcatgctaactagt

SEQ ID NO: 7581191 - DNA, 22 bp, Homo sapiens
agactctggcatgctaactagt

SEQ ID NO: 7581192 - DNA, 22 bp, Homo sapiens
agactctggaggggctggtcct

SEQ ID NO: 7581193 - DNA, 22 bp, Homo sapiens
agactctggaggggctggtcct

SEQ ID NO: 7581194 - DNA, 22 bp, Homo sapiens
agactctggagtcagctaggat

SEQ ID NO: 7581195 - DNA, 22 bp, Homo sapiens
agactctggagtcagctaggat

SEQ ID NO: 7581196 - DNA, 22 bp, Homo sapiens
agactctgtgctccttgctttc

SEQ ID NO: 7581197 - DNA, 22 bp, Homo sapiens
agactctgtgctccttgctttc

SEQ ID NO: 7581198 - DNA, 17 bp, Homo sapiens
agactctgtcccatgta

SEQ ID NO: 7581199 - DNA, 17 bp, Homo sapiens
agactctgtcccatgta

SEQ ID NO: 7581200 - DNA, 17 bp, Homo sapiens
agactctgtcccatgta

SEQ ID NO: 7581201 - DNA, 18 bp, Homo sapiens
agactctgtgtgaaagta

SEQ ID NO: 7581202 - DNA, 22 bp, Homo sapiens
agactctggtcctcttgaattt

SEQ ID NO: 7581203 - DNA, 22 bp, Homo sapiens
agactctggggctccctccacc

SEQ ID NO: 7581204 - DNA, 17 bp, Homo sapiens
agactctgtcccatgta

SEQ ID NO: 7581205 - DNA, 17 bp, Homo sapiens
agactctgtcccatgta

SEQ ID NO: 7581206 - DNA, 21 bp, Homo sapiens
agactctggggatctctgtcc

SEQ ID NO: 7581207 - DNA, 22 bp, Homo sapiens
agactctggtcctcttgaattt

SEQ ID NO: 7581208 - DNA, 22 bp, Homo sapiens
agacactggtgaagaaatcagg

SEQ ID NO: 7581209 - DNA, 21 bp, Homo sapiens
agacactggtttagcattcat

SEQ ID NO: 7581210 - DNA, 22 bp, Homo sapiens
agacactggcactggggaagcc

SEQ ID NO: 7581211 - DNA, 22 bp, Homo sapiens
agacactggtgaagaaatcagg

SEQ ID NO: 7581212 - DNA, 22 bp, Homo sapiens
agacactggtgaagaaatcagg

SEQ ID NO: 7581213 - DNA, 22 bp, Homo sapiens
agacactggtgaagaaatcagg

SEQ ID NO: 7581214 - DNA, 22 bp, Homo sapiens
agacactggtgaagaaatcagg

SEQ ID NO: 7581215 - DNA, 22 bp, Homo sapiens
agacactggcactggggaagcc

SEQ ID NO: 7581216 - DNA, 22 bp, Homo sapiens
agacactggcactggggaagcc

SEQ ID NO: 7581217 - DNA, 22 bp, Homo sapiens
agacctctgctcccttcatggt

SEQ ID NO: 7581218 - DNA, 22 bp, Homo sapiens
agacctctgctcccttcatggt

SEQ ID NO: 7581219 - DNA, 22 bp, Homo sapiens
agacctctgctcccttcatggt

SEQ ID NO: 7581220 - DNA, 22 bp, Homo sapiens
agacctctacgtgcgtctcatc

SEQ ID NO: 7581221 - DNA, 22 bp, Homo sapiens
agacctctacgtgcgtctcatc

SEQ ID NO: 7581222 - DNA, 22 bp, Homo sapiens
agacctctgagggcatcttgtc

SEQ ID NO: 7581223 - DNA, 22 bp, Homo sapiens
agacctctggatagatgtgagg

SEQ ID NO: 7581224 - DNA, 22 bp, Homo sapiens
agactctgctaagaatataatt

SEQ ID NO: 7581225 - DNA, 19 bp, Homo sapiens
agactctgccactcttctc

SEQ ID NO: 7581226 - DNA, 22 bp, Homo sapiens
agacctctgctcccttcatggt

SEQ ID NO: 7581227 - DNA, 21 bp, Homo sapiens
agacctcttcccttcatgcac

SEQ ID NO: 7581228 - DNA, 22 bp, Homo sapiens
agacctgaagagtatcttcaga

SEQ ID NO: 7581229 - DNA, 20 bp, Homo sapiens
agcaggtgacggggcctgct

SEQ ID NO: 7581230 - DNA, 20 bp, Homo sapiens
agcaggtgacggggcctgct

SEQ ID NO: 7581231 - DNA, 20 bp, Homo sapiens
agcaggtgacggggcctgct

SEQ ID NO: 7581232 - DNA, 22 bp, Homo sapiens
agcaggtgacccaagcaggctg

SEQ ID NO: 7581233 - DNA, 22 bp, Homo sapiens
agcaggtgagcacagccaggct

SEQ ID NO: 7581234 - DNA, 22 bp, Homo sapiens
agcaggtgagcacagccaggct

SEQ ID NO: 7581235 - DNA, 22 bp, Homo sapiens
agcaggtgagcacagccaggct

SEQ ID NO: 7581236 - DNA, 22 bp, Homo sapiens
agcaggtgagcacagccaggct

SEQ ID NO: 7581237 - DNA, 22 bp, Homo sapiens
agcagttatattgaaataaaaa

SEQ ID NO: 7581238 - DNA, 22 bp, Homo sapiens
agcagttatattgaaataaaaa

SEQ ID NO: 7581239 - DNA, 22 bp, Homo sapiens
agcagttatattgaaataaaaa

SEQ ID NO: 7581240 - DNA, 23 bp, Homo sapiens
agcagttagggatacaagttatc

SEQ ID NO: 7581241 - DNA, 19 bp, Homo sapiens
agcagttatatgcatggga

SEQ ID NO: 7581242 - DNA, 22 bp, Homo sapiens
agcagttatgttctataaagtc

SEQ ID NO: 7581243 - DNA, 22 bp, Homo sapiens
agcagttatgttctataaagtc

SEQ ID NO: 7581244 - DNA, 22 bp, Homo sapiens
agcagttatgtgtctcttgact

SEQ ID NO: 7581245 - DNA, 22 bp, Homo sapiens
agcatcccatgactctggagga

SEQ ID NO: 7581246 - DNA, 22 bp, Homo sapiens
agcatcccatgactctggagga

SEQ ID NO: 7581247 - DNA, 22 bp, Homo sapiens
agcatccatccaggaaaattga

SEQ ID NO: 7581248 - DNA, 19 bp, Homo sapiens
agcatccagtcatgggatc

SEQ ID NO: 7581249 - DNA, 19 bp, Homo sapiens
agcatccagtcatgggatc

SEQ ID NO: 7581250 - DNA, 22 bp, Homo sapiens
agcatccaggccaggttgggca

SEQ ID NO: 7581251 - DNA, 22 bp, Homo sapiens
agcatccagcatcctatagaaa

SEQ ID NO: 7581252 - DNA, 22 bp, Homo sapiens
agcatccagcatcctatagaaa

SEQ ID NO: 7581253 - DNA, 22 bp, Homo sapiens
agcatccagatgcctgatgtca

SEQ ID NO: 7581254 - DNA, 22 bp, Homo sapiens
agcatccagatgcctgatgtca

SEQ ID NO: 7581255 - DNA, 22 bp, Homo sapiens
agcatccagcatcctatagaaa

SEQ ID NO: 7581256 - DNA, 22 bp, Homo sapiens
agcatccagatgcctgatgtca

SEQ ID NO: 7581257 - DNA, 22 bp, Homo sapiens
agcatccaacaggagggaaggg

SEQ ID NO: 7581258 - DNA, 22 bp, Homo sapiens
agcatccaactttgattagaga

SEQ ID NO: 7581259 - DNA, 22 bp, Homo sapiens
agcatccagaaaactctcagaa

SEQ ID NO: 7581260 - DNA, 22 bp, Homo sapiens
agcatccagaaaactctcagaa

SEQ ID NO: 7581261 - DNA, 22 bp, Homo sapiens
agcatccactcactgggagagg

SEQ ID NO: 7581262 - DNA, 22 bp, Homo sapiens
agcatccactcactgggagagg

SEQ ID NO: 7581263 - DNA, 22 bp, Homo sapiens
agcatcagcctctgtcctggag

SEQ ID NO: 7581264 - DNA, 22 bp, Homo sapiens
agcatcagcctctgtcctggag

SEQ ID NO: 7581265 - DNA, 22 bp, Homo sapiens
agcatccaacaggagggaaggg

SEQ ID NO: 7581266 - DNA, 22 bp, Homo sapiens
agcatcagtactaatctggcca

SEQ ID NO: 7581267 - DNA, 22 bp, Homo sapiens
agcatcagcctctgtcctggag

SEQ ID NO: 7581268 - DNA, 22 bp, Homo sapiens
agcatcagtactaatctggcca

SEQ ID NO: 7581269 - DNA, 22 bp, Homo sapiens
agcagggctttggctggctttc

SEQ ID NO: 7581270 - DNA, 22 bp, Homo sapiens
agcagggctttgtctctgtgaa

SEQ ID NO: 7581271 - DNA, 22 bp, Homo sapiens
agcagggctttggctggctttc

SEQ ID NO: 7581272 - DNA, 22 bp, Homo sapiens
agcagggctttggctggctttc

SEQ ID NO: 7581273 - DNA, 22 bp, Homo sapiens
agcagggctttggctggctttc

SEQ ID NO: 7581274 - DNA, 22 bp, Homo sapiens
agcagggctttgtctctgtgaa

SEQ ID NO: 7581275 - DNA, 22 bp, Homo sapiens
agcagggctttgtctctgtgaa

SEQ ID NO: 7581276 - DNA, 22 bp, Homo sapiens
agcagggctttgtctctgtgaa

SEQ ID NO: 7581277 - DNA, 22 bp, Homo sapiens
agcagggctttgtctctgtgaa

SEQ ID NO: 7581278 - DNA, 22 bp, Homo sapiens
agcagggctttgtctctgtgaa

SEQ ID NO: 7581279 - DNA, 21 bp, Homo sapiens
agcaggtgaacctccagtaca

SEQ ID NO: 7581280 - DNA, 22 bp, Homo sapiens
agcaggtgaattcctggatgtg

SEQ ID NO: 7581281 - DNA, 22 bp, Homo sapiens
agcaggtgaattcctggatgtg

SEQ ID NO: 7581282 - DNA, 22 bp, Homo sapiens
agcaggtgaattcctggatgtg

SEQ ID NO: 7581283 - DNA, 21 bp, Homo sapiens
agcaggtgaacctccagtaca

SEQ ID NO: 7581284 - DNA, 22 bp, Homo sapiens
agcaggtcttgctctcaacagg

SEQ ID NO: 7581285 - DNA, 21 bp, Homo sapiens
agcaggtgaacctccagtaca

SEQ ID NO: 7581286 - DNA, 22 bp, Homo sapiens
agcaggtgacccaagcaggctg

SEQ ID NO: 7581287 - DNA, 22 bp, Homo sapiens
agcaggtgacccaagcaggctg

SEQ ID NO: 7581288 - DNA, 22 bp, Homo sapiens
agcaggtgacccaagcaggctg

SEQ ID NO: 7581289 - DNA, 22 bp, Homo sapiens
agcaggtgacccaagcaggctg

SEQ ID NO: 7581290 - DNA, 22 bp, Homo sapiens
agcaggtgacccaagcaggctg

SEQ ID NO: 7581291 - DNA, 22 bp, Homo sapiens
agcaggtgacagggctgtggtg

SEQ ID NO: 7581292 - DNA, 22 bp, Homo sapiens
agcaggtgacagggctgtggtg

SEQ ID NO: 7581293 - DNA, 22 bp, Homo sapiens
agcaggtgacagggctgtggtg

SEQ ID NO: 7581294 - DNA, 22 bp, Homo sapiens
agcaggcatagagtagcactca

SEQ ID NO: 7581295 - DNA, 22 bp, Homo sapiens
agcaggcatagagtagcactca

SEQ ID NO: 7581296 - DNA, 22 bp, Homo sapiens
agcaggcatagagtagcactca

SEQ ID NO: 7581297 - DNA, 23 bp, Homo sapiens
agcaggcatctgtggcacaaggc

SEQ ID NO: 7581298 - DNA, 22 bp, Homo sapiens
agcaggcatagagtagcactca

SEQ ID NO: 7581299 - DNA, 22 bp, Homo sapiens
agcaggcatagagtagcactca

SEQ ID NO: 7581300 - DNA, 22 bp, Homo sapiens
agcaggcagtgtagagccttca

SEQ ID NO: 7581301 - DNA, 22 bp, Homo sapiens
agcaggcagtgtagagccttca

SEQ ID NO: 7581302 - DNA, 22 bp, Homo sapiens
agcaggcatagagtagcactca

SEQ ID NO: 7581303 - DNA, 22 bp, Homo sapiens
agcaggcatagagtagcactca

SEQ ID NO: 7581304 - DNA, 21 bp, Homo sapiens
agcaggcagtgggctggattt

SEQ ID NO: 7581305 - DNA, 21 bp, Homo sapiens
agcaggcagtgggctggattt

SEQ ID NO: 7581306 - DNA, 22 bp, Homo sapiens
agcaggcagtgtagagccttca

SEQ ID NO: 7581307 - DNA, 21 bp, Homo sapiens
agcaggcagtgggctggattt

SEQ ID NO: 7581308 - DNA, 19 bp, Homo sapiens
agcaggcaggtggcccagg

SEQ ID NO: 7581309 - DNA, 19 bp, Homo sapiens
agcaggcaggtggcccagg

SEQ ID NO: 7581310 - DNA, 19 bp, Homo sapiens
agcaggcaggtggcccagg

SEQ ID NO: 7581311 - DNA, 23 bp, Homo sapiens
agcaggcatctgtggcacaaggc

SEQ ID NO: 7581312 - DNA, 23 bp, Homo sapiens
agcaggcatctgtggcacaaggc

SEQ ID NO: 7581313 - DNA, 23 bp, Homo sapiens
agcaggcatctgtggcacaaggc

SEQ ID NO: 7581314 - DNA, 23 bp, Homo sapiens
agcaggcatctgtggcacaaggc

SEQ ID NO: 7581315 - DNA, 23 bp, Homo sapiens
agcaggcatctgtggcacaaggc

SEQ ID NO: 7581316 - DNA, 23 bp, Homo sapiens
agcaggcatctgtggcacaaggc

SEQ ID NO: 7581317 - DNA, 23 bp, Homo sapiens
agcaggcatctgtggcacaaggc

SEQ ID NO: 7581318 - DNA, 23 bp, Homo sapiens
agcaggcatctgtggcacaaggc

SEQ ID NO: 7581319 - DNA, 23 bp, Homo sapiens
agcaggcatctgtggcacaaggc

SEQ ID NO: 7581320 - DNA, 22 bp, Homo sapiens
agcaggcatttgatatatattt

SEQ ID NO: 7581321 - DNA, 22 bp, Homo sapiens
agcaggcatttgatatatattt

SEQ ID NO: 7581322 - DNA, 22 bp, Homo sapiens
agcaggcatttgatatatattt

SEQ ID NO: 7581323 - DNA, 22 bp, Homo sapiens
agcaggccaaggaactttgtgg

SEQ ID NO: 7581324 - DNA, 19 bp, Homo sapiens
agcaggccacagggccagc

SEQ ID NO: 7581325 - DNA, 19 bp, Homo sapiens
agcaggccacagggccagc

SEQ ID NO: 7581326 - DNA, 22 bp, Homo sapiens
agcaggccaaggaactttgtgg

SEQ ID NO: 7581327 - DNA, 19 bp, Homo sapiens
agcaggccacagggccagc

SEQ ID NO: 7581328 - DNA, 19 bp, Homo sapiens
agcaggccacagggccagc

SEQ ID NO: 7581329 - DNA, 22 bp, Homo sapiens
agcagggcccactaggggagat

SEQ ID NO: 7581330 - DNA, 22 bp, Homo sapiens
agcagggcctctggcactggtc

SEQ ID NO: 7581331 - DNA, 22 bp, Homo sapiens
agcagggctttgcagacttggg

SEQ ID NO: 7581332 - DNA, 22 bp, Homo sapiens
agcagggctttgcagacttggg

SEQ ID NO: 7581333 - DNA, 22 bp, Homo sapiens
agcagggctttgcagacttggg

SEQ ID NO: 7581334 - DNA, 22 bp, Homo sapiens
agcagggcttgccgcttgtcct

SEQ ID NO: 7581335 - DNA, 22 bp, Homo sapiens
agcagggcttgccgcttgtcct

SEQ ID NO: 7581336 - DNA, 22 bp, Homo sapiens
agcagggctttgcagacttggg

SEQ ID NO: 7581337 - DNA, 22 bp, Homo sapiens
agcagggctttgcagacttggg

SEQ ID NO: 7581338 - DNA, 22 bp, Homo sapiens
agcagggctttgcagacttggg

SEQ ID NO: 7581339 - DNA, 22 bp, Homo sapiens
agcagggcttctgtgcctgtgc

SEQ ID NO: 7581340 - DNA, 22 bp, Homo sapiens
agcagggcttctgtgcctgtgc

SEQ ID NO: 7581341 - DNA, 22 bp, Homo sapiens
agcagggcttgccgcttgtcct

SEQ ID NO: 7581342 - DNA, 22 bp, Homo sapiens
agcagggcttgccgcttgtcct

SEQ ID NO: 7581343 - DNA, 22 bp, Homo sapiens
agcagggcttgccgcttgtcct

SEQ ID NO: 7581344 - DNA, 22 bp, Homo sapiens
agcagggctgtgctccttccga

SEQ ID NO: 7581345 - DNA, 22 bp, Homo sapiens
agcagggcctctggcactggtc

SEQ ID NO: 7581346 - DNA, 22 bp, Homo sapiens
agcagggcctctggcactggtc

SEQ ID NO: 7581347 - DNA, 22 bp, Homo sapiens
agcagggcctctggcactggtc

SEQ ID NO: 7581348 - DNA, 22 bp, Homo sapiens
agcagggctgtgctccttccga

SEQ ID NO: 7581349 - DNA, 22 bp, Homo sapiens
agcagggctgtgctccttccga

SEQ ID NO: 7581350 - DNA, 22 bp, Homo sapiens
agcagggctgtgtaggtaatga

SEQ ID NO: 7581351 - DNA, 22 bp, Homo sapiens
agcagggctgtgctccttccga

SEQ ID NO: 7581352 - DNA, 22 bp, Homo sapiens
agcagggctgtgtaggtaatga

SEQ ID NO: 7581353 - DNA, 22 bp, Homo sapiens
agcagggctgtgtaggtaatga

SEQ ID NO: 7581354 - DNA, 22 bp, Homo sapiens
agcagggcttctgtgcctgtgc

SEQ ID NO: 7581355 - DNA, 22 bp, Homo sapiens
agcagggcttctgtgcctgtgc

SEQ ID NO: 7581356 - DNA, 22 bp, Homo sapiens
agcagggcttctgtgcctgtgc

SEQ ID NO: 7581357 - DNA, 22 bp, Homo sapiens
agcagggcttctgtgcctgtgc

SEQ ID NO: 7581358 - DNA, 19 bp, Homo sapiens
agcagccatcgaccatgga

SEQ ID NO: 7581359 - DNA, 19 bp, Homo sapiens
agcagccatcgaccatgga

SEQ ID NO: 7581360 - DNA, 19 bp, Homo sapiens
agcagccatcgaccatgga

SEQ ID NO: 7581361 - DNA, 21 bp, Homo sapiens
agcagccatggatggtatgta

SEQ ID NO: 7581362 - DNA, 21 bp, Homo sapiens
agcagccatggatggtatgta

SEQ ID NO: 7581363 - DNA, 21 bp, Homo sapiens
agcagccatggatggtatgta

SEQ ID NO: 7581364 - DNA, 19 bp, Homo sapiens
agcagccatcgaccatgga

SEQ ID NO: 7581365 - DNA, 21 bp, Homo sapiens
agcagccatggatggtatgta

SEQ ID NO: 7581366 - DNA, 21 bp, Homo sapiens
agcagccatggatggtatgta

SEQ ID NO: 7581367 - DNA, 22 bp, Homo sapiens
agcagctcctctaggaacggat

SEQ ID NO: 7581368 - DNA, 22 bp, Homo sapiens
agcagctcctgccatgagtgct

SEQ ID NO: 7581369 - DNA, 21 bp, Homo sapiens
agcagccatttcacagagact

SEQ ID NO: 7581370 - DNA, 21 bp, Homo sapiens
agcagccatttcacagagact

SEQ ID NO: 7581371 - DNA, 22 bp, Homo sapiens
agcagcccaaacagactaagac

SEQ ID NO: 7581372 - DNA, 22 bp, Homo sapiens
agcagccatttaaaatgaattg

SEQ ID NO: 7581373 - DNA, 21 bp, Homo sapiens
agcagccatttcacagagact

SEQ ID NO: 7581374 - DNA, 21 bp, Homo sapiens
agcagccatttcacagagact

SEQ ID NO: 7581375 - DNA, 21 bp, Homo sapiens
agcagccatttcacagagact

SEQ ID NO: 7581376 - DNA, 22 bp, Homo sapiens
agcagccatttaaaatgaattg

SEQ ID NO: 7581377 - DNA, 21 bp, Homo sapiens
agcagccatttcacagagact

SEQ ID NO: 7581378 - DNA, 23 bp, Homo sapiens
agcagccatagggaagcaataca

SEQ ID NO: 7581379 - DNA, 19 bp, Homo sapiens
agcagccatagacaatatg

SEQ ID NO: 7581380 - DNA, 22 bp, Homo sapiens
agcagccatagatagcatgcaa

SEQ ID NO: 7581381 - DNA, 23 bp, Homo sapiens
agcagccatagggaagcaataca

SEQ ID NO: 7581382 - DNA, 23 bp, Homo sapiens
agcagccatagggaagcaataca

SEQ ID NO: 7581383 - DNA, 23 bp, Homo sapiens
agcagccatagggaagcaataca

SEQ ID NO: 7581384 - DNA, 22 bp, Homo sapiens
agcagccatccttagagaaaga

SEQ ID NO: 7581385 - DNA, 22 bp, Homo sapiens
agcagccatccttagagaaaga

SEQ ID NO: 7581386 - DNA, 19 bp, Homo sapiens
agcagccatagacaatatg

SEQ ID NO: 7581387 - DNA, 22 bp, Homo sapiens
agcagccagttctctgtggtag

SEQ ID NO: 7581388 - DNA, 22 bp, Homo sapiens
agcagccatagatagcatgcaa

SEQ ID NO: 7581389 - DNA, 22 bp, Homo sapiens
agcagccatagatagcatgcaa

SEQ ID NO: 7581390 - DNA, 22 bp, Homo sapiens
agcagccagtgggagtgataca

SEQ ID NO: 7581391 - DNA, 22 bp, Homo sapiens
agcagccagtgggagtgataca

SEQ ID NO: 7581392 - DNA, 22 bp, Homo sapiens
agcagccagtgggagtgataca

SEQ ID NO: 7581393 - DNA, 22 bp, Homo sapiens
agcagccagttctctgtggtag

SEQ ID NO: 7581394 - DNA, 22 bp, Homo sapiens
agcagccagttctctgtggtag

SEQ ID NO: 7581395 - DNA, 22 bp, Homo sapiens
agcagccagttctctgtggtag

SEQ ID NO: 7581396 - DNA, 22 bp, Homo sapiens
agcagctgaccagtgagtcctg

SEQ ID NO: 7581397 - DNA, 22 bp, Homo sapiens
agcagctgaccagtgagtcctg

SEQ ID NO: 7581398 - DNA, 22 bp, Homo sapiens
agcagctgaccagtgagtcctg

SEQ ID NO: 7581399 - DNA, 22 bp, Homo sapiens
agcagctgaccagtgagtcctg

SEQ ID NO: 7581400 - DNA, 22 bp, Homo sapiens
agcagctgaccagtgagtcctg

SEQ ID NO: 7581401 - DNA, 22 bp, Homo sapiens
agcagctgaccagtgagtcctg

SEQ ID NO: 7581402 - DNA, 22 bp, Homo sapiens
agcagctgaccagtgagtcctg

SEQ ID NO: 7581403 - DNA, 22 bp, Homo sapiens
agcagctgaccagtgagtcctg

SEQ ID NO: 7581404 - DNA, 17 bp, Homo sapiens
agcagctgaagcagcca

SEQ ID NO: 7581405 - DNA, 17 bp, Homo sapiens
agcagctgaagcagcca

SEQ ID NO: 7581406 - DNA, 22 bp, Homo sapiens
agcagctgaaaggcaaacttct

SEQ ID NO: 7581407 - DNA, 17 bp, Homo sapiens
agcagctgaagcagcca

SEQ ID NO: 7581408 - DNA, 22 bp, Homo sapiens
agcagctgaaaggcaaacttct

SEQ ID NO: 7581409 - DNA, 17 bp, Homo sapiens
agcagctgaagcagcca

SEQ ID NO: 7581410 - DNA, 17 bp, Homo sapiens
agcagctgaagcagcca

SEQ ID NO: 7581411 - DNA, 17 bp, Homo sapiens
agcagctgaagcagcca

SEQ ID NO: 7581412 - DNA, 17 bp, Homo sapiens
agcagctgaagcagcca

SEQ ID NO: 7581413 - DNA, 17 bp, Homo sapiens
agcagctgaagcagcca

SEQ ID NO: 7581414 - DNA, 22 bp, Homo sapiens
agcagctctgagaggccagcac

SEQ ID NO: 7581415 - DNA, 22 bp, Homo sapiens
agcagctctgagaggccagcac

SEQ ID NO: 7581416 - DNA, 22 bp, Homo sapiens
agcagctcgggctacagagggg

SEQ ID NO: 7581417 - DNA, 22 bp, Homo sapiens
agcagctcgggctacagagggg

SEQ ID NO: 7581418 - DNA, 22 bp, Homo sapiens
agcagctctgagaggccagcac

SEQ ID NO: 7581419 - DNA, 22 bp, Homo sapiens
agcagctctgagaggccagcac

SEQ ID NO: 7581420 - DNA, 22 bp, Homo sapiens
agcagctcggccagtcaccagg

SEQ ID NO: 7581421 - DNA, 22 bp, Homo sapiens
agcagctcctgtttttgggata

SEQ ID NO: 7581422 - DNA, 22 bp, Homo sapiens
agcagctcgggctacagagggg

SEQ ID NO: 7581423 - DNA, 22 bp, Homo sapiens
agcagctcggccagtcaccagg

SEQ ID NO: 7581424 - DNA, 22 bp, Homo sapiens
agcagctctgtttacctggagg

SEQ ID NO: 7581425 - DNA, 22 bp, Homo sapiens
agcagctctgtttacctggagg

SEQ ID NO: 7581426 - DNA, 22 bp, Homo sapiens
agcagctcttaacaaagcatgg

SEQ ID NO: 7581427 - DNA, 22 bp, Homo sapiens
agcagctcttaacaaagcatgg

SEQ ID NO: 7581428 - DNA, 22 bp, Homo sapiens
agcagctctggcactgtagcat

SEQ ID NO: 7581429 - DNA, 22 bp, Homo sapiens
agcagctctggcactgtagcat

SEQ ID NO: 7581430 - DNA, 22 bp, Homo sapiens
agcagctctggcactgtagcat

SEQ ID NO: 7581431 - DNA, 22 bp, Homo sapiens
agcagctctggcactgtagcat

SEQ ID NO: 7581432 - DNA, 22 bp, Homo sapiens
agcagctctggcactgtagcat

SEQ ID NO: 7581433 - DNA, 22 bp, Homo sapiens
agcaggagggttttgtagagtc

SEQ ID NO: 7581434 - DNA, 22 bp, Homo sapiens
agcaggagggttttgtagagtc

SEQ ID NO: 7581435 - DNA, 22 bp, Homo sapiens
agcaggagggttttgtagagtc

SEQ ID NO: 7581436 - DNA, 22 bp, Homo sapiens
agcaggagggttttgtagagtc

SEQ ID NO: 7581437 - DNA, 22 bp, Homo sapiens
agcaggagggttttgtagagtc

SEQ ID NO: 7581438 - DNA, 22 bp, Homo sapiens
agcaggagggttttgtagagtc

SEQ ID NO: 7581439 - DNA, 22 bp, Homo sapiens
agcaggagggttttgtagagtc

SEQ ID NO: 7581440 - DNA, 22 bp, Homo sapiens
agcaggagggttttgtagagtc

SEQ ID NO: 7581441 - DNA, 22 bp, Homo sapiens
agcaggagggttttgtagagtc

SEQ ID NO: 7581442 - DNA, 22 bp, Homo sapiens
agcaggagggttttgtagagtc

SEQ ID NO: 7581443 - DNA, 21 bp, Homo sapiens
agcaggaggcagtcacagctc

SEQ ID NO: 7581444 - DNA, 21 bp, Homo sapiens
agcaggaggcagtcacagctc

SEQ ID NO: 7581445 - DNA, 21 bp, Homo sapiens
agcaggaggcagtcacagctc

SEQ ID NO: 7581446 - DNA, 22 bp, Homo sapiens
agcaggagtgtcccctggctgt

SEQ ID NO: 7581447 - DNA, 22 bp, Homo sapiens
agcaggagtgtcccctggctgt

SEQ ID NO: 7581448 - DNA, 22 bp, Homo sapiens
agcaggagtgtcccctggctgt

SEQ ID NO: 7581449 - DNA, 22 bp, Homo sapiens
agcaggagtgtcccctggctgt

SEQ ID NO: 7581450 - DNA, 22 bp, Homo sapiens
agcaggagtgtcccctggctgt

SEQ ID NO: 7581451 - DNA, 22 bp, Homo sapiens
agcaggagtgtcccctggctgt

SEQ ID NO: 7581452 - DNA, 22 bp, Homo sapiens
agcaggagggttttgtagagtc

SEQ ID NO: 7581453 - DNA, 22 bp, Homo sapiens
agcaggagggttttgtagagtc

SEQ ID NO: 7581454 - DNA, 22 bp, Homo sapiens
agcaggagggttttgtagagtc

SEQ ID NO: 7581455 - DNA, 22 bp, Homo sapiens
agcaggagggttttgtagagtc

SEQ ID NO: 7581456 - DNA, 22 bp, Homo sapiens
agcaggcaggctgccagtgaat

SEQ ID NO: 7581457 - DNA, 22 bp, Homo sapiens
agcaggcaggctgccagtgaat

SEQ ID NO: 7581458 - DNA, 22 bp, Homo sapiens
agcaggcaggctgccagtgaat

SEQ ID NO: 7581459 - DNA, 22 bp, Homo sapiens
agcaggagtgtcccctggctgt

SEQ ID NO: 7581460 - DNA, 22 bp, Homo sapiens
agcaggcaggctgccagtgaat

SEQ ID NO: 7581461 - DNA, 22 bp, Homo sapiens
agcaggcaggctgccagtgaat

SEQ ID NO: 7581462 - DNA, 19 bp, Homo sapiens
agcaggcaggtggcccagg

SEQ ID NO: 7581463 - DNA, 19 bp, Homo sapiens
agcaggcaggtggcccagg

SEQ ID NO: 7581464 - DNA, 22 bp, Homo sapiens
agcaggcaggctgccagtgaat

SEQ ID NO: 7581465 - DNA, 22 bp, Homo sapiens
agcaggcaggctgccagtgaat

SEQ ID NO: 7581466 - DNA, 22 bp, Homo sapiens
agcagctgagatggtaagattc

SEQ ID NO: 7581467 - DNA, 22 bp, Homo sapiens
agcagctgagatggtaagattc

SEQ ID NO: 7581468 - DNA, 22 bp, Homo sapiens
agcagctgagatggtaagattc

SEQ ID NO: 7581469 - DNA, 22 bp, Homo sapiens
agcagctgagatggtaagattc

SEQ ID NO: 7581470 - DNA, 22 bp, Homo sapiens
agcagctgagccccagctgtga

SEQ ID NO: 7581471 - DNA, 22 bp, Homo sapiens
agcagctgagatggtaagattc

SEQ ID NO: 7581472 - DNA, 22 bp, Homo sapiens
agcagctgagccccagctgtga

SEQ ID NO: 7581473 - DNA, 22 bp, Homo sapiens
agcagctgagccccagctgtga

SEQ ID NO: 7581474 - DNA, 22 bp, Homo sapiens
agcagctgagccccagctgtga

SEQ ID NO: 7581475 - DNA, 22 bp, Homo sapiens
agcagctgagccccagctgtga

SEQ ID NO: 7581476 - DNA, 22 bp, Homo sapiens
agcagctgagccccagctgtga

SEQ ID NO: 7581477 - DNA, 22 bp, Homo sapiens
agcagctgagccccagctgtga

SEQ ID NO: 7581478 - DNA, 22 bp, Homo sapiens
agcaggagctgtgggaagatgg

SEQ ID NO: 7581479 - DNA, 22 bp, Homo sapiens
agcaggagcccttatcaccagg

SEQ ID NO: 7581480 - DNA, 22 bp, Homo sapiens
agcaggaacgagttcatgggga

SEQ ID NO: 7581481 - DNA, 22 bp, Homo sapiens
agcaggagcccttatcaccagg

SEQ ID NO: 7581482 - DNA, 22 bp, Homo sapiens
agcaggaacgagttcatgggga

SEQ ID NO: 7581483 - DNA, 22 bp, Homo sapiens
agcaggaacgagttcatgggga

SEQ ID NO: 7581484 - DNA, 22 bp, Homo sapiens
agcaggaggagagcctggcggt

SEQ ID NO: 7581485 - DNA, 22 bp, Homo sapiens
agcaggaggagagcctggcggt

SEQ ID NO: 7581486 - DNA, 22 bp, Homo sapiens
agcaggaggagagcctggcggt

SEQ ID NO: 7581487 - DNA, 22 bp, Homo sapiens
agcaggaggagagcctggcggt

SEQ ID NO: 7581488 - DNA, 22 bp, Homo sapiens
agcaggaggagagcctggcggt

SEQ ID NO: 7581489 - DNA, 22 bp, Homo sapiens
agcaggaggagagcctggcggt

SEQ ID NO: 7581490 - DNA, 22 bp, Homo sapiens
agcaggaggagagcctggcggt

SEQ ID NO: 7581491 - DNA, 21 bp, Homo sapiens
agcaggaggcagtcacagctc

SEQ ID NO: 7581492 - DNA, 21 bp, Homo sapiens
agcaggaggcagtcacagctc

SEQ ID NO: 7581493 - DNA, 21 bp, Homo sapiens
agcaggaggcagtcacagctc

SEQ ID NO: 7581494 - DNA, 21 bp, Homo sapiens
agcaggaggcagtcacagctc

SEQ ID NO: 7581495 - DNA, 21 bp, Homo sapiens
agcaggaggcagtcacagctc

SEQ ID NO: 7581496 - DNA, 21 bp, Homo sapiens
agcaggaggcagtcacagctc

SEQ ID NO: 7581497 - DNA, 22 bp, Homo sapiens
agcaggagctgtgggaagatgg

SEQ ID NO: 7581498 - DNA, 22 bp, Homo sapiens
agcaggagctgtgggaagatgg

SEQ ID NO: 7581499 - DNA, 22 bp, Homo sapiens
agcaggagctgtgggaagatgg

SEQ ID NO: 7581500 - DNA, 22 bp, Homo sapiens
agcaggagctgtgggaagatgg

SEQ ID NO: 7581501 - DNA, 22 bp, Homo sapiens
agcaggagctgtgggaagatgg

SEQ ID NO: 7581502 - DNA, 22 bp, Homo sapiens
agcaggagctgtgggaagatgg

SEQ ID NO: 7581503 - DNA, 22 bp, Homo sapiens
agcaggagctgtgggaagatgg

SEQ ID NO: 7581504 - DNA, 22 bp, Homo sapiens
agcaggagctgtgggaagatgg

SEQ ID NO: 7581505 - DNA, 22 bp, Homo sapiens
agcagcagattatggtctacat

SEQ ID NO: 7581506 - DNA, 22 bp, Homo sapiens
agcagcagattatggtctacat

SEQ ID NO: 7581507 - DNA, 22 bp, Homo sapiens
agcagcagattcagcaggaatg

SEQ ID NO: 7581508 - DNA, 19 bp, Homo sapiens
agcagcaactgttgattca

SEQ ID NO: 7581509 - DNA, 22 bp, Homo sapiens
agcagcagattatggtctacat

SEQ ID NO: 7581510 - DNA, 22 bp, Homo sapiens
agcagcaacttatttttcttat

SEQ ID NO: 7581511 - DNA, 22 bp, Homo sapiens
agcagcagattatggtctacat

SEQ ID NO: 7581512 - DNA, 22 bp, Homo sapiens
agcagcagattatggtctacat

SEQ ID NO: 7581513 - DNA, 23 bp, Homo sapiens
agcagcagcaattaagtggatat

SEQ ID NO: 7581514 - DNA, 23 bp, Homo sapiens
agcagcagcaattaagtggatat

SEQ ID NO: 7581515 - DNA, 23 bp, Homo sapiens
agcagcagcaattaagtggatat

SEQ ID NO: 7581516 - DNA, 23 bp, Homo sapiens
agcagcagcaattaagtggatat

SEQ ID NO: 7581517 - DNA, 22 bp, Homo sapiens
agcagcagattcagcaggaatg

SEQ ID NO: 7581518 - DNA, 22 bp, Homo sapiens
agcagcagattcagcaggaatg

SEQ ID NO: 7581519 - DNA, 22 bp, Homo sapiens
agcagcagattcagcaggaatg

SEQ ID NO: 7581520 - DNA, 22 bp, Homo sapiens
agcagcagattcagcaggaatg

SEQ ID NO: 7581521 - DNA, 22 bp, Homo sapiens
agcagcagattcagcaggaatg

SEQ ID NO: 7581522 - DNA, 22 bp, Homo sapiens
agcagcagattcagcaggaatg

SEQ ID NO: 7581523 - DNA, 22 bp, Homo sapiens
agcagaacagtcttctagttct

SEQ ID NO: 7581524 - DNA, 21 bp, Homo sapiens
agcagaacagtcgagcactgc

SEQ ID NO: 7581525 - DNA, 22 bp, Homo sapiens
agcagaacagtcttctagttct

SEQ ID NO: 7581526 - DNA, 21 bp, Homo sapiens
agcagaacagtcgagcactgc

SEQ ID NO: 7581527 - DNA, 21 bp, Homo sapiens
agcagaacagtcgagcactgc

SEQ ID NO: 7581528 - DNA, 21 bp, Homo sapiens
agcagaacagtcgagcactgc

SEQ ID NO: 7581529 - DNA, 22 bp, Homo sapiens
agcagaaatgatggtatgggac

SEQ ID NO: 7581530 - DNA, 22 bp, Homo sapiens
agcagaacattatctaggtctt

SEQ ID NO: 7581531 - DNA, 22 bp, Homo sapiens
agcagaacagtcttctagttct

SEQ ID NO: 7581532 - DNA, 22 bp, Homo sapiens
agcagaacattatctaggtctt

SEQ ID NO: 7581533 - DNA, 22 bp, Homo sapiens
agcagaacattatctaggtctt

SEQ ID NO: 7581534 - DNA, 22 bp, Homo sapiens
agcagaacattatctaggtctt

SEQ ID NO: 7581535 - DNA, 22 bp, Homo sapiens
agcagaacattttcagggctgt

SEQ ID NO: 7581536 - DNA, 22 bp, Homo sapiens
agcagaacattttcagggctgt

SEQ ID NO: 7581537 - DNA, 22 bp, Homo sapiens
agcagaacattttcagggctgt

SEQ ID NO: 7581538 - DNA, 21 bp, Homo sapiens
agcagcaaccacatagttttt

SEQ ID NO: 7581539 - DNA, 21 bp, Homo sapiens
agcagcaaccacatagttttt

SEQ ID NO: 7581540 - DNA, 22 bp, Homo sapiens
agcagcaaagtattgggcaaga

SEQ ID NO: 7581541 - DNA, 22 bp, Homo sapiens
agcagcaaagtattgggcaaga

SEQ ID NO: 7581542 - DNA, 22 bp, Homo sapiens
agcagcaaagtattgggcaaga

SEQ ID NO: 7581543 - DNA, 22 bp, Homo sapiens
agcagaaccacagcactgttga

SEQ ID NO: 7581544 - DNA, 22 bp, Homo sapiens
agcagaaccacagcactgttga

SEQ ID NO: 7581545 - DNA, 22 bp, Homo sapiens
agcagaaccacagcactgttga

SEQ ID NO: 7581546 - DNA, 22 bp, Homo sapiens
agcagaaccacagcactgttga

SEQ ID NO: 7581547 - DNA, 19 bp, Homo sapiens
agcagcaactgttgattca

SEQ ID NO: 7581548 - DNA, 22 bp, Homo sapiens
agcagcaactgctagagtggca

SEQ ID NO: 7581549 - DNA, 22 bp, Homo sapiens
agcagcaactgctagagtggca

SEQ ID NO: 7581550 - DNA, 22 bp, Homo sapiens
agcagcaactgctagagtggca

SEQ ID NO: 7581551 - DNA, 22 bp, Homo sapiens
agcagcaactgctagagtggca

SEQ ID NO: 7581552 - DNA, 22 bp, Homo sapiens
agcagcaactgctagagtggca

SEQ ID NO: 7581553 - DNA, 21 bp, Homo sapiens
agcagcaaccacatagttttt

SEQ ID NO: 7581554 - DNA, 21 bp, Homo sapiens
agcagcagcagtggggcttct

SEQ ID NO: 7581555 - DNA, 21 bp, Homo sapiens
agcagcagcagtggggcttct

SEQ ID NO: 7581556 - DNA, 19 bp, Homo sapiens
agcagcagcaccagggatt

SEQ ID NO: 7581557 - DNA, 19 bp, Homo sapiens
agcagcagcaccagggatt

SEQ ID NO: 7581558 - DNA, 23 bp, Homo sapiens
agcagcagcaattaagtggatat

SEQ ID NO: 7581559 - DNA, 23 bp, Homo sapiens
agcagcagcaattaagtggatat

SEQ ID NO: 7581560 - DNA, 19 bp, Homo sapiens
agcagcagcaccagggatt

SEQ ID NO: 7581561 - DNA, 19 bp, Homo sapiens
agcagcagcaccagggatt

SEQ ID NO: 7581562 - DNA, 19 bp, Homo sapiens
agcagcagcaccagggatt

SEQ ID NO: 7581563 - DNA, 19 bp, Homo sapiens
agcagcagcaccagggatt

SEQ ID NO: 7581564 - DNA, 22 bp, Homo sapiens
agcagcagcattgagcgcttgt

SEQ ID NO: 7581565 - DNA, 22 bp, Homo sapiens
agcagcagcattgagcgcttgt

SEQ ID NO: 7581566 - DNA, 22 bp, Homo sapiens
agcagcagcattgagcgcttgt

SEQ ID NO: 7581567 - DNA, 22 bp, Homo sapiens
agcagcagccgtagccttatta

SEQ ID NO: 7581568 - DNA, 22 bp, Homo sapiens
agcagcagccgtagccttatta

SEQ ID NO: 7581569 - DNA, 22 bp, Homo sapiens
agcagcagctcagttctcagct

SEQ ID NO: 7581570 - DNA, 22 bp, Homo sapiens
agcagcagctcagttctcagct

SEQ ID NO: 7581571 - DNA, 22 bp, Homo sapiens
agcagcagctcagttctcagct

SEQ ID NO: 7581572 - DNA, 22 bp, Homo sapiens
agcagcagctcagttctcagct

SEQ ID NO: 7581573 - DNA, 19 bp, Homo sapiens
agcagcagctaccacttgt

SEQ ID NO: 7581574 - DNA, 19 bp, Homo sapiens
agcagcagctaccacttgt

SEQ ID NO: 7581575 - DNA, 19 bp, Homo sapiens
agcagcagctaccacttgt

SEQ ID NO: 7581576 - DNA, 19 bp, Homo sapiens
agcagcagctaccacttgt

SEQ ID NO: 7581577 - DNA, 22 bp, Homo sapiens
agcagcagttgctgacgttcta

SEQ ID NO: 7581578 - DNA, 22 bp, Homo sapiens
agcagcagttgctgacgttcta

SEQ ID NO: 7581579 - DNA, 22 bp, Homo sapiens
agcagcagttgctgacgttcta

SEQ ID NO: 7581580 - DNA, 23 bp, Homo sapiens
acacagaagaagacccaaggaag

SEQ ID NO: 7581581 - DNA, 23 bp, Homo sapiens
acacagaagaagacccaaggaag

SEQ ID NO: 7581582 - DNA, 23 bp, Homo sapiens
acacagaagaagacccaaggaag

SEQ ID NO: 7581583 - DNA, 22 bp, Homo sapiens
agcagcatacacatcatgttga

SEQ ID NO: 7581584 - DNA, 22 bp, Homo sapiens
agcagcatacacatcatgttga

SEQ ID NO: 7581585 - DNA, 22 bp, Homo sapiens
agcagcatagaagctgggagga

SEQ ID NO: 7581586 - DNA, 22 bp, Homo sapiens
agcagcatacacatcatgttga

SEQ ID NO: 7581587 - DNA, 22 bp, Homo sapiens
agcagcatacacatcatgttga

SEQ ID NO: 7581588 - DNA, 22 bp, Homo sapiens
acacagaacctcatagcctctc

SEQ ID NO: 7581589 - DNA, 22 bp, Homo sapiens
acacagaacctcatagcctctc

SEQ ID NO: 7581590 - DNA, 22 bp, Homo sapiens
acacagaacctcatagcctctc

SEQ ID NO: 7581591 - DNA, 22 bp, Homo sapiens
acacagaacctcatagcctctc

SEQ ID NO: 7581592 - DNA, 23 bp, Homo sapiens
acacagaagaagacccaaggaag

SEQ ID NO: 7581593 - DNA, 23 bp, Homo sapiens
acacagaagaagacccaaggaag

SEQ ID NO: 7581594 - DNA, 23 bp, Homo sapiens
acacagaagaagacccaaggaag

SEQ ID NO: 7581595 - DNA, 23 bp, Homo sapiens
acacagaagaagacccaaggaag

SEQ ID NO: 7581596 - DNA, 22 bp, Homo sapiens
acacagaacctcatagcctctc

SEQ ID NO: 7581597 - DNA, 23 bp, Homo sapiens
acacagaagaagacccaaggaag

SEQ ID NO: 7581598 - DNA, 23 bp, Homo sapiens
acacagaagaagacccaaggaag

SEQ ID NO: 7581599 - DNA, 22 bp, Homo sapiens
agcagccaggaatctgcagagc

SEQ ID NO: 7581600 - DNA, 16 bp, Homo sapiens
agcagccagcactgga

SEQ ID NO: 7581601 - DNA, 22 bp, Homo sapiens
agcagccaggaatctgcagagc

SEQ ID NO: 7581602 - DNA, 22 bp, Homo sapiens
agcagccaggaatctgcagagc

SEQ ID NO: 7581603 - DNA, 22 bp, Homo sapiens
agcagccaggaatctgcagagc

SEQ ID NO: 7581604 - DNA, 16 bp, Homo sapiens
agcagccagcactgga

SEQ ID NO: 7581605 - DNA, 22 bp, Homo sapiens
agcagccaggaatctgcagagc

SEQ ID NO: 7581606 - DNA, 22 bp, Homo sapiens
agcagccagtgggagtgataca

SEQ ID NO: 7581607 - DNA, 22 bp, Homo sapiens
agcagccagagtctgaacatta

SEQ ID NO: 7581608 - DNA, 22 bp, Homo sapiens
agcagccagagtctgaacatta

SEQ ID NO: 7581609 - DNA, 22 bp, Homo sapiens
agcagccagagtctgaacatta

SEQ ID NO: 7581610 - DNA, 23 bp, Homo sapiens
agcagccagagatcctcggccct

SEQ ID NO: 7581611 - DNA, 22 bp, Homo sapiens
agcagccagagtctgaacatta

SEQ ID NO: 7581612 - DNA, 22 bp, Homo sapiens
agcagccagagaatgatgcagt

SEQ ID NO: 7581613 - DNA, 23 bp, Homo sapiens
agcagccagagatcctcggccct

SEQ ID NO: 7581614 - DNA, 22 bp, Homo sapiens
agcagccagagtctgaacatta

SEQ ID NO: 7581615 - DNA, 22 bp, Homo sapiens
acacactggcaggagctataaa

SEQ ID NO: 7581616 - DNA, 22 bp, Homo sapiens
acacactggcaggagctataaa

SEQ ID NO: 7581617 - DNA, 22 bp, Homo sapiens
agcagcagctcattcttcctgt

SEQ ID NO: 7581618 - DNA, 22 bp, Homo sapiens
agcagcagctcattcttcctgt

SEQ ID NO: 7581619 - DNA, 22 bp, Homo sapiens
agcagcagctcattcttcctgt

SEQ ID NO: 7581620 - DNA, 22 bp, Homo sapiens
agcagcagctcattcttcctgt

SEQ ID NO: 7581621 - DNA, 22 bp, Homo sapiens
agcagcagctcattcttcctgt

SEQ ID NO: 7581622 - DNA, 22 bp, Homo sapiens
acacactgtaaggactatcact

SEQ ID NO: 7581623 - DNA, 22 bp, Homo sapiens
acacactgtaaggactatcact

SEQ ID NO: 7581624 - DNA, 22 bp, Homo sapiens
acacactgtaaggactatcact

SEQ ID NO: 7581625 - DNA, 22 bp, Homo sapiens
acacactgtaaggactatcact

SEQ ID NO: 7581626 - DNA, 22 bp, Homo sapiens
acacactgtaaggactatcact

SEQ ID NO: 7581627 - DNA, 22 bp, Homo sapiens
acacactggcccccagtactga

SEQ ID NO: 7581628 - DNA, 22 bp, Homo sapiens
acacactggcccccagtactga

SEQ ID NO: 7581629 - DNA, 22 bp, Homo sapiens
acacactggcccccagtactga

SEQ ID NO: 7581630 - DNA, 22 bp, Homo sapiens
acacactggcccccagtactga

SEQ ID NO: 7581631 - DNA, 22 bp, Homo sapiens
acacacttcagatgtaatttgt

SEQ ID NO: 7581632 - DNA, 22 bp, Homo sapiens
acacacttcagatgtaatttgt

SEQ ID NO: 7581633 - DNA, 22 bp, Homo sapiens
acacacttcagatgtaatttgt

SEQ ID NO: 7581634 - DNA, 22 bp, Homo sapiens
acacactttaaattaaacctct

SEQ ID NO: 7581635 - DNA, 22 bp, Homo sapiens
acacacttgcagagaggaggga

SEQ ID NO: 7581636 - DNA, 20 bp, Homo sapiens
acacactttgatcttgagcc

SEQ ID NO: 7581637 - DNA, 20 bp, Homo sapiens
acacactttgatcttgagcc

SEQ ID NO: 7581638 - DNA, 22 bp, Homo sapiens
acacacttcacccttgagctaa

SEQ ID NO: 7581639 - DNA, 22 bp, Homo sapiens
acacacttcacccttgagctaa

SEQ ID NO: 7581640 - DNA, 22 bp, Homo sapiens
acacacttcacccttgagctaa

SEQ ID NO: 7581641 - DNA, 22 bp, Homo sapiens
acacactgttgctcatccaggc

SEQ ID NO: 7581642 - DNA, 22 bp, Homo sapiens
acacactgtaaggactatcact

SEQ ID NO: 7581643 - DNA, 22 bp, Homo sapiens
acacactgtaaggactatcact

SEQ ID NO: 7581644 - DNA, 22 bp, Homo sapiens
acacactgtaaggactatcact

SEQ ID NO: 7581645 - DNA, 22 bp, Homo sapiens
acacactggcaggagctataaa

SEQ ID NO: 7581646 - DNA, 22 bp, Homo sapiens
acacactggcaggagctataaa

SEQ ID NO: 7581647 - DNA, 22 bp, Homo sapiens
acacactggcaggagctataaa

SEQ ID NO: 7581648 - DNA, 22 bp, Homo sapiens
agcacttatgtgattaggacag

SEQ ID NO: 7581649 - DNA, 22 bp, Homo sapiens
agcacttctcatgggatcaggt

SEQ ID NO: 7581650 - DNA, 20 bp, Homo sapiens
agcacttgctgtgtgccata

SEQ ID NO: 7581651 - DNA, 22 bp, Homo sapiens
acacactgagtgccataggacc

SEQ ID NO: 7581652 - DNA, 22 bp, Homo sapiens
acacactgagtgccataggacc

SEQ ID NO: 7581653 - DNA, 21 bp, Homo sapiens
acacactgagttttccactgt

SEQ ID NO: 7581654 - DNA, 21 bp, Homo sapiens
acacactgagttttccactgt

SEQ ID NO: 7581655 - DNA, 21 bp, Homo sapiens
acacactgagttttccactgt

SEQ ID NO: 7581656 - DNA, 22 bp, Homo sapiens
acacactgctcgctcagattaa

SEQ ID NO: 7581657 - DNA, 21 bp, Homo sapiens
acacactacacattcctagtt

SEQ ID NO: 7581658 - DNA, 22 bp, Homo sapiens
acacactcaattgcataagcac

SEQ ID NO: 7581659 - DNA, 22 bp, Homo sapiens
acacacgtgctcaacacgctcc

SEQ ID NO: 7581660 - DNA, 19 bp, Homo sapiens
acacaccagtgcctgtgac

SEQ ID NO: 7581661 - DNA, 22 bp, Homo sapiens
acacacgtatatatacgtatgt

SEQ ID NO: 7581662 - DNA, 22 bp, Homo sapiens
acacaccatgatttatttaccc

SEQ ID NO: 7581663 - DNA, 22 bp, Homo sapiens
acacaccatgatttatttaccc

SEQ ID NO: 7581664 - DNA, 22 bp, Homo sapiens
acacaccatgatttatttaccc

SEQ ID NO: 7581665 - DNA, 22 bp, Homo sapiens
acacaccatgatttatttaccc

SEQ ID NO: 7581666 - DNA, 19 bp, Homo sapiens
acacaccagtgcctgtgac

SEQ ID NO: 7581667 - DNA, 21 bp, Homo sapiens
acacactacacattcctagtt

SEQ ID NO: 7581668 - DNA, 22 bp, Homo sapiens
acacactcaattgcataagcac

SEQ ID NO: 7581669 - DNA, 22 bp, Homo sapiens
acacactcaattgcataagcac

SEQ ID NO: 7581670 - DNA, 22 bp, Homo sapiens
acacactgagtgccataggacc

SEQ ID NO: 7581671 - DNA, 22 bp, Homo sapiens
acacactgaattttgtggaaac

SEQ ID NO: 7581672 - DNA, 22 bp, Homo sapiens
agcagaaatgatggtatgggac

SEQ ID NO: 7581673 - DNA, 22 bp, Homo sapiens
agcagaaatagaagtcaatgat

SEQ ID NO: 7581674 - DNA, 22 bp, Homo sapiens
agcagaaatagaagtcaatgat

SEQ ID NO: 7581675 - DNA, 22 bp, Homo sapiens
agcagaaatagaagtcaatgat

SEQ ID NO: 7581676 - DNA, 22 bp, Homo sapiens
agcagaaagcttattttgactg

SEQ ID NO: 7581677 - DNA, 22 bp, Homo sapiens
agcagaaatagaagtcaatgat

SEQ ID NO: 7581678 - DNA, 22 bp, Homo sapiens
agcagaaatagaagtcaatgat

SEQ ID NO: 7581679 - DNA, 22 bp, Homo sapiens
agcagaaatagaagtcaatgat

SEQ ID NO: 7581680 - DNA, 22 bp, Homo sapiens
agcagaaacagccagtctggac

SEQ ID NO: 7581681 - DNA, 22 bp, Homo sapiens
agcagaaaattggaaatgacaa

SEQ ID NO: 7581682 - DNA, 22 bp, Homo sapiens
agcagaaaattggaaatgacaa

SEQ ID NO: 7581683 - DNA, 22 bp, Homo sapiens
agcagaaaattggaaatgacaa

SEQ ID NO: 7581684 - DNA, 22 bp, Homo sapiens
agcagaaaactttcatgctctg

SEQ ID NO: 7581685 - DNA, 22 bp, Homo sapiens
agcagaaaactttcatgctctg

SEQ ID NO: 7581686 - DNA, 22 bp, Homo sapiens
agcagaaaattggaaatgacaa

SEQ ID NO: 7581687 - DNA, 22 bp, Homo sapiens
agcagaaaattggaaatgacaa

SEQ ID NO: 7581688 - DNA, 22 bp, Homo sapiens
agcagaaacagccagtctggac

SEQ ID NO: 7581689 - DNA, 22 bp, Homo sapiens
agcagaaacagccagtctggac

SEQ ID NO: 7581690 - DNA, 22 bp, Homo sapiens
agcagaaaattggaaatgacaa

SEQ ID NO: 7581691 - DNA, 22 bp, Homo sapiens
agcagaaaactttcatgctctg

SEQ ID NO: 7581692 - DNA, 22 bp, Homo sapiens
agcagaaaactttcatgctctg

SEQ ID NO: 7581693 - DNA, 22 bp, Homo sapiens
agcagaaaactttcatgctctg

SEQ ID NO: 7581694 - DNA, 22 bp, Homo sapiens
agcactttgggagataaagctg

SEQ ID NO: 7581695 - DNA, 22 bp, Homo sapiens
agcactttgtgcatttctgaag

SEQ ID NO: 7581696 - DNA, 22 bp, Homo sapiens
agcactttgtgcatttctgaag

SEQ ID NO: 7581697 - DNA, 22 bp, Homo sapiens
agcactttgggagataaagctg

SEQ ID NO: 7581698 - DNA, 22 bp, Homo sapiens
agcactttgagcagatgaagga

SEQ ID NO: 7581699 - DNA, 22 bp, Homo sapiens
agcactttcctggcaaatgtgg

SEQ ID NO: 7581700 - DNA, 22 bp, Homo sapiens
agcactttcctggcaaatgtgg

SEQ ID NO: 7581701 - DNA, 22 bp, Homo sapiens
agcactttattcaggaactcca

SEQ ID NO: 7581702 - DNA, 22 bp, Homo sapiens
agcactttaagcaacagatcaa

SEQ ID NO: 7581703 - DNA, 22 bp, Homo sapiens
agcacttgtcaggcagctctat

SEQ ID NO: 7581704 - DNA, 21 bp, Homo sapiens
agattcaggacagcagtcact

SEQ ID NO: 7581705 - DNA, 22 bp, Homo sapiens
agatttcccactccatgtattg

SEQ ID NO: 7581706 - DNA, 22 bp, Homo sapiens
agatttcccactccatgtattg

SEQ ID NO: 7581707 - DNA, 22 bp, Homo sapiens
agatttcccaaatacttgttat

SEQ ID NO: 7581708 - DNA, 22 bp, Homo sapiens
agatttcctcttttgtaaagtg

SEQ ID NO: 7581709 - DNA, 22 bp, Homo sapiens
agatttcctatggtaattatag

SEQ ID NO: 7581710 - DNA, 22 bp, Homo sapiens
agatttcctcttttgtaaagtg

SEQ ID NO: 7581711 - DNA, 22 bp, Homo sapiens
agatttccctcttgtatttgca

SEQ ID NO: 7581712 - DNA, 22 bp, Homo sapiens
agatttccgttctctcttcagt

SEQ ID NO: 7581713 - DNA, 22 bp, Homo sapiens
agatttccgttctctcttcagt

SEQ ID NO: 7581714 - DNA, 22 bp, Homo sapiens
agatttcctatggtaattatag

SEQ ID NO: 7581715 - DNA, 22 bp, Homo sapiens
agatttctgtggtcatgtaatg

SEQ ID NO: 7581716 - DNA, 22 bp, Homo sapiens
agatttctgtcaccttctatgc

SEQ ID NO: 7581717 - DNA, 22 bp, Homo sapiens
agatttctgtcaccttctatgc

SEQ ID NO: 7581718 - DNA, 22 bp, Homo sapiens
agatttctgtcaccttctatgc

SEQ ID NO: 7581719 - DNA, 22 bp, Homo sapiens
agatttctgtcaccttctatgc

SEQ ID NO: 7581720 - DNA, 22 bp, Homo sapiens
agatttctgggcttcaccacct

SEQ ID NO: 7581721 - DNA, 22 bp, Homo sapiens
agatttctgtcaccttctatgc

SEQ ID NO: 7581722 - DNA, 22 bp, Homo sapiens
agatttctgtcaccttctatgc

SEQ ID NO: 7581723 - DNA, 22 bp, Homo sapiens
agatttctgggcttcaccacct

SEQ ID NO: 7581724 - DNA, 22 bp, Homo sapiens
agatttctgggcttcaccacct

SEQ ID NO: 7581725 - DNA, 22 bp, Homo sapiens
agatttcctgcactgcctttga

SEQ ID NO: 7581726 - DNA, 22 bp, Homo sapiens
agatttctctttccctggctga

SEQ ID NO: 7581727 - DNA, 22 bp, Homo sapiens
agatttgatatcatgcaacaaa

SEQ ID NO: 7581728 - DNA, 22 bp, Homo sapiens
agatttgccatggatgttcttt

SEQ ID NO: 7581729 - DNA, 23 bp, Homo sapiens
agatttggaaagctgagtggcgt

SEQ ID NO: 7581730 - DNA, 22 bp, Homo sapiens
agatttgaaacttgcttcataa

SEQ ID NO: 7581731 - DNA, 22 bp, Homo sapiens
agatttgagttttctatccttg

SEQ ID NO: 7581732 - DNA, 22 bp, Homo sapiens
agatttctgtggtcatgtaatg

SEQ ID NO: 7581733 - DNA, 22 bp, Homo sapiens
agatttctgtggtcatgtaatg

SEQ ID NO: 7581734 - DNA, 22 bp, Homo sapiens
agatttgaaacttgcttcataa

SEQ ID NO: 7581735 - DNA, 22 bp, Homo sapiens
agatttggtgtctggttgatat

SEQ ID NO: 7581736 - DNA, 22 bp, Homo sapiens
agatttgtatgtctaaatgtaa

SEQ ID NO: 7581737 - DNA, 22 bp, Homo sapiens
agatttgtcagctcagtcttta

SEQ ID NO: 7581738 - DNA, 22 bp, Homo sapiens
agatttggtgtctggttgatat

SEQ ID NO: 7581739 - DNA, 22 bp, Homo sapiens
agatttggtgtctggttgatat

SEQ ID NO: 7581740 - DNA, 22 bp, Homo sapiens
agatttggtgtctggttgatat

SEQ ID NO: 7581741 - DNA, 22 bp, Homo sapiens
agatttgggggctagggctggt

SEQ ID NO: 7581742 - DNA, 23 bp, Homo sapiens
agatttggaaagctgagtggcgt

SEQ ID NO: 7581743 - DNA, 21 bp, Homo sapiens
agatttgtcccttcccattta

SEQ ID NO: 7581744 - DNA, 22 bp, Homo sapiens
agatttgtcctgctttctacct

SEQ ID NO: 7581745 - DNA, 21 bp, Homo sapiens
agatttgtcccttcccattta

SEQ ID NO: 7581746 - DNA, 22 bp, Homo sapiens
agatttgtcctgctttctacct

SEQ ID NO: 7581747 - DNA, 22 bp, Homo sapiens
agatttgtcttggtctcatctg

SEQ ID NO: 7581748 - DNA, 21 bp, Homo sapiens
agatttgtcccttcccattta

SEQ ID NO: 7581749 - DNA, 22 bp, Homo sapiens
agatttgtcttggtctcatctg

SEQ ID NO: 7581750 - DNA, 22 bp, Homo sapiens
agatttgttgtgagcaggaata

SEQ ID NO: 7581751 - DNA, 22 bp, Homo sapiens
agatttgttgtgagcaggaata

SEQ ID NO: 7581752 - DNA, 22 bp, Homo sapiens
agattttagtgtagaggacttg

SEQ ID NO: 7581753 - DNA, 18 bp, Homo sapiens
agattttgagaaatacaa

SEQ ID NO: 7581754 - DNA, 22 bp, Homo sapiens
agattttatagataatttccca

SEQ ID NO: 7581755 - DNA, 22 bp, Homo sapiens
agattttagtgtagaggacttg

SEQ ID NO: 7581756 - DNA, 22 bp, Homo sapiens
agattttagtttggggaggtgc

SEQ ID NO: 7581757 - DNA, 22 bp, Homo sapiens
agattttagtgtagaggacttg

SEQ ID NO: 7581758 - DNA, 22 bp, Homo sapiens
agattttagtttggggaggtgc

SEQ ID NO: 7581759 - DNA, 22 bp, Homo sapiens
agattttatagataatttccca

SEQ ID NO: 7581760 - DNA, 22 bp, Homo sapiens
agattttagtttggggaggtgc

SEQ ID NO: 7581761 - DNA, 22 bp, Homo sapiens
acacacatggtattgttcagaa

SEQ ID NO: 7581762 - DNA, 22 bp, Homo sapiens
acacacatggtattgttcagaa

SEQ ID NO: 7581763 - DNA, 22 bp, Homo sapiens
acacacatggtattgttcagaa

SEQ ID NO: 7581764 - DNA, 22 bp, Homo sapiens
acacacatggtattgttcagaa

SEQ ID NO: 7581765 - DNA, 22 bp, Homo sapiens
acacacatggtattgttcagaa

SEQ ID NO: 7581766 - DNA, 22 bp, Homo sapiens
acacacatggtattgttcagaa

SEQ ID NO: 7581767 - DNA, 22 bp, Homo sapiens
acacacatggtattgttcagaa

SEQ ID NO: 7581768 - DNA, 22 bp, Homo sapiens
acacacatggtattgttcagaa

SEQ ID NO: 7581769 - DNA, 22 bp, Homo sapiens
acacacatggtattgttcagaa

SEQ ID NO: 7581770 - DNA, 22 bp, Homo sapiens
acacacatggtattgttcagaa

SEQ ID NO: 7581771 - DNA, 22 bp, Homo sapiens
acacacatgcctttcctaagta

SEQ ID NO: 7581772 - DNA, 22 bp, Homo sapiens
acacacagaaggaagccccact

SEQ ID NO: 7581773 - DNA, 22 bp, Homo sapiens
acacacagaaggaagccccact

SEQ ID NO: 7581774 - DNA, 22 bp, Homo sapiens
acacacagaaggaagccccact

SEQ ID NO: 7581775 - DNA, 22 bp, Homo sapiens
acacacagaaggaagccccact

SEQ ID NO: 7581776 - DNA, 22 bp, Homo sapiens
acacacagaaggaagccccact

SEQ ID NO: 7581777 - DNA, 22 bp, Homo sapiens
agcccctgtcctctctgatgac

SEQ ID NO: 7581778 - DNA, 22 bp, Homo sapiens
agcccctgtcctctctgatgac

SEQ ID NO: 7581779 - DNA, 22 bp, Homo sapiens
agcccctgtcctctctgatgac

SEQ ID NO: 7581780 - DNA, 22 bp, Homo sapiens
agcccctgtcctctctgatgac

SEQ ID NO: 7581781 - DNA, 22 bp, Homo sapiens
agcccctgtcctctctgatgac

SEQ ID NO: 7581782 - DNA, 22 bp, Homo sapiens
agcccctgtttttccagtcaga

SEQ ID NO: 7581783 - DNA, 22 bp, Homo sapiens
agcccctgtttttccagtcaga

SEQ ID NO: 7581784 - DNA, 22 bp, Homo sapiens
agcccctgtttttccagtcaga

SEQ ID NO: 7581785 - DNA, 22 bp, Homo sapiens
agccctgcacaggtctgtggct

SEQ ID NO: 7581786 - DNA, 22 bp, Homo sapiens
agcccctgtttttccagtcaga

SEQ ID NO: 7581787 - DNA, 22 bp, Homo sapiens
agccctgcacaggtctgtggct

SEQ ID NO: 7581788 - DNA, 22 bp, Homo sapiens
acagacatggaccaagcactgt

SEQ ID NO: 7581789 - DNA, 22 bp, Homo sapiens
acagacatggaccaagcactgt

SEQ ID NO: 7581790 - DNA, 22 bp, Homo sapiens
acagacatggaccaagcactgt

SEQ ID NO: 7581791 - DNA, 22 bp, Homo sapiens
acagacatggaccaagcactgt

SEQ ID NO: 7581792 - DNA, 22 bp, Homo sapiens
acagacatggaccaagcactgt

SEQ ID NO: 7581793 - DNA, 22 bp, Homo sapiens
agcccctgtcctctctgatgac

SEQ ID NO: 7581794 - DNA, 22 bp, Homo sapiens
acagacatgggccgctcttgag

SEQ ID NO: 7581795 - DNA, 22 bp, Homo sapiens
acagacatgggccgctcttgag

SEQ ID NO: 7581796 - DNA, 22 bp, Homo sapiens
acagacatgggccgctcttgag

SEQ ID NO: 7581797 - DNA, 22 bp, Homo sapiens
acagacatgggccgctcttgag

SEQ ID NO: 7581798 - DNA, 22 bp, Homo sapiens
agccctgcaggatgagggaggt

SEQ ID NO: 7581799 - DNA, 22 bp, Homo sapiens
agccctgcaggatgagggaggt

SEQ ID NO: 7581800 - DNA, 22 bp, Homo sapiens
agccctgcaggatgagggaggt

SEQ ID NO: 7581801 - DNA, 22 bp, Homo sapiens
agccctgcataaatcagttggt

SEQ ID NO: 7581802 - DNA, 22 bp, Homo sapiens
agccctgcataaatcagttggt

SEQ ID NO: 7581803 - DNA, 22 bp, Homo sapiens
agccctgcataaatcagttggt

SEQ ID NO: 7581804 - DNA, 22 bp, Homo sapiens
agccctgcacagttcgggagga

SEQ ID NO: 7581805 - DNA, 22 bp, Homo sapiens
agccctgcacagttcgggagga

SEQ ID NO: 7581806 - DNA, 22 bp, Homo sapiens
agccctgcaggaggtgggagag

SEQ ID NO: 7581807 - DNA, 22 bp, Homo sapiens
agccctgcaggaggtgggagag

SEQ ID NO: 7581808 - DNA, 22 bp, Homo sapiens
agccctgcaggaggtgggagag

SEQ ID NO: 7581809 - DNA, 22 bp, Homo sapiens
agccctggggctggtcttggaa

SEQ ID NO: 7581810 - DNA, 22 bp, Homo sapiens
agccctggggctggtcttggaa

SEQ ID NO: 7581811 - DNA, 22 bp, Homo sapiens
agccctggggctggtcttggaa

SEQ ID NO: 7581812 - DNA, 22 bp, Homo sapiens
agccctggggctggtcttggaa

SEQ ID NO: 7581813 - DNA, 22 bp, Homo sapiens
agccctggggctggtcttggaa

SEQ ID NO: 7581814 - DNA, 22 bp, Homo sapiens
agccctggggctggtcttggaa

SEQ ID NO: 7581815 - DNA, 22 bp, Homo sapiens
agccctggggctggtcttggaa

SEQ ID NO: 7581816 - DNA, 22 bp, Homo sapiens
agccctggggctggtgcttacc

SEQ ID NO: 7581817 - DNA, 22 bp, Homo sapiens
agccctggggctggtgcttacc

SEQ ID NO: 7581818 - DNA, 22 bp, Homo sapiens
agccctggggctggtgcttacc

SEQ ID NO: 7581819 - DNA, 22 bp, Homo sapiens
agccctgcgctcacgttctgca

SEQ ID NO: 7581820 - DNA, 22 bp, Homo sapiens
agccctgcgatcgtgatttctt

SEQ ID NO: 7581821 - DNA, 22 bp, Homo sapiens
agccctgcgtgccaggggactg

SEQ ID NO: 7581822 - DNA, 22 bp, Homo sapiens
agccctgcgtgccaggggactg

SEQ ID NO: 7581823 - DNA, 22 bp, Homo sapiens
agccctgcgtgccaggggactg

SEQ ID NO: 7581824 - DNA, 22 bp, Homo sapiens
agccctggggctggtcttggaa

SEQ ID NO: 7581825 - DNA, 22 bp, Homo sapiens
agccctgccctgccatgtggca

SEQ ID NO: 7581826 - DNA, 22 bp, Homo sapiens
agccctgccctgccatgtggca

SEQ ID NO: 7581827 - DNA, 22 bp, Homo sapiens
agccctgccctgccatgtggca

SEQ ID NO: 7581828 - DNA, 22 bp, Homo sapiens
agccctgcctctccaatgccca

SEQ ID NO: 7581829 - DNA, 22 bp, Homo sapiens
agccctgcctctccaatgccca

SEQ ID NO: 7581830 - DNA, 22 bp, Homo sapiens
agccctgccctgccatgtggca

SEQ ID NO: 7581831 - DNA, 22 bp, Homo sapiens
agccctgccattctctggagct

SEQ ID NO: 7581832 - DNA, 22 bp, Homo sapiens
agccctgccattctctggagct

SEQ ID NO: 7581833 - DNA, 22 bp, Homo sapiens
agccctgccattctctggagct

SEQ ID NO: 7581834 - DNA, 22 bp, Homo sapiens
agccctgcatagaagggaacac

SEQ ID NO: 7581835 - DNA, 22 bp, Homo sapiens
agccctgcatagaagggaacac

SEQ ID NO: 7581836 - DNA, 22 bp, Homo sapiens
agcctgcttccctttgtgcccc

SEQ ID NO: 7581837 - DNA, 22 bp, Homo sapiens
agcctgcttcctcagggaacaa

SEQ ID NO: 7581838 - DNA, 22 bp, Homo sapiens
agccctgttaactgttttgaag

SEQ ID NO: 7581839 - DNA, 22 bp, Homo sapiens
agccctgtgtgcttgtgttcct

SEQ ID NO: 7581840 - DNA, 22 bp, Homo sapiens
agccctgttaactgttttgaag

SEQ ID NO: 7581841 - DNA, 22 bp, Homo sapiens
agccctgtgggccttgtggcac

SEQ ID NO: 7581842 - DNA, 22 bp, Homo sapiens
agcctgctgggaagggaggctt

SEQ ID NO: 7581843 - DNA, 22 bp, Homo sapiens
agcctggccaggcctgcccagg

SEQ ID NO: 7581844 - DNA, 22 bp, Homo sapiens
agcctggccaggcctgcccagg

SEQ ID NO: 7581845 - DNA, 22 bp, Homo sapiens
agcctggccaggcctgcccagg

SEQ ID NO: 7581846 - DNA, 22 bp, Homo sapiens
agcctggccaggcctgcccagg

SEQ ID NO: 7581847 - DNA, 22 bp, Homo sapiens
agcctggccaggcctgcccagg

SEQ ID NO: 7581848 - DNA, 22 bp, Homo sapiens
agcctggccactcagggcctga

SEQ ID NO: 7581849 - DNA, 22 bp, Homo sapiens
agcctggccaggcctgcccagg

SEQ ID NO: 7581850 - DNA, 22 bp, Homo sapiens
agcctggccaggcctgcccagg

SEQ ID NO: 7581851 - DNA, 22 bp, Homo sapiens
agcctggcggtcgtcggtcagg

SEQ ID NO: 7581852 - DNA, 22 bp, Homo sapiens
agcctggcggtcgtcggtcagg

SEQ ID NO: 7581853 - DNA, 22 bp, Homo sapiens
agcctggcggtcgtcggtcagg

SEQ ID NO: 7581854 - DNA, 22 bp, Homo sapiens
agcctggcctgggcaggcacat

SEQ ID NO: 7581855 - DNA, 22 bp, Homo sapiens
agcctggcctgggcaggcacat

SEQ ID NO: 7581856 - DNA, 22 bp, Homo sapiens
agcctggcctgggcaggcacat

SEQ ID NO: 7581857 - DNA, 22 bp, Homo sapiens
agcctggcctgggcaggcacat

SEQ ID NO: 7581858 - DNA, 22 bp, Homo sapiens
agcctggcctgggcaggcacat

SEQ ID NO: 7581859 - DNA, 22 bp, Homo sapiens
agcctggccctgctgaactctg

SEQ ID NO: 7581860 - DNA, 22 bp, Homo sapiens
agcctggccctgctgaactctg

SEQ ID NO: 7581861 - DNA, 22 bp, Homo sapiens
agcctggccctgctgaactctg

SEQ ID NO: 7581862 - DNA, 22 bp, Homo sapiens
agcctggccctgctgaactctg

SEQ ID NO: 7581863 - DNA, 22 bp, Homo sapiens
agcctggccctgctgaactctg

SEQ ID NO: 7581864 - DNA, 21 bp, Homo sapiens
agcctggcccagggggaggct

SEQ ID NO: 7581865 - DNA, 21 bp, Homo sapiens
agcctggcccagggggaggct

SEQ ID NO: 7581866 - DNA, 21 bp, Homo sapiens
agcctggcccagggggaggct

SEQ ID NO: 7581867 - DNA, 21 bp, Homo sapiens
agcctggcccagggggaggct

SEQ ID NO: 7581868 - DNA, 21 bp, Homo sapiens
agcctggcccagggggaggct

SEQ ID NO: 7581869 - DNA, 21 bp, Homo sapiens
agcctggcccagggggaggct

SEQ ID NO: 7581870 - DNA, 22 bp, Homo sapiens
agcctggccctgctgaactctg

SEQ ID NO: 7581871 - DNA, 21 bp, Homo sapiens
agcctggcccagggggaggct

SEQ ID NO: 7581872 - DNA, 22 bp, Homo sapiens
agccctgtctctcactccaggt

SEQ ID NO: 7581873 - DNA, 22 bp, Homo sapiens
agccctgtagatttaggagagt

SEQ ID NO: 7581874 - DNA, 22 bp, Homo sapiens
agccctgtagatttaggagagt

SEQ ID NO: 7581875 - DNA, 22 bp, Homo sapiens
agccctgtagatttaggagagt

SEQ ID NO: 7581876 - DNA, 22 bp, Homo sapiens
agccctgtgggccttgtggcac

SEQ ID NO: 7581877 - DNA, 22 bp, Homo sapiens
agccctgtgtgcttgtgttcct

SEQ ID NO: 7581878 - DNA, 22 bp, Homo sapiens
agccctgtgggccttgtggcac

SEQ ID NO: 7581879 - DNA, 17 bp, Homo sapiens
agccctgtgctcttttt

SEQ ID NO: 7581880 - DNA, 22 bp, Homo sapiens
agccctgtctctcactccaggt

SEQ ID NO: 7581881 - DNA, 20 bp, Homo sapiens
agccctgtaaatcccctgga

SEQ ID NO: 7581882 - DNA, 20 bp, Homo sapiens
agccctgtaaatcccctgga

SEQ ID NO: 7581883 - DNA, 20 bp, Homo sapiens
agccctgtaaatcccctgga

SEQ ID NO: 7581884 - DNA, 22 bp, Homo sapiens
agccctggtttgcagcatttgc

SEQ ID NO: 7581885 - DNA, 22 bp, Homo sapiens
agccctggtttgcagcatttgc

SEQ ID NO: 7581886 - DNA, 22 bp, Homo sapiens
agccctggtagcctgctgccat

SEQ ID NO: 7581887 - DNA, 22 bp, Homo sapiens
agccctggtagcctgctgccat

SEQ ID NO: 7581888 - DNA, 22 bp, Homo sapiens
agccctggtagcctgctgccat

SEQ ID NO: 7581889 - DNA, 22 bp, Homo sapiens
agccctggtagcctgctgccat

SEQ ID NO: 7581890 - DNA, 22 bp, Homo sapiens
agccctggtagcctgctgccat

SEQ ID NO: 7581891 - DNA, 22 bp, Homo sapiens
agccctggtagcctgctgccat

SEQ ID NO: 7581892 - DNA, 22 bp, Homo sapiens
agccctggtagcctgctgccat

SEQ ID NO: 7581893 - DNA, 22 bp, Homo sapiens
agccctggtagcctgctgccat

SEQ ID NO: 7581894 - DNA, 22 bp, Homo sapiens
agccctggtagcctgctgccat

SEQ ID NO: 7581895 - DNA, 22 bp, Homo sapiens
agccctggtagcctgctgccat

SEQ ID NO: 7581896 - DNA, 22 bp, Homo sapiens
agccctggtagcctgctgccat

SEQ ID NO: 7581897 - DNA, 22 bp, Homo sapiens
agccctggtttgcagcatttgc

SEQ ID NO: 7581898 - DNA, 22 bp, Homo sapiens
agccctggtttgcagcatttgc

SEQ ID NO: 7581899 - DNA, 22 bp, Homo sapiens
agccctgggttagggtgggagc

SEQ ID NO: 7581900 - DNA, 22 bp, Homo sapiens
agccctgggttagggtgggagc

SEQ ID NO: 7581901 - DNA, 22 bp, Homo sapiens
agccctgggttagggtgggagc

SEQ ID NO: 7581902 - DNA, 22 bp, Homo sapiens
agccctgggttagggtgggagc

SEQ ID NO: 7581903 - DNA, 22 bp, Homo sapiens
agccctgggttagggtgggagc

SEQ ID NO: 7581904 - DNA, 22 bp, Homo sapiens
agccctgggtcccagtcctggc

SEQ ID NO: 7581905 - DNA, 22 bp, Homo sapiens
agccctgggttagggtgggagc

SEQ ID NO: 7581906 - DNA, 22 bp, Homo sapiens
agccctgggttagggtgggagc

SEQ ID NO: 7581907 - DNA, 22 bp, Homo sapiens
agccctgggttagggtgggagc

SEQ ID NO: 7581908 - DNA, 22 bp, Homo sapiens
agccctgggtcccagtcctggc

SEQ ID NO: 7581909 - DNA, 22 bp, Homo sapiens
agccctgggtcccagtcctggc

SEQ ID NO: 7581910 - DNA, 22 bp, Homo sapiens
agccctgggtcccagtcctggc

SEQ ID NO: 7581911 - DNA, 22 bp, Homo sapiens
agccctgggtcccagtcctggc

SEQ ID NO: 7581912 - DNA, 22 bp, Homo sapiens
agccctgggtcccagtcctggc

SEQ ID NO: 7581913 - DNA, 22 bp, Homo sapiens
agccctgggtcccagtcctggc

SEQ ID NO: 7581914 - DNA, 22 bp, Homo sapiens
agccctgggtcccagtcctggc

SEQ ID NO: 7581915 - DNA, 22 bp, Homo sapiens
agccctgggtcccagtcctggc

SEQ ID NO: 7581916 - DNA, 22 bp, Homo sapiens
agccctggggtgcagaaccatg

SEQ ID NO: 7581917 - DNA, 22 bp, Homo sapiens
agccctggggctggtgcttacc

SEQ ID NO: 7581918 - DNA, 22 bp, Homo sapiens
agccctggggctggtgcttacc

SEQ ID NO: 7581919 - DNA, 22 bp, Homo sapiens
agccctggggtgcagaaccatg

SEQ ID NO: 7581920 - DNA, 22 bp, Homo sapiens
agccctggggtgcagaaccatg

SEQ ID NO: 7581921 - DNA, 22 bp, Homo sapiens
agccctggggtgcagaaccatg

SEQ ID NO: 7581922 - DNA, 22 bp, Homo sapiens
agccctggggtgcagaaccatg

SEQ ID NO: 7581923 - DNA, 22 bp, Homo sapiens
agctcagtggctcagtgggtat

SEQ ID NO: 7581924 - DNA, 22 bp, Homo sapiens
agctcagttggccactctttca

SEQ ID NO: 7581925 - DNA, 22 bp, Homo sapiens
agctcaggtctcaggaggtgtc

SEQ ID NO: 7581926 - DNA, 22 bp, Homo sapiens
agctcaggtctcaggaggtgtc

SEQ ID NO: 7581927 - DNA, 22 bp, Homo sapiens
agctcaggtctcaggaggtgtc

SEQ ID NO: 7581928 - DNA, 22 bp, Homo sapiens
agctcaggtctcaggaggtgtc

SEQ ID NO: 7581929 - DNA, 22 bp, Homo sapiens
agctcaggtctcaggaggtgtc

SEQ ID NO: 7581930 - DNA, 22 bp, Homo sapiens
agctcaggtctcaggaggtgtc

SEQ ID NO: 7581931 - DNA, 22 bp, Homo sapiens
agctcaggtctcaggaggtgtc

SEQ ID NO: 7581932 - DNA, 22 bp, Homo sapiens
agctcaggtagactcagcatct

SEQ ID NO: 7581933 - DNA, 22 bp, Homo sapiens
agctcaggtagactcagcatct

SEQ ID NO: 7581934 - DNA, 22 bp, Homo sapiens
agctcagggcgatctgtctcgg

SEQ ID NO: 7581935 - DNA, 22 bp, Homo sapiens
agctcaggtcattccagggatg

SEQ ID NO: 7581936 - DNA, 22 bp, Homo sapiens
agctcaggtcattccagggatg

SEQ ID NO: 7581937 - DNA, 22 bp, Homo sapiens
agctcaggtagactcagcatct

SEQ ID NO: 7581938 - DNA, 22 bp, Homo sapiens
agctcaggtcattccagggatg

SEQ ID NO: 7581939 - DNA, 22 bp, Homo sapiens
agctcaggtcattccagggatg

SEQ ID NO: 7581940 - DNA, 22 bp, Homo sapiens
agctcaggtcattccagggatg

SEQ ID NO: 7581941 - DNA, 22 bp, Homo sapiens
agctccagaaaggtacacacag

SEQ ID NO: 7581942 - DNA, 22 bp, Homo sapiens
agctccagaaaggtacacacag

SEQ ID NO: 7581943 - DNA, 22 bp, Homo sapiens
agctccagaaaggtacacacag

SEQ ID NO: 7581944 - DNA, 23 bp, Homo sapiens
agctccagggaacaggcagtagg

SEQ ID NO: 7581945 - DNA, 22 bp, Homo sapiens
agctccaggtagtgccttatcg

SEQ ID NO: 7581946 - DNA, 22 bp, Homo sapiens
agctccaggtagtgccttatcg

SEQ ID NO: 7581947 - DNA, 23 bp, Homo sapiens
agctccagggaacaggcagtagg

SEQ ID NO: 7581948 - DNA, 23 bp, Homo sapiens
agctccagggaacaggcagtagg

SEQ ID NO: 7581949 - DNA, 22 bp, Homo sapiens
agctccactaaacagaatactc

SEQ ID NO: 7581950 - DNA, 22 bp, Homo sapiens
agctccactccctgcctgtttc

SEQ ID NO: 7581951 - DNA, 22 bp, Homo sapiens
agctccactccctgcctgtttc

SEQ ID NO: 7581952 - DNA, 22 bp, Homo sapiens
agctccaaggttgaggagtgag

SEQ ID NO: 7581953 - DNA, 22 bp, Homo sapiens
agctccaggtcagtgcacccct

SEQ ID NO: 7581954 - DNA, 22 bp, Homo sapiens
agctccaggtcagtgcacccct

SEQ ID NO: 7581955 - DNA, 22 bp, Homo sapiens
agctccaggtcagtgcacccct

SEQ ID NO: 7581956 - DNA, 22 bp, Homo sapiens
agctccaggtcagtgcacccct

SEQ ID NO: 7581957 - DNA, 22 bp, Homo sapiens
agctccaggtagtgccttatcg

SEQ ID NO: 7581958 - DNA, 23 bp, Homo sapiens
agctccaggtgattgtaatgtgt

SEQ ID NO: 7581959 - DNA, 23 bp, Homo sapiens
agctccaggtgattgtaatgtgt

SEQ ID NO: 7581960 - DNA, 23 bp, Homo sapiens
agctccaggtgattgtaatgtgt

SEQ ID NO: 7581961 - DNA, 23 bp, Homo sapiens
agctccaggtgattgtaatgtgt

SEQ ID NO: 7581962 - DNA, 22 bp, Homo sapiens
agctccaggtcagtgcacccct

SEQ ID NO: 7581963 - DNA, 22 bp, Homo sapiens
agctcaggctctgcagggacta

SEQ ID NO: 7581964 - DNA, 22 bp, Homo sapiens
agctcaggctctgcagggacta

SEQ ID NO: 7581965 - DNA, 22 bp, Homo sapiens
agctcaggctctgcagggacta

SEQ ID NO: 7581966 - DNA, 22 bp, Homo sapiens
agctcaggctctgcagggacta

SEQ ID NO: 7581967 - DNA, 22 bp, Homo sapiens
agctcaggctctgcagggacta

SEQ ID NO: 7581968 - DNA, 22 bp, Homo sapiens
agctcagggcaaagactcaaat

SEQ ID NO: 7581969 - DNA, 22 bp, Homo sapiens
agctcagggcaaagactcaaat

SEQ ID NO: 7581970 - DNA, 22 bp, Homo sapiens
agctcaggctctgcagggacta

SEQ ID NO: 7581971 - DNA, 22 bp, Homo sapiens
agctcagggctccaggaccgct

SEQ ID NO: 7581972 - DNA, 22 bp, Homo sapiens
agctcagggctccaggaccgct

SEQ ID NO: 7581973 - DNA, 22 bp, Homo sapiens
agctcagggcgatctgtctcgg

SEQ ID NO: 7581974 - DNA, 22 bp, Homo sapiens
agctcagggcgatctgtctcgg

SEQ ID NO: 7581975 - DNA, 22 bp, Homo sapiens
agctcagggcgatctgtctcgg

SEQ ID NO: 7581976 - DNA, 22 bp, Homo sapiens
agctcagggcgatctgtctcgg

SEQ ID NO: 7581977 - DNA, 22 bp, Homo sapiens
agctcagggcgatctgtctcgg

SEQ ID NO: 7581978 - DNA, 22 bp, Homo sapiens
agctcagggcgatctgtctcgg

SEQ ID NO: 7581979 - DNA, 22 bp, Homo sapiens
agctcagggccatcggcccttt

SEQ ID NO: 7581980 - DNA, 22 bp, Homo sapiens
agctcagggccatcggcccttt

SEQ ID NO: 7581981 - DNA, 22 bp, Homo sapiens
agctcagggcaaagactcaaat

SEQ ID NO: 7581982 - DNA, 22 bp, Homo sapiens
agctcaggccggagctacaggc

SEQ ID NO: 7581983 - DNA, 22 bp, Homo sapiens
agctcaagttcttttaccatat

SEQ ID NO: 7581984 - DNA, 22 bp, Homo sapiens
agctcaggccggagctacaggc

SEQ ID NO: 7581985 - DNA, 22 bp, Homo sapiens
agctcaggccggagctacaggc

SEQ ID NO: 7581986 - DNA, 22 bp, Homo sapiens
agctcaggccggagctacaggc

SEQ ID NO: 7581987 - DNA, 22 bp, Homo sapiens
agctcaggctctgcagggacta

SEQ ID NO: 7581988 - DNA, 22 bp, Homo sapiens
agctcaggccggagctacaggc

SEQ ID NO: 7581989 - DNA, 22 bp, Homo sapiens
agctcaggccggagctacaggc

SEQ ID NO: 7581990 - DNA, 22 bp, Homo sapiens
agctcaggccggagctacaggc

SEQ ID NO: 7581991 - DNA, 23 bp, Homo sapiens
agctcaaggcagtccacatttcc

SEQ ID NO: 7581992 - DNA, 22 bp, Homo sapiens
agctcaagtatttgggatttgt

SEQ ID NO: 7581993 - DNA, 22 bp, Homo sapiens
agctcaagtgcagttgggggat

SEQ ID NO: 7581994 - DNA, 22 bp, Homo sapiens
agctcaagtgcaagcattctat

SEQ ID NO: 7581995 - DNA, 22 bp, Homo sapiens
agctcaagtgcagttgggggat

SEQ ID NO: 7581996 - DNA, 22 bp, Homo sapiens
agccttagataaatgctagctc

SEQ ID NO: 7581997 - DNA, 22 bp, Homo sapiens
agctcaagctacacacagagtc

SEQ ID NO: 7581998 - DNA, 22 bp, Homo sapiens
agccttagatttgggcaagaac

SEQ ID NO: 7581999 - DNA, 22 bp, Homo sapiens
agctcaagctacacacagagtc

SEQ ID NO: 7582000 - DNA, 22 bp, Homo sapiens
agcctggcttaatcctcctttt

SEQ ID NO: 7582001 - DNA, 22 bp, Homo sapiens
agcctggcttaatcctcctttt

SEQ ID NO: 7582002 - DNA, 22 bp, Homo sapiens
agcctggcttaatcctcctttt

SEQ ID NO: 7582003 - DNA, 22 bp, Homo sapiens
agcctggcttaatcctcctttt

SEQ ID NO: 7582004 - DNA, 22 bp, Homo sapiens
agcctggcttaatcctcctttt

SEQ ID NO: 7582005 - DNA, 22 bp, Homo sapiens
agcctggcttaatcctcctttt

SEQ ID NO: 7582006 - DNA, 22 bp, Homo sapiens
agcctgtgaaatctctgccact

SEQ ID NO: 7582007 - DNA, 22 bp, Homo sapiens
agcctgtgaaatctctgccact

SEQ ID NO: 7582008 - DNA, 22 bp, Homo sapiens
agcctgtgaaatctctgccact

SEQ ID NO: 7582009 - DNA, 22 bp, Homo sapiens
agcctgtgaaatctctgccact

SEQ ID NO: 7582010 - DNA, 22 bp, Homo sapiens
agcctggcttaatcctcctttt

SEQ ID NO: 7582011 - DNA, 22 bp, Homo sapiens
agcctgtctgtctccaaagctg

SEQ ID NO: 7582012 - DNA, 22 bp, Homo sapiens
agcctgtgagggatgctgcagt

SEQ ID NO: 7582013 - DNA, 22 bp, Homo sapiens
agcctgtgagggatgctgcagt

SEQ ID NO: 7582014 - DNA, 22 bp, Homo sapiens
agcctgtgagggatgctgcagt

SEQ ID NO: 7582015 - DNA, 22 bp, Homo sapiens
agcctgtgagggatgctgcagt

SEQ ID NO: 7582016 - DNA, 22 bp, Homo sapiens
agcctggctaaattctcccatg

SEQ ID NO: 7582017 - DNA, 22 bp, Homo sapiens
agcctggctaaattctcccatg

SEQ ID NO: 7582018 - DNA, 22 bp, Homo sapiens
agcctggctaaattctcccatg

SEQ ID NO: 7582019 - DNA, 22 bp, Homo sapiens
agcctggctaaattctcccatg

SEQ ID NO: 7582020 - DNA, 22 bp, Homo sapiens
agcctggcggtcgtcggtcagg

SEQ ID NO: 7582021 - DNA, 22 bp, Homo sapiens
agcctggctaaattctcccatg

SEQ ID NO: 7582022 - DNA, 22 bp, Homo sapiens
agcctggctaaattctcccatg

SEQ ID NO: 7582023 - DNA, 22 bp, Homo sapiens
agcctggctaaattctcccatg

SEQ ID NO: 7582024 - DNA, 22 bp, Homo sapiens
agcctggctgggaagagcctct

SEQ ID NO: 7582025 - DNA, 22 bp, Homo sapiens
agcctggctaaattctcccatg

SEQ ID NO: 7582026 - DNA, 22 bp, Homo sapiens
agcctggctgggaagagcctct

SEQ ID NO: 7582027 - DNA, 22 bp, Homo sapiens
agcctggctaaattctcccatg

SEQ ID NO: 7582028 - DNA, 22 bp, Homo sapiens
agcctggctgggaagagcctct

SEQ ID NO: 7582029 - DNA, 22 bp, Homo sapiens
agcctggctgtaacctcatggt

SEQ ID NO: 7582030 - DNA, 22 bp, Homo sapiens
agcctggctgtaacctcatggt

SEQ ID NO: 7582031 - DNA, 22 bp, Homo sapiens
agcctggctgtaacctcatggt

SEQ ID NO: 7582032 - DNA, 22 bp, Homo sapiens
agcctggctgtaacctcatggt

SEQ ID NO: 7582033 - DNA, 22 bp, Homo sapiens
agcctggctgtaacctcatggt

SEQ ID NO: 7582034 - DNA, 22 bp, Homo sapiens
agcctggctgtaacctcatggt

SEQ ID NO: 7582035 - DNA, 22 bp, Homo sapiens
agcctggctgtaacctcatggt

SEQ ID NO: 7582036 - DNA, 22 bp, Homo sapiens
agcctggctgtaacctcatggt

SEQ ID NO: 7582037 - DNA, 22 bp, Homo sapiens
agcctggctgtaacctcatggt

SEQ ID NO: 7582038 - DNA, 22 bp, Homo sapiens
agcctggctgggaagagcctct

SEQ ID NO: 7582039 - DNA, 22 bp, Homo sapiens
agcctggctgggaagagcctct

SEQ ID NO: 7582040 - DNA, 22 bp, Homo sapiens
agcctggctgggaagagcctct

SEQ ID NO: 7582041 - DNA, 22 bp, Homo sapiens
agcctgtggatccctgcactgg

SEQ ID NO: 7582042 - DNA, 22 bp, Homo sapiens
agcctgtggatccctgcactgg

SEQ ID NO: 7582043 - DNA, 22 bp, Homo sapiens
agcctgtggatccctgcactgg

SEQ ID NO: 7582044 - DNA, 22 bp, Homo sapiens
agcctgtggaaactgggtgcag

SEQ ID NO: 7582045 - DNA, 22 bp, Homo sapiens
agcctgtgctgtgtttgctcca

SEQ ID NO: 7582046 - DNA, 22 bp, Homo sapiens
agcctgtgctgtgtttgctcca

SEQ ID NO: 7582047 - DNA, 22 bp, Homo sapiens
agcctgtggatccctgcactgg

SEQ ID NO: 7582048 - DNA, 22 bp, Homo sapiens
agcctgtggatccctgcactgg

SEQ ID NO: 7582049 - DNA, 22 bp, Homo sapiens
agcctgtggatccctgcactgg

SEQ ID NO: 7582050 - DNA, 22 bp, Homo sapiens
agcctgtgggagccgctcccgt

SEQ ID NO: 7582051 - DNA, 22 bp, Homo sapiens
agcctgtgggagccgctcccgt

SEQ ID NO: 7582052 - DNA, 22 bp, Homo sapiens
agcctgtgtcctcatctgcagc

SEQ ID NO: 7582053 - DNA, 22 bp, Homo sapiens
agcctgtgtcctcatctgcagc

SEQ ID NO: 7582054 - DNA, 22 bp, Homo sapiens
agcctgtgtcctcatctgcagc

SEQ ID NO: 7582055 - DNA, 22 bp, Homo sapiens
agcctgtgtcctcatctgcagc

SEQ ID NO: 7582056 - DNA, 22 bp, Homo sapiens
agcctgtgtgaagccctcagag

SEQ ID NO: 7582057 - DNA, 22 bp, Homo sapiens
agcctgtgtgctttggacaggg

SEQ ID NO: 7582058 - DNA, 22 bp, Homo sapiens
agcctgttcagtccactctcca

SEQ ID NO: 7582059 - DNA, 22 bp, Homo sapiens
agcctgtgttgctctggcgata

SEQ ID NO: 7582060 - DNA, 22 bp, Homo sapiens
agcctgtgtgctttggacaggg

SEQ ID NO: 7582061 - DNA, 22 bp, Homo sapiens
agcctgtgtgctttggacaggg

SEQ ID NO: 7582062 - DNA, 22 bp, Homo sapiens
agcctgtgtgctttggacaggg

SEQ ID NO: 7582063 - DNA, 22 bp, Homo sapiens
agcctgtgtgctttggacaggg

SEQ ID NO: 7582064 - DNA, 21 bp, Homo sapiens
agcctgttggtttactgctca

SEQ ID NO: 7582065 - DNA, 21 bp, Homo sapiens
agcctgttggtttactgctca

SEQ ID NO: 7582066 - DNA, 22 bp, Homo sapiens
agcctgttctggtactccaggt

SEQ ID NO: 7582067 - DNA, 22 bp, Homo sapiens
agcctgttctggtactccaggt

SEQ ID NO: 7582068 - DNA, 22 bp, Homo sapiens
agccttagaggaaaacattagt

SEQ ID NO: 7582069 - DNA, 22 bp, Homo sapiens
agccttacataaacagccttat

SEQ ID NO: 7582070 - DNA, 20 bp, Homo sapiens
agcattctactagacttttc

SEQ ID NO: 7582071 - DNA, 20 bp, Homo sapiens
agcattctactagacttttc

SEQ ID NO: 7582072 - DNA, 22 bp, Homo sapiens
agcattccacactgaagtctgc

SEQ ID NO: 7582073 - DNA, 22 bp, Homo sapiens
agcattccacactgaagtctgc

SEQ ID NO: 7582074 - DNA, 22 bp, Homo sapiens
agcattccacactgaagtctgc

SEQ ID NO: 7582075 - DNA, 22 bp, Homo sapiens
agcattccacactgaagtctgc

SEQ ID NO: 7582076 - DNA, 23 bp, Homo sapiens
agcattctctccaacatttaaca

SEQ ID NO: 7582077 - DNA, 23 bp, Homo sapiens
agcattctctccaacatttaaca

SEQ ID NO: 7582078 - DNA, 22 bp, Homo sapiens
agcattctcagaatgtcatttt

SEQ ID NO: 7582079 - DNA, 22 bp, Homo sapiens
agcattctcagaatgtcatttt

SEQ ID NO: 7582080 - DNA, 21 bp, Homo sapiens
agcattctgcttctttcctgg

SEQ ID NO: 7582081 - DNA, 22 bp, Homo sapiens
agcattctgtggtcttctatgg

SEQ ID NO: 7582082 - DNA, 21 bp, Homo sapiens
agcattcttggccagtccacc

SEQ ID NO: 7582083 - DNA, 22 bp, Homo sapiens
agcattctgtggtcttctatgg

SEQ ID NO: 7582084 - DNA, 22 bp, Homo sapiens
agcattgacctagggaaaggac

SEQ ID NO: 7582085 - DNA, 22 bp, Homo sapiens
agcattcatgatgacaacagga

SEQ ID NO: 7582086 - DNA, 22 bp, Homo sapiens
agcattcatgatgacaacagga

SEQ ID NO: 7582087 - DNA, 22 bp, Homo sapiens
agcatgaaaacatgaaacagca

SEQ ID NO: 7582088 - DNA, 22 bp, Homo sapiens
agcatctttaggaagagaaaga

SEQ ID NO: 7582089 - DNA, 22 bp, Homo sapiens
agcattcattgctagaatgtaa

SEQ ID NO: 7582090 - DNA, 22 bp, Homo sapiens
agcattcattgctagaatgtaa

SEQ ID NO: 7582091 - DNA, 22 bp, Homo sapiens
agcattcattgctagaatgtaa

SEQ ID NO: 7582092 - DNA, 22 bp, Homo sapiens
agcattcattgctagaatgtaa

SEQ ID NO: 7582093 - DNA, 22 bp, Homo sapiens
agcattcattgctagaatgtaa

SEQ ID NO: 7582094 - DNA, 22 bp, Homo sapiens
agcattccacactgaagtctgc

SEQ ID NO: 7582095 - DNA, 22 bp, Homo sapiens
agcattccacactgaagtctgc

SEQ ID NO: 7582096 - DNA, 22 bp, Homo sapiens
agcattccacactgaagtctgc

SEQ ID NO: 7582097 - DNA, 19 bp, Homo sapiens
agcatctccctgatcattc

SEQ ID NO: 7582098 - DNA, 22 bp, Homo sapiens
agcatctaaactatcagtttga

SEQ ID NO: 7582099 - DNA, 22 bp, Homo sapiens
agcatcctgcttgctgtctgtg

SEQ ID NO: 7582100 - DNA, 22 bp, Homo sapiens
agcatcctgcttgctgtctgtg

SEQ ID NO: 7582101 - DNA, 22 bp, Homo sapiens
agcatcccatgactctggagga

SEQ ID NO: 7582102 - DNA, 22 bp, Homo sapiens
agcatcccatgactctggagga

SEQ ID NO: 7582103 - DNA, 22 bp, Homo sapiens
agcatcctccttcccagagatg

SEQ ID NO: 7582104 - DNA, 19 bp, Homo sapiens
agcatctccctgatcattc

SEQ ID NO: 7582105 - DNA, 22 bp, Homo sapiens
agcatctaacagatgggagatg

SEQ ID NO: 7582106 - DNA, 22 bp, Homo sapiens
agcatctctaaatccagtaagt

SEQ ID NO: 7582107 - DNA, 21 bp, Homo sapiens
agcatctgaggcagtttccta

SEQ ID NO: 7582108 - DNA, 22 bp, Homo sapiens
agcatctctgggagtcatccgt

SEQ ID NO: 7582109 - DNA, 21 bp, Homo sapiens
agcatctgaggcagtttccta

SEQ ID NO: 7582110 - DNA, 21 bp, Homo sapiens
agcatctgaggcagtttccta

SEQ ID NO: 7582111 - DNA, 21 bp, Homo sapiens
agcatctgaggcagtttccta

SEQ ID NO: 7582112 - DNA, 22 bp, Homo sapiens
agcatctgcatattgggagacc

SEQ ID NO: 7582113 - DNA, 22 bp, Homo sapiens
agcatctgcatattgggagacc

SEQ ID NO: 7582114 - DNA, 22 bp, Homo sapiens
agcatctgcataatgccttccc

SEQ ID NO: 7582115 - DNA, 22 bp, Homo sapiens
agcatctgcataatgccttccc

SEQ ID NO: 7582116 - DNA, 22 bp, Homo sapiens
agcatctgcatattgggagacc

SEQ ID NO: 7582117 - DNA, 22 bp, Homo sapiens
agcatctggcagaaagtcagaa

SEQ ID NO: 7582118 - DNA, 22 bp, Homo sapiens
agcatctggcagaaagtcagaa

SEQ ID NO: 7582119 - DNA, 22 bp, Homo sapiens
agcatctggatggaaagcaagg

SEQ ID NO: 7582120 - DNA, 22 bp, Homo sapiens
agcatctggcagaaagtcagaa

SEQ ID NO: 7582121 - DNA, 22 bp, Homo sapiens
agcatctgcttaatggcttaac

SEQ ID NO: 7582122 - DNA, 22 bp, Homo sapiens
agcatctggatggaaagcaagg

SEQ ID NO: 7582123 - DNA, 22 bp, Homo sapiens
agcatctggcctggttactttt

SEQ ID NO: 7582124 - DNA, 22 bp, Homo sapiens
agcatctggcagaaagtcagaa

SEQ ID NO: 7582125 - DNA, 22 bp, Homo sapiens
agcatctggcctggttactttt

SEQ ID NO: 7582126 - DNA, 22 bp, Homo sapiens
agcatctggcctggttactttt

SEQ ID NO: 7582127 - DNA, 23 bp, Homo sapiens
agcatctggcttcccctggatgg

SEQ ID NO: 7582128 - DNA, 22 bp, Homo sapiens
agcatctggtcatgagtgagaa

SEQ ID NO: 7582129 - DNA, 22 bp, Homo sapiens
agcatctggtcatgagtgagaa

SEQ ID NO: 7582130 - DNA, 22 bp, Homo sapiens
agcatctggtcatgagtgagaa

SEQ ID NO: 7582131 - DNA, 22 bp, Homo sapiens
agcatctggtgagggcctagtt

SEQ ID NO: 7582132 - DNA, 22 bp, Homo sapiens
agcatctggtgagggcctagtt

SEQ ID NO: 7582133 - DNA, 22 bp, Homo sapiens
agcatctgtgatattttgttat

SEQ ID NO: 7582134 - DNA, 22 bp, Homo sapiens
agcatctgtgatattttgttat

SEQ ID NO: 7582135 - DNA, 22 bp, Homo sapiens
agcatctgttgaatataatatt

SEQ ID NO: 7582136 - DNA, 22 bp, Homo sapiens
agcatctgttaagtgccttcaa

SEQ ID NO: 7582137 - DNA, 22 bp, Homo sapiens
agcatctgttaagtgccttcaa

SEQ ID NO: 7582138 - DNA, 22 bp, Homo sapiens
agcatcttgaaatataaagtca

SEQ ID NO: 7582139 - DNA, 22 bp, Homo sapiens
agcatcttcaacaggcatttta

SEQ ID NO: 7582140 - DNA, 22 bp, Homo sapiens
agccaggcgcagtggcttatgc

SEQ ID NO: 7582141 - DNA, 22 bp, Homo sapiens
agccaggcgcagtggcttatgc

SEQ ID NO: 7582142 - DNA, 22 bp, Homo sapiens
agccaggacagggcagctcgct

SEQ ID NO: 7582143 - DNA, 22 bp, Homo sapiens
agccaggcgcagtggcttatgc

SEQ ID NO: 7582144 - DNA, 22 bp, Homo sapiens
agccaggcggggcaggtttcct

SEQ ID NO: 7582145 - DNA, 22 bp, Homo sapiens
agccaggcggggcaggtttcct

SEQ ID NO: 7582146 - DNA, 22 bp, Homo sapiens
agccaggcggggcaggtttcct

SEQ ID NO: 7582147 - DNA, 22 bp, Homo sapiens
agccaggcggggcaggtttcct

SEQ ID NO: 7582148 - DNA, 22 bp, Homo sapiens
agccaggacagggcagctcgct

SEQ ID NO: 7582149 - DNA, 22 bp, Homo sapiens
agccaggacagggcagctcgct

SEQ ID NO: 7582150 - DNA, 22 bp, Homo sapiens
agccaggaattggacaacacat

SEQ ID NO: 7582151 - DNA, 22 bp, Homo sapiens
agccaggaattggacaacacat

SEQ ID NO: 7582152 - DNA, 22 bp, Homo sapiens
agccaggaatgcatgctctgct

SEQ ID NO: 7582153 - DNA, 22 bp, Homo sapiens
agccaggaatgcatgctctgct

SEQ ID NO: 7582154 - DNA, 22 bp, Homo sapiens
agcatttaatcctacatagatc

SEQ ID NO: 7582155 - DNA, 22 bp, Homo sapiens
agcatttaattacagtttaatt

SEQ ID NO: 7582156 - DNA, 22 bp, Homo sapiens
agcatttaattacagtttaatt

SEQ ID NO: 7582157 - DNA, 22 bp, Homo sapiens
agccaggaattggacaacacat

SEQ ID NO: 7582158 - DNA, 22 bp, Homo sapiens
agcattggtggccagagtgcct

SEQ ID NO: 7582159 - DNA, 22 bp, Homo sapiens
agcattgtctccaagcaggtct

SEQ ID NO: 7582160 - DNA, 22 bp, Homo sapiens
agcattggtggccagagtgcct

SEQ ID NO: 7582161 - DNA, 22 bp, Homo sapiens
agcattgatttgtgaccaacaa

SEQ ID NO: 7582162 - DNA, 23 bp, Homo sapiens
agcattgatgcaaggtgcccctg

SEQ ID NO: 7582163 - DNA, 22 bp, Homo sapiens
agcattgctaaagctaattttt

SEQ ID NO: 7582164 - DNA, 22 bp, Homo sapiens
agcatttaatcctacatagatc

SEQ ID NO: 7582165 - DNA, 22 bp, Homo sapiens
agcatttaagggtggatacagg

SEQ ID NO: 7582166 - DNA, 22 bp, Homo sapiens
agcatttaagcttctgcaaagc

SEQ ID NO: 7582167 - DNA, 22 bp, Homo sapiens
agcatttaagggtggatacagg

SEQ ID NO: 7582168 - DNA, 22 bp, Homo sapiens
agcatttaagggtggatacagg

SEQ ID NO: 7582169 - DNA, 22 bp, Homo sapiens
agcatttaatcctacatagatc

SEQ ID NO: 7582170 - DNA, 22 bp, Homo sapiens
agcatttaatcctacatagatc

SEQ ID NO: 7582171 - DNA, 22 bp, Homo sapiens
agcatttaatcctacatagatc

SEQ ID NO: 7582172 - DNA, 22 bp, Homo sapiens
agccaggcgggtctttgctcct

SEQ ID NO: 7582173 - DNA, 22 bp, Homo sapiens
agccaggcgggtctttgctcct

SEQ ID NO: 7582174 - DNA, 22 bp, Homo sapiens
agccaggcggggcaggtttcct

SEQ ID NO: 7582175 - DNA, 22 bp, Homo sapiens
agccaggctaaatgagccatga

SEQ ID NO: 7582176 - DNA, 22 bp, Homo sapiens
agccaggctaaatgagccatga

SEQ ID NO: 7582177 - DNA, 22 bp, Homo sapiens
agccaggcgggtctttgctcct

SEQ ID NO: 7582178 - DNA, 22 bp, Homo sapiens
agccaggcgggtctttgctcct

SEQ ID NO: 7582179 - DNA, 22 bp, Homo sapiens
agccaggctaaatgagccatga

SEQ ID NO: 7582180 - DNA, 22 bp, Homo sapiens
agccaggctaaatgagccatga

SEQ ID NO: 7582181 - DNA, 22 bp, Homo sapiens
agccaggctactccttgctgac

SEQ ID NO: 7582182 - DNA, 22 bp, Homo sapiens
agccaggctactccttgctgac

SEQ ID NO: 7582183 - DNA, 22 bp, Homo sapiens
agccaggctaaatgagccatga

SEQ ID NO: 7582184 - DNA, 22 bp, Homo sapiens
agccaggctaaatgagccatga

SEQ ID NO: 7582185 - DNA, 22 bp, Homo sapiens
agccaggctaaatgagccatga

SEQ ID NO: 7582186 - DNA, 22 bp, Homo sapiens
agccaggctaaatgagccatga

SEQ ID NO: 7582187 - DNA, 20 bp, Homo sapiens
agccaggctcaagctccccc

SEQ ID NO: 7582188 - DNA, 20 bp, Homo sapiens
agccaggctcaagctccccc

SEQ ID NO: 7582189 - DNA, 20 bp, Homo sapiens
agccaggctcaagctccccc

SEQ ID NO: 7582190 - DNA, 20 bp, Homo sapiens
agccaggctcaagctccccc

SEQ ID NO: 7582191 - DNA, 22 bp, Homo sapiens
agccaggctactccttgctgac

SEQ ID NO: 7582192 - DNA, 22 bp, Homo sapiens
agccaggctactccttgctgac

SEQ ID NO: 7582193 - DNA, 22 bp, Homo sapiens
agccaggctactccttgctgac

SEQ ID NO: 7582194 - DNA, 22 bp, Homo sapiens
agccaggctactccttgctgac

SEQ ID NO: 7582195 - DNA, 22 bp, Homo sapiens
agccaggctactccttgctgac

SEQ ID NO: 7582196 - DNA, 22 bp, Homo sapiens
acagaacagagggttttagaat

SEQ ID NO: 7582197 - DNA, 22 bp, Homo sapiens
acagaacagagggttttagaat

SEQ ID NO: 7582198 - DNA, 22 bp, Homo sapiens
acagaacaagacctgcttattg

SEQ ID NO: 7582199 - DNA, 22 bp, Homo sapiens
agccaggctcaaggcctgctcc

SEQ ID NO: 7582200 - DNA, 22 bp, Homo sapiens
agccaggctcaaggcctgctcc

SEQ ID NO: 7582201 - DNA, 20 bp, Homo sapiens
agccaggctcaagctccccc

SEQ ID NO: 7582202 - DNA, 20 bp, Homo sapiens
agccaggctcaagctccccc

SEQ ID NO: 7582203 - DNA, 20 bp, Homo sapiens
agccaggctcaagctccccc

SEQ ID NO: 7582204 - DNA, 22 bp, Homo sapiens
acagacatcatcaacatcttcc

SEQ ID NO: 7582205 - DNA, 22 bp, Homo sapiens
acagacatcatcaacatcttcc

SEQ ID NO: 7582206 - DNA, 22 bp, Homo sapiens
acagacatctatccatttaatt

SEQ ID NO: 7582207 - DNA, 22 bp, Homo sapiens
acagacatctatccatttaatt

SEQ ID NO: 7582208 - DNA, 22 bp, Homo sapiens
acagacatctatccatttaatt

SEQ ID NO: 7582209 - DNA, 22 bp, Homo sapiens
acagacatctatccatttaatt

SEQ ID NO: 7582210 - DNA, 22 bp, Homo sapiens
acagacatctatccatttaatt

SEQ ID NO: 7582211 - DNA, 22 bp, Homo sapiens
acagacatctatccatttaatt

SEQ ID NO: 7582212 - DNA, 22 bp, Homo sapiens
acagacagtatggtggggctga

SEQ ID NO: 7582213 - DNA, 21 bp, Homo sapiens
acagacagtccagagaaaaga

SEQ ID NO: 7582214 - DNA, 21 bp, Homo sapiens
acagacagtccagagaaaaga

SEQ ID NO: 7582215 - DNA, 21 bp, Homo sapiens
acagacagtccagagaaaaga

SEQ ID NO: 7582216 - DNA, 22 bp, Homo sapiens
acagacatcatcaacatcttcc

SEQ ID NO: 7582217 - DNA, 22 bp, Homo sapiens
acagacatatttggcccatagc

SEQ ID NO: 7582218 - DNA, 22 bp, Homo sapiens
acagacatatttggcccatagc

SEQ ID NO: 7582219 - DNA, 22 bp, Homo sapiens
acagacatatttggcccatagc

SEQ ID NO: 7582220 - DNA, 21 bp, Homo sapiens
acagacagtccagagaaaaga

SEQ ID NO: 7582221 - DNA, 21 bp, Homo sapiens
acagacagtccagagaaaaga

SEQ ID NO: 7582222 - DNA, 22 bp, Homo sapiens
acagacagtatggtggggctga

SEQ ID NO: 7582223 - DNA, 22 bp, Homo sapiens
acagacagtaaatagtgtggct

SEQ ID NO: 7582224 - DNA, 22 bp, Homo sapiens
acagacagtatggtggggctga

SEQ ID NO: 7582225 - DNA, 22 bp, Homo sapiens
acagacagtatggtggggctga

SEQ ID NO: 7582226 - DNA, 22 bp, Homo sapiens
acagacagtatggtggggctga

SEQ ID NO: 7582227 - DNA, 22 bp, Homo sapiens
acagacagtaaatagtgtggct

SEQ ID NO: 7582228 - DNA, 22 bp, Homo sapiens
acagacagtaaatagtgtggct

SEQ ID NO: 7582229 - DNA, 22 bp, Homo sapiens
acagacagtaaatagtgtggct

SEQ ID NO: 7582230 - DNA, 22 bp, Homo sapiens
agcccaggttctaaagccaaac

SEQ ID NO: 7582231 - DNA, 21 bp, Homo sapiens
acagacagggccagtgtcccc

SEQ ID NO: 7582232 - DNA, 21 bp, Homo sapiens
acagacagggccagtgtcccc

SEQ ID NO: 7582233 - DNA, 21 bp, Homo sapiens
acagacagggccagtgtcccc

SEQ ID NO: 7582234 - DNA, 22 bp, Homo sapiens
acagacagtaaatagtgtggct

SEQ ID NO: 7582235 - DNA, 22 bp, Homo sapiens
acagacagtaaatagtgtggct

SEQ ID NO: 7582236 - DNA, 22 bp, Homo sapiens
agcccaggtgactcatacaccc

SEQ ID NO: 7582237 - DNA, 22 bp, Homo sapiens
agcccaggtgactcatacaccc

SEQ ID NO: 7582238 - DNA, 22 bp, Homo sapiens
agcccaggtgactcatacaccc

SEQ ID NO: 7582239 - DNA, 22 bp, Homo sapiens
agcccaggtctggcccagcctg

SEQ ID NO: 7582240 - DNA, 22 bp, Homo sapiens
agcccaggtctggcccagcctg

SEQ ID NO: 7582241 - DNA, 22 bp, Homo sapiens
agcccaggtctggcccagcctg

SEQ ID NO: 7582242 - DNA, 22 bp, Homo sapiens
agcccaggtctggcccagcctg

SEQ ID NO: 7582243 - DNA, 22 bp, Homo sapiens
agcccaggtctggcccagcctg

SEQ ID NO: 7582244 - DNA, 22 bp, Homo sapiens
agcccaggtctggcccagcctg

SEQ ID NO: 7582245 - DNA, 22 bp, Homo sapiens
agcccaggtctggcccagcctg

SEQ ID NO: 7582246 - DNA, 22 bp, Homo sapiens
agcccaggtctggcccagcctg

SEQ ID NO: 7582247 - DNA, 22 bp, Homo sapiens
agcccaggtctggcccagcctg

SEQ ID NO: 7582248 - DNA, 22 bp, Homo sapiens
agcccaggtctggcccagcctg

SEQ ID NO: 7582249 - DNA, 22 bp, Homo sapiens
agcccaggtctggcccagcctg

SEQ ID NO: 7582250 - DNA, 22 bp, Homo sapiens
agcccaggtctcaaagtacagg

SEQ ID NO: 7582251 - DNA, 22 bp, Homo sapiens
agcccaggtctcaaagtacagg

SEQ ID NO: 7582252 - DNA, 22 bp, Homo sapiens
agcccaggtctcaaagtacagg

SEQ ID NO: 7582253 - DNA, 22 bp, Homo sapiens
agcccaggtctcaaagtacagg

SEQ ID NO: 7582254 - DNA, 22 bp, Homo sapiens
agcccaggtctcaaagtacagg

SEQ ID NO: 7582255 - DNA, 22 bp, Homo sapiens
agcccaggtctcaaagtacagg

SEQ ID NO: 7582256 - DNA, 22 bp, Homo sapiens
agcccaggtctcaaagtacagg

SEQ ID NO: 7582257 - DNA, 22 bp, Homo sapiens
agcccaggtctcaaagtacagg

SEQ ID NO: 7582258 - DNA, 22 bp, Homo sapiens
agcccaggtctcaaagtacagg

SEQ ID NO: 7582259 - DNA, 22 bp, Homo sapiens
agcccaggtggagtgtgtgggg

SEQ ID NO: 7582260 - DNA, 22 bp, Homo sapiens
agcccaggtggagtgtgtgggg

SEQ ID NO: 7582261 - DNA, 22 bp, Homo sapiens
agcccaggtggagtgtgtgggg

SEQ ID NO: 7582262 - DNA, 22 bp, Homo sapiens
agcccaggtggagtgtgtgggg

SEQ ID NO: 7582263 - DNA, 22 bp, Homo sapiens
acagacagggcacctgcctcct

SEQ ID NO: 7582264 - DNA, 22 bp, Homo sapiens
agcccaggttctaaagccaaac

SEQ ID NO: 7582265 - DNA, 22 bp, Homo sapiens
agcccaggtgaggggttcgaaa

SEQ ID NO: 7582266 - DNA, 22 bp, Homo sapiens
agcccaggtggagtgtgtgggg

SEQ ID NO: 7582267 - DNA, 22 bp, Homo sapiens
agcccaggtgaggggttcgaaa

SEQ ID NO: 7582268 - DNA, 22 bp, Homo sapiens
agcccaggtgaggggttcgaaa

SEQ ID NO: 7582269 - DNA, 22 bp, Homo sapiens
agcccaggtgaggggttcgaaa

SEQ ID NO: 7582270 - DNA, 22 bp, Homo sapiens
agcccaggtgaggggttcgaaa

SEQ ID NO: 7582271 - DNA, 22 bp, Homo sapiens
agcccaggtgactcatacaccc

SEQ ID NO: 7582272 - DNA, 22 bp, Homo sapiens
agcccaggtgactcatacaccc

SEQ ID NO: 7582273 - DNA, 22 bp, Homo sapiens
agcccaggtgactcatacaccc

SEQ ID NO: 7582274 - DNA, 22 bp, Homo sapiens
agcccaggtgactcatacaccc

SEQ ID NO: 7582275 - DNA, 22 bp, Homo sapiens
agcccaggtgactcatacaccc

SEQ ID NO: 7582276 - DNA, 22 bp, Homo sapiens
agcccagctttgaaccatatca

SEQ ID NO: 7582277 - DNA, 22 bp, Homo sapiens
agcccagctttgaaccatatca

SEQ ID NO: 7582278 - DNA, 22 bp, Homo sapiens
agcccagggagttgattagcat

SEQ ID NO: 7582279 - DNA, 22 bp, Homo sapiens
agcccagggctaataggaacca

SEQ ID NO: 7582280 - DNA, 22 bp, Homo sapiens
agcccagggctaataggaacca

SEQ ID NO: 7582281 - DNA, 22 bp, Homo sapiens
agcccagggctaataggaacca

SEQ ID NO: 7582282 - DNA, 22 bp, Homo sapiens
agcccagggctaataggaacca

SEQ ID NO: 7582283 - DNA, 22 bp, Homo sapiens
agcccagggctaataggaacca

SEQ ID NO: 7582284 - DNA, 22 bp, Homo sapiens
agcccagggctaataggaacca

SEQ ID NO: 7582285 - DNA, 22 bp, Homo sapiens
agcccagggctaataggaacca

SEQ ID NO: 7582286 - DNA, 22 bp, Homo sapiens
agcccaggtccagttcactgca

SEQ ID NO: 7582287 - DNA, 22 bp, Homo sapiens
agcccaggtccagttcactgca

SEQ ID NO: 7582288 - DNA, 22 bp, Homo sapiens
agcccaggtccagttcactgca

SEQ ID NO: 7582289 - DNA, 22 bp, Homo sapiens
agcccaggtccagttcactgca

SEQ ID NO: 7582290 - DNA, 22 bp, Homo sapiens
agcccaggtccagttcactgca

SEQ ID NO: 7582291 - DNA, 22 bp, Homo sapiens
agcccaggtccagttcactgca

SEQ ID NO: 7582292 - DNA, 22 bp, Homo sapiens
agcccagggctaataggaacca

SEQ ID NO: 7582293 - DNA, 22 bp, Homo sapiens
agcccagggctaataggaacca

SEQ ID NO: 7582294 - DNA, 22 bp, Homo sapiens
agcccagggctaataggaacca

SEQ ID NO: 7582295 - DNA, 22 bp, Homo sapiens
agcccaggtccagttcactgca

SEQ ID NO: 7582296 - DNA, 22 bp, Homo sapiens
agcccaggtctcaaagtacagg

SEQ ID NO: 7582297 - DNA, 22 bp, Homo sapiens
agcccagctttcacccctctgg

SEQ ID NO: 7582298 - DNA, 22 bp, Homo sapiens
agcccagctttgaaccatatca

SEQ ID NO: 7582299 - DNA, 22 bp, Homo sapiens
agcccagctttgaaccatatca

SEQ ID NO: 7582300 - DNA, 22 bp, Homo sapiens
agcccagctttcacccctctgg

SEQ ID NO: 7582301 - DNA, 22 bp, Homo sapiens
acagaactgtgatctcataaat

SEQ ID NO: 7582302 - DNA, 22 bp, Homo sapiens
acagaactgtgatctcataaat

SEQ ID NO: 7582303 - DNA, 22 bp, Homo sapiens
acagaactgtgtgatgattaag

SEQ ID NO: 7582304 - DNA, 22 bp, Homo sapiens
acagaactgtgtgatgattaag

SEQ ID NO: 7582305 - DNA, 22 bp, Homo sapiens
acagaacttcagtagtattccc

SEQ ID NO: 7582306 - DNA, 22 bp, Homo sapiens
acagaacttcagtagtattccc

SEQ ID NO: 7582307 - DNA, 21 bp, Homo sapiens
acagaactgtatagtgataaa

SEQ ID NO: 7582308 - DNA, 21 bp, Homo sapiens
acagaactgtatagtgataaa

SEQ ID NO: 7582309 - DNA, 21 bp, Homo sapiens
acagaactgtatagtgataaa

SEQ ID NO: 7582310 - DNA, 21 bp, Homo sapiens
acagaactgtatagtgataaa

SEQ ID NO: 7582311 - DNA, 21 bp, Homo sapiens
acagaactgtatagtgataaa

SEQ ID NO: 7582312 - DNA, 22 bp, Homo sapiens
acagaactgggggcacagatag

SEQ ID NO: 7582313 - DNA, 22 bp, Homo sapiens
acagaactgggaaatgcacata

SEQ ID NO: 7582314 - DNA, 22 bp, Homo sapiens
acagaactgggaaatgcacata

SEQ ID NO: 7582315 - DNA, 22 bp, Homo sapiens
acagaactgggggcacagatag

SEQ ID NO: 7582316 - DNA, 22 bp, Homo sapiens
acagaactgggggcacagatag

SEQ ID NO: 7582317 - DNA, 22 bp, Homo sapiens
acagaactgggaaatgcacata

SEQ ID NO: 7582318 - DNA, 22 bp, Homo sapiens
acagaactggaattggaactca

SEQ ID NO: 7582319 - DNA, 22 bp, Homo sapiens
acagaactggaattggaactca

SEQ ID NO: 7582320 - DNA, 22 bp, Homo sapiens
acagaactgcaggaggaaaagc

SEQ ID NO: 7582321 - DNA, 22 bp, Homo sapiens
acagaactggaattggaactca

SEQ ID NO: 7582322 - DNA, 22 bp, Homo sapiens
acagaactgcagacagtgccaa

SEQ ID NO: 7582323 - DNA, 22 bp, Homo sapiens
acagaactgcagacagtgccaa

SEQ ID NO: 7582324 - DNA, 22 bp, Homo sapiens
acagaactgcaggaggaaaagc

SEQ ID NO: 7582325 - DNA, 22 bp, Homo sapiens
acagaactgcaggaggaaaagc

SEQ ID NO: 7582326 - DNA, 22 bp, Homo sapiens
acagaactgcaggaggaaaagc

SEQ ID NO: 7582327 - DNA, 20 bp, Homo sapiens
acagaactgagaacagtctc

SEQ ID NO: 7582328 - DNA, 22 bp, Homo sapiens
acagaactgagaattctctatc

SEQ ID NO: 7582329 - DNA, 18 bp, Homo sapiens
acagaactgagatttgag

SEQ ID NO: 7582330 - DNA, 18 bp, Homo sapiens
acagaactgagatttgag

SEQ ID NO: 7582331 - DNA, 18 bp, Homo sapiens
acagaactcaggggcacc

SEQ ID NO: 7582332 - DNA, 18 bp, Homo sapiens
acagaactcaggggcacc

SEQ ID NO: 7582333 - DNA, 22 bp, Homo sapiens
acagaacatggatttttgaagt

SEQ ID NO: 7582334 - DNA, 22 bp, Homo sapiens
acagaacatggatttttgaagt

SEQ ID NO: 7582335 - DNA, 22 bp, Homo sapiens
acagaacatggatttttgaagt

SEQ ID NO: 7582336 - DNA, 22 bp, Homo sapiens
acagaacaggctgagaaaaaca

SEQ ID NO: 7582337 - DNA, 22 bp, Homo sapiens
acagaacaggctgagaaaaaca

SEQ ID NO: 7582338 - DNA, 22 bp, Homo sapiens
acagaacaggctgagaaaaaca

SEQ ID NO: 7582339 - DNA, 22 bp, Homo sapiens
acagaacaggctgagaaaaaca

SEQ ID NO: 7582340 - DNA, 22 bp, Homo sapiens
acagaacaggctgagaaaaaca

SEQ ID NO: 7582341 - DNA, 22 bp, Homo sapiens
acagaacagagggttttagaat

SEQ ID NO: 7582342 - DNA, 22 bp, Homo sapiens
acagaacaggctgagaaaaaca

SEQ ID NO: 7582343 - DNA, 22 bp, Homo sapiens
acagaacaggctgagaaaaaca

SEQ ID NO: 7582344 - DNA, 22 bp, Homo sapiens
acagaacaggctgagaaaaaca

SEQ ID NO: 7582345 - DNA, 22 bp, Homo sapiens
acagaacaggctgagaaaaaca

SEQ ID NO: 7582346 - DNA, 22 bp, Homo sapiens
acagaacaggctgagaaaaaca

SEQ ID NO: 7582347 - DNA, 22 bp, Homo sapiens
acagaacatattgcttctctca

SEQ ID NO: 7582348 - DNA, 22 bp, Homo sapiens
acagaacatattgcttctctca

SEQ ID NO: 7582349 - DNA, 22 bp, Homo sapiens
acagaacatattgcttctctca

SEQ ID NO: 7582350 - DNA, 22 bp, Homo sapiens
acagaacaggctgagaaaaaca

SEQ ID NO: 7582351 - DNA, 22 bp, Homo sapiens
acagaacatggatttttgaagt

SEQ ID NO: 7582352 - DNA, 22 bp, Homo sapiens
acagaacatattgcttctctca

SEQ ID NO: 7582353 - DNA, 22 bp, Homo sapiens
acagaacatattgcttctctca

SEQ ID NO: 7582354 - DNA, 22 bp, Homo sapiens
acagaacatattgcttctctca

SEQ ID NO: 7582355 - DNA, 22 bp, Homo sapiens
acagaacatattgcttctctca

SEQ ID NO: 7582356 - DNA, 22 bp, Homo sapiens
acagaacatattgcttctctca

SEQ ID NO: 7582357 - DNA, 19 bp, Homo sapiens
tcagtggagaaaggggaag

SEQ ID NO: 7582358 - DNA, 19 bp, Homo sapiens
tcagtggagaaaggggaag

SEQ ID NO: 7582359 - DNA, 22 bp, Homo sapiens
tcagtggagagcttccaggatt

SEQ ID NO: 7582360 - DNA, 19 bp, Homo sapiens
tcagtggagaaaggggaag

SEQ ID NO: 7582361 - DNA, 22 bp, Homo sapiens
tcagtgcttttgtcacatggtc

SEQ ID NO: 7582362 - DNA, 22 bp, Homo sapiens
tcagtggaactgtctgggtgag

SEQ ID NO: 7582363 - DNA, 22 bp, Homo sapiens
tcagtgcttttgtcacatggtc

SEQ ID NO: 7582364 - DNA, 22 bp, Homo sapiens
tcagtgcttttgagaagctcct

SEQ ID NO: 7582365 - DNA, 22 bp, Homo sapiens
tcagtgcttttgagaagctcct

SEQ ID NO: 7582366 - DNA, 22 bp, Homo sapiens
tcagtgcttgcctctggaggag

SEQ ID NO: 7582367 - DNA, 22 bp, Homo sapiens
tcagtgcttgacagctctggga

SEQ ID NO: 7582368 - DNA, 22 bp, Homo sapiens
tcagtgcttcggcgagcaccta

SEQ ID NO: 7582369 - DNA, 22 bp, Homo sapiens
tcagtgcttgacagctctggga

SEQ ID NO: 7582370 - DNA, 22 bp, Homo sapiens
tcagtgcttgcctctggaggag

SEQ ID NO: 7582371 - DNA, 22 bp, Homo sapiens
tcagtgcttgcctctggaggag

SEQ ID NO: 7582372 - DNA, 22 bp, Homo sapiens
tcagtgcttgcctctggaggag

SEQ ID NO: 7582373 - DNA, 22 bp, Homo sapiens
tcagtgcttcggcgagcaccta

SEQ ID NO: 7582374 - DNA, 22 bp, Homo sapiens
tcagtgcttcctggaggaagcc

SEQ ID NO: 7582375 - DNA, 22 bp, Homo sapiens
tcagtgcttcctggaggaagcc

SEQ ID NO: 7582376 - DNA, 22 bp, Homo sapiens
tcagtgcttcctggaggaagcc

SEQ ID NO: 7582377 - DNA, 22 bp, Homo sapiens
tcagtgcttcctggaggaagcc

SEQ ID NO: 7582378 - DNA, 22 bp, Homo sapiens
tcagtgcttatattctgagcct

SEQ ID NO: 7582379 - DNA, 21 bp, Homo sapiens
tcagttactgagagagaagtg

SEQ ID NO: 7582380 - DNA, 22 bp, Homo sapiens
tcagttagattgcctccttaga

SEQ ID NO: 7582381 - DNA, 22 bp, Homo sapiens
tcagttagcgtaatcactgggg

SEQ ID NO: 7582382 - DNA, 20 bp, Homo sapiens
tcagttaggaagaggcactc

SEQ ID NO: 7582383 - DNA, 22 bp, Homo sapiens
tcagttatagatacttttacca

SEQ ID NO: 7582384 - DNA, 22 bp, Homo sapiens
tcagttcaaacaggtgtctgga

SEQ ID NO: 7582385 - DNA, 22 bp, Homo sapiens
tcagttcaaacaggtgtctgga

SEQ ID NO: 7582386 - DNA, 23 bp, Homo sapiens
tcagttattggtgataaagctgg

SEQ ID NO: 7582387 - DNA, 22 bp, Homo sapiens
tcagttatcattgctgtaaatt

SEQ ID NO: 7582388 - DNA, 22 bp, Homo sapiens
tcagttagggcctcagaagaca

SEQ ID NO: 7582389 - DNA, 22 bp, Homo sapiens
tcagtggtaccaagggggctgg

SEQ ID NO: 7582390 - DNA, 22 bp, Homo sapiens
tcagttactcctttccttaggt

SEQ ID NO: 7582391 - DNA, 22 bp, Homo sapiens
tcagtggtatgcgtgggagctg

SEQ ID NO: 7582392 - DNA, 22 bp, Homo sapiens
tcagttacctgacagtggttat

SEQ ID NO: 7582393 - DNA, 22 bp, Homo sapiens
tcagtggggtcgatgtgaggga

SEQ ID NO: 7582394 - DNA, 21 bp, Homo sapiens
tcagtggctcctggtgacgtc

SEQ ID NO: 7582395 - DNA, 22 bp, Homo sapiens
tcagtggggtcgatgtgaggga

SEQ ID NO: 7582396 - DNA, 22 bp, Homo sapiens
tcagtggtatgcgtgggagctg

SEQ ID NO: 7582397 - DNA, 22 bp, Homo sapiens
tcagtggtatgcgtgggagctg

SEQ ID NO: 7582398 - DNA, 22 bp, Homo sapiens
tcagtggtaccaagggggctgg

SEQ ID NO: 7582399 - DNA, 22 bp, Homo sapiens
tcagtggattgacatgaaaaag

SEQ ID NO: 7582400 - DNA, 19 bp, Homo sapiens
tcagtggatgaacatgttt

SEQ ID NO: 7582401 - DNA, 22 bp, Homo sapiens
tcagtggagtatggatgaagtc

SEQ ID NO: 7582402 - DNA, 22 bp, Homo sapiens
tcagtggatatttctgtggctg

SEQ ID NO: 7582403 - DNA, 22 bp, Homo sapiens
tcagtggagtatggatgaagtc

SEQ ID NO: 7582404 - DNA, 22 bp, Homo sapiens
tcagtggagctaagcatgagat

SEQ ID NO: 7582405 - DNA, 22 bp, Homo sapiens
tcagtggagctaagcatgagat

SEQ ID NO: 7582406 - DNA, 22 bp, Homo sapiens
tcagtggagctaagcatgagat

SEQ ID NO: 7582407 - DNA, 22 bp, Homo sapiens
tcagtggattgtagaaggctta

SEQ ID NO: 7582408 - DNA, 22 bp, Homo sapiens
tcagtggattgtagaaggctta

SEQ ID NO: 7582409 - DNA, 22 bp, Homo sapiens
tcagtggattggatgagatctg

SEQ ID NO: 7582410 - DNA, 19 bp, Homo sapiens
tcagtggatgaacatgttt

SEQ ID NO: 7582411 - DNA, 22 bp, Homo sapiens
tcagtggattgacatgaaaaag

SEQ ID NO: 7582412 - DNA, 20 bp, Homo sapiens
tcagtgggaaagtgagagtg

SEQ ID NO: 7582413 - DNA, 20 bp, Homo sapiens
tcagtgggaaagtgagagtg

SEQ ID NO: 7582414 - DNA, 22 bp, Homo sapiens
tcagtgggagcaggagagtgac

SEQ ID NO: 7582415 - DNA, 22 bp, Homo sapiens
tcagtgggagcaggagagtgac

SEQ ID NO: 7582416 - DNA, 22 bp, Homo sapiens
tcagttttaaggtttgagaatt

SEQ ID NO: 7582417 - DNA, 22 bp, Homo sapiens
tcagttttaaggtttgagaatt

SEQ ID NO: 7582418 - DNA, 22 bp, Homo sapiens
tcagttttaaggtttgagaatt

SEQ ID NO: 7582419 - DNA, 19 bp, Homo sapiens
tcagttttagtcatcagtt

SEQ ID NO: 7582420 - DNA, 19 bp, Homo sapiens
tcagttttagtcatcagtt

SEQ ID NO: 7582421 - DNA, 22 bp, Homo sapiens
tcagttttaaggtttgagaatt

SEQ ID NO: 7582422 - DNA, 22 bp, Homo sapiens
tcagtttgctcataggtgaggg

SEQ ID NO: 7582423 - DNA, 23 bp, Homo sapiens
tcagtttgtataatccatatgca

SEQ ID NO: 7582424 - DNA, 22 bp, Homo sapiens
tcagtttgaatgttagcacagt

SEQ ID NO: 7582425 - DNA, 19 bp, Homo sapiens
tcagttttagtcatcagtt

SEQ ID NO: 7582426 - DNA, 22 bp, Homo sapiens
tcagttttcaatttcatcagag

SEQ ID NO: 7582427 - DNA, 22 bp, Homo sapiens
tcagttttcaatttcatcagag

SEQ ID NO: 7582428 - DNA, 22 bp, Homo sapiens
tcagttttcaatttcatcagag

SEQ ID NO: 7582429 - DNA, 19 bp, Homo sapiens
tcagttttagtcatcagtt

SEQ ID NO: 7582430 - DNA, 22 bp, Homo sapiens
tcagttttcaatttcatcagag

SEQ ID NO: 7582431 - DNA, 22 bp, Homo sapiens
tcagtttctacctactatgtgt

SEQ ID NO: 7582432 - DNA, 22 bp, Homo sapiens
tcagtttctaaatcttaccaat

SEQ ID NO: 7582433 - DNA, 22 bp, Homo sapiens
tcagtttcctggttttgacatt

SEQ ID NO: 7582434 - DNA, 22 bp, Homo sapiens
tcagttctaacagtttagaaca

SEQ ID NO: 7582435 - DNA, 22 bp, Homo sapiens
tcagttcagtatacactattct

SEQ ID NO: 7582436 - DNA, 22 bp, Homo sapiens
tcagttcagtatacactattct

SEQ ID NO: 7582437 - DNA, 22 bp, Homo sapiens
tcagttcctgttgcacagcatc

SEQ ID NO: 7582438 - DNA, 22 bp, Homo sapiens
tcagttctaacagtttagaaca

SEQ ID NO: 7582439 - DNA, 22 bp, Homo sapiens
tcagttctaacagtttagaaca

SEQ ID NO: 7582440 - DNA, 22 bp, Homo sapiens
tcagtttcttcatctccctaac

SEQ ID NO: 7582441 - DNA, 22 bp, Homo sapiens
tcagtttcttcatctccctaac

SEQ ID NO: 7582442 - DNA, 22 bp, Homo sapiens
tcagtttctccatcgctccagt

SEQ ID NO: 7582443 - DNA, 22 bp, Homo sapiens
tcagtttctttactcatagaat

SEQ ID NO: 7582444 - DNA, 22 bp, Homo sapiens
tcagtttctttactcatagaat

SEQ ID NO: 7582445 - DNA, 22 bp, Homo sapiens
tcataaaaatagactctaaagt

SEQ ID NO: 7582446 - DNA, 19 bp, Homo sapiens
tcataaaaatggtaaccca

SEQ ID NO: 7582447 - DNA, 22 bp, Homo sapiens
tcataaaacacaccaggtagtt

SEQ ID NO: 7582448 - DNA, 22 bp, Homo sapiens
tcataaaacacaccaggtagtt

SEQ ID NO: 7582449 - DNA, 22 bp, Homo sapiens
tcataaaaatagactctaaagt

SEQ ID NO: 7582450 - DNA, 22 bp, Homo sapiens
tcataaaaatagactctaaagt

SEQ ID NO: 7582451 - DNA, 22 bp, Homo sapiens
tcataaaaatagactctaaagt

SEQ ID NO: 7582452 - DNA, 22 bp, Homo sapiens
tcataaaaatagactctaaagt

SEQ ID NO: 7582453 - DNA, 22 bp, Homo sapiens
tcagtttttacggtcacaggga

SEQ ID NO: 7582454 - DNA, 22 bp, Homo sapiens
tcagtttttacggtcacaggga

SEQ ID NO: 7582455 - DNA, 22 bp, Homo sapiens
tcagtttttctatactttgtag

SEQ ID NO: 7582456 - DNA, 22 bp, Homo sapiens
tcagtttttctatactttgtag

SEQ ID NO: 7582457 - DNA, 22 bp, Homo sapiens
tcagtttttctatactttgtag

SEQ ID NO: 7582458 - DNA, 22 bp, Homo sapiens
tcagtttttgtttgccagatag

SEQ ID NO: 7582459 - DNA, 22 bp, Homo sapiens
tcagttttgtatgttgtaagtc

SEQ ID NO: 7582460 - DNA, 22 bp, Homo sapiens
tcagttttgattcctggttctc

SEQ ID NO: 7582461 - DNA, 22 bp, Homo sapiens
tcagttttgtatgttgtaagtc

SEQ ID NO: 7582462 - DNA, 23 bp, Homo sapiens
tcagttttggctgttcagtgttg

SEQ ID NO: 7582463 - DNA, 23 bp, Homo sapiens
tcagttttggctgttcagtgttg

SEQ ID NO: 7582464 - DNA, 22 bp, Homo sapiens
tcagtttttaaatgatataatt

SEQ ID NO: 7582465 - DNA, 22 bp, Homo sapiens
tcagtttttaaatgatataatt

SEQ ID NO: 7582466 - DNA, 22 bp, Homo sapiens
tcagtttttaagagttatgcga

SEQ ID NO: 7582467 - DNA, 22 bp, Homo sapiens
tcagttttgaaaacattgaatg

SEQ ID NO: 7582468 - DNA, 22 bp, Homo sapiens
tcagttttgaaaacattgaatg

SEQ ID NO: 7582469 - DNA, 22 bp, Homo sapiens
tcagttttgaaaacattgaatg

SEQ ID NO: 7582470 - DNA, 22 bp, Homo sapiens
tcagttttctcatttatgagat

SEQ ID NO: 7582471 - DNA, 22 bp, Homo sapiens
tcagttttctcatctgtgaaat

SEQ ID NO: 7582472 - DNA, 22 bp, Homo sapiens
tcagttttctcatctgtaattt

SEQ ID NO: 7582473 - DNA, 22 bp, Homo sapiens
tcagttttcatttcatgagcag

SEQ ID NO: 7582474 - DNA, 22 bp, Homo sapiens
tcagttttcatttcatgagcag

SEQ ID NO: 7582475 - DNA, 22 bp, Homo sapiens
tcagttttctcatctgtaattt

SEQ ID NO: 7582476 - DNA, 22 bp, Homo sapiens
tcatctaagagtcttacattta

SEQ ID NO: 7582477 - DNA, 22 bp, Homo sapiens
tcatctaagagtcttacattta

SEQ ID NO: 7582478 - DNA, 22 bp, Homo sapiens
tcatctaagagtcttacattta

SEQ ID NO: 7582479 - DNA, 22 bp, Homo sapiens
tcatctaagagtcttacattta

SEQ ID NO: 7582480 - DNA, 22 bp, Homo sapiens
tcatctaagagtcttacattta

SEQ ID NO: 7582481 - DNA, 22 bp, Homo sapiens
tcatctaagagtcttacattta

SEQ ID NO: 7582482 - DNA, 22 bp, Homo sapiens
tcatctaagagtcttacattta

SEQ ID NO: 7582483 - DNA, 22 bp, Homo sapiens
tcatcgtgctgctctgtccata

SEQ ID NO: 7582484 - DNA, 22 bp, Homo sapiens
tcatccttttgcatgggaaggc

SEQ ID NO: 7582485 - DNA, 22 bp, Homo sapiens
tcatctaagagtcttacattta

SEQ ID NO: 7582486 - DNA, 22 bp, Homo sapiens
tcatctaagagtcttacattta

SEQ ID NO: 7582487 - DNA, 22 bp, Homo sapiens
tcatctaagagtcttacattta

SEQ ID NO: 7582488 - DNA, 22 bp, Homo sapiens
tcatctaagagtcttacattta

SEQ ID NO: 7582489 - DNA, 22 bp, Homo sapiens
tcatcctgtatcctcagaccat

SEQ ID NO: 7582490 - DNA, 22 bp, Homo sapiens
tcatcctgcactggctcctcct

SEQ ID NO: 7582491 - DNA, 22 bp, Homo sapiens
tcatcctgcactggctcctcct

SEQ ID NO: 7582492 - DNA, 20 bp, Homo sapiens
tcatccttggcctctaccca

SEQ ID NO: 7582493 - DNA, 22 bp, Homo sapiens
tcatcctgtctcactttttgct

SEQ ID NO: 7582494 - DNA, 22 bp, Homo sapiens
tcatccttttgcatgggaaggc

SEQ ID NO: 7582495 - DNA, 22 bp, Homo sapiens
tcatccttttgcatgggaaggc

SEQ ID NO: 7582496 - DNA, 22 bp, Homo sapiens
tcatctaagagtcttacattta

SEQ ID NO: 7582497 - DNA, 22 bp, Homo sapiens
tcatctatttatgtagaacaag

SEQ ID NO: 7582498 - DNA, 18 bp, Homo sapiens
tcatctactggtccaggt

SEQ ID NO: 7582499 - DNA, 18 bp, Homo sapiens
tcatctactggtccaggt

SEQ ID NO: 7582500 - DNA, 22 bp, Homo sapiens
tcatctcagggcgacatcatgt

SEQ ID NO: 7582501 - DNA, 22 bp, Homo sapiens
tcatctctccccagtgtcttta

SEQ ID NO: 7582502 - DNA, 22 bp, Homo sapiens
tcatctccctcctggatacctg

SEQ ID NO: 7582503 - DNA, 22 bp, Homo sapiens
tcatctctagacaggaggctgg

SEQ ID NO: 7582504 - DNA, 22 bp, Homo sapiens
tcatctccatacggtctcgcag

SEQ ID NO: 7582505 - DNA, 22 bp, Homo sapiens
tcatctccatacggtctcgcag

SEQ ID NO: 7582506 - DNA, 22 bp, Homo sapiens
tcatctcagggcgacatcatgt

SEQ ID NO: 7582507 - DNA, 22 bp, Homo sapiens
tcatccattgtcctcacattag

SEQ ID NO: 7582508 - DNA, 22 bp, Homo sapiens
tcatcccagtgtccatgctcag

SEQ ID NO: 7582509 - DNA, 22 bp, Homo sapiens
tcatcccagaccacttattttc

SEQ ID NO: 7582510 - DNA, 22 bp, Homo sapiens
tcatcccagaccacttattttc

SEQ ID NO: 7582511 - DNA, 22 bp, Homo sapiens
tcatccatgtcagagcatgtat

SEQ ID NO: 7582512 - DNA, 22 bp, Homo sapiens
tcatccatgtgcaaactttggt

SEQ ID NO: 7582513 - DNA, 22 bp, Homo sapiens
tcatccatgtcagagcatgtat

SEQ ID NO: 7582514 - DNA, 16 bp, Homo sapiens
tcatccatgacagctc

SEQ ID NO: 7582515 - DNA, 21 bp, Homo sapiens
tcatccatggcttttgtgctt

SEQ ID NO: 7582516 - DNA, 22 bp, Homo sapiens
tcatcctgaagaacctgcttcc

SEQ ID NO: 7582517 - DNA, 22 bp, Homo sapiens
tcatcctgaagaacctgcttcc

SEQ ID NO: 7582518 - DNA, 22 bp, Homo sapiens
tcatccctctgccaggcccagg

SEQ ID NO: 7582519 - DNA, 22 bp, Homo sapiens
tcatcctgaagaacctgcttcc

SEQ ID NO: 7582520 - DNA, 22 bp, Homo sapiens
tcatcccagtgtccatgctcag

SEQ ID NO: 7582521 - DNA, 22 bp, Homo sapiens
tcatccctaaggacagctctgc

SEQ ID NO: 7582522 - DNA, 22 bp, Homo sapiens
tcatccctaaggacagctctgc

SEQ ID NO: 7582523 - DNA, 22 bp, Homo sapiens
tcatccctctgccaggcccagg

SEQ ID NO: 7582524 - DNA, 22 bp, Homo sapiens
tcatccctaaggacagctctgc

SEQ ID NO: 7582525 - DNA, 22 bp, Homo sapiens
tcatccatctttgatttcatag

SEQ ID NO: 7582526 - DNA, 22 bp, Homo sapiens
tcatccatcctcgcctttgctt

SEQ ID NO: 7582527 - DNA, 22 bp, Homo sapiens
tcatccatgaagagtgacagaa

SEQ ID NO: 7582528 - DNA, 22 bp, Homo sapiens
tcatccatatagaaagatgatt

SEQ ID NO: 7582529 - DNA, 22 bp, Homo sapiens
tcatccatatagaaagatgatt

SEQ ID NO: 7582530 - DNA, 22 bp, Homo sapiens
tcatccatactattgagaggca

SEQ ID NO: 7582531 - DNA, 22 bp, Homo sapiens
tcatccagttgtggagagggaa

SEQ ID NO: 7582532 - DNA, 22 bp, Homo sapiens
tcatccatagtttggttggact

SEQ ID NO: 7582533 - DNA, 22 bp, Homo sapiens
tcatccagtatgactggtgtct

SEQ ID NO: 7582534 - DNA, 22 bp, Homo sapiens
tcatccagtaccatggaaggca

SEQ ID NO: 7582535 - DNA, 22 bp, Homo sapiens
tcatccagtatgactggtgtct

SEQ ID NO: 7582536 - DNA, 22 bp, Homo sapiens
tcatccagtatgactggtgtct

SEQ ID NO: 7582537 - DNA, 22 bp, Homo sapiens
tcatccatactattgagaggca

SEQ ID NO: 7582538 - DNA, 20 bp, Homo sapiens
tcatccagttggtttatggt

SEQ ID NO: 7582539 - DNA, 20 bp, Homo sapiens
tcatccagttggtttatggt

SEQ ID NO: 7582540 - DNA, 20 bp, Homo sapiens
tcatatttttgccctgggcc

SEQ ID NO: 7582541 - DNA, 22 bp, Homo sapiens
tcatcaaaagccttctgggtta

SEQ ID NO: 7582542 - DNA, 23 bp, Homo sapiens
tcatcaaacagctgctcaagaaa

SEQ ID NO: 7582543 - DNA, 22 bp, Homo sapiens
tcatcaaagcgcttggagtagg

SEQ ID NO: 7582544 - DNA, 22 bp, Homo sapiens
tcatcatgtttgatttccacag

SEQ ID NO: 7582545 - DNA, 22 bp, Homo sapiens
tcatcattctgacaagtctaca

SEQ ID NO: 7582546 - DNA, 22 bp, Homo sapiens
tcatcatgtttgatttccacag

SEQ ID NO: 7582547 - DNA, 22 bp, Homo sapiens
tcatcatctgcaagctcatgtc

SEQ ID NO: 7582548 - DNA, 22 bp, Homo sapiens
tcatcatctgggcttgggggtg

SEQ ID NO: 7582549 - DNA, 22 bp, Homo sapiens
tcatcaaagcgcttggagtagg

SEQ ID NO: 7582550 - DNA, 22 bp, Homo sapiens
tcatcatctgggcttgggggtg

SEQ ID NO: 7582551 - DNA, 22 bp, Homo sapiens
tcatcaaaggattgcatgattt

SEQ ID NO: 7582552 - DNA, 22 bp, Homo sapiens
tcatcaaaggattgcatgattt

SEQ ID NO: 7582553 - DNA, 22 bp, Homo sapiens
tcatcaaaggattgcatgattt

SEQ ID NO: 7582554 - DNA, 20 bp, Homo sapiens
tcatccaggacaggagtggc

SEQ ID NO: 7582555 - DNA, 20 bp, Homo sapiens
tcatccaggacaggagtggc

SEQ ID NO: 7582556 - DNA, 20 bp, Homo sapiens
tcatccaggacaggagtggc

SEQ ID NO: 7582557 - DNA, 20 bp, Homo sapiens
tcatccaggacaggagtggc

SEQ ID NO: 7582558 - DNA, 22 bp, Homo sapiens
tcatccagagcttcataagtaa

SEQ ID NO: 7582559 - DNA, 22 bp, Homo sapiens
tcatccaggaaaagatttggaa

SEQ ID NO: 7582560 - DNA, 22 bp, Homo sapiens
tcatccagcctcatcaggagct

SEQ ID NO: 7582561 - DNA, 22 bp, Homo sapiens
tcatccagcctcatcaggagct

SEQ ID NO: 7582562 - DNA, 22 bp, Homo sapiens
tcataaaagtactcatgttcat

SEQ ID NO: 7582563 - DNA, 22 bp, Homo sapiens
tcataaaatgctcctgatattg

SEQ ID NO: 7582564 - DNA, 22 bp, Homo sapiens
tcataaaatgctcctgatattg

SEQ ID NO: 7582565 - DNA, 22 bp, Homo sapiens
tcataaaatgctcctgatattg

SEQ ID NO: 7582566 - DNA, 22 bp, Homo sapiens
tcataaaagtactcatgttcat

SEQ ID NO: 7582567 - DNA, 22 bp, Homo sapiens
tcataaaacacaccaggtagtt

SEQ ID NO: 7582568 - DNA, 22 bp, Homo sapiens
tcataaaacacaccaggtagtt

SEQ ID NO: 7582569 - DNA, 22 bp, Homo sapiens
tcataaaagtactcatgttcat

SEQ ID NO: 7582570 - DNA, 22 bp, Homo sapiens
tcataaaagtactcatgttcat

SEQ ID NO: 7582571 - DNA, 22 bp, Homo sapiens
tcataaaagtactcatgttcat

SEQ ID NO: 7582572 - DNA, 22 bp, Homo sapiens
tcataaaagtactcatgttcat

SEQ ID NO: 7582573 - DNA, 22 bp, Homo sapiens
tcataaaatgctcctgatattg

SEQ ID NO: 7582574 - DNA, 22 bp, Homo sapiens
tcataaaatgctcctgatattg

SEQ ID NO: 7582575 - DNA, 22 bp, Homo sapiens
tcataaaatgctcctgatattg

SEQ ID NO: 7582576 - DNA, 22 bp, Homo sapiens
tcataaaatgctcctgatattg

SEQ ID NO: 7582577 - DNA, 22 bp, Homo sapiens
tcataaaatgctcctgatattg

SEQ ID NO: 7582578 - DNA, 22 bp, Homo sapiens
tcataaaatgctcctgatattg

SEQ ID NO: 7582579 - DNA, 20 bp, Homo sapiens
tcataaagaggaaataaata

SEQ ID NO: 7582580 - DNA, 20 bp, Homo sapiens
tcataaagaggaaataaata

SEQ ID NO: 7582581 - DNA, 20 bp, Homo sapiens
tcataaagaggaaataaata

SEQ ID NO: 7582582 - DNA, 20 bp, Homo sapiens
tcataaagaggaaataaata

SEQ ID NO: 7582583 - DNA, 21 bp, Homo sapiens
tcataaactagtatcaaagtt

SEQ ID NO: 7582584 - DNA, 22 bp, Homo sapiens
tcataaacacactagtatgatt

SEQ ID NO: 7582585 - DNA, 22 bp, Homo sapiens
tcataaagctcttccaaatgta

SEQ ID NO: 7582586 - DNA, 22 bp, Homo sapiens
tcatatttgggggtgtgtgttt

SEQ ID NO: 7582587 - DNA, 22 bp, Homo sapiens
tcatatttgggggtgtgtgttt

SEQ ID NO: 7582588 - DNA, 22 bp, Homo sapiens
tcatatttgggggtgtgtgttt

SEQ ID NO: 7582589 - DNA, 22 bp, Homo sapiens
tcataaagatactaagtgagtt

SEQ ID NO: 7582590 - DNA, 22 bp, Homo sapiens
tcataaagatactaagtgagtt

SEQ ID NO: 7582591 - DNA, 22 bp, Homo sapiens
tcataaagagtgctgttgtttt

SEQ ID NO: 7582592 - DNA, 22 bp, Homo sapiens
tcaggggcagctgtgctttgtg

SEQ ID NO: 7582593 - DNA, 22 bp, Homo sapiens
tcaggggcagctgtgctttgtg

SEQ ID NO: 7582594 - DNA, 22 bp, Homo sapiens
tcaggggcagccggggaagcca

SEQ ID NO: 7582595 - DNA, 22 bp, Homo sapiens
tcaggggcagctgtgctttgtg

SEQ ID NO: 7582596 - DNA, 22 bp, Homo sapiens
tcaggggcccttccctcagcag

SEQ ID NO: 7582597 - DNA, 22 bp, Homo sapiens
tcaggggcccttccctcagcag

SEQ ID NO: 7582598 - DNA, 22 bp, Homo sapiens
tcaggggcagccggggaagcca

SEQ ID NO: 7582599 - DNA, 22 bp, Homo sapiens
tcaggggcagccggggaagcca

SEQ ID NO: 7582600 - DNA, 22 bp, Homo sapiens
tcaggggcagccggggaagcca

SEQ ID NO: 7582601 - DNA, 22 bp, Homo sapiens
tcaggggacagccagctggagg

SEQ ID NO: 7582602 - DNA, 22 bp, Homo sapiens
tcaggggacagccagctggagg

SEQ ID NO: 7582603 - DNA, 22 bp, Homo sapiens
tcaggggacttaggagagaagt

SEQ ID NO: 7582604 - DNA, 22 bp, Homo sapiens
tcaggggacttaggagagaagt

SEQ ID NO: 7582605 - DNA, 22 bp, Homo sapiens
tcaggggacttaggagagaagt

SEQ ID NO: 7582606 - DNA, 22 bp, Homo sapiens
tcaggggaaatctctcagcgaa

SEQ ID NO: 7582607 - DNA, 22 bp, Homo sapiens
tcaggggaaatctctcagcgaa

SEQ ID NO: 7582608 - DNA, 22 bp, Homo sapiens
tcaggggaaatctctcagcgaa

SEQ ID NO: 7582609 - DNA, 22 bp, Homo sapiens
tcaggggaaatctctcagcgaa

SEQ ID NO: 7582610 - DNA, 22 bp, Homo sapiens
tcaggggcttgaggtgcatgtc

SEQ ID NO: 7582611 - DNA, 22 bp, Homo sapiens
tcaggggcttgaggtgcatgtc

SEQ ID NO: 7582612 - DNA, 22 bp, Homo sapiens
tcaggggcttgaggtgcatgtc

SEQ ID NO: 7582613 - DNA, 22 bp, Homo sapiens
tcaggggcttgaggtgcatgtc

SEQ ID NO: 7582614 - DNA, 21 bp, Homo sapiens
tcaggggctgtgttttccatc

SEQ ID NO: 7582615 - DNA, 21 bp, Homo sapiens
tcaggggctgtgttttccatc

SEQ ID NO: 7582616 - DNA, 22 bp, Homo sapiens
tcaggggcttgaggtgcatgtc

SEQ ID NO: 7582617 - DNA, 22 bp, Homo sapiens
tcaggggcttgaggtgcatgtc

SEQ ID NO: 7582618 - DNA, 22 bp, Homo sapiens
tcaggggctgtgcatttcccag

SEQ ID NO: 7582619 - DNA, 22 bp, Homo sapiens
tcaggggctgtgcatttcccag

SEQ ID NO: 7582620 - DNA, 22 bp, Homo sapiens
tcaggggcccttccctcagcag

SEQ ID NO: 7582621 - DNA, 22 bp, Homo sapiens
tcaggggcccttccctcagcag

SEQ ID NO: 7582622 - DNA, 21 bp, Homo sapiens
tcaggggctgtgttttccatc

SEQ ID NO: 7582623 - DNA, 21 bp, Homo sapiens
tcaggggctgtgttttccatc

SEQ ID NO: 7582624 - DNA, 22 bp, Homo sapiens
tcaggggctgtgcatttcccag

SEQ ID NO: 7582625 - DNA, 21 bp, Homo sapiens
tcagggcagctgctcttcaga

SEQ ID NO: 7582626 - DNA, 22 bp, Homo sapiens
tcagggcagcctaaggcacctc

SEQ ID NO: 7582627 - DNA, 22 bp, Homo sapiens
tcagggcagcctaaggcacctc

SEQ ID NO: 7582628 - DNA, 22 bp, Homo sapiens
tcagggcagcctaaggcacctc

SEQ ID NO: 7582629 - DNA, 16 bp, Homo sapiens
tcagggcagaatggca

SEQ ID NO: 7582630 - DNA, 22 bp, Homo sapiens
tcagggcagcctaaggcacctc

SEQ ID NO: 7582631 - DNA, 22 bp, Homo sapiens
tcagggcagcctaaggcacctc

SEQ ID NO: 7582632 - DNA, 22 bp, Homo sapiens
tcagggcagcctaaggcacctc

SEQ ID NO: 7582633 - DNA, 22 bp, Homo sapiens
tcagggcagcctaaggcacctc

SEQ ID NO: 7582634 - DNA, 22 bp, Homo sapiens
tcagggctggcttttgcagagc

SEQ ID NO: 7582635 - DNA, 22 bp, Homo sapiens
tcaggggaaatctctcagcgaa

SEQ ID NO: 7582636 - DNA, 22 bp, Homo sapiens
tcaggggaaatctctcagcgaa

SEQ ID NO: 7582637 - DNA, 22 bp, Homo sapiens
tcagggctgtggttccttttct

SEQ ID NO: 7582638 - DNA, 22 bp, Homo sapiens
tcagggctggcttttgcagagc

SEQ ID NO: 7582639 - DNA, 22 bp, Homo sapiens
tcagggctgtggttccttttct

SEQ ID NO: 7582640 - DNA, 22 bp, Homo sapiens
tcagggcactgtcacctgatat

SEQ ID NO: 7582641 - DNA, 22 bp, Homo sapiens
tcagggcactgtcacctgatat

SEQ ID NO: 7582642 - DNA, 22 bp, Homo sapiens
tcagggcaccaaaaaagatgcc

SEQ ID NO: 7582643 - DNA, 22 bp, Homo sapiens
tcagggcacgtttctgcaatgc

SEQ ID NO: 7582644 - DNA, 22 bp, Homo sapiens
tcagggcagaatccaaagaatt

SEQ ID NO: 7582645 - DNA, 22 bp, Homo sapiens
tcagggcagaatccaaagaatt

SEQ ID NO: 7582646 - DNA, 22 bp, Homo sapiens
tcagggcagaatccaaagaatt

SEQ ID NO: 7582647 - DNA, 22 bp, Homo sapiens
tcagggcagaatccaaagaatt

SEQ ID NO: 7582648 - DNA, 16 bp, Homo sapiens
tcagggcagaatggca

SEQ ID NO: 7582649 - DNA, 22 bp, Homo sapiens
tcaggtgacctgagccactatg

SEQ ID NO: 7582650 - DNA, 20 bp, Homo sapiens
tcaggtgacacacgtggcac

SEQ ID NO: 7582651 - DNA, 22 bp, Homo sapiens
tcaggtgacctgagccactatg

SEQ ID NO: 7582652 - DNA, 22 bp, Homo sapiens
tcagtgcagtgaaaggtttact

SEQ ID NO: 7582653 - DNA, 22 bp, Homo sapiens
tcagtgcagtgaaaggtttact

SEQ ID NO: 7582654 - DNA, 22 bp, Homo sapiens
tcagtgcatcacagaactttgt

SEQ ID NO: 7582655 - DNA, 22 bp, Homo sapiens
tcagtgcagtgaaaggtttact

SEQ ID NO: 7582656 - DNA, 22 bp, Homo sapiens
tcagtgcagtgaaaggtttact

SEQ ID NO: 7582657 - DNA, 22 bp, Homo sapiens
tcagtgcattaataatatcagt

SEQ ID NO: 7582658 - DNA, 22 bp, Homo sapiens
tcagtgcattaataatatcagt

SEQ ID NO: 7582659 - DNA, 22 bp, Homo sapiens
tcagtgcattaataatatcagt

SEQ ID NO: 7582660 - DNA, 22 bp, Homo sapiens
tcagtgcattaataatatcagt

SEQ ID NO: 7582661 - DNA, 22 bp, Homo sapiens
tcagtgcattcatgggtggctg

SEQ ID NO: 7582662 - DNA, 22 bp, Homo sapiens
tcagtgcattcatgggtggctg

SEQ ID NO: 7582663 - DNA, 22 bp, Homo sapiens
tcagtgcatggacagatttaga

SEQ ID NO: 7582664 - DNA, 22 bp, Homo sapiens
tcagtgcatggacagatttaga

SEQ ID NO: 7582665 - DNA, 22 bp, Homo sapiens
tcagtgcatggacagatttaga

SEQ ID NO: 7582666 - DNA, 22 bp, Homo sapiens
tcagtgcatggacagatttaga

SEQ ID NO: 7582667 - DNA, 22 bp, Homo sapiens
tcaggtcccactgctagtaagt

SEQ ID NO: 7582668 - DNA, 22 bp, Homo sapiens
tcaggtcctctgggtcccagcc

SEQ ID NO: 7582669 - DNA, 22 bp, Homo sapiens
tcaggtcctctgggtcccagcc

SEQ ID NO: 7582670 - DNA, 22 bp, Homo sapiens
tcaggtcctctgggtcccagcc

SEQ ID NO: 7582671 - DNA, 22 bp, Homo sapiens
tcaggtcctctgggtcccagcc

SEQ ID NO: 7582672 - DNA, 22 bp, Homo sapiens
tcaggtcctctgggtcccagcc

SEQ ID NO: 7582673 - DNA, 22 bp, Homo sapiens
tcaggtccttactgtgctccct

SEQ ID NO: 7582674 - DNA, 22 bp, Homo sapiens
tcaggtccttactgtgctccct

SEQ ID NO: 7582675 - DNA, 22 bp, Homo sapiens
tcaggtccttactgtgctccct

SEQ ID NO: 7582676 - DNA, 22 bp, Homo sapiens
tcaggtccttttggtgtatatt

SEQ ID NO: 7582677 - DNA, 22 bp, Homo sapiens
tcaggtccttttggtgtatatt

SEQ ID NO: 7582678 - DNA, 22 bp, Homo sapiens
tcaggtctatactatgagaggc

SEQ ID NO: 7582679 - DNA, 22 bp, Homo sapiens
tcaggtctatagaagaggaggg

SEQ ID NO: 7582680 - DNA, 22 bp, Homo sapiens
tcaggtcttttgtctcctagaa

SEQ ID NO: 7582681 - DNA, 22 bp, Homo sapiens
tcaggtcttgagccatcaggat

SEQ ID NO: 7582682 - DNA, 20 bp, Homo sapiens
tcaggtgacacacgtggcac

SEQ ID NO: 7582683 - DNA, 22 bp, Homo sapiens
tcaggtctgggcacatggtaca

SEQ ID NO: 7582684 - DNA, 22 bp, Homo sapiens
tcaggtctgatgcctcatccat

SEQ ID NO: 7582685 - DNA, 22 bp, Homo sapiens
tcagggtgaaccaggcaggaat

SEQ ID NO: 7582686 - DNA, 22 bp, Homo sapiens
tcagggtgaaccaggcaggaat

SEQ ID NO: 7582687 - DNA, 22 bp, Homo sapiens
tcagggtcaggacccagctgtt

SEQ ID NO: 7582688 - DNA, 22 bp, Homo sapiens
tcagggtcagattccagagcct

SEQ ID NO: 7582689 - DNA, 22 bp, Homo sapiens
tcagggtcaggacccagctgtt

SEQ ID NO: 7582690 - DNA, 19 bp, Homo sapiens
tcagggttcctccatggag

SEQ ID NO: 7582691 - DNA, 19 bp, Homo sapiens
tcagggttcctccatggag

SEQ ID NO: 7582692 - DNA, 21 bp, Homo sapiens
tcagggttcaaaggaactgat

SEQ ID NO: 7582693 - DNA, 22 bp, Homo sapiens
tcagggtgaaccaggcaggaat

SEQ ID NO: 7582694 - DNA, 22 bp, Homo sapiens
tcagggtaaaccttcactgtga

SEQ ID NO: 7582695 - DNA, 19 bp, Homo sapiens
tcagggggctgataggagg

SEQ ID NO: 7582696 - DNA, 22 bp, Homo sapiens
tcagggtcaggacccagctgtt

SEQ ID NO: 7582697 - DNA, 22 bp, Homo sapiens
tcagggtcagattccagagcct

SEQ ID NO: 7582698 - DNA, 22 bp, Homo sapiens
tcagggtatgttctagatctga

SEQ ID NO: 7582699 - DNA, 22 bp, Homo sapiens
tcagggtatgttctagatctga

SEQ ID NO: 7582700 - DNA, 22 bp, Homo sapiens
tcagggtcagattccagagcct

SEQ ID NO: 7582701 - DNA, 22 bp, Homo sapiens
tcaggtagtggttaagttctgt

SEQ ID NO: 7582702 - DNA, 20 bp, Homo sapiens
tcaggtagatctttgaggtc

SEQ ID NO: 7582703 - DNA, 22 bp, Homo sapiens
tcaggtcatctgtctctgggct

SEQ ID NO: 7582704 - DNA, 21 bp, Homo sapiens
tcaggtagttgctttgttgaa

SEQ ID NO: 7582705 - DNA, 22 bp, Homo sapiens
tcaggtatttcttttagctgtg

SEQ ID NO: 7582706 - DNA, 22 bp, Homo sapiens
tcagggtttggggctacagcca

SEQ ID NO: 7582707 - DNA, 22 bp, Homo sapiens
tcaggtccagctcctgtgcctc

SEQ ID NO: 7582708 - DNA, 22 bp, Homo sapiens
tcaggtccaagatggccatcca

SEQ ID NO: 7582709 - DNA, 22 bp, Homo sapiens
tcaggtccagctcctgtgcctc

SEQ ID NO: 7582710 - DNA, 20 bp, Homo sapiens
tcaggtagatctttgaggtc

SEQ ID NO: 7582711 - DNA, 22 bp, Homo sapiens
tcagggtttcggctcaacagaa

SEQ ID NO: 7582712 - DNA, 22 bp, Homo sapiens
tcagggtttggggctacagcca

SEQ ID NO: 7582713 - DNA, 22 bp, Homo sapiens
tcaggtaagtgtaatatataga

SEQ ID NO: 7582714 - DNA, 22 bp, Homo sapiens
tcagggttgtgaaggaaagggg

SEQ ID NO: 7582715 - DNA, 20 bp, Homo sapiens
tcagggtttcccattcttgg

SEQ ID NO: 7582716 - DNA, 22 bp, Homo sapiens
tcagggtttcggctcaacagaa

SEQ ID NO: 7582717 - DNA, 22 bp, Homo sapiens
tcagggttgtggtggaattcag

SEQ ID NO: 7582718 - DNA, 22 bp, Homo sapiens
tcagggttgtggtggaattcag

SEQ ID NO: 7582719 - DNA, 22 bp, Homo sapiens
tcagggttgtgaaggaaagggg

SEQ ID NO: 7582720 - DNA, 22 bp, Homo sapiens
tcagggttgtgaaggaaagggg

SEQ ID NO: 7582721 - DNA, 21 bp, Homo sapiens
tcagggttcaaaggaactgat

SEQ ID NO: 7582722 - DNA, 22 bp, Homo sapiens
tcagggttctttcagttaagtt

SEQ ID NO: 7582723 - DNA, 22 bp, Homo sapiens
tcagggttgaaataattcagtt

SEQ ID NO: 7582724 - DNA, 22 bp, Homo sapiens
tcagggttgaaataattcagtt

SEQ ID NO: 7582725 - DNA, 22 bp, Homo sapiens
tcagggttgctgtgatcagtcc

SEQ ID NO: 7582726 - DNA, 22 bp, Homo sapiens
tcagggttgctgtgatcagtcc

SEQ ID NO: 7582727 - DNA, 22 bp, Homo sapiens
tcagggttctttcagttaagtt

SEQ ID NO: 7582728 - DNA, 22 bp, Homo sapiens
tcagggagagcctgtctgacgt

SEQ ID NO: 7582729 - DNA, 22 bp, Homo sapiens
tcagggagagcctgtctgacgt

SEQ ID NO: 7582730 - DNA, 22 bp, Homo sapiens
tcagggacttacaaaccagaag

SEQ ID NO: 7582731 - DNA, 22 bp, Homo sapiens
tcagggactgcagagggaagct

SEQ ID NO: 7582732 - DNA, 22 bp, Homo sapiens
tcagggactgcagagggaagct

SEQ ID NO: 7582733 - DNA, 22 bp, Homo sapiens
tcagggactaggtgctgcctga

SEQ ID NO: 7582734 - DNA, 22 bp, Homo sapiens
tcagggagaggtgagagcctgt

SEQ ID NO: 7582735 - DNA, 22 bp, Homo sapiens
tcagggagagcctgtctgacgt

SEQ ID NO: 7582736 - DNA, 22 bp, Homo sapiens
tcagggcaaaagggaaaccatt

SEQ ID NO: 7582737 - DNA, 22 bp, Homo sapiens
tcagggcaaaagggaaaccatt

SEQ ID NO: 7582738 - DNA, 22 bp, Homo sapiens
tcagggcaaaagggaaaccatt

SEQ ID NO: 7582739 - DNA, 22 bp, Homo sapiens
tcagggcaaaagggaaaccatt

SEQ ID NO: 7582740 - DNA, 22 bp, Homo sapiens
tcagggcaaaagggaaaccatt

SEQ ID NO: 7582741 - DNA, 22 bp, Homo sapiens
tcaggctgagaaaatctggacc

SEQ ID NO: 7582742 - DNA, 22 bp, Homo sapiens
tcaggctgagaaaatctggacc

SEQ ID NO: 7582743 - DNA, 22 bp, Homo sapiens
tcaggctgagaaaatctggacc

SEQ ID NO: 7582744 - DNA, 22 bp, Homo sapiens
tcaggctgagaaaatctggacc

SEQ ID NO: 7582745 - DNA, 22 bp, Homo sapiens
tcaggctgaccaggttttgctc

SEQ ID NO: 7582746 - DNA, 22 bp, Homo sapiens
tcaggctgaccaggttttgctc

SEQ ID NO: 7582747 - DNA, 22 bp, Homo sapiens
tcaggctgaccaggttttgctc

SEQ ID NO: 7582748 - DNA, 22 bp, Homo sapiens
tcaggctgaggtcatctgcatc

SEQ ID NO: 7582749 - DNA, 22 bp, Homo sapiens
tcaggctgaggtcatctgcatc

SEQ ID NO: 7582750 - DNA, 22 bp, Homo sapiens
tcaggctgaggtcatctgcatc

SEQ ID NO: 7582751 - DNA, 22 bp, Homo sapiens
tcaggctgagaaaatctggacc

SEQ ID NO: 7582752 - DNA, 22 bp, Homo sapiens
tcaggctgaggtcatctgcatc

SEQ ID NO: 7582753 - DNA, 21 bp, Homo sapiens
tcagggactaggtactgggga

SEQ ID NO: 7582754 - DNA, 22 bp, Homo sapiens
tcagggactaggtgctgcctga

SEQ ID NO: 7582755 - DNA, 22 bp, Homo sapiens
tcaggctgaggtcatctgcatc

SEQ ID NO: 7582756 - DNA, 22 bp, Homo sapiens
tcagggcacattctgcagtggc

SEQ ID NO: 7582757 - DNA, 22 bp, Homo sapiens
tcagggcacattctgcagtggc

SEQ ID NO: 7582758 - DNA, 22 bp, Homo sapiens
tcagggcacattctgcagtggc

SEQ ID NO: 7582759 - DNA, 22 bp, Homo sapiens
tcagggcacattctgcagtggc

SEQ ID NO: 7582760 - DNA, 22 bp, Homo sapiens
tcagggcaccaaaaaagatgcc

SEQ ID NO: 7582761 - DNA, 22 bp, Homo sapiens
tcagggcaccaaaaaagatgcc

SEQ ID NO: 7582762 - DNA, 22 bp, Homo sapiens
tcagggcacattctgcagtggc

SEQ ID NO: 7582763 - DNA, 22 bp, Homo sapiens
tcagggcacaggcctgtgggtt

SEQ ID NO: 7582764 - DNA, 22 bp, Homo sapiens
tcagggcacaggcctgtgggtt

SEQ ID NO: 7582765 - DNA, 22 bp, Homo sapiens
tcagggcaatgtccctcagaag

SEQ ID NO: 7582766 - DNA, 22 bp, Homo sapiens
tcagggcaatgtccctcagaag

SEQ ID NO: 7582767 - DNA, 22 bp, Homo sapiens
tcagggcaatgtccctcagaag

SEQ ID NO: 7582768 - DNA, 22 bp, Homo sapiens
tcagggcaatgtccctcagaag

SEQ ID NO: 7582769 - DNA, 22 bp, Homo sapiens
tcagggcaagtctcagaaggtt

SEQ ID NO: 7582770 - DNA, 22 bp, Homo sapiens
tcagggcaagtctcagaaggtt

SEQ ID NO: 7582771 - DNA, 22 bp, Homo sapiens
tcagggcaagtctcagaaggtt

SEQ ID NO: 7582772 - DNA, 22 bp, Homo sapiens
tcagggcaagtctcagaaggtt

SEQ ID NO: 7582773 - DNA, 22 bp, Homo sapiens
tcagggcaagtctcagaaggtt

SEQ ID NO: 7582774 - DNA, 22 bp, Homo sapiens
tcagggcaagtctcagaaggtt

SEQ ID NO: 7582775 - DNA, 22 bp, Homo sapiens
tcagggcaagtctcagaaggtt

SEQ ID NO: 7582776 - DNA, 22 bp, Homo sapiens
tcagggcaagtctcagaaggtt

SEQ ID NO: 7582777 - DNA, 22 bp, Homo sapiens
tcagggcaaagggcagagtttg

SEQ ID NO: 7582778 - DNA, 22 bp, Homo sapiens
tcagggcaaagggcagagtttg

SEQ ID NO: 7582779 - DNA, 22 bp, Homo sapiens
tcagggcaaagggcagagtttg

SEQ ID NO: 7582780 - DNA, 22 bp, Homo sapiens
tcagggcaagattggttaataa

SEQ ID NO: 7582781 - DNA, 22 bp, Homo sapiens
tcaggctccctgctgggctctg

SEQ ID NO: 7582782 - DNA, 22 bp, Homo sapiens
tcaggctccctgctgggctctg

SEQ ID NO: 7582783 - DNA, 22 bp, Homo sapiens
tcaggctccctgctgggctctg

SEQ ID NO: 7582784 - DNA, 22 bp, Homo sapiens
tcaggctccctgctgggctctg

SEQ ID NO: 7582785 - DNA, 20 bp, Homo sapiens
tcaggctccgcattaactta

SEQ ID NO: 7582786 - DNA, 22 bp, Homo sapiens
tcaggctccctgctgggctctg

SEQ ID NO: 7582787 - DNA, 22 bp, Homo sapiens
tcaggctccctgctgggctctg

SEQ ID NO: 7582788 - DNA, 22 bp, Homo sapiens
tcaggctcaggttaggggccaa

SEQ ID NO: 7582789 - DNA, 22 bp, Homo sapiens
tcaggctccctgctgggctctg

SEQ ID NO: 7582790 - DNA, 22 bp, Homo sapiens
tcaggctctacacttgacacac

SEQ ID NO: 7582791 - DNA, 22 bp, Homo sapiens
tcaggctctcagaccaacagca

SEQ ID NO: 7582792 - DNA, 22 bp, Homo sapiens
tcaggctctcagaccaacagca

SEQ ID NO: 7582793 - DNA, 22 bp, Homo sapiens
tcaggctctcagaccaacagca

SEQ ID NO: 7582794 - DNA, 18 bp, Homo sapiens
tcaggctctctggctaga

SEQ ID NO: 7582795 - DNA, 18 bp, Homo sapiens
tcaggctctctggctaga

SEQ ID NO: 7582796 - DNA, 22 bp, Homo sapiens
tcaggcctttcttcagagcttc

SEQ ID NO: 7582797 - DNA, 22 bp, Homo sapiens
tcaggcctttcttcagagcttc

SEQ ID NO: 7582798 - DNA, 22 bp, Homo sapiens
tcaggcctttcttcagagcttc

SEQ ID NO: 7582799 - DNA, 22 bp, Homo sapiens
tcaggcctttgaacttggagtg

SEQ ID NO: 7582800 - DNA, 22 bp, Homo sapiens
tcaggcctttgaacttggagtg

SEQ ID NO: 7582801 - DNA, 22 bp, Homo sapiens
tcaggcctttgaacttggagtg

SEQ ID NO: 7582802 - DNA, 22 bp, Homo sapiens
tcaggcctttcttcagagcttc

SEQ ID NO: 7582803 - DNA, 22 bp, Homo sapiens
tcaggcctttgaacttggagtg

SEQ ID NO: 7582804 - DNA, 22 bp, Homo sapiens
tcaggcctttgaacttggagtg

SEQ ID NO: 7582805 - DNA, 22 bp, Homo sapiens
tcaggctaaccctaggcagaag

SEQ ID NO: 7582806 - DNA, 22 bp, Homo sapiens
tcaggcgaggcttaatccaagg

SEQ ID NO: 7582807 - DNA, 22 bp, Homo sapiens
tcaggctaacggcatattgcct

SEQ ID NO: 7582808 - DNA, 22 bp, Homo sapiens
tcaggctaagggagaggcgctc

SEQ ID NO: 7582809 - DNA, 21 bp, Homo sapiens
tcaggctaattccaaggtagg

SEQ ID NO: 7582810 - DNA, 22 bp, Homo sapiens
tcaggctacactcttttcatgg

SEQ ID NO: 7582811 - DNA, 22 bp, Homo sapiens
tcaggctacactcttttcatgg

SEQ ID NO: 7582812 - DNA, 22 bp, Homo sapiens
tcaggctcaggaatgtgtttat

SEQ ID NO: 7582813 - DNA, 22 bp, Homo sapiens
tcaggctatatccaggtatcca

SEQ ID NO: 7582814 - DNA, 22 bp, Homo sapiens
tcaggctcaggaatgtgtttat

SEQ ID NO: 7582815 - DNA, 22 bp, Homo sapiens
tcaggctagcccagtgcttggg

SEQ ID NO: 7582816 - DNA, 22 bp, Homo sapiens
tcaggctacttcctttgaggct

SEQ ID NO: 7582817 - DNA, 22 bp, Homo sapiens
tcaggctacttgctttaaagta

SEQ ID NO: 7582818 - DNA, 22 bp, Homo sapiens
tcaggctagaagtaattgtgtt

SEQ ID NO: 7582819 - DNA, 22 bp, Homo sapiens
tcaggctctgagctgatgctaa

SEQ ID NO: 7582820 - DNA, 22 bp, Homo sapiens
tcaggctctgagctgatgctaa

SEQ ID NO: 7582821 - DNA, 18 bp, Homo sapiens
tcaggctctctggctaga

SEQ ID NO: 7582822 - DNA, 22 bp, Homo sapiens
tcaggctctgagctgatgctaa

SEQ ID NO: 7582823 - DNA, 22 bp, Homo sapiens
tcaggctctgagctgatgctaa

SEQ ID NO: 7582824 - DNA, 22 bp, Homo sapiens
tcaggctctgagctgatgctaa

SEQ ID NO: 7582825 - DNA, 22 bp, Homo sapiens
tcaggctctgccacctagatta

SEQ ID NO: 7582826 - DNA, 22 bp, Homo sapiens
tcaggctctgccacctagatta

SEQ ID NO: 7582827 - DNA, 22 bp, Homo sapiens
tcaggctctgccacctagatta

SEQ ID NO: 7582828 - DNA, 22 bp, Homo sapiens
tcaggctgaaaggactccagtt

SEQ ID NO: 7582829 - DNA, 22 bp, Homo sapiens
tcaggctgaaaggactccagtt

SEQ ID NO: 7582830 - DNA, 22 bp, Homo sapiens
tcaggctctgggtacacctgac

SEQ ID NO: 7582831 - DNA, 22 bp, Homo sapiens
tcaggctgaaaggactccagtt

SEQ ID NO: 7582832 - DNA, 22 bp, Homo sapiens
tcaggctctgggtacacctgac

SEQ ID NO: 7582833 - DNA, 22 bp, Homo sapiens
tcaggctctgggtacacctgac

SEQ ID NO: 7582834 - DNA, 22 bp, Homo sapiens
tcaggctctgggtacacctgac

SEQ ID NO: 7582835 - DNA, 22 bp, Homo sapiens
tcaggctgaaaggactccagtt

SEQ ID NO: 7582836 - DNA, 22 bp, Homo sapiens
tcaggctgaaaggactccagtt

SEQ ID NO: 7582837 - DNA, 22 bp, Homo sapiens
tcaggctgaaggaggcctatct

SEQ ID NO: 7582838 - DNA, 22 bp, Homo sapiens
tcaggctgaaaggactccagtt

SEQ ID NO: 7582839 - DNA, 22 bp, Homo sapiens
tcaggctgaaaggactccagtt

SEQ ID NO: 7582840 - DNA, 22 bp, Homo sapiens
tcaggctgaaggaggcctatct

SEQ ID NO: 7582841 - DNA, 22 bp, Homo sapiens
tcaggctgaaggaggcctatct

SEQ ID NO: 7582842 - DNA, 22 bp, Homo sapiens
tcaggctgaaggaggcctatct

SEQ ID NO: 7582843 - DNA, 22 bp, Homo sapiens
tcaggctgaaggaggcctatct

SEQ ID NO: 7582844 - DNA, 22 bp, Homo sapiens
tcaggctgaaggaggcctatct

SEQ ID NO: 7582845 - DNA, 22 bp, Homo sapiens
tcaggctgaatcatcctagctt

SEQ ID NO: 7582846 - DNA, 22 bp, Homo sapiens
tcaggctgaatcatcctagctt

SEQ ID NO: 7582847 - DNA, 22 bp, Homo sapiens
tcaggctctgggtacacctgac

SEQ ID NO: 7582848 - DNA, 22 bp, Homo sapiens
tcaggctgaaggaggcctatct

SEQ ID NO: 7582849 - DNA, 22 bp, Homo sapiens
tcaggctgaatcatcctagctt

SEQ ID NO: 7582850 - DNA, 22 bp, Homo sapiens
tcaggctgaatcatcctagctt

SEQ ID NO: 7582851 - DNA, 22 bp, Homo sapiens
tcaggctgaatcatcctagctt

SEQ ID NO: 7582852 - DNA, 22 bp, Homo sapiens
tcaggctgaatcatcctagctt

SEQ ID NO: 7582853 - DNA, 22 bp, Homo sapiens
tcaggctgaatcatcctagctt

SEQ ID NO: 7582854 - DNA, 22 bp, Homo sapiens
tcaggctgaatcatcctagctt

SEQ ID NO: 7582855 - DNA, 22 bp, Homo sapiens
tcaggcaccctctattttcatc

SEQ ID NO: 7582856 - DNA, 22 bp, Homo sapiens
tcaggcaccccttgagtagggg

SEQ ID NO: 7582857 - DNA, 22 bp, Homo sapiens
tcaggcaccccttgagtagggg

SEQ ID NO: 7582858 - DNA, 22 bp, Homo sapiens
tcaggcaccccttgagtagggg

SEQ ID NO: 7582859 - DNA, 22 bp, Homo sapiens
tcaggcaaggctggtctcatac

SEQ ID NO: 7582860 - DNA, 22 bp, Homo sapiens
tcaggcaaggcccttagagtgt

SEQ ID NO: 7582861 - DNA, 22 bp, Homo sapiens
tcaggcaatctgacagctggag

SEQ ID NO: 7582862 - DNA, 22 bp, Homo sapiens
tcaggcaatctgacagctggag

SEQ ID NO: 7582863 - DNA, 22 bp, Homo sapiens
tcaggaggtctgctgcggggtg

SEQ ID NO: 7582864 - DNA, 19 bp, Homo sapiens
tcaggaggtcgacctggca

SEQ ID NO: 7582865 - DNA, 22 bp, Homo sapiens
tcaggaggtctgctgcggggtg

SEQ ID NO: 7582866 - DNA, 22 bp, Homo sapiens
tcaggaggtctgctgcggggtg

SEQ ID NO: 7582867 - DNA, 22 bp, Homo sapiens
tcaggaggtctgctgcggggtg

SEQ ID NO: 7582868 - DNA, 19 bp, Homo sapiens
tcaggaggtcgacctggca

SEQ ID NO: 7582869 - DNA, 22 bp, Homo sapiens
tcaggaggtgtaacgaatacag

SEQ ID NO: 7582870 - DNA, 22 bp, Homo sapiens
tcaggaggtgtaacgaatacag

SEQ ID NO: 7582871 - DNA, 22 bp, Homo sapiens
tcaggaggtgtaacgaatacag

SEQ ID NO: 7582872 - DNA, 22 bp, Homo sapiens
tcaggaggtgtaacgaatacag

SEQ ID NO: 7582873 - DNA, 22 bp, Homo sapiens
tcaggaggtctgctgcggggtg

SEQ ID NO: 7582874 - DNA, 19 bp, Homo sapiens
tcaggaggtcgacctggca

SEQ ID NO: 7582875 - DNA, 19 bp, Homo sapiens
tcaggaggtcgacctggca

SEQ ID NO: 7582876 - DNA, 19 bp, Homo sapiens
tcaggaggtcgacctggca

SEQ ID NO: 7582877 - DNA, 19 bp, Homo sapiens
tcaggaggtcgacctggca

SEQ ID NO: 7582878 - DNA, 19 bp, Homo sapiens
tcaggaggtcgacctggca

SEQ ID NO: 7582879 - DNA, 22 bp, Homo sapiens
tcaggaggtccgcccgggaggg

SEQ ID NO: 7582880 - DNA, 22 bp, Homo sapiens
tcaggaggtccgcccgggaggg

SEQ ID NO: 7582881 - DNA, 22 bp, Homo sapiens
tcaggaggtccgcccgggaggg

SEQ ID NO: 7582882 - DNA, 22 bp, Homo sapiens
tcaggaggtccgcccgggaggg

SEQ ID NO: 7582883 - DNA, 22 bp, Homo sapiens
tcaggaggtccgcccgggaggg

SEQ ID NO: 7582884 - DNA, 22 bp, Homo sapiens
tcaggaggtccgcccgggaggg

SEQ ID NO: 7582885 - DNA, 22 bp, Homo sapiens
tcaggaggtccgcccgggaggg

SEQ ID NO: 7582886 - DNA, 22 bp, Homo sapiens
tcaggaggtccgcccgggaggg

SEQ ID NO: 7582887 - DNA, 22 bp, Homo sapiens
tcaggaggtccgcccgggaggg

SEQ ID NO: 7582888 - DNA, 22 bp, Homo sapiens
tcaggaggtccgcccgggaggg

SEQ ID NO: 7582889 - DNA, 22 bp, Homo sapiens
tcaggaggtaggacatactggt

SEQ ID NO: 7582890 - DNA, 22 bp, Homo sapiens
tcaggaggtaggacatactggt

SEQ ID NO: 7582891 - DNA, 22 bp, Homo sapiens
tcaggaggtaggacatactggt

SEQ ID NO: 7582892 - DNA, 22 bp, Homo sapiens
tcaggaggtaggacatactggt

SEQ ID NO: 7582893 - DNA, 22 bp, Homo sapiens
tcaggaggtaggacatactggt

SEQ ID NO: 7582894 - DNA, 22 bp, Homo sapiens
tcaggaggtccgcccgggaggg

SEQ ID NO: 7582895 - DNA, 22 bp, Homo sapiens
tcaggaggtaggacatactggt

SEQ ID NO: 7582896 - DNA, 22 bp, Homo sapiens
tcaggaggtaaggtaaaacaga

SEQ ID NO: 7582897 - DNA, 22 bp, Homo sapiens
tcaggaggtaaggtaaaacaga

SEQ ID NO: 7582898 - DNA, 22 bp, Homo sapiens
tcaggaggtaaggtaaaacaga

SEQ ID NO: 7582899 - DNA, 22 bp, Homo sapiens
tcaggcagctccaggaatggta

SEQ ID NO: 7582900 - DNA, 22 bp, Homo sapiens
tcaggcagcattaaacttcagc

SEQ ID NO: 7582901 - DNA, 22 bp, Homo sapiens
tcaggcagctccaggaatggta

SEQ ID NO: 7582902 - DNA, 22 bp, Homo sapiens
tcaggcagctccaggaatggta

SEQ ID NO: 7582903 - DNA, 22 bp, Homo sapiens
tcaggcagctccaggaatggta

SEQ ID NO: 7582904 - DNA, 22 bp, Homo sapiens
tcaggcagctccaggaatggta

SEQ ID NO: 7582905 - DNA, 22 bp, Homo sapiens
tcaggcagctccaggaatggta

SEQ ID NO: 7582906 - DNA, 22 bp, Homo sapiens
tcaggcaggaagcccctgcaca

SEQ ID NO: 7582907 - DNA, 22 bp, Homo sapiens
tcaggcaggaagcccctgcaca

SEQ ID NO: 7582908 - DNA, 22 bp, Homo sapiens
tcaggcaggaagcccctgcaca

SEQ ID NO: 7582909 - DNA, 22 bp, Homo sapiens
tcaggcaggaagcccctgcaca

SEQ ID NO: 7582910 - DNA, 22 bp, Homo sapiens
tcaggcagctccaggaatggta

SEQ ID NO: 7582911 - DNA, 23 bp, Homo sapiens
tcaggcagctggggtagttggag

SEQ ID NO: 7582912 - DNA, 23 bp, Homo sapiens
tcaggcagctggggtagttggag

SEQ ID NO: 7582913 - DNA, 22 bp, Homo sapiens
tcaggcagctccaggaatggta

SEQ ID NO: 7582914 - DNA, 23 bp, Homo sapiens
tcaggcagctggggtagttggag

SEQ ID NO: 7582915 - DNA, 22 bp, Homo sapiens
tcaggcagatgcagggatggat

SEQ ID NO: 7582916 - DNA, 22 bp, Homo sapiens
tcaggcagatgcagggatggat

SEQ ID NO: 7582917 - DNA, 22 bp, Homo sapiens
tcaggcagagttaatttgctcc

SEQ ID NO: 7582918 - DNA, 22 bp, Homo sapiens
tcaggcagagttaatttgctcc

SEQ ID NO: 7582919 - DNA, 22 bp, Homo sapiens
tcaggcagagttaatttgctcc

SEQ ID NO: 7582920 - DNA, 22 bp, Homo sapiens
tcaggcagaaaaatcactaatt

SEQ ID NO: 7582921 - DNA, 22 bp, Homo sapiens
tcaggcagaaaaatcactaatt

SEQ ID NO: 7582922 - DNA, 22 bp, Homo sapiens
tcaggcagagttaatttgctcc

SEQ ID NO: 7582923 - DNA, 22 bp, Homo sapiens
tcaggcagagttaatttgctcc

SEQ ID NO: 7582924 - DNA, 22 bp, Homo sapiens
tcaggcactgctttctgatatg

SEQ ID NO: 7582925 - DNA, 22 bp, Homo sapiens
tcaggcaccctctattttcatc

SEQ ID NO: 7582926 - DNA, 22 bp, Homo sapiens
tcaggcagatgcagggatggat

SEQ ID NO: 7582927 - DNA, 22 bp, Homo sapiens
tcaggcagatgcagggatggat

SEQ ID NO: 7582928 - DNA, 22 bp, Homo sapiens
tcaggcagcattaaacttcagc

SEQ ID NO: 7582929 - DNA, 22 bp, Homo sapiens
tcaggcagcattaaacttcagc

SEQ ID NO: 7582930 - DNA, 22 bp, Homo sapiens
tcaggcagcattaaacttcagc

SEQ ID NO: 7582931 - DNA, 22 bp, Homo sapiens
tcaggcagcattaaacttcagc

SEQ ID NO: 7582932 - DNA, 22 bp, Homo sapiens
tcaggcagatgcagggatggat

SEQ ID NO: 7582933 - DNA, 22 bp, Homo sapiens
tcaggcagatgcagggatggat

SEQ ID NO: 7582934 - DNA, 22 bp, Homo sapiens
tcaggcagatgcagggatggat

SEQ ID NO: 7582935 - DNA, 22 bp, Homo sapiens
tcaggcagatgcagggatggat

SEQ ID NO: 7582936 - DNA, 22 bp, Homo sapiens
tcaggcagatgcagggatggat

SEQ ID NO: 7582937 - DNA, 22 bp, Homo sapiens
tcaggcaggcagagggcaaatg

SEQ ID NO: 7582938 - DNA, 22 bp, Homo sapiens
tcaggcaggatcccagggaagg

SEQ ID NO: 7582939 - DNA, 22 bp, Homo sapiens
tcaggcaggcagagggcaaatg

SEQ ID NO: 7582940 - DNA, 22 bp, Homo sapiens
tcaggcaggcagagggcaaatg

SEQ ID NO: 7582941 - DNA, 22 bp, Homo sapiens
tcaggcaggcagagggcaaatg

SEQ ID NO: 7582942 - DNA, 22 bp, Homo sapiens
tcaggcaggcagagggcaaatg

SEQ ID NO: 7582943 - DNA, 22 bp, Homo sapiens
tcaggcaggcagagggcaaatg

SEQ ID NO: 7582944 - DNA, 21 bp, Homo sapiens
tcaggcaggcgcagagggaag

SEQ ID NO: 7582945 - DNA, 21 bp, Homo sapiens
tcaggcaggcgcagagggaag

SEQ ID NO: 7582946 - DNA, 21 bp, Homo sapiens
tcaggcaggcgcagagggaag

SEQ ID NO: 7582947 - DNA, 21 bp, Homo sapiens
tcaggcaggcgcagagggaag

SEQ ID NO: 7582948 - DNA, 21 bp, Homo sapiens
tcaggcaggcgcagagggaag

SEQ ID NO: 7582949 - DNA, 21 bp, Homo sapiens
tcaggcaggcgcagagggaag

SEQ ID NO: 7582950 - DNA, 21 bp, Homo sapiens
tcaggcaggcgcagagggaag

SEQ ID NO: 7582951 - DNA, 21 bp, Homo sapiens
tcaggcaggcgcagagggaag

SEQ ID NO: 7582952 - DNA, 21 bp, Homo sapiens
tcaggcaggcgcagagggaag

SEQ ID NO: 7582953 - DNA, 21 bp, Homo sapiens
tcaggcaggcgcagagggaag

SEQ ID NO: 7582954 - DNA, 21 bp, Homo sapiens
tcaggcaggcgcagagggaag

SEQ ID NO: 7582955 - DNA, 21 bp, Homo sapiens
tcaggcaggcgcagagggaag

SEQ ID NO: 7582956 - DNA, 22 bp, Homo sapiens
tcaggcaggaagggaggacttg

SEQ ID NO: 7582957 - DNA, 22 bp, Homo sapiens
tcaggcaggaagggaggacttg

SEQ ID NO: 7582958 - DNA, 22 bp, Homo sapiens
tcaggcaggaagggaggacttg

SEQ ID NO: 7582959 - DNA, 22 bp, Homo sapiens
tcaggcaggaagggaggacttg

SEQ ID NO: 7582960 - DNA, 22 bp, Homo sapiens
tcaggcaggaagggaggacttg

SEQ ID NO: 7582961 - DNA, 22 bp, Homo sapiens
tcaggcaggaagggaggacttg

SEQ ID NO: 7582962 - DNA, 22 bp, Homo sapiens
tcaggcaggaagggaggacttg

SEQ ID NO: 7582963 - DNA, 22 bp, Homo sapiens
tcaggcaggaagggaggacttg

SEQ ID NO: 7582964 - DNA, 22 bp, Homo sapiens
tcaggcaggaagggaggacttg

SEQ ID NO: 7582965 - DNA, 22 bp, Homo sapiens
tcaggcaggacaattatttagg

SEQ ID NO: 7582966 - DNA, 22 bp, Homo sapiens
tcaggcaggacaattatttagg

SEQ ID NO: 7582967 - DNA, 22 bp, Homo sapiens
tcaggcaggacaattatttagg

SEQ ID NO: 7582968 - DNA, 22 bp, Homo sapiens
tcaggcaggacaattatttagg

SEQ ID NO: 7582969 - DNA, 22 bp, Homo sapiens
tcaggcaggatcccagggaagg

SEQ ID NO: 7582970 - DNA, 22 bp, Homo sapiens
tcaggcaggatcccagggaagg

SEQ ID NO: 7582971 - DNA, 22 bp, Homo sapiens
tcaggcaggatcccagggaagg

SEQ ID NO: 7582972 - DNA, 22 bp, Homo sapiens
tcaggcaggatcccagggaagg

SEQ ID NO: 7582973 - DNA, 22 bp, Homo sapiens
tcaggcaggatcccagggaagg

SEQ ID NO: 7582974 - DNA, 22 bp, Homo sapiens
tcaggcaggatcccagggaagg

SEQ ID NO: 7582975 - DNA, 22 bp, Homo sapiens
tcaggcctttcttcagagcttc

SEQ ID NO: 7582976 - DNA, 22 bp, Homo sapiens
tcaggcagtagaattgcttgaa

SEQ ID NO: 7582977 - DNA, 22 bp, Homo sapiens
tcaggcagtagaattgcttgaa

SEQ ID NO: 7582978 - DNA, 22 bp, Homo sapiens
tcaggcagtagaattgcttgaa

SEQ ID NO: 7582979 - DNA, 22 bp, Homo sapiens
tcaggcagtagaattgcttgaa

SEQ ID NO: 7582980 - DNA, 22 bp, Homo sapiens
tcaggcaggttggctgcaggtc

SEQ ID NO: 7582981 - DNA, 22 bp, Homo sapiens
tcaggcagtagaattgcttgaa

SEQ ID NO: 7582982 - DNA, 22 bp, Homo sapiens
tcaggcaggttggctgcaggtc

SEQ ID NO: 7582983 - DNA, 22 bp, Homo sapiens
tcaggcaggtggctggctatgg

SEQ ID NO: 7582984 - DNA, 22 bp, Homo sapiens
tcaggcaggtggctggctatgg

SEQ ID NO: 7582985 - DNA, 22 bp, Homo sapiens
tcaggcaggttggctgcaggtc

SEQ ID NO: 7582986 - DNA, 22 bp, Homo sapiens
tcaggcaggttggctgcaggtc

SEQ ID NO: 7582987 - DNA, 22 bp, Homo sapiens
tcaggcaggttggctgcaggtc

SEQ ID NO: 7582988 - DNA, 22 bp, Homo sapiens
tcaggcaggttggctgcaggtc

SEQ ID NO: 7582989 - DNA, 22 bp, Homo sapiens
tcaggcaggttggctgcaggtc

SEQ ID NO: 7582990 - DNA, 22 bp, Homo sapiens
tcaggcaggttggctgcaggtc

SEQ ID NO: 7582991 - DNA, 22 bp, Homo sapiens
tcaggcaggttggctgcaggtc

SEQ ID NO: 7582992 - DNA, 22 bp, Homo sapiens
tcaggcaggttggctgcaggtc

SEQ ID NO: 7582993 - DNA, 22 bp, Homo sapiens
tcaggcaggctcagaggaaaac

SEQ ID NO: 7582994 - DNA, 21 bp, Homo sapiens
tcaggcaggcgcagagggaag

SEQ ID NO: 7582995 - DNA, 22 bp, Homo sapiens
tcaggcaggctcagaggaaaac

SEQ ID NO: 7582996 - DNA, 21 bp, Homo sapiens
tcaggcaggcgcagagggaag

SEQ ID NO: 7582997 - DNA, 22 bp, Homo sapiens
tcaggcaggctcagaggaaaac

SEQ ID NO: 7582998 - DNA, 22 bp, Homo sapiens
tcaggcaggctcagaggaaaac

SEQ ID NO: 7582999 - DNA, 22 bp, Homo sapiens
tcaggcaggctcagaggaaaac

SEQ ID NO: 7583000 - DNA, 22 bp, Homo sapiens
tcaggcaggctcagaggaaaac

SEQ ID NO: 7583001 - DNA, 22 bp, Homo sapiens
tcaggcaggctcagaggaaaac

SEQ ID NO: 7583002 - DNA, 22 bp, Homo sapiens
tcaggcaggctcagaggaaaac

SEQ ID NO: 7583003 - DNA, 21 bp, Homo sapiens
tcaggcaggtcccactgaaca

SEQ ID NO: 7583004 - DNA, 21 bp, Homo sapiens
tcaggcaggtcccactgaaca

SEQ ID NO: 7583005 - DNA, 21 bp, Homo sapiens
tcaggcaggtcccactgaaca

SEQ ID NO: 7583006 - DNA, 22 bp, Homo sapiens
tcaggcaggtggctggctatgg

SEQ ID NO: 7583007 - DNA, 22 bp, Homo sapiens
tcaggcaggtggctggctatgg

SEQ ID NO: 7583008 - DNA, 22 bp, Homo sapiens
tcaggcaggtggctggctatgg

SEQ ID NO: 7583009 - DNA, 22 bp, Homo sapiens
tcaggcaggtggctggctatgg

SEQ ID NO: 7583010 - DNA, 22 bp, Homo sapiens
tcaggcaggtggctggctatgg

SEQ ID NO: 7583011 - DNA, 22 bp, Homo sapiens
tcaggcaggtggctggctatgg

SEQ ID NO: 7583012 - DNA, 22 bp, Homo sapiens
tcaggaaagagtaatgtataca

SEQ ID NO: 7583013 - DNA, 22 bp, Homo sapiens
tcagctttctctcgccatcagg

SEQ ID NO: 7583014 - DNA, 22 bp, Homo sapiens
tcagctttctcaaagaagctgg

SEQ ID NO: 7583015 - DNA, 22 bp, Homo sapiens
tcaggaaagagttagatgatta

SEQ ID NO: 7583016 - DNA, 22 bp, Homo sapiens
tcaggaaagagttagatgatta

SEQ ID NO: 7583017 - DNA, 22 bp, Homo sapiens
tcaggaaagagttagatgatta

SEQ ID NO: 7583018 - DNA, 22 bp, Homo sapiens
tcaggaaagagttagatgatta

SEQ ID NO: 7583019 - DNA, 22 bp, Homo sapiens
tcaggaaagagttagatgatta

SEQ ID NO: 7583020 - DNA, 22 bp, Homo sapiens
tcaggaaagagttagatgatta

SEQ ID NO: 7583021 - DNA, 22 bp, Homo sapiens
tcaggaaagagtgtatccatca

SEQ ID NO: 7583022 - DNA, 22 bp, Homo sapiens
tcaggaaagagtgtatccatca

SEQ ID NO: 7583023 - DNA, 22 bp, Homo sapiens
tcaggaaagagtgtatccatca

SEQ ID NO: 7583024 - DNA, 22 bp, Homo sapiens
tcaggaaagagtgtatccatca

SEQ ID NO: 7583025 - DNA, 22 bp, Homo sapiens
tcaggaaagagttagatgatta

SEQ ID NO: 7583026 - DNA, 22 bp, Homo sapiens
tcaggaaaggtttgttgaatgg

SEQ ID NO: 7583027 - DNA, 22 bp, Homo sapiens
tcaggaaaggtttgttgaatgg

SEQ ID NO: 7583028 - DNA, 22 bp, Homo sapiens
tcaggaaaggcagagtgtctgt

SEQ ID NO: 7583029 - DNA, 22 bp, Homo sapiens
tcaggaaaggcagagtgtctgt

SEQ ID NO: 7583030 - DNA, 22 bp, Homo sapiens
tcaggaaaggcagagtgtctgt

SEQ ID NO: 7583031 - DNA, 22 bp, Homo sapiens
tcaggaaaggcagagtgtctgt

SEQ ID NO: 7583032 - DNA, 22 bp, Homo sapiens
tcaggaaagcctagaagagaac

SEQ ID NO: 7583033 - DNA, 22 bp, Homo sapiens
tcaggaaagcctagaagagaac

SEQ ID NO: 7583034 - DNA, 22 bp, Homo sapiens
tcaggaaagctgcggtcacctg

SEQ ID NO: 7583035 - DNA, 22 bp, Homo sapiens
tcaggaaagctgcggtcacctg

SEQ ID NO: 7583036 - DNA, 22 bp, Homo sapiens
tcaggaaagcctagaagagaac

SEQ ID NO: 7583037 - DNA, 22 bp, Homo sapiens
tcaggaaatggaattcttgtgt

SEQ ID NO: 7583038 - DNA, 22 bp, Homo sapiens
tcaggaaatggaattcttgtgt

SEQ ID NO: 7583039 - DNA, 22 bp, Homo sapiens
tcaggaaatggaattcttgtgt

SEQ ID NO: 7583040 - DNA, 22 bp, Homo sapiens
tcaggaaatacaagtgacatca

SEQ ID NO: 7583041 - DNA, 22 bp, Homo sapiens
tcaggaaatggaattcttgtgt

SEQ ID NO: 7583042 - DNA, 22 bp, Homo sapiens
tcaggaaatggaattcttgtgt

SEQ ID NO: 7583043 - DNA, 22 bp, Homo sapiens
tcaggaaatacaagtgacatca

SEQ ID NO: 7583044 - DNA, 22 bp, Homo sapiens
tcaggaaatacaagtgacatca

SEQ ID NO: 7583045 - DNA, 22 bp, Homo sapiens
tcaggaaatacaagtgacatca

SEQ ID NO: 7583046 - DNA, 22 bp, Homo sapiens
tcaggaaagtgttctcagagga

SEQ ID NO: 7583047 - DNA, 22 bp, Homo sapiens
tcaggaaagtgttctcagagga

SEQ ID NO: 7583048 - DNA, 22 bp, Homo sapiens
tcaggaaaggtttgttgaatgg

SEQ ID NO: 7583049 - DNA, 22 bp, Homo sapiens
tcaggaaaggtttgttgaatgg

SEQ ID NO: 7583050 - DNA, 22 bp, Homo sapiens
tcaggaaaggtttgttgaatgg

SEQ ID NO: 7583051 - DNA, 22 bp, Homo sapiens
tcaggaaagtgttctcagagga

SEQ ID NO: 7583052 - DNA, 22 bp, Homo sapiens
tcaggagcagcatgggtgagag

SEQ ID NO: 7583053 - DNA, 22 bp, Homo sapiens
tcaggagcaacatctttgaatc

SEQ ID NO: 7583054 - DNA, 22 bp, Homo sapiens
tcaggagcagcatgggtgagag

SEQ ID NO: 7583055 - DNA, 22 bp, Homo sapiens
tcaggagcagcatgggtgagag

SEQ ID NO: 7583056 - DNA, 22 bp, Homo sapiens
tcaggagcagctgtaggaaggg

SEQ ID NO: 7583057 - DNA, 22 bp, Homo sapiens
tcaggagcagccttggagagcg

SEQ ID NO: 7583058 - DNA, 22 bp, Homo sapiens
tcaggagcagccttggagagcg

SEQ ID NO: 7583059 - DNA, 22 bp, Homo sapiens
tcaggagatggtctttataggc

SEQ ID NO: 7583060 - DNA, 22 bp, Homo sapiens
tcaggagagtgttcagtggagg

SEQ ID NO: 7583061 - DNA, 22 bp, Homo sapiens
tcaggagatgtaaccttagctg

SEQ ID NO: 7583062 - DNA, 22 bp, Homo sapiens
tcaggagatggtctttataggc

SEQ ID NO: 7583063 - DNA, 22 bp, Homo sapiens
tcaggagatggtctttataggc

SEQ ID NO: 7583064 - DNA, 22 bp, Homo sapiens
tcaggagatgtaaccttagctg

SEQ ID NO: 7583065 - DNA, 22 bp, Homo sapiens
tcaggagatgtaaccttagctg

SEQ ID NO: 7583066 - DNA, 22 bp, Homo sapiens
tcaggagcaacatctttgaatc

SEQ ID NO: 7583067 - DNA, 22 bp, Homo sapiens
tcaggagatgtaaccttagctg

SEQ ID NO: 7583068 - DNA, 22 bp, Homo sapiens
tcaggaaatgtcccaggttgtg

SEQ ID NO: 7583069 - DNA, 22 bp, Homo sapiens
tcaggaaatgtcccaggttgtg

SEQ ID NO: 7583070 - DNA, 22 bp, Homo sapiens
tcaggaaatgtcccaggttgtg

SEQ ID NO: 7583071 - DNA, 22 bp, Homo sapiens
tcaggaaattaaacacttgaaa

SEQ ID NO: 7583072 - DNA, 22 bp, Homo sapiens
tcaggaaatggtgatttggttg

SEQ ID NO: 7583073 - DNA, 22 bp, Homo sapiens
tcaggaaattaaacacttgaaa

SEQ ID NO: 7583074 - DNA, 22 bp, Homo sapiens
tcaggaaattaaacacttgaaa

SEQ ID NO: 7583075 - DNA, 22 bp, Homo sapiens
tcaggaacacaggggcccatgc

SEQ ID NO: 7583076 - DNA, 22 bp, Homo sapiens
tcaggagagtgttcagtggagg

SEQ ID NO: 7583077 - DNA, 22 bp, Homo sapiens
tcaggagagtgttcagtggagg

SEQ ID NO: 7583078 - DNA, 22 bp, Homo sapiens
tcaggagagtgttcagtggagg

SEQ ID NO: 7583079 - DNA, 22 bp, Homo sapiens
tcaggaaatggcttcatggttt

SEQ ID NO: 7583080 - DNA, 22 bp, Homo sapiens
tcaggaaatggacatctttgct

SEQ ID NO: 7583081 - DNA, 22 bp, Homo sapiens
tcaggaaatggcttcatggttt

SEQ ID NO: 7583082 - DNA, 22 bp, Homo sapiens
tcaggaaatggtgatttggttg

SEQ ID NO: 7583083 - DNA, 22 bp, Homo sapiens
tcaggaaatggtgatttggttg

SEQ ID NO: 7583084 - DNA, 22 bp, Homo sapiens
tcaggaaatggtgatttggttg

SEQ ID NO: 7583085 - DNA, 22 bp, Homo sapiens
tcaggaaatggaattcttgtgt

SEQ ID NO: 7583086 - DNA, 22 bp, Homo sapiens
tcaggaaatggacatctttgct

SEQ ID NO: 7583087 - DNA, 22 bp, Homo sapiens
tcaggaaatggacatctttgct

SEQ ID NO: 7583088 - DNA, 22 bp, Homo sapiens
tcaggaaatggacatctttgct

SEQ ID NO: 7583089 - DNA, 22 bp, Homo sapiens
tcaggaaatggacatctttgct

SEQ ID NO: 7583090 - DNA, 22 bp, Homo sapiens
tcaggaaatggacatctttgct

SEQ ID NO: 7583091 - DNA, 22 bp, Homo sapiens
tcaggaaatggacatctttgct

SEQ ID NO: 7583092 - DNA, 22 bp, Homo sapiens
tcaggaaatggacatctttgct

SEQ ID NO: 7583093 - DNA, 22 bp, Homo sapiens
tcaggagctgtgaatacaaagg

SEQ ID NO: 7583094 - DNA, 22 bp, Homo sapiens
tcaggagctgtgaatacaaagg

SEQ ID NO: 7583095 - DNA, 22 bp, Homo sapiens
tcaggagcttggtagtgtgatt

SEQ ID NO: 7583096 - DNA, 22 bp, Homo sapiens
tcaggagcttagatgctttgac

SEQ ID NO: 7583097 - DNA, 22 bp, Homo sapiens
tcaggagctgcactgggcccac

SEQ ID NO: 7583098 - DNA, 22 bp, Homo sapiens
tcaggagctgcattatcctgtg

SEQ ID NO: 7583099 - DNA, 22 bp, Homo sapiens
tcaggagctgcattatcctgtg

SEQ ID NO: 7583100 - DNA, 22 bp, Homo sapiens
tcaggagctcaggctgatggaa

SEQ ID NO: 7583101 - DNA, 22 bp, Homo sapiens
tcaggagctatggactgtcaaa

SEQ ID NO: 7583102 - DNA, 22 bp, Homo sapiens
tcaggagctatggactgtcaaa

SEQ ID NO: 7583103 - DNA, 22 bp, Homo sapiens
tcaggagctcaggctgatggaa

SEQ ID NO: 7583104 - DNA, 22 bp, Homo sapiens
tcaggagctcaggctgatggaa

SEQ ID NO: 7583105 - DNA, 22 bp, Homo sapiens
tcaggagctcttccctggtgtg

SEQ ID NO: 7583106 - DNA, 22 bp, Homo sapiens
tcaggagctcttccctggtgtg

SEQ ID NO: 7583107 - DNA, 22 bp, Homo sapiens
tcaggagcagggggaagctctg

SEQ ID NO: 7583108 - DNA, 22 bp, Homo sapiens
tcaggagcagggtctgttacca

SEQ ID NO: 7583109 - DNA, 22 bp, Homo sapiens
tcaggagcagggtctgttacca

SEQ ID NO: 7583110 - DNA, 22 bp, Homo sapiens
tcaggagcagggggaagctctg

SEQ ID NO: 7583111 - DNA, 22 bp, Homo sapiens
tcaggagcagggggaagctctg

SEQ ID NO: 7583112 - DNA, 19 bp, Homo sapiens
tcaggagcagcttctgaac

SEQ ID NO: 7583113 - DNA, 22 bp, Homo sapiens
tcaggagcagggggaagctctg

SEQ ID NO: 7583114 - DNA, 22 bp, Homo sapiens
tcaggagcagctgtaggaaggg

SEQ ID NO: 7583115 - DNA, 20 bp, Homo sapiens
tcaggagcctaggacatgat

SEQ ID NO: 7583116 - DNA, 20 bp, Homo sapiens
tcaggagcctaggacatgat

SEQ ID NO: 7583117 - DNA, 20 bp, Homo sapiens
tcaggagcctaggacatgat

SEQ ID NO: 7583118 - DNA, 22 bp, Homo sapiens
tcaggagcaggttgtttggttt

SEQ ID NO: 7583119 - DNA, 22 bp, Homo sapiens
tcaggagcatatattgatgtct

SEQ ID NO: 7583120 - DNA, 22 bp, Homo sapiens
tcaggagcctgaaagaggtcta

SEQ ID NO: 7583121 - DNA, 22 bp, Homo sapiens
tcaggagcctgaaagaggtcta

SEQ ID NO: 7583122 - DNA, 22 bp, Homo sapiens
tcaggagctatggactgtcaaa

SEQ ID NO: 7583123 - DNA, 22 bp, Homo sapiens
tcaggagcctgaaagaggtcta

SEQ ID NO: 7583124 - DNA, 22 bp, Homo sapiens
tcaggagggattgttgcctatt

SEQ ID NO: 7583125 - DNA, 22 bp, Homo sapiens
tcaggagggattgttgcctatt

SEQ ID NO: 7583126 - DNA, 22 bp, Homo sapiens
tcaggagggattgttgcctatt

SEQ ID NO: 7583127 - DNA, 22 bp, Homo sapiens
tcaggagggattgttgcctatt

SEQ ID NO: 7583128 - DNA, 22 bp, Homo sapiens
tcaggagggagtgtggatagag

SEQ ID NO: 7583129 - DNA, 22 bp, Homo sapiens
tcaggagggagtgtggatagag

SEQ ID NO: 7583130 - DNA, 22 bp, Homo sapiens
tcaggagggctaagactgtagc

SEQ ID NO: 7583131 - DNA, 22 bp, Homo sapiens
tcaggagggctaagactgtagc

SEQ ID NO: 7583132 - DNA, 22 bp, Homo sapiens
tcaggagggctaagactgtagc

SEQ ID NO: 7583133 - DNA, 22 bp, Homo sapiens
tcaggagggtctctattttcct

SEQ ID NO: 7583134 - DNA, 22 bp, Homo sapiens
tcaggagggtctctattttcct

SEQ ID NO: 7583135 - DNA, 22 bp, Homo sapiens
tcaggagggctaagactgtagc

SEQ ID NO: 7583136 - DNA, 22 bp, Homo sapiens
tcaggagggtctctattttcct

SEQ ID NO: 7583137 - DNA, 22 bp, Homo sapiens
tcaggagggctaagactgtagc

SEQ ID NO: 7583138 - DNA, 22 bp, Homo sapiens
tcaggagggtgacaggccctgg

SEQ ID NO: 7583139 - DNA, 22 bp, Homo sapiens
tcaggagggtgacaggccctgg

SEQ ID NO: 7583140 - DNA, 22 bp, Homo sapiens
tcaggagggtgacaggccctgg

SEQ ID NO: 7583141 - DNA, 22 bp, Homo sapiens
tcaggagggtgacaggccctgg

SEQ ID NO: 7583142 - DNA, 22 bp, Homo sapiens
tcaggagggtgacaggccctgg

SEQ ID NO: 7583143 - DNA, 22 bp, Homo sapiens
tcaggagggtgacaggccctgg

SEQ ID NO: 7583144 - DNA, 22 bp, Homo sapiens
tcaggaggatgtcggcaaattt

SEQ ID NO: 7583145 - DNA, 22 bp, Homo sapiens
tcaggaggatgtcggcaaattt

SEQ ID NO: 7583146 - DNA, 22 bp, Homo sapiens
tcaggaggatgtcggcaaattt

SEQ ID NO: 7583147 - DNA, 22 bp, Homo sapiens
tcaggaggatgtcggcaaattt

SEQ ID NO: 7583148 - DNA, 22 bp, Homo sapiens
tcaggaggatgtcggcaaattt

SEQ ID NO: 7583149 - DNA, 22 bp, Homo sapiens
tcaggaggcaagtaggtattga

SEQ ID NO: 7583150 - DNA, 22 bp, Homo sapiens
tcaggaggcaagtaggtattga

SEQ ID NO: 7583151 - DNA, 22 bp, Homo sapiens
tcaggaggcaagtaggtattga

SEQ ID NO: 7583152 - DNA, 22 bp, Homo sapiens
tcaggaggcaagtaggtattga

SEQ ID NO: 7583153 - DNA, 22 bp, Homo sapiens
tcaggagggagtgtggatagag

SEQ ID NO: 7583154 - DNA, 22 bp, Homo sapiens
tcaggagggagtgtggatagag

SEQ ID NO: 7583155 - DNA, 22 bp, Homo sapiens
tcaggaggacagataaggatag

SEQ ID NO: 7583156 - DNA, 22 bp, Homo sapiens
tcaggaggacagataaggatag

SEQ ID NO: 7583157 - DNA, 22 bp, Homo sapiens
tcaggaggacagataaggatag

SEQ ID NO: 7583158 - DNA, 22 bp, Homo sapiens
tcaggaggacagataaggatag

SEQ ID NO: 7583159 - DNA, 22 bp, Homo sapiens
tcaggagcttggtagtgtgatt

SEQ ID NO: 7583160 - DNA, 22 bp, Homo sapiens
tcaggagcttggtagtgtgatt

SEQ ID NO: 7583161 - DNA, 22 bp, Homo sapiens
tcaggagctgtgaatacaaagg

SEQ ID NO: 7583162 - DNA, 22 bp, Homo sapiens
tcaggaggagctcataagtttg

SEQ ID NO: 7583163 - DNA, 22 bp, Homo sapiens
tcaggaggacagataaggatag

SEQ ID NO: 7583164 - DNA, 22 bp, Homo sapiens
tcaggaggagctcataagtttg

SEQ ID NO: 7583165 - DNA, 22 bp, Homo sapiens
tcaggaggagctcataagtttg

SEQ ID NO: 7583166 - DNA, 22 bp, Homo sapiens
tcagctgtaggtatggatgtcc

SEQ ID NO: 7583167 - DNA, 22 bp, Homo sapiens
tcagcctgcgtcatggtgacac

SEQ ID NO: 7583168 - DNA, 22 bp, Homo sapiens
tcagctgtaggtatggatgtcc

SEQ ID NO: 7583169 - DNA, 22 bp, Homo sapiens
tcagctgtaggtatggatgtcc

SEQ ID NO: 7583170 - DNA, 22 bp, Homo sapiens
tcagctgtatcttgctgcactt

SEQ ID NO: 7583171 - DNA, 22 bp, Homo sapiens
tcagctgtatcttgctgcactt

SEQ ID NO: 7583172 - DNA, 22 bp, Homo sapiens
tcagctgtatcagaaatacaat

SEQ ID NO: 7583173 - DNA, 22 bp, Homo sapiens
tcagctgtatcagaaatacaat

SEQ ID NO: 7583174 - DNA, 22 bp, Homo sapiens
tcagctgtccgcagcccacttc

SEQ ID NO: 7583175 - DNA, 22 bp, Homo sapiens
tcagctgtgatccatctatcta

SEQ ID NO: 7583176 - DNA, 22 bp, Homo sapiens
tcagctgtgatccatctatcta

SEQ ID NO: 7583177 - DNA, 22 bp, Homo sapiens
tcagctgtccgcagcccacttc

SEQ ID NO: 7583178 - DNA, 23 bp, Homo sapiens
tcagcctcttaggacttctcacc

SEQ ID NO: 7583179 - DNA, 23 bp, Homo sapiens
tcagcctcttaggacttctcacc

SEQ ID NO: 7583180 - DNA, 23 bp, Homo sapiens
tcagcctcttaggacttctcacc

SEQ ID NO: 7583181 - DNA, 23 bp, Homo sapiens
tcagcctcttaggacttctcacc

SEQ ID NO: 7583182 - DNA, 22 bp, Homo sapiens
tcagcctctctgagtccagacc

SEQ ID NO: 7583183 - DNA, 23 bp, Homo sapiens
tcagcctcttaggacttctcacc

SEQ ID NO: 7583184 - DNA, 22 bp, Homo sapiens
tcagcctgcgtcatggtgacac

SEQ ID NO: 7583185 - DNA, 22 bp, Homo sapiens
tcagctgtgtatcccagggcct

SEQ ID NO: 7583186 - DNA, 22 bp, Homo sapiens
tcagctgtgtatcccagggcct

SEQ ID NO: 7583187 - DNA, 22 bp, Homo sapiens
tcagctgtgtatcccagggcct

SEQ ID NO: 7583188 - DNA, 22 bp, Homo sapiens
tcagctgtgtatcccagggcct

SEQ ID NO: 7583189 - DNA, 22 bp, Homo sapiens
tcagctgttatcactgtctgtc

SEQ ID NO: 7583190 - DNA, 22 bp, Homo sapiens
tcagctgttatcactgtctgtc

SEQ ID NO: 7583191 - DNA, 23 bp, Homo sapiens
tcagctgttcttttccctgggac

SEQ ID NO: 7583192 - DNA, 23 bp, Homo sapiens
tcagctgttcttttccctgggac

SEQ ID NO: 7583193 - DNA, 22 bp, Homo sapiens
tcagctgttttgagtttaattg

SEQ ID NO: 7583194 - DNA, 22 bp, Homo sapiens
tcagcttatatttttagtgtaa

SEQ ID NO: 7583195 - DNA, 22 bp, Homo sapiens
tcagcttcaaatttggtgaagt

SEQ ID NO: 7583196 - DNA, 23 bp, Homo sapiens
tcagcttcattgtcttctatggc

SEQ ID NO: 7583197 - DNA, 18 bp, Homo sapiens
tcagcttccagcatgttt

SEQ ID NO: 7583198 - DNA, 22 bp, Homo sapiens
tcagcttggacagcttggttga

SEQ ID NO: 7583199 - DNA, 22 bp, Homo sapiens
tcagcttgggaaattgagcaag

SEQ ID NO: 7583200 - DNA, 22 bp, Homo sapiens
tcagcttgggaaattgagcaag

SEQ ID NO: 7583201 - DNA, 22 bp, Homo sapiens
tcagcttggacagcttggttga

SEQ ID NO: 7583202 - DNA, 20 bp, Homo sapiens
tcagcttgggtgaagttcat

SEQ ID NO: 7583203 - DNA, 22 bp, Homo sapiens
tcagcttgggggtggcttctca

SEQ ID NO: 7583204 - DNA, 22 bp, Homo sapiens
tcagcttgtttatgataagcag

SEQ ID NO: 7583205 - DNA, 22 bp, Homo sapiens
tcagcttgtgggtcagcctctg

SEQ ID NO: 7583206 - DNA, 22 bp, Homo sapiens
tcagctttccttgctttagatt

SEQ ID NO: 7583207 - DNA, 22 bp, Homo sapiens
tcagctttccttgctttagatt

SEQ ID NO: 7583208 - DNA, 22 bp, Homo sapiens
tcagctttccttgctttagatt

SEQ ID NO: 7583209 - DNA, 22 bp, Homo sapiens
tcagctttccttgctttagatt

SEQ ID NO: 7583210 - DNA, 22 bp, Homo sapiens
tcagctttcctgcagctaaggg

SEQ ID NO: 7583211 - DNA, 22 bp, Homo sapiens
tcagctttccttgctttagatt

SEQ ID NO: 7583212 - DNA, 22 bp, Homo sapiens
tcagctttctatgttgctaaac

SEQ ID NO: 7583213 - DNA, 22 bp, Homo sapiens
tcagctttctatgttgctaaac

SEQ ID NO: 7583214 - DNA, 22 bp, Homo sapiens
tcagctttctcaaagaagctgg

SEQ ID NO: 7583215 - DNA, 22 bp, Homo sapiens
tcagctttctcaaagaagctgg

SEQ ID NO: 7583216 - DNA, 22 bp, Homo sapiens
tcagcttctcaaaatggcttag

SEQ ID NO: 7583217 - DNA, 22 bp, Homo sapiens
tcagcttctcaaaatggcttag

SEQ ID NO: 7583218 - DNA, 22 bp, Homo sapiens
tcagcttccctatctgaccata

SEQ ID NO: 7583219 - DNA, 18 bp, Homo sapiens
tcagcttccagcatgttt

SEQ ID NO: 7583220 - DNA, 22 bp, Homo sapiens
tcagcttcctctgtggttccag

SEQ ID NO: 7583221 - DNA, 21 bp, Homo sapiens
tcagcttgaatctagagatag

SEQ ID NO: 7583222 - DNA, 22 bp, Homo sapiens
tcagcttctttcacttaacatg

SEQ ID NO: 7583223 - DNA, 22 bp, Homo sapiens
tcagcttgatccatccaactat

SEQ ID NO: 7583224 - DNA, 21 bp, Homo sapiens
tcagcttgaatctagagatag

SEQ ID NO: 7583225 - DNA, 21 bp, Homo sapiens
tcagcttgaatctagagatag

SEQ ID NO: 7583226 - DNA, 22 bp, Homo sapiens
tcagcttctccaagtgacatgg

SEQ ID NO: 7583227 - DNA, 22 bp, Homo sapiens
tcagcttctcaaaatggcttag

SEQ ID NO: 7583228 - DNA, 22 bp, Homo sapiens
tcagcttctccaagtgacatgg

SEQ ID NO: 7583229 - DNA, 22 bp, Homo sapiens
tcagcttctccaagtgacatgg

SEQ ID NO: 7583230 - DNA, 22 bp, Homo sapiens
tcagcttctccaagtgacatgg

SEQ ID NO: 7583231 - DNA, 22 bp, Homo sapiens
tcagccagtttgattctatttg

SEQ ID NO: 7583232 - DNA, 22 bp, Homo sapiens
tcagccagtttgattctatttg

SEQ ID NO: 7583233 - DNA, 22 bp, Homo sapiens
tcagccagtttgtttattccgg

SEQ ID NO: 7583234 - DNA, 22 bp, Homo sapiens
tcagccagtttgtttattccgg

SEQ ID NO: 7583235 - DNA, 22 bp, Homo sapiens
tcagccagttgccccagttagt

SEQ ID NO: 7583236 - DNA, 22 bp, Homo sapiens
tcagccagtttgattctatttg

SEQ ID NO: 7583237 - DNA, 22 bp, Homo sapiens
tcagccagttaaggcttagaca

SEQ ID NO: 7583238 - DNA, 22 bp, Homo sapiens
tcagccagttaaggcttagaca

SEQ ID NO: 7583239 - DNA, 22 bp, Homo sapiens
tcagccagttaaggcttagaca

SEQ ID NO: 7583240 - DNA, 22 bp, Homo sapiens
tcagccagttaagtcaagaaat

SEQ ID NO: 7583241 - DNA, 22 bp, Homo sapiens
tcagccagtgtgcacctggagt

SEQ ID NO: 7583242 - DNA, 22 bp, Homo sapiens
tcagccagtgtgcacctggagt

SEQ ID NO: 7583243 - DNA, 22 bp, Homo sapiens
tcagcccaaccctgcacaagga

SEQ ID NO: 7583244 - DNA, 20 bp, Homo sapiens
tcagccattccttacctttc

SEQ ID NO: 7583245 - DNA, 20 bp, Homo sapiens
tcagccattccttacctttc

SEQ ID NO: 7583246 - DNA, 23 bp, Homo sapiens
tcagccatgcagccgggaagtgg

SEQ ID NO: 7583247 - DNA, 22 bp, Homo sapiens
tcagccatggtgagagtgagag

SEQ ID NO: 7583248 - DNA, 22 bp, Homo sapiens
tcagccatgtcaggggaatgac

SEQ ID NO: 7583249 - DNA, 20 bp, Homo sapiens
tcagccattccttacctttc

SEQ ID NO: 7583250 - DNA, 20 bp, Homo sapiens
tcagccattccttacctttc

SEQ ID NO: 7583251 - DNA, 20 bp, Homo sapiens
tcagccattccttacctttc

SEQ ID NO: 7583252 - DNA, 22 bp, Homo sapiens
tcagcccagaccacctcattgc

SEQ ID NO: 7583253 - DNA, 22 bp, Homo sapiens
tcagcccaccttcaggggagtt

SEQ ID NO: 7583254 - DNA, 22 bp, Homo sapiens
tcagcccacctggtgtggggct

SEQ ID NO: 7583255 - DNA, 22 bp, Homo sapiens
tcagcccacctggtgtggggct

SEQ ID NO: 7583256 - DNA, 22 bp, Homo sapiens
tcagcccacctggtgtggggct

SEQ ID NO: 7583257 - DNA, 23 bp, Homo sapiens
tcagcccacatctagtcattagc

SEQ ID NO: 7583258 - DNA, 22 bp, Homo sapiens
tcagcccaaccctgcacaagga

SEQ ID NO: 7583259 - DNA, 22 bp, Homo sapiens
tcagcctccgaaagtgctggga

SEQ ID NO: 7583260 - DNA, 22 bp, Homo sapiens
tcagcctcattttctgctctgt

SEQ ID NO: 7583261 - DNA, 22 bp, Homo sapiens
tcagcctcattttctgctctgt

SEQ ID NO: 7583262 - DNA, 22 bp, Homo sapiens
tcagcctcctaatttcctgtga

SEQ ID NO: 7583263 - DNA, 22 bp, Homo sapiens
tcagcctcctaatttcctgtga

SEQ ID NO: 7583264 - DNA, 22 bp, Homo sapiens
tcagcctccgaaagtgctggga

SEQ ID NO: 7583265 - DNA, 22 bp, Homo sapiens
tcagcctccgaaagtgctggga

SEQ ID NO: 7583266 - DNA, 22 bp, Homo sapiens
tcagcctccgaaagtgctggga

SEQ ID NO: 7583267 - DNA, 22 bp, Homo sapiens
tcagcctctctgagtccagacc

SEQ ID NO: 7583268 - DNA, 22 bp, Homo sapiens
tcagcctctctgagtccagacc

SEQ ID NO: 7583269 - DNA, 23 bp, Homo sapiens
tcagcctcttaggacttctcacc

SEQ ID NO: 7583270 - DNA, 22 bp, Homo sapiens
tcagcctcctaatttcctgtga

SEQ ID NO: 7583271 - DNA, 22 bp, Homo sapiens
tcagcctcattttctgctctgt

SEQ ID NO: 7583272 - DNA, 22 bp, Homo sapiens
tcagcctcattttctgctctgt

SEQ ID NO: 7583273 - DNA, 22 bp, Homo sapiens
tcagcctcattttctgctctgt

SEQ ID NO: 7583274 - DNA, 22 bp, Homo sapiens
tcagcctcattttctgctctgt

SEQ ID NO: 7583275 - DNA, 22 bp, Homo sapiens
tcagcctcaggtgttcagattt

SEQ ID NO: 7583276 - DNA, 22 bp, Homo sapiens
tcagcccttgatgtttgggggt

SEQ ID NO: 7583277 - DNA, 22 bp, Homo sapiens
tcagcccttgatgtttgggggt

SEQ ID NO: 7583278 - DNA, 22 bp, Homo sapiens
tcagcctcaggtgttcagattt

SEQ ID NO: 7583279 - DNA, 22 bp, Homo sapiens
tcagcctcaggtgttcagattt

SEQ ID NO: 7583280 - DNA, 22 bp, Homo sapiens
tcagcccttcctggagctttta

SEQ ID NO: 7583281 - DNA, 22 bp, Homo sapiens
tcagcccttgatgtttgggggt

SEQ ID NO: 7583282 - DNA, 22 bp, Homo sapiens
tcagcccaggaatgagccttct

SEQ ID NO: 7583283 - DNA, 22 bp, Homo sapiens
tcagcccttcctggagctttta

SEQ ID NO: 7583284 - DNA, 22 bp, Homo sapiens
tcagcccagcccagcaagtgca

SEQ ID NO: 7583285 - DNA, 22 bp, Homo sapiens
tcagcccagcccagcaagtgca

SEQ ID NO: 7583286 - DNA, 22 bp, Homo sapiens
tcagcccagcccagcaagtgca

SEQ ID NO: 7583287 - DNA, 18 bp, Homo sapiens
tcagcccagagcccagtt

SEQ ID NO: 7583288 - DNA, 22 bp, Homo sapiens
tcagagtctgtgcattctgcta

SEQ ID NO: 7583289 - DNA, 22 bp, Homo sapiens
tcagagtcttaactattcagag

SEQ ID NO: 7583290 - DNA, 22 bp, Homo sapiens
tcagagtctcccccagtttggg

SEQ ID NO: 7583291 - DNA, 22 bp, Homo sapiens
tcagagtcttggcaataggtta

SEQ ID NO: 7583292 - DNA, 22 bp, Homo sapiens
tcagagtcttggcaataggtta

SEQ ID NO: 7583293 - DNA, 22 bp, Homo sapiens
tcagagtgaggcccagcaatct

SEQ ID NO: 7583294 - DNA, 22 bp, Homo sapiens
tcagagtgaggcgtcaacatga

SEQ ID NO: 7583295 - DNA, 22 bp, Homo sapiens
tcagagtgaggcccagcaatct

SEQ ID NO: 7583296 - DNA, 22 bp, Homo sapiens
tcagagtgaccttacatggtct

SEQ ID NO: 7583297 - DNA, 22 bp, Homo sapiens
tcagagtcctcaccctgaggat

SEQ ID NO: 7583298 - DNA, 22 bp, Homo sapiens
tcagagtcctttggcctgacag

SEQ ID NO: 7583299 - DNA, 22 bp, Homo sapiens
tcagagtcctttggcctgacag

SEQ ID NO: 7583300 - DNA, 22 bp, Homo sapiens
tcagagtccatggtacttaatt

SEQ ID NO: 7583301 - DNA, 22 bp, Homo sapiens
tcagagtcctcaccctgaggat

SEQ ID NO: 7583302 - DNA, 21 bp, Homo sapiens
tcagagtctcaggagcaaggg

SEQ ID NO: 7583303 - DNA, 21 bp, Homo sapiens
tcagagtctcaggagcaaggg

SEQ ID NO: 7583304 - DNA, 22 bp, Homo sapiens
tcagagtctatgcaacagaatt

SEQ ID NO: 7583305 - DNA, 21 bp, Homo sapiens
tcagagtctcaggagcaaggg

SEQ ID NO: 7583306 - DNA, 21 bp, Homo sapiens
tcagagtctcaggagcaaggg

SEQ ID NO: 7583307 - DNA, 22 bp, Homo sapiens
tcagagtcattgcaagtagaag

SEQ ID NO: 7583308 - DNA, 22 bp, Homo sapiens
tcagagtcattgcaagtagaag

SEQ ID NO: 7583309 - DNA, 22 bp, Homo sapiens
tcagagtcaactgttgcctgtt

SEQ ID NO: 7583310 - DNA, 22 bp, Homo sapiens
tcagagtcaggaatgcttgatt

SEQ ID NO: 7583311 - DNA, 20 bp, Homo sapiens
tcagagtcatcaaagatggt

SEQ ID NO: 7583312 - DNA, 22 bp, Homo sapiens
tcagagtatttcattcttaggt

SEQ ID NO: 7583313 - DNA, 22 bp, Homo sapiens
tcagagtcaactgttgcctgtt

SEQ ID NO: 7583314 - DNA, 22 bp, Homo sapiens
tcagagtcaactgttgcctgtt

SEQ ID NO: 7583315 - DNA, 22 bp, Homo sapiens
tcagaggttccggccataacca

SEQ ID NO: 7583316 - DNA, 23 bp, Homo sapiens
tcagagtagcaatttttctctcc

SEQ ID NO: 7583317 - DNA, 22 bp, Homo sapiens
tcagaggtggtaaaggacagca

SEQ ID NO: 7583318 - DNA, 22 bp, Homo sapiens
tcagaggttacccatgggacag

SEQ ID NO: 7583319 - DNA, 22 bp, Homo sapiens
tcagaggtggcccctgccctca

SEQ ID NO: 7583320 - DNA, 22 bp, Homo sapiens
tcagaggtggtaaaggacagca

SEQ ID NO: 7583321 - DNA, 22 bp, Homo sapiens
tcagaggttcttctcagtggcc

SEQ ID NO: 7583322 - DNA, 22 bp, Homo sapiens
tcagaggttcttctcagtggcc

SEQ ID NO: 7583323 - DNA, 22 bp, Homo sapiens
tcagaggttcttctcagtggcc

SEQ ID NO: 7583324 - DNA, 22 bp, Homo sapiens
tcagaggttcttctcagtggcc

SEQ ID NO: 7583325 - DNA, 22 bp, Homo sapiens
tcagccaggccctaagagattg

SEQ ID NO: 7583326 - DNA, 22 bp, Homo sapiens
tcagccaggccctaagagattg

SEQ ID NO: 7583327 - DNA, 22 bp, Homo sapiens
tcagccaggccaggcattcaca

SEQ ID NO: 7583328 - DNA, 22 bp, Homo sapiens
tcagccaggccaggcattcaca

SEQ ID NO: 7583329 - DNA, 22 bp, Homo sapiens
tcagccaggccaggcattcaca

SEQ ID NO: 7583330 - DNA, 22 bp, Homo sapiens
tcagagtgcagggagtagcagc

SEQ ID NO: 7583331 - DNA, 22 bp, Homo sapiens
tcagagtgcagggagtagcagc

SEQ ID NO: 7583332 - DNA, 22 bp, Homo sapiens
tcagccagggcagagcaggtga

SEQ ID NO: 7583333 - DNA, 22 bp, Homo sapiens
tcagccagggcagagcaggtga

SEQ ID NO: 7583334 - DNA, 22 bp, Homo sapiens
tcagccagggcagagcaggtga

SEQ ID NO: 7583335 - DNA, 22 bp, Homo sapiens
tcagccagggcagagcaggtga

SEQ ID NO: 7583336 - DNA, 22 bp, Homo sapiens
tcagccagggcagagcaggtga

SEQ ID NO: 7583337 - DNA, 22 bp, Homo sapiens
tcagccagggctctggcctcag

SEQ ID NO: 7583338 - DNA, 22 bp, Homo sapiens
tcagccagggctctggcctcag

SEQ ID NO: 7583339 - DNA, 22 bp, Homo sapiens
tcagccagtgccttgatcttgc

SEQ ID NO: 7583340 - DNA, 22 bp, Homo sapiens
tcagccagtgccttgatcttgc

SEQ ID NO: 7583341 - DNA, 22 bp, Homo sapiens
tcagccagtgccttgatcttgc

SEQ ID NO: 7583342 - DNA, 22 bp, Homo sapiens
tcagccagtgccttgatcttgc

SEQ ID NO: 7583343 - DNA, 22 bp, Homo sapiens
tcagccagtatttgagtgctca

SEQ ID NO: 7583344 - DNA, 22 bp, Homo sapiens
tcagccagtatttgagtgctca

SEQ ID NO: 7583345 - DNA, 22 bp, Homo sapiens
tcagccagtatttgagtgctca

SEQ ID NO: 7583346 - DNA, 22 bp, Homo sapiens
tcagccaggtaatgtggagatg

SEQ ID NO: 7583347 - DNA, 22 bp, Homo sapiens
tcagccaggtaatgtggagatg

SEQ ID NO: 7583348 - DNA, 22 bp, Homo sapiens
tcagccagggggagagaatgga

SEQ ID NO: 7583349 - DNA, 22 bp, Homo sapiens
tcagccagggggagagaatgga

SEQ ID NO: 7583350 - DNA, 21 bp, Homo sapiens
tcagaggctgggggaatgccc

SEQ ID NO: 7583351 - DNA, 21 bp, Homo sapiens
tcagaggctgggggaatgccc

SEQ ID NO: 7583352 - DNA, 22 bp, Homo sapiens
tcagaggctggaagagcctcct

SEQ ID NO: 7583353 - DNA, 22 bp, Homo sapiens
tcagaggctggaagagcctcct

SEQ ID NO: 7583354 - DNA, 22 bp, Homo sapiens
tcagaggctggaagagcctcct

SEQ ID NO: 7583355 - DNA, 20 bp, Homo sapiens
tcagaggctgccagctgggg

SEQ ID NO: 7583356 - DNA, 22 bp, Homo sapiens
tcagaggcttctgctcacctca

SEQ ID NO: 7583357 - DNA, 22 bp, Homo sapiens
tcagaggcttctgctcacctca

SEQ ID NO: 7583358 - DNA, 22 bp, Homo sapiens
tcagaggcttctgctcacctca

SEQ ID NO: 7583359 - DNA, 22 bp, Homo sapiens
tcagaggcttccttcctcggag

SEQ ID NO: 7583360 - DNA, 22 bp, Homo sapiens
tcagaggcttccttcctcggag

SEQ ID NO: 7583361 - DNA, 22 bp, Homo sapiens
tcagaggcttctggccagtctg

SEQ ID NO: 7583362 - DNA, 22 bp, Homo sapiens
tcagaggcttctggccagtctg

SEQ ID NO: 7583363 - DNA, 22 bp, Homo sapiens
tcagaggcttctggccagtctg

SEQ ID NO: 7583364 - DNA, 22 bp, Homo sapiens
tcagaggcttctggccagtctg

SEQ ID NO: 7583365 - DNA, 22 bp, Homo sapiens
tcagaggcttgaagcccaagcc

SEQ ID NO: 7583366 - DNA, 22 bp, Homo sapiens
tcagaggcttgaagcccaagcc

SEQ ID NO: 7583367 - DNA, 22 bp, Homo sapiens
tcagaggcttgaagcccaagcc

SEQ ID NO: 7583368 - DNA, 22 bp, Homo sapiens
tcagaggcttctggccagtctg

SEQ ID NO: 7583369 - DNA, 22 bp, Homo sapiens
tcagaggctttcaatgtgtttt

SEQ ID NO: 7583370 - DNA, 17 bp, Homo sapiens
tcagagggatgagcagg

SEQ ID NO: 7583371 - DNA, 17 bp, Homo sapiens
tcagagggatgagcagg

SEQ ID NO: 7583372 - DNA, 17 bp, Homo sapiens
tcagagggatgagcagg

SEQ ID NO: 7583373 - DNA, 21 bp, Homo sapiens
tcagagggccctggaggctca

SEQ ID NO: 7583374 - DNA, 22 bp, Homo sapiens
tcagagggtggctgggagcatc

SEQ ID NO: 7583375 - DNA, 22 bp, Homo sapiens
tcagagggcttatgatatattg

SEQ ID NO: 7583376 - DNA, 21 bp, Homo sapiens
tcagagggccctggaggctca

SEQ ID NO: 7583377 - DNA, 17 bp, Homo sapiens
tcagagggatgagcagg

SEQ ID NO: 7583378 - DNA, 21 bp, Homo sapiens
tcagagggccctggaggctca

SEQ ID NO: 7583379 - DNA, 17 bp, Homo sapiens
tcagagggatgagcagg

SEQ ID NO: 7583380 - DNA, 17 bp, Homo sapiens
tcagagggatgagcagg

SEQ ID NO: 7583381 - DNA, 22 bp, Homo sapiens
tcagaggtgagcttcttgctaa

SEQ ID NO: 7583382 - DNA, 22 bp, Homo sapiens
tcagaggtgcaagaagttctga

SEQ ID NO: 7583383 - DNA, 22 bp, Homo sapiens
tcagaggtgagcttcttgctaa

SEQ ID NO: 7583384 - DNA, 22 bp, Homo sapiens
tcagaggtcagcagcttgccca

SEQ ID NO: 7583385 - DNA, 22 bp, Homo sapiens
tcagaggtccctagcaggagtg

SEQ ID NO: 7583386 - DNA, 22 bp, Homo sapiens
tcagaggtccctagcaggagtg

SEQ ID NO: 7583387 - DNA, 22 bp, Homo sapiens
tcagaggtgagcatgtgaccaa

SEQ ID NO: 7583388 - DNA, 22 bp, Homo sapiens
tcagaggtgagcatgtgaccaa

SEQ ID NO: 7583389 - DNA, 22 bp, Homo sapiens
tcagaggtggcaggggtgtcca

SEQ ID NO: 7583390 - DNA, 22 bp, Homo sapiens
tcagaggtggcaggggtgtcca

SEQ ID NO: 7583391 - DNA, 22 bp, Homo sapiens
tcagaggtggcaggggtgtcca

SEQ ID NO: 7583392 - DNA, 22 bp, Homo sapiens
tcagaggtgcaagaagttctga

SEQ ID NO: 7583393 - DNA, 22 bp, Homo sapiens
tcagaggtggagatagttggga

SEQ ID NO: 7583394 - DNA, 22 bp, Homo sapiens
tcagaggtgcaagaagttctga

SEQ ID NO: 7583395 - DNA, 22 bp, Homo sapiens
tcagaggtggtaaaggacagca

SEQ ID NO: 7583396 - DNA, 22 bp, Homo sapiens
tcagaggtggtaaaggacagca

SEQ ID NO: 7583397 - DNA, 22 bp, Homo sapiens
tcagaggtggcaggggtgtcca

SEQ ID NO: 7583398 - DNA, 22 bp, Homo sapiens
tcagaggtcagcagcttgccca

SEQ ID NO: 7583399 - DNA, 22 bp, Homo sapiens
tcagaggtccctagcaggagtg

SEQ ID NO: 7583400 - DNA, 22 bp, Homo sapiens
tcagaggtccctagcaggagtg

SEQ ID NO: 7583401 - DNA, 22 bp, Homo sapiens
tcagaggtcacacagcaagttt

SEQ ID NO: 7583402 - DNA, 22 bp, Homo sapiens
tcagaggtcacacagcaagttt

SEQ ID NO: 7583403 - DNA, 22 bp, Homo sapiens
tcagaggtaagggctgagagga

SEQ ID NO: 7583404 - DNA, 22 bp, Homo sapiens
tcagaggtcacacagcaagttt

SEQ ID NO: 7583405 - DNA, 22 bp, Homo sapiens
tcagaggtcacacagcaagttt

SEQ ID NO: 7583406 - DNA, 22 bp, Homo sapiens
tcagaggtagtagcagagttga

SEQ ID NO: 7583407 - DNA, 22 bp, Homo sapiens
tcagaggtagtagcagagttga

SEQ ID NO: 7583408 - DNA, 22 bp, Homo sapiens
tcagaggtagtagcagagttga

SEQ ID NO: 7583409 - DNA, 22 bp, Homo sapiens
tcagagggtggctgggagcatc

SEQ ID NO: 7583410 - DNA, 22 bp, Homo sapiens
tcagagggtggctgggagcatc

SEQ ID NO: 7583411 - DNA, 22 bp, Homo sapiens
tcagaggtaaaaactcactgta

SEQ ID NO: 7583412 - DNA, 22 bp, Homo sapiens
tcagaggtaaaaactcactgta

SEQ ID NO: 7583413 - DNA, 22 bp, Homo sapiens
tcagaggtaagggctgagagga

SEQ ID NO: 7583414 - DNA, 22 bp, Homo sapiens
tcagaggtaagggctgagagga

SEQ ID NO: 7583415 - DNA, 18 bp, Homo sapiens
tcagaggtacagaaaagt

SEQ ID NO: 7583416 - DNA, 18 bp, Homo sapiens
tcagaggtacagaaaagt

SEQ ID NO: 7583417 - DNA, 18 bp, Homo sapiens
tcagaggtacagaaaagt

SEQ ID NO: 7583418 - DNA, 22 bp, Homo sapiens
tcactggggccatgtgagggac

SEQ ID NO: 7583419 - DNA, 22 bp, Homo sapiens
tcactggggccatgtgagggac

SEQ ID NO: 7583420 - DNA, 22 bp, Homo sapiens
tcactggggccatgtgagggac

SEQ ID NO: 7583421 - DNA, 22 bp, Homo sapiens
tcactggggccatgtgagggac

SEQ ID NO: 7583422 - DNA, 17 bp, Homo sapiens
tcactgggcctgctccc

SEQ ID NO: 7583423 - DNA, 22 bp, Homo sapiens
tcactggggagcactgacatgt

SEQ ID NO: 7583424 - DNA, 22 bp, Homo sapiens
tcactggggagcactgacatgt

SEQ ID NO: 7583425 - DNA, 22 bp, Homo sapiens
tcactggggagcactgacatgt

SEQ ID NO: 7583426 - DNA, 22 bp, Homo sapiens
tcactgggagatgtgggaaggg

SEQ ID NO: 7583427 - DNA, 22 bp, Homo sapiens
tcactgggcatcggagctgaaa

SEQ ID NO: 7583428 - DNA, 22 bp, Homo sapiens
tcactgggccctgaggtgggac

SEQ ID NO: 7583429 - DNA, 17 bp, Homo sapiens
tcactgggcctgctccc

SEQ ID NO: 7583430 - DNA, 17 bp, Homo sapiens
tcactgggcctgctccc

SEQ ID NO: 7583431 - DNA, 22 bp, Homo sapiens
tcactggcaacttgtgctccct

SEQ ID NO: 7583432 - DNA, 22 bp, Homo sapiens
tcactggcaacttgtgctccct

SEQ ID NO: 7583433 - DNA, 20 bp, Homo sapiens
tcactggccagagtagccct

SEQ ID NO: 7583434 - DNA, 22 bp, Homo sapiens
tcactggcaacttgtgctccct

SEQ ID NO: 7583435 - DNA, 22 bp, Homo sapiens
tcactggcaacttgtgctccct

SEQ ID NO: 7583436 - DNA, 22 bp, Homo sapiens
tcactggagaaaagtaatgtat

SEQ ID NO: 7583437 - DNA, 21 bp, Homo sapiens
tcactggacgtgagccagggg

SEQ ID NO: 7583438 - DNA, 22 bp, Homo sapiens
tcactggatcctagctgagcct

SEQ ID NO: 7583439 - DNA, 22 bp, Homo sapiens
tcactggatcctagctgagcct

SEQ ID NO: 7583440 - DNA, 22 bp, Homo sapiens
tcactggattaagcattgacat

SEQ ID NO: 7583441 - DNA, 22 bp, Homo sapiens
tcactggattaagcattgacat

SEQ ID NO: 7583442 - DNA, 22 bp, Homo sapiens
tcactgggagagctgacaagga

SEQ ID NO: 7583443 - DNA, 22 bp, Homo sapiens
tcactgggagagctgacaagga

SEQ ID NO: 7583444 - DNA, 22 bp, Homo sapiens
tcactgggagagctgacaagga

SEQ ID NO: 7583445 - DNA, 18 bp, Homo sapiens
tcactgggagaagatatt

SEQ ID NO: 7583446 - DNA, 18 bp, Homo sapiens
tcactgggagaagatatt

SEQ ID NO: 7583447 - DNA, 20 bp, Homo sapiens
tcactggccagagtagccct

SEQ ID NO: 7583448 - DNA, 22 bp, Homo sapiens
tcactgggagagctgacaagga

SEQ ID NO: 7583449 - DNA, 22 bp, Homo sapiens
tcactacaacctccgcctcctg

SEQ ID NO: 7583450 - DNA, 22 bp, Homo sapiens
tcactacaaccgctacctgaca

SEQ ID NO: 7583451 - DNA, 22 bp, Homo sapiens
tcactaatgattttgaaagaag

SEQ ID NO: 7583452 - DNA, 22 bp, Homo sapiens
tcactaatgattttgaaagaag

SEQ ID NO: 7583453 - DNA, 22 bp, Homo sapiens
tcactaatgagctaaggaaaag

SEQ ID NO: 7583454 - DNA, 22 bp, Homo sapiens
tcactaatgagctaaggaaaag

SEQ ID NO: 7583455 - DNA, 22 bp, Homo sapiens
tcactaatgagctaaggaaaag

SEQ ID NO: 7583456 - DNA, 22 bp, Homo sapiens
tcactaatagggggagcatagg

SEQ ID NO: 7583457 - DNA, 22 bp, Homo sapiens
tcactaagtgccgagtttagtt

SEQ ID NO: 7583458 - DNA, 22 bp, Homo sapiens
tcactaagttacatttagtatt

SEQ ID NO: 7583459 - DNA, 22 bp, Homo sapiens
tcacgttttactgagtgagata

SEQ ID NO: 7583460 - DNA, 22 bp, Homo sapiens
tcacgttttactgagtgagata

SEQ ID NO: 7583461 - DNA, 22 bp, Homo sapiens
tcacgttaatatttgtcaggta

SEQ ID NO: 7583462 - DNA, 21 bp, Homo sapiens
tcacgtggtcacatgagcttt

SEQ ID NO: 7583463 - DNA, 21 bp, Homo sapiens
tcacgtggtcacatgagcttt

SEQ ID NO: 7583464 - DNA, 23 bp, Homo sapiens
tcactaaagtgtttagtgcagat

SEQ ID NO: 7583465 - DNA, 22 bp, Homo sapiens
tcactaaagttggagaagagct

SEQ ID NO: 7583466 - DNA, 22 bp, Homo sapiens
tcactaaagttggagaagagct

SEQ ID NO: 7583467 - DNA, 22 bp, Homo sapiens
tcactaaagttggagaagagct

SEQ ID NO: 7583468 - DNA, 22 bp, Homo sapiens
tcactaaagttggagaagagct

SEQ ID NO: 7583469 - DNA, 22 bp, Homo sapiens
tcactaagtgccgagtttagtt

SEQ ID NO: 7583470 - DNA, 21 bp, Homo sapiens
tcactggaatacaattgattt

SEQ ID NO: 7583471 - DNA, 21 bp, Homo sapiens
tcactggaatacaattgattt

SEQ ID NO: 7583472 - DNA, 21 bp, Homo sapiens
tcactggacgtgagccagggg

SEQ ID NO: 7583473 - DNA, 21 bp, Homo sapiens
tcactggacgtgagccagggg

SEQ ID NO: 7583474 - DNA, 21 bp, Homo sapiens
tcactggacgtgagccagggg

SEQ ID NO: 7583475 - DNA, 22 bp, Homo sapiens
tcactggaaatgcacagctgta

SEQ ID NO: 7583476 - DNA, 22 bp, Homo sapiens
tcactgctttgtttacaactat

SEQ ID NO: 7583477 - DNA, 22 bp, Homo sapiens
tcactgctttgagccactgagc

SEQ ID NO: 7583478 - DNA, 22 bp, Homo sapiens
tcactggaaatgcacagctgta

SEQ ID NO: 7583479 - DNA, 22 bp, Homo sapiens
tcactggaaatgcacagctgta

SEQ ID NO: 7583480 - DNA, 22 bp, Homo sapiens
tcactgctttgtttacaactat

SEQ ID NO: 7583481 - DNA, 22 bp, Homo sapiens
tcactacaacctccgcctcctg

SEQ ID NO: 7583482 - DNA, 22 bp, Homo sapiens
tcactacaacctccgcctcctg

SEQ ID NO: 7583483 - DNA, 22 bp, Homo sapiens
tcactacaacctccgcctcctg

SEQ ID NO: 7583484 - DNA, 22 bp, Homo sapiens
tcactacaacctccgcctcctg

SEQ ID NO: 7583485 - DNA, 22 bp, Homo sapiens
tcactgcttcttggagaatgtc

SEQ ID NO: 7583486 - DNA, 22 bp, Homo sapiens
tcactgctttcaaaaattattg

SEQ ID NO: 7583487 - DNA, 22 bp, Homo sapiens
tcactgctttcaaaaattattg

SEQ ID NO: 7583488 - DNA, 22 bp, Homo sapiens
tcactgctttgagccactgagc

SEQ ID NO: 7583489 - DNA, 22 bp, Homo sapiens
tcactgctttgagccactgagc

SEQ ID NO: 7583490 - DNA, 22 bp, Homo sapiens
tcactgctttgagccactgagc

SEQ ID NO: 7583491 - DNA, 22 bp, Homo sapiens
tcagaacatcccagatagtaga

SEQ ID NO: 7583492 - DNA, 22 bp, Homo sapiens
tcagaacatcccagatagtaga

SEQ ID NO: 7583493 - DNA, 22 bp, Homo sapiens
tcagaacatcccagatagtaga

SEQ ID NO: 7583494 - DNA, 22 bp, Homo sapiens
tcagaacatcctggtttaaaat

SEQ ID NO: 7583495 - DNA, 22 bp, Homo sapiens
tcagaacatcctggtttaaaat

SEQ ID NO: 7583496 - DNA, 23 bp, Homo sapiens
tcagaacagttcttggtgcatag

SEQ ID NO: 7583497 - DNA, 23 bp, Homo sapiens
tcagaacagttcttggtgcatag

SEQ ID NO: 7583498 - DNA, 22 bp, Homo sapiens
tcagaacatatattttgtgatg

SEQ ID NO: 7583499 - DNA, 22 bp, Homo sapiens
tcagaacatatattttgtgatg

SEQ ID NO: 7583500 - DNA, 22 bp, Homo sapiens
tcagaacatatattttgtgatg

SEQ ID NO: 7583501 - DNA, 23 bp, Homo sapiens
tcagaacagttcttggtgcatag

SEQ ID NO: 7583502 - DNA, 23 bp, Homo sapiens
tcagaacagttcttggtgcatag

SEQ ID NO: 7583503 - DNA, 22 bp, Homo sapiens
tcagaacagttcttaatattgc

SEQ ID NO: 7583504 - DNA, 22 bp, Homo sapiens
tcagaacagttcttaatattgc

SEQ ID NO: 7583505 - DNA, 22 bp, Homo sapiens
tcagaacagttcttaatattgc

SEQ ID NO: 7583506 - DNA, 22 bp, Homo sapiens
tcagaacagttcttaatattgc

SEQ ID NO: 7583507 - DNA, 22 bp, Homo sapiens
tcagaacagtgcctggcactaa

SEQ ID NO: 7583508 - DNA, 22 bp, Homo sapiens
tcagaacagtgcctggcactaa

SEQ ID NO: 7583509 - DNA, 20 bp, Homo sapiens
tcagaacagtagaggagcta

SEQ ID NO: 7583510 - DNA, 20 bp, Homo sapiens
tcagaacagtagaggagcta

SEQ ID NO: 7583511 - DNA, 22 bp, Homo sapiens
tcactgtgcacatatgataggt

SEQ ID NO: 7583512 - DNA, 22 bp, Homo sapiens
tcactgtgaatgttatcatctt

SEQ ID NO: 7583513 - DNA, 22 bp, Homo sapiens
tcactgtgattctgtatggatt

SEQ ID NO: 7583514 - DNA, 23 bp, Homo sapiens
tcactgtcctgctcctggaacgc

SEQ ID NO: 7583515 - DNA, 22 bp, Homo sapiens
tcactgtcttttaaggtggtta

SEQ ID NO: 7583516 - DNA, 22 bp, Homo sapiens
tcactgtgaatgttatcatctt

SEQ ID NO: 7583517 - DNA, 22 bp, Homo sapiens
tcactgtgaatgttatcatctt

SEQ ID NO: 7583518 - DNA, 22 bp, Homo sapiens
tcactgtgattctgtatggatt

SEQ ID NO: 7583519 - DNA, 21 bp, Homo sapiens
tcactgtgcaaatgttgatgg

SEQ ID NO: 7583520 - DNA, 21 bp, Homo sapiens
tcactgtgcaaatgttgatgg

SEQ ID NO: 7583521 - DNA, 21 bp, Homo sapiens
tcactgtgcaaatgttgatgg

SEQ ID NO: 7583522 - DNA, 22 bp, Homo sapiens
tcactgtgcacatatgataggt

SEQ ID NO: 7583523 - DNA, 22 bp, Homo sapiens
tcactgtatttggaagggatgg

SEQ ID NO: 7583524 - DNA, 22 bp, Homo sapiens
tcactgtcactaggcaccaaac

SEQ ID NO: 7583525 - DNA, 22 bp, Homo sapiens
tcactgtccctgtcctcttatc

SEQ ID NO: 7583526 - DNA, 22 bp, Homo sapiens
tcactgtccctgtcctcttatc

SEQ ID NO: 7583527 - DNA, 22 bp, Homo sapiens
tcactgtccctgtcctcttatc

SEQ ID NO: 7583528 - DNA, 23 bp, Homo sapiens
tcactgtcctgctcctggaacgc

SEQ ID NO: 7583529 - DNA, 22 bp, Homo sapiens
tcactgtctgaaagaaatggcc

SEQ ID NO: 7583530 - DNA, 22 bp, Homo sapiens
tcactggtgtgagaggagcaaa

SEQ ID NO: 7583531 - DNA, 18 bp, Homo sapiens
tcactgggtgtatgtggc

SEQ ID NO: 7583532 - DNA, 22 bp, Homo sapiens
tcactggtgtgagaggagcaaa

SEQ ID NO: 7583533 - DNA, 22 bp, Homo sapiens
tcactggtgtgagaggagcaaa

SEQ ID NO: 7583534 - DNA, 22 bp, Homo sapiens
tcactgggtaggacatgctgat

SEQ ID NO: 7583535 - DNA, 22 bp, Homo sapiens
tcactgggtaggacatgctgat

SEQ ID NO: 7583536 - DNA, 22 bp, Homo sapiens
tcactgggtaggacatgctgat

SEQ ID NO: 7583537 - DNA, 22 bp, Homo sapiens
tcactgggtaggacatgctgat

SEQ ID NO: 7583538 - DNA, 22 bp, Homo sapiens
tcactgggtaggacatgctgat

SEQ ID NO: 7583539 - DNA, 22 bp, Homo sapiens
tcactggggcctttggtcagga

SEQ ID NO: 7583540 - DNA, 22 bp, Homo sapiens
tcactggggcctttggtcagga

SEQ ID NO: 7583541 - DNA, 22 bp, Homo sapiens
tcactggggcccacatcaacat

SEQ ID NO: 7583542 - DNA, 22 bp, Homo sapiens
tcactggggcccacatcaacat

SEQ ID NO: 7583543 - DNA, 22 bp, Homo sapiens
tcactggggcccacatcaacat

SEQ ID NO: 7583544 - DNA, 22 bp, Homo sapiens
tcactgtaccttccatttcatt

SEQ ID NO: 7583545 - DNA, 22 bp, Homo sapiens
tcactgtagagtctgtttccac

SEQ ID NO: 7583546 - DNA, 22 bp, Homo sapiens
tcactgtagagtctgtttccac

SEQ ID NO: 7583547 - DNA, 22 bp, Homo sapiens
tcactgtagcctcaacctttca

SEQ ID NO: 7583548 - DNA, 22 bp, Homo sapiens
tcactgtagcctcaacctttca

SEQ ID NO: 7583549 - DNA, 22 bp, Homo sapiens
tcactgtatcatgttgcactta

SEQ ID NO: 7583550 - DNA, 22 bp, Homo sapiens
tcactgtatgtctttttttgat

SEQ ID NO: 7583551 - DNA, 22 bp, Homo sapiens
tcactgtatgtctttttttgat

SEQ ID NO: 7583552 - DNA, 22 bp, Homo sapiens
tcactgtagcctcaactcttgg

SEQ ID NO: 7583553 - DNA, 22 bp, Homo sapiens
tcactgtagcctcaactcttgg

SEQ ID NO: 7583554 - DNA, 22 bp, Homo sapiens
tcactgtagcctcaactcttgg

SEQ ID NO: 7583555 - DNA, 22 bp, Homo sapiens
tcactgtaaactaggtcagtcc

SEQ ID NO: 7583556 - DNA, 20 bp, Homo sapiens
tcactgtaacatttgggggg

SEQ ID NO: 7583557 - DNA, 20 bp, Homo sapiens
tcactgtaacatttgggggg

SEQ ID NO: 7583558 - DNA, 22 bp, Homo sapiens
tcactgtaatttgtatctgtgg

SEQ ID NO: 7583559 - DNA, 22 bp, Homo sapiens
tcactgtaatttgtatctgtgg

SEQ ID NO: 7583560 - DNA, 22 bp, Homo sapiens
tcactgtaataggtttgaagat

SEQ ID NO: 7583561 - DNA, 22 bp, Homo sapiens
tcacatcttattagagtatctc

SEQ ID NO: 7583562 - DNA, 22 bp, Homo sapiens
tcacatcttattagagtatctc

SEQ ID NO: 7583563 - DNA, 22 bp, Homo sapiens
tcacatcttattagagtatctc

SEQ ID NO: 7583564 - DNA, 20 bp, Homo sapiens
tcacatctggcagctgatga

SEQ ID NO: 7583565 - DNA, 22 bp, Homo sapiens
tcacatctgcctccatagcacc

SEQ ID NO: 7583566 - DNA, 22 bp, Homo sapiens
tcacatctgcctccatagcacc

SEQ ID NO: 7583567 - DNA, 22 bp, Homo sapiens
tcacatctgcctccatagcacc

SEQ ID NO: 7583568 - DNA, 22 bp, Homo sapiens
tcacatctgcctccatagcacc

SEQ ID NO: 7583569 - DNA, 22 bp, Homo sapiens
tcacatctgtgtgattgtcatt

SEQ ID NO: 7583570 - DNA, 22 bp, Homo sapiens
tcacatctgtgtgattgtcatt

SEQ ID NO: 7583571 - DNA, 22 bp, Homo sapiens
tcacatctttaggcttacaggt

SEQ ID NO: 7583572 - DNA, 22 bp, Homo sapiens
tcacatctgttgatacagcatc

SEQ ID NO: 7583573 - DNA, 22 bp, Homo sapiens
tcacatgaagatccctcaattt

SEQ ID NO: 7583574 - DNA, 22 bp, Homo sapiens
tcacatgaagatccctcaattt

SEQ ID NO: 7583575 - DNA, 22 bp, Homo sapiens
tcacatgaaatgctgtaaagaa

SEQ ID NO: 7583576 - DNA, 22 bp, Homo sapiens
tcacatgaaatgctgtaaagaa

SEQ ID NO: 7583577 - DNA, 22 bp, Homo sapiens
tcacatgaaatgctgtaaagaa

SEQ ID NO: 7583578 - DNA, 18 bp, Homo sapiens
tcacatgacagctgttgc

SEQ ID NO: 7583579 - DNA, 19 bp, Homo sapiens
tcacatgaagcctagagaa

SEQ ID NO: 7583580 - DNA, 22 bp, Homo sapiens
tcacatgagtattattttccaa

SEQ ID NO: 7583581 - DNA, 22 bp, Homo sapiens
tcacatgaggttatgacaaagc

SEQ ID NO: 7583582 - DNA, 22 bp, Homo sapiens
tcacatgaggttatgacaaagc

SEQ ID NO: 7583583 - DNA, 22 bp, Homo sapiens
tcacatgaggttatgacaaagc

SEQ ID NO: 7583584 - DNA, 22 bp, Homo sapiens
tcacatgaggttatgacaaagc

SEQ ID NO: 7583585 - DNA, 22 bp, Homo sapiens
tcacatgaggttatgacaaagc

SEQ ID NO: 7583586 - DNA, 22 bp, Homo sapiens
tcacatgaggcatccccgggca

SEQ ID NO: 7583587 - DNA, 18 bp, Homo sapiens
tcacatgacagctgttgc

SEQ ID NO: 7583588 - DNA, 22 bp, Homo sapiens
tcacatgactttttggtggcct

SEQ ID NO: 7583589 - DNA, 20 bp, Homo sapiens
tcacatgagctggggcaggc

SEQ ID NO: 7583590 - DNA, 20 bp, Homo sapiens
tcacatgagctggggcaggc

SEQ ID NO: 7583591 - DNA, 22 bp, Homo sapiens
tcacatgccttttactctgcac

SEQ ID NO: 7583592 - DNA, 22 bp, Homo sapiens
tcacatgccttttactctgcac

SEQ ID NO: 7583593 - DNA, 22 bp, Homo sapiens
tcacatgccctgtatttaccag

SEQ ID NO: 7583594 - DNA, 22 bp, Homo sapiens
tcacccaggctggtgcgcagtg

SEQ ID NO: 7583595 - DNA, 22 bp, Homo sapiens
tcacatgccttttactctgcac

SEQ ID NO: 7583596 - DNA, 22 bp, Homo sapiens
tcacccagggactgtgatggaa

SEQ ID NO: 7583597 - DNA, 22 bp, Homo sapiens
tcacccaggctggtgcgcagtg

SEQ ID NO: 7583598 - DNA, 22 bp, Homo sapiens
tcacccagggactgtgatggaa

SEQ ID NO: 7583599 - DNA, 22 bp, Homo sapiens
tcacccagggactgtgatggaa

SEQ ID NO: 7583600 - DNA, 22 bp, Homo sapiens
tcacccagggactgtgatggaa

SEQ ID NO: 7583601 - DNA, 22 bp, Homo sapiens
tcacccagggactgtgatggaa

SEQ ID NO: 7583602 - DNA, 22 bp, Homo sapiens
tcacccagggactgtgatggaa

SEQ ID NO: 7583603 - DNA, 22 bp, Homo sapiens
tcacccaggtccaggctctggc

SEQ ID NO: 7583604 - DNA, 22 bp, Homo sapiens
tcacccaggtccaggctctggc

SEQ ID NO: 7583605 - DNA, 22 bp, Homo sapiens
tcacccaggtccaggctctggc

SEQ ID NO: 7583606 - DNA, 22 bp, Homo sapiens
tcacccaggtccaggctctggc

SEQ ID NO: 7583607 - DNA, 22 bp, Homo sapiens
tcacccaggtaatagcagtttg

SEQ ID NO: 7583608 - DNA, 22 bp, Homo sapiens
tcacccaggtaatagcagtttg

SEQ ID NO: 7583609 - DNA, 22 bp, Homo sapiens
tcacccagggtgtttggtgtct

SEQ ID NO: 7583610 - DNA, 22 bp, Homo sapiens
tcacccagggtgtttggtgtct

SEQ ID NO: 7583611 - DNA, 22 bp, Homo sapiens
tcacccagggtgtttggtgtct

SEQ ID NO: 7583612 - DNA, 22 bp, Homo sapiens
tcacccagggtgtttggtgtct

SEQ ID NO: 7583613 - DNA, 22 bp, Homo sapiens
tcacccaggtaatagcagtttg

SEQ ID NO: 7583614 - DNA, 22 bp, Homo sapiens
tcacccaggtaatagcagtttg

SEQ ID NO: 7583615 - DNA, 22 bp, Homo sapiens
tcacatgcacatacttcctgtg

SEQ ID NO: 7583616 - DNA, 22 bp, Homo sapiens
tcacatgcacatacttcctgtg

SEQ ID NO: 7583617 - DNA, 22 bp, Homo sapiens
tcacatgcacatacttcctgtg

SEQ ID NO: 7583618 - DNA, 22 bp, Homo sapiens
tcacatgcagtcactgagcagg

SEQ ID NO: 7583619 - DNA, 22 bp, Homo sapiens
tcacatgcagtcactgagcagg

SEQ ID NO: 7583620 - DNA, 22 bp, Homo sapiens
tcacatgcacatctctggaacc

SEQ ID NO: 7583621 - DNA, 22 bp, Homo sapiens
tcacatgagtcactatcttaat

SEQ ID NO: 7583622 - DNA, 22 bp, Homo sapiens
tcacatgagtcactatcttaat

SEQ ID NO: 7583623 - DNA, 22 bp, Homo sapiens
tcacatgagtcactatcttaat

SEQ ID NO: 7583624 - DNA, 22 bp, Homo sapiens
tcacatgcacatacttcctgtg

SEQ ID NO: 7583625 - DNA, 22 bp, Homo sapiens
tcacatgatgtttcctctgtgc

SEQ ID NO: 7583626 - DNA, 18 bp, Homo sapiens
tcacatgattaccctggg

SEQ ID NO: 7583627 - DNA, 18 bp, Homo sapiens
tcacatgattaccctggg

SEQ ID NO: 7583628 - DNA, 22 bp, Homo sapiens
tcacatgcagtcactgagcagg

SEQ ID NO: 7583629 - DNA, 22 bp, Homo sapiens
tcacatgccacagatgaggcaa

SEQ ID NO: 7583630 - DNA, 22 bp, Homo sapiens
tcacatgccacagatgaggcaa

SEQ ID NO: 7583631 - DNA, 22 bp, Homo sapiens
tcacatgccacagatgaggcaa

SEQ ID NO: 7583632 - DNA, 20 bp, Homo sapiens
tcacatgcatattcgtttct

SEQ ID NO: 7583633 - DNA, 22 bp, Homo sapiens
tcacatgccctacctaatctta

SEQ ID NO: 7583634 - DNA, 21 bp, Homo sapiens
tcacatgcccattactggagc

SEQ ID NO: 7583635 - DNA, 22 bp, Homo sapiens
tcacatgccacagatgaggcaa

SEQ ID NO: 7583636 - DNA, 22 bp, Homo sapiens
tcacatgccctacctaatctta

SEQ ID NO: 7583637 - DNA, 22 bp, Homo sapiens
tcacatgccctacctaatctta

SEQ ID NO: 7583638 - DNA, 22 bp, Homo sapiens
tcacatgccctacctaatctta

SEQ ID NO: 7583639 - DNA, 17 bp, Homo sapiens
tcaccgtttggctttcc

SEQ ID NO: 7583640 - DNA, 22 bp, Homo sapiens
tcaccggtgaccctcggctcgc

SEQ ID NO: 7583641 - DNA, 22 bp, Homo sapiens
tcaccggcagacgtggcctgat

SEQ ID NO: 7583642 - DNA, 22 bp, Homo sapiens
tcaccgccttgcccggccgggc

SEQ ID NO: 7583643 - DNA, 22 bp, Homo sapiens
tcaccggcagacgtggcctgat

SEQ ID NO: 7583644 - DNA, 19 bp, Homo sapiens
tcaccgcatgaaatgaagc

SEQ ID NO: 7583645 - DNA, 22 bp, Homo sapiens
tcaccgccttgcccggccgggc

SEQ ID NO: 7583646 - DNA, 22 bp, Homo sapiens
tcaccgaggctggagtgcagtg

SEQ ID NO: 7583647 - DNA, 22 bp, Homo sapiens
tcaccgaggctggagtgcagtg

SEQ ID NO: 7583648 - DNA, 22 bp, Homo sapiens
tcaccctgtgattgcaaagaaa

SEQ ID NO: 7583649 - DNA, 22 bp, Homo sapiens
tcaccctgtgattgcaaagaaa

SEQ ID NO: 7583650 - DNA, 22 bp, Homo sapiens
tcacccttagtgtactatcatg

SEQ ID NO: 7583651 - DNA, 22 bp, Homo sapiens
tcaccctgtttctcttttgtct

SEQ ID NO: 7583652 - DNA, 22 bp, Homo sapiens
tcaccctgtttctcttttgtct

SEQ ID NO: 7583653 - DNA, 22 bp, Homo sapiens
tcacccttagtgtactatcatg

SEQ ID NO: 7583654 - DNA, 22 bp, Homo sapiens
tcaccgaggctggagtgcagtg

SEQ ID NO: 7583655 - DNA, 22 bp, Homo sapiens
tcaccgaggctggagtgcagtg

SEQ ID NO: 7583656 - DNA, 22 bp, Homo sapiens
tcaccgaggctggagtgcagtg

SEQ ID NO: 7583657 - DNA, 22 bp, Homo sapiens
tcaccgaggctggagtgcagtg

SEQ ID NO: 7583658 - DNA, 22 bp, Homo sapiens
tcaccgaggctggagtgcagtg

SEQ ID NO: 7583659 - DNA, 22 bp, Homo sapiens
tcacccaggtccaggctctggc

SEQ ID NO: 7583660 - DNA, 22 bp, Homo sapiens
tcacccaggtccaggctctggc

SEQ ID NO: 7583661 - DNA, 22 bp, Homo sapiens
tcaccccaaagttgagtttgat

SEQ ID NO: 7583662 - DNA, 22 bp, Homo sapiens
tcacccatgtgtctcccttata

SEQ ID NO: 7583663 - DNA, 22 bp, Homo sapiens
tcaccccctgtattagtagcta

SEQ ID NO: 7583664 - DNA, 22 bp, Homo sapiens
tcaccccaaagttgagtttgat

SEQ ID NO: 7583665 - DNA, 22 bp, Homo sapiens
tcacccctacatttcccttgct

SEQ ID NO: 7583666 - DNA, 22 bp, Homo sapiens
tcacccctacatttcccttgct

SEQ ID NO: 7583667 - DNA, 22 bp, Homo sapiens
tcaccccctgtattagtagcta

SEQ ID NO: 7583668 - DNA, 22 bp, Homo sapiens
tcacccctacatttcccttgct

SEQ ID NO: 7583669 - DNA, 22 bp, Homo sapiens
tcacccctacatttcccttgct

SEQ ID NO: 7583670 - DNA, 22 bp, Homo sapiens
tcacccctacatttcccttgct

SEQ ID NO: 7583671 - DNA, 22 bp, Homo sapiens
tcaccccttgtgaatgctgctc

SEQ ID NO: 7583672 - DNA, 22 bp, Homo sapiens
tcacccctggcccagtcttgga

SEQ ID NO: 7583673 - DNA, 22 bp, Homo sapiens
tcaccccttgtgaatgctgctc

SEQ ID NO: 7583674 - DNA, 22 bp, Homo sapiens
tcaccccttgtgaatgctgctc

SEQ ID NO: 7583675 - DNA, 22 bp, Homo sapiens
tcacccctggcccagtcttgga

SEQ ID NO: 7583676 - DNA, 22 bp, Homo sapiens
tcacccctccattctctcatgt

SEQ ID NO: 7583677 - DNA, 22 bp, Homo sapiens
tcacccctccattctctcatgt

SEQ ID NO: 7583678 - DNA, 22 bp, Homo sapiens
tcacccctaccaaggagcactg

SEQ ID NO: 7583679 - DNA, 22 bp, Homo sapiens
tcacccctaccaaggagcactg

SEQ ID NO: 7583680 - DNA, 22 bp, Homo sapiens
tcacccctaccaaggagcactg

SEQ ID NO: 7583681 - DNA, 22 bp, Homo sapiens
tcaccttgtgatctccctgcct

SEQ ID NO: 7583682 - DNA, 22 bp, Homo sapiens
tcaccttgtgatctccctgcct

SEQ ID NO: 7583683 - DNA, 22 bp, Homo sapiens
tcaccttgtgatctccctgcct

SEQ ID NO: 7583684 - DNA, 22 bp, Homo sapiens
tcaccttgtgatctccctgcct

SEQ ID NO: 7583685 - DNA, 22 bp, Homo sapiens
tcaccttgtgatccgcccacct

SEQ ID NO: 7583686 - DNA, 22 bp, Homo sapiens
tcaccttgtgatccgcccacct

SEQ ID NO: 7583687 - DNA, 22 bp, Homo sapiens
tcaccttgtgatctccctgcct

SEQ ID NO: 7583688 - DNA, 22 bp, Homo sapiens
tcaccttgtgatctccctgcct

SEQ ID NO: 7583689 - DNA, 22 bp, Homo sapiens
tcacggacctaagaggaagatt

SEQ ID NO: 7583690 - DNA, 22 bp, Homo sapiens
tcacgtgagggacctgtgtctg

SEQ ID NO: 7583691 - DNA, 22 bp, Homo sapiens
tcacgtgagggacctgtgtctg

SEQ ID NO: 7583692 - DNA, 21 bp, Homo sapiens
tcacgtggtcacatgagcttt

SEQ ID NO: 7583693 - DNA, 21 bp, Homo sapiens
tcacgtggtcacatgagcttt

SEQ ID NO: 7583694 - DNA, 21 bp, Homo sapiens
tcacgtggtcacatgagcttt

SEQ ID NO: 7583695 - DNA, 21 bp, Homo sapiens
tcacgtggtcacatgagcttt

SEQ ID NO: 7583696 - DNA, 21 bp, Homo sapiens
tcacgtggtcacatgagcttt

SEQ ID NO: 7583697 - DNA, 22 bp, Homo sapiens
tcacctaattgaagtcaggagt

SEQ ID NO: 7583698 - DNA, 22 bp, Homo sapiens
tcacctaattgaagtcaggagt

SEQ ID NO: 7583699 - DNA, 22 bp, Homo sapiens
tcacctctactcagcctagttc

SEQ ID NO: 7583700 - DNA, 22 bp, Homo sapiens
tcacctcaccacccttatggtt

SEQ ID NO: 7583701 - DNA, 22 bp, Homo sapiens
tcacctcaccacccttatggtt

SEQ ID NO: 7583702 - DNA, 22 bp, Homo sapiens
tcacctcttttttaacaggctt

SEQ ID NO: 7583703 - DNA, 22 bp, Homo sapiens
tcacctcttttttaacaggctt

SEQ ID NO: 7583704 - DNA, 21 bp, Homo sapiens
tcacctggcttctgacctggc

SEQ ID NO: 7583705 - DNA, 22 bp, Homo sapiens
tcacctctctggccgtctacct

SEQ ID NO: 7583706 - DNA, 22 bp, Homo sapiens
tcacctctctggccgtctacct

SEQ ID NO: 7583707 - DNA, 22 bp, Homo sapiens
tcacctgtattaatacagaact

SEQ ID NO: 7583708 - DNA, 22 bp, Homo sapiens
tcacctgggagggctgtggtag

SEQ ID NO: 7583709 - DNA, 22 bp, Homo sapiens
tcacctgtattaatacagaact

SEQ ID NO: 7583710 - DNA, 22 bp, Homo sapiens
tcaccttgtgatccgcccacct

SEQ ID NO: 7583711 - DNA, 22 bp, Homo sapiens
tcaccttgtgatccgcccacct

SEQ ID NO: 7583712 - DNA, 22 bp, Homo sapiens
tcaccttgtgatccgcccacct

SEQ ID NO: 7583713 - DNA, 22 bp, Homo sapiens
tcaccttgaatgcagcagcgtg

SEQ ID NO: 7583714 - DNA, 22 bp, Homo sapiens
tcacctgttcaacagcaataat

SEQ ID NO: 7583715 - DNA, 22 bp, Homo sapiens
tcacctgttcaacagcaataat

SEQ ID NO: 7583716 - DNA, 22 bp, Homo sapiens
tcacctgttggatgtatactgt

SEQ ID NO: 7583717 - DNA, 22 bp, Homo sapiens
tcacctgttggatgtatactgt

SEQ ID NO: 7583718 - DNA, 22 bp, Homo sapiens
tcagaacatgtttgagtaagac

SEQ ID NO: 7583719 - DNA, 22 bp, Homo sapiens
tcagaacatgtttgagtaagac

SEQ ID NO: 7583720 - DNA, 22 bp, Homo sapiens
tcagaacattaaggatttgaag

SEQ ID NO: 7583721 - DNA, 22 bp, Homo sapiens
tcagaacatcctggtttaaaat

SEQ ID NO: 7583722 - DNA, 22 bp, Homo sapiens
tcagaacatgaaggttaatttg

SEQ ID NO: 7583723 - DNA, 22 bp, Homo sapiens
tcagaacatgaaggttaatttg

SEQ ID NO: 7583724 - DNA, 22 bp, Homo sapiens
tcagaacattctcattgactgc

SEQ ID NO: 7583725 - DNA, 22 bp, Homo sapiens
tcagaacattctcattgactgc

SEQ ID NO: 7583726 - DNA, 22 bp, Homo sapiens
tcagaacattctcattgactgc

SEQ ID NO: 7583727 - DNA, 22 bp, Homo sapiens
tcagaacattctcattgactgc

SEQ ID NO: 7583728 - DNA, 22 bp, Homo sapiens
tcagaacattacattttgagct

SEQ ID NO: 7583729 - DNA, 22 bp, Homo sapiens
tcagaacattacattttgagct

SEQ ID NO: 7583730 - DNA, 22 bp, Homo sapiens
tcagaacattacattttgagct

SEQ ID NO: 7583731 - DNA, 22 bp, Homo sapiens
tcagaacattacattttgagct

SEQ ID NO: 7583732 - DNA, 22 bp, Homo sapiens
tcagaacattaaggatttgaag

SEQ ID NO: 7583733 - DNA, 22 bp, Homo sapiens
tcagaacattaaggatttgaag

SEQ ID NO: 7583734 - DNA, 22 bp, Homo sapiens
tcagaacattaaggatttgaag

SEQ ID NO: 7583735 - DNA, 22 bp, Homo sapiens
tcagaactacatggacatgtta

SEQ ID NO: 7583736 - DNA, 22 bp, Homo sapiens
tcagaacctcctagcagtgttc

SEQ ID NO: 7583737 - DNA, 22 bp, Homo sapiens
tcagaacatttgggactttggg

SEQ ID NO: 7583738 - DNA, 22 bp, Homo sapiens
tcagaacatttgggactttggg

SEQ ID NO: 7583739 - DNA, 22 bp, Homo sapiens
tcagaacatttgggactttggg

SEQ ID NO: 7583740 - DNA, 22 bp, Homo sapiens
tcagaacattgacattcttatt

SEQ ID NO: 7583741 - DNA, 22 bp, Homo sapiens
tcagaacattctcattgactgc

SEQ ID NO: 7583742 - DNA, 22 bp, Homo sapiens
tcagaacattctcattgactgc

SEQ ID NO: 7583743 - DNA, 22 bp, Homo sapiens
tcagaacatttaaaaagtggtt

SEQ ID NO: 7583744 - DNA, 22 bp, Homo sapiens
tcagaacattgacattcttatt

SEQ ID NO: 7583745 - DNA, 22 bp, Homo sapiens
tcagaacattgacattcttatt

SEQ ID NO: 7583746 - DNA, 22 bp, Homo sapiens
tcagaacattgacattcttatt

SEQ ID NO: 7583747 - DNA, 19 bp, Homo sapiens
tcagaactcagaatgtgta

SEQ ID NO: 7583748 - DNA, 22 bp, Homo sapiens
tcagaactcaagacttgacatc

SEQ ID NO: 7583749 - DNA, 22 bp, Homo sapiens
tcagaactcaagacttgacatc

SEQ ID NO: 7583750 - DNA, 22 bp, Homo sapiens
tcagaactcaagacttgacatc

SEQ ID NO: 7583751 - DNA, 22 bp, Homo sapiens
tcagaactatagtagtttcatg

SEQ ID NO: 7583752 - DNA, 22 bp, Homo sapiens
tcagaactatagtagtttcatg

SEQ ID NO: 7583753 - DNA, 22 bp, Homo sapiens
tcagaactgctgctcctgcaaa

SEQ ID NO: 7583754 - DNA, 22 bp, Homo sapiens
tcagaactggtatttatcaagg

SEQ ID NO: 7583755 - DNA, 22 bp, Homo sapiens
tcagaactggtatttatcaagg

SEQ ID NO: 7583756 - DNA, 22 bp, Homo sapiens
tcagaactggtatttatcaagg

SEQ ID NO: 7583757 - DNA, 22 bp, Homo sapiens
tcagaactggaagaggttctgc

SEQ ID NO: 7583758 - DNA, 21 bp, Homo sapiens
tcagaactggtgcagatgaat

SEQ ID NO: 7583759 - DNA, 21 bp, Homo sapiens
tcagaactggtgcagatgaat

SEQ ID NO: 7583760 - DNA, 21 bp, Homo sapiens
tcagaactggtgcagatgaat

SEQ ID NO: 7583761 - DNA, 21 bp, Homo sapiens
tcagaactggtgcagatgaat

SEQ ID NO: 7583762 - DNA, 22 bp, Homo sapiens
tcagaacttcagttttcttaat

SEQ ID NO: 7583763 - DNA, 22 bp, Homo sapiens
tcagaacttcagttttcttaat

SEQ ID NO: 7583764 - DNA, 21 bp, Homo sapiens
tcagaactggtgcagatgaat

SEQ ID NO: 7583765 - DNA, 22 bp, Homo sapiens
tcagaacttcagttttcttaat

SEQ ID NO: 7583766 - DNA, 22 bp, Homo sapiens
tcagaagaaaagacttttagag

SEQ ID NO: 7583767 - DNA, 22 bp, Homo sapiens
tcagaagaaagatgttattact

SEQ ID NO: 7583768 - DNA, 22 bp, Homo sapiens
tcagaagaaagatgttattact

SEQ ID NO: 7583769 - DNA, 22 bp, Homo sapiens
tcagaagaaagatgttattact

SEQ ID NO: 7583770 - DNA, 22 bp, Homo sapiens
tcagaagaagagactccacagc

SEQ ID NO: 7583771 - DNA, 22 bp, Homo sapiens
tcagaagactactaggacacat

SEQ ID NO: 7583772 - DNA, 21 bp, Homo sapiens
tcagaagagctgcctcttggt

SEQ ID NO: 7583773 - DNA, 21 bp, Homo sapiens
tcagaagagctgcctcttggt

SEQ ID NO: 7583774 - DNA, 21 bp, Homo sapiens
tcagaagagctgcctcttggt

SEQ ID NO: 7583775 - DNA, 22 bp, Homo sapiens
tcagaagactactaggacacat

SEQ ID NO: 7583776 - DNA, 22 bp, Homo sapiens
tcagaagactactaggacacat

SEQ ID NO: 7583777 - DNA, 22 bp, Homo sapiens
tcagaagactactaggacacat

SEQ ID NO: 7583778 - DNA, 22 bp, Homo sapiens
tcagaagagtaatagggtgaga

SEQ ID NO: 7583779 - DNA, 22 bp, Homo sapiens
tcagaagagtaatagggtgaga

SEQ ID NO: 7583780 - DNA, 22 bp, Homo sapiens
tcagaagataaagctttttgtt

SEQ ID NO: 7583781 - DNA, 22 bp, Homo sapiens
tcagaagagctggtgctgcctg

SEQ ID NO: 7583782 - DNA, 22 bp, Homo sapiens
tcagaagagctggtgctgcctg

SEQ ID NO: 7583783 - DNA, 22 bp, Homo sapiens
tcagaagcaaacatcactctag

SEQ ID NO: 7583784 - DNA, 22 bp, Homo sapiens
tcagaagataaagctttttgtt

SEQ ID NO: 7583785 - DNA, 22 bp, Homo sapiens
tcagaagcaaacatcactctag

SEQ ID NO: 7583786 - DNA, 22 bp, Homo sapiens
tcagaagcaaacatcactctag

SEQ ID NO: 7583787 - DNA, 22 bp, Homo sapiens
tcagaagcagaaaataggtggg

SEQ ID NO: 7583788 - DNA, 22 bp, Homo sapiens
tcagaagcagaaaataggtggg

SEQ ID NO: 7583789 - DNA, 22 bp, Homo sapiens
tcagaagcaagcttctacttct

SEQ ID NO: 7583790 - DNA, 22 bp, Homo sapiens
tcagaagcaagcttctacttct

SEQ ID NO: 7583791 - DNA, 23 bp, Homo sapiens
tcagagaataattctgatagact

SEQ ID NO: 7583792 - DNA, 23 bp, Homo sapiens
tcagagaataattctgatagact

SEQ ID NO: 7583793 - DNA, 23 bp, Homo sapiens
tcagagaagttgtaggctgggga

SEQ ID NO: 7583794 - DNA, 23 bp, Homo sapiens
tcagagaagttgtaggctgggga

SEQ ID NO: 7583795 - DNA, 23 bp, Homo sapiens
tcagagaagttgtaggctgggga

SEQ ID NO: 7583796 - DNA, 22 bp, Homo sapiens
tcagagaagtaaggtggggtgc

SEQ ID NO: 7583797 - DNA, 22 bp, Homo sapiens
tcagagaagtaggctaatggtg

SEQ ID NO: 7583798 - DNA, 22 bp, Homo sapiens
tcagagaagtaggctaatggtg

SEQ ID NO: 7583799 - DNA, 22 bp, Homo sapiens
tcagagaagtaggctaatggtg

SEQ ID NO: 7583800 - DNA, 22 bp, Homo sapiens
tcagagaagtaggctaatggtg

SEQ ID NO: 7583801 - DNA, 22 bp, Homo sapiens
tcagagaagtaggctaatggtg

SEQ ID NO: 7583802 - DNA, 23 bp, Homo sapiens
tcagagaagttgtaggctgggga

SEQ ID NO: 7583803 - DNA, 23 bp, Homo sapiens
tcagagaagttgtaggctgggga

SEQ ID NO: 7583804 - DNA, 23 bp, Homo sapiens
tcagagaagttgtaggctgggga

SEQ ID NO: 7583805 - DNA, 22 bp, Homo sapiens
tcagagaaggtaagtgacctgc

SEQ ID NO: 7583806 - DNA, 22 bp, Homo sapiens
tcagagaaggtaagtgacctgc

SEQ ID NO: 7583807 - DNA, 22 bp, Homo sapiens
tcagagaagtaaggtggggtgc

SEQ ID NO: 7583808 - DNA, 22 bp, Homo sapiens
tcagagaagtaaggtggggtgc

SEQ ID NO: 7583809 - DNA, 22 bp, Homo sapiens
tcagagaagtaaggtggggtgc

SEQ ID NO: 7583810 - DNA, 22 bp, Homo sapiens
tcagagaagtaaggtggggtgc

SEQ ID NO: 7583811 - DNA, 22 bp, Homo sapiens
tcagagaaggtaagtgacctgc

SEQ ID NO: 7583812 - DNA, 22 bp, Homo sapiens
tcagagaaggtaagtgacctgc

SEQ ID NO: 7583813 - DNA, 22 bp, Homo sapiens
tcagagaaggtaagtgacctgc

SEQ ID NO: 7583814 - DNA, 22 bp, Homo sapiens
tcagagaaggtaagtgacctgc

SEQ ID NO: 7583815 - DNA, 22 bp, Homo sapiens
tcagagaaggtaagtgacctgc

SEQ ID NO: 7583816 - DNA, 22 bp, Homo sapiens
tcagaagcagatatttcaaaat

SEQ ID NO: 7583817 - DNA, 22 bp, Homo sapiens
tcagaagcagatatttcaaaat

SEQ ID NO: 7583818 - DNA, 22 bp, Homo sapiens
tcagaagcaggagtgtgcacaa

SEQ ID NO: 7583819 - DNA, 22 bp, Homo sapiens
tcagaagcaggagtgtgcacaa

SEQ ID NO: 7583820 - DNA, 22 bp, Homo sapiens
tcagaagcatccatttcaccac

SEQ ID NO: 7583821 - DNA, 22 bp, Homo sapiens
tcagaagcaggagtgtgcacaa

SEQ ID NO: 7583822 - DNA, 22 bp, Homo sapiens
tcagaagcaggagtgtgcacaa

SEQ ID NO: 7583823 - DNA, 22 bp, Homo sapiens
tcagaagcaggagtgtgcacaa

SEQ ID NO: 7583824 - DNA, 22 bp, Homo sapiens
tcagaagcatgtggggagcctg

SEQ ID NO: 7583825 - DNA, 22 bp, Homo sapiens
tcagaagcatgtggggagcctg

SEQ ID NO: 7583826 - DNA, 22 bp, Homo sapiens
tcagaagcaggagtgtgcacaa

SEQ ID NO: 7583827 - DNA, 22 bp, Homo sapiens
tcagaagcatgtggggagcctg

SEQ ID NO: 7583828 - DNA, 20 bp, Homo sapiens
tcagagaagggactgagatt

SEQ ID NO: 7583829 - DNA, 20 bp, Homo sapiens
tcagagaagggactgagatt

SEQ ID NO: 7583830 - DNA, 22 bp, Homo sapiens
tcagaagcatgtggggagcctg

SEQ ID NO: 7583831 - DNA, 22 bp, Homo sapiens
tcagaagccaccttttgttggg

SEQ ID NO: 7583832 - DNA, 22 bp, Homo sapiens
tcagagaatctctccttagttt

SEQ ID NO: 7583833 - DNA, 22 bp, Homo sapiens
tcagagaatctctccttagttt

SEQ ID NO: 7583834 - DNA, 22 bp, Homo sapiens
tcagagaatctctccttagttt

SEQ ID NO: 7583835 - DNA, 21 bp, Homo sapiens
tcagagaatggcctactctca

SEQ ID NO: 7583836 - DNA, 22 bp, Homo sapiens
tcagagaatctctccttagttt

SEQ ID NO: 7583837 - DNA, 22 bp, Homo sapiens
tcagagaatctctccttagttt

SEQ ID NO: 7583838 - DNA, 22 bp, Homo sapiens
tcagagaatctctccttagttt

SEQ ID NO: 7583839 - DNA, 22 bp, Homo sapiens
tcagagaatccgtaagtcacaa

SEQ ID NO: 7583840 - DNA, 22 bp, Homo sapiens
tcagagaatccgtaagtcacaa

SEQ ID NO: 7583841 - DNA, 22 bp, Homo sapiens
tcagagaatccgtaagtcacaa

SEQ ID NO: 7583842 - DNA, 22 bp, Homo sapiens
tcagagaatccgtaagtcacaa

SEQ ID NO: 7583843 - DNA, 22 bp, Homo sapiens
tcagagaatccgtaagtcacaa

SEQ ID NO: 7583844 - DNA, 23 bp, Homo sapiens
tcagagaataattctgatagact

SEQ ID NO: 7583845 - DNA, 22 bp, Homo sapiens
tcagagaatccgtaagtcacaa

SEQ ID NO: 7583846 - DNA, 22 bp, Homo sapiens
tcagagaatgtccttcttcatt

SEQ ID NO: 7583847 - DNA, 22 bp, Homo sapiens
tcagagaatgtccttcttcatt

SEQ ID NO: 7583848 - DNA, 23 bp, Homo sapiens
tcagagaatggtatgcttttcct

SEQ ID NO: 7583849 - DNA, 23 bp, Homo sapiens
tcagagaatggtatgcttttcct

SEQ ID NO: 7583850 - DNA, 23 bp, Homo sapiens
tcagagaatggtatgcttttcct

SEQ ID NO: 7583851 - DNA, 21 bp, Homo sapiens
tcagagaatggcctactctca

SEQ ID NO: 7583852 - DNA, 23 bp, Homo sapiens
tcagagaatggtatgcttttcct

SEQ ID NO: 7583853 - DNA, 21 bp, Homo sapiens
tcagagaatggcctactctca

SEQ ID NO: 7583854 - DNA, 21 bp, Homo sapiens
tcagagaatggcctactctca

SEQ ID NO: 7583855 - DNA, 21 bp, Homo sapiens
tcagagaatggcctactctca

SEQ ID NO: 7583856 - DNA, 22 bp, Homo sapiens
tcagagaattctcagatgactc

SEQ ID NO: 7583857 - DNA, 22 bp, Homo sapiens
tcagagaattgtttaatggaat

SEQ ID NO: 7583858 - DNA, 22 bp, Homo sapiens
tcagagaattgtttaatggaat

SEQ ID NO: 7583859 - DNA, 22 bp, Homo sapiens
tcagagacaccagagagctgtg

SEQ ID NO: 7583860 - DNA, 22 bp, Homo sapiens
tcagagacaccagagagctgtg

SEQ ID NO: 7583861 - DNA, 22 bp, Homo sapiens
tcagagacaccattttctttct

SEQ ID NO: 7583862 - DNA, 22 bp, Homo sapiens
tcagagaattgtttaatggaat

SEQ ID NO: 7583863 - DNA, 22 bp, Homo sapiens
tcagagaattctcagatgactc

SEQ ID NO: 7583864 - DNA, 22 bp, Homo sapiens
tcagagaattctcagatgactc

SEQ ID NO: 7583865 - DNA, 22 bp, Homo sapiens
tcagagaattctcagatgactc

SEQ ID NO: 7583866 - DNA, 22 bp, Homo sapiens
tcagagaattcgattaaatgca

SEQ ID NO: 7583867 - DNA, 22 bp, Homo sapiens
tcagagaattcgattaaatgca

SEQ ID NO: 7583868 - DNA, 22 bp, Homo sapiens
tcagagaattctcagatgactc

SEQ ID NO: 7583869 - DNA, 22 bp, Homo sapiens
tcagagaattctcagatgactc

SEQ ID NO: 7583870 - DNA, 22 bp, Homo sapiens
tcagagaattctcagatgactc

SEQ ID NO: 7583871 - DNA, 22 bp, Homo sapiens
tcagagaattctcagatgactc

SEQ ID NO: 7583872 - DNA, 22 bp, Homo sapiens
tcagagaattctcagatgactc

SEQ ID NO: 7583873 - DNA, 22 bp, Homo sapiens
tcagagaatgtgaatattaaac

SEQ ID NO: 7583874 - DNA, 22 bp, Homo sapiens
tcagagaattcgattaaatgca

SEQ ID NO: 7583875 - DNA, 22 bp, Homo sapiens
tcagagaatgtgaatattaaac

SEQ ID NO: 7583876 - DNA, 22 bp, Homo sapiens
tcagagaatgtgaatattaaac

SEQ ID NO: 7583877 - DNA, 22 bp, Homo sapiens
tcagagaatgtccttcttcatt

SEQ ID NO: 7583878 - DNA, 22 bp, Homo sapiens
tcagaggacagcagctaaataa

SEQ ID NO: 7583879 - DNA, 22 bp, Homo sapiens
tcagaggacagcagctaaataa

SEQ ID NO: 7583880 - DNA, 22 bp, Homo sapiens
tcagaggacagcagctaaataa

SEQ ID NO: 7583881 - DNA, 22 bp, Homo sapiens
tcagaggacagcagctaaataa

SEQ ID NO: 7583882 - DNA, 22 bp, Homo sapiens
tcagaggaccttactgagaacc

SEQ ID NO: 7583883 - DNA, 22 bp, Homo sapiens
tcagaggaccttactgagaacc

SEQ ID NO: 7583884 - DNA, 22 bp, Homo sapiens
tcagaggaccttactgagaacc

SEQ ID NO: 7583885 - DNA, 22 bp, Homo sapiens
tcagaggaccttactgagaacc

SEQ ID NO: 7583886 - DNA, 22 bp, Homo sapiens
tcagaggacagcagctaaataa

SEQ ID NO: 7583887 - DNA, 22 bp, Homo sapiens
tcagaggaccttactgagaacc

SEQ ID NO: 7583888 - DNA, 22 bp, Homo sapiens
tcagaggacaagctccctggtg

SEQ ID NO: 7583889 - DNA, 22 bp, Homo sapiens
tcagaggacaagctccctggtg

SEQ ID NO: 7583890 - DNA, 22 bp, Homo sapiens
tcagaggacaagctccctggtg

SEQ ID NO: 7583891 - DNA, 22 bp, Homo sapiens
tcagaggaatttgcttttcatg

SEQ ID NO: 7583892 - DNA, 22 bp, Homo sapiens
tcagaggaatttgcttttcatg

SEQ ID NO: 7583893 - DNA, 22 bp, Homo sapiens
tcagaggaatttgcttttcatg

SEQ ID NO: 7583894 - DNA, 22 bp, Homo sapiens
tcagaggaatctgtacttgaaa

SEQ ID NO: 7583895 - DNA, 22 bp, Homo sapiens
tcagaggaatctgtacttgaaa

SEQ ID NO: 7583896 - DNA, 22 bp, Homo sapiens
tcagaggacaagctccctggtg

SEQ ID NO: 7583897 - DNA, 22 bp, Homo sapiens
tcagaggacagcagctaaataa

SEQ ID NO: 7583898 - DNA, 22 bp, Homo sapiens
tcagaggacaagctccctggtg

SEQ ID NO: 7583899 - DNA, 22 bp, Homo sapiens
tcagaggaatctgtacttgaaa

SEQ ID NO: 7583900 - DNA, 22 bp, Homo sapiens
tcagaggaatctgtacttgaaa

SEQ ID NO: 7583901 - DNA, 22 bp, Homo sapiens
tcagaggaataatgctgcattt

SEQ ID NO: 7583902 - DNA, 22 bp, Homo sapiens
tcagaggaataatgctgcattt

SEQ ID NO: 7583903 - DNA, 22 bp, Homo sapiens
tcagaggaagccttggtgggag

SEQ ID NO: 7583904 - DNA, 22 bp, Homo sapiens
tcagaggaataatgctgcattt

SEQ ID NO: 7583905 - DNA, 22 bp, Homo sapiens
tcagaggaataatgctgcattt

SEQ ID NO: 7583906 - DNA, 23 bp, Homo sapiens
tcagagagctgttgagagctgcc

SEQ ID NO: 7583907 - DNA, 23 bp, Homo sapiens
tcagagagctgttgagagctgcc

SEQ ID NO: 7583908 - DNA, 23 bp, Homo sapiens
tcagagagctgttgagagctgcc

SEQ ID NO: 7583909 - DNA, 23 bp, Homo sapiens
tcagagagctgttgagagctgcc

SEQ ID NO: 7583910 - DNA, 23 bp, Homo sapiens
tcagagagctgttgagagctgcc

SEQ ID NO: 7583911 - DNA, 23 bp, Homo sapiens
tcagagagctgttgagagctgcc

SEQ ID NO: 7583912 - DNA, 23 bp, Homo sapiens
tcagagagctgttgagagctgcc

SEQ ID NO: 7583913 - DNA, 23 bp, Homo sapiens
tcagagagctgttgagagctgcc

SEQ ID NO: 7583914 - DNA, 22 bp, Homo sapiens
tcagagaggattttaataagtg

SEQ ID NO: 7583915 - DNA, 22 bp, Homo sapiens
tcagagaggattttaataagtg

SEQ ID NO: 7583916 - DNA, 22 bp, Homo sapiens
tcagagacatcaggttgtagca

SEQ ID NO: 7583917 - DNA, 22 bp, Homo sapiens
tcagagacatcaggttgtagca

SEQ ID NO: 7583918 - DNA, 22 bp, Homo sapiens
tcagagacagttctggggcagg

SEQ ID NO: 7583919 - DNA, 22 bp, Homo sapiens
tcagagacagttctggggcagg

SEQ ID NO: 7583920 - DNA, 22 bp, Homo sapiens
tcagagacaccattttctttct

SEQ ID NO: 7583921 - DNA, 22 bp, Homo sapiens
tcagagacaccattttctttct

SEQ ID NO: 7583922 - DNA, 22 bp, Homo sapiens
tcagagacagtattggctattg

SEQ ID NO: 7583923 - DNA, 22 bp, Homo sapiens
tcagagacagtattggctattg

SEQ ID NO: 7583924 - DNA, 22 bp, Homo sapiens
tcagagactggtctgcagatgc

SEQ ID NO: 7583925 - DNA, 22 bp, Homo sapiens
tcagagactggtctgcagatgc

SEQ ID NO: 7583926 - DNA, 22 bp, Homo sapiens
tcagagactggtctgcagatgc

SEQ ID NO: 7583927 - DNA, 22 bp, Homo sapiens
tcagagacctagcaagaaattg

SEQ ID NO: 7583928 - DNA, 22 bp, Homo sapiens
tcagagacatcaggttgtagca

SEQ ID NO: 7583929 - DNA, 22 bp, Homo sapiens
tcagagacctagcaagaaattg

SEQ ID NO: 7583930 - DNA, 22 bp, Homo sapiens
tcagagacctagcaagaaattg

SEQ ID NO: 7583931 - DNA, 22 bp, Homo sapiens
tcagagacagttctggggcagg

SEQ ID NO: 7583932 - DNA, 22 bp, Homo sapiens
tcagagactgtaggagcagcct

SEQ ID NO: 7583933 - DNA, 22 bp, Homo sapiens
tcagagagaaatagtttttgac

SEQ ID NO: 7583934 - DNA, 22 bp, Homo sapiens
tcagagactgtaggagcagcct

SEQ ID NO: 7583935 - DNA, 22 bp, Homo sapiens
tcagagactgtaggagcagcct

SEQ ID NO: 7583936 - DNA, 22 bp, Homo sapiens
tcagagactggtctgcagatgc

SEQ ID NO: 7583937 - DNA, 22 bp, Homo sapiens
tcagagactgtaggagcagcct

SEQ ID NO: 7583938 - DNA, 22 bp, Homo sapiens
tcagagactgtaggagcagcct

SEQ ID NO: 7583939 - DNA, 22 bp, Homo sapiens
tcagagactggtctgcagatgc

SEQ ID NO: 7583940 - DNA, 18 bp, Homo sapiens
tcagagagaatagtaatt

SEQ ID NO: 7583941 - DNA, 20 bp, Homo sapiens
tcagagagagggtgccactt

SEQ ID NO: 7583942 - DNA, 20 bp, Homo sapiens
tcagagagagggtgccactt

SEQ ID NO: 7583943 - DNA, 20 bp, Homo sapiens
tcagagagagggtgccactt

SEQ ID NO: 7583944 - DNA, 20 bp, Homo sapiens
tcagagagagggtgccactt

SEQ ID NO: 7583945 - DNA, 18 bp, Homo sapiens
tcagagagcagctttatt

SEQ ID NO: 7583946 - DNA, 22 bp, Homo sapiens
tcagagagcctcaggcactgcc

SEQ ID NO: 7583947 - DNA, 22 bp, Homo sapiens
tcagagagcctcaggcactgcc

SEQ ID NO: 7583948 - DNA, 22 bp, Homo sapiens
tcagagagcctcaggcactgcc

SEQ ID NO: 7583949 - DNA, 22 bp, Homo sapiens
tcagagagcctcaggcactgcc

SEQ ID NO: 7583950 - DNA, 22 bp, Homo sapiens
tcagagagcctcaggcactgcc

SEQ ID NO: 7583951 - DNA, 22 bp, Homo sapiens
tcagagagcctcaggcactgcc

SEQ ID NO: 7583952 - DNA, 22 bp, Homo sapiens
tcagagagcctcaggcactgcc

SEQ ID NO: 7583953 - DNA, 22 bp, Homo sapiens
tcagagagcctcaggcactgcc

SEQ ID NO: 7583954 - DNA, 22 bp, Homo sapiens
tcagagagctggtgggcagagg

SEQ ID NO: 7583955 - DNA, 22 bp, Homo sapiens
tcagagagctggtgggcagagg

SEQ ID NO: 7583956 - DNA, 22 bp, Homo sapiens
tcagagagctggtgggcagagg

SEQ ID NO: 7583957 - DNA, 22 bp, Homo sapiens
tcagagagctggtgggcagagg

SEQ ID NO: 7583958 - DNA, 22 bp, Homo sapiens
tcagagagctggtgggcagagg

SEQ ID NO: 7583959 - DNA, 22 bp, Homo sapiens
tcagagagctggtgggcagagg

SEQ ID NO: 7583960 - DNA, 22 bp, Homo sapiens
tcagaggcatcattcatagtta

SEQ ID NO: 7583961 - DNA, 22 bp, Homo sapiens
tcagaggcagctgatgttctgt

SEQ ID NO: 7583962 - DNA, 22 bp, Homo sapiens
tcagaggcatcattcatagtta

SEQ ID NO: 7583963 - DNA, 22 bp, Homo sapiens
tcagaggccaaactgagcaggg

SEQ ID NO: 7583964 - DNA, 22 bp, Homo sapiens
tcagaggccaaactgagcaggg

SEQ ID NO: 7583965 - DNA, 22 bp, Homo sapiens
tcagaggccaaactgagcaggg

SEQ ID NO: 7583966 - DNA, 22 bp, Homo sapiens
tcagaggccaaactgagcaggg

SEQ ID NO: 7583967 - DNA, 21 bp, Homo sapiens
tcagaggcactgagagcaatg

SEQ ID NO: 7583968 - DNA, 21 bp, Homo sapiens
tcagaggcactgagagcaatg

SEQ ID NO: 7583969 - DNA, 21 bp, Homo sapiens
tcagaggcactgagagcaatg

SEQ ID NO: 7583970 - DNA, 22 bp, Homo sapiens
tcagaggcaaagaactttatta

SEQ ID NO: 7583971 - DNA, 21 bp, Homo sapiens
tcagaggcactgagagcaatg

SEQ ID NO: 7583972 - DNA, 22 bp, Homo sapiens
tcagaggcagctgatgttctgt

SEQ ID NO: 7583973 - DNA, 21 bp, Homo sapiens
tcagaggcactgagagcaatg

SEQ ID NO: 7583974 - DNA, 22 bp, Homo sapiens
tcagaggcctgaaagaatttgg

SEQ ID NO: 7583975 - DNA, 22 bp, Homo sapiens
tcagaggcctgaaagaatttgg

SEQ ID NO: 7583976 - DNA, 22 bp, Homo sapiens
tcagaggcctatgtctacaact

SEQ ID NO: 7583977 - DNA, 22 bp, Homo sapiens
tcagaggctacagtctgggagt

SEQ ID NO: 7583978 - DNA, 22 bp, Homo sapiens
tcagaggctacagtctgggagt

SEQ ID NO: 7583979 - DNA, 22 bp, Homo sapiens
tcagaggctacagtctgggagt

SEQ ID NO: 7583980 - DNA, 22 bp, Homo sapiens
tcagaggccttggttatggtat

SEQ ID NO: 7583981 - DNA, 22 bp, Homo sapiens
tcagaggctacagtctgggagt

SEQ ID NO: 7583982 - DNA, 22 bp, Homo sapiens
tcagaggctcactgtctacttt

SEQ ID NO: 7583983 - DNA, 22 bp, Homo sapiens
tcagaggctcatctgccttgca

SEQ ID NO: 7583984 - DNA, 20 bp, Homo sapiens
tcagaggctgccagctgggg

SEQ ID NO: 7583985 - DNA, 20 bp, Homo sapiens
tcagaggctgccagctgggg

SEQ ID NO: 7583986 - DNA, 20 bp, Homo sapiens
tcagaggctgccagctgggg

SEQ ID NO: 7583987 - DNA, 22 bp, Homo sapiens
tcagaggctgcatttttatcca

SEQ ID NO: 7583988 - DNA, 18 bp, Homo sapiens
tcagaggagatacctaaa

SEQ ID NO: 7583989 - DNA, 22 bp, Homo sapiens
tcagaggagaccaaggggaata

SEQ ID NO: 7583990 - DNA, 18 bp, Homo sapiens
tcagaggagatacctaaa

SEQ ID NO: 7583991 - DNA, 22 bp, Homo sapiens
tcagaggagaccaaggggaata

SEQ ID NO: 7583992 - DNA, 18 bp, Homo sapiens
tcagaggagatacctaaa

SEQ ID NO: 7583993 - DNA, 22 bp, Homo sapiens
tcagaggattgcctcagcgagc

SEQ ID NO: 7583994 - DNA, 22 bp, Homo sapiens
tcagaggattgcctcagcgagc

SEQ ID NO: 7583995 - DNA, 22 bp, Homo sapiens
tcagaggattgcctcagcgagc

SEQ ID NO: 7583996 - DNA, 19 bp, Homo sapiens
tcagaggatttggctatga

SEQ ID NO: 7583997 - DNA, 19 bp, Homo sapiens
tcagaggatttggctatga

SEQ ID NO: 7583998 - DNA, 22 bp, Homo sapiens
tcagaggattggacttttatgt

SEQ ID NO: 7583999 - DNA, 22 bp, Homo sapiens
tcagaggattggacttttatgt

SEQ ID NO: 7584000 - DNA, 22 bp, Homo sapiens
tcagaggattgcctcagcgagc

SEQ ID NO: 7584001 - DNA, 19 bp, Homo sapiens
tcagaggatttggctatga

SEQ ID NO: 7584002 - DNA, 19 bp, Homo sapiens
tcagaggatttggctatga

SEQ ID NO: 7584003 - DNA, 19 bp, Homo sapiens
tcagaggatttggctatga

SEQ ID NO: 7584004 - DNA, 19 bp, Homo sapiens
tcagaggatttggctatga

SEQ ID NO: 7584005 - DNA, 19 bp, Homo sapiens
tcagaggatttggctatga

SEQ ID NO: 7584006 - DNA, 22 bp, Homo sapiens
tcagaggagaccaaggggaata

SEQ ID NO: 7584007 - DNA, 22 bp, Homo sapiens
tcagaggagaagttgggaaaat

SEQ ID NO: 7584008 - DNA, 22 bp, Homo sapiens
tcagaggagaccaaggggaata

SEQ ID NO: 7584009 - DNA, 22 bp, Homo sapiens
tcagaggagaccaaggggaata

SEQ ID NO: 7584010 - DNA, 22 bp, Homo sapiens
tcagaggagaccaaggggaata

SEQ ID NO: 7584011 - DNA, 22 bp, Homo sapiens
tcagaggagaccaaggggaata

SEQ ID NO: 7584012 - DNA, 22 bp, Homo sapiens
tcagaggactaccttctccagt

SEQ ID NO: 7584013 - DNA, 22 bp, Homo sapiens
tcagaggagaagttgggaaaat

SEQ ID NO: 7584014 - DNA, 22 bp, Homo sapiens
tcagaggagaagttgggaaaat

SEQ ID NO: 7584015 - DNA, 22 bp, Homo sapiens
tcagaggagaagttgggaaaat

SEQ ID NO: 7584016 - DNA, 22 bp, Homo sapiens
tcagaggagaagttgggaaaat

SEQ ID NO: 7584017 - DNA, 22 bp, Homo sapiens
tcagaggagaagttgggaaaat

SEQ ID NO: 7584018 - DNA, 22 bp, Homo sapiens
tcagaggacgcactagggttgt

SEQ ID NO: 7584019 - DNA, 22 bp, Homo sapiens
tcagaggacgcactagggttgt

SEQ ID NO: 7584020 - DNA, 22 bp, Homo sapiens
tcagaggaccttactgagaacc

SEQ ID NO: 7584021 - DNA, 22 bp, Homo sapiens
tcagaggacgcactagggttgt

SEQ ID NO: 7584022 - DNA, 22 bp, Homo sapiens
tcagaggaccttactgagaacc

SEQ ID NO: 7584023 - DNA, 22 bp, Homo sapiens
tcagaggactaccttctccagt

SEQ ID NO: 7584024 - DNA, 22 bp, Homo sapiens
tcagaggactaccttctccagt

SEQ ID NO: 7584025 - DNA, 22 bp, Homo sapiens
tcagaggactaccttctccagt

SEQ ID NO: 7584026 - DNA, 22 bp, Homo sapiens
tcagaggactaccttctccagt

SEQ ID NO: 7584027 - DNA, 22 bp, Homo sapiens
tcaattctgcatacatttcact

SEQ ID NO: 7584028 - DNA, 22 bp, Homo sapiens
tcaattctagtggagagagttt

SEQ ID NO: 7584029 - DNA, 22 bp, Homo sapiens
tcaattctgcatacatttcact

SEQ ID NO: 7584030 - DNA, 22 bp, Homo sapiens
tcaattctgcctctaaatattt

SEQ ID NO: 7584031 - DNA, 22 bp, Homo sapiens
tcaattctgcctctaaatattt

SEQ ID NO: 7584032 - DNA, 22 bp, Homo sapiens
tcaattctgcctctaaatattt

SEQ ID NO: 7584033 - DNA, 22 bp, Homo sapiens
tcaattctggtcctcaggaact

SEQ ID NO: 7584034 - DNA, 22 bp, Homo sapiens
tcaattctagagccttacattg

SEQ ID NO: 7584035 - DNA, 22 bp, Homo sapiens
tcaattctagagccttacattg

SEQ ID NO: 7584036 - DNA, 22 bp, Homo sapiens
tcaattcatagagttgacacag

SEQ ID NO: 7584037 - DNA, 22 bp, Homo sapiens
tcaattctagtggagagagttt

SEQ ID NO: 7584038 - DNA, 22 bp, Homo sapiens
tcaattcatagagttgacacag

SEQ ID NO: 7584039 - DNA, 22 bp, Homo sapiens
tcaattcagtccaacagtaatt

SEQ ID NO: 7584040 - DNA, 22 bp, Homo sapiens
tcaattcatagagttgacacag

SEQ ID NO: 7584041 - DNA, 22 bp, Homo sapiens
tcaattctagagccttacattg

SEQ ID NO: 7584042 - DNA, 22 bp, Homo sapiens
tcaattcaacacatgcacattg

SEQ ID NO: 7584043 - DNA, 22 bp, Homo sapiens
tcaattcaacacatgcacattg

SEQ ID NO: 7584044 - DNA, 22 bp, Homo sapiens
tcaattcaacacatgcacattg

SEQ ID NO: 7584045 - DNA, 22 bp, Homo sapiens
tcaattattttggctatgctaa

SEQ ID NO: 7584046 - DNA, 22 bp, Homo sapiens
tcaattattttggctatgctaa

SEQ ID NO: 7584047 - DNA, 22 bp, Homo sapiens
tcaattattttggctatgctaa

SEQ ID NO: 7584048 - DNA, 22 bp, Homo sapiens
tcaattatttgatatgaaaggg

SEQ ID NO: 7584049 - DNA, 22 bp, Homo sapiens
tcaattatttgatatgaaaggg

SEQ ID NO: 7584050 - DNA, 22 bp, Homo sapiens
tcaattatttgatatgaaaggg

SEQ ID NO: 7584051 - DNA, 22 bp, Homo sapiens
tcaattatttgatatgaaaggg

SEQ ID NO: 7584052 - DNA, 22 bp, Homo sapiens
tcaattatttgatatgaaaggg

SEQ ID NO: 7584053 - DNA, 22 bp, Homo sapiens
tcaattatttgatatgaaaggg

SEQ ID NO: 7584054 - DNA, 22 bp, Homo sapiens
tcaattcacagctctgctattt

SEQ ID NO: 7584055 - DNA, 22 bp, Homo sapiens
tcaattcacagctctgctattt

SEQ ID NO: 7584056 - DNA, 22 bp, Homo sapiens
tcaattcagactgagaaatgat

SEQ ID NO: 7584057 - DNA, 22 bp, Homo sapiens
tcaattcagactgagaaatgat

SEQ ID NO: 7584058 - DNA, 22 bp, Homo sapiens
tcaattcagtccaacagtaatt

SEQ ID NO: 7584059 - DNA, 22 bp, Homo sapiens
tcaattcagtccaacagtaatt

SEQ ID NO: 7584060 - DNA, 22 bp, Homo sapiens
tcaattcagtccaacagtaatt

SEQ ID NO: 7584061 - DNA, 22 bp, Homo sapiens
tcaattcaattgcatttctgtg

SEQ ID NO: 7584062 - DNA, 22 bp, Homo sapiens
tcaattcaattgcatttctgtg

SEQ ID NO: 7584063 - DNA, 22 bp, Homo sapiens
tcaattcaattgcatttctgtg

SEQ ID NO: 7584064 - DNA, 22 bp, Homo sapiens
tcaattcaattgaacagttact

SEQ ID NO: 7584065 - DNA, 22 bp, Homo sapiens
tcaattcaattgaacagttact

SEQ ID NO: 7584066 - DNA, 22 bp, Homo sapiens
tcaattcaattgaacagttact

SEQ ID NO: 7584067 - DNA, 20 bp, Homo sapiens
tcaatgtaatcatatcatca

SEQ ID NO: 7584068 - DNA, 22 bp, Homo sapiens
tcaatgtaataaaatactctat

SEQ ID NO: 7584069 - DNA, 22 bp, Homo sapiens
tcaatgtaataaaatactctat

SEQ ID NO: 7584070 - DNA, 22 bp, Homo sapiens
tcaatgctgccaaatcttctag

SEQ ID NO: 7584071 - DNA, 22 bp, Homo sapiens
tcaatgtcagctggtaggaaat

SEQ ID NO: 7584072 - DNA, 22 bp, Homo sapiens
tcaatgtccgggccccattcca

SEQ ID NO: 7584073 - DNA, 20 bp, Homo sapiens
tcaatgtaatcatatcatca

SEQ ID NO: 7584074 - DNA, 22 bp, Homo sapiens
tcaatgtctgtctatctattta

SEQ ID NO: 7584075 - DNA, 22 bp, Homo sapiens
tcaatgtttgttcatgaaaata

SEQ ID NO: 7584076 - DNA, 22 bp, Homo sapiens
tcaatgtttgttcatgaaaata

SEQ ID NO: 7584077 - DNA, 22 bp, Homo sapiens
tcaatgtttgttcatgaaaata

SEQ ID NO: 7584078 - DNA, 22 bp, Homo sapiens
tcaatgtttggaaatcctttgt

SEQ ID NO: 7584079 - DNA, 22 bp, Homo sapiens
tcaatgttctgattcttttgca

SEQ ID NO: 7584080 - DNA, 22 bp, Homo sapiens
tcaatgtttggaaatcctttgt

SEQ ID NO: 7584081 - DNA, 22 bp, Homo sapiens
tcaatgtttgttcatgaaaata

SEQ ID NO: 7584082 - DNA, 22 bp, Homo sapiens
tcaatgttctgattcttttgca

SEQ ID NO: 7584083 - DNA, 22 bp, Homo sapiens
tcaatgttcaagtatgacaatg

SEQ ID NO: 7584084 - DNA, 22 bp, Homo sapiens
tcaatgttcttggtatatcctt

SEQ ID NO: 7584085 - DNA, 22 bp, Homo sapiens
tcaatgtgaattaagaatactt

SEQ ID NO: 7584086 - DNA, 22 bp, Homo sapiens
tcaatgttcaagtatgacaatg

SEQ ID NO: 7584087 - DNA, 23 bp, Homo sapiens
tcaattatcaatggaaagaagtt

SEQ ID NO: 7584088 - DNA, 23 bp, Homo sapiens
tcaattatcaatggaaagaagtt

SEQ ID NO: 7584089 - DNA, 23 bp, Homo sapiens
tcaattatcaatggaaagaagtt

SEQ ID NO: 7584090 - DNA, 22 bp, Homo sapiens
tcaattatgccattgcaatatt

SEQ ID NO: 7584091 - DNA, 22 bp, Homo sapiens
tcaattatgccattgcaatatt

SEQ ID NO: 7584092 - DNA, 22 bp, Homo sapiens
tcaattatgccattgcaatatt

SEQ ID NO: 7584093 - DNA, 22 bp, Homo sapiens
tcaattatgccattgcaatatt

SEQ ID NO: 7584094 - DNA, 22 bp, Homo sapiens
tcaattatgccattgcaatatt

SEQ ID NO: 7584095 - DNA, 21 bp, Homo sapiens
tcaattatggatgtgtgcaaa

SEQ ID NO: 7584096 - DNA, 22 bp, Homo sapiens
tcaattatgccattgcaatatt

SEQ ID NO: 7584097 - DNA, 22 bp, Homo sapiens
tcaattactaaccaaataatgt

SEQ ID NO: 7584098 - DNA, 22 bp, Homo sapiens
tcaattactaaccaaataatgt

SEQ ID NO: 7584099 - DNA, 22 bp, Homo sapiens
tcaattactaaccaaataatgt

SEQ ID NO: 7584100 - DNA, 22 bp, Homo sapiens
tcaattacagcaatgactgtac

SEQ ID NO: 7584101 - DNA, 22 bp, Homo sapiens
tcaattaagaggctaagttact

SEQ ID NO: 7584102 - DNA, 22 bp, Homo sapiens
tcaattaagaggctaagttact

SEQ ID NO: 7584103 - DNA, 22 bp, Homo sapiens
tcaattaagaggctaagttact

SEQ ID NO: 7584104 - DNA, 21 bp, Homo sapiens
tcacacacgtttccaagggca

SEQ ID NO: 7584105 - DNA, 22 bp, Homo sapiens
tcacacagattggtagagctga

SEQ ID NO: 7584106 - DNA, 22 bp, Homo sapiens
tcacacagattggtagagctga

SEQ ID NO: 7584107 - DNA, 22 bp, Homo sapiens
tcacacagattggtagagctga

SEQ ID NO: 7584108 - DNA, 21 bp, Homo sapiens
tcacacacgtttccaagggca

SEQ ID NO: 7584109 - DNA, 21 bp, Homo sapiens
tcacacacgtttccaagggca

SEQ ID NO: 7584110 - DNA, 21 bp, Homo sapiens
tcacacacgtttccaagggca

SEQ ID NO: 7584111 - DNA, 22 bp, Homo sapiens
tcacacacatttgctgtctgat

SEQ ID NO: 7584112 - DNA, 22 bp, Homo sapiens
tcacacacatttgctgtctgat

SEQ ID NO: 7584113 - DNA, 22 bp, Homo sapiens
tcacacacatttgctgtctgat

SEQ ID NO: 7584114 - DNA, 22 bp, Homo sapiens
tcacacacatggatagtatttt

SEQ ID NO: 7584115 - DNA, 22 bp, Homo sapiens
tcacacacatttgctgtctgat

SEQ ID NO: 7584116 - DNA, 22 bp, Homo sapiens
tcacacacatttgctgtctgat

SEQ ID NO: 7584117 - DNA, 22 bp, Homo sapiens
tcacacacatggatagtatttt

SEQ ID NO: 7584118 - DNA, 22 bp, Homo sapiens
tcacacacatggatagtatttt

SEQ ID NO: 7584119 - DNA, 22 bp, Homo sapiens
tcacacacataatctaagatta

SEQ ID NO: 7584120 - DNA, 22 bp, Homo sapiens
tcacacacatggatagtatttt

SEQ ID NO: 7584121 - DNA, 22 bp, Homo sapiens
tcacacacataatctaagatta

SEQ ID NO: 7584122 - DNA, 22 bp, Homo sapiens
tcacacacataatctaagatta

SEQ ID NO: 7584123 - DNA, 22 bp, Homo sapiens
tcacacacataatctaagatta

SEQ ID NO: 7584124 - DNA, 22 bp, Homo sapiens
tcacaattgtttttaggatcaa

SEQ ID NO: 7584125 - DNA, 22 bp, Homo sapiens
tcaatttaaggtactactttgg

SEQ ID NO: 7584126 - DNA, 22 bp, Homo sapiens
tcacaattgagatcctcccacc

SEQ ID NO: 7584127 - DNA, 22 bp, Homo sapiens
tcacaatttggatacagctatg

SEQ ID NO: 7584128 - DNA, 22 bp, Homo sapiens
tcaattctggtcctcaggaact

SEQ ID NO: 7584129 - DNA, 22 bp, Homo sapiens
tcaatttaaggtactactttgg

SEQ ID NO: 7584130 - DNA, 22 bp, Homo sapiens
tcaatttaaggtactactttgg

SEQ ID NO: 7584131 - DNA, 22 bp, Homo sapiens
tcacacagcttggagttatggt

SEQ ID NO: 7584132 - DNA, 22 bp, Homo sapiens
tcacacagcttggagttatggt

SEQ ID NO: 7584133 - DNA, 22 bp, Homo sapiens
tcacacagcttggagttatggt

SEQ ID NO: 7584134 - DNA, 23 bp, Homo sapiens
tcacacagctggtcaggtacaga

SEQ ID NO: 7584135 - DNA, 23 bp, Homo sapiens
tcacacagctggtcaggtacaga

SEQ ID NO: 7584136 - DNA, 22 bp, Homo sapiens
tcacacagggtcggaaagagtg

SEQ ID NO: 7584137 - DNA, 22 bp, Homo sapiens
tcacacagggtcggaaagagtg

SEQ ID NO: 7584138 - DNA, 22 bp, Homo sapiens
tcacacagggtcggaaagagtg

SEQ ID NO: 7584139 - DNA, 22 bp, Homo sapiens
tcacacagggtcggaaagagtg

SEQ ID NO: 7584140 - DNA, 22 bp, Homo sapiens
tcacacagggtcggaaagagtg

SEQ ID NO: 7584141 - DNA, 22 bp, Homo sapiens
tcacacagggtcggaaagagtg

SEQ ID NO: 7584142 - DNA, 22 bp, Homo sapiens
tcacacagggtcggaaagagtg

SEQ ID NO: 7584143 - DNA, 22 bp, Homo sapiens
tcacacagctagtaagggccga

SEQ ID NO: 7584144 - DNA, 22 bp, Homo sapiens
tcacacagctagtaagggccga

SEQ ID NO: 7584145 - DNA, 22 bp, Homo sapiens
tcacacagctcctttccttagt

SEQ ID NO: 7584146 - DNA, 22 bp, Homo sapiens
tcacacagcagccccgggtgtt

SEQ ID NO: 7584147 - DNA, 22 bp, Homo sapiens
tcacacagattggtagagctga

SEQ ID NO: 7584148 - DNA, 23 bp, Homo sapiens
tcacacagctggtcaggtacaga

SEQ ID NO: 7584149 - DNA, 23 bp, Homo sapiens
tcacacagctggtcaggtacaga

SEQ ID NO: 7584150 - DNA, 23 bp, Homo sapiens
tcacacagctggtcaggtacaga

SEQ ID NO: 7584151 - DNA, 22 bp, Homo sapiens
tcacacagctgacagagccttt

SEQ ID NO: 7584152 - DNA, 22 bp, Homo sapiens
tcacacagctgctctgttttat

SEQ ID NO: 7584153 - DNA, 22 bp, Homo sapiens
tcacacagctgctctgttttat

SEQ ID NO: 7584154 - DNA, 22 bp, Homo sapiens
tcacacagctgacagagccttt

SEQ ID NO: 7584155 - DNA, 22 bp, Homo sapiens
tcaaaattaaaccaacgtccag

SEQ ID NO: 7584156 - DNA, 22 bp, Homo sapiens
tcaaaattaaaccaacgtccag

SEQ ID NO: 7584157 - DNA, 22 bp, Homo sapiens
tcaaaattagtgaccaaaggca

SEQ ID NO: 7584158 - DNA, 22 bp, Homo sapiens
tcaaaattagtgaccaaaggca

SEQ ID NO: 7584159 - DNA, 18 bp, Homo sapiens
tcaaaatatttctgtgga

SEQ ID NO: 7584160 - DNA, 18 bp, Homo sapiens
tcaaaatatttctgtgga

SEQ ID NO: 7584161 - DNA, 22 bp, Homo sapiens
tcaaaatcaaagatacttgaaa

SEQ ID NO: 7584162 - DNA, 18 bp, Homo sapiens
tcaaaatatttctgtgga

SEQ ID NO: 7584163 - DNA, 18 bp, Homo sapiens
tcaaaatatttctgtgga

SEQ ID NO: 7584164 - DNA, 20 bp, Homo sapiens
tcaaaataggtgtgggcgga

SEQ ID NO: 7584165 - DNA, 18 bp, Homo sapiens
tcaaaatatttctgtgga

SEQ ID NO: 7584166 - DNA, 18 bp, Homo sapiens
tcaaaatatttctgtgga

SEQ ID NO: 7584167 - DNA, 18 bp, Homo sapiens
tcaaaatatttctgtgga

SEQ ID NO: 7584168 - DNA, 18 bp, Homo sapiens
tcaaaatatttctgtgga

SEQ ID NO: 7584169 - DNA, 18 bp, Homo sapiens
tcaaaatatttctgtgga

SEQ ID NO: 7584170 - DNA, 18 bp, Homo sapiens
tcaaaatatttctgtgga

SEQ ID NO: 7584171 - DNA, 22 bp, Homo sapiens
tcaaaattttatttctcaagga

SEQ ID NO: 7584172 - DNA, 22 bp, Homo sapiens
tcaaaattttatttctcaagga

SEQ ID NO: 7584173 - DNA, 22 bp, Homo sapiens
tcaaacactgtaacatggaaaa

SEQ ID NO: 7584174 - DNA, 22 bp, Homo sapiens
tcaaacaccatctgaccttatg

SEQ ID NO: 7584175 - DNA, 22 bp, Homo sapiens
tcaaacagaaattgttcatgct

SEQ ID NO: 7584176 - DNA, 22 bp, Homo sapiens
tcaaacagaaattgttcatgct

SEQ ID NO: 7584177 - DNA, 22 bp, Homo sapiens
tcaaacactgtaacatggaaaa

SEQ ID NO: 7584178 - DNA, 22 bp, Homo sapiens
tcaaacactgtaacatggaaaa

SEQ ID NO: 7584179 - DNA, 22 bp, Homo sapiens
tcaaacagaaattgttcatgct

SEQ ID NO: 7584180 - DNA, 22 bp, Homo sapiens
tcaaacagaggaacaattgttt

SEQ ID NO: 7584181 - DNA, 22 bp, Homo sapiens
tcaaacagaggaacaattgttt

SEQ ID NO: 7584182 - DNA, 22 bp, Homo sapiens
tcaaaatttcagcactagccct

SEQ ID NO: 7584183 - DNA, 22 bp, Homo sapiens
tcaaaatttcagcactagccct

SEQ ID NO: 7584184 - DNA, 22 bp, Homo sapiens
tcaaaattttatttctcaagga

SEQ ID NO: 7584185 - DNA, 22 bp, Homo sapiens
tcaaaattctagggagaatggt

SEQ ID NO: 7584186 - DNA, 22 bp, Homo sapiens
tcaaaattctagggagaatggt

SEQ ID NO: 7584187 - DNA, 22 bp, Homo sapiens
tcaaaattctagggagaatggt

SEQ ID NO: 7584188 - DNA, 22 bp, Homo sapiens
tcaaaatttcagcactagccct

SEQ ID NO: 7584189 - DNA, 22 bp, Homo sapiens
tcaaaatttcagcactagccct

SEQ ID NO: 7584190 - DNA, 22 bp, Homo sapiens
tcaaaaatggtctttgagctgc

SEQ ID NO: 7584191 - DNA, 22 bp, Homo sapiens
tcaaaaatggtctttgagctgc

SEQ ID NO: 7584192 - DNA, 22 bp, Homo sapiens
tcaaaaatggtctttgagctgc

SEQ ID NO: 7584193 - DNA, 22 bp, Homo sapiens
tcaaaaatggtctttgagctgc

SEQ ID NO: 7584194 - DNA, 22 bp, Homo sapiens
tcaaaaatggtctttgagctgc

SEQ ID NO: 7584195 - DNA, 22 bp, Homo sapiens
tcaaaaatggtctttgagctgc

SEQ ID NO: 7584196 - DNA, 22 bp, Homo sapiens
tcaaaagacacaggaggctagt

SEQ ID NO: 7584197 - DNA, 22 bp, Homo sapiens
tcaaaaggacagaagacctaaa

SEQ ID NO: 7584198 - DNA, 22 bp, Homo sapiens
tcaaaagacacaggaggctagt

SEQ ID NO: 7584199 - DNA, 22 bp, Homo sapiens
tcaaaaatgttttatattggta

SEQ ID NO: 7584200 - DNA, 22 bp, Homo sapiens
tcaaaagaaacaccatgttcct

SEQ ID NO: 7584201 - DNA, 22 bp, Homo sapiens
tcaaaagacacaggaggctagt

SEQ ID NO: 7584202 - DNA, 22 bp, Homo sapiens
tcaaaagaaacaccatgttcct

SEQ ID NO: 7584203 - DNA, 22 bp, Homo sapiens
tcaaaaatgttttatattggta

SEQ ID NO: 7584204 - DNA, 22 bp, Homo sapiens
tcaaaaatgttttatattggta

SEQ ID NO: 7584205 - DNA, 22 bp, Homo sapiens
tcaaaaatgttttatattggta

SEQ ID NO: 7584206 - DNA, 22 bp, Homo sapiens
tcaaaaatgttttatattggta

SEQ ID NO: 7584207 - DNA, 22 bp, Homo sapiens
tcaaaaatgttttatattggta

SEQ ID NO: 7584208 - DNA, 22 bp, Homo sapiens
tcaaaagtctgcattcttcaca

SEQ ID NO: 7584209 - DNA, 22 bp, Homo sapiens
tcaaaagtctgcattcttcaca

SEQ ID NO: 7584210 - DNA, 22 bp, Homo sapiens
tcaaaagtggcctgtaaaatct

SEQ ID NO: 7584211 - DNA, 22 bp, Homo sapiens
tcaaaagtctgcattcttcaca

SEQ ID NO: 7584212 - DNA, 22 bp, Homo sapiens
tcaaaagtttcacatagagata

SEQ ID NO: 7584213 - DNA, 22 bp, Homo sapiens
tcaaaagtttcacatagagata

SEQ ID NO: 7584214 - DNA, 22 bp, Homo sapiens
tcaaaagtggcctgtaaaatct

SEQ ID NO: 7584215 - DNA, 22 bp, Homo sapiens
tcaaaagtggcctgtaaaatct

SEQ ID NO: 7584216 - DNA, 22 bp, Homo sapiens
tcaaaagtggcctgtaaaatct

SEQ ID NO: 7584217 - DNA, 20 bp, Homo sapiens
tcaaaataggtgtgggcgga

SEQ ID NO: 7584218 - DNA, 20 bp, Homo sapiens
tcaaaataggtgtgggcgga

SEQ ID NO: 7584219 - DNA, 22 bp, Homo sapiens
tcaaaagtttcacatagagata

SEQ ID NO: 7584220 - DNA, 22 bp, Homo sapiens
tcaaaagtttcacatagagata

SEQ ID NO: 7584221 - DNA, 22 bp, Homo sapiens
tcaaaagtttcacatagagata

SEQ ID NO: 7584222 - DNA, 23 bp, Homo sapiens
tcaaacatattgtgagacacagg

SEQ ID NO: 7584223 - DNA, 23 bp, Homo sapiens
tcaaacatattgtgagacacagg

SEQ ID NO: 7584224 - DNA, 22 bp, Homo sapiens
tcaaacatccccaccagggact

SEQ ID NO: 7584225 - DNA, 22 bp, Homo sapiens
tcaaacatgaaagcttgatttt

SEQ ID NO: 7584226 - DNA, 22 bp, Homo sapiens
tcaaacatgaaagcttgatttt

SEQ ID NO: 7584227 - DNA, 22 bp, Homo sapiens
tcaaacatgaaagcttgatttt

SEQ ID NO: 7584228 - DNA, 22 bp, Homo sapiens
tcaaacatgaaagcttgatttt

SEQ ID NO: 7584229 - DNA, 21 bp, Homo sapiens
tcaaacatgatctgggtcatc

SEQ ID NO: 7584230 - DNA, 22 bp, Homo sapiens
tcaaaccaccttgttactgggg

SEQ ID NO: 7584231 - DNA, 22 bp, Homo sapiens
tcaaaccaccttgttactgggg

SEQ ID NO: 7584232 - DNA, 22 bp, Homo sapiens
tcaaaccaccttgttactgggg

SEQ ID NO: 7584233 - DNA, 22 bp, Homo sapiens
tcaaaccagccttgcatcccag

SEQ ID NO: 7584234 - DNA, 22 bp, Homo sapiens
tcaaaccagccttgcatcccag

SEQ ID NO: 7584235 - DNA, 22 bp, Homo sapiens
tcaaaccatataatcggttaca

SEQ ID NO: 7584236 - DNA, 22 bp, Homo sapiens
tcaaaccatataatcggttaca

SEQ ID NO: 7584237 - DNA, 22 bp, Homo sapiens
tcaaacataggcacacattcag

SEQ ID NO: 7584238 - DNA, 23 bp, Homo sapiens
tcaaacaggtttcagagcatctt

SEQ ID NO: 7584239 - DNA, 23 bp, Homo sapiens
tcaaacaggtttcagagcatctt

SEQ ID NO: 7584240 - DNA, 22 bp, Homo sapiens
tcaaacataaaactaaatcgag

SEQ ID NO: 7584241 - DNA, 22 bp, Homo sapiens
tcaaacataggcacacattcag

SEQ ID NO: 7584242 - DNA, 22 bp, Homo sapiens
tcaaacataggcacacattcag

SEQ ID NO: 7584243 - DNA, 22 bp, Homo sapiens
tcaaacatatctgattttccat

SEQ ID NO: 7584244 - DNA, 22 bp, Homo sapiens
tcaaacatatctgattttccat

SEQ ID NO: 7584245 - DNA, 22 bp, Homo sapiens
tcaaacatatctgattttccat

SEQ ID NO: 7584246 - DNA, 22 bp, Homo sapiens
tcaaacatatctgattttccat

SEQ ID NO: 7584247 - DNA, 22 bp, Homo sapiens
tcaaacaggactacattctcat

SEQ ID NO: 7584248 - DNA, 22 bp, Homo sapiens
tcaaacaggactacattctcat

SEQ ID NO: 7584249 - DNA, 22 bp, Homo sapiens
tcaaacagcaggtctttcatag

SEQ ID NO: 7584250 - DNA, 22 bp, Homo sapiens
tcaaacagcaggtctttcatag

SEQ ID NO: 7584251 - DNA, 22 bp, Homo sapiens
tcaaacaggactacattctcat

SEQ ID NO: 7584252 - DNA, 22 bp, Homo sapiens
tcaaacaggactacattctcat

SEQ ID NO: 7584253 - DNA, 23 bp, Homo sapiens
tcaaacaggtttcagagcatctt

SEQ ID NO: 7584254 - DNA, 23 bp, Homo sapiens
tcaaacaggtttcagagcatctt

SEQ ID NO: 7584255 - DNA, 22 bp, Homo sapiens
tcaaacagcaggtctttcatag

SEQ ID NO: 7584256 - DNA, 22 bp, Homo sapiens
tcaaacagcaggtctttcatag

SEQ ID NO: 7584257 - DNA, 22 bp, Homo sapiens
tcaaacagaggaacaattgttt

SEQ ID NO: 7584258 - DNA, 22 bp, Homo sapiens
tcaaacagaggaacaattgttt

SEQ ID NO: 7584259 - DNA, 22 bp, Homo sapiens
tcaaacagcaggtctttcatag

SEQ ID NO: 7584260 - DNA, 22 bp, Homo sapiens
tcaaacagcaggtctttcatag

SEQ ID NO: 7584261 - DNA, 22 bp, Homo sapiens
tcaaacagaggaacaattgttt

SEQ ID NO: 7584262 - DNA, 22 bp, Homo sapiens
tcaaacagaggaacaattgttt

SEQ ID NO: 7584263 - DNA, 22 bp, Homo sapiens
tcaatacatacaatgtatagtg

SEQ ID NO: 7584264 - DNA, 22 bp, Homo sapiens
tcaatacatacaatgtatagtg

SEQ ID NO: 7584265 - DNA, 22 bp, Homo sapiens
tcaatacatacaatgtatagtg

SEQ ID NO: 7584266 - DNA, 22 bp, Homo sapiens
tcaaacctgctgtcttgttcat

SEQ ID NO: 7584267 - DNA, 21 bp, Homo sapiens
tcaatacaggtgcatgtgtct

SEQ ID NO: 7584268 - DNA, 22 bp, Homo sapiens
tcaaactagcctgactggtatt

SEQ ID NO: 7584269 - DNA, 22 bp, Homo sapiens
tcaaactagcctgactggtatt

SEQ ID NO: 7584270 - DNA, 22 bp, Homo sapiens
tcaaaccaccttgttactgggg

SEQ ID NO: 7584271 - DNA, 23 bp, Homo sapiens
tcaaaccgtctgctggaagacat

SEQ ID NO: 7584272 - DNA, 22 bp, Homo sapiens
tcaaacctgctgtcttgttcat

SEQ ID NO: 7584273 - DNA, 22 bp, Homo sapiens
tcaatactatgattttgtacat

SEQ ID NO: 7584274 - DNA, 22 bp, Homo sapiens
tcaatactcacaaagagatttt

SEQ ID NO: 7584275 - DNA, 22 bp, Homo sapiens
tcaatacatgtgtgtggatggt

SEQ ID NO: 7584276 - DNA, 22 bp, Homo sapiens
tcaatagaaatgcagagtctca

SEQ ID NO: 7584277 - DNA, 22 bp, Homo sapiens
tcaatgcaacttccacctccca

SEQ ID NO: 7584278 - DNA, 22 bp, Homo sapiens
tcaatgcacacaggacttggtg

SEQ ID NO: 7584279 - DNA, 22 bp, Homo sapiens
tcaatgcaatcattggacaagt

SEQ ID NO: 7584280 - DNA, 19 bp, Homo sapiens
tcaatgcatgaaatcagcc

SEQ ID NO: 7584281 - DNA, 22 bp, Homo sapiens
tcaatgcatgtgacaaagagta

SEQ ID NO: 7584282 - DNA, 22 bp, Homo sapiens
tcaatgcataggaggtggcaga

SEQ ID NO: 7584283 - DNA, 19 bp, Homo sapiens
tcaatgcatgaaatcagcc

SEQ ID NO: 7584284 - DNA, 22 bp, Homo sapiens
tcaatgatagacaagatctaag

SEQ ID NO: 7584285 - DNA, 22 bp, Homo sapiens
tcaatacttaagcttaattcta

SEQ ID NO: 7584286 - DNA, 22 bp, Homo sapiens
tcaatgatagtacaatcagcct

SEQ ID NO: 7584287 - DNA, 22 bp, Homo sapiens
tcaatgatgctgaaggtagcgt

SEQ ID NO: 7584288 - DNA, 22 bp, Homo sapiens
tcaatgcaacctccacctcccg

SEQ ID NO: 7584289 - DNA, 22 bp, Homo sapiens
tcaatgattagagtttagtgtg

SEQ ID NO: 7584290 - DNA, 22 bp, Homo sapiens
tcaatgatagacaagatctaag

SEQ ID NO: 7584291 - DNA, 22 bp, Homo sapiens
tcaatagaaatgcagagtctca

SEQ ID NO: 7584292 - DNA, 22 bp, Homo sapiens
tcaatgatagtacaatcagcct

SEQ ID NO: 7584293 - DNA, 22 bp, Homo sapiens
tcacagacactgggttattgca

SEQ ID NO: 7584294 - DNA, 22 bp, Homo sapiens
tcacagacaccttggccacagt

SEQ ID NO: 7584295 - DNA, 22 bp, Homo sapiens
tcacagacaccttggccacagt

SEQ ID NO: 7584296 - DNA, 22 bp, Homo sapiens
tcacagacacattaaacatgtg

SEQ ID NO: 7584297 - DNA, 22 bp, Homo sapiens
tcacagacacattaaacatgtg

SEQ ID NO: 7584298 - DNA, 22 bp, Homo sapiens
tcacagacacagggagaagcat

SEQ ID NO: 7584299 - DNA, 19 bp, Homo sapiens
tcacagacagagcaatcac

SEQ ID NO: 7584300 - DNA, 19 bp, Homo sapiens
tcacagacagagcaatcac

SEQ ID NO: 7584301 - DNA, 18 bp, Homo sapiens
tcacagacagctgtcttt

SEQ ID NO: 7584302 - DNA, 22 bp, Homo sapiens
tcacagacatggtgaggtaaca

SEQ ID NO: 7584303 - DNA, 22 bp, Homo sapiens
tcacagagagaatattgtgttt

SEQ ID NO: 7584304 - DNA, 22 bp, Homo sapiens
tcacagagaggttaagcagttg

SEQ ID NO: 7584305 - DNA, 22 bp, Homo sapiens
tcacagagaggttaagcagttg

SEQ ID NO: 7584306 - DNA, 22 bp, Homo sapiens
tcacagagagaatattgtgttt

SEQ ID NO: 7584307 - DNA, 22 bp, Homo sapiens
tcacagagagaatattgtgttt

SEQ ID NO: 7584308 - DNA, 22 bp, Homo sapiens
tcacagagaggttaagcagttg

SEQ ID NO: 7584309 - DNA, 22 bp, Homo sapiens
tcacagagagtgacttgttgct

SEQ ID NO: 7584310 - DNA, 22 bp, Homo sapiens
tcacagagagtgacttgttgct

SEQ ID NO: 7584311 - DNA, 22 bp, Homo sapiens
tcacagagagtgacttgttgct

SEQ ID NO: 7584312 - DNA, 22 bp, Homo sapiens
tcacagagaggttaagcagttg

SEQ ID NO: 7584313 - DNA, 22 bp, Homo sapiens
tcacagagaggttaagcagttg

SEQ ID NO: 7584314 - DNA, 22 bp, Homo sapiens
tcacagagatgaacttttgata

SEQ ID NO: 7584315 - DNA, 22 bp, Homo sapiens
tcacagagatgaacttttgata

SEQ ID NO: 7584316 - DNA, 22 bp, Homo sapiens
tcacagagcacacaagaattgc

SEQ ID NO: 7584317 - DNA, 22 bp, Homo sapiens
tcacagagcacacaagaattgc

SEQ ID NO: 7584318 - DNA, 22 bp, Homo sapiens
tcacagagcacacaagaattgc

SEQ ID NO: 7584319 - DNA, 22 bp, Homo sapiens
tcacagcaaatgctgcttctca

SEQ ID NO: 7584320 - DNA, 22 bp, Homo sapiens
tcacagcaaatgctgcttctca

SEQ ID NO: 7584321 - DNA, 22 bp, Homo sapiens
tcacagcaaatgctgcttctca

SEQ ID NO: 7584322 - DNA, 22 bp, Homo sapiens
tcacagcaaatgctgcttctca

SEQ ID NO: 7584323 - DNA, 22 bp, Homo sapiens
tcacagcaaatgctgcttctca

SEQ ID NO: 7584324 - DNA, 22 bp, Homo sapiens
tcacagcaaaagtgtgcagagc

SEQ ID NO: 7584325 - DNA, 22 bp, Homo sapiens
tcacagcaaaagtgtgcagagc

SEQ ID NO: 7584326 - DNA, 22 bp, Homo sapiens
tcacagcaaaagtgtgcagagc

SEQ ID NO: 7584327 - DNA, 22 bp, Homo sapiens
tcacagcaaaagtgtgcagagc

SEQ ID NO: 7584328 - DNA, 22 bp, Homo sapiens
tcacagcaaaagtgtgcagagc

SEQ ID NO: 7584329 - DNA, 22 bp, Homo sapiens
tcacagcaaaagtgtgcagagc

SEQ ID NO: 7584330 - DNA, 20 bp, Homo sapiens
tcacagatgaaagttcaaga

SEQ ID NO: 7584331 - DNA, 19 bp, Homo sapiens
tcacagagttcttacggga

SEQ ID NO: 7584332 - DNA, 20 bp, Homo sapiens
tcacagatgaaagttcaaga

SEQ ID NO: 7584333 - DNA, 19 bp, Homo sapiens
tcacagagttcttacggga

SEQ ID NO: 7584334 - DNA, 22 bp, Homo sapiens
tcacagagttaaaagtttcttt

SEQ ID NO: 7584335 - DNA, 21 bp, Homo sapiens
tcacagagccacagaattggt

SEQ ID NO: 7584336 - DNA, 21 bp, Homo sapiens
tcacagagccacagaattggt

SEQ ID NO: 7584337 - DNA, 23 bp, Homo sapiens
tcacagagcatactgcattttgc

SEQ ID NO: 7584338 - DNA, 21 bp, Homo sapiens
tcacagagccacagaattggt

SEQ ID NO: 7584339 - DNA, 21 bp, Homo sapiens
tcacagagccacagaattggt

SEQ ID NO: 7584340 - DNA, 23 bp, Homo sapiens
tcacagagcatactgcattttgc

SEQ ID NO: 7584341 - DNA, 23 bp, Homo sapiens
tcacagagcatactgcattttgc

SEQ ID NO: 7584342 - DNA, 22 bp, Homo sapiens
tcacagagcacgtatcatgcct

SEQ ID NO: 7584343 - DNA, 22 bp, Homo sapiens
tcacagagcacgtatcatgcct

SEQ ID NO: 7584344 - DNA, 22 bp, Homo sapiens
tcacagagcacgtatcatgcct

SEQ ID NO: 7584345 - DNA, 22 bp, Homo sapiens
tcacagagcacacaagaattgc

SEQ ID NO: 7584346 - DNA, 22 bp, Homo sapiens
tcacagagttaaaagtttcttt

SEQ ID NO: 7584347 - DNA, 22 bp, Homo sapiens
tcacagagttaaaagtttcttt

SEQ ID NO: 7584348 - DNA, 22 bp, Homo sapiens
tcacagagttaaaagtttcttt

SEQ ID NO: 7584349 - DNA, 22 bp, Homo sapiens
tcacagagttaaaagtttcttt

SEQ ID NO: 7584350 - DNA, 22 bp, Homo sapiens
tcacagagttaaaagtttcttt

SEQ ID NO: 7584351 - DNA, 22 bp, Homo sapiens
tcacagagttaaaagtttcttt

SEQ ID NO: 7584352 - DNA, 20 bp, Homo sapiens
tcacagagtagccttgtctg

SEQ ID NO: 7584353 - DNA, 20 bp, Homo sapiens
tcacagagtagccttgtctg

SEQ ID NO: 7584354 - DNA, 22 bp, Homo sapiens
tcacagagctcacagtttagca

SEQ ID NO: 7584355 - DNA, 22 bp, Homo sapiens
tcacagagctcacagtttagca

SEQ ID NO: 7584356 - DNA, 22 bp, Homo sapiens
tcacagagctcacagtttagca

SEQ ID NO: 7584357 - DNA, 22 bp, Homo sapiens
tcacagagctcacagtttagca

SEQ ID NO: 7584358 - DNA, 22 bp, Homo sapiens
tcacagagctcacagtttagca

SEQ ID NO: 7584359 - DNA, 22 bp, Homo sapiens
tcacagaatgtctagcataatt

SEQ ID NO: 7584360 - DNA, 22 bp, Homo sapiens
tcacagaatgtcagagttgggg

SEQ ID NO: 7584361 - DNA, 22 bp, Homo sapiens
tcacagaatgtctagcataatt

SEQ ID NO: 7584362 - DNA, 22 bp, Homo sapiens
tcacagaatgtctagcataatt

SEQ ID NO: 7584363 - DNA, 22 bp, Homo sapiens
tcacagaatgtctagcataatt

SEQ ID NO: 7584364 - DNA, 22 bp, Homo sapiens
tcacagaatgtcagagttgggg

SEQ ID NO: 7584365 - DNA, 22 bp, Homo sapiens
tcacagaatgtcagagttgggg

SEQ ID NO: 7584366 - DNA, 22 bp, Homo sapiens
tcacagaatgtcagagttgggg

SEQ ID NO: 7584367 - DNA, 22 bp, Homo sapiens
tcacagaatgtcagagttgggg

SEQ ID NO: 7584368 - DNA, 22 bp, Homo sapiens
tcacagaatgtctagcataatt

SEQ ID NO: 7584369 - DNA, 22 bp, Homo sapiens
tcacagaatgtctagcataatt

SEQ ID NO: 7584370 - DNA, 22 bp, Homo sapiens
tcacagaatgtctagcataatt

SEQ ID NO: 7584371 - DNA, 22 bp, Homo sapiens
tcacagaatgtctagcataatt

SEQ ID NO: 7584372 - DNA, 22 bp, Homo sapiens
tcacagaatgtctagcataatt

SEQ ID NO: 7584373 - DNA, 22 bp, Homo sapiens
tcacagaatgtctagcataatt

SEQ ID NO: 7584374 - DNA, 22 bp, Homo sapiens
tcacagaatgtctagcataatt

SEQ ID NO: 7584375 - DNA, 22 bp, Homo sapiens
tcacagacacagggagaagcat

SEQ ID NO: 7584376 - DNA, 22 bp, Homo sapiens
tcacagaatttttgcttccagt

SEQ ID NO: 7584377 - DNA, 22 bp, Homo sapiens
tcacagaatttttgcttccagt

SEQ ID NO: 7584378 - DNA, 22 bp, Homo sapiens
tcacagaatttttgcttccagt

SEQ ID NO: 7584379 - DNA, 22 bp, Homo sapiens
tcacagaattgacatgggaatc

SEQ ID NO: 7584380 - DNA, 22 bp, Homo sapiens
tcacagaattgacatgggaatc

SEQ ID NO: 7584381 - DNA, 22 bp, Homo sapiens
tcacagaattgacatgggaatc

SEQ ID NO: 7584382 - DNA, 22 bp, Homo sapiens
tcacagaatttttgcttccagt

SEQ ID NO: 7584383 - DNA, 22 bp, Homo sapiens
tcacagaatttttgcttccagt

SEQ ID NO: 7584384 - DNA, 22 bp, Homo sapiens
tcacagaatttttgcttccagt

SEQ ID NO: 7584385 - DNA, 22 bp, Homo sapiens
tcacagaatttttgcttccagt

SEQ ID NO: 7584386 - DNA, 22 bp, Homo sapiens
tcacagaatttttgcttccagt

SEQ ID NO: 7584387 - DNA, 20 bp, Homo sapiens
tcacagaatgcctgaagaag

SEQ ID NO: 7584388 - DNA, 20 bp, Homo sapiens
tcacagaatgcctgaagaag

SEQ ID NO: 7584389 - DNA, 22 bp, Homo sapiens
tcacagaatctctgataagtct

SEQ ID NO: 7584390 - DNA, 20 bp, Homo sapiens
tcacagaatgcctgaagaag

SEQ ID NO: 7584391 - DNA, 20 bp, Homo sapiens
tcacagaatgcctgaagaag

SEQ ID NO: 7584392 - DNA, 22 bp, Homo sapiens
tcacagaatgtcagagttgggg

SEQ ID NO: 7584393 - DNA, 20 bp, Homo sapiens
tcacagaatgcctgaagaag

SEQ ID NO: 7584394 - DNA, 22 bp, Homo sapiens
tcacagaatctctgataagtct

SEQ ID NO: 7584395 - DNA, 18 bp, Homo sapiens
tcacagaatattgagtgg

SEQ ID NO: 7584396 - DNA, 22 bp, Homo sapiens
tcacagaatctctgataagtct

SEQ ID NO: 7584397 - DNA, 22 bp, Homo sapiens
tcacagaatctctgataagtct

SEQ ID NO: 7584398 - DNA, 22 bp, Homo sapiens
tcacagaatagcactgtaagcg

SEQ ID NO: 7584399 - DNA, 22 bp, Homo sapiens
tcacagaatagcactgtaagcg

SEQ ID NO: 7584400 - DNA, 22 bp, Homo sapiens
tcacagaatagcactgtaagcg

SEQ ID NO: 7584401 - DNA, 22 bp, Homo sapiens
tcacagaatagcactgtaagcg

SEQ ID NO: 7584402 - DNA, 22 bp, Homo sapiens
tcacagaataaattgagaagac

SEQ ID NO: 7584403 - DNA, 18 bp, Homo sapiens
tcacagaatattgagtgg

SEQ ID NO: 7584404 - DNA, 22 bp, Homo sapiens
tcacagaatagcactgtaagcg

SEQ ID NO: 7584405 - DNA, 22 bp, Homo sapiens
tcacagaatagcactgtaagcg

SEQ ID NO: 7584406 - DNA, 22 bp, Homo sapiens
tcacagaatagcactgtaagcg

SEQ ID NO: 7584407 - DNA, 18 bp, Homo sapiens
tcacagaatattgagtgg

SEQ ID NO: 7584408 - DNA, 18 bp, Homo sapiens
tcacagaatattgagtgg

SEQ ID NO: 7584409 - DNA, 22 bp, Homo sapiens
tcacacaggtttgcaatgattt

SEQ ID NO: 7584410 - DNA, 22 bp, Homo sapiens
tcacacaggtttgcaatgattt

SEQ ID NO: 7584411 - DNA, 22 bp, Homo sapiens
tcacacaggtttgcaatgattt

SEQ ID NO: 7584412 - DNA, 22 bp, Homo sapiens
tcacacagggttctggtctcat

SEQ ID NO: 7584413 - DNA, 22 bp, Homo sapiens
tcacacagggttctggtctcat

SEQ ID NO: 7584414 - DNA, 22 bp, Homo sapiens
tcacacagggttctggtctcat

SEQ ID NO: 7584415 - DNA, 22 bp, Homo sapiens
tcacacagtgagcggggctcag

SEQ ID NO: 7584416 - DNA, 22 bp, Homo sapiens
tcacacagtgagcggggctcag

SEQ ID NO: 7584417 - DNA, 22 bp, Homo sapiens
tcacacagtgagcggggctcag

SEQ ID NO: 7584418 - DNA, 22 bp, Homo sapiens
tcacacagtggtaaaaccctga

SEQ ID NO: 7584419 - DNA, 22 bp, Homo sapiens
tcacacagtggtaaaaccctga

SEQ ID NO: 7584420 - DNA, 22 bp, Homo sapiens
tcacacagtggtaaaaccctga

SEQ ID NO: 7584421 - DNA, 22 bp, Homo sapiens
tcacacagtgagaaagtgcgga

SEQ ID NO: 7584422 - DNA, 22 bp, Homo sapiens
tcacacagtgagaaagtgcgga

SEQ ID NO: 7584423 - DNA, 20 bp, Homo sapiens
tcacacataagtgaacgcac

SEQ ID NO: 7584424 - DNA, 20 bp, Homo sapiens
tcacacataagtgaacgcac

SEQ ID NO: 7584425 - DNA, 22 bp, Homo sapiens
tcacacatactcatgtgtgagt

SEQ ID NO: 7584426 - DNA, 22 bp, Homo sapiens
tcacacatactcatgtgtgagt

SEQ ID NO: 7584427 - DNA, 22 bp, Homo sapiens
tcacacataaaaagaagactag

SEQ ID NO: 7584428 - DNA, 22 bp, Homo sapiens
tcacacataaaaagaagactag

SEQ ID NO: 7584429 - DNA, 22 bp, Homo sapiens
tcacacatactcatgtgtgagt

SEQ ID NO: 7584430 - DNA, 22 bp, Homo sapiens
tcacacatctcaggtgtttaat

SEQ ID NO: 7584431 - DNA, 22 bp, Homo sapiens
tcacacatgagtaaatacaggg

SEQ ID NO: 7584432 - DNA, 22 bp, Homo sapiens
tcacacatgagtaaatacaggg

SEQ ID NO: 7584433 - DNA, 22 bp, Homo sapiens
tcacacatctcaggtgtttaat

SEQ ID NO: 7584434 - DNA, 22 bp, Homo sapiens
tcacacatctcaggtgtttaat

SEQ ID NO: 7584435 - DNA, 22 bp, Homo sapiens
tcacacatctcaggtgtttaat

SEQ ID NO: 7584436 - DNA, 22 bp, Homo sapiens
tcacacatgagtaaatacaggg

SEQ ID NO: 7584437 - DNA, 22 bp, Homo sapiens
tcacacatgagtaaatacaggg

SEQ ID NO: 7584438 - DNA, 22 bp, Homo sapiens
tcacatctaattccatttctgc

SEQ ID NO: 7584439 - DNA, 22 bp, Homo sapiens
tcacatctatacccaataattt

SEQ ID NO: 7584440 - DNA, 22 bp, Homo sapiens
tcacatctatacccaataattt

SEQ ID NO: 7584441 - DNA, 21 bp, Homo sapiens
tcacatctatgttaagcaaac

SEQ ID NO: 7584442 - DNA, 21 bp, Homo sapiens
tcacatctatgttaagcaaac

SEQ ID NO: 7584443 - DNA, 20 bp, Homo sapiens
tcacatcctctcccaacatg

SEQ ID NO: 7584444 - DNA, 20 bp, Homo sapiens
tcacatcctctcccaacatg

SEQ ID NO: 7584445 - DNA, 18 bp, Homo sapiens
tcacatcatcccatgctt

SEQ ID NO: 7584446 - DNA, 22 bp, Homo sapiens
tcacatcattaagacttctcct

SEQ ID NO: 7584447 - DNA, 23 bp, Homo sapiens
tcacatctgccgtagtgtattct

SEQ ID NO: 7584448 - DNA, 22 bp, Homo sapiens
tcacatctgcctccatagcacc

SEQ ID NO: 7584449 - DNA, 22 bp, Homo sapiens
tcacatctgcaaaatccctttt

SEQ ID NO: 7584450 - DNA, 22 bp, Homo sapiens
tcacatctgaaaaaatattgag

SEQ ID NO: 7584451 - DNA, 22 bp, Homo sapiens
tcacatctctgttttctaaatc

SEQ ID NO: 7584452 - DNA, 22 bp, Homo sapiens
tcacatctctgttttctaaatc

SEQ ID NO: 7584453 - DNA, 22 bp, Homo sapiens
tcacatctctcattgcctctgc

SEQ ID NO: 7584454 - DNA, 22 bp, Homo sapiens
tcacatctctcattgcctctgc

SEQ ID NO: 7584455 - DNA, 22 bp, Homo sapiens
tcacagctattctcatgtattt

SEQ ID NO: 7584456 - DNA, 22 bp, Homo sapiens
tcacagctattctcatgtattt

SEQ ID NO: 7584457 - DNA, 22 bp, Homo sapiens
tcacagctaagcttggtcactg

SEQ ID NO: 7584458 - DNA, 22 bp, Homo sapiens
tcacagctaagcttggtcactg

SEQ ID NO: 7584459 - DNA, 23 bp, Homo sapiens
tcacatatgtagaagtggaattc

SEQ ID NO: 7584460 - DNA, 22 bp, Homo sapiens
tcacagctattctcatgtattt

SEQ ID NO: 7584461 - DNA, 23 bp, Homo sapiens
tcacatatcaagaaagtggtaga

SEQ ID NO: 7584462 - DNA, 23 bp, Homo sapiens
tcacatatcaagaaagtggtaga

SEQ ID NO: 7584463 - DNA, 22 bp, Homo sapiens
tcacagcctggtcactctgccc

SEQ ID NO: 7584464 - DNA, 22 bp, Homo sapiens
tcacagctaagcttggtcactg

SEQ ID NO: 7584465 - DNA, 22 bp, Homo sapiens
tcacagcctggtcactctgccc

SEQ ID NO: 7584466 - DNA, 22 bp, Homo sapiens
tcacagcctggacagttgcctg

SEQ ID NO: 7584467 - DNA, 22 bp, Homo sapiens
tcacagcctggacagttgcctg

SEQ ID NO: 7584468 - DNA, 22 bp, Homo sapiens
tcacagcctggtcactctgccc

SEQ ID NO: 7584469 - DNA, 22 bp, Homo sapiens
tcacagcatttttagaaagatt

SEQ ID NO: 7584470 - DNA, 22 bp, Homo sapiens
tcacagcatttttagaaagatt

SEQ ID NO: 7584471 - DNA, 22 bp, Homo sapiens
tcacagcatttttagaaagatt

SEQ ID NO: 7584472 - DNA, 22 bp, Homo sapiens
tcacagcatttttagaaagatt

SEQ ID NO: 7584473 - DNA, 22 bp, Homo sapiens
tcacagcatttttagaaagatt

SEQ ID NO: 7584474 - DNA, 22 bp, Homo sapiens
tcacagcctggacagttgcctg

SEQ ID NO: 7584475 - DNA, 22 bp, Homo sapiens
tcacatcacatgagtgcaagga

SEQ ID NO: 7584476 - DNA, 22 bp, Homo sapiens
tcacatcactagctggtaatga

SEQ ID NO: 7584477 - DNA, 22 bp, Homo sapiens
tcacatcaggtgtctccccaag

SEQ ID NO: 7584478 - DNA, 22 bp, Homo sapiens
tcacatcacatgacagtaggcc

SEQ ID NO: 7584479 - DNA, 22 bp, Homo sapiens
tcacatcacatgacagtaggcc

SEQ ID NO: 7584480 - DNA, 17 bp, Homo sapiens
tcacatcacacaagcaa

SEQ ID NO: 7584481 - DNA, 17 bp, Homo sapiens
tcacatcacacaagcaa

SEQ ID NO: 7584482 - DNA, 17 bp, Homo sapiens
tcacatcacacaagcaa

SEQ ID NO: 7584483 - DNA, 17 bp, Homo sapiens
tcacatcacacaagcaa

SEQ ID NO: 7584484 - DNA, 22 bp, Homo sapiens
tcacatcaacattatagcatga

SEQ ID NO: 7584485 - DNA, 22 bp, Homo sapiens
tcacatatttaagaaagttaaa

SEQ ID NO: 7584486 - DNA, 22 bp, Homo sapiens
tcacatatttaagaaagttaaa

SEQ ID NO: 7584487 - DNA, 22 bp, Homo sapiens
tcacatatttaagaaagttaaa

SEQ ID NO: 7584488 - DNA, 22 bp, Homo sapiens
tcacatatttaagaaagttaaa

SEQ ID NO: 7584489 - DNA, 22 bp, Homo sapiens
tcacagcaccctgaggtgctgg

SEQ ID NO: 7584490 - DNA, 22 bp, Homo sapiens
tcacagcaccctgaggtgctgg

SEQ ID NO: 7584491 - DNA, 22 bp, Homo sapiens
tcacagcaccctgaggtgctgg

SEQ ID NO: 7584492 - DNA, 22 bp, Homo sapiens
tcacagcaccctgaggtgctgg

SEQ ID NO: 7584493 - DNA, 22 bp, Homo sapiens
tcacagcaccctgaggtgctgg

SEQ ID NO: 7584494 - DNA, 22 bp, Homo sapiens
tcacagcagaatttaggaggca

SEQ ID NO: 7584495 - DNA, 22 bp, Homo sapiens
tcacagcaccctgaggtgctgg

SEQ ID NO: 7584496 - DNA, 22 bp, Homo sapiens
tcacagcaccctgaggtgctgg

SEQ ID NO: 7584497 - DNA, 22 bp, Homo sapiens
tcacagcaccctgaggtgctgg

SEQ ID NO: 7584498 - DNA, 22 bp, Homo sapiens
tcacagcaggcagatattgttg

SEQ ID NO: 7584499 - DNA, 22 bp, Homo sapiens
tcacagcaggcagatattgttg

SEQ ID NO: 7584500 - DNA, 22 bp, Homo sapiens
tcacagcaggcagatattgttg

SEQ ID NO: 7584501 - DNA, 22 bp, Homo sapiens
tcacagcagggtaacaggaaga

SEQ ID NO: 7584502 - DNA, 22 bp, Homo sapiens
tcacagcagggtaacaggaaga

SEQ ID NO: 7584503 - DNA, 22 bp, Homo sapiens
tcacagcagggtaacaggaaga

SEQ ID NO: 7584504 - DNA, 22 bp, Homo sapiens
tcacagcagggtaacaggaaga

SEQ ID NO: 7584505 - DNA, 22 bp, Homo sapiens
tcacagcagaatttaggaggca

SEQ ID NO: 7584506 - DNA, 22 bp, Homo sapiens
tcacagcagaatttaggaggca

SEQ ID NO: 7584507 - DNA, 22 bp, Homo sapiens
tcacagcagaatttaggaggca

SEQ ID NO: 7584508 - DNA, 22 bp, Homo sapiens
tcacagcagaatttaggaggca

SEQ ID NO: 7584509 - DNA, 22 bp, Homo sapiens
tcacagcaacactggggcagac

SEQ ID NO: 7584510 - DNA, 22 bp, Homo sapiens
tcacagcaacactggggcagac

SEQ ID NO: 7584511 - DNA, 22 bp, Homo sapiens
tcacagcaacactggggcagac

SEQ ID NO: 7584512 - DNA, 22 bp, Homo sapiens
tcacagcaacactggggcagac

SEQ ID NO: 7584513 - DNA, 22 bp, Homo sapiens
tcacagcaacactggggcagac

SEQ ID NO: 7584514 - DNA, 22 bp, Homo sapiens
tcacagcaacactggggcagac

SEQ ID NO: 7584515 - DNA, 22 bp, Homo sapiens
tcacagcaacactggggcagac

SEQ ID NO: 7584516 - DNA, 22 bp, Homo sapiens
tcacagcaacactggggcagac

SEQ ID NO: 7584517 - DNA, 22 bp, Homo sapiens
tcacagcaaccctgaggcgagt

SEQ ID NO: 7584518 - DNA, 22 bp, Homo sapiens
tcacagcaaccctgaggcgagt

SEQ ID NO: 7584519 - DNA, 22 bp, Homo sapiens
tcacagcaaccctgaggcgagt

SEQ ID NO: 7584520 - DNA, 22 bp, Homo sapiens
tcacagcaaccctgaggcgagt

SEQ ID NO: 7584521 - DNA, 22 bp, Homo sapiens
tcacagcaaccctgaggcgagt

SEQ ID NO: 7584522 - DNA, 22 bp, Homo sapiens
tcacagcaaccctgaggcgagt

SEQ ID NO: 7584523 - DNA, 22 bp, Homo sapiens
tcacagcaccaggatctctcca

SEQ ID NO: 7584524 - DNA, 22 bp, Homo sapiens
tcacagcaccaggatctctcca

SEQ ID NO: 7584525 - DNA, 22 bp, Homo sapiens
tcacagcaccaggatctctcca

SEQ ID NO: 7584526 - DNA, 22 bp, Homo sapiens
tcacagcaccaggatctctcca

SEQ ID NO: 7584527 - DNA, 22 bp, Homo sapiens
tcacagcacatggaccgagtcc

SEQ ID NO: 7584528 - DNA, 22 bp, Homo sapiens
tcacagcacatggaccgagtcc

SEQ ID NO: 7584529 - DNA, 22 bp, Homo sapiens
tcacagcacatggaccgagtcc

SEQ ID NO: 7584530 - DNA, 22 bp, Homo sapiens
tcacagcaccaggatctctcca

SEQ ID NO: 7584531 - DNA, 22 bp, Homo sapiens
tcacagcattcgcaatggacag

SEQ ID NO: 7584532 - DNA, 22 bp, Homo sapiens
tcacagcattcgcaatggacag

SEQ ID NO: 7584533 - DNA, 22 bp, Homo sapiens
tcacagcattcgcaatggacag

SEQ ID NO: 7584534 - DNA, 22 bp, Homo sapiens
tcacagcattcgcaatggacag

SEQ ID NO: 7584535 - DNA, 22 bp, Homo sapiens
tcacagcattcgcaatggacag

SEQ ID NO: 7584536 - DNA, 22 bp, Homo sapiens
tcacagcattcgcaatggacag

SEQ ID NO: 7584537 - DNA, 22 bp, Homo sapiens
tcacagcattcgcaatggacag

SEQ ID NO: 7584538 - DNA, 22 bp, Homo sapiens
tcacagcattgagtgtactaga

SEQ ID NO: 7584539 - DNA, 22 bp, Homo sapiens
tcacagcattgagtgtactaga

SEQ ID NO: 7584540 - DNA, 22 bp, Homo sapiens
tcacagcattgagtgtactaga

SEQ ID NO: 7584541 - DNA, 22 bp, Homo sapiens
tcacagcattgagtgtactaga

SEQ ID NO: 7584542 - DNA, 22 bp, Homo sapiens
tcacagcattgtcacaaggctg

SEQ ID NO: 7584543 - DNA, 22 bp, Homo sapiens
tcacagcattgtcacaaggctg

SEQ ID NO: 7584544 - DNA, 22 bp, Homo sapiens
tcacagcattgtcacaaggctg

SEQ ID NO: 7584545 - DNA, 22 bp, Homo sapiens
tcacagcattgtcacaaggctg

SEQ ID NO: 7584546 - DNA, 22 bp, Homo sapiens
tcacagcattgtcacaaggctg

SEQ ID NO: 7584547 - DNA, 22 bp, Homo sapiens
tcacagcattgagtgtactaga

SEQ ID NO: 7584548 - DNA, 22 bp, Homo sapiens
tcacagcattgtcacaaggctg

SEQ ID NO: 7584549 - DNA, 22 bp, Homo sapiens
tcacagcattgtcacaaggctg

SEQ ID NO: 7584550 - DNA, 22 bp, Homo sapiens
tcacagcatttttagaaagatt

SEQ ID NO: 7584551 - DNA, 22 bp, Homo sapiens
tcacagcatttttagaaagatt

SEQ ID NO: 7584552 - DNA, 22 bp, Homo sapiens
tcacagcattgtcacaaggctg

SEQ ID NO: 7584553 - DNA, 22 bp, Homo sapiens
tcacagcagggtaacaggaaga

SEQ ID NO: 7584554 - DNA, 22 bp, Homo sapiens
tcacagcagggtaacaggaaga

SEQ ID NO: 7584555 - DNA, 22 bp, Homo sapiens
tcacagcagggtaacaggaaga

SEQ ID NO: 7584556 - DNA, 22 bp, Homo sapiens
tcacagcagggtaacaggaaga

SEQ ID NO: 7584557 - DNA, 22 bp, Homo sapiens
tcacagcagggtaacaggaaga

SEQ ID NO: 7584558 - DNA, 22 bp, Homo sapiens
tcacagcagggtaacaggaaga

SEQ ID NO: 7584559 - DNA, 22 bp, Homo sapiens
tcacagcagggtaacaggaaga

SEQ ID NO: 7584560 - DNA, 22 bp, Homo sapiens
tcacagcagtaaagaaaacact

SEQ ID NO: 7584561 - DNA, 22 bp, Homo sapiens
tcacagcagtaaagaaaacact

SEQ ID NO: 7584562 - DNA, 19 bp, Homo sapiens
tcacagcatctgtctgaac

SEQ ID NO: 7584563 - DNA, 19 bp, Homo sapiens
tcacagcatctgtctgaac

SEQ ID NO: 7584564 - DNA, 19 bp, Homo sapiens
tcacagcatctgtctgaac

SEQ ID NO: 7584565 - DNA, 22 bp, Homo sapiens
tcacagcattcgcaatggacag

SEQ ID NO: 7584566 - DNA, 22 bp, Homo sapiens
tcacagcagtaaagaaaacact

SEQ ID NO: 7584567 - DNA, 22 bp, Homo sapiens
tcacagcagtaaagaaaacact

SEQ ID NO: 7584568 - DNA, 22 bp, Homo sapiens
tcacagcagtaaagaaaacact

SEQ ID NO: 7584569 - DNA, 22 bp, Homo sapiens
tcacagcagtaaagaaaacact

SEQ ID NO: 7584570 - DNA, 19 bp, Homo sapiens
tcacagcatctgtctgaac

SEQ ID NO: 7584571 - DNA, 22 bp, Homo sapiens
tccgggaggcagaggttgcagt

SEQ ID NO: 7584572 - DNA, 22 bp, Homo sapiens
tccgggaggcagaggttgcagt

SEQ ID NO: 7584573 - DNA, 22 bp, Homo sapiens
tccgggcaactgaagggaggtt

SEQ ID NO: 7584574 - DNA, 21 bp, Homo sapiens
tccgggaggtggaggctgcag

SEQ ID NO: 7584575 - DNA, 22 bp, Homo sapiens
tccgggagctgaacgtcttgcg

SEQ ID NO: 7584576 - DNA, 22 bp, Homo sapiens
tccggactcacctgacaatggc

SEQ ID NO: 7584577 - DNA, 23 bp, Homo sapiens
tccggcaacttcactcctcccgc

SEQ ID NO: 7584578 - DNA, 22 bp, Homo sapiens
tccggcagcatctggagggatg

SEQ ID NO: 7584579 - DNA, 22 bp, Homo sapiens
tccgctggagagggggctgcca

SEQ ID NO: 7584580 - DNA, 22 bp, Homo sapiens
tccgctggcctgtgtcccaggc

SEQ ID NO: 7584581 - DNA, 22 bp, Homo sapiens
tccggactcacctgacaatggc

SEQ ID NO: 7584582 - DNA, 22 bp, Homo sapiens
tccgctggagagggggctgcca

SEQ ID NO: 7584583 - DNA, 22 bp, Homo sapiens
tccgagaagcataaagcaggaa

SEQ ID NO: 7584584 - DNA, 22 bp, Homo sapiens
tccgaggccaaagctgtgaata

SEQ ID NO: 7584585 - DNA, 22 bp, Homo sapiens
tccgaggccaaagctgtgaata

SEQ ID NO: 7584586 - DNA, 22 bp, Homo sapiens
tccgagaagcataaagcaggaa

SEQ ID NO: 7584587 - DNA, 22 bp, Homo sapiens
tccctttggatccaagcttatg

SEQ ID NO: 7584588 - DNA, 22 bp, Homo sapiens
tccgaacactcaggaagccaga

SEQ ID NO: 7584589 - DNA, 22 bp, Homo sapiens
tccctttcactactgtgttggt

SEQ ID NO: 7584590 - DNA, 22 bp, Homo sapiens
tccctttcactactgtgttggt

SEQ ID NO: 7584591 - DNA, 22 bp, Homo sapiens
tccctttcactactgtgttggt

SEQ ID NO: 7584592 - DNA, 22 bp, Homo sapiens
tccctttcactactgtgttggt

SEQ ID NO: 7584593 - DNA, 22 bp, Homo sapiens
tccctttgatcactaacagaac

SEQ ID NO: 7584594 - DNA, 22 bp, Homo sapiens
tccgccaggactgagggcccat

SEQ ID NO: 7584595 - DNA, 22 bp, Homo sapiens
tccgccaggactgagggcccat

SEQ ID NO: 7584596 - DNA, 22 bp, Homo sapiens
tccgccaggactgagggcccat

SEQ ID NO: 7584597 - DNA, 22 bp, Homo sapiens
tccgccaggactgagggcccat

SEQ ID NO: 7584598 - DNA, 22 bp, Homo sapiens
tccgccaggactgagggcccat

SEQ ID NO: 7584599 - DNA, 22 bp, Homo sapiens
tccgccaggactgagggcccat

SEQ ID NO: 7584600 - DNA, 22 bp, Homo sapiens
tccgataagcaattcttgtgct

SEQ ID NO: 7584601 - DNA, 22 bp, Homo sapiens
tccgaggcgcaccggcgctcct

SEQ ID NO: 7584602 - DNA, 22 bp, Homo sapiens
tcctcagtgctagccaactgcc

SEQ ID NO: 7584603 - DNA, 22 bp, Homo sapiens
tcctcagtctctcaaatgaggc

SEQ ID NO: 7584604 - DNA, 22 bp, Homo sapiens
tcctcagtggggcattcattat

SEQ ID NO: 7584605 - DNA, 22 bp, Homo sapiens
tcctcagtggggcattcattat

SEQ ID NO: 7584606 - DNA, 22 bp, Homo sapiens
tcctcagttataaataggaaac

SEQ ID NO: 7584607 - DNA, 22 bp, Homo sapiens
tcctcagttataaataggaaac

SEQ ID NO: 7584608 - DNA, 22 bp, Homo sapiens
tcctcatctcggaacctgccac

SEQ ID NO: 7584609 - DNA, 22 bp, Homo sapiens
tcctcagttttctagtatggca

SEQ ID NO: 7584610 - DNA, 22 bp, Homo sapiens
tcctcagttttctagtatggca

SEQ ID NO: 7584611 - DNA, 22 bp, Homo sapiens
tcctcagtcgtttgagccaaaa

SEQ ID NO: 7584612 - DNA, 22 bp, Homo sapiens
tcctcagtcgtttgagccaaaa

SEQ ID NO: 7584613 - DNA, 22 bp, Homo sapiens
tcctcagtctctaaggcctcag

SEQ ID NO: 7584614 - DNA, 22 bp, Homo sapiens
tcctcagtctctaaggcctcag

SEQ ID NO: 7584615 - DNA, 22 bp, Homo sapiens
tcctcagtctctaaggcctcag

SEQ ID NO: 7584616 - DNA, 22 bp, Homo sapiens
tcctcagtctctcaaatgaggc

SEQ ID NO: 7584617 - DNA, 22 bp, Homo sapiens
tcctcagtattgtggagcagat

SEQ ID NO: 7584618 - DNA, 22 bp, Homo sapiens
tcctcagtcacggtagcacatt

SEQ ID NO: 7584619 - DNA, 22 bp, Homo sapiens
tcctcagtcacggtagcacatt

SEQ ID NO: 7584620 - DNA, 22 bp, Homo sapiens
tcctcagtcacggtagcacatt

SEQ ID NO: 7584621 - DNA, 22 bp, Homo sapiens
tccgggttttacactcacatca

SEQ ID NO: 7584622 - DNA, 22 bp, Homo sapiens
tccggggcttccccgcagtgcc

SEQ ID NO: 7584623 - DNA, 22 bp, Homo sapiens
tccggggcttccccgcagtgcc

SEQ ID NO: 7584624 - DNA, 22 bp, Homo sapiens
tccgggcaactgaagggaggtt

SEQ ID NO: 7584625 - DNA, 22 bp, Homo sapiens
tccggtccgggtactcctctct

SEQ ID NO: 7584626 - DNA, 22 bp, Homo sapiens
tccggtccgggtactcctctct

SEQ ID NO: 7584627 - DNA, 23 bp, Homo sapiens
tcctcagtatataaaggcagatg

SEQ ID NO: 7584628 - DNA, 22 bp, Homo sapiens
tcctccaggataaaatgtgttg

SEQ ID NO: 7584629 - DNA, 22 bp, Homo sapiens
tcctccagcttctcttttgggg

SEQ ID NO: 7584630 - DNA, 22 bp, Homo sapiens
tcctccagcttctcttttgggg

SEQ ID NO: 7584631 - DNA, 22 bp, Homo sapiens
tcctccagctgtatcctgcctg

SEQ ID NO: 7584632 - DNA, 22 bp, Homo sapiens
tcctccagctgtatcctgcctg

SEQ ID NO: 7584633 - DNA, 22 bp, Homo sapiens
tcctccagctgtatcctgcctg

SEQ ID NO: 7584634 - DNA, 22 bp, Homo sapiens
tcctccagggggatcttcagcc

SEQ ID NO: 7584635 - DNA, 22 bp, Homo sapiens
tcctccagggggatcttcagcc

SEQ ID NO: 7584636 - DNA, 22 bp, Homo sapiens
tcctccagggggatcttcagcc

SEQ ID NO: 7584637 - DNA, 22 bp, Homo sapiens
tcctccaggcacctcactggct

SEQ ID NO: 7584638 - DNA, 22 bp, Homo sapiens
tcctccaggataaaatgtgttg

SEQ ID NO: 7584639 - DNA, 22 bp, Homo sapiens
tcctccaggataaaatgtgttg

SEQ ID NO: 7584640 - DNA, 22 bp, Homo sapiens
tcctccaggcacctcactggct

SEQ ID NO: 7584641 - DNA, 22 bp, Homo sapiens
tcctccaggcacctcactggct

SEQ ID NO: 7584642 - DNA, 22 bp, Homo sapiens
tcctccaggcacctcactggct

SEQ ID NO: 7584643 - DNA, 22 bp, Homo sapiens
tcctccagcaggactgaggccc

SEQ ID NO: 7584644 - DNA, 22 bp, Homo sapiens
tcctccagcaggactgaggccc

SEQ ID NO: 7584645 - DNA, 22 bp, Homo sapiens
tcctccagcaggactgaggccc

SEQ ID NO: 7584646 - DNA, 22 bp, Homo sapiens
tcctccagcaggactgaggccc

SEQ ID NO: 7584647 - DNA, 22 bp, Homo sapiens
tcctccagctactaggcaaata

SEQ ID NO: 7584648 - DNA, 22 bp, Homo sapiens
tcctccagctactaggcaaata

SEQ ID NO: 7584649 - DNA, 22 bp, Homo sapiens
tcctccagccctctaggaaaat

SEQ ID NO: 7584650 - DNA, 22 bp, Homo sapiens
tcctccagccctctaggaaaat

SEQ ID NO: 7584651 - DNA, 22 bp, Homo sapiens
tcctccagccctctaggaaaat

SEQ ID NO: 7584652 - DNA, 22 bp, Homo sapiens
tcctccagcaggactgaggccc

SEQ ID NO: 7584653 - DNA, 23 bp, Homo sapiens
tcctccagaggccctccttggcc

SEQ ID NO: 7584654 - DNA, 23 bp, Homo sapiens
tcctccagaggccctccttggcc

SEQ ID NO: 7584655 - DNA, 23 bp, Homo sapiens
tcctccagaggccctccttggcc

SEQ ID NO: 7584656 - DNA, 23 bp, Homo sapiens
tcctccagaggccctccttggcc

SEQ ID NO: 7584657 - DNA, 22 bp, Homo sapiens
tcctccagagatttgagttatt

SEQ ID NO: 7584658 - DNA, 22 bp, Homo sapiens
tcctccagagatttgagttatt

SEQ ID NO: 7584659 - DNA, 22 bp, Homo sapiens
tcctccagagatttgagttatt

SEQ ID NO: 7584660 - DNA, 22 bp, Homo sapiens
tcctccagaccacttctgtgcg

SEQ ID NO: 7584661 - DNA, 22 bp, Homo sapiens
tcctccactttgtctagcaaca

SEQ ID NO: 7584662 - DNA, 22 bp, Homo sapiens
tcctccagaaactgaggcagaa

SEQ ID NO: 7584663 - DNA, 22 bp, Homo sapiens
tcctccagaaactgaggcagaa

SEQ ID NO: 7584664 - DNA, 22 bp, Homo sapiens
tcctccagaaactgaggcagaa

SEQ ID NO: 7584665 - DNA, 22 bp, Homo sapiens
tcctccacgatggcacacctgg

SEQ ID NO: 7584666 - DNA, 22 bp, Homo sapiens
tcctccacgtgagggcatacag

SEQ ID NO: 7584667 - DNA, 22 bp, Homo sapiens
tcctccacgtgagggcatacag

SEQ ID NO: 7584668 - DNA, 22 bp, Homo sapiens
tcctccactttgtctagcaaca

SEQ ID NO: 7584669 - DNA, 20 bp, Homo sapiens
tcctccagaagggcagggtg

SEQ ID NO: 7584670 - DNA, 20 bp, Homo sapiens
tcctccagaagggcagggtg

SEQ ID NO: 7584671 - DNA, 22 bp, Homo sapiens
tcctccagaaactgaggcagaa

SEQ ID NO: 7584672 - DNA, 22 bp, Homo sapiens
tcctccagaaactgaggcagaa

SEQ ID NO: 7584673 - DNA, 20 bp, Homo sapiens
tcctccagaagggcagggtg

SEQ ID NO: 7584674 - DNA, 20 bp, Homo sapiens
tcctccagaagggcagggtg

SEQ ID NO: 7584675 - DNA, 22 bp, Homo sapiens
tcctccacactctggactgttg

SEQ ID NO: 7584676 - DNA, 23 bp, Homo sapiens
tcctccaatctcatggcccttaa

SEQ ID NO: 7584677 - DNA, 22 bp, Homo sapiens
tcctccacactctggactgttg

SEQ ID NO: 7584678 - DNA, 22 bp, Homo sapiens
tcctccaaggcagggggagaga

SEQ ID NO: 7584679 - DNA, 22 bp, Homo sapiens
tcctccacgatggcacacctgg

SEQ ID NO: 7584680 - DNA, 22 bp, Homo sapiens
tcctccacgatggcacacctgg

SEQ ID NO: 7584681 - DNA, 22 bp, Homo sapiens
tcctccaagcctttgtgaagtg

SEQ ID NO: 7584682 - DNA, 22 bp, Homo sapiens
tcctccaagcagaggccctgaa

SEQ ID NO: 7584683 - DNA, 22 bp, Homo sapiens
tcctcatctcggaacctgccac

SEQ ID NO: 7584684 - DNA, 22 bp, Homo sapiens
tcctcatgccgggtctcacgct

SEQ ID NO: 7584685 - DNA, 23 bp, Homo sapiens
tcctccaaccagcagctgcataa

SEQ ID NO: 7584686 - DNA, 23 bp, Homo sapiens
tcctccaaccagcagctgcataa

SEQ ID NO: 7584687 - DNA, 20 bp, Homo sapiens
tcctccaaccagctgctaat

SEQ ID NO: 7584688 - DNA, 20 bp, Homo sapiens
tcctccaaccagctgctaat

SEQ ID NO: 7584689 - DNA, 22 bp, Homo sapiens
tcctcctcctcacagtcacctg

SEQ ID NO: 7584690 - DNA, 22 bp, Homo sapiens
tcctcctcctcacagtcacctg

SEQ ID NO: 7584691 - DNA, 22 bp, Homo sapiens
tcctcctctatcagacagtgcc

SEQ ID NO: 7584692 - DNA, 22 bp, Homo sapiens
tcctcctctatcagacagtgcc

SEQ ID NO: 7584693 - DNA, 22 bp, Homo sapiens
tcctcctctatcagacagtgcc

SEQ ID NO: 7584694 - DNA, 23 bp, Homo sapiens
tcctcctgacacagcctgagtga

SEQ ID NO: 7584695 - DNA, 23 bp, Homo sapiens
tcctcctgacacagcctgagtga

SEQ ID NO: 7584696 - DNA, 23 bp, Homo sapiens
tcctcctgacacagcctgagtga

SEQ ID NO: 7584697 - DNA, 23 bp, Homo sapiens
tcctcctgacacagcctgagtga

SEQ ID NO: 7584698 - DNA, 23 bp, Homo sapiens
tcctcctgacacagcctgagtga

SEQ ID NO: 7584699 - DNA, 23 bp, Homo sapiens
tcctcctgacacagcctgagtga

SEQ ID NO: 7584700 - DNA, 23 bp, Homo sapiens
tcctcctgacacagcctgagtga

SEQ ID NO: 7584701 - DNA, 19 bp, Homo sapiens
tcctccctttggtgtcctg

SEQ ID NO: 7584702 - DNA, 19 bp, Homo sapiens
tcctccctttggtgtcctg

SEQ ID NO: 7584703 - DNA, 19 bp, Homo sapiens
tcctccctttggtgtcctg

SEQ ID NO: 7584704 - DNA, 19 bp, Homo sapiens
tcctccctttggtgtcctg

SEQ ID NO: 7584705 - DNA, 22 bp, Homo sapiens
tcctcccttggggtttcgttat

SEQ ID NO: 7584706 - DNA, 22 bp, Homo sapiens
tcctcccttggggtttcgttat

SEQ ID NO: 7584707 - DNA, 22 bp, Homo sapiens
tcctcccttggggtttcgttat

SEQ ID NO: 7584708 - DNA, 22 bp, Homo sapiens
tcctcccttggggtttcgttat

SEQ ID NO: 7584709 - DNA, 22 bp, Homo sapiens
tcctcccttgactcctgctttt

SEQ ID NO: 7584710 - DNA, 22 bp, Homo sapiens
tcctcccttgactcctgctttt

SEQ ID NO: 7584711 - DNA, 22 bp, Homo sapiens
tcctcccttgactcctgctttt

SEQ ID NO: 7584712 - DNA, 22 bp, Homo sapiens
tcctcccttgactcctgctttt

SEQ ID NO: 7584713 - DNA, 22 bp, Homo sapiens
tcctcccttgactcctgctttt

SEQ ID NO: 7584714 - DNA, 21 bp, Homo sapiens
tcctcctccactaggctagcc

SEQ ID NO: 7584715 - DNA, 21 bp, Homo sapiens
tcctcctccactaggctagcc

SEQ ID NO: 7584716 - DNA, 22 bp, Homo sapiens
tcctcctcctcacagtcacctg

SEQ ID NO: 7584717 - DNA, 21 bp, Homo sapiens
tcctcctccactaggctagcc

SEQ ID NO: 7584718 - DNA, 22 bp, Homo sapiens
tcctcctcacgctgttgcttgt

SEQ ID NO: 7584719 - DNA, 22 bp, Homo sapiens
tcctcctcacgctgttgcttgt

SEQ ID NO: 7584720 - DNA, 23 bp, Homo sapiens
tcctcctggatacaaagggaaca

SEQ ID NO: 7584721 - DNA, 23 bp, Homo sapiens
tcctcctggatacaaagggaaca

SEQ ID NO: 7584722 - DNA, 23 bp, Homo sapiens
tcctcctggatacaaagggaaca

SEQ ID NO: 7584723 - DNA, 21 bp, Homo sapiens
tcctcctggccaggcggcccc

SEQ ID NO: 7584724 - DNA, 21 bp, Homo sapiens
tcctcctggccaggcggcccc

SEQ ID NO: 7584725 - DNA, 23 bp, Homo sapiens
tcctcctgagtgagagtgccagc

SEQ ID NO: 7584726 - DNA, 23 bp, Homo sapiens
tcctcctgagtgagagtgccagc

SEQ ID NO: 7584727 - DNA, 23 bp, Homo sapiens
tcctcctgagtgagagtgccagc

SEQ ID NO: 7584728 - DNA, 22 bp, Homo sapiens
tcctcctgcctttgcttcttgt

SEQ ID NO: 7584729 - DNA, 22 bp, Homo sapiens
tcctcctgcctttgcttcttgt

SEQ ID NO: 7584730 - DNA, 23 bp, Homo sapiens
tcctcctgagtgagagtgccagc

SEQ ID NO: 7584731 - DNA, 21 bp, Homo sapiens
tcctcctggccaggcggcccc

SEQ ID NO: 7584732 - DNA, 21 bp, Homo sapiens
tcctcctggccaggcggcccc

SEQ ID NO: 7584733 - DNA, 23 bp, Homo sapiens
tcctcccaaatttcagcctcatt

SEQ ID NO: 7584734 - DNA, 22 bp, Homo sapiens
tcctcccctgcccatgaggagg

SEQ ID NO: 7584735 - DNA, 22 bp, Homo sapiens
tcctcccctgcccatgaggagg

SEQ ID NO: 7584736 - DNA, 22 bp, Homo sapiens
tcctcccctgcccatgaggagg

SEQ ID NO: 7584737 - DNA, 22 bp, Homo sapiens
tcctcccctgcccatgaggagg

SEQ ID NO: 7584738 - DNA, 22 bp, Homo sapiens
tcctcccctgcccatgaggagg

SEQ ID NO: 7584739 - DNA, 22 bp, Homo sapiens
tcctccctaaatcctagactgt

SEQ ID NO: 7584740 - DNA, 22 bp, Homo sapiens
tcctccctaaatcctagactgt

SEQ ID NO: 7584741 - DNA, 22 bp, Homo sapiens
tcctccctaaatcctagactgt

SEQ ID NO: 7584742 - DNA, 22 bp, Homo sapiens
tcctcccctgcccatgaggagg

SEQ ID NO: 7584743 - DNA, 22 bp, Homo sapiens
tcctcccctgcccatgaggagg

SEQ ID NO: 7584744 - DNA, 22 bp, Homo sapiens
tcctcccctgcccatgaggagg

SEQ ID NO: 7584745 - DNA, 22 bp, Homo sapiens
tcctcccctgcccatgaggagg

SEQ ID NO: 7584746 - DNA, 22 bp, Homo sapiens
tcctccagtggtactggccaat

SEQ ID NO: 7584747 - DNA, 22 bp, Homo sapiens
tcctccagtggtactggccaat

SEQ ID NO: 7584748 - DNA, 22 bp, Homo sapiens
tcctccagtgtctggggccttg

SEQ ID NO: 7584749 - DNA, 22 bp, Homo sapiens
tcctccagtgtctggggccttg

SEQ ID NO: 7584750 - DNA, 22 bp, Homo sapiens
tcctccagtgtctggggccttg

SEQ ID NO: 7584751 - DNA, 22 bp, Homo sapiens
tcctccagttccttggtttcag

SEQ ID NO: 7584752 - DNA, 22 bp, Homo sapiens
tcctccagtggcccagtccttc

SEQ ID NO: 7584753 - DNA, 22 bp, Homo sapiens
tcctccagtggcccagtccttc

SEQ ID NO: 7584754 - DNA, 22 bp, Homo sapiens
tcctccagtggcccagtccttc

SEQ ID NO: 7584755 - DNA, 22 bp, Homo sapiens
tcctccagtggcccagtccttc

SEQ ID NO: 7584756 - DNA, 22 bp, Homo sapiens
tcctccagtggcccagtccttc

SEQ ID NO: 7584757 - DNA, 22 bp, Homo sapiens
tcctccagtggtactggccaat

SEQ ID NO: 7584758 - DNA, 22 bp, Homo sapiens
tcctccagtggtactggccaat

SEQ ID NO: 7584759 - DNA, 22 bp, Homo sapiens
tcctccagtggtactggccaat

SEQ ID NO: 7584760 - DNA, 22 bp, Homo sapiens
tcctccaggtctagggtggctt

SEQ ID NO: 7584761 - DNA, 22 bp, Homo sapiens
tcctccaggtctagggtggctt

SEQ ID NO: 7584762 - DNA, 22 bp, Homo sapiens
tcctccaggtctagggtggctt

SEQ ID NO: 7584763 - DNA, 22 bp, Homo sapiens
tcctccaggtctagggtggctt

SEQ ID NO: 7584764 - DNA, 22 bp, Homo sapiens
tcctccagtcttggtgaggttg

SEQ ID NO: 7584765 - DNA, 22 bp, Homo sapiens
tcctccagtcttggtgaggttg

SEQ ID NO: 7584766 - DNA, 22 bp, Homo sapiens
tcctccctgggagcttctgagt

SEQ ID NO: 7584767 - DNA, 22 bp, Homo sapiens
tcctccctgggagcttctgagt

SEQ ID NO: 7584768 - DNA, 22 bp, Homo sapiens
tcctccctgggagcttctgagt

SEQ ID NO: 7584769 - DNA, 22 bp, Homo sapiens
tcctccctgggagcttctgagt

SEQ ID NO: 7584770 - DNA, 22 bp, Homo sapiens
tcctccctgcactcagtgaagt

SEQ ID NO: 7584771 - DNA, 22 bp, Homo sapiens
tcctccctgcactcagtgaagt

SEQ ID NO: 7584772 - DNA, 22 bp, Homo sapiens
tcctccctgcactcagtgaagt

SEQ ID NO: 7584773 - DNA, 22 bp, Homo sapiens
tcctccctgcactcagtgaagt

SEQ ID NO: 7584774 - DNA, 22 bp, Homo sapiens
tcctccctgggagcttctgagt

SEQ ID NO: 7584775 - DNA, 22 bp, Homo sapiens
tcctccctgtaccattcctctg

SEQ ID NO: 7584776 - DNA, 22 bp, Homo sapiens
tcctccctgtaccattcctctg

SEQ ID NO: 7584777 - DNA, 22 bp, Homo sapiens
tcctccctgtaccattcctctg

SEQ ID NO: 7584778 - DNA, 22 bp, Homo sapiens
tcctccctgtaccattcctctg

SEQ ID NO: 7584779 - DNA, 22 bp, Homo sapiens
tcctccctgtaccattcctctg

SEQ ID NO: 7584780 - DNA, 22 bp, Homo sapiens
tcctcccttctcactgggaagg

SEQ ID NO: 7584781 - DNA, 22 bp, Homo sapiens
tcctcccttctcactgggaagg

SEQ ID NO: 7584782 - DNA, 22 bp, Homo sapiens
tcctcccttctcactgggaagg

SEQ ID NO: 7584783 - DNA, 22 bp, Homo sapiens
tcctcccttctcactgggaagg

SEQ ID NO: 7584784 - DNA, 22 bp, Homo sapiens
tcctcccttgactcctgctttt

SEQ ID NO: 7584785 - DNA, 22 bp, Homo sapiens
tcctcccttctcactgggaagg

SEQ ID NO: 7584786 - DNA, 21 bp, Homo sapiens
tcctccctgagctgtggggga

SEQ ID NO: 7584787 - DNA, 21 bp, Homo sapiens
tcctccctgagctgtggggga

SEQ ID NO: 7584788 - DNA, 22 bp, Homo sapiens
tcctccctgagtggggacagct

SEQ ID NO: 7584789 - DNA, 22 bp, Homo sapiens
tcctccctgagtggggacagct

SEQ ID NO: 7584790 - DNA, 21 bp, Homo sapiens
tcctccctgagctgtggggga

SEQ ID NO: 7584791 - DNA, 21 bp, Homo sapiens
tcctccctgagctgtggggga

SEQ ID NO: 7584792 - DNA, 21 bp, Homo sapiens
tcctccctgagctgtggggga

SEQ ID NO: 7584793 - DNA, 22 bp, Homo sapiens
tcctccctgagtggggacagct

SEQ ID NO: 7584794 - DNA, 22 bp, Homo sapiens
tcctccctgagtggggacagct

SEQ ID NO: 7584795 - DNA, 22 bp, Homo sapiens
tcctccctgagtggggacagct

SEQ ID NO: 7584796 - DNA, 22 bp, Homo sapiens
tcctccctgagtggggacagct

SEQ ID NO: 7584797 - DNA, 22 bp, Homo sapiens
tcctccctgagtggggacagct

SEQ ID NO: 7584798 - DNA, 22 bp, Homo sapiens
tcctccctgagtggggacagct

SEQ ID NO: 7584799 - DNA, 22 bp, Homo sapiens
tcctccctgagtggggacagct

SEQ ID NO: 7584800 - DNA, 22 bp, Homo sapiens
tcctccctaaatcctagactgt

SEQ ID NO: 7584801 - DNA, 22 bp, Homo sapiens
tcctccctaactcatgatgagt

SEQ ID NO: 7584802 - DNA, 22 bp, Homo sapiens
tcctccctaactcatgatgagt

SEQ ID NO: 7584803 - DNA, 22 bp, Homo sapiens
tcctccctaaatcctagactgt

SEQ ID NO: 7584804 - DNA, 22 bp, Homo sapiens
tcctccctaaatcctagactgt

SEQ ID NO: 7584805 - DNA, 23 bp, Homo sapiens
tcctccctgacttctacagcaca

SEQ ID NO: 7584806 - DNA, 23 bp, Homo sapiens
tcctccctgacttctacagcaca

SEQ ID NO: 7584807 - DNA, 23 bp, Homo sapiens
tcctccctgacttctacagcaca

SEQ ID NO: 7584808 - DNA, 23 bp, Homo sapiens
tcctccctgacttctacagcaca

SEQ ID NO: 7584809 - DNA, 23 bp, Homo sapiens
tcctccctgacttctacagcaca

SEQ ID NO: 7584810 - DNA, 23 bp, Homo sapiens
tcctccctgacttctacagcaca

SEQ ID NO: 7584811 - DNA, 22 bp, Homo sapiens
tccctgcagctgtaggccggcg

SEQ ID NO: 7584812 - DNA, 22 bp, Homo sapiens
tccctgcagctgtaggccggcg

SEQ ID NO: 7584813 - DNA, 22 bp, Homo sapiens
tccctgcagtaggcagccctcc

SEQ ID NO: 7584814 - DNA, 22 bp, Homo sapiens
tccctgcaggtgtgcaagctga

SEQ ID NO: 7584815 - DNA, 22 bp, Homo sapiens
tccctgcagtaggcagccctcc

SEQ ID NO: 7584816 - DNA, 22 bp, Homo sapiens
tccctgcagtaggcagccctcc

SEQ ID NO: 7584817 - DNA, 22 bp, Homo sapiens
tccctgcagtagtggctaagat

SEQ ID NO: 7584818 - DNA, 22 bp, Homo sapiens
tccctgcagtagtggctaagat

SEQ ID NO: 7584819 - DNA, 22 bp, Homo sapiens
tccctgcagtagtggctaagat

SEQ ID NO: 7584820 - DNA, 22 bp, Homo sapiens
tccctgcatttgggagagtgtc

SEQ ID NO: 7584821 - DNA, 22 bp, Homo sapiens
tccctgcatttgggagagtgtc

SEQ ID NO: 7584822 - DNA, 22 bp, Homo sapiens
tccctgcaggtggggtggccag

SEQ ID NO: 7584823 - DNA, 22 bp, Homo sapiens
tccctgcaggtggggtggccag

SEQ ID NO: 7584824 - DNA, 22 bp, Homo sapiens
tccctgcagctgtaggccggcg

SEQ ID NO: 7584825 - DNA, 22 bp, Homo sapiens
tccctgcagcccctgagccttc

SEQ ID NO: 7584826 - DNA, 22 bp, Homo sapiens
tccctgcagcccctgagccttc

SEQ ID NO: 7584827 - DNA, 22 bp, Homo sapiens
tccctgcagcccctgagccttc

SEQ ID NO: 7584828 - DNA, 22 bp, Homo sapiens
tccctgcagcccctgagccttc

SEQ ID NO: 7584829 - DNA, 22 bp, Homo sapiens
tccctgcagcccctgagccttc

SEQ ID NO: 7584830 - DNA, 22 bp, Homo sapiens
tccctgcagcaggtgatcaatg

SEQ ID NO: 7584831 - DNA, 22 bp, Homo sapiens
tccctgcacccttgctgggccc

SEQ ID NO: 7584832 - DNA, 22 bp, Homo sapiens
tccctgcacccttgctgggccc

SEQ ID NO: 7584833 - DNA, 22 bp, Homo sapiens
tccctgcacccttgctgggccc

SEQ ID NO: 7584834 - DNA, 22 bp, Homo sapiens
tccctgcagacgtcctgcgggt

SEQ ID NO: 7584835 - DNA, 22 bp, Homo sapiens
tccctgcacccttgctgggccc

SEQ ID NO: 7584836 - DNA, 22 bp, Homo sapiens
tccctgcagacgtcctgcgggt

SEQ ID NO: 7584837 - DNA, 22 bp, Homo sapiens
tccctgcagacgtcctgcgggt

SEQ ID NO: 7584838 - DNA, 22 bp, Homo sapiens
tccctgatgtgggctgcgtgac

SEQ ID NO: 7584839 - DNA, 22 bp, Homo sapiens
tccctgcacagccgagccatgc

SEQ ID NO: 7584840 - DNA, 22 bp, Homo sapiens
tccctgcacagccgagccatgc

SEQ ID NO: 7584841 - DNA, 22 bp, Homo sapiens
tccctgcacagccgagccatgc

SEQ ID NO: 7584842 - DNA, 22 bp, Homo sapiens
tccctgcacagccgagccatgc

SEQ ID NO: 7584843 - DNA, 22 bp, Homo sapiens
tccctgcacagccgagccatgc

SEQ ID NO: 7584844 - DNA, 22 bp, Homo sapiens
tccctgcacagccgagccatgc

SEQ ID NO: 7584845 - DNA, 22 bp, Homo sapiens
tccctgatgccaaagaagcatg

SEQ ID NO: 7584846 - DNA, 22 bp, Homo sapiens
tccctgatgccttgatccgtgg

SEQ ID NO: 7584847 - DNA, 22 bp, Homo sapiens
tccctgagttttctttctgact

SEQ ID NO: 7584848 - DNA, 19 bp, Homo sapiens
tccctgagttccagcccag

SEQ ID NO: 7584849 - DNA, 21 bp, Homo sapiens
tccctgagttctctgagcatc

SEQ ID NO: 7584850 - DNA, 21 bp, Homo sapiens
tccctgagttctctgagcatc

SEQ ID NO: 7584851 - DNA, 21 bp, Homo sapiens
tccctgagttctctgagcatc

SEQ ID NO: 7584852 - DNA, 21 bp, Homo sapiens
tccctgagttctctgagcatc

SEQ ID NO: 7584853 - DNA, 22 bp, Homo sapiens
tccctgccaatgattggagcaa

SEQ ID NO: 7584854 - DNA, 22 bp, Homo sapiens
tccctgccaatgattggagcaa

SEQ ID NO: 7584855 - DNA, 22 bp, Homo sapiens
tccctgcatttgggagagtgtc

SEQ ID NO: 7584856 - DNA, 22 bp, Homo sapiens
tccctgccaatgattggagcaa

SEQ ID NO: 7584857 - DNA, 22 bp, Homo sapiens
tccctgccagtcctggtctgaa

SEQ ID NO: 7584858 - DNA, 22 bp, Homo sapiens
tccctgccagtcctggtctgaa

SEQ ID NO: 7584859 - DNA, 22 bp, Homo sapiens
tccctgccagtcctggtctgaa

SEQ ID NO: 7584860 - DNA, 22 bp, Homo sapiens
tccctgccagtcctggtctgaa

SEQ ID NO: 7584861 - DNA, 22 bp, Homo sapiens
tccctgccagtcctggtctgaa

SEQ ID NO: 7584862 - DNA, 22 bp, Homo sapiens
tccctgccctcagtgcacccgg

SEQ ID NO: 7584863 - DNA, 22 bp, Homo sapiens
tccctgccctcagtgcacccgg

SEQ ID NO: 7584864 - DNA, 22 bp, Homo sapiens
tccctgccctcagtgcacccgg

SEQ ID NO: 7584865 - DNA, 22 bp, Homo sapiens
tccctgccctcagtgcacccgg

SEQ ID NO: 7584866 - DNA, 22 bp, Homo sapiens
tccctgggcaagtttactcttc

SEQ ID NO: 7584867 - DNA, 22 bp, Homo sapiens
tccctgccctgccttcatggtt

SEQ ID NO: 7584868 - DNA, 22 bp, Homo sapiens
tccctgggcacaatctgctggc

SEQ ID NO: 7584869 - DNA, 22 bp, Homo sapiens
tccctgggcacaatctgctggc

SEQ ID NO: 7584870 - DNA, 22 bp, Homo sapiens
tccctgggcacaatctgctggc

SEQ ID NO: 7584871 - DNA, 22 bp, Homo sapiens
tccctgggcacaatctgctggc

SEQ ID NO: 7584872 - DNA, 22 bp, Homo sapiens
tccctgggcacaatctgctggc

SEQ ID NO: 7584873 - DNA, 22 bp, Homo sapiens
tccctgggcacaatctgctggc

SEQ ID NO: 7584874 - DNA, 22 bp, Homo sapiens
tccctgggcatcacgttgcttc

SEQ ID NO: 7584875 - DNA, 22 bp, Homo sapiens
tccctgggcatcacgttgcttc

SEQ ID NO: 7584876 - DNA, 22 bp, Homo sapiens
tccctgggccacagctgtgagc

SEQ ID NO: 7584877 - DNA, 23 bp, Homo sapiens
tccctgggcccgtgccagcggtg

SEQ ID NO: 7584878 - DNA, 23 bp, Homo sapiens
tccctgggcccgtgccagcggtg

SEQ ID NO: 7584879 - DNA, 23 bp, Homo sapiens
tccctgggcccgtgccagcggtg

SEQ ID NO: 7584880 - DNA, 22 bp, Homo sapiens
tcccaggcaaaggcagctcatt

SEQ ID NO: 7584881 - DNA, 22 bp, Homo sapiens
tcccaggcaaaggcagctcatt

SEQ ID NO: 7584882 - DNA, 22 bp, Homo sapiens
tcccaggcaaaggcagctcatt

SEQ ID NO: 7584883 - DNA, 22 bp, Homo sapiens
tcccaggcaaaggcagctcatt

SEQ ID NO: 7584884 - DNA, 22 bp, Homo sapiens
tcccaggattttaggctctcag

SEQ ID NO: 7584885 - DNA, 22 bp, Homo sapiens
tcccaggattttaggctctcag

SEQ ID NO: 7584886 - DNA, 22 bp, Homo sapiens
tcccaggattttaggctctcag

SEQ ID NO: 7584887 - DNA, 22 bp, Homo sapiens
tcccaggattttaggctctcag

SEQ ID NO: 7584888 - DNA, 22 bp, Homo sapiens
tcccaggattttaggctctcag

SEQ ID NO: 7584889 - DNA, 22 bp, Homo sapiens
tcccaggatgtttatggctggt

SEQ ID NO: 7584890 - DNA, 22 bp, Homo sapiens
tcccaggatgtttatggctggt

SEQ ID NO: 7584891 - DNA, 22 bp, Homo sapiens
tcccaggattttaggctctcag

SEQ ID NO: 7584892 - DNA, 22 bp, Homo sapiens
tcccaggatgtttatggctggt

SEQ ID NO: 7584893 - DNA, 22 bp, Homo sapiens
tcccaggatgtttatggctggt

SEQ ID NO: 7584894 - DNA, 22 bp, Homo sapiens
tcccaggatgtttatggctggt

SEQ ID NO: 7584895 - DNA, 22 bp, Homo sapiens
tcccaggatgtttatggctggt

SEQ ID NO: 7584896 - DNA, 22 bp, Homo sapiens
tcccaggatgttggcggcaggt

SEQ ID NO: 7584897 - DNA, 22 bp, Homo sapiens
tcccaggatgttggcggcaggt

SEQ ID NO: 7584898 - DNA, 22 bp, Homo sapiens
tcccaggcagcttctttcatca

SEQ ID NO: 7584899 - DNA, 22 bp, Homo sapiens
tcccaggcagcttctttcatca

SEQ ID NO: 7584900 - DNA, 22 bp, Homo sapiens
tccctgagagcactggggagcc

SEQ ID NO: 7584901 - DNA, 19 bp, Homo sapiens
tcccaggcaaaggcttctc

SEQ ID NO: 7584902 - DNA, 19 bp, Homo sapiens
tcccaggcaaaggcttctc

SEQ ID NO: 7584903 - DNA, 19 bp, Homo sapiens
tcccaggcaaaggcttctc

SEQ ID NO: 7584904 - DNA, 19 bp, Homo sapiens
tcccaggcaaaggcttctc

SEQ ID NO: 7584905 - DNA, 19 bp, Homo sapiens
tcccaggcaaaggcttctc

SEQ ID NO: 7584906 - DNA, 19 bp, Homo sapiens
tcccaggcaaaggcttctc

SEQ ID NO: 7584907 - DNA, 21 bp, Homo sapiens
tccctgagcccaaggggctcc

SEQ ID NO: 7584908 - DNA, 23 bp, Homo sapiens
tccctgagatgctgctctgtccc

SEQ ID NO: 7584909 - DNA, 23 bp, Homo sapiens
tccctgagatgctgctctgtccc

SEQ ID NO: 7584910 - DNA, 23 bp, Homo sapiens
tccctgagatgctgctctgtccc

SEQ ID NO: 7584911 - DNA, 22 bp, Homo sapiens
tccctgagctcacatggcagga

SEQ ID NO: 7584912 - DNA, 22 bp, Homo sapiens
tccctgagctcacatggcagga

SEQ ID NO: 7584913 - DNA, 21 bp, Homo sapiens
tccctgagcccaaggggctcc

SEQ ID NO: 7584914 - DNA, 21 bp, Homo sapiens
tccctgagcccaaggggctcc

SEQ ID NO: 7584915 - DNA, 21 bp, Homo sapiens
tccctgagcccaaggggctcc

SEQ ID NO: 7584916 - DNA, 21 bp, Homo sapiens
tccctgagcccaaggggctcc

SEQ ID NO: 7584917 - DNA, 23 bp, Homo sapiens
tccctgagctggagagactgcac

SEQ ID NO: 7584918 - DNA, 23 bp, Homo sapiens
tccctgagctggagagactgcac

SEQ ID NO: 7584919 - DNA, 23 bp, Homo sapiens
tccctgagctggagagactgcac

SEQ ID NO: 7584920 - DNA, 22 bp, Homo sapiens
tccctgagctgagctcaacagc

SEQ ID NO: 7584921 - DNA, 22 bp, Homo sapiens
tccctgagctgagctcaacagc

SEQ ID NO: 7584922 - DNA, 22 bp, Homo sapiens
tccctgagctgagctcaacagc

SEQ ID NO: 7584923 - DNA, 22 bp, Homo sapiens
tccctgagctcacatggcagga

SEQ ID NO: 7584924 - DNA, 22 bp, Homo sapiens
tccctgagctgagctcaacagc

SEQ ID NO: 7584925 - DNA, 22 bp, Homo sapiens
tccctgagcttctctgaaatgg

SEQ ID NO: 7584926 - DNA, 22 bp, Homo sapiens
tccctgaggaaggggtgtggtg

SEQ ID NO: 7584927 - DNA, 22 bp, Homo sapiens
tccctgaggaaggggtgtggtg

SEQ ID NO: 7584928 - DNA, 22 bp, Homo sapiens
tccctgagcttctctgaaatgg

SEQ ID NO: 7584929 - DNA, 22 bp, Homo sapiens
tccctgagcttcatcaggcttt

SEQ ID NO: 7584930 - DNA, 22 bp, Homo sapiens
tccctgagcttcatcaggcttt

SEQ ID NO: 7584931 - DNA, 22 bp, Homo sapiens
tccctgagcttcatcaggcttt

SEQ ID NO: 7584932 - DNA, 22 bp, Homo sapiens
tccctgagcttcatcaggcttt

SEQ ID NO: 7584933 - DNA, 22 bp, Homo sapiens
tccctgagcttcatcaggcttt

SEQ ID NO: 7584934 - DNA, 22 bp, Homo sapiens
tccctgagggcagctcaagtcc

SEQ ID NO: 7584935 - DNA, 22 bp, Homo sapiens
tccctgagggcagctcaagtcc

SEQ ID NO: 7584936 - DNA, 22 bp, Homo sapiens
tccctgagggcagctcaagtcc

SEQ ID NO: 7584937 - DNA, 22 bp, Homo sapiens
tccctgaggatggttgtattta

SEQ ID NO: 7584938 - DNA, 22 bp, Homo sapiens
tccctgaggatgaggctgatca

SEQ ID NO: 7584939 - DNA, 22 bp, Homo sapiens
tccctgaggatgaggctgatca

SEQ ID NO: 7584940 - DNA, 22 bp, Homo sapiens
tccctgaggatgaggctgatca

SEQ ID NO: 7584941 - DNA, 22 bp, Homo sapiens
tccctgagtgtatgtggtgaac

SEQ ID NO: 7584942 - DNA, 22 bp, Homo sapiens
tccctgagtgggctggtagtat

SEQ ID NO: 7584943 - DNA, 16 bp, Homo sapiens
tccctgaggttttgga

SEQ ID NO: 7584944 - DNA, 22 bp, Homo sapiens
tccctgagtgggctggtagtat

SEQ ID NO: 7584945 - DNA, 19 bp, Homo sapiens
tccctgagttccagcccag

SEQ ID NO: 7584946 - DNA, 19 bp, Homo sapiens
tccctgagttccagcccag

SEQ ID NO: 7584947 - DNA, 22 bp, Homo sapiens
tccctgtaaggttctgagattt

SEQ ID NO: 7584948 - DNA, 22 bp, Homo sapiens
tccctggttacgtataaagatg

SEQ ID NO: 7584949 - DNA, 20 bp, Homo sapiens
tccctggggccctacttcct

SEQ ID NO: 7584950 - DNA, 20 bp, Homo sapiens
tccctggggccctacttcct

SEQ ID NO: 7584951 - DNA, 20 bp, Homo sapiens
tccctggggccctacttcct

SEQ ID NO: 7584952 - DNA, 22 bp, Homo sapiens
tccctgtccaaagtcttcctat

SEQ ID NO: 7584953 - DNA, 22 bp, Homo sapiens
tccctgtcctgggcaatcccag

SEQ ID NO: 7584954 - DNA, 22 bp, Homo sapiens
tccctgtccaaagtcttcctat

SEQ ID NO: 7584955 - DNA, 22 bp, Homo sapiens
tccctgtccaaagtcttcctat

SEQ ID NO: 7584956 - DNA, 22 bp, Homo sapiens
tccctgtatatcacaagggcta

SEQ ID NO: 7584957 - DNA, 22 bp, Homo sapiens
tccctgtattcgaaagtgatcg

SEQ ID NO: 7584958 - DNA, 22 bp, Homo sapiens
tccctgtctaatatgccatgaa

SEQ ID NO: 7584959 - DNA, 22 bp, Homo sapiens
tccctgtctcccttgagactag

SEQ ID NO: 7584960 - DNA, 22 bp, Homo sapiens
tccctgtctcccttgagactag

SEQ ID NO: 7584961 - DNA, 22 bp, Homo sapiens
tccctgtctaatatgccatgaa

SEQ ID NO: 7584962 - DNA, 22 bp, Homo sapiens
tccctgtctaatatgccatgaa

SEQ ID NO: 7584963 - DNA, 22 bp, Homo sapiens
tccctgtctccttgtgtgtcct

SEQ ID NO: 7584964 - DNA, 22 bp, Homo sapiens
tccctgtctccttgtgtgtcct

SEQ ID NO: 7584965 - DNA, 22 bp, Homo sapiens
tccctgtgaatcagaagcaggt

SEQ ID NO: 7584966 - DNA, 22 bp, Homo sapiens
tccctgtgaatcagaagcaggt

SEQ ID NO: 7584967 - DNA, 22 bp, Homo sapiens
tccctgtggaagactgccagag

SEQ ID NO: 7584968 - DNA, 22 bp, Homo sapiens
tccctgtggaagactgccagag

SEQ ID NO: 7584969 - DNA, 22 bp, Homo sapiens
tccctgtgcctatatgtgctga

SEQ ID NO: 7584970 - DNA, 22 bp, Homo sapiens
tccctgtgcctatatgtgctga

SEQ ID NO: 7584971 - DNA, 22 bp, Homo sapiens
tccctgtggatatctgcagctg

SEQ ID NO: 7584972 - DNA, 22 bp, Homo sapiens
tccctgtggatatctgcagctg

SEQ ID NO: 7584973 - DNA, 22 bp, Homo sapiens
tccctgtggctaagacatgaca

SEQ ID NO: 7584974 - DNA, 22 bp, Homo sapiens
tccctgtggatatctgcagctg

SEQ ID NO: 7584975 - DNA, 22 bp, Homo sapiens
tccctgtctcccttgagactag

SEQ ID NO: 7584976 - DNA, 22 bp, Homo sapiens
tccctgtgacaagtctgagttc

SEQ ID NO: 7584977 - DNA, 22 bp, Homo sapiens
tccctgtgaatcagaagcaggt

SEQ ID NO: 7584978 - DNA, 22 bp, Homo sapiens
tccctgtgaatcagaagcaggt

SEQ ID NO: 7584979 - DNA, 22 bp, Homo sapiens
tccctgtgagaaatgaagcagg

SEQ ID NO: 7584980 - DNA, 21 bp, Homo sapiens
tccctgtgagcagctcttcct

SEQ ID NO: 7584981 - DNA, 22 bp, Homo sapiens
tccctgtgagtcaactaaacaa

SEQ ID NO: 7584982 - DNA, 22 bp, Homo sapiens
tccctgtgagtcaactaaacaa

SEQ ID NO: 7584983 - DNA, 21 bp, Homo sapiens
tccctgtgagcagctcttcct

SEQ ID NO: 7584984 - DNA, 21 bp, Homo sapiens
tccctgtgagcagctcttcct

SEQ ID NO: 7584985 - DNA, 22 bp, Homo sapiens
tccctgggcttctccagacttg

SEQ ID NO: 7584986 - DNA, 22 bp, Homo sapiens
tccctgggcttctccagacttg

SEQ ID NO: 7584987 - DNA, 22 bp, Homo sapiens
tccctgggcttctccagacttg

SEQ ID NO: 7584988 - DNA, 22 bp, Homo sapiens
tccctgggcttctccagacttg

SEQ ID NO: 7584989 - DNA, 22 bp, Homo sapiens
tccctgggcggacattctccca

SEQ ID NO: 7584990 - DNA, 22 bp, Homo sapiens
tccctgggcggacattctccca

SEQ ID NO: 7584991 - DNA, 22 bp, Homo sapiens
tccctgggcctcctgctatgca

SEQ ID NO: 7584992 - DNA, 22 bp, Homo sapiens
tccctgggcctatcttagctcc

SEQ ID NO: 7584993 - DNA, 22 bp, Homo sapiens
tccctgggcctatcttagctcc

SEQ ID NO: 7584994 - DNA, 22 bp, Homo sapiens
tccctgggcctcctgctatgca

SEQ ID NO: 7584995 - DNA, 22 bp, Homo sapiens
tccctgggcctcctgctatgca

SEQ ID NO: 7584996 - DNA, 22 bp, Homo sapiens
tccctgggcctatcttagctcc

SEQ ID NO: 7584997 - DNA, 22 bp, Homo sapiens
tccctgggcctatcttagctcc

SEQ ID NO: 7584998 - DNA, 22 bp, Homo sapiens
tccctgggcctatcttagctcc

SEQ ID NO: 7584999 - DNA, 22 bp, Homo sapiens
tccctgggcctatcttagctcc

SEQ ID NO: 7585000 - DNA, 22 bp, Homo sapiens
tccctgggcctatcttagctcc

SEQ ID NO: 7585001 - DNA, 22 bp, Homo sapiens
tccctggggaagggcaagcaag

SEQ ID NO: 7585002 - DNA, 22 bp, Homo sapiens
tccctggggaagggcaagcaag

SEQ ID NO: 7585003 - DNA, 22 bp, Homo sapiens
tccctggggaagggcaagcaag

SEQ ID NO: 7585004 - DNA, 22 bp, Homo sapiens
tccctggggatgttggcctgcc

SEQ ID NO: 7585005 - DNA, 22 bp, Homo sapiens
tccctggggatgttggcctgcc

SEQ ID NO: 7585006 - DNA, 22 bp, Homo sapiens
tccctggggatgttggcctgcc

SEQ ID NO: 7585007 - DNA, 22 bp, Homo sapiens
tccctggggcagtggctcggag

SEQ ID NO: 7585008 - DNA, 22 bp, Homo sapiens
tccctggggcagtggctcggag

SEQ ID NO: 7585009 - DNA, 22 bp, Homo sapiens
tccctggggatgttggcctgcc

SEQ ID NO: 7585010 - DNA, 22 bp, Homo sapiens
tccctggggatgttggcctgcc

SEQ ID NO: 7585011 - DNA, 18 bp, Homo sapiens
tcccttctcccttgcctc

SEQ ID NO: 7585012 - DNA, 19 bp, Homo sapiens
tcccttctatagtaataaa

SEQ ID NO: 7585013 - DNA, 19 bp, Homo sapiens
tcccttctatagtaataaa

SEQ ID NO: 7585014 - DNA, 19 bp, Homo sapiens
tcccttctatagtaataaa

SEQ ID NO: 7585015 - DNA, 19 bp, Homo sapiens
tcccttcctgtcgggctcc

SEQ ID NO: 7585016 - DNA, 19 bp, Homo sapiens
tcccttcctgtcgggctcc

SEQ ID NO: 7585017 - DNA, 19 bp, Homo sapiens
tcccttcctgtcgggctcc

SEQ ID NO: 7585018 - DNA, 19 bp, Homo sapiens
tcccttcctgtcgggctcc

SEQ ID NO: 7585019 - DNA, 22 bp, Homo sapiens
tcccttcctcataggcagaagg

SEQ ID NO: 7585020 - DNA, 22 bp, Homo sapiens
tcccttcatcagtgagcaagcc

SEQ ID NO: 7585021 - DNA, 22 bp, Homo sapiens
tcccttcctcataggcagaagg

SEQ ID NO: 7585022 - DNA, 22 bp, Homo sapiens
tcccttcctcataggcagaagg

SEQ ID NO: 7585023 - DNA, 18 bp, Homo sapiens
tcccttctcccttgcctc

SEQ ID NO: 7585024 - DNA, 18 bp, Homo sapiens
tcccttctcccttgcctc

SEQ ID NO: 7585025 - DNA, 18 bp, Homo sapiens
tcccttctcccttgcctc

SEQ ID NO: 7585026 - DNA, 18 bp, Homo sapiens
tcccttctcccttgcctc

SEQ ID NO: 7585027 - DNA, 18 bp, Homo sapiens
tcccttctcccttgcctc

SEQ ID NO: 7585028 - DNA, 22 bp, Homo sapiens
tcccttctggcagcagtgtgag

SEQ ID NO: 7585029 - DNA, 22 bp, Homo sapiens
tcccttctggcagcagtgtgag

SEQ ID NO: 7585030 - DNA, 22 bp, Homo sapiens
tcccttctggcagcagtgtgag

SEQ ID NO: 7585031 - DNA, 22 bp, Homo sapiens
tcccttgaacgctggggctgga

SEQ ID NO: 7585032 - DNA, 22 bp, Homo sapiens
tcccttgagagttggccaattg

SEQ ID NO: 7585033 - DNA, 22 bp, Homo sapiens
tcccttctggcagcagtgtgag

SEQ ID NO: 7585034 - DNA, 22 bp, Homo sapiens
tcccttctggcagcagtgtgag

SEQ ID NO: 7585035 - DNA, 22 bp, Homo sapiens
tcccttctggcagcagtgtgag

SEQ ID NO: 7585036 - DNA, 21 bp, Homo sapiens
tcccttgggaaactttcttga

SEQ ID NO: 7585037 - DNA, 21 bp, Homo sapiens
tcccttgggaaactttcttga

SEQ ID NO: 7585038 - DNA, 22 bp, Homo sapiens
tcccttgggagtggtgaccaca

SEQ ID NO: 7585039 - DNA, 22 bp, Homo sapiens
tcccttggtaattctgttcctt

SEQ ID NO: 7585040 - DNA, 22 bp, Homo sapiens
tcccttggtaattctgttcctt

SEQ ID NO: 7585041 - DNA, 22 bp, Homo sapiens
tcccttggaaagtagcctcaca

SEQ ID NO: 7585042 - DNA, 22 bp, Homo sapiens
tcccttggttaaatatgtagga

SEQ ID NO: 7585043 - DNA, 22 bp, Homo sapiens
tcccttggttaaatatgtagga

SEQ ID NO: 7585044 - DNA, 22 bp, Homo sapiens
tcccttggtaattctgttcctt

SEQ ID NO: 7585045 - DNA, 22 bp, Homo sapiens
tcccttggttaaatatgtagga

SEQ ID NO: 7585046 - DNA, 23 bp, Homo sapiens
tccctgtgtacagcctgcatgag

SEQ ID NO: 7585047 - DNA, 23 bp, Homo sapiens
tccctgtgtacagcctgcatgag

SEQ ID NO: 7585048 - DNA, 23 bp, Homo sapiens
tccctgtgtacagcctgcatgag

SEQ ID NO: 7585049 - DNA, 22 bp, Homo sapiens
tccctgtgtccatgccaggagg

SEQ ID NO: 7585050 - DNA, 23 bp, Homo sapiens
tccctgtgtacagcctgcatgag

SEQ ID NO: 7585051 - DNA, 22 bp, Homo sapiens
tccctgtgtccatgccaggagg

SEQ ID NO: 7585052 - DNA, 22 bp, Homo sapiens
tccctgtgtccatgccaggagg

SEQ ID NO: 7585053 - DNA, 23 bp, Homo sapiens
tccctgtgtacagcctgcatgag

SEQ ID NO: 7585054 - DNA, 22 bp, Homo sapiens
tccctgtgggcagaggctgcct

SEQ ID NO: 7585055 - DNA, 22 bp, Homo sapiens
tccctgtgggcagaggctgcct

SEQ ID NO: 7585056 - DNA, 22 bp, Homo sapiens
tccctgtgggatgaggactctg

SEQ ID NO: 7585057 - DNA, 22 bp, Homo sapiens
tccctgtgggcagaggctgcct

SEQ ID NO: 7585058 - DNA, 22 bp, Homo sapiens
tccctgtggctaagacatgaca

SEQ ID NO: 7585059 - DNA, 22 bp, Homo sapiens
tccctgtgggatgaggactctg

SEQ ID NO: 7585060 - DNA, 22 bp, Homo sapiens
tccctgtggctaagacatgaca

SEQ ID NO: 7585061 - DNA, 22 bp, Homo sapiens
tccctgtgggatgaggactctg

SEQ ID NO: 7585062 - DNA, 22 bp, Homo sapiens
tcccttaaaactcatgtgttgt

SEQ ID NO: 7585063 - DNA, 22 bp, Homo sapiens
tcccttaaaactcatgtgttgt

SEQ ID NO: 7585064 - DNA, 22 bp, Homo sapiens
tccctgtgtgtatataaacggt

SEQ ID NO: 7585065 - DNA, 22 bp, Homo sapiens
tccctgtgtcttcctcttgccc

SEQ ID NO: 7585066 - DNA, 22 bp, Homo sapiens
tccctgtgtgtatataaacggt

SEQ ID NO: 7585067 - DNA, 22 bp, Homo sapiens
tccctgtgtcctgggggcacct

SEQ ID NO: 7585068 - DNA, 22 bp, Homo sapiens
tccctgtgtcttcctcttgccc

SEQ ID NO: 7585069 - DNA, 22 bp, Homo sapiens
tcccttcatcagtgagcaagcc

SEQ ID NO: 7585070 - DNA, 22 bp, Homo sapiens
tcccttcaataattcaacatta

SEQ ID NO: 7585071 - DNA, 22 bp, Homo sapiens
tcccttcaataattcaacatta

SEQ ID NO: 7585072 - DNA, 22 bp, Homo sapiens
tcccttcaagatttggggaaat

SEQ ID NO: 7585073 - DNA, 22 bp, Homo sapiens
tcccttcaataattcaacatta

SEQ ID NO: 7585074 - DNA, 22 bp, Homo sapiens
tcccttcaataattcaacatta

SEQ ID NO: 7585075 - DNA, 22 bp, Homo sapiens
tcccttcaataattcaacatta

SEQ ID NO: 7585076 - DNA, 22 bp, Homo sapiens
tccagggagatactggctgcca

SEQ ID NO: 7585077 - DNA, 22 bp, Homo sapiens
tccagggagagccgctgctcca

SEQ ID NO: 7585078 - DNA, 22 bp, Homo sapiens
tccagggagagccgctgctcca

SEQ ID NO: 7585079 - DNA, 22 bp, Homo sapiens
tccagggagagccgctgctcca

SEQ ID NO: 7585080 - DNA, 22 bp, Homo sapiens
tccagggagatactggctgcca

SEQ ID NO: 7585081 - DNA, 22 bp, Homo sapiens
tccagggagatactggctgcca

SEQ ID NO: 7585082 - DNA, 22 bp, Homo sapiens
tccagggagagccgctgctcca

SEQ ID NO: 7585083 - DNA, 22 bp, Homo sapiens
tccagggagatactggctgcca

SEQ ID NO: 7585084 - DNA, 22 bp, Homo sapiens
tccagggagatggcagaggctg

SEQ ID NO: 7585085 - DNA, 22 bp, Homo sapiens
tccagggagatggcagaggctg

SEQ ID NO: 7585086 - DNA, 22 bp, Homo sapiens
tccagggagatggcagaggctg

SEQ ID NO: 7585087 - DNA, 22 bp, Homo sapiens
tccagggagatggcagaggctg

SEQ ID NO: 7585088 - DNA, 22 bp, Homo sapiens
tccagggagatactggctgcca

SEQ ID NO: 7585089 - DNA, 22 bp, Homo sapiens
tccagggagatggcagaggctg

SEQ ID NO: 7585090 - DNA, 22 bp, Homo sapiens
tccagggagcaagtcaggccgg

SEQ ID NO: 7585091 - DNA, 22 bp, Homo sapiens
tccagggagatggcagaggctg

SEQ ID NO: 7585092 - DNA, 22 bp, Homo sapiens
tccagggagatggcagaggctg

SEQ ID NO: 7585093 - DNA, 22 bp, Homo sapiens
tccagggacagtatagaggatc

SEQ ID NO: 7585094 - DNA, 22 bp, Homo sapiens
tccagggacagtatagaggatc

SEQ ID NO: 7585095 - DNA, 22 bp, Homo sapiens
tccagggacagtatagaggatc

SEQ ID NO: 7585096 - DNA, 22 bp, Homo sapiens
tccagggacagtatagaggatc

SEQ ID NO: 7585097 - DNA, 22 bp, Homo sapiens
tccagggacagcgctggagcta

SEQ ID NO: 7585098 - DNA, 22 bp, Homo sapiens
tccagggacagcgctggagcta

SEQ ID NO: 7585099 - DNA, 22 bp, Homo sapiens
tccagggacagcgctggagcta

SEQ ID NO: 7585100 - DNA, 21 bp, Homo sapiens
tccaggcctcaggaagggatg

SEQ ID NO: 7585101 - DNA, 21 bp, Homo sapiens
tccaggcctcaggaagggatg

SEQ ID NO: 7585102 - DNA, 22 bp, Homo sapiens
tccagggagagccgctgctcca

SEQ ID NO: 7585103 - DNA, 22 bp, Homo sapiens
tccagggagagccgctgctcca

SEQ ID NO: 7585104 - DNA, 22 bp, Homo sapiens
tccagggagagccgctgctcca

SEQ ID NO: 7585105 - DNA, 22 bp, Homo sapiens
tccagggacctccctgagagct

SEQ ID NO: 7585106 - DNA, 22 bp, Homo sapiens
tccagggacctccctgagagct

SEQ ID NO: 7585107 - DNA, 22 bp, Homo sapiens
tccagggacctccctgagagct

SEQ ID NO: 7585108 - DNA, 22 bp, Homo sapiens
tccagggacctccctgagagct

SEQ ID NO: 7585109 - DNA, 22 bp, Homo sapiens
tccagggacctccctgagagct

SEQ ID NO: 7585110 - DNA, 22 bp, Homo sapiens
tccagggacctccctgagagct

SEQ ID NO: 7585111 - DNA, 22 bp, Homo sapiens
tccaggcccatagacacttctc

SEQ ID NO: 7585112 - DNA, 22 bp, Homo sapiens
tccaggcccatagacacttctc

SEQ ID NO: 7585113 - DNA, 22 bp, Homo sapiens
tccaggcccagacggggtgagg

SEQ ID NO: 7585114 - DNA, 22 bp, Homo sapiens
tccaggccctgggatgggagca

SEQ ID NO: 7585115 - DNA, 22 bp, Homo sapiens
tccaggccctgggatgggagca

SEQ ID NO: 7585116 - DNA, 22 bp, Homo sapiens
tccaggccctgggatgggagca

SEQ ID NO: 7585117 - DNA, 22 bp, Homo sapiens
tccaggccctgggatgggagca

SEQ ID NO: 7585118 - DNA, 22 bp, Homo sapiens
tccaggccctgggatgggagca

SEQ ID NO: 7585119 - DNA, 22 bp, Homo sapiens
tccaggccgcaggggcagcccc

SEQ ID NO: 7585120 - DNA, 22 bp, Homo sapiens
tccaggccgcaggggcagcccc

SEQ ID NO: 7585121 - DNA, 22 bp, Homo sapiens
tccaggccctgggatgggagca

SEQ ID NO: 7585122 - DNA, 22 bp, Homo sapiens
tccaggccgcaggggcagcccc

SEQ ID NO: 7585123 - DNA, 22 bp, Homo sapiens
tccaggccgcaggggcagcccc

SEQ ID NO: 7585124 - DNA, 22 bp, Homo sapiens
tccaggccgcaggggcagcccc

SEQ ID NO: 7585125 - DNA, 22 bp, Homo sapiens
tccaggccgcaggggcagcccc

SEQ ID NO: 7585126 - DNA, 22 bp, Homo sapiens
tccaggccgcaggggcagcccc

SEQ ID NO: 7585127 - DNA, 22 bp, Homo sapiens
tccaggccgcaggggcagcccc

SEQ ID NO: 7585128 - DNA, 22 bp, Homo sapiens
tccaggccgcaggggcagcccc

SEQ ID NO: 7585129 - DNA, 22 bp, Homo sapiens
tccaggccgcaggggcagcccc

SEQ ID NO: 7585130 - DNA, 22 bp, Homo sapiens
tccaggcctaggccaagtgatt

SEQ ID NO: 7585131 - DNA, 22 bp, Homo sapiens
tccaggcctaggccaagtgatt

SEQ ID NO: 7585132 - DNA, 22 bp, Homo sapiens
tccaggcctaggccaagtgatt

SEQ ID NO: 7585133 - DNA, 22 bp, Homo sapiens
tccaggccgcatagttactctg

SEQ ID NO: 7585134 - DNA, 22 bp, Homo sapiens
tccaggccgcatagttactctg

SEQ ID NO: 7585135 - DNA, 21 bp, Homo sapiens
tccaggcctcaggaagggatg

SEQ ID NO: 7585136 - DNA, 22 bp, Homo sapiens
tccaggcctaggccaagtgatt

SEQ ID NO: 7585137 - DNA, 21 bp, Homo sapiens
tccaggcctcaggaagggatg

SEQ ID NO: 7585138 - DNA, 21 bp, Homo sapiens
tccaggcctcaggaagggatg

SEQ ID NO: 7585139 - DNA, 22 bp, Homo sapiens
tccaggcctaggccaagtgatt

SEQ ID NO: 7585140 - DNA, 22 bp, Homo sapiens
tccaggcctaggccaagtgatt

SEQ ID NO: 7585141 - DNA, 22 bp, Homo sapiens
tccaggcctaggccaagtgatt

SEQ ID NO: 7585142 - DNA, 22 bp, Homo sapiens
tccaggccattgactgcatcct

SEQ ID NO: 7585143 - DNA, 22 bp, Homo sapiens
tccaggccattgactgcatcct

SEQ ID NO: 7585144 - DNA, 22 bp, Homo sapiens
tccaggccattgactgcatcct

SEQ ID NO: 7585145 - DNA, 22 bp, Homo sapiens
tccaggccattgactgcatcct

SEQ ID NO: 7585146 - DNA, 22 bp, Homo sapiens
tccaggccattgactgcatcct

SEQ ID NO: 7585147 - DNA, 22 bp, Homo sapiens
tccaggccattgactgcatcct

SEQ ID NO: 7585148 - DNA, 22 bp, Homo sapiens
tccaggccattgactgcatcct

SEQ ID NO: 7585149 - DNA, 22 bp, Homo sapiens
tccaggccattgactgcatcct

SEQ ID NO: 7585150 - DNA, 22 bp, Homo sapiens
tccaggccattgactgcatcct

SEQ ID NO: 7585151 - DNA, 22 bp, Homo sapiens
tccaggcccactcagctgaaat

SEQ ID NO: 7585152 - DNA, 20 bp, Homo sapiens
tccaggcccactcagctgaa

SEQ ID NO: 7585153 - DNA, 20 bp, Homo sapiens
tccaggcccactcagctgaa

SEQ ID NO: 7585154 - DNA, 22 bp, Homo sapiens
tccaggccattgactgcatcct

SEQ ID NO: 7585155 - DNA, 20 bp, Homo sapiens
tccaggcccactcagctgaa

SEQ ID NO: 7585156 - DNA, 20 bp, Homo sapiens
tccaggcccactcagctgaa

SEQ ID NO: 7585157 - DNA, 20 bp, Homo sapiens
tccaggcccactcagctgaa

SEQ ID NO: 7585158 - DNA, 22 bp, Homo sapiens
tccaggcccactcggtggggct

SEQ ID NO: 7585159 - DNA, 22 bp, Homo sapiens
tccaggcccactcggtggggct

SEQ ID NO: 7585160 - DNA, 22 bp, Homo sapiens
tccaggcccactcagctgaaat

SEQ ID NO: 7585161 - DNA, 22 bp, Homo sapiens
tccaggcccactcagctgaaat

SEQ ID NO: 7585162 - DNA, 22 bp, Homo sapiens
tccaggcccactcagctgaaat

SEQ ID NO: 7585163 - DNA, 22 bp, Homo sapiens
tccaggcccagacggggtgagg

SEQ ID NO: 7585164 - DNA, 22 bp, Homo sapiens
tccaggcccagacggggtgagg

SEQ ID NO: 7585165 - DNA, 22 bp, Homo sapiens
tccaggcccactcggtggggct

SEQ ID NO: 7585166 - DNA, 22 bp, Homo sapiens
tccaggcccactcggtggggct

SEQ ID NO: 7585167 - DNA, 22 bp, Homo sapiens
tccaggcccactcggtggggct

SEQ ID NO: 7585168 - DNA, 22 bp, Homo sapiens
tccaggcccagacggggtgagg

SEQ ID NO: 7585169 - DNA, 22 bp, Homo sapiens
tccaggcccagacggggtgagg

SEQ ID NO: 7585170 - DNA, 22 bp, Homo sapiens
tccaggcccagacggggtgagg

SEQ ID NO: 7585171 - DNA, 19 bp, Homo sapiens
tccaggccattcccagagc

SEQ ID NO: 7585172 - DNA, 19 bp, Homo sapiens
tccaggccattcccagagc

SEQ ID NO: 7585173 - DNA, 19 bp, Homo sapiens
tccaggccattcccagagc

SEQ ID NO: 7585174 - DNA, 19 bp, Homo sapiens
tccaggccattcccagagc

SEQ ID NO: 7585175 - DNA, 21 bp, Homo sapiens
tccaggccatggtggggaggc

SEQ ID NO: 7585176 - DNA, 21 bp, Homo sapiens
tccaggccatggtggggaggc

SEQ ID NO: 7585177 - DNA, 21 bp, Homo sapiens
tccaggccatggtggggaggc

SEQ ID NO: 7585178 - DNA, 21 bp, Homo sapiens
tccaggccatggtggggaggc

SEQ ID NO: 7585179 - DNA, 21 bp, Homo sapiens
tccaggccatggtggggaggc

SEQ ID NO: 7585180 - DNA, 22 bp, Homo sapiens
tccaggccagggtaagaggaga

SEQ ID NO: 7585181 - DNA, 22 bp, Homo sapiens
tccaggccagggtaagaggaga

SEQ ID NO: 7585182 - DNA, 22 bp, Homo sapiens
tccaggccagggtaagaggaga

SEQ ID NO: 7585183 - DNA, 22 bp, Homo sapiens
tccaggccagggtaagaggaga

SEQ ID NO: 7585184 - DNA, 22 bp, Homo sapiens
tccaggccagggtaagaggaga

SEQ ID NO: 7585185 - DNA, 22 bp, Homo sapiens
tccaggccactgcagaggctct

SEQ ID NO: 7585186 - DNA, 22 bp, Homo sapiens
tccaggccagggtaagaggaga

SEQ ID NO: 7585187 - DNA, 22 bp, Homo sapiens
tccaggaggcagggctgtgccc

SEQ ID NO: 7585188 - DNA, 22 bp, Homo sapiens
tccaggaggcagggctgtgccc

SEQ ID NO: 7585189 - DNA, 22 bp, Homo sapiens
tccaggaggcagggctgtgccc

SEQ ID NO: 7585190 - DNA, 22 bp, Homo sapiens
tccaggaggcagggctgtgccc

SEQ ID NO: 7585191 - DNA, 22 bp, Homo sapiens
tccaggaggcagggctgtgccc

SEQ ID NO: 7585192 - DNA, 22 bp, Homo sapiens
tccaggaggcagggctgtgccc

SEQ ID NO: 7585193 - DNA, 22 bp, Homo sapiens
tccaggaggcacctttggacca

SEQ ID NO: 7585194 - DNA, 22 bp, Homo sapiens
tccaggaggcagggctgtgccc

SEQ ID NO: 7585195 - DNA, 22 bp, Homo sapiens
tccaggagctcatccacgtcaa

SEQ ID NO: 7585196 - DNA, 22 bp, Homo sapiens
tccaggaggcacctttggacca

SEQ ID NO: 7585197 - DNA, 22 bp, Homo sapiens
tccaggaggaggaaggctgcca

SEQ ID NO: 7585198 - DNA, 22 bp, Homo sapiens
tccaggaggaggaaggctgcca

SEQ ID NO: 7585199 - DNA, 22 bp, Homo sapiens
tccaggaggaggaaggctgcca

SEQ ID NO: 7585200 - DNA, 22 bp, Homo sapiens
tccaggaggaggaaggctgcca

SEQ ID NO: 7585201 - DNA, 22 bp, Homo sapiens
tccaggaggaggaaggctgcca

SEQ ID NO: 7585202 - DNA, 22 bp, Homo sapiens
tccagtggtacatggagacact

SEQ ID NO: 7585203 - DNA, 22 bp, Homo sapiens
tccagtggtagtaaagaggtct

SEQ ID NO: 7585204 - DNA, 21 bp, Homo sapiens
tccagtggtgtctagaatgtg

SEQ ID NO: 7585205 - DNA, 21 bp, Homo sapiens
tccagtggtgtctagaatgtg

SEQ ID NO: 7585206 - DNA, 21 bp, Homo sapiens
tccagtggtgtctagaatgtg

SEQ ID NO: 7585207 - DNA, 22 bp, Homo sapiens
tccagtggtggtttgaagggca

SEQ ID NO: 7585208 - DNA, 22 bp, Homo sapiens
tccagtggtggtttgaagggca

SEQ ID NO: 7585209 - DNA, 20 bp, Homo sapiens
tccagtggcctgaatctgga

SEQ ID NO: 7585210 - DNA, 20 bp, Homo sapiens
tccagtggcctgaatctgga

SEQ ID NO: 7585211 - DNA, 21 bp, Homo sapiens
tccagtggggatctctgatat

SEQ ID NO: 7585212 - DNA, 22 bp, Homo sapiens
tccagtggcttcctggaaaaaa

SEQ ID NO: 7585213 - DNA, 22 bp, Homo sapiens
tccagtggctttgctgctttaa

SEQ ID NO: 7585214 - DNA, 22 bp, Homo sapiens
tccagtggctttgctgctttaa

SEQ ID NO: 7585215 - DNA, 22 bp, Homo sapiens
tccagtgggttgctgagggagg

SEQ ID NO: 7585216 - DNA, 22 bp, Homo sapiens
tccagtgggttgctgagggagg

SEQ ID NO: 7585217 - DNA, 22 bp, Homo sapiens
tccagtgggtctggcaagacca

SEQ ID NO: 7585218 - DNA, 21 bp, Homo sapiens
tccagtggggatctctgatat

SEQ ID NO: 7585219 - DNA, 22 bp, Homo sapiens
tccagtggaacagatgttgcct

SEQ ID NO: 7585220 - DNA, 22 bp, Homo sapiens
tccagtggaacagatgttgcct

SEQ ID NO: 7585221 - DNA, 22 bp, Homo sapiens
tccagtgctggaccagagcacc

SEQ ID NO: 7585222 - DNA, 22 bp, Homo sapiens
tccagtggaaattgtgttcatt

SEQ ID NO: 7585223 - DNA, 22 bp, Homo sapiens
tccagtgctggaccagagcacc

SEQ ID NO: 7585224 - DNA, 22 bp, Homo sapiens
tccagtgctggaccagagcacc

SEQ ID NO: 7585225 - DNA, 22 bp, Homo sapiens
tccagtgcctcactgaggattc

SEQ ID NO: 7585226 - DNA, 22 bp, Homo sapiens
tccagtgcctcactgaggattc

SEQ ID NO: 7585227 - DNA, 22 bp, Homo sapiens
tccagtggcaggcggtgaggtc

SEQ ID NO: 7585228 - DNA, 22 bp, Homo sapiens
tccagtggcaggcggtgaggtc

SEQ ID NO: 7585229 - DNA, 20 bp, Homo sapiens
tccagtggcctgaatctgga

SEQ ID NO: 7585230 - DNA, 22 bp, Homo sapiens
tccagtggcaggcggtgaggtc

SEQ ID NO: 7585231 - DNA, 22 bp, Homo sapiens
tccagtggcactggagactaga

SEQ ID NO: 7585232 - DNA, 22 bp, Homo sapiens
tccagtggcactggagactaga

SEQ ID NO: 7585233 - DNA, 22 bp, Homo sapiens
tccagtggagtgtgggggtgaa

SEQ ID NO: 7585234 - DNA, 22 bp, Homo sapiens
tccagtctggagccttctggtt

SEQ ID NO: 7585235 - DNA, 22 bp, Homo sapiens
tccagtctggagccttctggtt

SEQ ID NO: 7585236 - DNA, 18 bp, Homo sapiens
tccagtcttattaccatt

SEQ ID NO: 7585237 - DNA, 22 bp, Homo sapiens
tccagtctctactctgagataa

SEQ ID NO: 7585238 - DNA, 22 bp, Homo sapiens
tccagtctggagccttctggtt

SEQ ID NO: 7585239 - DNA, 22 bp, Homo sapiens
tccagtgagcactacatgaact

SEQ ID NO: 7585240 - DNA, 22 bp, Homo sapiens
tccagtgagcactacatgaact

SEQ ID NO: 7585241 - DNA, 22 bp, Homo sapiens
tccagtgagcactacatgaact

SEQ ID NO: 7585242 - DNA, 22 bp, Homo sapiens
tccagtgagcactacatgaact

SEQ ID NO: 7585243 - DNA, 22 bp, Homo sapiens
tccagtgatctagggagctgga

SEQ ID NO: 7585244 - DNA, 22 bp, Homo sapiens
tccagtgatctagggagctgga

SEQ ID NO: 7585245 - DNA, 22 bp, Homo sapiens
tccagtcttcttgcagctacat

SEQ ID NO: 7585246 - DNA, 22 bp, Homo sapiens
tccagtcttcttgcagctacat

SEQ ID NO: 7585247 - DNA, 22 bp, Homo sapiens
tccagtgcattcagacacttgg

SEQ ID NO: 7585248 - DNA, 22 bp, Homo sapiens
tccagtgcattcagacacttgg

SEQ ID NO: 7585249 - DNA, 22 bp, Homo sapiens
tccagtgatctagggagctgga

SEQ ID NO: 7585250 - DNA, 22 bp, Homo sapiens
tccagtgatgctgcaagagtga

SEQ ID NO: 7585251 - DNA, 22 bp, Homo sapiens
tccagtgatgctgcaagagtga

SEQ ID NO: 7585252 - DNA, 22 bp, Homo sapiens
tccagtgatgctgcaagagtga

SEQ ID NO: 7585253 - DNA, 22 bp, Homo sapiens
tccagtccttgaaaatccaaca

SEQ ID NO: 7585254 - DNA, 22 bp, Homo sapiens
tccagtccttgcctctgtcagg

SEQ ID NO: 7585255 - DNA, 23 bp, Homo sapiens
tccagtctcctgaaaggcagcgt

SEQ ID NO: 7585256 - DNA, 23 bp, Homo sapiens
tccagtctcctgaaaggcagcgt

SEQ ID NO: 7585257 - DNA, 22 bp, Homo sapiens
tccagtctcccagggctgggac

SEQ ID NO: 7585258 - DNA, 22 bp, Homo sapiens
tccagtcggataactagacggt

SEQ ID NO: 7585259 - DNA, 22 bp, Homo sapiens
tccagtctaatgagtcagagtg

SEQ ID NO: 7585260 - DNA, 22 bp, Homo sapiens
tccagtctaatgagtcagagtg

SEQ ID NO: 7585261 - DNA, 22 bp, Homo sapiens
tccagtcctatctgcccttgga

SEQ ID NO: 7585262 - DNA, 22 bp, Homo sapiens
tccagtcctagaaactggagag

SEQ ID NO: 7585263 - DNA, 22 bp, Homo sapiens
tccagtcctagaaactggagag

SEQ ID NO: 7585264 - DNA, 22 bp, Homo sapiens
tccagtcctagaaactggagag

SEQ ID NO: 7585265 - DNA, 22 bp, Homo sapiens
tccagtcccattacccacattt

SEQ ID NO: 7585266 - DNA, 18 bp, Homo sapiens
tccagtcccagctctgcc

SEQ ID NO: 7585267 - DNA, 22 bp, Homo sapiens
tccagggatgtcctgtagcact

SEQ ID NO: 7585268 - DNA, 22 bp, Homo sapiens
tccagggatggtaatgagcagt

SEQ ID NO: 7585269 - DNA, 22 bp, Homo sapiens
tccagggatggtaatgagcagt

SEQ ID NO: 7585270 - DNA, 22 bp, Homo sapiens
tccagggatggtaatgagcagt

SEQ ID NO: 7585271 - DNA, 22 bp, Homo sapiens
tccagggatgccagccatgttg

SEQ ID NO: 7585272 - DNA, 22 bp, Homo sapiens
tccagggatggtaatgagcagt

SEQ ID NO: 7585273 - DNA, 22 bp, Homo sapiens
tccagggatggtaatgagcagt

SEQ ID NO: 7585274 - DNA, 22 bp, Homo sapiens
tccagggatgccagccatgttg

SEQ ID NO: 7585275 - DNA, 22 bp, Homo sapiens
tccagggatgccagccatgttg

SEQ ID NO: 7585276 - DNA, 22 bp, Homo sapiens
tccagggatgccagccatgttg

SEQ ID NO: 7585277 - DNA, 22 bp, Homo sapiens
tccagggatgccagccatgttg

SEQ ID NO: 7585278 - DNA, 20 bp, Homo sapiens
tccagggcaaactcatcacc

SEQ ID NO: 7585279 - DNA, 20 bp, Homo sapiens
tccagggcaaactcatcacc

SEQ ID NO: 7585280 - DNA, 20 bp, Homo sapiens
tccagggcaaactcatcacc

SEQ ID NO: 7585281 - DNA, 23 bp, Homo sapiens
tccagggattaatgaagtcagtc

SEQ ID NO: 7585282 - DNA, 23 bp, Homo sapiens
tccagggattaatgaagtcagtc

SEQ ID NO: 7585283 - DNA, 23 bp, Homo sapiens
tccagggattaatgaagtcagtc

SEQ ID NO: 7585284 - DNA, 23 bp, Homo sapiens
tccagggattaatgaagtcagtc

SEQ ID NO: 7585285 - DNA, 22 bp, Homo sapiens
tccagggatgtcctgtagcact

SEQ ID NO: 7585286 - DNA, 22 bp, Homo sapiens
tccagggatgtcctgtagcact

SEQ ID NO: 7585287 - DNA, 22 bp, Homo sapiens
tccagggatgtcctgtagcact

SEQ ID NO: 7585288 - DNA, 22 bp, Homo sapiens
tccagggatgtcctgtagcact

SEQ ID NO: 7585289 - DNA, 22 bp, Homo sapiens
tccagggatgccagccatgttg

SEQ ID NO: 7585290 - DNA, 22 bp, Homo sapiens
tccagggatgccagccatgttg

SEQ ID NO: 7585291 - DNA, 22 bp, Homo sapiens
tccagggatctttagagtcttt

SEQ ID NO: 7585292 - DNA, 22 bp, Homo sapiens
tccagggatctttagagtcttt

SEQ ID NO: 7585293 - DNA, 22 bp, Homo sapiens
tccagggatctttagagtcttt

SEQ ID NO: 7585294 - DNA, 22 bp, Homo sapiens
tccagggatctttagagtcttt

SEQ ID NO: 7585295 - DNA, 22 bp, Homo sapiens
tccagggatctttagagtcttt

SEQ ID NO: 7585296 - DNA, 22 bp, Homo sapiens
tccagggagttggctggatagt

SEQ ID NO: 7585297 - DNA, 22 bp, Homo sapiens
tccagggagttggctggatagt

SEQ ID NO: 7585298 - DNA, 22 bp, Homo sapiens
tccagggagttggctggatagt

SEQ ID NO: 7585299 - DNA, 22 bp, Homo sapiens
tccagggagtcaaatgaactac

SEQ ID NO: 7585300 - DNA, 22 bp, Homo sapiens
tccagggagtcaaatgaactac

SEQ ID NO: 7585301 - DNA, 22 bp, Homo sapiens
tccagggagtcaaatgaactac

SEQ ID NO: 7585302 - DNA, 22 bp, Homo sapiens
tccagggagttggctggatagt

SEQ ID NO: 7585303 - DNA, 22 bp, Homo sapiens
tccagggagtcaaatgaactac

SEQ ID NO: 7585304 - DNA, 22 bp, Homo sapiens
tccagggagcaagtcaggccgg

SEQ ID NO: 7585305 - DNA, 22 bp, Homo sapiens
tccagggagcaagtcaggccgg

SEQ ID NO: 7585306 - DNA, 22 bp, Homo sapiens
tccagggagcaagtcaggccgg

SEQ ID NO: 7585307 - DNA, 22 bp, Homo sapiens
tccagggagcaagtcaggccgg

SEQ ID NO: 7585308 - DNA, 22 bp, Homo sapiens
tccagggagcaagtcaggccgg

SEQ ID NO: 7585309 - DNA, 22 bp, Homo sapiens
tccagggagcaagtcaggccgg

SEQ ID NO: 7585310 - DNA, 20 bp, Homo sapiens
tccagggcaactagagtgtg

SEQ ID NO: 7585311 - DNA, 20 bp, Homo sapiens
tccagggcaactagagtgtg

SEQ ID NO: 7585312 - DNA, 20 bp, Homo sapiens
tccagggcaactagagtgtg

SEQ ID NO: 7585313 - DNA, 20 bp, Homo sapiens
tccagggcaactagagtgtg

SEQ ID NO: 7585314 - DNA, 22 bp, Homo sapiens
tccagggcaccagcgtccccct

SEQ ID NO: 7585315 - DNA, 22 bp, Homo sapiens
tccagggcaccagcgtccccct

SEQ ID NO: 7585316 - DNA, 22 bp, Homo sapiens
tccagggcaccagcgtccccct

SEQ ID NO: 7585317 - DNA, 20 bp, Homo sapiens
tccagggcaaactcatcacc

SEQ ID NO: 7585318 - DNA, 20 bp, Homo sapiens
tccagggcaactagagtgtg

SEQ ID NO: 7585319 - DNA, 20 bp, Homo sapiens
tccagggcaaactcatcacc

SEQ ID NO: 7585320 - DNA, 20 bp, Homo sapiens
tccagggcaaactcatcacc

SEQ ID NO: 7585321 - DNA, 20 bp, Homo sapiens
tccagggcaaactcatcacc

SEQ ID NO: 7585322 - DNA, 22 bp, Homo sapiens
tccagggcagccgcgggtgcgc

SEQ ID NO: 7585323 - DNA, 22 bp, Homo sapiens
tccagggcagccgcgggtgcgc

SEQ ID NO: 7585324 - DNA, 22 bp, Homo sapiens
tccagtcaggctgaattcaagg

SEQ ID NO: 7585325 - DNA, 22 bp, Homo sapiens
tccagtcaggctgaattcaagg

SEQ ID NO: 7585326 - DNA, 22 bp, Homo sapiens
tccagtcatggtgtcctcacaa

SEQ ID NO: 7585327 - DNA, 22 bp, Homo sapiens
tccagtcatctcccttcacatt

SEQ ID NO: 7585328 - DNA, 22 bp, Homo sapiens
tccagtcatctcccttcacatt

SEQ ID NO: 7585329 - DNA, 22 bp, Homo sapiens
tccagtcatctcccttcacatt

SEQ ID NO: 7585330 - DNA, 22 bp, Homo sapiens
tccagggcagccgcgggtgcgc

SEQ ID NO: 7585331 - DNA, 22 bp, Homo sapiens
tccagggcagccgcgggtgcgc

SEQ ID NO: 7585332 - DNA, 22 bp, Homo sapiens
tccagtccatggcctcagtctt

SEQ ID NO: 7585333 - DNA, 22 bp, Homo sapiens
tccagtccatggcctcagtctt

SEQ ID NO: 7585334 - DNA, 18 bp, Homo sapiens
tccagtcccagctctgcc

SEQ ID NO: 7585335 - DNA, 18 bp, Homo sapiens
tccagtcccaaggccagc

SEQ ID NO: 7585336 - DNA, 22 bp, Homo sapiens
tccagtccatggcctcagtctt

SEQ ID NO: 7585337 - DNA, 22 bp, Homo sapiens
tccagtcatttccattgttccc

SEQ ID NO: 7585338 - DNA, 22 bp, Homo sapiens
tccagtcatggtgtcctcacaa

SEQ ID NO: 7585339 - DNA, 22 bp, Homo sapiens
tccagtcatttccattgttccc

SEQ ID NO: 7585340 - DNA, 21 bp, Homo sapiens
tcccagagtgcttgggactgc

SEQ ID NO: 7585341 - DNA, 21 bp, Homo sapiens
tcccagagtgcttgggactgc

SEQ ID NO: 7585342 - DNA, 21 bp, Homo sapiens
tcccagagtgcttgggactgc

SEQ ID NO: 7585343 - DNA, 22 bp, Homo sapiens
tcccagagtgtgggcatcaagg

SEQ ID NO: 7585344 - DNA, 22 bp, Homo sapiens
tcccagagtgtgggcatcaagg

SEQ ID NO: 7585345 - DNA, 22 bp, Homo sapiens
tcccagagtgagccaggggcag

SEQ ID NO: 7585346 - DNA, 22 bp, Homo sapiens
tcccagagtgagccaggggcag

SEQ ID NO: 7585347 - DNA, 22 bp, Homo sapiens
tcccagagtgagccaggggcag

SEQ ID NO: 7585348 - DNA, 21 bp, Homo sapiens
tcccagagtgcttgggactgc

SEQ ID NO: 7585349 - DNA, 21 bp, Homo sapiens
tcccagagtgcttgggactgc

SEQ ID NO: 7585350 - DNA, 21 bp, Homo sapiens
tcccagagtgcttgggactgc

SEQ ID NO: 7585351 - DNA, 21 bp, Homo sapiens
tcccagagtgcttgggactgc

SEQ ID NO: 7585352 - DNA, 22 bp, Homo sapiens
tcccagagttcaatgggaaggt

SEQ ID NO: 7585353 - DNA, 22 bp, Homo sapiens
tcccagagtgtgggcatcaagg

SEQ ID NO: 7585354 - DNA, 22 bp, Homo sapiens
tcccagagtgtgggcatcaagg

SEQ ID NO: 7585355 - DNA, 22 bp, Homo sapiens
tcccagagttcaatgggaaggt

SEQ ID NO: 7585356 - DNA, 22 bp, Homo sapiens
tcccagagttcaatgggaaggt

SEQ ID NO: 7585357 - DNA, 22 bp, Homo sapiens
tcccagagttcaatgggaaggt

SEQ ID NO: 7585358 - DNA, 22 bp, Homo sapiens
tcccagagttcaatgggaaggt

SEQ ID NO: 7585359 - DNA, 22 bp, Homo sapiens
tcccagagttcaatgggaaggt

SEQ ID NO: 7585360 - DNA, 22 bp, Homo sapiens
tcccagagtgtgggcatcaagg

SEQ ID NO: 7585361 - DNA, 22 bp, Homo sapiens
tcccagagtgtgggcatcaagg

SEQ ID NO: 7585362 - DNA, 22 bp, Homo sapiens
tcccagagtgtgggcatcaagg

SEQ ID NO: 7585363 - DNA, 22 bp, Homo sapiens
tcccagagtgtgggcatcaagg

SEQ ID NO: 7585364 - DNA, 22 bp, Homo sapiens
tcccagagtgtgggcatcaagg

SEQ ID NO: 7585365 - DNA, 22 bp, Homo sapiens
tcccagagtcagaggtggggcc

SEQ ID NO: 7585366 - DNA, 22 bp, Homo sapiens
tcccagagtcagaggtggggcc

SEQ ID NO: 7585367 - DNA, 22 bp, Homo sapiens
tcccagagtcagaggtggggcc

SEQ ID NO: 7585368 - DNA, 22 bp, Homo sapiens
tcccagagaaagtcaaggtctt

SEQ ID NO: 7585369 - DNA, 22 bp, Homo sapiens
tcccagagtattagcaattgct

SEQ ID NO: 7585370 - DNA, 22 bp, Homo sapiens
tcccagagaaagtcaaggtctt

SEQ ID NO: 7585371 - DNA, 19 bp, Homo sapiens
tcccagagtctagaggttg

SEQ ID NO: 7585372 - DNA, 19 bp, Homo sapiens
tcccagagtctagaggttg

SEQ ID NO: 7585373 - DNA, 22 bp, Homo sapiens
tcccagagtcagaggtggggcc

SEQ ID NO: 7585374 - DNA, 19 bp, Homo sapiens
tcccagagtctagaggttg

SEQ ID NO: 7585375 - DNA, 19 bp, Homo sapiens
tcccagagtctagaggttg

SEQ ID NO: 7585376 - DNA, 19 bp, Homo sapiens
tcccagagtctagaggttg

SEQ ID NO: 7585377 - DNA, 19 bp, Homo sapiens
tcccagagtctagaggttg

SEQ ID NO: 7585378 - DNA, 22 bp, Homo sapiens
tcccagagtcttctcctgtaat

SEQ ID NO: 7585379 - DNA, 22 bp, Homo sapiens
tcccagagtcttctcctgtaat

SEQ ID NO: 7585380 - DNA, 22 bp, Homo sapiens
tcccagagtcttctcctgtaat

SEQ ID NO: 7585381 - DNA, 19 bp, Homo sapiens
tcccagagtctagaggttg

SEQ ID NO: 7585382 - DNA, 22 bp, Homo sapiens
tcccagagtcttctcctgtaat

SEQ ID NO: 7585383 - DNA, 22 bp, Homo sapiens
tcccagagtgagccaggggcag

SEQ ID NO: 7585384 - DNA, 22 bp, Homo sapiens
tcccagagtgagccaggggcag

SEQ ID NO: 7585385 - DNA, 22 bp, Homo sapiens
tcccagagtgagccaggggcag

SEQ ID NO: 7585386 - DNA, 22 bp, Homo sapiens
tcccagagtcttctcctgtaat

SEQ ID NO: 7585387 - DNA, 22 bp, Homo sapiens
tcccagaatctccagtgctaca

SEQ ID NO: 7585388 - DNA, 22 bp, Homo sapiens
tcccagaatctccagtgctaca

SEQ ID NO: 7585389 - DNA, 22 bp, Homo sapiens
tcccagaatcctcactctatca

SEQ ID NO: 7585390 - DNA, 22 bp, Homo sapiens
tcccagaatctccagtgctaca

SEQ ID NO: 7585391 - DNA, 22 bp, Homo sapiens
tcccagaatctccagtgctaca

SEQ ID NO: 7585392 - DNA, 22 bp, Homo sapiens
tcccagaatctccagtgctaca

SEQ ID NO: 7585393 - DNA, 22 bp, Homo sapiens
tcccagaatctccagtgctaca

SEQ ID NO: 7585394 - DNA, 22 bp, Homo sapiens
tcccagaatctccagtgctaca

SEQ ID NO: 7585395 - DNA, 22 bp, Homo sapiens
tcccagaatctccagtgctaca

SEQ ID NO: 7585396 - DNA, 22 bp, Homo sapiens
tcccagaatctttggaagagca

SEQ ID NO: 7585397 - DNA, 22 bp, Homo sapiens
tcccagaatctttggaagagca

SEQ ID NO: 7585398 - DNA, 22 bp, Homo sapiens
tcccagaatctttggaagagca

SEQ ID NO: 7585399 - DNA, 22 bp, Homo sapiens
tcccagagaaagtcaaggtctt

SEQ ID NO: 7585400 - DNA, 22 bp, Homo sapiens
tcccagagaaagtcaaggtctt

SEQ ID NO: 7585401 - DNA, 22 bp, Homo sapiens
tcccagagaaagtcaaggtctt

SEQ ID NO: 7585402 - DNA, 22 bp, Homo sapiens
tcccagagaaagtcaaggtctt

SEQ ID NO: 7585403 - DNA, 22 bp, Homo sapiens
tcccagaatctttggaagagca

SEQ ID NO: 7585404 - DNA, 22 bp, Homo sapiens
tcccagaatggcccagctgccc

SEQ ID NO: 7585405 - DNA, 22 bp, Homo sapiens
tcccagaatggcccagctgccc

SEQ ID NO: 7585406 - DNA, 22 bp, Homo sapiens
tcccagaatggcccagctgccc

SEQ ID NO: 7585407 - DNA, 22 bp, Homo sapiens
tcccagaagtgaaatttctaga

SEQ ID NO: 7585408 - DNA, 22 bp, Homo sapiens
tcccagaatcctcactctatca

SEQ ID NO: 7585409 - DNA, 22 bp, Homo sapiens
tcccagaagtgaaatttctaga

SEQ ID NO: 7585410 - DNA, 22 bp, Homo sapiens
tcccagaagtccagccatgggc

SEQ ID NO: 7585411 - DNA, 22 bp, Homo sapiens
tcccagaagtccagccatgggc

SEQ ID NO: 7585412 - DNA, 22 bp, Homo sapiens
tcccagaagtccagccatgggc

SEQ ID NO: 7585413 - DNA, 22 bp, Homo sapiens
tcccagaagtccagccatgggc

SEQ ID NO: 7585414 - DNA, 22 bp, Homo sapiens
tcccagaagagatgccacttga

SEQ ID NO: 7585415 - DNA, 22 bp, Homo sapiens
tcccagaagagatgccacttga

SEQ ID NO: 7585416 - DNA, 22 bp, Homo sapiens
tcccagaacgggttcttcccag

SEQ ID NO: 7585417 - DNA, 22 bp, Homo sapiens
tcccagaagagatgccacttga

SEQ ID NO: 7585418 - DNA, 22 bp, Homo sapiens
tcccagaacgggttcttcccag

SEQ ID NO: 7585419 - DNA, 22 bp, Homo sapiens
tcccagaacctcagagtgtgac

SEQ ID NO: 7585420 - DNA, 22 bp, Homo sapiens
tcccagaaccttttagcttcac

SEQ ID NO: 7585421 - DNA, 22 bp, Homo sapiens
tcccagaaccttttagcttcac

SEQ ID NO: 7585422 - DNA, 22 bp, Homo sapiens
tcccagaacctcagagtgtgac

SEQ ID NO: 7585423 - DNA, 22 bp, Homo sapiens
tcccagaaccttttagcttcac

SEQ ID NO: 7585424 - DNA, 22 bp, Homo sapiens
tcccagaaccttttagcttcac

SEQ ID NO: 7585425 - DNA, 22 bp, Homo sapiens
tcccagaacctcagagtgtgac

SEQ ID NO: 7585426 - DNA, 22 bp, Homo sapiens
tcccagaacctcagagtgtgac

SEQ ID NO: 7585427 - DNA, 22 bp, Homo sapiens
tcccagaaccctgccaggtcct

SEQ ID NO: 7585428 - DNA, 22 bp, Homo sapiens
tcccagaaccctgccaggtcct

SEQ ID NO: 7585429 - DNA, 22 bp, Homo sapiens
tcccagaaacgcatatgttcat

SEQ ID NO: 7585430 - DNA, 22 bp, Homo sapiens
tcccagaaacgcatatgttcat

SEQ ID NO: 7585431 - DNA, 22 bp, Homo sapiens
tcccagaaaaaggaggctatga

SEQ ID NO: 7585432 - DNA, 22 bp, Homo sapiens
tcccagaaaaaggaggctatga

SEQ ID NO: 7585433 - DNA, 22 bp, Homo sapiens
tcccagaaaaaggaggctatga

SEQ ID NO: 7585434 - DNA, 22 bp, Homo sapiens
tcccagaaacgcatatgttcat

SEQ ID NO: 7585435 - DNA, 22 bp, Homo sapiens
tcccacttaactgtgacttctc

SEQ ID NO: 7585436 - DNA, 22 bp, Homo sapiens
tcccagaaaaaggaggctatga

SEQ ID NO: 7585437 - DNA, 22 bp, Homo sapiens
tcccactgtcttctcgtgctcg

SEQ ID NO: 7585438 - DNA, 22 bp, Homo sapiens
tcccactgtcttctcgtgctcg

SEQ ID NO: 7585439 - DNA, 22 bp, Homo sapiens
tcccactgtctgtcttgctgca

SEQ ID NO: 7585440 - DNA, 22 bp, Homo sapiens
tcccactgtgcctgttgtaatc

SEQ ID NO: 7585441 - DNA, 22 bp, Homo sapiens
tcccactgtgaatccaaggcct

SEQ ID NO: 7585442 - DNA, 22 bp, Homo sapiens
tcccactgtgaatccaaggcct

SEQ ID NO: 7585443 - DNA, 22 bp, Homo sapiens
tcccactgtgaatccaaggcct

SEQ ID NO: 7585444 - DNA, 22 bp, Homo sapiens
tcccactgctttgctctgctca

SEQ ID NO: 7585445 - DNA, 22 bp, Homo sapiens
tcccactgctttgctctgctca

SEQ ID NO: 7585446 - DNA, 22 bp, Homo sapiens
tcccactgctttgctctgctca

SEQ ID NO: 7585447 - DNA, 22 bp, Homo sapiens
tcccactgctttgctctgctca

SEQ ID NO: 7585448 - DNA, 22 bp, Homo sapiens
tcccactggacgtctgtgctgg

SEQ ID NO: 7585449 - DNA, 21 bp, Homo sapiens
tcccactgccacagcttcagg

SEQ ID NO: 7585450 - DNA, 21 bp, Homo sapiens
tcccactgccacagcttcagg

SEQ ID NO: 7585451 - DNA, 21 bp, Homo sapiens
tcccactgccacagcttcagg

SEQ ID NO: 7585452 - DNA, 21 bp, Homo sapiens
tcccactgccacagcttcagg

SEQ ID NO: 7585453 - DNA, 22 bp, Homo sapiens
tcccactgtctgtcttgctgca

SEQ ID NO: 7585454 - DNA, 22 bp, Homo sapiens
tcccactgtctgtcttgctgca

SEQ ID NO: 7585455 - DNA, 22 bp, Homo sapiens
tcccactgtctgtcttgctgca

SEQ ID NO: 7585456 - DNA, 22 bp, Homo sapiens
tcccactgtctgtcttgctgca

SEQ ID NO: 7585457 - DNA, 20 bp, Homo sapiens
tcccactgggcctcagtttc

SEQ ID NO: 7585458 - DNA, 22 bp, Homo sapiens
tcccactggacgtctgtgctgg

SEQ ID NO: 7585459 - DNA, 22 bp, Homo sapiens
tcccactggacgtctgtgctgg

SEQ ID NO: 7585460 - DNA, 21 bp, Homo sapiens
tcccactggcccagggctcca

SEQ ID NO: 7585461 - DNA, 21 bp, Homo sapiens
tcccactggcccagggctcca

SEQ ID NO: 7585462 - DNA, 22 bp, Homo sapiens
tcccactggacgtctgtgctgg

SEQ ID NO: 7585463 - DNA, 22 bp, Homo sapiens
tcccacagtggtacagccctga

SEQ ID NO: 7585464 - DNA, 22 bp, Homo sapiens
tcccacagtggtacagccctga

SEQ ID NO: 7585465 - DNA, 22 bp, Homo sapiens
tcccacagtggtacagccctga

SEQ ID NO: 7585466 - DNA, 22 bp, Homo sapiens
tcccacagtggtacagccctga

SEQ ID NO: 7585467 - DNA, 22 bp, Homo sapiens
tccagttctaggtcactctctg

SEQ ID NO: 7585468 - DNA, 20 bp, Homo sapiens
tccagttacatagaggaaag

SEQ ID NO: 7585469 - DNA, 22 bp, Homo sapiens
tcccactgagcccctgctggtg

SEQ ID NO: 7585470 - DNA, 22 bp, Homo sapiens
tcccactgagcccctgctggtg

SEQ ID NO: 7585471 - DNA, 22 bp, Homo sapiens
tcccactgagcccctgctggtg

SEQ ID NO: 7585472 - DNA, 22 bp, Homo sapiens
tcccacagtggtacagccctga

SEQ ID NO: 7585473 - DNA, 22 bp, Homo sapiens
tcccactgagcccctgctggtg

SEQ ID NO: 7585474 - DNA, 22 bp, Homo sapiens
tcccactgagcccctgctggtg

SEQ ID NO: 7585475 - DNA, 22 bp, Homo sapiens
tcccactgagcccctgctggtg

SEQ ID NO: 7585476 - DNA, 22 bp, Homo sapiens
tcccactgagcccctgctggtg

SEQ ID NO: 7585477 - DNA, 22 bp, Homo sapiens
tcccacagtggtacagccctga

SEQ ID NO: 7585478 - DNA, 22 bp, Homo sapiens
tcccacatgtgaatcctcaggt

SEQ ID NO: 7585479 - DNA, 22 bp, Homo sapiens
tcccacatatgcaatcctgaat

SEQ ID NO: 7585480 - DNA, 20 bp, Homo sapiens
tccagtgtctctctggtgga

SEQ ID NO: 7585481 - DNA, 19 bp, Homo sapiens
tccagtgtagctggtcatt

SEQ ID NO: 7585482 - DNA, 19 bp, Homo sapiens
tccagtgtagctggtcatt

SEQ ID NO: 7585483 - DNA, 19 bp, Homo sapiens
tccagtgtagctggtcatt

SEQ ID NO: 7585484 - DNA, 22 bp, Homo sapiens
tccagtgtacaaaagctatctt

SEQ ID NO: 7585485 - DNA, 22 bp, Homo sapiens
tccagtgtacaaaagctatctt

SEQ ID NO: 7585486 - DNA, 22 bp, Homo sapiens
tccagtgtacaaaagctatctt

SEQ ID NO: 7585487 - DNA, 22 bp, Homo sapiens
tccagtggtttgaaaggggtgt

SEQ ID NO: 7585488 - DNA, 19 bp, Homo sapiens
tccagtgtagctggtcatt

SEQ ID NO: 7585489 - DNA, 19 bp, Homo sapiens
tccagtgtagctggtcatt

SEQ ID NO: 7585490 - DNA, 22 bp, Homo sapiens
tccagtgtggaggtgaccaact

SEQ ID NO: 7585491 - DNA, 22 bp, Homo sapiens
tccagtgtggacccctgcagtc

SEQ ID NO: 7585492 - DNA, 22 bp, Homo sapiens
tccagtgtggaggtgaccaact

SEQ ID NO: 7585493 - DNA, 22 bp, Homo sapiens
tccagtgtggacccctgcagtc

SEQ ID NO: 7585494 - DNA, 22 bp, Homo sapiens
tccagtgtggacccctgcagtc

SEQ ID NO: 7585495 - DNA, 22 bp, Homo sapiens
tccagtgtctgagcccttagct

SEQ ID NO: 7585496 - DNA, 20 bp, Homo sapiens
tccagtgtctctctggtgga

SEQ ID NO: 7585497 - DNA, 20 bp, Homo sapiens
tccagtgtctctctggtgga

SEQ ID NO: 7585498 - DNA, 22 bp, Homo sapiens
tccagtgtctgagcccttagct

SEQ ID NO: 7585499 - DNA, 22 bp, Homo sapiens
tccagtgtgagaagcagcatga

SEQ ID NO: 7585500 - DNA, 22 bp, Homo sapiens
tccagtgtgagaagcagcatga

SEQ ID NO: 7585501 - DNA, 16 bp, Homo sapiens
tccagtgttcctggat

SEQ ID NO: 7585502 - DNA, 16 bp, Homo sapiens
tccagtgttcctggat

SEQ ID NO: 7585503 - DNA, 22 bp, Homo sapiens
tccagtgttgtcagatcatctg

SEQ ID NO: 7585504 - DNA, 22 bp, Homo sapiens
tccagtgttgtcagatcatctg

SEQ ID NO: 7585505 - DNA, 22 bp, Homo sapiens
tccagtgtgtgtccagctgctg

SEQ ID NO: 7585506 - DNA, 22 bp, Homo sapiens
tccagtgttataatatgcgtct

SEQ ID NO: 7585507 - DNA, 22 bp, Homo sapiens
tccagtgttataatatgcgtct

SEQ ID NO: 7585508 - DNA, 22 bp, Homo sapiens
tccagtgttgtcagatcatctg

SEQ ID NO: 7585509 - DNA, 22 bp, Homo sapiens
tccagtgtttttcttcacaggt

SEQ ID NO: 7585510 - DNA, 22 bp, Homo sapiens
tccagtgtttttcttcacaggt

SEQ ID NO: 7585511 - DNA, 20 bp, Homo sapiens
tccagtgtggggactggggc

SEQ ID NO: 7585512 - DNA, 22 bp, Homo sapiens
tccagtgtggaggtgaccaact

SEQ ID NO: 7585513 - DNA, 22 bp, Homo sapiens
tccagtgtggtcaaaggggaat

SEQ ID NO: 7585514 - DNA, 22 bp, Homo sapiens
tccagtgtggtcaaaggggaat

SEQ ID NO: 7585515 - DNA, 20 bp, Homo sapiens
tccagtgtggggactggggc

SEQ ID NO: 7585516 - DNA, 23 bp, Homo sapiens
tccagtgtgtgcagattaagtgc

SEQ ID NO: 7585517 - DNA, 23 bp, Homo sapiens
tccagtgtgtgcagattaagtgc

SEQ ID NO: 7585518 - DNA, 23 bp, Homo sapiens
tccagtgtgtgcagattaagtgc

SEQ ID NO: 7585519 - DNA, 23 bp, Homo sapiens
tccagtgtgtgcagattaagtgc

SEQ ID NO: 7585520 - DNA, 22 bp, Homo sapiens
tccagtgtgtgtccagctgctg

SEQ ID NO: 7585521 - DNA, 22 bp, Homo sapiens
tccagtgtgtgtccagctgctg

SEQ ID NO: 7585522 - DNA, 22 bp, Homo sapiens
tcccagcctttcttttctgctg

SEQ ID NO: 7585523 - DNA, 22 bp, Homo sapiens
tcccagcctttcttttctgctg

SEQ ID NO: 7585524 - DNA, 22 bp, Homo sapiens
tcccagcctttcttttctgctg

SEQ ID NO: 7585525 - DNA, 22 bp, Homo sapiens
tcccagcataacaaactgcccg

SEQ ID NO: 7585526 - DNA, 22 bp, Homo sapiens
tcccagcataacaaactgcccg

SEQ ID NO: 7585527 - DNA, 22 bp, Homo sapiens
tcccagcagtcagagctatgtg

SEQ ID NO: 7585528 - DNA, 22 bp, Homo sapiens
tcccagcctttcttttctgctg

SEQ ID NO: 7585529 - DNA, 22 bp, Homo sapiens
tcccagcctttcttttctgctg

SEQ ID NO: 7585530 - DNA, 22 bp, Homo sapiens
tcccagcctttcttttctgctg

SEQ ID NO: 7585531 - DNA, 22 bp, Homo sapiens
tcccagcctttcttttctgctg

SEQ ID NO: 7585532 - DNA, 22 bp, Homo sapiens
tcccagcgcggggggaggatcc

SEQ ID NO: 7585533 - DNA, 22 bp, Homo sapiens
tcccagcagtcagagctatgtg

SEQ ID NO: 7585534 - DNA, 22 bp, Homo sapiens
tcccagcagtcagagctatgtg

SEQ ID NO: 7585535 - DNA, 22 bp, Homo sapiens
tcccagcagtcagagctatgtg

SEQ ID NO: 7585536 - DNA, 22 bp, Homo sapiens
tcccagcagggccgaccagcct

SEQ ID NO: 7585537 - DNA, 22 bp, Homo sapiens
tcccagcagtcagagctatgtg

SEQ ID NO: 7585538 - DNA, 22 bp, Homo sapiens
tcccagcagtcagagctatgtg

SEQ ID NO: 7585539 - DNA, 22 bp, Homo sapiens
tcccagcagtcagagctatgtg

SEQ ID NO: 7585540 - DNA, 22 bp, Homo sapiens
tcccagcagggccgaccagcct

SEQ ID NO: 7585541 - DNA, 22 bp, Homo sapiens
tcccagcaggagtccagttccc

SEQ ID NO: 7585542 - DNA, 22 bp, Homo sapiens
tcccagcaggagtccagttccc

SEQ ID NO: 7585543 - DNA, 22 bp, Homo sapiens
tcccagcaggagtccagttccc

SEQ ID NO: 7585544 - DNA, 22 bp, Homo sapiens
tcccagcaggagtccagttccc

SEQ ID NO: 7585545 - DNA, 22 bp, Homo sapiens
tcccagcagcatagctcagaat

SEQ ID NO: 7585546 - DNA, 22 bp, Homo sapiens
tcccagcagatgagctgaccta

SEQ ID NO: 7585547 - DNA, 22 bp, Homo sapiens
tcccagcagatgagctgaccta

SEQ ID NO: 7585548 - DNA, 22 bp, Homo sapiens
tcccagcagatgagctgaccta

SEQ ID NO: 7585549 - DNA, 22 bp, Homo sapiens
tcccagcagatgagctgaccta

SEQ ID NO: 7585550 - DNA, 22 bp, Homo sapiens
tcccagcagatgagctgaccta

SEQ ID NO: 7585551 - DNA, 22 bp, Homo sapiens
tcccagcagcatagctcagaat

SEQ ID NO: 7585552 - DNA, 22 bp, Homo sapiens
tcccagcagatgagctgaccta

SEQ ID NO: 7585553 - DNA, 22 bp, Homo sapiens
tcccagcagcatagctcagaat

SEQ ID NO: 7585554 - DNA, 22 bp, Homo sapiens
tcccagagtttcctgtgtccca

SEQ ID NO: 7585555 - DNA, 22 bp, Homo sapiens
tcccagagtttcctgtgtccca

SEQ ID NO: 7585556 - DNA, 22 bp, Homo sapiens
tcccagattcctgctcttatat

SEQ ID NO: 7585557 - DNA, 22 bp, Homo sapiens
tcccagagtttcctgtgtccca

SEQ ID NO: 7585558 - DNA, 22 bp, Homo sapiens
tcccagattcctgctcttatat

SEQ ID NO: 7585559 - DNA, 22 bp, Homo sapiens
tcccagagtttcctgtgtccca

SEQ ID NO: 7585560 - DNA, 22 bp, Homo sapiens
tcccagagtttcctgtgtccca

SEQ ID NO: 7585561 - DNA, 22 bp, Homo sapiens
tcccagagttcaatgggaaggt

SEQ ID NO: 7585562 - DNA, 22 bp, Homo sapiens
tcccagagttcaatgggaaggt

SEQ ID NO: 7585563 - DNA, 22 bp, Homo sapiens
tcccagagttcaatgggaaggt

SEQ ID NO: 7585564 - DNA, 22 bp, Homo sapiens
tcccagattcctgctcttatat

SEQ ID NO: 7585565 - DNA, 22 bp, Homo sapiens
tcccagattcctgctcttatat

SEQ ID NO: 7585566 - DNA, 22 bp, Homo sapiens
tcccagattcctgctcttatat

SEQ ID NO: 7585567 - DNA, 22 bp, Homo sapiens
tcccagattcctgctcttatat

SEQ ID NO: 7585568 - DNA, 22 bp, Homo sapiens
tcccagattcctgctcttatat

SEQ ID NO: 7585569 - DNA, 22 bp, Homo sapiens
tcccagattcctgctcttatat

SEQ ID NO: 7585570 - DNA, 22 bp, Homo sapiens
tcccagattgttgatggcttaa

SEQ ID NO: 7585571 - DNA, 22 bp, Homo sapiens
tcccagattcctgctcttatat

SEQ ID NO: 7585572 - DNA, 22 bp, Homo sapiens
tcccagattcctgctcttatat

SEQ ID NO: 7585573 - DNA, 22 bp, Homo sapiens
tcccagcagatgagctgaccta

SEQ ID NO: 7585574 - DNA, 22 bp, Homo sapiens
tcccagcagagccagcaagccg

SEQ ID NO: 7585575 - DNA, 22 bp, Homo sapiens
tcccagcagagccagcaagccg

SEQ ID NO: 7585576 - DNA, 22 bp, Homo sapiens
tcccagcagagccagcaagccg

SEQ ID NO: 7585577 - DNA, 22 bp, Homo sapiens
tcccagcagagccagcaagccg

SEQ ID NO: 7585578 - DNA, 22 bp, Homo sapiens
tcccagcagagccagcaagccg

SEQ ID NO: 7585579 - DNA, 22 bp, Homo sapiens
tcccagcactgtaattctttgg

SEQ ID NO: 7585580 - DNA, 22 bp, Homo sapiens
tcccagcaagaaagggggtggc

SEQ ID NO: 7585581 - DNA, 22 bp, Homo sapiens
tcccagcaagaaagggggtggc

SEQ ID NO: 7585582 - DNA, 22 bp, Homo sapiens
tcccagcacagggcagatgtga

SEQ ID NO: 7585583 - DNA, 22 bp, Homo sapiens
tcccagcacagggcagatgtga

SEQ ID NO: 7585584 - DNA, 22 bp, Homo sapiens
tcccagcacgtctgctgtttct

SEQ ID NO: 7585585 - DNA, 22 bp, Homo sapiens
tcccagcacagggcagatgtga

SEQ ID NO: 7585586 - DNA, 22 bp, Homo sapiens
tcccagcactgtaattctttgg

SEQ ID NO: 7585587 - DNA, 22 bp, Homo sapiens
tcccagcacgtctgctgtttct

SEQ ID NO: 7585588 - DNA, 22 bp, Homo sapiens
tcccagcacgtctgctgtttct

SEQ ID NO: 7585589 - DNA, 22 bp, Homo sapiens
tcccagcacgtctgctgtttct

SEQ ID NO: 7585590 - DNA, 22 bp, Homo sapiens
tcccagctgtgtggaggagatg

SEQ ID NO: 7585591 - DNA, 22 bp, Homo sapiens
tcccagcttagatttgctcatt

SEQ ID NO: 7585592 - DNA, 22 bp, Homo sapiens
tcccagctgtgtggaggagatg

SEQ ID NO: 7585593 - DNA, 22 bp, Homo sapiens
tcccagctgtgtggaggagatg

SEQ ID NO: 7585594 - DNA, 21 bp, Homo sapiens
tcccagctgggtcagtgctgc

SEQ ID NO: 7585595 - DNA, 21 bp, Homo sapiens
tcccagctgggtcagtgctgc

SEQ ID NO: 7585596 - DNA, 22 bp, Homo sapiens
tcccagctgtgtggaggagatg

SEQ ID NO: 7585597 - DNA, 22 bp, Homo sapiens
tcccagctgtgtggaggagatg

SEQ ID NO: 7585598 - DNA, 22 bp, Homo sapiens
tcccagctgtgtggaggagatg

SEQ ID NO: 7585599 - DNA, 22 bp, Homo sapiens
tcccagcttagatttgctcatt

SEQ ID NO: 7585600 - DNA, 22 bp, Homo sapiens
tcccagcttagatttgctcatt

SEQ ID NO: 7585601 - DNA, 22 bp, Homo sapiens
tcccagcttagatttgctcatt

SEQ ID NO: 7585602 - DNA, 22 bp, Homo sapiens
tcccagcttagatttgctcatt

SEQ ID NO: 7585603 - DNA, 22 bp, Homo sapiens
tcccagctgtgtggaggagatg

SEQ ID NO: 7585604 - DNA, 22 bp, Homo sapiens
tcccagcttagatttgctcatt

SEQ ID NO: 7585605 - DNA, 22 bp, Homo sapiens
tcccaggaaaacactcgaggac

SEQ ID NO: 7585606 - DNA, 22 bp, Homo sapiens
tcccaggaaaacactcgaggac

SEQ ID NO: 7585607 - DNA, 22 bp, Homo sapiens
tcccaggaaaacactcgaggac

SEQ ID NO: 7585608 - DNA, 22 bp, Homo sapiens
tcccaggaaaacactcgaggac

SEQ ID NO: 7585609 - DNA, 22 bp, Homo sapiens
tcccaggaaaacactcgaggac

SEQ ID NO: 7585610 - DNA, 22 bp, Homo sapiens
tcccaggaaaacactcgaggac

SEQ ID NO: 7585611 - DNA, 22 bp, Homo sapiens
tcccagctgagattgagcaagg

SEQ ID NO: 7585612 - DNA, 22 bp, Homo sapiens
tcccagctgagattgagcaagg

SEQ ID NO: 7585613 - DNA, 22 bp, Homo sapiens
tcccagctgctgagatagtgct

SEQ ID NO: 7585614 - DNA, 22 bp, Homo sapiens
tcccagctgctgagatagtgct

SEQ ID NO: 7585615 - DNA, 22 bp, Homo sapiens
tcccagctgagattgagcaagg

SEQ ID NO: 7585616 - DNA, 22 bp, Homo sapiens
tcccagctgagattgagcaagg

SEQ ID NO: 7585617 - DNA, 21 bp, Homo sapiens
tcccagctgggtcagtgctgc

SEQ ID NO: 7585618 - DNA, 21 bp, Homo sapiens
tcccagctgggtcagtgctgc

SEQ ID NO: 7585619 - DNA, 21 bp, Homo sapiens
tcccagctgggtcagtgctgc

SEQ ID NO: 7585620 - DNA, 21 bp, Homo sapiens
tcccagctgggtcagtgctgc

SEQ ID NO: 7585621 - DNA, 21 bp, Homo sapiens
tcccagctgggtcagtgctgc

SEQ ID NO: 7585622 - DNA, 21 bp, Homo sapiens
tcccagctgggtcagtgctgc

SEQ ID NO: 7585623 - DNA, 22 bp, Homo sapiens
tcccagctcacatatggtaact

SEQ ID NO: 7585624 - DNA, 22 bp, Homo sapiens
tcccagctgagattgagcaagg

SEQ ID NO: 7585625 - DNA, 22 bp, Homo sapiens
tcccagctgagattgagcaagg

SEQ ID NO: 7585626 - DNA, 22 bp, Homo sapiens
tcccagctcacatatggtaact

SEQ ID NO: 7585627 - DNA, 22 bp, Homo sapiens
tcccagctcacatatggtaact

SEQ ID NO: 7585628 - DNA, 22 bp, Homo sapiens
tcccagctcacatatggtaact

SEQ ID NO: 7585629 - DNA, 22 bp, Homo sapiens
tcccagctactctagaggctga

SEQ ID NO: 7585630 - DNA, 22 bp, Homo sapiens
tcccagctactctagaggctga

SEQ ID NO: 7585631 - DNA, 22 bp, Homo sapiens
tcccagctactctagaggctga

SEQ ID NO: 7585632 - DNA, 22 bp, Homo sapiens
tcccagcgcggggggaggatcc

SEQ ID NO: 7585633 - DNA, 22 bp, Homo sapiens
tcccagctactctagaggctga

SEQ ID NO: 7585634 - DNA, 22 bp, Homo sapiens
tcccagctactctagaggctga

SEQ ID NO: 7585635 - DNA, 22 bp, Homo sapiens
tcccagctactctagaggctga

SEQ ID NO: 7585636 - DNA, 17 bp, Homo sapiens
tcccaggaacagggaat

SEQ ID NO: 7585637 - DNA, 17 bp, Homo sapiens
tcccaggaacagggaat

SEQ ID NO: 7585638 - DNA, 17 bp, Homo sapiens
tcccaggaacagggaat

SEQ ID NO: 7585639 - DNA, 17 bp, Homo sapiens
tcccaggaacagggaat

SEQ ID NO: 7585640 - DNA, 17 bp, Homo sapiens
tcccaggaacagggaat

SEQ ID NO: 7585641 - DNA, 17 bp, Homo sapiens
tcccaggaacagggaat

SEQ ID NO: 7585642 - DNA, 19 bp, Homo sapiens
tcccaggaaccttttattt

SEQ ID NO: 7585643 - DNA, 17 bp, Homo sapiens
tcccaggaacagggaat

SEQ ID NO: 7585644 - DNA, 17 bp, Homo sapiens
tcccaggaacagggaat

SEQ ID NO: 7585645 - DNA, 22 bp, Homo sapiens
tcccaggaagatcccagggacc

SEQ ID NO: 7585646 - DNA, 22 bp, Homo sapiens
tcccaggaagatcccagggacc

SEQ ID NO: 7585647 - DNA, 22 bp, Homo sapiens
tcccaggaagatcccagggacc

SEQ ID NO: 7585648 - DNA, 22 bp, Homo sapiens
tcccaggaagatcccagggacc

SEQ ID NO: 7585649 - DNA, 19 bp, Homo sapiens
tcccaggaagcaaatgtca

SEQ ID NO: 7585650 - DNA, 22 bp, Homo sapiens
tcccaggaagatcccagggacc

SEQ ID NO: 7585651 - DNA, 22 bp, Homo sapiens
tcccaggaagatcccagggacc

SEQ ID NO: 7585652 - DNA, 22 bp, Homo sapiens
tcccaggaagatcccagggacc

SEQ ID NO: 7585653 - DNA, 19 bp, Homo sapiens
tcccaggaaccttttattt

SEQ ID NO: 7585654 - DNA, 19 bp, Homo sapiens
tcccaggaaccttttattt

SEQ ID NO: 7585655 - DNA, 19 bp, Homo sapiens
tcccaggaagcaaatgtca

SEQ ID NO: 7585656 - DNA, 22 bp, Homo sapiens
tcccaggaaggattcggcattt

SEQ ID NO: 7585657 - DNA, 22 bp, Homo sapiens
tcccaggaatccgtcctctaga

SEQ ID NO: 7585658 - DNA, 22 bp, Homo sapiens
tcccaggaaggattcggcattt

SEQ ID NO: 7585659 - DNA, 19 bp, Homo sapiens
tcccaggaagcaaatgtca

SEQ ID NO: 7585660 - DNA, 22 bp, Homo sapiens
tcccaggaaggattcggcattt

SEQ ID NO: 7585661 - DNA, 22 bp, Homo sapiens
tcccaggatgaagacagtgttg

SEQ ID NO: 7585662 - DNA, 22 bp, Homo sapiens
tcccaggaatccgtcctctaga

SEQ ID NO: 7585663 - DNA, 22 bp, Homo sapiens
tcccaggatctgagggcagaga

SEQ ID NO: 7585664 - DNA, 22 bp, Homo sapiens
tcccaggatctgagggcagaga

SEQ ID NO: 7585665 - DNA, 22 bp, Homo sapiens
tcccaggaatccgtcctctaga

SEQ ID NO: 7585666 - DNA, 22 bp, Homo sapiens
tcccaggatgtgcgtgccgccg

SEQ ID NO: 7585667 - DNA, 22 bp, Homo sapiens
tcccaggatgtgcgtgccgccg

SEQ ID NO: 7585668 - DNA, 22 bp, Homo sapiens
tcccaggatgtgcgtgccgccg

SEQ ID NO: 7585669 - DNA, 22 bp, Homo sapiens
tcccaggatgaagacagtgttg

SEQ ID NO: 7585670 - DNA, 22 bp, Homo sapiens
tcccaggatgaagacagtgttg

SEQ ID NO: 7585671 - DNA, 22 bp, Homo sapiens
tcccaggatgaagacagtgttg

SEQ ID NO: 7585672 - DNA, 22 bp, Homo sapiens
tcccaggatgttggcggcaggt

SEQ ID NO: 7585673 - DNA, 22 bp, Homo sapiens
tcccaggatgtgcgtgccgccg

SEQ ID NO: 7585674 - DNA, 22 bp, Homo sapiens
tcccaggatgttggcggcaggt

SEQ ID NO: 7585675 - DNA, 22 bp, Homo sapiens
tcccaggatgttggcggcaggt

SEQ ID NO: 7585676 - DNA, 22 bp, Homo sapiens
tccaggagcatccaggtgaagc

SEQ ID NO: 7585677 - DNA, 23 bp, Homo sapiens
tccaggagcatgctggctggcga

SEQ ID NO: 7585678 - DNA, 22 bp, Homo sapiens
tccaggagcatccaggtgaagc

SEQ ID NO: 7585679 - DNA, 22 bp, Homo sapiens
tccaggagcatccaggtgaagc

SEQ ID NO: 7585680 - DNA, 20 bp, Homo sapiens
tccaggagaactgggagccg

SEQ ID NO: 7585681 - DNA, 23 bp, Homo sapiens
tccaggagaacccctgtctgtcc

SEQ ID NO: 7585682 - DNA, 23 bp, Homo sapiens
tccaggagaacccctgtctgtcc

SEQ ID NO: 7585683 - DNA, 23 bp, Homo sapiens
tccaggagaacccctgtctgtcc

SEQ ID NO: 7585684 - DNA, 22 bp, Homo sapiens
tccaggagaaaactgacggtgg

SEQ ID NO: 7585685 - DNA, 22 bp, Homo sapiens
tccaggagaaaactgacggtgg

SEQ ID NO: 7585686 - DNA, 20 bp, Homo sapiens
tccaggagaactgggagccg

SEQ ID NO: 7585687 - DNA, 23 bp, Homo sapiens
tccaggagaacccctgtctgtcc

SEQ ID NO: 7585688 - DNA, 20 bp, Homo sapiens
tccaggagaactgggagccg

SEQ ID NO: 7585689 - DNA, 20 bp, Homo sapiens
tccaggagaactgggagccg

SEQ ID NO: 7585690 - DNA, 20 bp, Homo sapiens
tccaggagaactgggagccg

SEQ ID NO: 7585691 - DNA, 22 bp, Homo sapiens
tccaggaggaggaaggctgcca

SEQ ID NO: 7585692 - DNA, 22 bp, Homo sapiens
tccaggaggaggaaggctgcca

SEQ ID NO: 7585693 - DNA, 22 bp, Homo sapiens
tccaggaggaggaaggctgcca

SEQ ID NO: 7585694 - DNA, 22 bp, Homo sapiens
tccaggaggaggaaggctgcca

SEQ ID NO: 7585695 - DNA, 22 bp, Homo sapiens
tccaggaggactgagggggctg

SEQ ID NO: 7585696 - DNA, 22 bp, Homo sapiens
tccaggaggactgagggggctg

SEQ ID NO: 7585697 - DNA, 22 bp, Homo sapiens
tccaggaggactgagggggctg

SEQ ID NO: 7585698 - DNA, 22 bp, Homo sapiens
tccaggaggactgagggggctg

SEQ ID NO: 7585699 - DNA, 22 bp, Homo sapiens
tccaggaggactgagggggctg

SEQ ID NO: 7585700 - DNA, 22 bp, Homo sapiens
tccaggagctcatccacgtcaa

SEQ ID NO: 7585701 - DNA, 23 bp, Homo sapiens
tccaggagcatgctggctggcga

SEQ ID NO: 7585702 - DNA, 23 bp, Homo sapiens
tccaggagcatgctggctggcga

SEQ ID NO: 7585703 - DNA, 22 bp, Homo sapiens
tccaggagctcatccacgtcaa

SEQ ID NO: 7585704 - DNA, 22 bp, Homo sapiens
tccaggagctcatccacgtcaa

SEQ ID NO: 7585705 - DNA, 23 bp, Homo sapiens
tccaggagcatgctggctggcga

SEQ ID NO: 7585706 - DNA, 23 bp, Homo sapiens
tccaggagcatgctggctggcga

SEQ ID NO: 7585707 - DNA, 23 bp, Homo sapiens
tccaggagcatgctggctggcga

SEQ ID NO: 7585708 - DNA, 22 bp, Homo sapiens
tccaggacctgactgggcctgc

SEQ ID NO: 7585709 - DNA, 22 bp, Homo sapiens
tccaggactataggaaagacac

SEQ ID NO: 7585710 - DNA, 22 bp, Homo sapiens
tccaggactataggaaagacac

SEQ ID NO: 7585711 - DNA, 22 bp, Homo sapiens
tccaggactagcatttctgata

SEQ ID NO: 7585712 - DNA, 22 bp, Homo sapiens
tccaggactagcatttctgata

SEQ ID NO: 7585713 - DNA, 22 bp, Homo sapiens
tccaggacctcccaggctagag

SEQ ID NO: 7585714 - DNA, 22 bp, Homo sapiens
tccaggacctcccaggctagag

SEQ ID NO: 7585715 - DNA, 22 bp, Homo sapiens
tccaggacctcccaggctagag

SEQ ID NO: 7585716 - DNA, 22 bp, Homo sapiens
tccaggacctgactgggcctgc

SEQ ID NO: 7585717 - DNA, 22 bp, Homo sapiens
tccaggagaaaactgacggtgg

SEQ ID NO: 7585718 - DNA, 22 bp, Homo sapiens
tccaggactttcttaaggcact

SEQ ID NO: 7585719 - DNA, 22 bp, Homo sapiens
tccaggactttcttaaggcact

SEQ ID NO: 7585720 - DNA, 21 bp, Homo sapiens
tccaggacttgagaattccag

SEQ ID NO: 7585721 - DNA, 22 bp, Homo sapiens
tccaggacttggcaggagatga

SEQ ID NO: 7585722 - DNA, 22 bp, Homo sapiens
tccaggacttggcaggagatga

SEQ ID NO: 7585723 - DNA, 21 bp, Homo sapiens
tccaggacttgagaattccag

SEQ ID NO: 7585724 - DNA, 22 bp, Homo sapiens
tccaggacttagtgacctaaaa

SEQ ID NO: 7585725 - DNA, 22 bp, Homo sapiens
tccaggactggttcacacggtg

SEQ ID NO: 7585726 - DNA, 18 bp, Homo sapiens
tccaggactctgcgtggc

SEQ ID NO: 7585727 - DNA, 18 bp, Homo sapiens
tccaggactctgcgtggc

SEQ ID NO: 7585728 - DNA, 22 bp, Homo sapiens
tccaggaccaaagacacatgta

SEQ ID NO: 7585729 - DNA, 22 bp, Homo sapiens
tccaggaccaaagacacatgta

SEQ ID NO: 7585730 - DNA, 23 bp, Homo sapiens
tccaggaccctggtagacacaca

SEQ ID NO: 7585731 - DNA, 22 bp, Homo sapiens
tccaggaccaaagacacatgta

SEQ ID NO: 7585732 - DNA, 22 bp, Homo sapiens
tccaggacagcggcaggcagat

SEQ ID NO: 7585733 - DNA, 22 bp, Homo sapiens
tccaggacagcggcaggcagat

SEQ ID NO: 7585734 - DNA, 22 bp, Homo sapiens
tccaggacagcggcaggcagat

SEQ ID NO: 7585735 - DNA, 22 bp, Homo sapiens
tccaggacagagtagaagcagc

SEQ ID NO: 7585736 - DNA, 21 bp, Homo sapiens
tccaggaatgtctgttcatct

SEQ ID NO: 7585737 - DNA, 22 bp, Homo sapiens
tccaggaatgtgtgtgggctag

SEQ ID NO: 7585738 - DNA, 22 bp, Homo sapiens
tccaggaatttcccctttcctg

SEQ ID NO: 7585739 - DNA, 22 bp, Homo sapiens
tccaggaatttcccctttcctg

SEQ ID NO: 7585740 - DNA, 22 bp, Homo sapiens
tccaggacagagtagaagcagc

SEQ ID NO: 7585741 - DNA, 22 bp, Homo sapiens
tccaggacagagtagaagcagc

SEQ ID NO: 7585742 - DNA, 22 bp, Homo sapiens
tccaggaatgtgtgtgggctag

SEQ ID NO: 7585743 - DNA, 21 bp, Homo sapiens
tccaggaatgtctgttcatct

SEQ ID NO: 7585744 - DNA, 21 bp, Homo sapiens
tccaggaatgtctgttcatct

SEQ ID NO: 7585745 - DNA, 20 bp, Homo sapiens
tccaggaatggtagaggact

SEQ ID NO: 7585746 - DNA, 20 bp, Homo sapiens
tccaggaatggtagaggact

SEQ ID NO: 7585747 - DNA, 20 bp, Homo sapiens
tccaggaatggtagaggact

SEQ ID NO: 7585748 - DNA, 19 bp, Homo sapiens
tccagcctgctgtttctct

SEQ ID NO: 7585749 - DNA, 19 bp, Homo sapiens
tccagcctgctgtttctct

SEQ ID NO: 7585750 - DNA, 19 bp, Homo sapiens
tccagcctgctgtttctct

SEQ ID NO: 7585751 - DNA, 22 bp, Homo sapiens
tccagcctgaactttgtccaga

SEQ ID NO: 7585752 - DNA, 22 bp, Homo sapiens
tccagcctggttgcgggcatcc

SEQ ID NO: 7585753 - DNA, 22 bp, Homo sapiens
tccagcctggttgcgggcatcc

SEQ ID NO: 7585754 - DNA, 22 bp, Homo sapiens
tccagcctggttgcgggcatcc

SEQ ID NO: 7585755 - DNA, 22 bp, Homo sapiens
tccagccttccttttcactctc

SEQ ID NO: 7585756 - DNA, 22 bp, Homo sapiens
tccagccttctcaaggctggct

SEQ ID NO: 7585757 - DNA, 22 bp, Homo sapiens
tccagccttccttttcactctc

SEQ ID NO: 7585758 - DNA, 22 bp, Homo sapiens
tccagccttctcaaggctggct

SEQ ID NO: 7585759 - DNA, 22 bp, Homo sapiens
tccagccttctcaaggctggct

SEQ ID NO: 7585760 - DNA, 22 bp, Homo sapiens
tccagccttctcaaggctggct

SEQ ID NO: 7585761 - DNA, 22 bp, Homo sapiens
tccagcctgaactttgtccaga

SEQ ID NO: 7585762 - DNA, 23 bp, Homo sapiens
tccagcctcttgctctcacatgc

SEQ ID NO: 7585763 - DNA, 23 bp, Homo sapiens
tccagcctcttgctctcacatgc

SEQ ID NO: 7585764 - DNA, 23 bp, Homo sapiens
tccagcctcttgctctcacatgc

SEQ ID NO: 7585765 - DNA, 22 bp, Homo sapiens
tccagccctgtggcttccaccc

SEQ ID NO: 7585766 - DNA, 22 bp, Homo sapiens
tccagccctgtggcttccaccc

SEQ ID NO: 7585767 - DNA, 22 bp, Homo sapiens
tccagccctgtggcttccaccc

SEQ ID NO: 7585768 - DNA, 20 bp, Homo sapiens
tccagccctgcttctctctt

SEQ ID NO: 7585769 - DNA, 23 bp, Homo sapiens
tccagcctcttgctctcacatgc

SEQ ID NO: 7585770 - DNA, 23 bp, Homo sapiens
tccagcctcttgctctcacatgc

SEQ ID NO: 7585771 - DNA, 20 bp, Homo sapiens
tccagccctgcttctctctt

SEQ ID NO: 7585772 - DNA, 22 bp, Homo sapiens
tccagccctgcttcctgcctca

SEQ ID NO: 7585773 - DNA, 20 bp, Homo sapiens
tccagccctgcttctctctt

SEQ ID NO: 7585774 - DNA, 20 bp, Homo sapiens
tccagccctgcttctctctt

SEQ ID NO: 7585775 - DNA, 20 bp, Homo sapiens
tccagccctgcttctctctt

SEQ ID NO: 7585776 - DNA, 22 bp, Homo sapiens
tccagccctgcttcctgcctca

SEQ ID NO: 7585777 - DNA, 22 bp, Homo sapiens
tccagccctgtggcttccaccc

SEQ ID NO: 7585778 - DNA, 20 bp, Homo sapiens
tccagccctgcttctctctt

SEQ ID NO: 7585779 - DNA, 20 bp, Homo sapiens
tccagccctgcttctctctt

SEQ ID NO: 7585780 - DNA, 21 bp, Homo sapiens
tccagcctttccctcacttcc

SEQ ID NO: 7585781 - DNA, 21 bp, Homo sapiens
tccagcctttccctcacttcc

SEQ ID NO: 7585782 - DNA, 22 bp, Homo sapiens
tccagccttgccacttttctgt

SEQ ID NO: 7585783 - DNA, 22 bp, Homo sapiens
tccagccttgccacttttctgt

SEQ ID NO: 7585784 - DNA, 22 bp, Homo sapiens
tccagccttgccacttttctgt

SEQ ID NO: 7585785 - DNA, 22 bp, Homo sapiens
tccagccttctcaaggctggct

SEQ ID NO: 7585786 - DNA, 21 bp, Homo sapiens
tccagcctttccctcacttcc

SEQ ID NO: 7585787 - DNA, 21 bp, Homo sapiens
tccagcctttccctcacttcc

SEQ ID NO: 7585788 - DNA, 21 bp, Homo sapiens
tccagcctttccctcacttcc

SEQ ID NO: 7585789 - DNA, 21 bp, Homo sapiens
tccagcctttccctcacttcc

SEQ ID NO: 7585790 - DNA, 22 bp, Homo sapiens
tccaggaaatcagaagtggtaa

SEQ ID NO: 7585791 - DNA, 22 bp, Homo sapiens
tccaggaaatcataaattgctt

SEQ ID NO: 7585792 - DNA, 22 bp, Homo sapiens
tccaggaaatcataaattgctt

SEQ ID NO: 7585793 - DNA, 22 bp, Homo sapiens
tccaggaaatcataaattgctt

SEQ ID NO: 7585794 - DNA, 22 bp, Homo sapiens
tccaggaacagaatgttagtgc

SEQ ID NO: 7585795 - DNA, 22 bp, Homo sapiens
tccaggaacagaatgttagtgc

SEQ ID NO: 7585796 - DNA, 22 bp, Homo sapiens
tccaggaacgagaggctgggca

SEQ ID NO: 7585797 - DNA, 22 bp, Homo sapiens
tccaggaacgagaggctgggca

SEQ ID NO: 7585798 - DNA, 22 bp, Homo sapiens
tccaggaacgagaggctgggca

SEQ ID NO: 7585799 - DNA, 22 bp, Homo sapiens
tccaggaactcttgatggtgat

SEQ ID NO: 7585800 - DNA, 22 bp, Homo sapiens
tccaggaactgaagccaggtgt

SEQ ID NO: 7585801 - DNA, 22 bp, Homo sapiens
tccaggaactcttgatggtgat

SEQ ID NO: 7585802 - DNA, 22 bp, Homo sapiens
tccaggaactgaagccaggtgt

SEQ ID NO: 7585803 - DNA, 22 bp, Homo sapiens
tccaggaactgaagccaggtgt

SEQ ID NO: 7585804 - DNA, 22 bp, Homo sapiens
tccaggaagaggtgtgttggga

SEQ ID NO: 7585805 - DNA, 22 bp, Homo sapiens
tccaggaagcagctacagatcc

SEQ ID NO: 7585806 - DNA, 22 bp, Homo sapiens
tccaggaagcagctacagatcc

SEQ ID NO: 7585807 - DNA, 22 bp, Homo sapiens
tccaggaagcagtgtttggagc

SEQ ID NO: 7585808 - DNA, 22 bp, Homo sapiens
tccaggaatctgtgcctagccc

SEQ ID NO: 7585809 - DNA, 22 bp, Homo sapiens
tccaggaatctgtgcctagccc

SEQ ID NO: 7585810 - DNA, 22 bp, Homo sapiens
tccaggaatagtcatgttttag

SEQ ID NO: 7585811 - DNA, 22 bp, Homo sapiens
tccaggaatagatcagagattt

SEQ ID NO: 7585812 - DNA, 22 bp, Homo sapiens
tccaggaatagatcagagattt

SEQ ID NO: 7585813 - DNA, 22 bp, Homo sapiens
tccaggaaggactaatggtttg

SEQ ID NO: 7585814 - DNA, 22 bp, Homo sapiens
tccaggaaggactaatggtttg

SEQ ID NO: 7585815 - DNA, 22 bp, Homo sapiens
tccaggaagccacactgggcct

SEQ ID NO: 7585816 - DNA, 22 bp, Homo sapiens
tccagaaaattttacagtgcct

SEQ ID NO: 7585817 - DNA, 22 bp, Homo sapiens
tccagaaaattttacagtgcct

SEQ ID NO: 7585818 - DNA, 22 bp, Homo sapiens
tccagaaaattttacagtgcct

SEQ ID NO: 7585819 - DNA, 22 bp, Homo sapiens
tccagaaactgctgagataaga

SEQ ID NO: 7585820 - DNA, 22 bp, Homo sapiens
tccagaaactgctgagataaga

SEQ ID NO: 7585821 - DNA, 22 bp, Homo sapiens
tccagaaactgctgagataaga

SEQ ID NO: 7585822 - DNA, 22 bp, Homo sapiens
tccagaaaattttacagtgcct

SEQ ID NO: 7585823 - DNA, 22 bp, Homo sapiens
tccagaaaattttacagtgcct

SEQ ID NO: 7585824 - DNA, 22 bp, Homo sapiens
tccagaaacttcatttgcaagc

SEQ ID NO: 7585825 - DNA, 22 bp, Homo sapiens
tccagaaactgctgagataaga

SEQ ID NO: 7585826 - DNA, 22 bp, Homo sapiens
tccagaaactgctgagataaga

SEQ ID NO: 7585827 - DNA, 22 bp, Homo sapiens
tccagaaacttttccagtctca

SEQ ID NO: 7585828 - DNA, 22 bp, Homo sapiens
tccagaaacttttccagtctca

SEQ ID NO: 7585829 - DNA, 22 bp, Homo sapiens
tccagaaacttttccagtctca

SEQ ID NO: 7585830 - DNA, 22 bp, Homo sapiens
tccagaaacttcatttgcaagc

SEQ ID NO: 7585831 - DNA, 22 bp, Homo sapiens
tccagaaacttcatttgcaagc

SEQ ID NO: 7585832 - DNA, 22 bp, Homo sapiens
tccagaaacttcatttgcaagc

SEQ ID NO: 7585833 - DNA, 22 bp, Homo sapiens
tccagccacgtattatctcact

SEQ ID NO: 7585834 - DNA, 22 bp, Homo sapiens
tccagccactcagcagggattg

SEQ ID NO: 7585835 - DNA, 22 bp, Homo sapiens
tccagccactcagcagggattg

SEQ ID NO: 7585836 - DNA, 22 bp, Homo sapiens
tccagaaatgcaagccaggtgt

SEQ ID NO: 7585837 - DNA, 22 bp, Homo sapiens
tccagaaatgcaagccaggtgt

SEQ ID NO: 7585838 - DNA, 22 bp, Homo sapiens
tccagaaatgcaagccaggtgt

SEQ ID NO: 7585839 - DNA, 22 bp, Homo sapiens
tccagaaatgcaagccaggtgt

SEQ ID NO: 7585840 - DNA, 22 bp, Homo sapiens
tccagaaagtacatgggattca

SEQ ID NO: 7585841 - DNA, 22 bp, Homo sapiens
tccagaaatgcaagccaggtgt

SEQ ID NO: 7585842 - DNA, 22 bp, Homo sapiens
tccagaaacttttccagtctca

SEQ ID NO: 7585843 - DNA, 22 bp, Homo sapiens
tccagaaagtacatgggattca

SEQ ID NO: 7585844 - DNA, 22 bp, Homo sapiens
tccagaaagtacatgggattca

SEQ ID NO: 7585845 - DNA, 20 bp, Homo sapiens
tccagccacttccgctggtc

SEQ ID NO: 7585846 - DNA, 20 bp, Homo sapiens
tccagccacttccgctggtc

SEQ ID NO: 7585847 - DNA, 20 bp, Homo sapiens
tccagccacttccgctggtc

SEQ ID NO: 7585848 - DNA, 22 bp, Homo sapiens
tccagccactcagcagggattg

SEQ ID NO: 7585849 - DNA, 22 bp, Homo sapiens
tccagccactcagcagggattg

SEQ ID NO: 7585850 - DNA, 22 bp, Homo sapiens
tccagccactcagcagggattg

SEQ ID NO: 7585851 - DNA, 22 bp, Homo sapiens
tccagccactcagcagggattg

SEQ ID NO: 7585852 - DNA, 20 bp, Homo sapiens
tccagcccaggtcctgcctg

SEQ ID NO: 7585853 - DNA, 20 bp, Homo sapiens
tccagcccaggtcctgcctg

SEQ ID NO: 7585854 - DNA, 22 bp, Homo sapiens
tccagcccaggctggagtgtag

SEQ ID NO: 7585855 - DNA, 20 bp, Homo sapiens
tccagcccaggtcctgcctg

SEQ ID NO: 7585856 - DNA, 22 bp, Homo sapiens
tccagcccaggctggagtgtag

SEQ ID NO: 7585857 - DNA, 22 bp, Homo sapiens
tccagcccaggctggagtgtag

SEQ ID NO: 7585858 - DNA, 20 bp, Homo sapiens
tccagcccaggtcctgcctg

SEQ ID NO: 7585859 - DNA, 22 bp, Homo sapiens
tccagcccaggctggagtgtag

SEQ ID NO: 7585860 - DNA, 19 bp, Homo sapiens
tccagcccctctgtgtgtg

SEQ ID NO: 7585861 - DNA, 19 bp, Homo sapiens
tccagcccctctgtgtgtg

SEQ ID NO: 7585862 - DNA, 19 bp, Homo sapiens
tccagcccctctgtgtgtg

SEQ ID NO: 7585863 - DNA, 19 bp, Homo sapiens
tccagcccctctgtgtgtg

SEQ ID NO: 7585864 - DNA, 19 bp, Homo sapiens
tccagcccctctgtgtgtg

SEQ ID NO: 7585865 - DNA, 22 bp, Homo sapiens
tccagcccctcctgagccaagc

SEQ ID NO: 7585866 - DNA, 22 bp, Homo sapiens
tccagcccctcctgagccaagc

SEQ ID NO: 7585867 - DNA, 22 bp, Homo sapiens
tccagcccctcctgagccaagc

SEQ ID NO: 7585868 - DNA, 22 bp, Homo sapiens
tccagcccctcctgagccaagc

SEQ ID NO: 7585869 - DNA, 22 bp, Homo sapiens
tccagcccctcctgagccaagc

SEQ ID NO: 7585870 - DNA, 22 bp, Homo sapiens
tccagccccgggatgttcttca

SEQ ID NO: 7585871 - DNA, 22 bp, Homo sapiens
tccagccccgggatgttcttca

SEQ ID NO: 7585872 - DNA, 22 bp, Homo sapiens
tccagccccgggatgttcttca

SEQ ID NO: 7585873 - DNA, 22 bp, Homo sapiens
tccagccccggcttccttacag

SEQ ID NO: 7585874 - DNA, 22 bp, Homo sapiens
tccagccccgggatgttcttca

SEQ ID NO: 7585875 - DNA, 22 bp, Homo sapiens
tccagccccgggatgttcttca

SEQ ID NO: 7585876 - DNA, 22 bp, Homo sapiens
tccagccccgggatgttcttca

SEQ ID NO: 7585877 - DNA, 22 bp, Homo sapiens
tccagccccggcttccttacag

SEQ ID NO: 7585878 - DNA, 22 bp, Homo sapiens
tccagccccggcttccttacag

SEQ ID NO: 7585879 - DNA, 22 bp, Homo sapiens
tccagccccggcttccttacag

SEQ ID NO: 7585880 - DNA, 22 bp, Homo sapiens
tccagccccggcttccttacag

SEQ ID NO: 7585881 - DNA, 22 bp, Homo sapiens
tccagcccatccctagcctggg

SEQ ID NO: 7585882 - DNA, 22 bp, Homo sapiens
tccagcccatccctagcctggg

SEQ ID NO: 7585883 - DNA, 22 bp, Homo sapiens
tccagcccagtttggtgaattg

SEQ ID NO: 7585884 - DNA, 22 bp, Homo sapiens
tccagcccatccctagcctggg

SEQ ID NO: 7585885 - DNA, 22 bp, Homo sapiens
tccagcccatccctagcctggg

SEQ ID NO: 7585886 - DNA, 22 bp, Homo sapiens
tccagcccagtttggtgaattg

SEQ ID NO: 7585887 - DNA, 20 bp, Homo sapiens
tccagcccaggtcctgcctg

SEQ ID NO: 7585888 - DNA, 20 bp, Homo sapiens
tccagcccaggtcctgcctg

SEQ ID NO: 7585889 - DNA, 20 bp, Homo sapiens
tccagcccaggtcctgcctg

SEQ ID NO: 7585890 - DNA, 22 bp, Homo sapiens
tccagcccagtttggtgaattg

SEQ ID NO: 7585891 - DNA, 22 bp, Homo sapiens
tccagccccggcttccttacag

SEQ ID NO: 7585892 - DNA, 22 bp, Homo sapiens
tccagccccgaggccggcgacg

SEQ ID NO: 7585893 - DNA, 22 bp, Homo sapiens
tccagccccgaggccggcgacg

SEQ ID NO: 7585894 - DNA, 22 bp, Homo sapiens
tccagccccgaggccggcgacg

SEQ ID NO: 7585895 - DNA, 22 bp, Homo sapiens
tccagcccatccctagcctggg

SEQ ID NO: 7585896 - DNA, 22 bp, Homo sapiens
tccagcccatccctagcctggg

SEQ ID NO: 7585897 - DNA, 22 bp, Homo sapiens
tccagcccatccctagcctggg

SEQ ID NO: 7585898 - DNA, 22 bp, Homo sapiens
tccagccccgaggccggcgacg

SEQ ID NO: 7585899 - DNA, 22 bp, Homo sapiens
tccagccctctggcccgcggtg

SEQ ID NO: 7585900 - DNA, 17 bp, Homo sapiens
tccagccctgcccgacg

SEQ ID NO: 7585901 - DNA, 22 bp, Homo sapiens
tccagccctgcccattctctcg

SEQ ID NO: 7585902 - DNA, 17 bp, Homo sapiens
tccagccctgcccgacg

SEQ ID NO: 7585903 - DNA, 17 bp, Homo sapiens
tccagccctgcccgacg

SEQ ID NO: 7585904 - DNA, 17 bp, Homo sapiens
tccagccctgcccgacg

SEQ ID NO: 7585905 - DNA, 22 bp, Homo sapiens
tccagccctgcccattctctcg

SEQ ID NO: 7585906 - DNA, 22 bp, Homo sapiens
tccagccctgcactgattagat

SEQ ID NO: 7585907 - DNA, 17 bp, Homo sapiens
tccagccctgcccgacg

SEQ ID NO: 7585908 - DNA, 22 bp, Homo sapiens
tccagccctgcccattctctcg

SEQ ID NO: 7585909 - DNA, 22 bp, Homo sapiens
tccagccctgcttcctgcctca

SEQ ID NO: 7585910 - DNA, 22 bp, Homo sapiens
tccagccctgcttcctgcctca

SEQ ID NO: 7585911 - DNA, 22 bp, Homo sapiens
tccagccctgcttcctgcctca

SEQ ID NO: 7585912 - DNA, 22 bp, Homo sapiens
tccagccctgcttcctgcctca

SEQ ID NO: 7585913 - DNA, 17 bp, Homo sapiens
tccagccctgcccgacg

SEQ ID NO: 7585914 - DNA, 22 bp, Homo sapiens
tccagccctgcttcctgcctca

SEQ ID NO: 7585915 - DNA, 17 bp, Homo sapiens
tccagccctgcccgacg

SEQ ID NO: 7585916 - DNA, 17 bp, Homo sapiens
tccagccctgcccgacg

SEQ ID NO: 7585917 - DNA, 22 bp, Homo sapiens
tccagccctgcccattctctcg

SEQ ID NO: 7585918 - DNA, 22 bp, Homo sapiens
tccagccctgcccattctctcg

SEQ ID NO: 7585919 - DNA, 22 bp, Homo sapiens
tccagccctgcccattctctcg

SEQ ID NO: 7585920 - DNA, 22 bp, Homo sapiens
tccagccctgcactgattagat

SEQ ID NO: 7585921 - DNA, 22 bp, Homo sapiens
tccagccctgcactgattagat

SEQ ID NO: 7585922 - DNA, 22 bp, Homo sapiens
tccagccctgcactgattagat

SEQ ID NO: 7585923 - DNA, 22 bp, Homo sapiens
tccagccctctggcccgcggtg

SEQ ID NO: 7585924 - DNA, 22 bp, Homo sapiens
tccagccctctggcccgcggtg

SEQ ID NO: 7585925 - DNA, 22 bp, Homo sapiens
tccagccctctggcccgcggtg

SEQ ID NO: 7585926 - DNA, 22 bp, Homo sapiens
tccagccctctggcccgcggtg

SEQ ID NO: 7585927 - DNA, 22 bp, Homo sapiens
tccagccctgcactgattagat

SEQ ID NO: 7585928 - DNA, 22 bp, Homo sapiens
tccagccctcctgggatcacag

SEQ ID NO: 7585929 - DNA, 20 bp, Homo sapiens
tccagccctcatgtcgctca

SEQ ID NO: 7585930 - DNA, 22 bp, Homo sapiens
tccagccctcctgggatcacag

SEQ ID NO: 7585931 - DNA, 22 bp, Homo sapiens
tccagccctcctgggatcacag

SEQ ID NO: 7585932 - DNA, 22 bp, Homo sapiens
tccagccctcctgggatcacag

SEQ ID NO: 7585933 - DNA, 22 bp, Homo sapiens
tccagccctcctgggatcacag

SEQ ID NO: 7585934 - DNA, 20 bp, Homo sapiens
tccagccctcatgtcgctca

SEQ ID NO: 7585935 - DNA, 20 bp, Homo sapiens
tccagccctcatgtcgctca

SEQ ID NO: 7585936 - DNA, 20 bp, Homo sapiens
tccagccctcatgtcgctca

SEQ ID NO: 7585937 - DNA, 20 bp, Homo sapiens
tccagccctcatgtcgctca

SEQ ID NO: 7585938 - DNA, 22 bp, Homo sapiens
tccagcccgactgggcctgccg

SEQ ID NO: 7585939 - DNA, 22 bp, Homo sapiens
tccagcccgactgggcctgccg

SEQ ID NO: 7585940 - DNA, 22 bp, Homo sapiens
tccagcccgactgggcctgccg

SEQ ID NO: 7585941 - DNA, 22 bp, Homo sapiens
tccagcccgactgggcctgccg

SEQ ID NO: 7585942 - DNA, 22 bp, Homo sapiens
tccagccccttttactcattca

SEQ ID NO: 7585943 - DNA, 22 bp, Homo sapiens
tccagcccgactgggcctgccg

SEQ ID NO: 7585944 - DNA, 22 bp, Homo sapiens
tccagccccttttactcattca

SEQ ID NO: 7585945 - DNA, 22 bp, Homo sapiens
tccagcccgactgggcctgccg

SEQ ID NO: 7585946 - DNA, 22 bp, Homo sapiens
tccagcccgactgggcctgccg

SEQ ID NO: 7585947 - DNA, 22 bp, Homo sapiens
tccagcccgactgggcctgccg

SEQ ID NO: 7585948 - DNA, 22 bp, Homo sapiens
tccagcccgactgggcctgccg

SEQ ID NO: 7585949 - DNA, 22 bp, Homo sapiens
tccagcccgactgggcctgccg

SEQ ID NO: 7585950 - DNA, 22 bp, Homo sapiens
tccagccccttttactcattca

SEQ ID NO: 7585951 - DNA, 22 bp, Homo sapiens
tccagccccttttactcattca

SEQ ID NO: 7585952 - DNA, 22 bp, Homo sapiens
tccagccccttttactcattca

SEQ ID NO: 7585953 - DNA, 20 bp, Homo sapiens
tccagcccctgcatgttgct

SEQ ID NO: 7585954 - DNA, 20 bp, Homo sapiens
tccagcccctgcatgttgct

SEQ ID NO: 7585955 - DNA, 20 bp, Homo sapiens
tccagcccctgcatgttgct

SEQ ID NO: 7585956 - DNA, 19 bp, Homo sapiens
tccagcccctctgtgtgtg

SEQ ID NO: 7585957 - DNA, 20 bp, Homo sapiens
tccagcccctgcatgttgct

SEQ ID NO: 7585958 - DNA, 20 bp, Homo sapiens
tccagcccctgcatgttgct

SEQ ID NO: 7585959 - DNA, 19 bp, Homo sapiens
tccagcccctctgtgtgtg

SEQ ID NO: 7585960 - DNA, 19 bp, Homo sapiens
tccagcccctctgtgtgtg

SEQ ID NO: 7585961 - DNA, 19 bp, Homo sapiens
tccagcccctctgtgtgtg

SEQ ID NO: 7585962 - DNA, 20 bp, Homo sapiens
tccagccctcatgtcgctca

SEQ ID NO: 7585963 - DNA, 20 bp, Homo sapiens
tccagccctcatgtcgctca

SEQ ID NO: 7585964 - DNA, 22 bp, Homo sapiens
tccagccctcagccaagtggaa

SEQ ID NO: 7585965 - DNA, 22 bp, Homo sapiens
tccagccctcagccaagtggaa

SEQ ID NO: 7585966 - DNA, 22 bp, Homo sapiens
tccagccctcagccaagtggaa

SEQ ID NO: 7585967 - DNA, 22 bp, Homo sapiens
tccagccctcagccaagtggaa

SEQ ID NO: 7585968 - DNA, 22 bp, Homo sapiens
tccagcccgggggcaggtgacc

SEQ ID NO: 7585969 - DNA, 22 bp, Homo sapiens
tccagccctcagccaagtggaa

SEQ ID NO: 7585970 - DNA, 22 bp, Homo sapiens
tccagcccgggggcaggtgacc

SEQ ID NO: 7585971 - DNA, 22 bp, Homo sapiens
tccagcccgggggcaggtgacc

SEQ ID NO: 7585972 - DNA, 22 bp, Homo sapiens
tccagcccgggggcaggtgacc

SEQ ID NO: 7585973 - DNA, 22 bp, Homo sapiens
tccagcccgagggcgctgatga

SEQ ID NO: 7585974 - DNA, 22 bp, Homo sapiens
tccagcccgggggcaggtgacc

SEQ ID NO: 7585975 - DNA, 22 bp, Homo sapiens
tccagcccgagggcgctgatga

SEQ ID NO: 7585976 - DNA, 22 bp, Homo sapiens
tccagcccgagggcgctgatga

SEQ ID NO: 7585977 - DNA, 22 bp, Homo sapiens
tccagcccgactgggcctgccg

SEQ ID NO: 7585978 - DNA, 22 bp, Homo sapiens
tccagcccgagggcgctgatga

SEQ ID NO: 7585979 - DNA, 22 bp, Homo sapiens
tccacagggcctttctggtgtg

SEQ ID NO: 7585980 - DNA, 22 bp, Homo sapiens
tccacattctctgttacagata

SEQ ID NO: 7585981 - DNA, 22 bp, Homo sapiens
tccaccacttcctgcagccatt

SEQ ID NO: 7585982 - DNA, 22 bp, Homo sapiens
tccacattgcacagccagaaca

SEQ ID NO: 7585983 - DNA, 22 bp, Homo sapiens
tccaccacttcctgcagccatt

SEQ ID NO: 7585984 - DNA, 22 bp, Homo sapiens
tccacagggattcacccaaaag

SEQ ID NO: 7585985 - DNA, 22 bp, Homo sapiens
tccacagggattcacccaaaag

SEQ ID NO: 7585986 - DNA, 22 bp, Homo sapiens
tccacagggcctttctggtgtg

SEQ ID NO: 7585987 - DNA, 22 bp, Homo sapiens
tccacagggcctttctggtgtg

SEQ ID NO: 7585988 - DNA, 22 bp, Homo sapiens
tccacagggatgttgagttctt

SEQ ID NO: 7585989 - DNA, 22 bp, Homo sapiens
tccacagggattcacccaaaag

SEQ ID NO: 7585990 - DNA, 22 bp, Homo sapiens
tccacagggatgttgagttctt

SEQ ID NO: 7585991 - DNA, 22 bp, Homo sapiens
tccaccagagccttcccatgct

SEQ ID NO: 7585992 - DNA, 22 bp, Homo sapiens
tccaccagcagcctgtcagcct

SEQ ID NO: 7585993 - DNA, 22 bp, Homo sapiens
tccaccagcagcctgtcagcct

SEQ ID NO: 7585994 - DNA, 22 bp, Homo sapiens
tccaccagagccctctttgcgg

SEQ ID NO: 7585995 - DNA, 22 bp, Homo sapiens
tccaccacttcctgcagccatt

SEQ ID NO: 7585996 - DNA, 22 bp, Homo sapiens
tccaccagagccttcccatgct

SEQ ID NO: 7585997 - DNA, 22 bp, Homo sapiens
tccaccagagccttcccatgct

SEQ ID NO: 7585998 - DNA, 20 bp, Homo sapiens
tccaccaggaagggtaggga

SEQ ID NO: 7585999 - DNA, 22 bp, Homo sapiens
tccaccagggtttcatctccct

SEQ ID NO: 7586000 - DNA, 22 bp, Homo sapiens
tccaccaggctccatgttcagt

SEQ ID NO: 7586001 - DNA, 22 bp, Homo sapiens
tccaccaggctccatgttcagt

SEQ ID NO: 7586002 - DNA, 20 bp, Homo sapiens
tccaccaggaagggtaggga

SEQ ID NO: 7586003 - DNA, 20 bp, Homo sapiens
tccaccaggaagggtaggga

SEQ ID NO: 7586004 - DNA, 20 bp, Homo sapiens
tccaccaggaagggtaggga

SEQ ID NO: 7586005 - DNA, 22 bp, Homo sapiens
tccaccagcttcttcaccagct

SEQ ID NO: 7586006 - DNA, 22 bp, Homo sapiens
tccaccagcttcttcaccagct

SEQ ID NO: 7586007 - DNA, 22 bp, Homo sapiens
tccaccagccaggcccaggctg

SEQ ID NO: 7586008 - DNA, 22 bp, Homo sapiens
tccaccagccaggcccaggctg

SEQ ID NO: 7586009 - DNA, 22 bp, Homo sapiens
tccaccagccaggcccaggctg

SEQ ID NO: 7586010 - DNA, 22 bp, Homo sapiens
tccaccagccaggcccaggctg

SEQ ID NO: 7586011 - DNA, 22 bp, Homo sapiens
tccaccagccaggcccaggctg

SEQ ID NO: 7586012 - DNA, 22 bp, Homo sapiens
tccaccagcagcctgtcagcct

SEQ ID NO: 7586013 - DNA, 22 bp, Homo sapiens
tccaccatgtaacaagctctgt

SEQ ID NO: 7586014 - DNA, 22 bp, Homo sapiens
tccaccatgtaacaagctctgt

SEQ ID NO: 7586015 - DNA, 22 bp, Homo sapiens
tccaccatgtaacaagctctgt

SEQ ID NO: 7586016 - DNA, 22 bp, Homo sapiens
tccaccatgtaacaagctctgt

SEQ ID NO: 7586017 - DNA, 22 bp, Homo sapiens
tccaccatgtaacaagctctgt

SEQ ID NO: 7586018 - DNA, 22 bp, Homo sapiens
tccaccatgtaacaagctctgt

SEQ ID NO: 7586019 - DNA, 22 bp, Homo sapiens
tccaccatgtaacaagctctgt

SEQ ID NO: 7586020 - DNA, 22 bp, Homo sapiens
tccaccatgtaacaagctctgt

SEQ ID NO: 7586021 - DNA, 22 bp, Homo sapiens
tccaccatgtaacaagctctgt

SEQ ID NO: 7586022 - DNA, 22 bp, Homo sapiens
tccacccagcacactgtggtag

SEQ ID NO: 7586023 - DNA, 22 bp, Homo sapiens
tccacccagcacactgtggtag

SEQ ID NO: 7586024 - DNA, 22 bp, Homo sapiens
tccaccatgtaacaagctctgt

SEQ ID NO: 7586025 - DNA, 22 bp, Homo sapiens
tccaccagggtttcatctccct

SEQ ID NO: 7586026 - DNA, 18 bp, Homo sapiens
tccaccagtcaatctgtc

SEQ ID NO: 7586027 - DNA, 22 bp, Homo sapiens
tccaccagttcaccttgtagca

SEQ ID NO: 7586028 - DNA, 22 bp, Homo sapiens
tccaccagttcaccttgtagca

SEQ ID NO: 7586029 - DNA, 18 bp, Homo sapiens
tccaccagtcaatctgtc

SEQ ID NO: 7586030 - DNA, 18 bp, Homo sapiens
tccaccagtcaatctgtc

SEQ ID NO: 7586031 - DNA, 22 bp, Homo sapiens
tccaccagggtttcatctccct

SEQ ID NO: 7586032 - DNA, 19 bp, Homo sapiens
tccaccccagccagctctg

SEQ ID NO: 7586033 - DNA, 19 bp, Homo sapiens
tccaccccagccagctctg

SEQ ID NO: 7586034 - DNA, 19 bp, Homo sapiens
tccaccccagccagctctg

SEQ ID NO: 7586035 - DNA, 19 bp, Homo sapiens
tccaccccagccagctctg

SEQ ID NO: 7586036 - DNA, 22 bp, Homo sapiens
tccacccagcacactgtggtag

SEQ ID NO: 7586037 - DNA, 22 bp, Homo sapiens
tccacccagtgtttctacaggt

SEQ ID NO: 7586038 - DNA, 22 bp, Homo sapiens
tccacccagtgtttctacaggt

SEQ ID NO: 7586039 - DNA, 22 bp, Homo sapiens
tccacccccagacagctggtga

SEQ ID NO: 7586040 - DNA, 23 bp, Homo sapiens
tccaccccagctgaggcttagcc

SEQ ID NO: 7586041 - DNA, 23 bp, Homo sapiens
tccaccccagctgaggcttagcc

SEQ ID NO: 7586042 - DNA, 23 bp, Homo sapiens
tccaccccagctgaggcttagcc

SEQ ID NO: 7586043 - DNA, 22 bp, Homo sapiens
tccacccccagacagctggtga

SEQ ID NO: 7586044 - DNA, 22 bp, Homo sapiens
tccacccccagacagctggtga

SEQ ID NO: 7586045 - DNA, 22 bp, Homo sapiens
tccacccccagacagctggtga

SEQ ID NO: 7586046 - DNA, 22 bp, Homo sapiens
tccacccctgggaatgtcaata

SEQ ID NO: 7586047 - DNA, 22 bp, Homo sapiens
tccactgtggtcccttgctgcc

SEQ ID NO: 7586048 - DNA, 22 bp, Homo sapiens
tccactgtggtcccttgctgcc

SEQ ID NO: 7586049 - DNA, 22 bp, Homo sapiens
tccactggcttggaaaatcatt

SEQ ID NO: 7586050 - DNA, 22 bp, Homo sapiens
tccactggtaatacctagatcc

SEQ ID NO: 7586051 - DNA, 22 bp, Homo sapiens
tccactggtatccacagtgggg

SEQ ID NO: 7586052 - DNA, 22 bp, Homo sapiens
tccactggcctctgtctttcag

SEQ ID NO: 7586053 - DNA, 22 bp, Homo sapiens
tccactggcctctgtctttcag

SEQ ID NO: 7586054 - DNA, 22 bp, Homo sapiens
tccactgctacaacctcccaga

SEQ ID NO: 7586055 - DNA, 22 bp, Homo sapiens
tccactgctcattccacaggca

SEQ ID NO: 7586056 - DNA, 22 bp, Homo sapiens
tccactgctcattccacaggca

SEQ ID NO: 7586057 - DNA, 22 bp, Homo sapiens
tccactgcagcttctgatggaa

SEQ ID NO: 7586058 - DNA, 22 bp, Homo sapiens
tccactggaacaactctgaggc

SEQ ID NO: 7586059 - DNA, 22 bp, Homo sapiens
tccactggaacaactctgaggc

SEQ ID NO: 7586060 - DNA, 22 bp, Homo sapiens
tccactggaacaactctgaggc

SEQ ID NO: 7586061 - DNA, 22 bp, Homo sapiens
tccactggaacaactctgaggc

SEQ ID NO: 7586062 - DNA, 22 bp, Homo sapiens
tccactggcccacctcctcagt

SEQ ID NO: 7586063 - DNA, 22 bp, Homo sapiens
tccactggcccacctcctcagt

SEQ ID NO: 7586064 - DNA, 22 bp, Homo sapiens
tccactggcccacctcctcagt

SEQ ID NO: 7586065 - DNA, 22 bp, Homo sapiens
tccactggcccacctcctcagt

SEQ ID NO: 7586066 - DNA, 22 bp, Homo sapiens
tccacttcatccagggtcacca

SEQ ID NO: 7586067 - DNA, 22 bp, Homo sapiens
tccagaaaaagtaatttatttg

SEQ ID NO: 7586068 - DNA, 22 bp, Homo sapiens
tccacttttcttccatcatcat

SEQ ID NO: 7586069 - DNA, 22 bp, Homo sapiens
tccagaaaaagtaatttatttg

SEQ ID NO: 7586070 - DNA, 22 bp, Homo sapiens
tccactttagcaatgattgaat

SEQ ID NO: 7586071 - DNA, 22 bp, Homo sapiens
tccactttagcaatgattgaat

SEQ ID NO: 7586072 - DNA, 22 bp, Homo sapiens
tccactttagcaatgattgaat

SEQ ID NO: 7586073 - DNA, 22 bp, Homo sapiens
tccagaaaattttacagtgcct

SEQ ID NO: 7586074 - DNA, 22 bp, Homo sapiens
tccagaaaattttacagtgcct

SEQ ID NO: 7586075 - DNA, 22 bp, Homo sapiens
tccagaaaattcagaaattgtt

SEQ ID NO: 7586076 - DNA, 22 bp, Homo sapiens
tccagaaaattcagaaattgtt

SEQ ID NO: 7586077 - DNA, 21 bp, Homo sapiens
tccagaaaagaggtcattagc

SEQ ID NO: 7586078 - DNA, 22 bp, Homo sapiens
tccagaaaattcagaaattgtt

SEQ ID NO: 7586079 - DNA, 22 bp, Homo sapiens
tccagaaaattcagaaattgtt

SEQ ID NO: 7586080 - DNA, 22 bp, Homo sapiens
tccagaaaattcagaaattgtt

SEQ ID NO: 7586081 - DNA, 21 bp, Homo sapiens
tccagaaaagaggtcattagc

SEQ ID NO: 7586082 - DNA, 21 bp, Homo sapiens
tccagaaaagaggtcattagc

SEQ ID NO: 7586083 - DNA, 21 bp, Homo sapiens
tccagaaaagaggtcattagc

SEQ ID NO: 7586084 - DNA, 21 bp, Homo sapiens
tccagaaaagaggtcattagc

SEQ ID NO: 7586085 - DNA, 22 bp, Homo sapiens
tccagaaaaagtaatttatttg

SEQ ID NO: 7586086 - DNA, 22 bp, Homo sapiens
tccagaaaaagtaatttatttg

SEQ ID NO: 7586087 - DNA, 22 bp, Homo sapiens
tccagaaaaagtaatttatttg

SEQ ID NO: 7586088 - DNA, 22 bp, Homo sapiens
tccacgctgtgtgaccttgggc

SEQ ID NO: 7586089 - DNA, 22 bp, Homo sapiens
tccacgctgtgtgaccttgggc

SEQ ID NO: 7586090 - DNA, 22 bp, Homo sapiens
tccacgctgtgtgaccttgggc

SEQ ID NO: 7586091 - DNA, 22 bp, Homo sapiens
tccacgctgtgtgaccttgggc

SEQ ID NO: 7586092 - DNA, 22 bp, Homo sapiens
tccacctccatgctgggcagag

SEQ ID NO: 7586093 - DNA, 22 bp, Homo sapiens
tccacctgagtttcagttattt

SEQ ID NO: 7586094 - DNA, 22 bp, Homo sapiens
tccacctgagtttcagttattt

SEQ ID NO: 7586095 - DNA, 22 bp, Homo sapiens
tccacctgagtttcagttattt

SEQ ID NO: 7586096 - DNA, 22 bp, Homo sapiens
tccacctgggcaacagtgcctc

SEQ ID NO: 7586097 - DNA, 22 bp, Homo sapiens
tccacctgggcaacagtgcctc

SEQ ID NO: 7586098 - DNA, 22 bp, Homo sapiens
tccacctggattttgtctacag

SEQ ID NO: 7586099 - DNA, 21 bp, Homo sapiens
tccaccctctctgctcccagt

SEQ ID NO: 7586100 - DNA, 22 bp, Homo sapiens
tccacccctgggaatgtcaata

SEQ ID NO: 7586101 - DNA, 21 bp, Homo sapiens
tccaccctctctgctcccagt

SEQ ID NO: 7586102 - DNA, 21 bp, Homo sapiens
tccaccctctctgctcccagt

SEQ ID NO: 7586103 - DNA, 22 bp, Homo sapiens
tccaccctgcttttgtctttga

SEQ ID NO: 7586104 - DNA, 18 bp, Homo sapiens
tccaccgcgtgcacctct

SEQ ID NO: 7586105 - DNA, 18 bp, Homo sapiens
tccaccgcgtgcacctct

SEQ ID NO: 7586106 - DNA, 22 bp, Homo sapiens
tccaccctgctttcttatctcc

SEQ ID NO: 7586107 - DNA, 22 bp, Homo sapiens
tccaccctgctttcttatctcc

SEQ ID NO: 7586108 - DNA, 22 bp, Homo sapiens
tccaccctgctttcttatctcc

SEQ ID NO: 7586109 - DNA, 22 bp, Homo sapiens
tccactctaattactaccttct

SEQ ID NO: 7586110 - DNA, 22 bp, Homo sapiens
tccactctaattactaccttct

SEQ ID NO: 7586111 - DNA, 22 bp, Homo sapiens
tccactgacaggtgaatggata

SEQ ID NO: 7586112 - DNA, 22 bp, Homo sapiens
tccactgacaggtgaatggata

SEQ ID NO: 7586113 - DNA, 22 bp, Homo sapiens
tccactgacaggtgaatggata

SEQ ID NO: 7586114 - DNA, 22 bp, Homo sapiens
tccactctaattactaccttct

SEQ ID NO: 7586115 - DNA, 22 bp, Homo sapiens
tccacgtgagcttcgtgtgcag

SEQ ID NO: 7586116 - DNA, 22 bp, Homo sapiens
tccactcaaggccattgcacat

SEQ ID NO: 7586117 - DNA, 22 bp, Homo sapiens
tccactcatgagatctggctga

SEQ ID NO: 7586118 - DNA, 22 bp, Homo sapiens
tccactcatgagatctggctga

SEQ ID NO: 7586119 - DNA, 22 bp, Homo sapiens
tccacgtgagcttcgtgtgcag

SEQ ID NO: 7586120 - DNA, 22 bp, Homo sapiens
tccacgtgagcttcgtgtgcag

SEQ ID NO: 7586121 - DNA, 22 bp, Homo sapiens
tccacgtgagcttcgtgtgcag

SEQ ID NO: 7586122 - DNA, 22 bp, Homo sapiens
tccacgttttcaacacagccaa

SEQ ID NO: 7586123 - DNA, 22 bp, Homo sapiens
tccacgttgcatcaccagtcta

SEQ ID NO: 7586124 - DNA, 22 bp, Homo sapiens
tccacgtgacctttgtggtgga

SEQ ID NO: 7586125 - DNA, 22 bp, Homo sapiens
tccacgtgacctttgtggtgga

SEQ ID NO: 7586126 - DNA, 22 bp, Homo sapiens
tccacgtgagcttcgtgtgcag

SEQ ID NO: 7586127 - DNA, 22 bp, Homo sapiens
tccacgtgagcttcgtgtgcag

SEQ ID NO: 7586128 - DNA, 22 bp, Homo sapiens
tccacaggaaagcacctcccat

SEQ ID NO: 7586129 - DNA, 22 bp, Homo sapiens
tccacagcttttaaatgtctag

SEQ ID NO: 7586130 - DNA, 22 bp, Homo sapiens
tccacaggaaagcacctcccat

SEQ ID NO: 7586131 - DNA, 22 bp, Homo sapiens
tccacaggaaagcacctcccat

SEQ ID NO: 7586132 - DNA, 22 bp, Homo sapiens
tccacaggaaagcacctcccat

SEQ ID NO: 7586133 - DNA, 22 bp, Homo sapiens
tccacagctgtcctgtaacagg

SEQ ID NO: 7586134 - DNA, 22 bp, Homo sapiens
tccacagcacaaagccagtgtg

SEQ ID NO: 7586135 - DNA, 22 bp, Homo sapiens
tccacagcattattagaaggat

SEQ ID NO: 7586136 - DNA, 22 bp, Homo sapiens
tccacagcattattagaaggat

SEQ ID NO: 7586137 - DNA, 22 bp, Homo sapiens
tccacagatgacagaggggatg

SEQ ID NO: 7586138 - DNA, 22 bp, Homo sapiens
tccacagatgcctttaggagta

SEQ ID NO: 7586139 - DNA, 22 bp, Homo sapiens
tccacagcacaaagccagtgtg

SEQ ID NO: 7586140 - DNA, 22 bp, Homo sapiens
tccacagataaaaacagaggtt

SEQ ID NO: 7586141 - DNA, 22 bp, Homo sapiens
tccacagactattaagtgatct

SEQ ID NO: 7586142 - DNA, 22 bp, Homo sapiens
tccacagactattaagtgatct

SEQ ID NO: 7586143 - DNA, 22 bp, Homo sapiens
tccacagataaaaacagaggtt

SEQ ID NO: 7586144 - DNA, 22 bp, Homo sapiens
tccacagataaaaacagaggtt

SEQ ID NO: 7586145 - DNA, 22 bp, Homo sapiens
tccacagggatgttgagttctt

SEQ ID NO: 7586146 - DNA, 22 bp, Homo sapiens
tccacagggatgttgagttctt

SEQ ID NO: 7586147 - DNA, 22 bp, Homo sapiens
tccacagggatgttgagttctt

SEQ ID NO: 7586148 - DNA, 22 bp, Homo sapiens
tccacagggatgcctgcggctt

SEQ ID NO: 7586149 - DNA, 22 bp, Homo sapiens
tccacagggatgcctgcggctt

SEQ ID NO: 7586150 - DNA, 22 bp, Homo sapiens
tccacagggatgcctgcggctt

SEQ ID NO: 7586151 - DNA, 22 bp, Homo sapiens
tccacagggatgcctgcggctt

SEQ ID NO: 7586152 - DNA, 22 bp, Homo sapiens
tccacagggatgcctgcggctt

SEQ ID NO: 7586153 - DNA, 22 bp, Homo sapiens
tccacagggatgcctgcggctt

SEQ ID NO: 7586154 - DNA, 22 bp, Homo sapiens
tccacagggatgcctgcggctt

SEQ ID NO: 7586155 - DNA, 22 bp, Homo sapiens
tccacaggctgaggcccttctg

SEQ ID NO: 7586156 - DNA, 22 bp, Homo sapiens
tccacaggcaagtctcttggca

SEQ ID NO: 7586157 - DNA, 22 bp, Homo sapiens
tccacaggcaagtctcttggca

SEQ ID NO: 7586158 - DNA, 22 bp, Homo sapiens
tccacaggcaagtctcttggca

SEQ ID NO: 7586159 - DNA, 22 bp, Homo sapiens
tccacaggcaagtctcttggca

SEQ ID NO: 7586160 - DNA, 22 bp, Homo sapiens
tccacaggaaagcacctcccat

SEQ ID NO: 7586161 - DNA, 22 bp, Homo sapiens
tccacaggcaagtctcttggca

SEQ ID NO: 7586162 - DNA, 22 bp, Homo sapiens
tccacaggcaagtctcttggca

SEQ ID NO: 7586163 - DNA, 22 bp, Homo sapiens
tccacaggaaagcacctcccat

SEQ ID NO: 7586164 - DNA, 22 bp, Homo sapiens
tccacaggctgaggcccttctg

SEQ ID NO: 7586165 - DNA, 22 bp, Homo sapiens
tccacaggctgaggcccttctg

SEQ ID NO: 7586166 - DNA, 22 bp, Homo sapiens
tccacaggctgaggcccttctg

SEQ ID NO: 7586167 - DNA, 22 bp, Homo sapiens
tccacaggctgaggcccttctg

SEQ ID NO: 7586168 - DNA, 22 bp, Homo sapiens
tccacaggcaagtctcttggca

SEQ ID NO: 7586169 - DNA, 22 bp, Homo sapiens
tccacacacatttctatgtgca

SEQ ID NO: 7586170 - DNA, 22 bp, Homo sapiens
tccacacacatttctatgtgca

SEQ ID NO: 7586171 - DNA, 21 bp, Homo sapiens
tccacaatagggaaattcacc

SEQ ID NO: 7586172 - DNA, 22 bp, Homo sapiens
tccacaatggcagagaaatgtc

SEQ ID NO: 7586173 - DNA, 22 bp, Homo sapiens
tccacaatggcagagaaatgtc

SEQ ID NO: 7586174 - DNA, 22 bp, Homo sapiens
tcattacacagttcagtggaaa

SEQ ID NO: 7586175 - DNA, 22 bp, Homo sapiens
tcattacaagatttccaatttg

SEQ ID NO: 7586176 - DNA, 22 bp, Homo sapiens
tcattaataagtctaactctcc

SEQ ID NO: 7586177 - DNA, 22 bp, Homo sapiens
tcattaaatgtttgttgtgcca

SEQ ID NO: 7586178 - DNA, 22 bp, Homo sapiens
tcattaaatgtttgttgtgcca

SEQ ID NO: 7586179 - DNA, 22 bp, Homo sapiens
tcattaaaatgcagattctgac

SEQ ID NO: 7586180 - DNA, 22 bp, Homo sapiens
tcattaaaatgcagattctgac

SEQ ID NO: 7586181 - DNA, 22 bp, Homo sapiens
tcattaaatgtttgttgtgcca

SEQ ID NO: 7586182 - DNA, 22 bp, Homo sapiens
tcattaaatgtttgttgtgcca

SEQ ID NO: 7586183 - DNA, 22 bp, Homo sapiens
tcattaaatgtttgttgtgcca

SEQ ID NO: 7586184 - DNA, 22 bp, Homo sapiens
tcattaaaatgcagattctgac

SEQ ID NO: 7586185 - DNA, 22 bp, Homo sapiens
tcattaaaatgcagattctgac

SEQ ID NO: 7586186 - DNA, 22 bp, Homo sapiens
tcattaagtaaggcaggtggtt

SEQ ID NO: 7586187 - DNA, 22 bp, Homo sapiens
tcattaagattcctatggcatt

SEQ ID NO: 7586188 - DNA, 22 bp, Homo sapiens
tcattaagattcctatggcatt

SEQ ID NO: 7586189 - DNA, 22 bp, Homo sapiens
tcattaaatgtttgttgtgcca

SEQ ID NO: 7586190 - DNA, 22 bp, Homo sapiens
tcattaagaaatgaggagtccc

SEQ ID NO: 7586191 - DNA, 22 bp, Homo sapiens
tcattaagattacgtgccagaa

SEQ ID NO: 7586192 - DNA, 22 bp, Homo sapiens
tcattaagattacgtgccagaa

SEQ ID NO: 7586193 - DNA, 22 bp, Homo sapiens
tccacagacgtgttattagttg

SEQ ID NO: 7586194 - DNA, 22 bp, Homo sapiens
tccacagaccagtatctgcagc

SEQ ID NO: 7586195 - DNA, 22 bp, Homo sapiens
tccacacttgctgtctgctgag

SEQ ID NO: 7586196 - DNA, 22 bp, Homo sapiens
tccacacttgctgtctgctgag

SEQ ID NO: 7586197 - DNA, 22 bp, Homo sapiens
tccacacttgctgtctgctgag

SEQ ID NO: 7586198 - DNA, 22 bp, Homo sapiens
tccacagaatggaattctccgc

SEQ ID NO: 7586199 - DNA, 22 bp, Homo sapiens
tccacagaatgtaagatccaca

SEQ ID NO: 7586200 - DNA, 22 bp, Homo sapiens
tccacagaatgtaagatccaca

SEQ ID NO: 7586201 - DNA, 22 bp, Homo sapiens
tccacagaatgtaagatccaca

SEQ ID NO: 7586202 - DNA, 18 bp, Homo sapiens
tcatggctttagtccctc

SEQ ID NO: 7586203 - DNA, 22 bp, Homo sapiens
tcatgtgtcctagttcatataa

SEQ ID NO: 7586204 - DNA, 22 bp, Homo sapiens
tcatggctttttcactgttcgc

SEQ ID NO: 7586205 - DNA, 22 bp, Homo sapiens
tcatgtgtcctagttcatataa

SEQ ID NO: 7586206 - DNA, 22 bp, Homo sapiens
tcatgtgtcctagttcatataa

SEQ ID NO: 7586207 - DNA, 20 bp, Homo sapiens
tcatggctgctgagaggttc

SEQ ID NO: 7586208 - DNA, 22 bp, Homo sapiens
tcatggctggaagctcagttag

SEQ ID NO: 7586209 - DNA, 22 bp, Homo sapiens
tcatggcttcaaggaagcaggc

SEQ ID NO: 7586210 - DNA, 22 bp, Homo sapiens
tcatggcttcaaggaagcaggc

SEQ ID NO: 7586211 - DNA, 18 bp, Homo sapiens
tcatggcttgcagatggt

SEQ ID NO: 7586212 - DNA, 18 bp, Homo sapiens
tcatggcttgcagatggt

SEQ ID NO: 7586213 - DNA, 18 bp, Homo sapiens
tcatggcttgcagatggt

SEQ ID NO: 7586214 - DNA, 18 bp, Homo sapiens
tcatggcttgcagatggt

SEQ ID NO: 7586215 - DNA, 22 bp, Homo sapiens
tcatggcttcaaggaagcaggc

SEQ ID NO: 7586216 - DNA, 22 bp, Homo sapiens
tcatggcttgcagatggccacc

SEQ ID NO: 7586217 - DNA, 22 bp, Homo sapiens
tcatggcttgcagatggccacc

SEQ ID NO: 7586218 - DNA, 22 bp, Homo sapiens
tcatggcttgcagatggccacc

SEQ ID NO: 7586219 - DNA, 22 bp, Homo sapiens
tcatgtgtgtttcatgtatgga

SEQ ID NO: 7586220 - DNA, 22 bp, Homo sapiens
tcatgttatcttggctctggga

SEQ ID NO: 7586221 - DNA, 22 bp, Homo sapiens
tcatgttattgactcataatat

SEQ ID NO: 7586222 - DNA, 22 bp, Homo sapiens
tcatgttattgactcataatat

SEQ ID NO: 7586223 - DNA, 20 bp, Homo sapiens
tcatgtgtgtcctacagaga

SEQ ID NO: 7586224 - DNA, 22 bp, Homo sapiens
tcatgtgtgtttcatgtatgga

SEQ ID NO: 7586225 - DNA, 20 bp, Homo sapiens
tcatgtgtgtcctacagaga

SEQ ID NO: 7586226 - DNA, 20 bp, Homo sapiens
tcatgtgtgtcctacagaga

SEQ ID NO: 7586227 - DNA, 22 bp, Homo sapiens
tcatgtttttgccatatgactc

SEQ ID NO: 7586228 - DNA, 22 bp, Homo sapiens
tcatgtttttgccatatgactc

SEQ ID NO: 7586229 - DNA, 22 bp, Homo sapiens
tcatgtttttgccatatgactc

SEQ ID NO: 7586230 - DNA, 22 bp, Homo sapiens
tcatgttttagtaaagtgaagg

SEQ ID NO: 7586231 - DNA, 22 bp, Homo sapiens
tcatgttttagtaaagtgaagg

SEQ ID NO: 7586232 - DNA, 22 bp, Homo sapiens
tcatgttttagtaaagtgaagg

SEQ ID NO: 7586233 - DNA, 22 bp, Homo sapiens
tcatgttttagtaaagtgaagg

SEQ ID NO: 7586234 - DNA, 22 bp, Homo sapiens
tcatgttttagtaaagtgaagg

SEQ ID NO: 7586235 - DNA, 22 bp, Homo sapiens
tcatgttttagtaaagtgaagg

SEQ ID NO: 7586236 - DNA, 22 bp, Homo sapiens
tcatgtttttgccatatgactc

SEQ ID NO: 7586237 - DNA, 22 bp, Homo sapiens
tcatgtttttgccatatgactc

SEQ ID NO: 7586238 - DNA, 22 bp, Homo sapiens
tcatgtttttgccatatgactc

SEQ ID NO: 7586239 - DNA, 22 bp, Homo sapiens
tcatgtttttgccatatgactc

SEQ ID NO: 7586240 - DNA, 22 bp, Homo sapiens
tcatgtttttgccatatgactc

SEQ ID NO: 7586241 - DNA, 22 bp, Homo sapiens
tcatgttttagctgcaaaatga

SEQ ID NO: 7586242 - DNA, 22 bp, Homo sapiens
tcatgttttagctgcaaaatga

SEQ ID NO: 7586243 - DNA, 22 bp, Homo sapiens
tcatgttttagctgcaaaatga

SEQ ID NO: 7586244 - DNA, 22 bp, Homo sapiens
tcatgttttaatgcctttttct

SEQ ID NO: 7586245 - DNA, 22 bp, Homo sapiens
tcatgtttgttggaaatgtggc

SEQ ID NO: 7586246 - DNA, 22 bp, Homo sapiens
tcatgttttaatgcctttttct

SEQ ID NO: 7586247 - DNA, 22 bp, Homo sapiens
tcatgttttaatgcctttttct

SEQ ID NO: 7586248 - DNA, 22 bp, Homo sapiens
tcatgttttaatgcctttttct

SEQ ID NO: 7586249 - DNA, 22 bp, Homo sapiens
tcatgttttagctgcaaaatga

SEQ ID NO: 7586250 - DNA, 22 bp, Homo sapiens
tcatgttttagctgcaaaatga

SEQ ID NO: 7586251 - DNA, 22 bp, Homo sapiens
tcatgttttagctgcaaaatga

SEQ ID NO: 7586252 - DNA, 22 bp, Homo sapiens
tcatgttttagctgcaaaatga

SEQ ID NO: 7586253 - DNA, 22 bp, Homo sapiens
tcatgttttagtaaagtgaagg

SEQ ID NO: 7586254 - DNA, 22 bp, Homo sapiens
tcatgtttggagtttgctcact

SEQ ID NO: 7586255 - DNA, 22 bp, Homo sapiens
tcatgtttgccctaagaaaaag

SEQ ID NO: 7586256 - DNA, 22 bp, Homo sapiens
tcatgtttgccctaagaaaaag

SEQ ID NO: 7586257 - DNA, 22 bp, Homo sapiens
tcatgtttggagtttgctcact

SEQ ID NO: 7586258 - DNA, 22 bp, Homo sapiens
tcatgtttggagtttgctcact

SEQ ID NO: 7586259 - DNA, 22 bp, Homo sapiens
tcatgtttgttggaaatgtggc

SEQ ID NO: 7586260 - DNA, 22 bp, Homo sapiens
tcatgtttgttggaaatgtggc

SEQ ID NO: 7586261 - DNA, 22 bp, Homo sapiens
tcatgtttgttggaaatgtggc

SEQ ID NO: 7586262 - DNA, 22 bp, Homo sapiens
tcatgtttggagtttgctcact

SEQ ID NO: 7586263 - DNA, 22 bp, Homo sapiens
tcatgtttggagtttgctcact

SEQ ID NO: 7586264 - DNA, 22 bp, Homo sapiens
tcatgtttgttggaaatgtggc

SEQ ID NO: 7586265 - DNA, 20 bp, Homo sapiens
tcatgttgggccatcagaat

SEQ ID NO: 7586266 - DNA, 22 bp, Homo sapiens
tcatgtttctcttacagcagct

SEQ ID NO: 7586267 - DNA, 22 bp, Homo sapiens
tcatgtttctcttacagcagct

SEQ ID NO: 7586268 - DNA, 22 bp, Homo sapiens
tcatgtttctcttacagcagct

SEQ ID NO: 7586269 - DNA, 22 bp, Homo sapiens
tcatgtttctcttacagcagct

SEQ ID NO: 7586270 - DNA, 22 bp, Homo sapiens
tcatgtttgagactaatttttc

SEQ ID NO: 7586271 - DNA, 22 bp, Homo sapiens
tcatgtttgagactaatttttc

SEQ ID NO: 7586272 - DNA, 22 bp, Homo sapiens
tcatgtttgagactaatttttc

SEQ ID NO: 7586273 - DNA, 22 bp, Homo sapiens
tcatgtttgccctaagaaaaag

SEQ ID NO: 7586274 - DNA, 22 bp, Homo sapiens
tcatgtttgagactaatttttc

SEQ ID NO: 7586275 - DNA, 22 bp, Homo sapiens
tcatgtttgccctaagaaaaag

SEQ ID NO: 7586276 - DNA, 22 bp, Homo sapiens
tcatgtttgccctaagaaaaag

SEQ ID NO: 7586277 - DNA, 22 bp, Homo sapiens
gttttatttccatgagagaccg

SEQ ID NO: 7586278 - DNA, 22 bp, Homo sapiens
gttttatttccatgagagaccg

SEQ ID NO: 7586279 - DNA, 22 bp, Homo sapiens
gttttatttccatgagagaccg

SEQ ID NO: 7586280 - DNA, 22 bp, Homo sapiens
gttttatttccatgagagaccg

SEQ ID NO: 7586281 - DNA, 22 bp, Homo sapiens
gttttatttccatgagagaccg

SEQ ID NO: 7586282 - DNA, 22 bp, Homo sapiens
gttttatttccatgagagaccg

SEQ ID NO: 7586283 - DNA, 22 bp, Homo sapiens
gttttatttccatgagagaccg

SEQ ID NO: 7586284 - DNA, 22 bp, Homo sapiens
gttttatttccatgagagaccg

SEQ ID NO: 7586285 - DNA, 22 bp, Homo sapiens
gttttatttccatgagagaccg

SEQ ID NO: 7586286 - DNA, 22 bp, Homo sapiens
gttttatttccatgagagaccg

SEQ ID NO: 7586287 - DNA, 22 bp, Homo sapiens
gttttatttccatgagagaccg

SEQ ID NO: 7586288 - DNA, 23 bp, Homo sapiens
gttttcaacacaataaatgtaac

SEQ ID NO: 7586289 - DNA, 23 bp, Homo sapiens
gttttcaacacaataaatgtaac

SEQ ID NO: 7586290 - DNA, 23 bp, Homo sapiens
gttttcaacacaataaatgtaac

SEQ ID NO: 7586291 - DNA, 22 bp, Homo sapiens
gttttatttccatgagagaccg

SEQ ID NO: 7586292 - DNA, 22 bp, Homo sapiens
gttttatttccatgagagaccg

SEQ ID NO: 7586293 - DNA, 22 bp, Homo sapiens
gttttatttccatgagagaccg

SEQ ID NO: 7586294 - DNA, 22 bp, Homo sapiens
gttttatttccatgagagaccg

SEQ ID NO: 7586295 - DNA, 22 bp, Homo sapiens
gttttattggaacacagccatg

SEQ ID NO: 7586296 - DNA, 22 bp, Homo sapiens
gttttattggaacacagccatg

SEQ ID NO: 7586297 - DNA, 22 bp, Homo sapiens
gttttattggaacacagccatg

SEQ ID NO: 7586298 - DNA, 22 bp, Homo sapiens
gttttattggaacacagccatg

SEQ ID NO: 7586299 - DNA, 22 bp, Homo sapiens
gttttattggaacacagccatg

SEQ ID NO: 7586300 - DNA, 22 bp, Homo sapiens
gttttattggaacacagccatg

SEQ ID NO: 7586301 - DNA, 22 bp, Homo sapiens
gttttattggaacacagccatg

SEQ ID NO: 7586302 - DNA, 22 bp, Homo sapiens
gttttattggaacacagccatg

SEQ ID NO: 7586303 - DNA, 22 bp, Homo sapiens
gttttattggaacacagccatg

SEQ ID NO: 7586304 - DNA, 22 bp, Homo sapiens
gttttattggaacacagccatg

SEQ ID NO: 7586305 - DNA, 22 bp, Homo sapiens
gttttattggaacacagccatg

SEQ ID NO: 7586306 - DNA, 22 bp, Homo sapiens
gttttatttccatgagagaccg

SEQ ID NO: 7586307 - DNA, 22 bp, Homo sapiens
gttttatttccatgagagaccg

SEQ ID NO: 7586308 - DNA, 22 bp, Homo sapiens
gttttatttccatgagagaccg

SEQ ID NO: 7586309 - DNA, 22 bp, Homo sapiens
gttttattggaacacagccatg

SEQ ID NO: 7586310 - DNA, 22 bp, Homo sapiens
gttttattggaacacagccatg

SEQ ID NO: 7586311 - DNA, 22 bp, Homo sapiens
gttttattggaacacagccatg

SEQ ID NO: 7586312 - DNA, 22 bp, Homo sapiens
gttttattggaacacagccatg

SEQ ID NO: 7586313 - DNA, 22 bp, Homo sapiens
gttttatagttcgggacctgtt

SEQ ID NO: 7586314 - DNA, 22 bp, Homo sapiens
gttttatatgtctctgctgaca

SEQ ID NO: 7586315 - DNA, 22 bp, Homo sapiens
gttttatgagacctcaggaata

SEQ ID NO: 7586316 - DNA, 22 bp, Homo sapiens
gttttatatgtctctgctgaca

SEQ ID NO: 7586317 - DNA, 22 bp, Homo sapiens
gttttatgagacctcaggaata

SEQ ID NO: 7586318 - DNA, 22 bp, Homo sapiens
gttttattggaacacagccatg

SEQ ID NO: 7586319 - DNA, 22 bp, Homo sapiens
gttttattggaacacagccatg

SEQ ID NO: 7586320 - DNA, 20 bp, Homo sapiens
gttttatgccagttctgtgt

SEQ ID NO: 7586321 - DNA, 22 bp, Homo sapiens
gttttataggtgaaatattact

SEQ ID NO: 7586322 - DNA, 22 bp, Homo sapiens
gttttataggtgaaatattact

SEQ ID NO: 7586323 - DNA, 22 bp, Homo sapiens
gttttataggtgaaatattact

SEQ ID NO: 7586324 - DNA, 22 bp, Homo sapiens
gttttataggtgaaatattact

SEQ ID NO: 7586325 - DNA, 22 bp, Homo sapiens
gttttataggtgaaatattact

SEQ ID NO: 7586326 - DNA, 22 bp, Homo sapiens
gttttataggtgaaatattact

SEQ ID NO: 7586327 - DNA, 22 bp, Homo sapiens
gttttataggtgaaatattact

SEQ ID NO: 7586328 - DNA, 22 bp, Homo sapiens
gttttataggtgaaatattact

SEQ ID NO: 7586329 - DNA, 22 bp, Homo sapiens
gttttataggtgaaatattact

SEQ ID NO: 7586330 - DNA, 22 bp, Homo sapiens
gttttataggtgaaatattact

SEQ ID NO: 7586331 - DNA, 22 bp, Homo sapiens
gttttataggctgttgctatat

SEQ ID NO: 7586332 - DNA, 22 bp, Homo sapiens
gttttataggctgttgctatat

SEQ ID NO: 7586333 - DNA, 22 bp, Homo sapiens
gttttataggctgttgctatat

SEQ ID NO: 7586334 - DNA, 22 bp, Homo sapiens
gttttataggctgttgctatat

SEQ ID NO: 7586335 - DNA, 22 bp, Homo sapiens
gttttataggctgttgctatat

SEQ ID NO: 7586336 - DNA, 22 bp, Homo sapiens
gttttataggctgttgctatat

SEQ ID NO: 7586337 - DNA, 22 bp, Homo sapiens
gttttataggctgttgctatat

SEQ ID NO: 7586338 - DNA, 22 bp, Homo sapiens
gttttataggctgttgctatat

SEQ ID NO: 7586339 - DNA, 22 bp, Homo sapiens
gttttataggctgttgctatat

SEQ ID NO: 7586340 - DNA, 22 bp, Homo sapiens
gttttataattgcttcataaga

SEQ ID NO: 7586341 - DNA, 22 bp, Homo sapiens
gttttataattgcttcataaga

SEQ ID NO: 7586342 - DNA, 22 bp, Homo sapiens
gttttataattgcttcataaga

SEQ ID NO: 7586343 - DNA, 22 bp, Homo sapiens
gttttagtgtaacggagtgtga

SEQ ID NO: 7586344 - DNA, 22 bp, Homo sapiens
gttttataattgcttcataaga

SEQ ID NO: 7586345 - DNA, 22 bp, Homo sapiens
gttttataattgcttcataaga

SEQ ID NO: 7586346 - DNA, 22 bp, Homo sapiens
gttttataattgcttcataaga

SEQ ID NO: 7586347 - DNA, 22 bp, Homo sapiens
gttttcaaggggatttaactga

SEQ ID NO: 7586348 - DNA, 22 bp, Homo sapiens
gttttcaattataagatggctt

SEQ ID NO: 7586349 - DNA, 22 bp, Homo sapiens
gttttcaattataagatggctt

SEQ ID NO: 7586350 - DNA, 21 bp, Homo sapiens
gttttcatgatagagtctgta

SEQ ID NO: 7586351 - DNA, 22 bp, Homo sapiens
taaacagagaagactttgagca

SEQ ID NO: 7586352 - DNA, 22 bp, Homo sapiens
taaacagagaagactttgagca

SEQ ID NO: 7586353 - DNA, 22 bp, Homo sapiens
taaacagaattcaggcaagata

SEQ ID NO: 7586354 - DNA, 22 bp, Homo sapiens
taaacagagaagactttgagca

SEQ ID NO: 7586355 - DNA, 22 bp, Homo sapiens
taaacagagaagactttgagca

SEQ ID NO: 7586356 - DNA, 21 bp, Homo sapiens
gttttcatgatagagtctgta

SEQ ID NO: 7586357 - DNA, 21 bp, Homo sapiens
gttttcatgatagagtctgta

SEQ ID NO: 7586358 - DNA, 22 bp, Homo sapiens
gttttcagccaggagcacattt

SEQ ID NO: 7586359 - DNA, 22 bp, Homo sapiens
taaacagcctaaaactttcttt

SEQ ID NO: 7586360 - DNA, 16 bp, Homo sapiens
taaacagcagacagtt

SEQ ID NO: 7586361 - DNA, 22 bp, Homo sapiens
taaacagagtgctagttcacgg

SEQ ID NO: 7586362 - DNA, 22 bp, Homo sapiens
taaacagagtgctagttcacgg

SEQ ID NO: 7586363 - DNA, 22 bp, Homo sapiens
taaacagagtgctagttcacgg

SEQ ID NO: 7586364 - DNA, 22 bp, Homo sapiens
taaacagagtgctagttcacgg

SEQ ID NO: 7586365 - DNA, 22 bp, Homo sapiens
taaacagcctaaaactttcttt

SEQ ID NO: 7586366 - DNA, 22 bp, Homo sapiens
taaacagcctcccctttcactc

SEQ ID NO: 7586367 - DNA, 22 bp, Homo sapiens
taaacagcctcccctttcactc

SEQ ID NO: 7586368 - DNA, 22 bp, Homo sapiens
taaacagagagtgcagttatag

SEQ ID NO: 7586369 - DNA, 22 bp, Homo sapiens
taaacagagagtgcagttatag

SEQ ID NO: 7586370 - DNA, 22 bp, Homo sapiens
taaacagagagtgcagttatag

SEQ ID NO: 7586371 - DNA, 22 bp, Homo sapiens
taaacagagaagactttgagca

SEQ ID NO: 7586372 - DNA, 22 bp, Homo sapiens
taaacagagagtgcagttatag

SEQ ID NO: 7586373 - DNA, 22 bp, Homo sapiens
taaacagagtgctagttcacgg

SEQ ID NO: 7586374 - DNA, 22 bp, Homo sapiens
taaacagagtgctagttcacgg

SEQ ID NO: 7586375 - DNA, 22 bp, Homo sapiens
taaacagagatgcctgggtctg

SEQ ID NO: 7586376 - DNA, 21 bp, Homo sapiens
gttttcatgatagagtctgta

SEQ ID NO: 7586377 - DNA, 22 bp, Homo sapiens
taaacagagatgcctgggtctg

SEQ ID NO: 7586378 - DNA, 22 bp, Homo sapiens
taaacagagatgcctgggtctg

SEQ ID NO: 7586379 - DNA, 22 bp, Homo sapiens
taaacagagatgcctgggtctg

SEQ ID NO: 7586380 - DNA, 22 bp, Homo sapiens
taaacatctgtagccttcagtc

SEQ ID NO: 7586381 - DNA, 22 bp, Homo sapiens
taaacatctgaatcctgcttcc

SEQ ID NO: 7586382 - DNA, 22 bp, Homo sapiens
taaacatctgaatcctgcttcc

SEQ ID NO: 7586383 - DNA, 22 bp, Homo sapiens
taaacatctgtcatgtgtttat

SEQ ID NO: 7586384 - DNA, 22 bp, Homo sapiens
taaacatctgtcatgtgtttat

SEQ ID NO: 7586385 - DNA, 22 bp, Homo sapiens
taaacatctgtcatgtgtttat

SEQ ID NO: 7586386 - DNA, 22 bp, Homo sapiens
taaacatctgtcatgtgtttat

SEQ ID NO: 7586387 - DNA, 22 bp, Homo sapiens
taaacatgcccagtgacaggga

SEQ ID NO: 7586388 - DNA, 22 bp, Homo sapiens
taaacatggattctgatcacag

SEQ ID NO: 7586389 - DNA, 22 bp, Homo sapiens
taaacatggattctgatcacag

SEQ ID NO: 7586390 - DNA, 22 bp, Homo sapiens
taaacatggattctgatcacag

SEQ ID NO: 7586391 - DNA, 22 bp, Homo sapiens
taaacatggctgtttcagttat

SEQ ID NO: 7586392 - DNA, 22 bp, Homo sapiens
taaacatggctgtttcagttat

SEQ ID NO: 7586393 - DNA, 22 bp, Homo sapiens
taaacatggctgtttcagttat

SEQ ID NO: 7586394 - DNA, 22 bp, Homo sapiens
taaacatggctgtttcagttat

SEQ ID NO: 7586395 - DNA, 22 bp, Homo sapiens
taaacatggattctgatcacag

SEQ ID NO: 7586396 - DNA, 22 bp, Homo sapiens
taaacatgttgacatcttacct

SEQ ID NO: 7586397 - DNA, 22 bp, Homo sapiens
taaacatgtgagtgtgcatata

SEQ ID NO: 7586398 - DNA, 22 bp, Homo sapiens
taaacatgtgagtgtgcatata

SEQ ID NO: 7586399 - DNA, 22 bp, Homo sapiens
taaacatggctgtttcagttat

SEQ ID NO: 7586400 - DNA, 22 bp, Homo sapiens
taaacatgtgagtgtgcatata

SEQ ID NO: 7586401 - DNA, 22 bp, Homo sapiens
taaacatcagtacaaagactaa

SEQ ID NO: 7586402 - DNA, 22 bp, Homo sapiens
taaacatctgaatcctgcttcc

SEQ ID NO: 7586403 - DNA, 22 bp, Homo sapiens
taaacatcagtacaaagactaa

SEQ ID NO: 7586404 - DNA, 22 bp, Homo sapiens
taaacatcagtacaaagactaa

SEQ ID NO: 7586405 - DNA, 22 bp, Homo sapiens
taaacatcaccttctgcagttg

SEQ ID NO: 7586406 - DNA, 21 bp, Homo sapiens
taaacataaccttgtatggct

SEQ ID NO: 7586407 - DNA, 21 bp, Homo sapiens
taaacataaccttgtatggct

SEQ ID NO: 7586408 - DNA, 22 bp, Homo sapiens
taaacagttaacatgccagaat

SEQ ID NO: 7586409 - DNA, 22 bp, Homo sapiens
taaacagtgatacgttccagct

SEQ ID NO: 7586410 - DNA, 20 bp, Homo sapiens
taaacagtatttactaggag

SEQ ID NO: 7586411 - DNA, 20 bp, Homo sapiens
taaacagtatttactaggag

SEQ ID NO: 7586412 - DNA, 22 bp, Homo sapiens
taaacaggagttgaagcagtaa

SEQ ID NO: 7586413 - DNA, 22 bp, Homo sapiens
taaacagctactgtgtcaaagg

SEQ ID NO: 7586414 - DNA, 22 bp, Homo sapiens
taaacagctactgtgtcaaagg

SEQ ID NO: 7586415 - DNA, 22 bp, Homo sapiens
taaacagctactgtgtcaaagg

SEQ ID NO: 7586416 - DNA, 21 bp, Homo sapiens
taaagaagatgaatgtgatca

SEQ ID NO: 7586417 - DNA, 21 bp, Homo sapiens
taaagaagatgaatgtgatca

SEQ ID NO: 7586418 - DNA, 21 bp, Homo sapiens
taaagaagatgaatgtgatca

SEQ ID NO: 7586419 - DNA, 21 bp, Homo sapiens
taaagaagatgaatgtgatca

SEQ ID NO: 7586420 - DNA, 21 bp, Homo sapiens
taaagaagatgaatgtgatca

SEQ ID NO: 7586421 - DNA, 21 bp, Homo sapiens
taaagaagatgaatgtgatca

SEQ ID NO: 7586422 - DNA, 22 bp, Homo sapiens
taaagaacacagggaatagcac

SEQ ID NO: 7586423 - DNA, 22 bp, Homo sapiens
taaagaacacagggaatagcac

SEQ ID NO: 7586424 - DNA, 22 bp, Homo sapiens
taaactgtggaatgttctcttt

SEQ ID NO: 7586425 - DNA, 22 bp, Homo sapiens
taaactgtgtaatatgatgtct

SEQ ID NO: 7586426 - DNA, 22 bp, Homo sapiens
taaagaacacagggaatagcac

SEQ ID NO: 7586427 - DNA, 22 bp, Homo sapiens
taaagaacacagggaatagcac

SEQ ID NO: 7586428 - DNA, 22 bp, Homo sapiens
taaacatgttgacatcttacct

SEQ ID NO: 7586429 - DNA, 22 bp, Homo sapiens
taaacatgttgacatcttacct

SEQ ID NO: 7586430 - DNA, 22 bp, Homo sapiens
taaacatgttgacatcttacct

SEQ ID NO: 7586431 - DNA, 22 bp, Homo sapiens
taaactgcttctctcagtctgt

SEQ ID NO: 7586432 - DNA, 22 bp, Homo sapiens
taaactgtgaaaggcttaacat

SEQ ID NO: 7586433 - DNA, 22 bp, Homo sapiens
taaactgtggaatgttctcttt

SEQ ID NO: 7586434 - DNA, 22 bp, Homo sapiens
taaactgtggaatgttctcttt

SEQ ID NO: 7586435 - DNA, 22 bp, Homo sapiens
taaactgtagctctcgtaattc

SEQ ID NO: 7586436 - DNA, 22 bp, Homo sapiens
taaagacaaatgacattacggc

SEQ ID NO: 7586437 - DNA, 22 bp, Homo sapiens
taaagacaaatgacattacggc

SEQ ID NO: 7586438 - DNA, 22 bp, Homo sapiens
taaagacaaacccactagggtt

SEQ ID NO: 7586439 - DNA, 22 bp, Homo sapiens
taaagacaaacccactagggtt

SEQ ID NO: 7586440 - DNA, 22 bp, Homo sapiens
taaagacaaatgacattacggc

SEQ ID NO: 7586441 - DNA, 22 bp, Homo sapiens
taaagacaaatgacattacggc

SEQ ID NO: 7586442 - DNA, 22 bp, Homo sapiens
taaagacaataggaaagttgtt

SEQ ID NO: 7586443 - DNA, 22 bp, Homo sapiens
taaagacaataggaaagttgtt

SEQ ID NO: 7586444 - DNA, 22 bp, Homo sapiens
taaagacaataggaaagttgtt

SEQ ID NO: 7586445 - DNA, 22 bp, Homo sapiens
taaagacaataggaaagttgtt

SEQ ID NO: 7586446 - DNA, 22 bp, Homo sapiens
taaagaataatacccatggagc

SEQ ID NO: 7586447 - DNA, 22 bp, Homo sapiens
taaagaatagatgggtagggag

SEQ ID NO: 7586448 - DNA, 22 bp, Homo sapiens
taaagaatagatgggtagggag

SEQ ID NO: 7586449 - DNA, 22 bp, Homo sapiens
taaagaataatacccatggagc

SEQ ID NO: 7586450 - DNA, 22 bp, Homo sapiens
taaagacaaacccactagggtt

SEQ ID NO: 7586451 - DNA, 22 bp, Homo sapiens
taaagacaaacccactagggtt

SEQ ID NO: 7586452 - DNA, 22 bp, Homo sapiens
taaagtgttgtacaaatgtatg

SEQ ID NO: 7586453 - DNA, 22 bp, Homo sapiens
taaagtgttgtacaaatgtatg

SEQ ID NO: 7586454 - DNA, 22 bp, Homo sapiens
taaagtgttgtacaaatgtatg

SEQ ID NO: 7586455 - DNA, 22 bp, Homo sapiens
taaagtgttgtacaaatgtatg

SEQ ID NO: 7586456 - DNA, 22 bp, Homo sapiens
taaagtgttagagtctagcttc

SEQ ID NO: 7586457 - DNA, 22 bp, Homo sapiens
taaagtgttagagtctagcttc

SEQ ID NO: 7586458 - DNA, 22 bp, Homo sapiens
taaagtgtttgtatgcagataa

SEQ ID NO: 7586459 - DNA, 22 bp, Homo sapiens
taaagtgtttgtatgcagataa

SEQ ID NO: 7586460 - DNA, 22 bp, Homo sapiens
taaagtgttgtacaaatgtatg

SEQ ID NO: 7586461 - DNA, 22 bp, Homo sapiens
taaagtgtttgtatgcagataa

SEQ ID NO: 7586462 - DNA, 22 bp, Homo sapiens
taaagttataaattacctgtca

SEQ ID NO: 7586463 - DNA, 22 bp, Homo sapiens
taaagttataaattacctgtca

SEQ ID NO: 7586464 - DNA, 22 bp, Homo sapiens
taaagtgtgtatatacatatgg

SEQ ID NO: 7586465 - DNA, 22 bp, Homo sapiens
taaagtgtgtatatacatatgg

SEQ ID NO: 7586466 - DNA, 22 bp, Homo sapiens
taaagtgtgtatatacatatgg

SEQ ID NO: 7586467 - DNA, 22 bp, Homo sapiens
taaagtgtggatatgattagta

SEQ ID NO: 7586468 - DNA, 22 bp, Homo sapiens
taaagtgtggatatgattagta

SEQ ID NO: 7586469 - DNA, 22 bp, Homo sapiens
taaagtgtgtgggttctaaatt

SEQ ID NO: 7586470 - DNA, 22 bp, Homo sapiens
taaagtgtgtatatacatatgg

SEQ ID NO: 7586471 - DNA, 22 bp, Homo sapiens
taaagtgtgtatatacatatgg

SEQ ID NO: 7586472 - DNA, 22 bp, Homo sapiens
taaagtgtgtatatacatatgg

SEQ ID NO: 7586473 - DNA, 22 bp, Homo sapiens
taaagacactggttttaatcat

SEQ ID NO: 7586474 - DNA, 22 bp, Homo sapiens
taaagtgtggacagtatctata

SEQ ID NO: 7586475 - DNA, 22 bp, Homo sapiens
taaagtgtggacagtatctata

SEQ ID NO: 7586476 - DNA, 22 bp, Homo sapiens
taaagtgtggacagtatctata

SEQ ID NO: 7586477 - DNA, 22 bp, Homo sapiens
taaagtgtggacagtatctata

SEQ ID NO: 7586478 - DNA, 22 bp, Homo sapiens
taaagacactggttttaatcat

SEQ ID NO: 7586479 - DNA, 22 bp, Homo sapiens
taaagtgtgcatggtcaaatat

SEQ ID NO: 7586480 - DNA, 22 bp, Homo sapiens
taaagacacccagggagggact

SEQ ID NO: 7586481 - DNA, 22 bp, Homo sapiens
taaagacaatttcgagctgtag

SEQ ID NO: 7586482 - DNA, 22 bp, Homo sapiens
taaagacaataggaaagttgtt

SEQ ID NO: 7586483 - DNA, 22 bp, Homo sapiens
taaagacaataggaaagttgtt

SEQ ID NO: 7586484 - DNA, 22 bp, Homo sapiens
taaagacaatttcgagctgtag

SEQ ID NO: 7586485 - DNA, 22 bp, Homo sapiens
taaagacaatttcgagctgtag

SEQ ID NO: 7586486 - DNA, 22 bp, Homo sapiens
taaagacacccagggagggact

SEQ ID NO: 7586487 - DNA, 22 bp, Homo sapiens
taaagacacccagggagggact

SEQ ID NO: 7586488 - DNA, 22 bp, Homo sapiens
taaagttcagtgcatgaatgtg

SEQ ID NO: 7586489 - DNA, 22 bp, Homo sapiens
taaagttcagtgcatgaatgtg

SEQ ID NO: 7586490 - DNA, 22 bp, Homo sapiens
taaagtgtttgtatgcagataa

SEQ ID NO: 7586491 - DNA, 22 bp, Homo sapiens
taaagttataaattacctgtca

SEQ ID NO: 7586492 - DNA, 22 bp, Homo sapiens
taaagttctggtgagaggtaag

SEQ ID NO: 7586493 - DNA, 22 bp, Homo sapiens
taaagttcttagaacaaggcct

SEQ ID NO: 7586494 - DNA, 22 bp, Homo sapiens
taaagttggacctgattttatt

SEQ ID NO: 7586495 - DNA, 22 bp, Homo sapiens
taaagtttattggcaccaccat

SEQ ID NO: 7586496 - DNA, 22 bp, Homo sapiens
taaagtttattggcaccaccat

SEQ ID NO: 7586497 - DNA, 22 bp, Homo sapiens
taaagtttattggcaccaccat

SEQ ID NO: 7586498 - DNA, 22 bp, Homo sapiens
taaagtttatttgaacatctct

SEQ ID NO: 7586499 - DNA, 22 bp, Homo sapiens
taaagtttattggcaccaccat

SEQ ID NO: 7586500 - DNA, 22 bp, Homo sapiens
taaagtttatttgaacatctct

SEQ ID NO: 7586501 - DNA, 22 bp, Homo sapiens
taaagtttatttgaacatctct

SEQ ID NO: 7586502 - DNA, 22 bp, Homo sapiens
taaagtttatttgaacatctct

SEQ ID NO: 7586503 - DNA, 22 bp, Homo sapiens
taaagtttatttgaacatctct

SEQ ID NO: 7586504 - DNA, 22 bp, Homo sapiens
taaagtttatttgaacatctct

SEQ ID NO: 7586505 - DNA, 22 bp, Homo sapiens
taaagtttatttgaacatctct

SEQ ID NO: 7586506 - DNA, 22 bp, Homo sapiens
taaagtttatttgaacatctct

SEQ ID NO: 7586507 - DNA, 22 bp, Homo sapiens
taaagtttggcagacaataaca

SEQ ID NO: 7586508 - DNA, 22 bp, Homo sapiens
taaagtttggcagacaataaca

SEQ ID NO: 7586509 - DNA, 22 bp, Homo sapiens
taaagtttggcagacaataaca

SEQ ID NO: 7586510 - DNA, 22 bp, Homo sapiens
taaagtttggcagacaataaca

SEQ ID NO: 7586511 - DNA, 22 bp, Homo sapiens
taaagtttggcagacaataaca

SEQ ID NO: 7586512 - DNA, 22 bp, Homo sapiens
taaataagtcactgaccattta

SEQ ID NO: 7586513 - DNA, 22 bp, Homo sapiens
taaataagtcactgaccattta

SEQ ID NO: 7586514 - DNA, 22 bp, Homo sapiens
taaataagtcactgaccattta

SEQ ID NO: 7586515 - DNA, 22 bp, Homo sapiens
taaataagttcttcattgtttg

SEQ ID NO: 7586516 - DNA, 22 bp, Homo sapiens
taaataagtcactgaccattta

SEQ ID NO: 7586517 - DNA, 22 bp, Homo sapiens
taaataagtcactgaccattta

SEQ ID NO: 7586518 - DNA, 22 bp, Homo sapiens
taaataagtcactgaccattta

SEQ ID NO: 7586519 - DNA, 22 bp, Homo sapiens
taaagtttgtagcaattgatat

SEQ ID NO: 7586520 - DNA, 22 bp, Homo sapiens
taaagtttgtagcaattgatat

SEQ ID NO: 7586521 - DNA, 22 bp, Homo sapiens
taaagtttggcagacaataaca

SEQ ID NO: 7586522 - DNA, 22 bp, Homo sapiens
taaagtttggcagacaataaca

SEQ ID NO: 7586523 - DNA, 22 bp, Homo sapiens
taaagtttggcagacaataaca

SEQ ID NO: 7586524 - DNA, 22 bp, Homo sapiens
taaagtttgtagcaattgatat

SEQ ID NO: 7586525 - DNA, 22 bp, Homo sapiens
taaagtttgtagcaattgatat

SEQ ID NO: 7586526 - DNA, 22 bp, Homo sapiens
taaagtttggcagacaataaca

SEQ ID NO: 7586527 - DNA, 22 bp, Homo sapiens
taaagtttgtagcaattgatat

SEQ ID NO: 7586528 - DNA, 17 bp, Homo sapiens
taaatacacaagggtat

SEQ ID NO: 7586529 - DNA, 22 bp, Homo sapiens
taaatacagtcatttgagccat

SEQ ID NO: 7586530 - DNA, 22 bp, Homo sapiens
taaatacagtcatttgagccat

SEQ ID NO: 7586531 - DNA, 22 bp, Homo sapiens
taaatacagtcatttgagccat

SEQ ID NO: 7586532 - DNA, 22 bp, Homo sapiens
taaatacagtcatttgagccat

SEQ ID NO: 7586533 - DNA, 22 bp, Homo sapiens
taaatacagtcatttgagccat

SEQ ID NO: 7586534 - DNA, 22 bp, Homo sapiens
taaatacagtcatttgagccat

SEQ ID NO: 7586535 - DNA, 22 bp, Homo sapiens
taaatacagtcatttgagccat

SEQ ID NO: 7586536 - DNA, 17 bp, Homo sapiens
taaatacacaagggtat

SEQ ID NO: 7586537 - DNA, 17 bp, Homo sapiens
taaatacacaagggtat

SEQ ID NO: 7586538 - DNA, 17 bp, Homo sapiens
taaatacacaagggtat

SEQ ID NO: 7586539 - DNA, 17 bp, Homo sapiens
taaatacacaagggtat

SEQ ID NO: 7586540 - DNA, 17 bp, Homo sapiens
taaatacacaagggtat

SEQ ID NO: 7586541 - DNA, 17 bp, Homo sapiens
taaatacacaagggtat

SEQ ID NO: 7586542 - DNA, 17 bp, Homo sapiens
taaatacacaagggtat

SEQ ID NO: 7586543 - DNA, 21 bp, Homo sapiens
taaataataagttgctgagat

SEQ ID NO: 7586544 - DNA, 22 bp, Homo sapiens
taaataagttcttcattgtttg

SEQ ID NO: 7586545 - DNA, 22 bp, Homo sapiens
taaataagttcttcattgtttg

SEQ ID NO: 7586546 - DNA, 22 bp, Homo sapiens
taaataagttcttcattgtttg

SEQ ID NO: 7586547 - DNA, 22 bp, Homo sapiens
taaataagttcttcattgtttg

SEQ ID NO: 7586548 - DNA, 21 bp, Homo sapiens
taaataataagttgctgagat

SEQ ID NO: 7586549 - DNA, 21 bp, Homo sapiens
taaataataagttgctgagat

SEQ ID NO: 7586550 - DNA, 22 bp, Homo sapiens
taaataagttcttcattgtttg

SEQ ID NO: 7586551 - DNA, 22 bp, Homo sapiens
taaataagttcttcattgtttg

SEQ ID NO: 7586552 - DNA, 22 bp, Homo sapiens
taaataagttcttcattgtttg

SEQ ID NO: 7586553 - DNA, 22 bp, Homo sapiens
taaataagttcttcattgtttg

SEQ ID NO: 7586554 - DNA, 21 bp, Homo sapiens
taaataataagttgctgagat

SEQ ID NO: 7586555 - DNA, 21 bp, Homo sapiens
taaataataagttgctgagat

SEQ ID NO: 7586556 - DNA, 21 bp, Homo sapiens
taaataataagttgctgagat

SEQ ID NO: 7586557 - DNA, 21 bp, Homo sapiens
taaataataagttgctgagat

SEQ ID NO: 7586558 - DNA, 21 bp, Homo sapiens
taaataataagttgctgagat

SEQ ID NO: 7586559 - DNA, 21 bp, Homo sapiens
taaataataagttgctgagat

SEQ ID NO: 7586560 - DNA, 21 bp, Homo sapiens
taaataataagttgctgagat

SEQ ID NO: 7586561 - DNA, 22 bp, Homo sapiens
taacacatggttagtacacaat

SEQ ID NO: 7586562 - DNA, 22 bp, Homo sapiens
taacacatggttctgtcaggaa

SEQ ID NO: 7586563 - DNA, 22 bp, Homo sapiens
taacacatggttctgtcaggaa

SEQ ID NO: 7586564 - DNA, 22 bp, Homo sapiens
taacacatggttctgtcaggaa

SEQ ID NO: 7586565 - DNA, 22 bp, Homo sapiens
taacacatgtctgggatgtgaa

SEQ ID NO: 7586566 - DNA, 22 bp, Homo sapiens
taacacattagttctcctagat

SEQ ID NO: 7586567 - DNA, 21 bp, Homo sapiens
taacacattttggtactttgg

SEQ ID NO: 7586568 - DNA, 22 bp, Homo sapiens
taacacattttaagccatttta

SEQ ID NO: 7586569 - DNA, 22 bp, Homo sapiens
taacacattttcctcatacgga

SEQ ID NO: 7586570 - DNA, 22 bp, Homo sapiens
taacacattttcctcatacgga

SEQ ID NO: 7586571 - DNA, 22 bp, Homo sapiens
taacacattttcctcatacgga

SEQ ID NO: 7586572 - DNA, 22 bp, Homo sapiens
taactgtaatataaatatgagt

SEQ ID NO: 7586573 - DNA, 22 bp, Homo sapiens
taactgtaatataaatatgagt

SEQ ID NO: 7586574 - DNA, 22 bp, Homo sapiens
taactgtaatataaatatgagt

SEQ ID NO: 7586575 - DNA, 19 bp, Homo sapiens
taactggttaaaaagcttg

SEQ ID NO: 7586576 - DNA, 22 bp, Homo sapiens
taactggtttggctcagggtct

SEQ ID NO: 7586577 - DNA, 18 bp, Homo sapiens
taactggtttcttcccat

SEQ ID NO: 7586578 - DNA, 22 bp, Homo sapiens
taactggtttcatatcatttcc

SEQ ID NO: 7586579 - DNA, 22 bp, Homo sapiens
taactggttaagggtgaaatcc

SEQ ID NO: 7586580 - DNA, 19 bp, Homo sapiens
taactggttaaaaagcttg

SEQ ID NO: 7586581 - DNA, 19 bp, Homo sapiens
taactggtgccttcagtca

SEQ ID NO: 7586582 - DNA, 22 bp, Homo sapiens
taactggtgagttggttgagtg

SEQ ID NO: 7586583 - DNA, 22 bp, Homo sapiens
taactggtgagtaggatttata

SEQ ID NO: 7586584 - DNA, 22 bp, Homo sapiens
taactggtcctgaacagcccag

SEQ ID NO: 7586585 - DNA, 22 bp, Homo sapiens
taactggtatatcagtgtacac

SEQ ID NO: 7586586 - DNA, 22 bp, Homo sapiens
taactggtcctcggatgttgtg

SEQ ID NO: 7586587 - DNA, 22 bp, Homo sapiens
taactggtatatcagtgtacac

SEQ ID NO: 7586588 - DNA, 22 bp, Homo sapiens
taacacatagatattttaactt

SEQ ID NO: 7586589 - DNA, 22 bp, Homo sapiens
taacacatagatattttaactt

SEQ ID NO: 7586590 - DNA, 22 bp, Homo sapiens
taacacatatctacaacatgtg

SEQ ID NO: 7586591 - DNA, 22 bp, Homo sapiens
taacacatatctacaacatgtg

SEQ ID NO: 7586592 - DNA, 22 bp, Homo sapiens
taacacataagctgagaccatg

SEQ ID NO: 7586593 - DNA, 22 bp, Homo sapiens
taacacagttctctgttgcaca

SEQ ID NO: 7586594 - DNA, 22 bp, Homo sapiens
taacacagtgtcctcagaaaca

SEQ ID NO: 7586595 - DNA, 22 bp, Homo sapiens
taacacagtgtctaccattatt

SEQ ID NO: 7586596 - DNA, 22 bp, Homo sapiens
taacacagttctctgttgcaca

SEQ ID NO: 7586597 - DNA, 22 bp, Homo sapiens
taacacagttctctgttgcaca

SEQ ID NO: 7586598 - DNA, 22 bp, Homo sapiens
taacacagtgtcctcagaaaca

SEQ ID NO: 7586599 - DNA, 22 bp, Homo sapiens
taacacagagttttaaatgtgg

SEQ ID NO: 7586600 - DNA, 22 bp, Homo sapiens
taacacagtgtcctcagaaaca

SEQ ID NO: 7586601 - DNA, 22 bp, Homo sapiens
taacacagtgtcctcagaaaca

SEQ ID NO: 7586602 - DNA, 22 bp, Homo sapiens
taacacatatctacaacatgtg

SEQ ID NO: 7586603 - DNA, 22 bp, Homo sapiens
taacacatatctacaacatgtg

SEQ ID NO: 7586604 - DNA, 22 bp, Homo sapiens
taacacatatttcaagagtagt

SEQ ID NO: 7586605 - DNA, 22 bp, Homo sapiens
taacacatatttcaagagtagt

SEQ ID NO: 7586606 - DNA, 22 bp, Homo sapiens
taacacatatttcaagagtagt

SEQ ID NO: 7586607 - DNA, 22 bp, Homo sapiens
taacacatatctacaacatgtg

SEQ ID NO: 7586608 - DNA, 22 bp, Homo sapiens
taacacatatttcaagagtagt

SEQ ID NO: 7586609 - DNA, 22 bp, Homo sapiens
taacacatatttcaagagtagt

SEQ ID NO: 7586610 - DNA, 22 bp, Homo sapiens
taacacatatttcaagagtagt

SEQ ID NO: 7586611 - DNA, 22 bp, Homo sapiens
taacacatggttagtacacaat

SEQ ID NO: 7586612 - DNA, 22 bp, Homo sapiens
taacacatggttagtacacaat

SEQ ID NO: 7586613 - DNA, 22 bp, Homo sapiens
taacacatggttagtacacaat

SEQ ID NO: 7586614 - DNA, 22 bp, Homo sapiens
taacacatggttagtacacaat

SEQ ID NO: 7586615 - DNA, 22 bp, Homo sapiens
taacacatatttgcagtaagca

SEQ ID NO: 7586616 - DNA, 22 bp, Homo sapiens
taacacatgaaagcaccttctt

SEQ ID NO: 7586617 - DNA, 22 bp, Homo sapiens
taaatacagtcatttgagccat

SEQ ID NO: 7586618 - DNA, 22 bp, Homo sapiens
taaatacagtcatttgagccat

SEQ ID NO: 7586619 - DNA, 22 bp, Homo sapiens
taaatactgagttggagttggc

SEQ ID NO: 7586620 - DNA, 22 bp, Homo sapiens
taaatacagtcatttgagccat

SEQ ID NO: 7586621 - DNA, 22 bp, Homo sapiens
taaatacagtcatttgagccat

SEQ ID NO: 7586622 - DNA, 22 bp, Homo sapiens
taaatactgagttggagttggc

SEQ ID NO: 7586623 - DNA, 22 bp, Homo sapiens
taaatacttagttttgtgtcta

SEQ ID NO: 7586624 - DNA, 22 bp, Homo sapiens
taaatacttagttttgtgtcta

SEQ ID NO: 7586625 - DNA, 22 bp, Homo sapiens
taaatacttagttttgtgtcta

SEQ ID NO: 7586626 - DNA, 22 bp, Homo sapiens
taaatacttagttttgtgtcta

SEQ ID NO: 7586627 - DNA, 22 bp, Homo sapiens
taaatacttagttttgtgtcta

SEQ ID NO: 7586628 - DNA, 22 bp, Homo sapiens
taaatactttacaggatgtctc

SEQ ID NO: 7586629 - DNA, 22 bp, Homo sapiens
taaatactttacaggatgtctc

SEQ ID NO: 7586630 - DNA, 22 bp, Homo sapiens
taaatttttgttaacagcctct

SEQ ID NO: 7586631 - DNA, 22 bp, Homo sapiens
taacaaactggaaattgacatt

SEQ ID NO: 7586632 - DNA, 22 bp, Homo sapiens
taacaaactggaaattgacatt

SEQ ID NO: 7586633 - DNA, 22 bp, Homo sapiens
taaatttttgttaacagcctct

SEQ ID NO: 7586634 - DNA, 22 bp, Homo sapiens
taacaaactggaaattgacatt

SEQ ID NO: 7586635 - DNA, 22 bp, Homo sapiens
taacaaactggaaattgacatt

SEQ ID NO: 7586636 - DNA, 22 bp, Homo sapiens
taaatttttgttaacagcctct

SEQ ID NO: 7586637 - DNA, 22 bp, Homo sapiens
taacaaactggaaattgacatt

SEQ ID NO: 7586638 - DNA, 22 bp, Homo sapiens
taacaaactggaaattgacatt

SEQ ID NO: 7586639 - DNA, 22 bp, Homo sapiens
taacaaactggaaattgacatt

SEQ ID NO: 7586640 - DNA, 22 bp, Homo sapiens
taacaatagtgtttgctagtca

SEQ ID NO: 7586641 - DNA, 22 bp, Homo sapiens
taacaatagtgtttgctagtca

SEQ ID NO: 7586642 - DNA, 22 bp, Homo sapiens
taacaatacccattctaattac

SEQ ID NO: 7586643 - DNA, 22 bp, Homo sapiens
taacaatagtgtttgctagtca

SEQ ID NO: 7586644 - DNA, 22 bp, Homo sapiens
taacaatagtgtttgctagtca

SEQ ID NO: 7586645 - DNA, 21 bp, Homo sapiens
taacaaagacttctggtcagg

SEQ ID NO: 7586646 - DNA, 22 bp, Homo sapiens
taacaaaggttgccaaactaag

SEQ ID NO: 7586647 - DNA, 22 bp, Homo sapiens
taacaaaggttgccaaactaag

SEQ ID NO: 7586648 - DNA, 22 bp, Homo sapiens
taacaaaggttgccaaactaag

SEQ ID NO: 7586649 - DNA, 22 bp, Homo sapiens
taacaatacccattctaattac

SEQ ID NO: 7586650 - DNA, 22 bp, Homo sapiens
taacaattctcaaaagagggga

SEQ ID NO: 7586651 - DNA, 22 bp, Homo sapiens
taacaatggttttgctgataat

SEQ ID NO: 7586652 - DNA, 22 bp, Homo sapiens
taacaatggttttgctgataat

SEQ ID NO: 7586653 - DNA, 22 bp, Homo sapiens
taacaatggttttgctgataat

SEQ ID NO: 7586654 - DNA, 22 bp, Homo sapiens
taacaatgggaaggactgatga

SEQ ID NO: 7586655 - DNA, 22 bp, Homo sapiens
taacaatgggaaggactgatga

SEQ ID NO: 7586656 - DNA, 22 bp, Homo sapiens
taacaatgggaaggactgatga

SEQ ID NO: 7586657 - DNA, 22 bp, Homo sapiens
taacaatggagttttgagaaag

SEQ ID NO: 7586658 - DNA, 22 bp, Homo sapiens
taacaatggagttttgagaaag

SEQ ID NO: 7586659 - DNA, 22 bp, Homo sapiens
taacaatggagttttgagaaag

SEQ ID NO: 7586660 - DNA, 23 bp, Homo sapiens
taacaatggactcctcttagcta

SEQ ID NO: 7586661 - DNA, 23 bp, Homo sapiens
taacaatggactcctcttagcta

SEQ ID NO: 7586662 - DNA, 22 bp, Homo sapiens
taacaatgcaaaatgaatttag

SEQ ID NO: 7586663 - DNA, 22 bp, Homo sapiens
taacaatagtgtttgctagtca

SEQ ID NO: 7586664 - DNA, 22 bp, Homo sapiens
taacaatagtgtttgctagtca

SEQ ID NO: 7586665 - DNA, 22 bp, Homo sapiens
taacaatgattagtgactacag

SEQ ID NO: 7586666 - DNA, 21 bp, Homo sapiens
taacaatctctacttctcatt

SEQ ID NO: 7586667 - DNA, 22 bp, Homo sapiens
taacaatgcaaaatgaatttag

SEQ ID NO: 7586668 - DNA, 22 bp, Homo sapiens
taacaatgattagtgactacag

SEQ ID NO: 7586669 - DNA, 21 bp, Homo sapiens
taacaatctctacttctcatt

SEQ ID NO: 7586670 - DNA, 22 bp, Homo sapiens
taacaatgattagtgactacag

SEQ ID NO: 7586671 - DNA, 22 bp, Homo sapiens
taacaatgcaaaatgaatttag

SEQ ID NO: 7586672 - DNA, 22 bp, Homo sapiens
taacaatgcaaaatgaatttag

SEQ ID NO: 7586673 - DNA, 22 bp, Homo sapiens
taacaatgcaaaatgaatttag

SEQ ID NO: 7586674 - DNA, 18 bp, Homo sapiens
taacaatcctgagtgtct

SEQ ID NO: 7586675 - DNA, 22 bp, Homo sapiens
taacaatttgcttcatttgttt

SEQ ID NO: 7586676 - DNA, 22 bp, Homo sapiens
taacaatttgcttcatttgttt

SEQ ID NO: 7586677 - DNA, 22 bp, Homo sapiens
taacaatttgcttcatttgttt

SEQ ID NO: 7586678 - DNA, 22 bp, Homo sapiens
taacaatttgcttcatttgttt

SEQ ID NO: 7586679 - DNA, 22 bp, Homo sapiens
taacaatttgcttcatttgttt

SEQ ID NO: 7586680 - DNA, 22 bp, Homo sapiens
taacaatttgcttcatttgttt

SEQ ID NO: 7586681 - DNA, 22 bp, Homo sapiens
taacacaaaagaatatgtgtgt

SEQ ID NO: 7586682 - DNA, 22 bp, Homo sapiens
taacacaaaagaatatgtgtgt

SEQ ID NO: 7586683 - DNA, 22 bp, Homo sapiens
taacacaaaagaatatgtgtgt

SEQ ID NO: 7586684 - DNA, 22 bp, Homo sapiens
taacacactgaaggtgagatgg

SEQ ID NO: 7586685 - DNA, 22 bp, Homo sapiens
taacacagacagccactagtaa

SEQ ID NO: 7586686 - DNA, 22 bp, Homo sapiens
taacacagacagccactagtaa

SEQ ID NO: 7586687 - DNA, 22 bp, Homo sapiens
taacacagagttttaaatgtgg

SEQ ID NO: 7586688 - DNA, 17 bp, Homo sapiens
taacacaggctcagaga

SEQ ID NO: 7586689 - DNA, 22 bp, Homo sapiens
taacacagagtaagtggtcaat

SEQ ID NO: 7586690 - DNA, 22 bp, Homo sapiens
taacacagagtaagtggtcaat

SEQ ID NO: 7586691 - DNA, 22 bp, Homo sapiens
taagataaggaacattctgtga

SEQ ID NO: 7586692 - DNA, 22 bp, Homo sapiens
taagataaggaacattctgtga

SEQ ID NO: 7586693 - DNA, 22 bp, Homo sapiens
taagataaggaacattctgtga

SEQ ID NO: 7586694 - DNA, 22 bp, Homo sapiens
taagataaggaacattctgtga

SEQ ID NO: 7586695 - DNA, 22 bp, Homo sapiens
taagataaggagagtgctagta

SEQ ID NO: 7586696 - DNA, 22 bp, Homo sapiens
taagataaggaacattctgtga

SEQ ID NO: 7586697 - DNA, 22 bp, Homo sapiens
taagataaggaacattctgtga

SEQ ID NO: 7586698 - DNA, 22 bp, Homo sapiens
taagataagtgggttgagatgg

SEQ ID NO: 7586699 - DNA, 22 bp, Homo sapiens
taagataataagtatgtctatg

SEQ ID NO: 7586700 - DNA, 22 bp, Homo sapiens
taagataataagtatgtctatg

SEQ ID NO: 7586701 - DNA, 22 bp, Homo sapiens
taagataataagtatgtctatg

SEQ ID NO: 7586702 - DNA, 22 bp, Homo sapiens
taagataataagtatgtctatg

SEQ ID NO: 7586703 - DNA, 22 bp, Homo sapiens
taagataataagtatgtctatg

SEQ ID NO: 7586704 - DNA, 22 bp, Homo sapiens
taagataatccattataatgtt

SEQ ID NO: 7586705 - DNA, 22 bp, Homo sapiens
taagataatccattataatgtt

SEQ ID NO: 7586706 - DNA, 22 bp, Homo sapiens
taagataataccatgggccagg

SEQ ID NO: 7586707 - DNA, 22 bp, Homo sapiens
taagataatccattataatgtt

SEQ ID NO: 7586708 - DNA, 22 bp, Homo sapiens
taagataataccatgggccagg

SEQ ID NO: 7586709 - DNA, 22 bp, Homo sapiens
taagaaatttagttatagaatg

SEQ ID NO: 7586710 - DNA, 22 bp, Homo sapiens
taagaaatttagttatagaatg

SEQ ID NO: 7586711 - DNA, 22 bp, Homo sapiens
taagaggcagcattcctcgcct

SEQ ID NO: 7586712 - DNA, 22 bp, Homo sapiens
taagaggcattagagacatagc

SEQ ID NO: 7586713 - DNA, 22 bp, Homo sapiens
taagaggcagcattcctcgcct

SEQ ID NO: 7586714 - DNA, 22 bp, Homo sapiens
taagagtaagtgattaagaaga

SEQ ID NO: 7586715 - DNA, 22 bp, Homo sapiens
taagagtaagtgattaagaaga

SEQ ID NO: 7586716 - DNA, 22 bp, Homo sapiens
taagagtaagtgattaagaaga

SEQ ID NO: 7586717 - DNA, 22 bp, Homo sapiens
taagagttgaaggagattttca

SEQ ID NO: 7586718 - DNA, 22 bp, Homo sapiens
taagagttagggctagcaatat

SEQ ID NO: 7586719 - DNA, 22 bp, Homo sapiens
taagagttgaaggagattttca

SEQ ID NO: 7586720 - DNA, 22 bp, Homo sapiens
taagataaggaacattctgtga

SEQ ID NO: 7586721 - DNA, 22 bp, Homo sapiens
taagataaggaacattctgtga

SEQ ID NO: 7586722 - DNA, 22 bp, Homo sapiens
taagagttactggtttagaacc

SEQ ID NO: 7586723 - DNA, 22 bp, Homo sapiens
taagagttagggctagcaatat

SEQ ID NO: 7586724 - DNA, 21 bp, Homo sapiens
taagagtaggctgattgcttc

SEQ ID NO: 7586725 - DNA, 22 bp, Homo sapiens
taagagtatctattaagtactt

SEQ ID NO: 7586726 - DNA, 22 bp, Homo sapiens
taagagttactggtttagaacc

SEQ ID NO: 7586727 - DNA, 23 bp, Homo sapiens
taagagtgaggtcataaattttc

SEQ ID NO: 7586728 - DNA, 22 bp, Homo sapiens
taagataatccattataatgtt

SEQ ID NO: 7586729 - DNA, 19 bp, Homo sapiens
taagatacccctctatttt

SEQ ID NO: 7586730 - DNA, 22 bp, Homo sapiens
taagataatccattataatgtt

SEQ ID NO: 7586731 - DNA, 22 bp, Homo sapiens
taagataagtgggttgagatgg

SEQ ID NO: 7586732 - DNA, 22 bp, Homo sapiens
taagataatccattataatgtt

SEQ ID NO: 7586733 - DNA, 22 bp, Homo sapiens
taagatatggtaggaagtttgg

SEQ ID NO: 7586734 - DNA, 22 bp, Homo sapiens
taagatagaactctgaggctac

SEQ ID NO: 7586735 - DNA, 22 bp, Homo sapiens
taagatattgagtggtaatttg

SEQ ID NO: 7586736 - DNA, 22 bp, Homo sapiens
taagatcagttcaaacatgtgt

SEQ ID NO: 7586737 - DNA, 22 bp, Homo sapiens
taagatagaactctgaggctac

SEQ ID NO: 7586738 - DNA, 22 bp, Homo sapiens
taagatcatgggaaatggacat

SEQ ID NO: 7586739 - DNA, 22 bp, Homo sapiens
taagatcagttcaaacatgtgt

SEQ ID NO: 7586740 - DNA, 22 bp, Homo sapiens
taagatgaaggctcacctagaa

SEQ ID NO: 7586741 - DNA, 22 bp, Homo sapiens
taagatgaccttataaagagca

SEQ ID NO: 7586742 - DNA, 20 bp, Homo sapiens
taagatgagctataagaagt

SEQ ID NO: 7586743 - DNA, 20 bp, Homo sapiens
taagatgagctataagaagt

SEQ ID NO: 7586744 - DNA, 22 bp, Homo sapiens
taagatgactacttaccactga

SEQ ID NO: 7586745 - DNA, 22 bp, Homo sapiens
taagatgaggtaggtaagactt

SEQ ID NO: 7586746 - DNA, 22 bp, Homo sapiens
taagatgaggtaggtaagactt

SEQ ID NO: 7586747 - DNA, 22 bp, Homo sapiens
taagatgatcaccaaatgctgg

SEQ ID NO: 7586748 - DNA, 22 bp, Homo sapiens
taagatgatcaccaaatgctgg

SEQ ID NO: 7586749 - DNA, 22 bp, Homo sapiens
taagatgggggaaagaaatagt

SEQ ID NO: 7586750 - DNA, 22 bp, Homo sapiens
taagatgggggaaagaaatagt

SEQ ID NO: 7586751 - DNA, 22 bp, Homo sapiens
taagatggcagatgagcttgtt

SEQ ID NO: 7586752 - DNA, 22 bp, Homo sapiens
taagatggcagatgagcttgtt

SEQ ID NO: 7586753 - DNA, 22 bp, Homo sapiens
taagatgcattataccacagag

SEQ ID NO: 7586754 - DNA, 22 bp, Homo sapiens
taagatgcattataccacagag

SEQ ID NO: 7586755 - DNA, 22 bp, Homo sapiens
taagatgggggaaagaaatagt

SEQ ID NO: 7586756 - DNA, 22 bp, Homo sapiens
taagatgggggaaagaaatagt

SEQ ID NO: 7586757 - DNA, 22 bp, Homo sapiens
taagatggttgtagatggactg

SEQ ID NO: 7586758 - DNA, 22 bp, Homo sapiens
taagatggttgtagatggactg

SEQ ID NO: 7586759 - DNA, 22 bp, Homo sapiens
taagatggtccagaagggaggc

SEQ ID NO: 7586760 - DNA, 22 bp, Homo sapiens
taagatgtaagatcagagcttg

SEQ ID NO: 7586761 - DNA, 22 bp, Homo sapiens
taagcaagatttattgaatttt

SEQ ID NO: 7586762 - DNA, 21 bp, Homo sapiens
taagcaaggaaagggcagccc

SEQ ID NO: 7586763 - DNA, 21 bp, Homo sapiens
taagcaaggaaagggcagccc

SEQ ID NO: 7586764 - DNA, 22 bp, Homo sapiens
taagcaagggtctctgtatcag

SEQ ID NO: 7586765 - DNA, 22 bp, Homo sapiens
taagcaagggtctctgtatcag

SEQ ID NO: 7586766 - DNA, 22 bp, Homo sapiens
taagcaagggtctctgtatcag

SEQ ID NO: 7586767 - DNA, 22 bp, Homo sapiens
taagcaagtggtagaaggacaa

SEQ ID NO: 7586768 - DNA, 22 bp, Homo sapiens
taagaaactaatgcaataagag

SEQ ID NO: 7586769 - DNA, 22 bp, Homo sapiens
taagaaactaatgcaataagag

SEQ ID NO: 7586770 - DNA, 22 bp, Homo sapiens
taagaaactaatgcaataagag

SEQ ID NO: 7586771 - DNA, 22 bp, Homo sapiens
taagaaactaatgcaataagag

SEQ ID NO: 7586772 - DNA, 22 bp, Homo sapiens
taagaaactatggagaagaact

SEQ ID NO: 7586773 - DNA, 22 bp, Homo sapiens
taagaaactaatgcaataagag

SEQ ID NO: 7586774 - DNA, 22 bp, Homo sapiens
taagaaactatggagaagaact

SEQ ID NO: 7586775 - DNA, 22 bp, Homo sapiens
taagaaactatggagaagaact

SEQ ID NO: 7586776 - DNA, 22 bp, Homo sapiens
taacttctggaaatgcatctgc

SEQ ID NO: 7586777 - DNA, 22 bp, Homo sapiens
taacttctgcacagaaaatttg

SEQ ID NO: 7586778 - DNA, 22 bp, Homo sapiens
taacttctgcacagaaaatttg

SEQ ID NO: 7586779 - DNA, 22 bp, Homo sapiens
taacttctttggtttaaagaga

SEQ ID NO: 7586780 - DNA, 22 bp, Homo sapiens
taagaaacccaggaatttctta

SEQ ID NO: 7586781 - DNA, 22 bp, Homo sapiens
taacttctttggtttaaagaga

SEQ ID NO: 7586782 - DNA, 22 bp, Homo sapiens
taagaaacttaactgggaacta

SEQ ID NO: 7586783 - DNA, 22 bp, Homo sapiens
taagaaacttaactgggaacta

SEQ ID NO: 7586784 - DNA, 22 bp, Homo sapiens
taagaaacttaactgggaacta

SEQ ID NO: 7586785 - DNA, 22 bp, Homo sapiens
taagaaactgtcacagtactat

SEQ ID NO: 7586786 - DNA, 22 bp, Homo sapiens
taagaaactgtcacagtactat

SEQ ID NO: 7586787 - DNA, 22 bp, Homo sapiens
taagaaactgtcacagtactat

SEQ ID NO: 7586788 - DNA, 22 bp, Homo sapiens
taagaaactgtcacagtactat

SEQ ID NO: 7586789 - DNA, 22 bp, Homo sapiens
taagaaactattgtctctgaac

SEQ ID NO: 7586790 - DNA, 22 bp, Homo sapiens
taagaaatttagttatagaatg

SEQ ID NO: 7586791 - DNA, 22 bp, Homo sapiens
taagaaatttagttatagaatg

SEQ ID NO: 7586792 - DNA, 22 bp, Homo sapiens
taagaaacttaactgggaacta

SEQ ID NO: 7586793 - DNA, 22 bp, Homo sapiens
taagaaatttagttatagaatg

SEQ ID NO: 7586794 - DNA, 22 bp, Homo sapiens
taagaaatttagttatagaatg

SEQ ID NO: 7586795 - DNA, 22 bp, Homo sapiens
taagaaatttagttatagaatg

SEQ ID NO: 7586796 - DNA, 22 bp, Homo sapiens
taagaaatttagttatagaatg

SEQ ID NO: 7586797 - DNA, 22 bp, Homo sapiens
taagaaatttagttatagaatg

SEQ ID NO: 7586798 - DNA, 22 bp, Homo sapiens
taagaaatttagttatagaatg

SEQ ID NO: 7586799 - DNA, 22 bp, Homo sapiens
taagaaatttagttatagaatg

SEQ ID NO: 7586800 - DNA, 22 bp, Homo sapiens
taactgtagtaattctagtttt

SEQ ID NO: 7586801 - DNA, 22 bp, Homo sapiens
taactgtagtaattctagtttt

SEQ ID NO: 7586802 - DNA, 22 bp, Homo sapiens
taactgtagctaaccgatgaga

SEQ ID NO: 7586803 - DNA, 22 bp, Homo sapiens
taactgtagctaaccgatgaga

SEQ ID NO: 7586804 - DNA, 22 bp, Homo sapiens
taactgtagtaattctagtttt

SEQ ID NO: 7586805 - DNA, 22 bp, Homo sapiens
taactgtagttataaagctatc

SEQ ID NO: 7586806 - DNA, 22 bp, Homo sapiens
taactgtagttataaagctatc

SEQ ID NO: 7586807 - DNA, 22 bp, Homo sapiens
taactgtagttataaagctatc

SEQ ID NO: 7586808 - DNA, 22 bp, Homo sapiens
taactgtacaactggttagtca

SEQ ID NO: 7586809 - DNA, 22 bp, Homo sapiens
taactgtacaactggttagtca

SEQ ID NO: 7586810 - DNA, 22 bp, Homo sapiens
taactgtacctagataacgaac

SEQ ID NO: 7586811 - DNA, 22 bp, Homo sapiens
taactgtacctagataacgaac

SEQ ID NO: 7586812 - DNA, 22 bp, Homo sapiens
taactgtacctagataacgaac

SEQ ID NO: 7586813 - DNA, 22 bp, Homo sapiens
taactgtagaacaaaatgggct

SEQ ID NO: 7586814 - DNA, 22 bp, Homo sapiens
taactgtattttaggtctcatt

SEQ ID NO: 7586815 - DNA, 22 bp, Homo sapiens
taactgtatattaaggtggccc

SEQ ID NO: 7586816 - DNA, 22 bp, Homo sapiens
taactgtatattaaggtggccc

SEQ ID NO: 7586817 - DNA, 22 bp, Homo sapiens
taactgtatttttctgagattc

SEQ ID NO: 7586818 - DNA, 22 bp, Homo sapiens
taactgtatttttctgagattc

SEQ ID NO: 7586819 - DNA, 22 bp, Homo sapiens
taactgtcacttctgcacatct

SEQ ID NO: 7586820 - DNA, 22 bp, Homo sapiens
taactgtatagcttggactaaa

SEQ ID NO: 7586821 - DNA, 22 bp, Homo sapiens
taactgtatagcttggactaaa

SEQ ID NO: 7586822 - DNA, 22 bp, Homo sapiens
taactgtatagcttggactaaa

SEQ ID NO: 7586823 - DNA, 22 bp, Homo sapiens
taacttcactggactcagcagc

SEQ ID NO: 7586824 - DNA, 22 bp, Homo sapiens
taacttcactggactcagcagc

SEQ ID NO: 7586825 - DNA, 22 bp, Homo sapiens
taacttcaagtctgtggatcag

SEQ ID NO: 7586826 - DNA, 22 bp, Homo sapiens
taacttcaagtctgtggatcag

SEQ ID NO: 7586827 - DNA, 22 bp, Homo sapiens
taacttctctgctatcatagga

SEQ ID NO: 7586828 - DNA, 22 bp, Homo sapiens
taacttctctgagcctcattcc

SEQ ID NO: 7586829 - DNA, 22 bp, Homo sapiens
taactgtgtgaacgtgatcatt

SEQ ID NO: 7586830 - DNA, 22 bp, Homo sapiens
taactgtttttgaaatatatct

SEQ ID NO: 7586831 - DNA, 22 bp, Homo sapiens
taacttagaagtttaattgtat

SEQ ID NO: 7586832 - DNA, 22 bp, Homo sapiens
taactgtttttgaaatatatct

SEQ ID NO: 7586833 - DNA, 22 bp, Homo sapiens
taactgtgtgaacgtgatcatt

SEQ ID NO: 7586834 - DNA, 22 bp, Homo sapiens
taactgttgtgcgggtctctgg

SEQ ID NO: 7586835 - DNA, 22 bp, Homo sapiens
taactgtgaagtaattgtggat

SEQ ID NO: 7586836 - DNA, 22 bp, Homo sapiens
gttccaaagtctctgagctgag

SEQ ID NO: 7586837 - DNA, 19 bp, Homo sapiens
gttccaaaggccagacctt

SEQ ID NO: 7586838 - DNA, 22 bp, Homo sapiens
gttccaaagtctctgagctgag

SEQ ID NO: 7586839 - DNA, 22 bp, Homo sapiens
gttccaaacaagtcataaagta

SEQ ID NO: 7586840 - DNA, 22 bp, Homo sapiens
gttccaaacaagtcataaagta

SEQ ID NO: 7586841 - DNA, 22 bp, Homo sapiens
gttccaaagcaaaggaggtgag

SEQ ID NO: 7586842 - DNA, 22 bp, Homo sapiens
gttccaaagcaaaggaggtgag

SEQ ID NO: 7586843 - DNA, 22 bp, Homo sapiens
gttccaaatttggatctttagg

SEQ ID NO: 7586844 - DNA, 22 bp, Homo sapiens
gttccaattccaaattccaagg

SEQ ID NO: 7586845 - DNA, 22 bp, Homo sapiens
gttccaaatttggatctttagg

SEQ ID NO: 7586846 - DNA, 22 bp, Homo sapiens
gttccaattccaaattccaagg

SEQ ID NO: 7586847 - DNA, 22 bp, Homo sapiens
gttccacaaaaggtctagttta

SEQ ID NO: 7586848 - DNA, 22 bp, Homo sapiens
gttccacaaaaggtctagttta

SEQ ID NO: 7586849 - DNA, 22 bp, Homo sapiens
gttccaaagtctctgagctgag

SEQ ID NO: 7586850 - DNA, 22 bp, Homo sapiens
gttccaaagttagagtgtattg

SEQ ID NO: 7586851 - DNA, 22 bp, Homo sapiens
gttccaaatttggatctttagg

SEQ ID NO: 7586852 - DNA, 22 bp, Homo sapiens
gttcatttttactttgatctac

SEQ ID NO: 7586853 - DNA, 22 bp, Homo sapiens
gttcatttttactttgatctac

SEQ ID NO: 7586854 - DNA, 23 bp, Homo sapiens
gttcattttattgtctgattgct

SEQ ID NO: 7586855 - DNA, 23 bp, Homo sapiens
gttcattttattgtctgattgct

SEQ ID NO: 7586856 - DNA, 22 bp, Homo sapiens
gttcatttttactttgatctac

SEQ ID NO: 7586857 - DNA, 22 bp, Homo sapiens
gttcatttttactttgatctac

SEQ ID NO: 7586858 - DNA, 23 bp, Homo sapiens
gttcattttattgtctgattgct

SEQ ID NO: 7586859 - DNA, 23 bp, Homo sapiens
gttcattttattgtctgattgct

SEQ ID NO: 7586860 - DNA, 23 bp, Homo sapiens
gttcattttattgtctgattgct

SEQ ID NO: 7586861 - DNA, 23 bp, Homo sapiens
gttcattttattgtctgattgct

SEQ ID NO: 7586862 - DNA, 23 bp, Homo sapiens
gttcattttattgtctgattgct

SEQ ID NO: 7586863 - DNA, 22 bp, Homo sapiens
gttcattttactgtaaatagca

SEQ ID NO: 7586864 - DNA, 22 bp, Homo sapiens
gttcatttttccctaatgagta

SEQ ID NO: 7586865 - DNA, 22 bp, Homo sapiens
gttcatttttccctaatgagta

SEQ ID NO: 7586866 - DNA, 22 bp, Homo sapiens
gttcatttttccctaatgagta

SEQ ID NO: 7586867 - DNA, 22 bp, Homo sapiens
gttcatttttccctaatgagta

SEQ ID NO: 7586868 - DNA, 22 bp, Homo sapiens
gttcatttttccctaatgagta

SEQ ID NO: 7586869 - DNA, 22 bp, Homo sapiens
gttcatttttagaatgctagta

SEQ ID NO: 7586870 - DNA, 22 bp, Homo sapiens
gttcatttttagaatgctagta

SEQ ID NO: 7586871 - DNA, 22 bp, Homo sapiens
gttcatttttactttgatctac

SEQ ID NO: 7586872 - DNA, 22 bp, Homo sapiens
gttcatttttagaatgctagta

SEQ ID NO: 7586873 - DNA, 22 bp, Homo sapiens
gttcatttttagaatgctagta

SEQ ID NO: 7586874 - DNA, 22 bp, Homo sapiens
gttcatttttagaatgctagta

SEQ ID NO: 7586875 - DNA, 22 bp, Homo sapiens
gttataaaggtgataatggtca

SEQ ID NO: 7586876 - DNA, 22 bp, Homo sapiens
gttataaaggtgataatggtca

SEQ ID NO: 7586877 - DNA, 22 bp, Homo sapiens
gttataaaatgcacagttgttt

SEQ ID NO: 7586878 - DNA, 22 bp, Homo sapiens
gttataaaatgcacagttgttt

SEQ ID NO: 7586879 - DNA, 22 bp, Homo sapiens
gttataaaatgcacagttgttt

SEQ ID NO: 7586880 - DNA, 22 bp, Homo sapiens
gttagtttgaacttgtctatgt

SEQ ID NO: 7586881 - DNA, 22 bp, Homo sapiens
gttataaaatgcacagttgttt

SEQ ID NO: 7586882 - DNA, 22 bp, Homo sapiens
gttataaaatgcacagttgttt

SEQ ID NO: 7586883 - DNA, 22 bp, Homo sapiens
gttataaaatgcacagttgttt

SEQ ID NO: 7586884 - DNA, 22 bp, Homo sapiens
gttataaaatgcacagttgttt

SEQ ID NO: 7586885 - DNA, 22 bp, Homo sapiens
gttataaaatgcacagttgttt

SEQ ID NO: 7586886 - DNA, 22 bp, Homo sapiens
gttagtagtaaagcagggattc

SEQ ID NO: 7586887 - DNA, 22 bp, Homo sapiens
gttagtaggttgcaaatttgga

SEQ ID NO: 7586888 - DNA, 22 bp, Homo sapiens
gttagtaggaggtggtatcttg

SEQ ID NO: 7586889 - DNA, 22 bp, Homo sapiens
gttagtagcatttcatgacatg

SEQ ID NO: 7586890 - DNA, 18 bp, Homo sapiens
gttagtcttttcagggca

SEQ ID NO: 7586891 - DNA, 22 bp, Homo sapiens
gttagtgcttattaaatagtat

SEQ ID NO: 7586892 - DNA, 22 bp, Homo sapiens
gttagtgtgactgaggaatgca

SEQ ID NO: 7586893 - DNA, 22 bp, Homo sapiens
gttagtgtgactgaggaatgca

SEQ ID NO: 7586894 - DNA, 22 bp, Homo sapiens
gttagtgtgactgaggaatgca

SEQ ID NO: 7586895 - DNA, 22 bp, Homo sapiens
gttagtgtatattgccttcaaa

SEQ ID NO: 7586896 - DNA, 22 bp, Homo sapiens
gttagtgtatattgccttcaaa

SEQ ID NO: 7586897 - DNA, 22 bp, Homo sapiens
gttataaaggtgataatggtca

SEQ ID NO: 7586898 - DNA, 22 bp, Homo sapiens
gttataaatacctaataggatt

SEQ ID NO: 7586899 - DNA, 22 bp, Homo sapiens
gttataaatacctaataggatt

SEQ ID NO: 7586900 - DNA, 22 bp, Homo sapiens
gttataaatacctaataggatt

SEQ ID NO: 7586901 - DNA, 22 bp, Homo sapiens
gttataaatacctaataggatt

SEQ ID NO: 7586902 - DNA, 22 bp, Homo sapiens
gttataaatacctaataggatt

SEQ ID NO: 7586903 - DNA, 22 bp, Homo sapiens
gttataaaggtgataatggtca

SEQ ID NO: 7586904 - DNA, 22 bp, Homo sapiens
gttataaaggtgataatggtca

SEQ ID NO: 7586905 - DNA, 22 bp, Homo sapiens
gttataaaggtgataatggtca

SEQ ID NO: 7586906 - DNA, 22 bp, Homo sapiens
gttataaaggtgataatggtca

SEQ ID NO: 7586907 - DNA, 22 bp, Homo sapiens
gttcattttactgtaaatagca

SEQ ID NO: 7586908 - DNA, 22 bp, Homo sapiens
gttcattttactgtaaatagca

SEQ ID NO: 7586909 - DNA, 22 bp, Homo sapiens
gttcattttactgtaaatagca

SEQ ID NO: 7586910 - DNA, 22 bp, Homo sapiens
gttcattttactgtaaatagca

SEQ ID NO: 7586911 - DNA, 22 bp, Homo sapiens
gttataaatacctaataggatt

SEQ ID NO: 7586912 - DNA, 22 bp, Homo sapiens
gttataaatacctaataggatt

SEQ ID NO: 7586913 - DNA, 22 bp, Homo sapiens
gttataaatacctaataggatt

SEQ ID NO: 7586914 - DNA, 22 bp, Homo sapiens
gttataaatacctaataggatt

SEQ ID NO: 7586915 - DNA, 22 bp, Homo sapiens
gttagagggctgccttttgttt

SEQ ID NO: 7586916 - DNA, 22 bp, Homo sapiens
gttagcaaaatgtttttgaggc

SEQ ID NO: 7586917 - DNA, 22 bp, Homo sapiens
gttagagggaaaaatcatttgc

SEQ ID NO: 7586918 - DNA, 22 bp, Homo sapiens
gttagagacatctctggtttct

SEQ ID NO: 7586919 - DNA, 22 bp, Homo sapiens
gttagcaccagtgctcataaca

SEQ ID NO: 7586920 - DNA, 22 bp, Homo sapiens
gttagcacaaccaagaaatgcg

SEQ ID NO: 7586921 - DNA, 22 bp, Homo sapiens
gttaggaaggtatagttgtatt

SEQ ID NO: 7586922 - DNA, 22 bp, Homo sapiens
gttaggaacattaatgtgattt

SEQ ID NO: 7586923 - DNA, 22 bp, Homo sapiens
gttaggaagacaggagtgggtt

SEQ ID NO: 7586924 - DNA, 22 bp, Homo sapiens
gttagcttgagcatttgccatg

SEQ ID NO: 7586925 - DNA, 22 bp, Homo sapiens
gttagcttttacttgaacactt

SEQ ID NO: 7586926 - DNA, 22 bp, Homo sapiens
gttaggaacactggagcctaaa

SEQ ID NO: 7586927 - DNA, 18 bp, Homo sapiens
gttagcttcctgttgccc

SEQ ID NO: 7586928 - DNA, 22 bp, Homo sapiens
gttagcttctgggccaaggagg

SEQ ID NO: 7586929 - DNA, 22 bp, Homo sapiens
gttagcttcttgaaggaaaggg

SEQ ID NO: 7586930 - DNA, 20 bp, Homo sapiens
gttaggaggttggacatgga

SEQ ID NO: 7586931 - DNA, 20 bp, Homo sapiens
gttaggaggttggacatgga

SEQ ID NO: 7586932 - DNA, 20 bp, Homo sapiens
gttaggaggttggacatgga

SEQ ID NO: 7586933 - DNA, 20 bp, Homo sapiens
gttaggaggttggacatgga

SEQ ID NO: 7586934 - DNA, 20 bp, Homo sapiens
gttaggaggttggacatgga

SEQ ID NO: 7586935 - DNA, 20 bp, Homo sapiens
gttaggaggttggacatgga

SEQ ID NO: 7586936 - DNA, 20 bp, Homo sapiens
gttaggaggttggacatgga

SEQ ID NO: 7586937 - DNA, 20 bp, Homo sapiens
gttaggaggttggacatgga

SEQ ID NO: 7586938 - DNA, 22 bp, Homo sapiens
gttaggaagtggtaaggttctg

SEQ ID NO: 7586939 - DNA, 22 bp, Homo sapiens
gttaggaatttgttactgtgta

SEQ ID NO: 7586940 - DNA, 22 bp, Homo sapiens
gttaggcagcccaagatgtcag

SEQ ID NO: 7586941 - DNA, 22 bp, Homo sapiens
gttaggtagaagtttactttga

SEQ ID NO: 7586942 - DNA, 22 bp, Homo sapiens
gttaggtagaagtttactttga

SEQ ID NO: 7586943 - DNA, 22 bp, Homo sapiens
gttacaaaggtcataaaagtgt

SEQ ID NO: 7586944 - DNA, 22 bp, Homo sapiens
gttacaaaggtcataaaagtgt

SEQ ID NO: 7586945 - DNA, 22 bp, Homo sapiens
gttacaaatgccaaagctgaga

SEQ ID NO: 7586946 - DNA, 22 bp, Homo sapiens
gttacaaatgccaaagctgaga

SEQ ID NO: 7586947 - DNA, 22 bp, Homo sapiens
gttacaaatgccaaagctgaga

SEQ ID NO: 7586948 - DNA, 22 bp, Homo sapiens
gttacaaatgccaaagctgaga

SEQ ID NO: 7586949 - DNA, 22 bp, Homo sapiens
gttacaaatgccaaagctgaga

SEQ ID NO: 7586950 - DNA, 22 bp, Homo sapiens
gttacaaatgccaaagctgaga

SEQ ID NO: 7586951 - DNA, 22 bp, Homo sapiens
gttactcctggttgagcttggt

SEQ ID NO: 7586952 - DNA, 22 bp, Homo sapiens
gttactcttccccggggtctgg

SEQ ID NO: 7586953 - DNA, 22 bp, Homo sapiens
gtgttacttgccatacagaaaa

SEQ ID NO: 7586954 - DNA, 22 bp, Homo sapiens
gtgttacttacctgggacagca

SEQ ID NO: 7586955 - DNA, 22 bp, Homo sapiens
gtgttacttaattagaatctgc

SEQ ID NO: 7586956 - DNA, 22 bp, Homo sapiens
gtgttactgggaggacggaggt

SEQ ID NO: 7586957 - DNA, 22 bp, Homo sapiens
gtgttacttaattagaatctgc

SEQ ID NO: 7586958 - DNA, 22 bp, Homo sapiens
gtgttacttacctgggacagca

SEQ ID NO: 7586959 - DNA, 22 bp, Homo sapiens
gtgttacttgccatacagaaaa

SEQ ID NO: 7586960 - DNA, 22 bp, Homo sapiens
gttacaaaggtcataaaagtgt

SEQ ID NO: 7586961 - DNA, 22 bp, Homo sapiens
gttacaaaggtcataaaagtgt

SEQ ID NO: 7586962 - DNA, 22 bp, Homo sapiens
gttacaaaggtcataaaagtgt

SEQ ID NO: 7586963 - DNA, 22 bp, Homo sapiens
gttacaaaggtcataaaagtgt

SEQ ID NO: 7586964 - DNA, 22 bp, Homo sapiens
gttagaaacacattcttattga

SEQ ID NO: 7586965 - DNA, 22 bp, Homo sapiens
gttagaaacacattcttattga

SEQ ID NO: 7586966 - DNA, 22 bp, Homo sapiens
gttactcttgagaggctgaggt

SEQ ID NO: 7586967 - DNA, 22 bp, Homo sapiens
gttactcttgagaggctgaggt

SEQ ID NO: 7586968 - DNA, 22 bp, Homo sapiens
gttagaaacgcaggctctccgg

SEQ ID NO: 7586969 - DNA, 22 bp, Homo sapiens
gttagaaacacattcttattga

SEQ ID NO: 7586970 - DNA, 22 bp, Homo sapiens
gttagaaacacattcttattga

SEQ ID NO: 7586971 - DNA, 22 bp, Homo sapiens
gttagaaacacattcttattga

SEQ ID NO: 7586972 - DNA, 22 bp, Homo sapiens
gttagaaagtgtctgcttgggt

SEQ ID NO: 7586973 - DNA, 22 bp, Homo sapiens
gttagaaatgcagaaacttgac

SEQ ID NO: 7586974 - DNA, 22 bp, Homo sapiens
gttagaaatgcagaaacttgac

SEQ ID NO: 7586975 - DNA, 22 bp, Homo sapiens
gttagaaagtgtctgcttgggt

SEQ ID NO: 7586976 - DNA, 22 bp, Homo sapiens
gttagacatgagtgtgcttaca

SEQ ID NO: 7586977 - DNA, 22 bp, Homo sapiens
gttagacatgcagaatctcagg

SEQ ID NO: 7586978 - DNA, 22 bp, Homo sapiens
gttagacatgcagaatctcagg

SEQ ID NO: 7586979 - DNA, 22 bp, Homo sapiens
gttagacatgagtgtgcttaca

SEQ ID NO: 7586980 - DNA, 22 bp, Homo sapiens
gttagagcacatactttgcatg

SEQ ID NO: 7586981 - DNA, 22 bp, Homo sapiens
gtgtgtgtgcatataacatata

SEQ ID NO: 7586982 - DNA, 22 bp, Homo sapiens
gtgtgtgtgcatataacatata

SEQ ID NO: 7586983 - DNA, 22 bp, Homo sapiens
gtgtgtgtgcatataacatata

SEQ ID NO: 7586984 - DNA, 22 bp, Homo sapiens
gtgtgtgtgcatctcttttatt

SEQ ID NO: 7586985 - DNA, 22 bp, Homo sapiens
gtgtgtgtgcatctcttttatt

SEQ ID NO: 7586986 - DNA, 22 bp, Homo sapiens
gtgtgtgtgcatctcttttatt

SEQ ID NO: 7586987 - DNA, 22 bp, Homo sapiens
gtgtgtgtgcatctcttttatt

SEQ ID NO: 7586988 - DNA, 22 bp, Homo sapiens
gtgtgtgtctccgcggccgtag

SEQ ID NO: 7586989 - DNA, 22 bp, Homo sapiens
gtgtgtgtctccgcggccgtag

SEQ ID NO: 7586990 - DNA, 22 bp, Homo sapiens
gtgtgtgtctccgcggccgtag

SEQ ID NO: 7586991 - DNA, 22 bp, Homo sapiens
gtgtgtgtctccgcggccgtag

SEQ ID NO: 7586992 - DNA, 22 bp, Homo sapiens
gtgtgtgtgcatataacatata

SEQ ID NO: 7586993 - DNA, 22 bp, Homo sapiens
gtgtgtgtctccgcggccgtag

SEQ ID NO: 7586994 - DNA, 22 bp, Homo sapiens
gtgtgtgtatctgcctatcaca

SEQ ID NO: 7586995 - DNA, 22 bp, Homo sapiens
gtgtgtgtatctgcctatcaca

SEQ ID NO: 7586996 - DNA, 22 bp, Homo sapiens
gtgtgtgtatctgcctatcaca

SEQ ID NO: 7586997 - DNA, 22 bp, Homo sapiens
gtgtgtgtatctgcctatcaca

SEQ ID NO: 7586998 - DNA, 21 bp, Homo sapiens
gtgtgtctaatgtagtggaaa

SEQ ID NO: 7586999 - DNA, 22 bp, Homo sapiens
gtgtgtccttgggcctctgcag

SEQ ID NO: 7587000 - DNA, 22 bp, Homo sapiens
gtgtgtccttgggcctctgcag

SEQ ID NO: 7587001 - DNA, 19 bp, Homo sapiens
gtgctttttaagagctcag

SEQ ID NO: 7587002 - DNA, 19 bp, Homo sapiens
gtgctttttaagagctcag

SEQ ID NO: 7587003 - DNA, 19 bp, Homo sapiens
gtgctttttaagagctcag

SEQ ID NO: 7587004 - DNA, 22 bp, Homo sapiens
gtgctttgttaagtctgaaatt

SEQ ID NO: 7587005 - DNA, 22 bp, Homo sapiens
gtgcttttaaaggcaattagta

SEQ ID NO: 7587006 - DNA, 22 bp, Homo sapiens
gtgcttttaaaggcaattagta

SEQ ID NO: 7587007 - DNA, 22 bp, Homo sapiens
gtgctttgttaagtctgaaatt

SEQ ID NO: 7587008 - DNA, 22 bp, Homo sapiens
gtgcttttaacttttgaaagga

SEQ ID NO: 7587009 - DNA, 22 bp, Homo sapiens
gtgctgtctcaagaaggattct

SEQ ID NO: 7587010 - DNA, 22 bp, Homo sapiens
gtgctttgtcttcaggatcata

SEQ ID NO: 7587011 - DNA, 23 bp, Homo sapiens
gtgctttatgatctgctgtccct

SEQ ID NO: 7587012 - DNA, 22 bp, Homo sapiens
gtgctttatatgtgggtatcca

SEQ ID NO: 7587013 - DNA, 22 bp, Homo sapiens
gtgctttccatcctccctgctg

SEQ ID NO: 7587014 - DNA, 22 bp, Homo sapiens
gtgctttactgtgttgccttta

SEQ ID NO: 7587015 - DNA, 22 bp, Homo sapiens
gtgctttagctgagttggtcaa

SEQ ID NO: 7587016 - DNA, 22 bp, Homo sapiens
gtgctttactggcagtgatgta

SEQ ID NO: 7587017 - DNA, 22 bp, Homo sapiens
gtgctttactgtgttgccttta

SEQ ID NO: 7587018 - DNA, 22 bp, Homo sapiens
gtgctttaccttattggtctcg

SEQ ID NO: 7587019 - DNA, 22 bp, Homo sapiens
gtgctttaccttattggtctcg

SEQ ID NO: 7587020 - DNA, 22 bp, Homo sapiens
gtgctttactggcagtgatgta

SEQ ID NO: 7587021 - DNA, 22 bp, Homo sapiens
gtgctttaggtgtttggctgaa

SEQ ID NO: 7587022 - DNA, 22 bp, Homo sapiens
gtgctttagttcttgcaactgg

SEQ ID NO: 7587023 - DNA, 22 bp, Homo sapiens
gtgctttagttcttgcaactgg

SEQ ID NO: 7587024 - DNA, 22 bp, Homo sapiens
gtgctttagttcttgcaactgg

SEQ ID NO: 7587025 - DNA, 22 bp, Homo sapiens
gtgctttagttcttgcaactgg

SEQ ID NO: 7587026 - DNA, 22 bp, Homo sapiens
gtgctttagttcttgcaactgg

SEQ ID NO: 7587027 - DNA, 22 bp, Homo sapiens
gtgctttagttcttgcaactgg

SEQ ID NO: 7587028 - DNA, 22 bp, Homo sapiens
gtgctttaaaccactgtgctgt

SEQ ID NO: 7587029 - DNA, 22 bp, Homo sapiens
gtgcttggcttggtgtgacctg

SEQ ID NO: 7587030 - DNA, 22 bp, Homo sapiens
gtgctttaaaaataggagatga

SEQ ID NO: 7587031 - DNA, 22 bp, Homo sapiens
gtgctttaataagatttcactt

SEQ ID NO: 7587032 - DNA, 22 bp, Homo sapiens
gtgctttaataagatttcactt

SEQ ID NO: 7587033 - DNA, 22 bp, Homo sapiens
gtgctttaaaccactgtgctgt

SEQ ID NO: 7587034 - DNA, 22 bp, Homo sapiens
gtgctttaaagacagttatgct

SEQ ID NO: 7587035 - DNA, 22 bp, Homo sapiens
gtgctttaaaccactgtgctgt

SEQ ID NO: 7587036 - DNA, 22 bp, Homo sapiens
gtgttaatgaaaaacaactcat

SEQ ID NO: 7587037 - DNA, 22 bp, Homo sapiens
gtgttaatggtagaatctgagt

SEQ ID NO: 7587038 - DNA, 22 bp, Homo sapiens
gtgttaatggctatgaactgat

SEQ ID NO: 7587039 - DNA, 22 bp, Homo sapiens
gtgttaatggtagaatctgagt

SEQ ID NO: 7587040 - DNA, 18 bp, Homo sapiens
gtgttacaggagtgcagc

SEQ ID NO: 7587041 - DNA, 22 bp, Homo sapiens
gtgttaatggtagaatctgagt

SEQ ID NO: 7587042 - DNA, 22 bp, Homo sapiens
gtgttaattattggtgaataga

SEQ ID NO: 7587043 - DNA, 22 bp, Homo sapiens
gtgttacaaatcacctgtgctg

SEQ ID NO: 7587044 - DNA, 22 bp, Homo sapiens
gtgttacagtaccttgtcacaa

SEQ ID NO: 7587045 - DNA, 22 bp, Homo sapiens
gtgttacatatacctgagctta

SEQ ID NO: 7587046 - DNA, 22 bp, Homo sapiens
gtgttacatatatacccacacc

SEQ ID NO: 7587047 - DNA, 22 bp, Homo sapiens
gtgttacatatacctgagctta

SEQ ID NO: 7587048 - DNA, 22 bp, Homo sapiens
gtgttacatattctaaaatgct

SEQ ID NO: 7587049 - DNA, 22 bp, Homo sapiens
gtgttacatattctaaaatgct

SEQ ID NO: 7587050 - DNA, 22 bp, Homo sapiens
gtgttactaaaatttgattctt

SEQ ID NO: 7587051 - DNA, 22 bp, Homo sapiens
gtgttactaaaatttgattctt

SEQ ID NO: 7587052 - DNA, 22 bp, Homo sapiens
gtgttactaaaatttgattctt

SEQ ID NO: 7587053 - DNA, 23 bp, Homo sapiens
gtgttactaaagatgaacattta

SEQ ID NO: 7587054 - DNA, 23 bp, Homo sapiens
gtgttactaaagatgaacattta

SEQ ID NO: 7587055 - DNA, 23 bp, Homo sapiens
gtgttactaaagatgaacattta

SEQ ID NO: 7587056 - DNA, 22 bp, Homo sapiens
gtgttactcaagagatagcttt

SEQ ID NO: 7587057 - DNA, 23 bp, Homo sapiens
gtgttactaaagatgaacattta

SEQ ID NO: 7587058 - DNA, 22 bp, Homo sapiens
gtgttactcaagagatagcttt

SEQ ID NO: 7587059 - DNA, 23 bp, Homo sapiens
gtgttactctgataggtgctttt

SEQ ID NO: 7587060 - DNA, 22 bp, Homo sapiens
gtgttactgacacatttttgtc

SEQ ID NO: 7587061 - DNA, 23 bp, Homo sapiens
gtgttactctgataggtgctttt

SEQ ID NO: 7587062 - DNA, 22 bp, Homo sapiens
gtgttactgacacatttttgtc

SEQ ID NO: 7587063 - DNA, 22 bp, Homo sapiens
gtgttactgacacatttttgtc

SEQ ID NO: 7587064 - DNA, 22 bp, Homo sapiens
gtgttactgcttttatctacca

SEQ ID NO: 7587065 - DNA, 22 bp, Homo sapiens
gtgttactgcttttatctacca

SEQ ID NO: 7587066 - DNA, 22 bp, Homo sapiens
gtgttactgggaggacggaggt

SEQ ID NO: 7587067 - DNA, 22 bp, Homo sapiens
gtgttaaaaatcccatgatatg

SEQ ID NO: 7587068 - DNA, 22 bp, Homo sapiens
gtgttaaaaatcccatgatatg

SEQ ID NO: 7587069 - DNA, 22 bp, Homo sapiens
gtgtgtttagcattagcagggg

SEQ ID NO: 7587070 - DNA, 22 bp, Homo sapiens
gtgttaaaaatcccatgatatg

SEQ ID NO: 7587071 - DNA, 22 bp, Homo sapiens
gtgttaaacatgttcacagcat

SEQ ID NO: 7587072 - DNA, 22 bp, Homo sapiens
gtgttaaaatgctttatagtag

SEQ ID NO: 7587073 - DNA, 22 bp, Homo sapiens
gtgttaaacatgttcacagcat

SEQ ID NO: 7587074 - DNA, 22 bp, Homo sapiens
gtgttaaacatgttcacagcat

SEQ ID NO: 7587075 - DNA, 22 bp, Homo sapiens
gtgttaaatgcaatcacatgca

SEQ ID NO: 7587076 - DNA, 22 bp, Homo sapiens
gtgttaaatgcaatcacatgca

SEQ ID NO: 7587077 - DNA, 22 bp, Homo sapiens
gtgttaaatgcaatcacatgca

SEQ ID NO: 7587078 - DNA, 22 bp, Homo sapiens
gtgttaaatgcaatcacatgca

SEQ ID NO: 7587079 - DNA, 22 bp, Homo sapiens
gtgttaaatgcaatcacatgca

SEQ ID NO: 7587080 - DNA, 22 bp, Homo sapiens
gtgttaaatttctaatttgtga

SEQ ID NO: 7587081 - DNA, 22 bp, Homo sapiens
gtgttaaccagctaaactttgc

SEQ ID NO: 7587082 - DNA, 22 bp, Homo sapiens
gtgtgtgtgtaaaaatccagag

SEQ ID NO: 7587083 - DNA, 22 bp, Homo sapiens
gtgtgtgttcaataaatttaag

SEQ ID NO: 7587084 - DNA, 22 bp, Homo sapiens
gtgtgtgtgtaaaaatccagag

SEQ ID NO: 7587085 - DNA, 22 bp, Homo sapiens
gtgtgtgtgtaaaaatccagag

SEQ ID NO: 7587086 - DNA, 22 bp, Homo sapiens
gtgtgtgtgtaaaaatccagag

SEQ ID NO: 7587087 - DNA, 22 bp, Homo sapiens
gtgtgtgtgcctgcacacacac

SEQ ID NO: 7587088 - DNA, 22 bp, Homo sapiens
gtgtgtgtgcatctcttttatt

SEQ ID NO: 7587089 - DNA, 22 bp, Homo sapiens
gtgtgtgtgcctgcacacacac

SEQ ID NO: 7587090 - DNA, 22 bp, Homo sapiens
gtgtgtgtgcatctcttttatt

SEQ ID NO: 7587091 - DNA, 22 bp, Homo sapiens
gtgtgtgtgcctgcacacacac

SEQ ID NO: 7587092 - DNA, 22 bp, Homo sapiens
gtgtgtgtgcctgcacacacac

SEQ ID NO: 7587093 - DNA, 23 bp, Homo sapiens
gtgtgttcccggagtagctcccg

SEQ ID NO: 7587094 - DNA, 22 bp, Homo sapiens
gtgtgttcccgtttccttcact

SEQ ID NO: 7587095 - DNA, 22 bp, Homo sapiens
gtgtgttcccgtttccttcact

SEQ ID NO: 7587096 - DNA, 22 bp, Homo sapiens
gtgtgtttcaccctgacaccaa

SEQ ID NO: 7587097 - DNA, 22 bp, Homo sapiens
gtgtgtttagcattagcagggg

SEQ ID NO: 7587098 - DNA, 22 bp, Homo sapiens
gtgtgtttagcattagcagggg

SEQ ID NO: 7587099 - DNA, 22 bp, Homo sapiens
gtgtgtttcagaagccaggtgt

SEQ ID NO: 7587100 - DNA, 22 bp, Homo sapiens
gtgtgtgttcaataaatttaag

SEQ ID NO: 7587101 - DNA, 22 bp, Homo sapiens
gtgtgtgttcaataaatttaag

SEQ ID NO: 7587102 - DNA, 22 bp, Homo sapiens
gtgtgtgttcaataaatttaag

SEQ ID NO: 7587103 - DNA, 22 bp, Homo sapiens
gtgtgttcagcaagaggtaagg

SEQ ID NO: 7587104 - DNA, 22 bp, Homo sapiens
gtgtgtgttcaataaatttaag

SEQ ID NO: 7587105 - DNA, 22 bp, Homo sapiens
gtgtgttccatggggacaacag

SEQ ID NO: 7587106 - DNA, 22 bp, Homo sapiens
gtgtgttcagcaagaggtaagg

SEQ ID NO: 7587107 - DNA, 22 bp, Homo sapiens
gtttcttaagttacaaaatctt

SEQ ID NO: 7587108 - DNA, 22 bp, Homo sapiens
gtttcttaagttacaaaatctt

SEQ ID NO: 7587109 - DNA, 22 bp, Homo sapiens
gtttcttaatagcaggggccaa

SEQ ID NO: 7587110 - DNA, 22 bp, Homo sapiens
gtttcttaagttacaaaatctt

SEQ ID NO: 7587111 - DNA, 22 bp, Homo sapiens
gtttcttaagttacaaaatctt

SEQ ID NO: 7587112 - DNA, 22 bp, Homo sapiens
gtttcttaaatgtagcaggacc

SEQ ID NO: 7587113 - DNA, 22 bp, Homo sapiens
gtttcttaaatgtagcaggacc

SEQ ID NO: 7587114 - DNA, 22 bp, Homo sapiens
gtttcttaagttacaaaatctt

SEQ ID NO: 7587115 - DNA, 22 bp, Homo sapiens
gtttcttagacagacattatct

SEQ ID NO: 7587116 - DNA, 22 bp, Homo sapiens
gtttcttagacagacattatct

SEQ ID NO: 7587117 - DNA, 22 bp, Homo sapiens
gttttacaaggttaatcagcag

SEQ ID NO: 7587118 - DNA, 22 bp, Homo sapiens
gtttcttaccacttggacctct

SEQ ID NO: 7587119 - DNA, 22 bp, Homo sapiens
gtttcttaccacttggacctct

SEQ ID NO: 7587120 - DNA, 22 bp, Homo sapiens
gtttcttaatagcaggggccaa

SEQ ID NO: 7587121 - DNA, 22 bp, Homo sapiens
gtttcttaatagcaggggccaa

SEQ ID NO: 7587122 - DNA, 22 bp, Homo sapiens
gtttctgttgctcagataatgc

SEQ ID NO: 7587123 - DNA, 22 bp, Homo sapiens
gtttcttaaaagaggagttaga

SEQ ID NO: 7587124 - DNA, 22 bp, Homo sapiens
gtttcttaaaagaggagttaga

SEQ ID NO: 7587125 - DNA, 22 bp, Homo sapiens
gtttcttaaaagaggagttaga

SEQ ID NO: 7587126 - DNA, 22 bp, Homo sapiens
gtttcttaaaagaggagttaga

SEQ ID NO: 7587127 - DNA, 22 bp, Homo sapiens
gtttcttaaatgtagcaggacc

SEQ ID NO: 7587128 - DNA, 22 bp, Homo sapiens
gtttcttaaatgtagcaggacc

SEQ ID NO: 7587129 - DNA, 22 bp, Homo sapiens
gtttcttaaatgtagcaggacc

SEQ ID NO: 7587130 - DNA, 22 bp, Homo sapiens
gtttcttaaatgtagcaggacc

SEQ ID NO: 7587131 - DNA, 22 bp, Homo sapiens
gtttcttaaatgtagcaggacc

SEQ ID NO: 7587132 - DNA, 23 bp, Homo sapiens
gttttacaggtgagaaaatggag

SEQ ID NO: 7587133 - DNA, 23 bp, Homo sapiens
gttttacaggtgagaaaatggag

SEQ ID NO: 7587134 - DNA, 23 bp, Homo sapiens
gttttacaggtgagaaaatggag

SEQ ID NO: 7587135 - DNA, 23 bp, Homo sapiens
gttttacaggtgagaaaatggag

SEQ ID NO: 7587136 - DNA, 22 bp, Homo sapiens
gtttcttagacagacattatct

SEQ ID NO: 7587137 - DNA, 22 bp, Homo sapiens
gttttagtgggtggccactgat

SEQ ID NO: 7587138 - DNA, 22 bp, Homo sapiens
gttttagtgggtggccactgat

SEQ ID NO: 7587139 - DNA, 22 bp, Homo sapiens
gttttacacacctatgaaagac

SEQ ID NO: 7587140 - DNA, 22 bp, Homo sapiens
gttttacacacctatgaaagac

SEQ ID NO: 7587141 - DNA, 22 bp, Homo sapiens
gttttacaaggttaatcagcag

SEQ ID NO: 7587142 - DNA, 22 bp, Homo sapiens
gttttacaaggttaatcagcag

SEQ ID NO: 7587143 - DNA, 22 bp, Homo sapiens
gttttacaaggttaatcagcag

SEQ ID NO: 7587144 - DNA, 22 bp, Homo sapiens
gttttacacacctatgaaagac

SEQ ID NO: 7587145 - DNA, 22 bp, Homo sapiens
gttttacacacctatgaaagac

SEQ ID NO: 7587146 - DNA, 22 bp, Homo sapiens
gttttacacacctatgaaagac

SEQ ID NO: 7587147 - DNA, 22 bp, Homo sapiens
gtttctcatcagtttctgatat

SEQ ID NO: 7587148 - DNA, 22 bp, Homo sapiens
gtttctcatcagtttctgatat

SEQ ID NO: 7587149 - DNA, 22 bp, Homo sapiens
gtttctcagtttggtctgcaga

SEQ ID NO: 7587150 - DNA, 21 bp, Homo sapiens
gtttctcatgtggccttatgg

SEQ ID NO: 7587151 - DNA, 22 bp, Homo sapiens
gtttctcatcagtttctgatat

SEQ ID NO: 7587152 - DNA, 18 bp, Homo sapiens
gtttctcccaggcggggc

SEQ ID NO: 7587153 - DNA, 22 bp, Homo sapiens
gtttctcctctgtgtcttgttt

SEQ ID NO: 7587154 - DNA, 22 bp, Homo sapiens
gtttctcctctgtgtcttgttt

SEQ ID NO: 7587155 - DNA, 22 bp, Homo sapiens
gtttctcctctgtgtcttgttt

SEQ ID NO: 7587156 - DNA, 22 bp, Homo sapiens
gtttctctgtctgttacattgg

SEQ ID NO: 7587157 - DNA, 22 bp, Homo sapiens
gtttctctgtctgttacattgg

SEQ ID NO: 7587158 - DNA, 22 bp, Homo sapiens
gtttctctgtctgttacattgg

SEQ ID NO: 7587159 - DNA, 22 bp, Homo sapiens
gtttctctgtctgttacattgg

SEQ ID NO: 7587160 - DNA, 22 bp, Homo sapiens
gtttctctgtctgttacattgg

SEQ ID NO: 7587161 - DNA, 22 bp, Homo sapiens
gtttctctgtacctctgtccca

SEQ ID NO: 7587162 - DNA, 22 bp, Homo sapiens
gtttctctgtacctctgtccca

SEQ ID NO: 7587163 - DNA, 22 bp, Homo sapiens
gtttctcttaacacataaagta

SEQ ID NO: 7587164 - DNA, 22 bp, Homo sapiens
gtttctgagcacttttattgca

SEQ ID NO: 7587165 - DNA, 22 bp, Homo sapiens
gtttctgagagccacacacagc

SEQ ID NO: 7587166 - DNA, 22 bp, Homo sapiens
gtttctgaagggattacttggt

SEQ ID NO: 7587167 - DNA, 22 bp, Homo sapiens
gtttctgaagggattacttggt

SEQ ID NO: 7587168 - DNA, 22 bp, Homo sapiens
gtttctgctccagtgatgcaag

SEQ ID NO: 7587169 - DNA, 22 bp, Homo sapiens
gtttctgctgcgtgctccagga

SEQ ID NO: 7587170 - DNA, 22 bp, Homo sapiens
gtttctgattctagaggcaggc

SEQ ID NO: 7587171 - DNA, 22 bp, Homo sapiens
gtttctgtgttagatgagtctt

SEQ ID NO: 7587172 - DNA, 22 bp, Homo sapiens
gtttctgtgttagatgagtctt

SEQ ID NO: 7587173 - DNA, 22 bp, Homo sapiens
gtttctgtaagactgaattgac

SEQ ID NO: 7587174 - DNA, 22 bp, Homo sapiens
gtttctgtaagactgaattgac

SEQ ID NO: 7587175 - DNA, 22 bp, Homo sapiens
gtttccttttggaattagagct

SEQ ID NO: 7587176 - DNA, 22 bp, Homo sapiens
gtttccttttggaattagagct

SEQ ID NO: 7587177 - DNA, 22 bp, Homo sapiens
gtttccttttggaattagagct

SEQ ID NO: 7587178 - DNA, 22 bp, Homo sapiens
gtttccttttggaattagagct

SEQ ID NO: 7587179 - DNA, 22 bp, Homo sapiens
gtttccttttggaattagagct

SEQ ID NO: 7587180 - DNA, 22 bp, Homo sapiens
gtttccttttggaattagagct

SEQ ID NO: 7587181 - DNA, 22 bp, Homo sapiens
gtttcctttgccagtaaatggg

SEQ ID NO: 7587182 - DNA, 22 bp, Homo sapiens
gtttcctttctattgccttgat

SEQ ID NO: 7587183 - DNA, 22 bp, Homo sapiens
gtttcctttgccagtaaatggg

SEQ ID NO: 7587184 - DNA, 22 bp, Homo sapiens
gtttcctttgccagtaaatggg

SEQ ID NO: 7587185 - DNA, 22 bp, Homo sapiens
gtttcctttgccagtaaatggg

SEQ ID NO: 7587186 - DNA, 22 bp, Homo sapiens
gtttcctttgccagtaaatggg

SEQ ID NO: 7587187 - DNA, 22 bp, Homo sapiens
gtttcccatatctagggagagg

SEQ ID NO: 7587188 - DNA, 22 bp, Homo sapiens
gtttatatgtgtgccactctta

SEQ ID NO: 7587189 - DNA, 22 bp, Homo sapiens
gtttcccatatctagggagagg

SEQ ID NO: 7587190 - DNA, 22 bp, Homo sapiens
gtttccgccctgggcctgtggg

SEQ ID NO: 7587191 - DNA, 22 bp, Homo sapiens
gtttcctacactgtagtattat

SEQ ID NO: 7587192 - DNA, 22 bp, Homo sapiens
gtttcctaccagtggttccaga

SEQ ID NO: 7587193 - DNA, 22 bp, Homo sapiens
gtttcctagatcagtgttctta

SEQ ID NO: 7587194 - DNA, 22 bp, Homo sapiens
gtttcctacactgtagtattat

SEQ ID NO: 7587195 - DNA, 22 bp, Homo sapiens
gtttcctaggcttatacagctg

SEQ ID NO: 7587196 - DNA, 22 bp, Homo sapiens
gtttatatgaacttcataccca

SEQ ID NO: 7587197 - DNA, 22 bp, Homo sapiens
gtttatacagtgcatggtgtta

SEQ ID NO: 7587198 - DNA, 22 bp, Homo sapiens
gtttatacagtgcatggtgtta

SEQ ID NO: 7587199 - DNA, 22 bp, Homo sapiens
gtttatatgtgtgccactctta

SEQ ID NO: 7587200 - DNA, 22 bp, Homo sapiens
gtttatatgtgtgccactctta

SEQ ID NO: 7587201 - DNA, 22 bp, Homo sapiens
gtttatatgaacttcataccca

SEQ ID NO: 7587202 - DNA, 22 bp, Homo sapiens
gtttataatccaactctgctcc

SEQ ID NO: 7587203 - DNA, 22 bp, Homo sapiens
gtttataatccaactctgctcc

SEQ ID NO: 7587204 - DNA, 22 bp, Homo sapiens
gtttataatgtctgtgccaaaa

SEQ ID NO: 7587205 - DNA, 22 bp, Homo sapiens
gtttataatccaactctgctcc

SEQ ID NO: 7587206 - DNA, 22 bp, Homo sapiens
gtttataatgtctgtgccaaaa

SEQ ID NO: 7587207 - DNA, 20 bp, Homo sapiens
gtttatacagaagaccccaa

SEQ ID NO: 7587208 - DNA, 22 bp, Homo sapiens
gtttataaggcccaatatttct

SEQ ID NO: 7587209 - DNA, 22 bp, Homo sapiens
gtttataaggtaaaggagagag

SEQ ID NO: 7587210 - DNA, 22 bp, Homo sapiens
gtttataaggcccaatatttct

SEQ ID NO: 7587211 - DNA, 22 bp, Homo sapiens
gtttctaagcacatgtgagtgt

SEQ ID NO: 7587212 - DNA, 22 bp, Homo sapiens
gtttctaagcacatgtgagtgt

SEQ ID NO: 7587213 - DNA, 22 bp, Homo sapiens
gtttctaaatgttctgagtttt

SEQ ID NO: 7587214 - DNA, 22 bp, Homo sapiens
gtttctaaatgttctgagtttt

SEQ ID NO: 7587215 - DNA, 22 bp, Homo sapiens
gtttctaaatgttctgagtttt

SEQ ID NO: 7587216 - DNA, 22 bp, Homo sapiens
gtttccttttggaattagagct

SEQ ID NO: 7587217 - DNA, 22 bp, Homo sapiens
gtttctaaatgttctgagtttt

SEQ ID NO: 7587218 - DNA, 22 bp, Homo sapiens
gtttcctttttctgccctcaat

SEQ ID NO: 7587219 - DNA, 22 bp, Homo sapiens
gtttcctttttctgccctcaat

SEQ ID NO: 7587220 - DNA, 22 bp, Homo sapiens
gtttcgtcaggcttattctatc

SEQ ID NO: 7587221 - DNA, 22 bp, Homo sapiens
gtttcgtcaggcttattctatc

SEQ ID NO: 7587222 - DNA, 22 bp, Homo sapiens
gtttcctttttctgccctcaat

SEQ ID NO: 7587223 - DNA, 22 bp, Homo sapiens
gtttctaagggagagctgccag

SEQ ID NO: 7587224 - DNA, 22 bp, Homo sapiens
gtttctaagggagagctgccag

SEQ ID NO: 7587225 - DNA, 22 bp, Homo sapiens
gtttctaagcacatgtgagtgt

SEQ ID NO: 7587226 - DNA, 22 bp, Homo sapiens
gtttctaattggaactttgagg

SEQ ID NO: 7587227 - DNA, 22 bp, Homo sapiens
gtttctaattggaactttgagg

SEQ ID NO: 7587228 - DNA, 22 bp, Homo sapiens
gtttctacatgcctctttcacc

SEQ ID NO: 7587229 - DNA, 22 bp, Homo sapiens
gtttctatggtttatattactg

SEQ ID NO: 7587230 - DNA, 22 bp, Homo sapiens
gtttctaattggaactttgagg

SEQ ID NO: 7587231 - DNA, 22 bp, Homo sapiens
gtttctaattggaactttgagg

SEQ ID NO: 7587232 - DNA, 22 bp, Homo sapiens
gtttctaattggaactttgagg

SEQ ID NO: 7587233 - DNA, 22 bp, Homo sapiens
gtttctcaaattatttcagctt

SEQ ID NO: 7587234 - DNA, 22 bp, Homo sapiens
gtttctcaacatgctttctaac

SEQ ID NO: 7587235 - DNA, 22 bp, Homo sapiens
gtttctcaacatgctttctaac

SEQ ID NO: 7587236 - DNA, 22 bp, Homo sapiens
gtttctcaacatgctttctaac

SEQ ID NO: 7587237 - DNA, 22 bp, Homo sapiens
gtttctcaagcttgaatgcaca

SEQ ID NO: 7587238 - DNA, 22 bp, Homo sapiens
gtttctcaagcttgaatgcaca

SEQ ID NO: 7587239 - DNA, 22 bp, Homo sapiens
gtttctcaacatgctttctaac

SEQ ID NO: 7587240 - DNA, 22 bp, Homo sapiens
gtttctcaacatgctttctaac

SEQ ID NO: 7587241 - DNA, 22 bp, Homo sapiens
gtttctatggtttatattactg

SEQ ID NO: 7587242 - DNA, 22 bp, Homo sapiens
gtttctatggtttatattactg

SEQ ID NO: 7587243 - DNA, 22 bp, Homo sapiens
gtttctatggtttatattactg

SEQ ID NO: 7587244 - DNA, 22 bp, Homo sapiens
gtttctcaaattatttcagctt

SEQ ID NO: 7587245 - DNA, 22 bp, Homo sapiens
gtttctatggtttatattactg

SEQ ID NO: 7587246 - DNA, 22 bp, Homo sapiens
gtttctcagcatgtcagtacaa

SEQ ID NO: 7587247 - DNA, 22 bp, Homo sapiens
gtttctcagcatgtcagtacaa

SEQ ID NO: 7587248 - DNA, 22 bp, Homo sapiens
gtttctcagtttggtctgcaga

SEQ ID NO: 7587249 - DNA, 22 bp, Homo sapiens
gtttctcagcatgtcagtacaa

SEQ ID NO: 7587250 - DNA, 22 bp, Homo sapiens
gtttctcagcaactatatgact

SEQ ID NO: 7587251 - DNA, 22 bp, Homo sapiens
gtttctcagaggcccccaaaca

SEQ ID NO: 7587252 - DNA, 22 bp, Homo sapiens
gtttctcacttccagtagccaa

SEQ ID NO: 7587253 - DNA, 22 bp, Homo sapiens
gtttctcacaaggctgcaatcc

SEQ ID NO: 7587254 - DNA, 22 bp, Homo sapiens
gtttctcacaaggctgcaatcc

SEQ ID NO: 7587255 - DNA, 22 bp, Homo sapiens
gtttctcacttaccaacacatg

SEQ ID NO: 7587256 - DNA, 22 bp, Homo sapiens
gtttctcacttaccaacacatg

SEQ ID NO: 7587257 - DNA, 22 bp, Homo sapiens
gtttctcaagcttgaatgcaca

SEQ ID NO: 7587258 - DNA, 22 bp, Homo sapiens
gtttctcaagcttgaatgcaca

SEQ ID NO: 7587259 - DNA, 22 bp, Homo sapiens
gttcctttgtttagcagagaca

SEQ ID NO: 7587260 - DNA, 22 bp, Homo sapiens
gtttaattttaggttgtcaagc

SEQ ID NO: 7587261 - DNA, 22 bp, Homo sapiens
gtttacaaatattttaaatggt

SEQ ID NO: 7587262 - DNA, 22 bp, Homo sapiens
gtttacaaatattttaaatggt

SEQ ID NO: 7587263 - DNA, 22 bp, Homo sapiens
gtttacaaatattttaaatggt

SEQ ID NO: 7587264 - DNA, 22 bp, Homo sapiens
gtttacaaatattttaaatggt

SEQ ID NO: 7587265 - DNA, 22 bp, Homo sapiens
gtttaattttaggttgtcaagc

SEQ ID NO: 7587266 - DNA, 22 bp, Homo sapiens
gtttaattttaggttgtcaagc

SEQ ID NO: 7587267 - DNA, 22 bp, Homo sapiens
gttccttgtaatttgttaagga

SEQ ID NO: 7587268 - DNA, 22 bp, Homo sapiens
gttccttgggaacaacgctgaa

SEQ ID NO: 7587269 - DNA, 22 bp, Homo sapiens
gttccttgggaacaacgctgaa

SEQ ID NO: 7587270 - DNA, 22 bp, Homo sapiens
gttccttgtatttcagacatga

SEQ ID NO: 7587271 - DNA, 22 bp, Homo sapiens
gttccttgtatttcagacatga

SEQ ID NO: 7587272 - DNA, 22 bp, Homo sapiens
gttccttgtatttcagacatga

SEQ ID NO: 7587273 - DNA, 22 bp, Homo sapiens
gttcctttcctatttggataag

SEQ ID NO: 7587274 - DNA, 22 bp, Homo sapiens
gttccttgtatttcagacatga

SEQ ID NO: 7587275 - DNA, 22 bp, Homo sapiens
gttcctttcctatttggataag

SEQ ID NO: 7587276 - DNA, 22 bp, Homo sapiens
gttccttgggaacaacgctgaa

SEQ ID NO: 7587277 - DNA, 22 bp, Homo sapiens
gttccttggaagaacttgaggt

SEQ ID NO: 7587278 - DNA, 22 bp, Homo sapiens
gttccttgggaacaacgctgaa

SEQ ID NO: 7587279 - DNA, 22 bp, Homo sapiens
gttccttggaagaacttgaggt

SEQ ID NO: 7587280 - DNA, 23 bp, Homo sapiens
gttccttcatgtggtcattggtt

SEQ ID NO: 7587281 - DNA, 16 bp, Homo sapiens
gttccttcccacacct

SEQ ID NO: 7587282 - DNA, 22 bp, Homo sapiens
gttccttcctatcccgagagcc

SEQ ID NO: 7587283 - DNA, 22 bp, Homo sapiens
gttcctggtggtcatggcagct

SEQ ID NO: 7587284 - DNA, 22 bp, Homo sapiens
gttcctggtggtcatggcagct

SEQ ID NO: 7587285 - DNA, 22 bp, Homo sapiens
gttcctggtggtcatggcagct

SEQ ID NO: 7587286 - DNA, 22 bp, Homo sapiens
gttcctgtggggttaaccctga

SEQ ID NO: 7587287 - DNA, 22 bp, Homo sapiens
gttcctgtggggttaaccctga

SEQ ID NO: 7587288 - DNA, 22 bp, Homo sapiens
gttccttagagttgatatggta

SEQ ID NO: 7587289 - DNA, 23 bp, Homo sapiens
gttccttcatgtggtcattggtt

SEQ ID NO: 7587290 - DNA, 23 bp, Homo sapiens
gttccttcatgtggtcattggtt

SEQ ID NO: 7587291 - DNA, 23 bp, Homo sapiens
gttccttcatgtggtcattggtt

SEQ ID NO: 7587292 - DNA, 22 bp, Homo sapiens
gttcctggtggtcatggcagct

SEQ ID NO: 7587293 - DNA, 22 bp, Homo sapiens
gttcctggtggtcatggcagct

SEQ ID NO: 7587294 - DNA, 22 bp, Homo sapiens
gttcctgggcctgcattcacca

SEQ ID NO: 7587295 - DNA, 22 bp, Homo sapiens
gttcctggtggtcatggcagct

SEQ ID NO: 7587296 - DNA, 22 bp, Homo sapiens
gttcctgggaggcatgggctgg

SEQ ID NO: 7587297 - DNA, 22 bp, Homo sapiens
gttcctgggaggcatgggctgg

SEQ ID NO: 7587298 - DNA, 22 bp, Homo sapiens
gttccatatcacagcagacgaa

SEQ ID NO: 7587299 - DNA, 22 bp, Homo sapiens
gttcccacagtatatttttgca

SEQ ID NO: 7587300 - DNA, 22 bp, Homo sapiens
gttccaggtggtcacagagctc

SEQ ID NO: 7587301 - DNA, 22 bp, Homo sapiens
gttccaggtggtcacagagctc

SEQ ID NO: 7587302 - DNA, 22 bp, Homo sapiens
gttccagggaagggaaggcaga

SEQ ID NO: 7587303 - DNA, 22 bp, Homo sapiens
gttccaggtggtcacagagctc

SEQ ID NO: 7587304 - DNA, 22 bp, Homo sapiens
gttccaggtggtcacagagctc

SEQ ID NO: 7587305 - DNA, 22 bp, Homo sapiens
gttccagggaagggaaggcaga

SEQ ID NO: 7587306 - DNA, 22 bp, Homo sapiens
gttccagggaagggaaggcaga

SEQ ID NO: 7587307 - DNA, 22 bp, Homo sapiens
gttccagggaagggaaggcaga

SEQ ID NO: 7587308 - DNA, 22 bp, Homo sapiens
gttccaggcagtggcaacagct

SEQ ID NO: 7587309 - DNA, 22 bp, Homo sapiens
gttccagggaagggaaggcaga

SEQ ID NO: 7587310 - DNA, 22 bp, Homo sapiens
gttccaggcagtggcaacagct

SEQ ID NO: 7587311 - DNA, 22 bp, Homo sapiens
gttccaggcaagtgggatagga

SEQ ID NO: 7587312 - DNA, 22 bp, Homo sapiens
gttccaggcaagtgggatagga

SEQ ID NO: 7587313 - DNA, 22 bp, Homo sapiens
gttcccactagactgctactta

SEQ ID NO: 7587314 - DNA, 22 bp, Homo sapiens
gttcccacgcctcctctccagc

SEQ ID NO: 7587315 - DNA, 22 bp, Homo sapiens
gttcccacttggtgcactatga

SEQ ID NO: 7587316 - DNA, 18 bp, Homo sapiens
gttcccagatggtgctga

SEQ ID NO: 7587317 - DNA, 22 bp, Homo sapiens
gttcccacgcctcctctccagc

SEQ ID NO: 7587318 - DNA, 22 bp, Homo sapiens
gttcccaccatgctgcacccat

SEQ ID NO: 7587319 - DNA, 22 bp, Homo sapiens
gttcccacccctgagctccgat

SEQ ID NO: 7587320 - DNA, 18 bp, Homo sapiens
gttcccagatggtgctga

SEQ ID NO: 7587321 - DNA, 18 bp, Homo sapiens
gttcccagatggtgctga

SEQ ID NO: 7587322 - DNA, 20 bp, Homo sapiens
gttcccaggaattgaagacc

SEQ ID NO: 7587323 - DNA, 18 bp, Homo sapiens
gttcccagatggtgctga

SEQ ID NO: 7587324 - DNA, 22 bp, Homo sapiens
gttccacaaaatgtacccagtt

SEQ ID NO: 7587325 - DNA, 22 bp, Homo sapiens
gttccacataacacatctacaa

SEQ ID NO: 7587326 - DNA, 22 bp, Homo sapiens
gttccacagtgagataaaagca

SEQ ID NO: 7587327 - DNA, 22 bp, Homo sapiens
gttccacagtgagataaaagca

SEQ ID NO: 7587328 - DNA, 22 bp, Homo sapiens
gttccacatcacactacttgat

SEQ ID NO: 7587329 - DNA, 22 bp, Homo sapiens
gttccacatttgtaaaatgagg

SEQ ID NO: 7587330 - DNA, 22 bp, Homo sapiens
gttccagacttgccagtggaag

SEQ ID NO: 7587331 - DNA, 22 bp, Homo sapiens
gttccagacttgccagtggaag

SEQ ID NO: 7587332 - DNA, 22 bp, Homo sapiens
gttccagacttgccagtggaag

SEQ ID NO: 7587333 - DNA, 22 bp, Homo sapiens
gttccaggaccctggcctctga

SEQ ID NO: 7587334 - DNA, 22 bp, Homo sapiens
gttccacatttgtaaaatgagg

SEQ ID NO: 7587335 - DNA, 22 bp, Homo sapiens
gttccaggaccctggcctctga

SEQ ID NO: 7587336 - DNA, 22 bp, Homo sapiens
gttccaggcaagtgggatagga

SEQ ID NO: 7587337 - DNA, 22 bp, Homo sapiens
gttccaggaccctggcctctga

SEQ ID NO: 7587338 - DNA, 22 bp, Homo sapiens
gtttacaaatattttaaatggt

SEQ ID NO: 7587339 - DNA, 22 bp, Homo sapiens
gtttacaaatattttaaatggt

SEQ ID NO: 7587340 - DNA, 22 bp, Homo sapiens
gtttacaaatattttaaatggt

SEQ ID NO: 7587341 - DNA, 22 bp, Homo sapiens
gtttacaaatattttaaatggt

SEQ ID NO: 7587342 - DNA, 22 bp, Homo sapiens
gtttacaaatattttaaatggt

SEQ ID NO: 7587343 - DNA, 22 bp, Homo sapiens
gtttacaaatattttaaatggt

SEQ ID NO: 7587344 - DNA, 22 bp, Homo sapiens
gtttacaaatattttaaatggt

SEQ ID NO: 7587345 - DNA, 22 bp, Homo sapiens
gtttacattgctgtttgtgtct

SEQ ID NO: 7587346 - DNA, 22 bp, Homo sapiens
gtttactgttttctgataagtg

SEQ ID NO: 7587347 - DNA, 22 bp, Homo sapiens
gtttacttagatgctcatgcag

SEQ ID NO: 7587348 - DNA, 22 bp, Homo sapiens
gtttacttctgcttaggcctct

SEQ ID NO: 7587349 - DNA, 22 bp, Homo sapiens
gtttacttagatgctcatgcag

SEQ ID NO: 7587350 - DNA, 22 bp, Homo sapiens
gtttacttagatgctcatgcag

SEQ ID NO: 7587351 - DNA, 22 bp, Homo sapiens
gtttactgctctaggttgcaca

SEQ ID NO: 7587352 - DNA, 22 bp, Homo sapiens
gtttactgctctaggttgcaca

SEQ ID NO: 7587353 - DNA, 22 bp, Homo sapiens
gtttactggagaagatgacctg

SEQ ID NO: 7587354 - DNA, 22 bp, Homo sapiens
gtttactggagaagatgacctg

SEQ ID NO: 7587355 - DNA, 22 bp, Homo sapiens
gtttactgtcttgcacagtgca

SEQ ID NO: 7587356 - DNA, 22 bp, Homo sapiens
gtttactgtcttgcacagtgca

SEQ ID NO: 7587357 - DNA, 22 bp, Homo sapiens
gtttactgttaaccaacgaatg

SEQ ID NO: 7587358 - DNA, 22 bp, Homo sapiens
gtttactgttaaccaacgaatg

SEQ ID NO: 7587359 - DNA, 22 bp, Homo sapiens
gtttagaaaatagtgaagcaag

SEQ ID NO: 7587360 - DNA, 22 bp, Homo sapiens
gtttagaaaatagtgaagcaag

SEQ ID NO: 7587361 - DNA, 22 bp, Homo sapiens
gtttacttgtgccttggcttaa

SEQ ID NO: 7587362 - DNA, 22 bp, Homo sapiens
gtttacttttcatggagcatat

SEQ ID NO: 7587363 - DNA, 22 bp, Homo sapiens
gtttagaaaatagtgaagcaag

SEQ ID NO: 7587364 - DNA, 22 bp, Homo sapiens
gtttagaaaatagtgaagcaag

SEQ ID NO: 7587365 - DNA, 22 bp, Homo sapiens
gtttagaacacggaaatactga

SEQ ID NO: 7587366 - DNA, 22 bp, Homo sapiens
gtttagaacacggaaatactga

SEQ ID NO: 7587367 - DNA, 22 bp, Homo sapiens
gtttagaagccaagatttgggt

SEQ ID NO: 7587368 - DNA, 21 bp, Homo sapiens
gtttagaagtagtctggctca

SEQ ID NO: 7587369 - DNA, 22 bp, Homo sapiens
gtttagaatgaaacttttgagc

SEQ ID NO: 7587370 - DNA, 21 bp, Homo sapiens
gtttagaagtagtctggctca

SEQ ID NO: 7587371 - DNA, 22 bp, Homo sapiens
gtttagaacacggaaatactga

SEQ ID NO: 7587372 - DNA, 22 bp, Homo sapiens
gtttagaagccaagatttgggt

SEQ ID NO: 7587373 - DNA, 22 bp, Homo sapiens
gtttagaagccaagatttgggt

SEQ ID NO: 7587374 - DNA, 22 bp, Homo sapiens
gtttagctatgtacagaatgcc

SEQ ID NO: 7587375 - DNA, 16 bp, Homo sapiens
gtttaggcacattaag

SEQ ID NO: 7587376 - DNA, 18 bp, Homo sapiens
gtttaggctacttaaaat

SEQ ID NO: 7587377 - DNA, 22 bp, Homo sapiens
gtttagcaataaaaacacatga

SEQ ID NO: 7587378 - DNA, 22 bp, Homo sapiens
gtttagcaataaaaacacatga

SEQ ID NO: 7587379 - DNA, 20 bp, Homo sapiens
gtttagcatggcagtgaaag

SEQ ID NO: 7587380 - DNA, 20 bp, Homo sapiens
gtttagcatggcagtgaaag

SEQ ID NO: 7587381 - DNA, 20 bp, Homo sapiens
gtttagcatggcagtgaaag

SEQ ID NO: 7587382 - DNA, 22 bp, Homo sapiens
gtttataaattctgcttttgtt

SEQ ID NO: 7587383 - DNA, 22 bp, Homo sapiens
gtttataaattctgcttttgtt

SEQ ID NO: 7587384 - DNA, 22 bp, Homo sapiens
gtttagtgtttcaagactcttt

SEQ ID NO: 7587385 - DNA, 22 bp, Homo sapiens
gtttataaattctgcttttgtt

SEQ ID NO: 7587386 - DNA, 22 bp, Homo sapiens
gtttataaattctgcttttgtt

SEQ ID NO: 7587387 - DNA, 22 bp, Homo sapiens
gtttagtgggacagtttaaagt

SEQ ID NO: 7587388 - DNA, 22 bp, Homo sapiens
gtttataaggcccaatatttct

SEQ ID NO: 7587389 - DNA, 22 bp, Homo sapiens
gtttataaggcccaatatttct

SEQ ID NO: 7587390 - DNA, 22 bp, Homo sapiens
gtttataaggcccaatatttct

SEQ ID NO: 7587391 - DNA, 22 bp, Homo sapiens
gtttataaggcccaatatttct

SEQ ID NO: 7587392 - DNA, 22 bp, Homo sapiens
gtttataaggcccaatatttct

SEQ ID NO: 7587393 - DNA, 22 bp, Homo sapiens
gtttagaatggcaaaattaagt

SEQ ID NO: 7587394 - DNA, 22 bp, Homo sapiens
gtttagaatggcaaaattaagt

SEQ ID NO: 7587395 - DNA, 22 bp, Homo sapiens
gtttagaatgaaacttttgagc

SEQ ID NO: 7587396 - DNA, 22 bp, Homo sapiens
gtttagaatggcaaaattaagt

SEQ ID NO: 7587397 - DNA, 22 bp, Homo sapiens
gtttagaatgaaacttttgagc

SEQ ID NO: 7587398 - DNA, 22 bp, Homo sapiens
gtttagaattctaactttaagg

SEQ ID NO: 7587399 - DNA, 22 bp, Homo sapiens
gtttagaattctaactttaagg

SEQ ID NO: 7587400 - DNA, 22 bp, Homo sapiens
gtttagaatggcaaaattaagt

SEQ ID NO: 7587401 - DNA, 22 bp, Homo sapiens
gtttagaatggcaaaattaagt

SEQ ID NO: 7587402 - DNA, 22 bp, Homo sapiens
gtttagaattctaactttaagg

SEQ ID NO: 7587403 - DNA, 22 bp, Homo sapiens
gtttagaattctaactttaagg

SEQ ID NO: 7587404 - DNA, 22 bp, Homo sapiens
gtttagaattctaactttaagg

SEQ ID NO: 7587405 - DNA, 22 bp, Homo sapiens
gtttagaattctaactttaagg

SEQ ID NO: 7587406 - DNA, 22 bp, Homo sapiens
gtttagatgaaagtttgtttca

SEQ ID NO: 7587407 - DNA, 22 bp, Homo sapiens
gtttagatgagattttagaaca

SEQ ID NO: 7587408 - DNA, 22 bp, Homo sapiens
gtttagactccttggtcttctg

SEQ ID NO: 7587409 - DNA, 22 bp, Homo sapiens
gtttagactccttggtcttctg

SEQ ID NO: 7587410 - DNA, 22 bp, Homo sapiens
gtttagaccaatcataatttat

SEQ ID NO: 7587411 - DNA, 22 bp, Homo sapiens
gtttagaattctaactttaagg

SEQ ID NO: 7587412 - DNA, 22 bp, Homo sapiens
gtttagaattctaactttaagg

SEQ ID NO: 7587413 - DNA, 22 bp, Homo sapiens
taatgacttgaaggacccatgg

SEQ ID NO: 7587414 - DNA, 22 bp, Homo sapiens
taatgactgccgtctctcttca

SEQ ID NO: 7587415 - DNA, 22 bp, Homo sapiens
taatgactgccgtctctcttca

SEQ ID NO: 7587416 - DNA, 22 bp, Homo sapiens
taatgactaagcatcattaaac

SEQ ID NO: 7587417 - DNA, 23 bp, Homo sapiens
taatgagaagctttgtttcctga

SEQ ID NO: 7587418 - DNA, 22 bp, Homo sapiens
taatgaggaaatagagggaatg

SEQ ID NO: 7587419 - DNA, 22 bp, Homo sapiens
taatgaacatcttaatctgaaa

SEQ ID NO: 7587420 - DNA, 22 bp, Homo sapiens
taatgaacatgcatcgtgtgta

SEQ ID NO: 7587421 - DNA, 22 bp, Homo sapiens
taatgaactctttactttggga

SEQ ID NO: 7587422 - DNA, 22 bp, Homo sapiens
taatgaacatcttaatctgaaa

SEQ ID NO: 7587423 - DNA, 22 bp, Homo sapiens
taataacaattgtaggacatga

SEQ ID NO: 7587424 - DNA, 22 bp, Homo sapiens
taatgaatgagaatataacaga

SEQ ID NO: 7587425 - DNA, 22 bp, Homo sapiens
taatgaatgagaatataacaga

SEQ ID NO: 7587426 - DNA, 22 bp, Homo sapiens
taatgaatgagaatataacaga

SEQ ID NO: 7587427 - DNA, 22 bp, Homo sapiens
taatgaataaacttgagagtca

SEQ ID NO: 7587428 - DNA, 22 bp, Homo sapiens
taatgaataaacttgagagtca

SEQ ID NO: 7587429 - DNA, 22 bp, Homo sapiens
taatgaatgagaatataacaga

SEQ ID NO: 7587430 - DNA, 22 bp, Homo sapiens
taatgaatgagaatataacaga

SEQ ID NO: 7587431 - DNA, 22 bp, Homo sapiens
taatgaatgagaatataacaga

SEQ ID NO: 7587432 - DNA, 22 bp, Homo sapiens
taatgaatgagaatataacaga

SEQ ID NO: 7587433 - DNA, 22 bp, Homo sapiens
taatgaatgagaatataacaga

SEQ ID NO: 7587434 - DNA, 22 bp, Homo sapiens
taatgaatgagaatataacaga

SEQ ID NO: 7587435 - DNA, 22 bp, Homo sapiens
taatgaatgagaatataacaga

SEQ ID NO: 7587436 - DNA, 22 bp, Homo sapiens
taatgactaagcatcattaaac

SEQ ID NO: 7587437 - DNA, 22 bp, Homo sapiens
taatgactaagcatcattaaac

SEQ ID NO: 7587438 - DNA, 22 bp, Homo sapiens
taatgacattgtatccacagag

SEQ ID NO: 7587439 - DNA, 22 bp, Homo sapiens
taatgacattgtatccacagag

SEQ ID NO: 7587440 - DNA, 22 bp, Homo sapiens
taatgacattgtatccacagag

SEQ ID NO: 7587441 - DNA, 22 bp, Homo sapiens
taatgacattgtatccacagag

SEQ ID NO: 7587442 - DNA, 22 bp, Homo sapiens
taatgactaagcaatcatgaat

SEQ ID NO: 7587443 - DNA, 22 bp, Homo sapiens
taatgactaagcaatcatgaat

SEQ ID NO: 7587444 - DNA, 22 bp, Homo sapiens
taatgagtcattcctgaatgct

SEQ ID NO: 7587445 - DNA, 22 bp, Homo sapiens
taatgataagagaggttctggc

SEQ ID NO: 7587446 - DNA, 22 bp, Homo sapiens
taatgatgtgtgcaaactgaat

SEQ ID NO: 7587447 - DNA, 22 bp, Homo sapiens
taatgatgcagttactgtctca

SEQ ID NO: 7587448 - DNA, 22 bp, Homo sapiens
taatgatatttcccatttctct

SEQ ID NO: 7587449 - DNA, 21 bp, Homo sapiens
taatgcaaggaactaatgtca

SEQ ID NO: 7587450 - DNA, 22 bp, Homo sapiens
taatgcaacgtgagataattaa

SEQ ID NO: 7587451 - DNA, 21 bp, Homo sapiens
taatgcaaggaactaatgtca

SEQ ID NO: 7587452 - DNA, 22 bp, Homo sapiens
taatgcaaggaattccaagtag

SEQ ID NO: 7587453 - DNA, 22 bp, Homo sapiens
taatgcaaggaattccaagtag

SEQ ID NO: 7587454 - DNA, 22 bp, Homo sapiens
taatgcaacgtgagataattaa

SEQ ID NO: 7587455 - DNA, 22 bp, Homo sapiens
taatgcaacgtgagataattaa

SEQ ID NO: 7587456 - DNA, 22 bp, Homo sapiens
taatgcaacagctgctagtgat

SEQ ID NO: 7587457 - DNA, 19 bp, Homo sapiens
taatgcacttaacacatgg

SEQ ID NO: 7587458 - DNA, 22 bp, Homo sapiens
taatgccaatttaatgatccat

SEQ ID NO: 7587459 - DNA, 22 bp, Homo sapiens
taatgcatgtaatgggctgata

SEQ ID NO: 7587460 - DNA, 22 bp, Homo sapiens
taatgcagtactgatataaaca

SEQ ID NO: 7587461 - DNA, 23 bp, Homo sapiens
taatgccagccctgcagttaagc

SEQ ID NO: 7587462 - DNA, 22 bp, Homo sapiens
taatgcaaggaattccaagtag

SEQ ID NO: 7587463 - DNA, 22 bp, Homo sapiens
taatgccacggcagggaacagc

SEQ ID NO: 7587464 - DNA, 22 bp, Homo sapiens
taatgccacctacctgctttat

SEQ ID NO: 7587465 - DNA, 22 bp, Homo sapiens
taatgccacctacctgctttat

SEQ ID NO: 7587466 - DNA, 22 bp, Homo sapiens
taatgccaatttaatgatccat

SEQ ID NO: 7587467 - DNA, 19 bp, Homo sapiens
taatgcacttaacacatgg

SEQ ID NO: 7587468 - DNA, 22 bp, Homo sapiens
taatgcacctttgctttctgaa

SEQ ID NO: 7587469 - DNA, 22 bp, Homo sapiens
taatgcacatgactgaactatt

SEQ ID NO: 7587470 - DNA, 22 bp, Homo sapiens
taatgcacatagaagtacttag

SEQ ID NO: 7587471 - DNA, 22 bp, Homo sapiens
taatgcacatagaagtacttag

SEQ ID NO: 7587472 - DNA, 22 bp, Homo sapiens
taatgcacatagaagtacttag

SEQ ID NO: 7587473 - DNA, 23 bp, Homo sapiens
taatgcacatctgtgagctccta

SEQ ID NO: 7587474 - DNA, 22 bp, Homo sapiens
taatgcaatttagcaaagtttt

SEQ ID NO: 7587475 - DNA, 22 bp, Homo sapiens
taatgcaatttagcaaagtttt

SEQ ID NO: 7587476 - DNA, 22 bp, Homo sapiens
taatgcaatttagcaaagtttt

SEQ ID NO: 7587477 - DNA, 22 bp, Homo sapiens
taatgcaaggaattccaagtag

SEQ ID NO: 7587478 - DNA, 22 bp, Homo sapiens
taatgcacagaattgacatggg

SEQ ID NO: 7587479 - DNA, 22 bp, Homo sapiens
taatgcacagaattgacatggg

SEQ ID NO: 7587480 - DNA, 22 bp, Homo sapiens
taatgcacagaattgacatggg

SEQ ID NO: 7587481 - DNA, 22 bp, Homo sapiens
taatgcttcaatttccttgatt

SEQ ID NO: 7587482 - DNA, 22 bp, Homo sapiens
taatgcttcaatttccttgatt

SEQ ID NO: 7587483 - DNA, 22 bp, Homo sapiens
taatgcttatgttatgcaattt

SEQ ID NO: 7587484 - DNA, 22 bp, Homo sapiens
taatgcttatgttatgcaattt

SEQ ID NO: 7587485 - DNA, 22 bp, Homo sapiens
taatgcttaatgtaggctggaa

SEQ ID NO: 7587486 - DNA, 22 bp, Homo sapiens
taatgcttgcaaattatgggac

SEQ ID NO: 7587487 - DNA, 22 bp, Homo sapiens
taatgcttctgttaggatcttc

SEQ ID NO: 7587488 - DNA, 22 bp, Homo sapiens
taatgcttgcaaattatgggac

SEQ ID NO: 7587489 - DNA, 22 bp, Homo sapiens
taatgcttcctatatagcactc

SEQ ID NO: 7587490 - DNA, 22 bp, Homo sapiens
taatgcttctgttaggatcttc

SEQ ID NO: 7587491 - DNA, 22 bp, Homo sapiens
taatgcttctgttaggatcttc

SEQ ID NO: 7587492 - DNA, 22 bp, Homo sapiens
taatgcttctgttaggatcttc

SEQ ID NO: 7587493 - DNA, 22 bp, Homo sapiens
taatgcttcctatatagcactc

SEQ ID NO: 7587494 - DNA, 22 bp, Homo sapiens
taatgcttcctatatagcactc

SEQ ID NO: 7587495 - DNA, 22 bp, Homo sapiens
taatgcttttccttcaaataag

SEQ ID NO: 7587496 - DNA, 22 bp, Homo sapiens
taatgctttgttttgatctaac

SEQ ID NO: 7587497 - DNA, 22 bp, Homo sapiens
taatgctttgttttgatctaac

SEQ ID NO: 7587498 - DNA, 22 bp, Homo sapiens
taatgctttgttttgatctaac

SEQ ID NO: 7587499 - DNA, 22 bp, Homo sapiens
taatgctttgttttgatctaac

SEQ ID NO: 7587500 - DNA, 22 bp, Homo sapiens
taatgctttgtcagcctaaggg

SEQ ID NO: 7587501 - DNA, 22 bp, Homo sapiens
taatgctttgtcagcctaaggg

SEQ ID NO: 7587502 - DNA, 22 bp, Homo sapiens
taatgcttttccttcaaataag

SEQ ID NO: 7587503 - DNA, 22 bp, Homo sapiens
taatgcttttccttcaaataag

SEQ ID NO: 7587504 - DNA, 22 bp, Homo sapiens
taatgcttttccttcaaataag

SEQ ID NO: 7587505 - DNA, 22 bp, Homo sapiens
taatgcttttccttcaaataag

SEQ ID NO: 7587506 - DNA, 22 bp, Homo sapiens
taatgccttatgtcaaatgtaa

SEQ ID NO: 7587507 - DNA, 23 bp, Homo sapiens
taatgccagccctgcagttaagc

SEQ ID NO: 7587508 - DNA, 22 bp, Homo sapiens
taatgcctagattattctgttt

SEQ ID NO: 7587509 - DNA, 20 bp, Homo sapiens
taatgcctcatgatactaga

SEQ ID NO: 7587510 - DNA, 22 bp, Homo sapiens
taatgctcaccctgcatcaggc

SEQ ID NO: 7587511 - DNA, 22 bp, Homo sapiens
taatgctcaccctgcatcaggc

SEQ ID NO: 7587512 - DNA, 22 bp, Homo sapiens
taatgctgagtgatgttgaaag

SEQ ID NO: 7587513 - DNA, 22 bp, Homo sapiens
taatgctaacatcatatcactg

SEQ ID NO: 7587514 - DNA, 22 bp, Homo sapiens
taatgctaacatcatatcactg

SEQ ID NO: 7587515 - DNA, 22 bp, Homo sapiens
taatgctgccaagccatgcaga

SEQ ID NO: 7587516 - DNA, 22 bp, Homo sapiens
taatgctggattctttcttgtc

SEQ ID NO: 7587517 - DNA, 22 bp, Homo sapiens
taatgctgccaagccatgcaga

SEQ ID NO: 7587518 - DNA, 22 bp, Homo sapiens
taatgctgtggtctaatgggga

SEQ ID NO: 7587519 - DNA, 22 bp, Homo sapiens
taatgcttaattttcacaagcc

SEQ ID NO: 7587520 - DNA, 22 bp, Homo sapiens
taatgcttaattttcacaagcc

SEQ ID NO: 7587521 - DNA, 22 bp, Homo sapiens
taatgcttaattttcacaagcc

SEQ ID NO: 7587522 - DNA, 22 bp, Homo sapiens
taatgcttaacagctggctttt

SEQ ID NO: 7587523 - DNA, 22 bp, Homo sapiens
taatgcttaatgtaggctggaa

SEQ ID NO: 7587524 - DNA, 20 bp, Homo sapiens
taatgcttaacacatcccct

SEQ ID NO: 7587525 - DNA, 22 bp, Homo sapiens
taatgcttaacagctggctttt

SEQ ID NO: 7587526 - DNA, 22 bp, Homo sapiens
taatgcttaacagctggctttt

SEQ ID NO: 7587527 - DNA, 22 bp, Homo sapiens
taatttcactgatatgaagtca

SEQ ID NO: 7587528 - DNA, 22 bp, Homo sapiens
taatttcactgatatgaagtca

SEQ ID NO: 7587529 - DNA, 22 bp, Homo sapiens
taatttcagtgggctctgggct

SEQ ID NO: 7587530 - DNA, 22 bp, Homo sapiens
taatttctaattcattttcagt

SEQ ID NO: 7587531 - DNA, 22 bp, Homo sapiens
taatttctaattcattttcagt

SEQ ID NO: 7587532 - DNA, 22 bp, Homo sapiens
taatttcaccgttgctagaaat

SEQ ID NO: 7587533 - DNA, 22 bp, Homo sapiens
taatttcaccgttgctagaaat

SEQ ID NO: 7587534 - DNA, 22 bp, Homo sapiens
taatttcactgatatgaagtca

SEQ ID NO: 7587535 - DNA, 22 bp, Homo sapiens
taatttcactgatatgaagtca

SEQ ID NO: 7587536 - DNA, 22 bp, Homo sapiens
taatttcactgatatgaagtca

SEQ ID NO: 7587537 - DNA, 22 bp, Homo sapiens
taatttcacagttcaacgcaca

SEQ ID NO: 7587538 - DNA, 22 bp, Homo sapiens
taatttcacagttcaacgcaca

SEQ ID NO: 7587539 - DNA, 22 bp, Homo sapiens
taatttcacagttcaacgcaca

SEQ ID NO: 7587540 - DNA, 22 bp, Homo sapiens
taatttcaatagcttgcataat

SEQ ID NO: 7587541 - DNA, 22 bp, Homo sapiens
taatttcaatagcttgcataat

SEQ ID NO: 7587542 - DNA, 22 bp, Homo sapiens
taatttcaatagcttgcataat

SEQ ID NO: 7587543 - DNA, 22 bp, Homo sapiens
taatggagcaagccactgaatg

SEQ ID NO: 7587544 - DNA, 22 bp, Homo sapiens
taatggagccagaagatcttga

SEQ ID NO: 7587545 - DNA, 22 bp, Homo sapiens
taatggagcctgccttccaggg

SEQ ID NO: 7587546 - DNA, 22 bp, Homo sapiens
taatggaagttaaatatggtat

SEQ ID NO: 7587547 - DNA, 22 bp, Homo sapiens
taatggaagttaaatatggtat

SEQ ID NO: 7587548 - DNA, 22 bp, Homo sapiens
taatggaagttaaatatggtat

SEQ ID NO: 7587549 - DNA, 22 bp, Homo sapiens
taatggagatgctgaagtcaca

SEQ ID NO: 7587550 - DNA, 23 bp, Homo sapiens
taatggagtgtggctgcttcgag

SEQ ID NO: 7587551 - DNA, 22 bp, Homo sapiens
taatggagttggaattaataag

SEQ ID NO: 7587552 - DNA, 22 bp, Homo sapiens
taatggagtgacaaattggatt

SEQ ID NO: 7587553 - DNA, 22 bp, Homo sapiens
taatggaggtggcaaaaggtct

SEQ ID NO: 7587554 - DNA, 22 bp, Homo sapiens
taatggattaacgtccctgtcg

SEQ ID NO: 7587555 - DNA, 22 bp, Homo sapiens
taatggattaacgtccctgtcg

SEQ ID NO: 7587556 - DNA, 22 bp, Homo sapiens
taatggattaacgtccctgtcg

SEQ ID NO: 7587557 - DNA, 22 bp, Homo sapiens
taagtttaaatgtacatgaagc

SEQ ID NO: 7587558 - DNA, 22 bp, Homo sapiens
taagtttaaatgtacatgaagc

SEQ ID NO: 7587559 - DNA, 22 bp, Homo sapiens
taagttgtattcccttgctttt

SEQ ID NO: 7587560 - DNA, 22 bp, Homo sapiens
taagttgtattcccttgctttt

SEQ ID NO: 7587561 - DNA, 22 bp, Homo sapiens
taagtttaaatgtacatgaagc

SEQ ID NO: 7587562 - DNA, 22 bp, Homo sapiens
taagtttaaatgtacatgaagc

SEQ ID NO: 7587563 - DNA, 20 bp, Homo sapiens
taagttgtatttgtcatgaa

SEQ ID NO: 7587564 - DNA, 22 bp, Homo sapiens
taagtttaaatgtacatgaagc

SEQ ID NO: 7587565 - DNA, 22 bp, Homo sapiens
taagtttaaatgtacatgaagc

SEQ ID NO: 7587566 - DNA, 22 bp, Homo sapiens
taagttcttttctatgtaatat

SEQ ID NO: 7587567 - DNA, 18 bp, Homo sapiens
taagttcttaggcagctt

SEQ ID NO: 7587568 - DNA, 21 bp, Homo sapiens
taagttctgatccctatcaac

SEQ ID NO: 7587569 - DNA, 22 bp, Homo sapiens
taagttctgagtaaatactgtt

SEQ ID NO: 7587570 - DNA, 22 bp, Homo sapiens
taagttctgagtaaatactgtt

SEQ ID NO: 7587571 - DNA, 22 bp, Homo sapiens
taagttctgagtaaatactgtt

SEQ ID NO: 7587572 - DNA, 22 bp, Homo sapiens
taagttctctgaaatgaaaaag

SEQ ID NO: 7587573 - DNA, 22 bp, Homo sapiens
taagttcctagcctttacatag

SEQ ID NO: 7587574 - DNA, 22 bp, Homo sapiens
taagttcagttggtcgaagtag

SEQ ID NO: 7587575 - DNA, 22 bp, Homo sapiens
taagtttccagattgtaagtcc

SEQ ID NO: 7587576 - DNA, 22 bp, Homo sapiens
taagtttccagattgtaagtcc

SEQ ID NO: 7587577 - DNA, 22 bp, Homo sapiens
taagtttatagataaatgccta

SEQ ID NO: 7587578 - DNA, 22 bp, Homo sapiens
taagtttatagataaatgccta

SEQ ID NO: 7587579 - DNA, 22 bp, Homo sapiens
taagtttgaagtccatctgtac

SEQ ID NO: 7587580 - DNA, 22 bp, Homo sapiens
taagtttgaagtccatctgtac

SEQ ID NO: 7587581 - DNA, 22 bp, Homo sapiens
taagtttgaagtccatctgtac

SEQ ID NO: 7587582 - DNA, 22 bp, Homo sapiens
taagtttgactaactttatgta

SEQ ID NO: 7587583 - DNA, 22 bp, Homo sapiens
taagtttgacttttggctctgc

SEQ ID NO: 7587584 - DNA, 22 bp, Homo sapiens
taagtttggggaaaatgttaag

SEQ ID NO: 7587585 - DNA, 22 bp, Homo sapiens
taagtttggggaaaatgttaag

SEQ ID NO: 7587586 - DNA, 22 bp, Homo sapiens
taagtttgtgtctctgttactt

SEQ ID NO: 7587587 - DNA, 22 bp, Homo sapiens
taagtttgtgtctctgttactt

SEQ ID NO: 7587588 - DNA, 22 bp, Homo sapiens
taagtttaccactttcagaatt

SEQ ID NO: 7587589 - DNA, 22 bp, Homo sapiens
taagtttaccactttcagaatt

SEQ ID NO: 7587590 - DNA, 22 bp, Homo sapiens
taagtttatagataaatgccta

SEQ ID NO: 7587591 - DNA, 22 bp, Homo sapiens
taagtttagagagaatggggac

SEQ ID NO: 7587592 - DNA, 22 bp, Homo sapiens
taagtttagagagaatggggac

SEQ ID NO: 7587593 - DNA, 22 bp, Homo sapiens
taagtttaagtcatgtttgatg

SEQ ID NO: 7587594 - DNA, 22 bp, Homo sapiens
taagtttaaccctctgggacta

SEQ ID NO: 7587595 - DNA, 22 bp, Homo sapiens
taagtttaagtcatgtttgatg

SEQ ID NO: 7587596 - DNA, 22 bp, Homo sapiens
taagtttaagtcatgtttgatg

SEQ ID NO: 7587597 - DNA, 22 bp, Homo sapiens
taagtttaccactttcagaatt

SEQ ID NO: 7587598 - DNA, 22 bp, Homo sapiens
taataaagatgtgggctttgaa

SEQ ID NO: 7587599 - DNA, 22 bp, Homo sapiens
taataaagatgtgggctttgaa

SEQ ID NO: 7587600 - DNA, 22 bp, Homo sapiens
taataaactgctacgcttagtt

SEQ ID NO: 7587601 - DNA, 22 bp, Homo sapiens
taataaactgctacgcttagtt

SEQ ID NO: 7587602 - DNA, 22 bp, Homo sapiens
taagttttctggaataacttgg

SEQ ID NO: 7587603 - DNA, 22 bp, Homo sapiens
taataaactgctacgcttagtt

SEQ ID NO: 7587604 - DNA, 22 bp, Homo sapiens
taagttttctggaataacttgg

SEQ ID NO: 7587605 - DNA, 22 bp, Homo sapiens
taagttttctggaataacttgg

SEQ ID NO: 7587606 - DNA, 22 bp, Homo sapiens
taagttttctggaataacttgg

SEQ ID NO: 7587607 - DNA, 22 bp, Homo sapiens
taagttttctggaataacttgg

SEQ ID NO: 7587608 - DNA, 22 bp, Homo sapiens
taagttttaagcaatctgataa

SEQ ID NO: 7587609 - DNA, 22 bp, Homo sapiens
taagttttaagcaatctgataa

SEQ ID NO: 7587610 - DNA, 22 bp, Homo sapiens
taagttttaagcaatctgataa

SEQ ID NO: 7587611 - DNA, 22 bp, Homo sapiens
taagttttaagcaatctgataa

SEQ ID NO: 7587612 - DNA, 21 bp, Homo sapiens
taagtttggaagctgtcagca

SEQ ID NO: 7587613 - DNA, 22 bp, Homo sapiens
taagttttaagcaatctgataa

SEQ ID NO: 7587614 - DNA, 22 bp, Homo sapiens
taataaatgaaagtgctggcat

SEQ ID NO: 7587615 - DNA, 22 bp, Homo sapiens
taataaatgaaagtgctggcat

SEQ ID NO: 7587616 - DNA, 22 bp, Homo sapiens
taataaatgaaagtgctggcat

SEQ ID NO: 7587617 - DNA, 22 bp, Homo sapiens
taataaatgaaagtgctggcat

SEQ ID NO: 7587618 - DNA, 22 bp, Homo sapiens
taataaatgaaagtgctggcat

SEQ ID NO: 7587619 - DNA, 22 bp, Homo sapiens
taataaatgaaagtgctggcat

SEQ ID NO: 7587620 - DNA, 22 bp, Homo sapiens
taataaatgaaagtgctggcat

SEQ ID NO: 7587621 - DNA, 22 bp, Homo sapiens
taataacaattgtaggacatga

SEQ ID NO: 7587622 - DNA, 22 bp, Homo sapiens
taataacaattgtaggacatga

SEQ ID NO: 7587623 - DNA, 22 bp, Homo sapiens
taataacaattgtaggacatga

SEQ ID NO: 7587624 - DNA, 22 bp, Homo sapiens
taataacaattgtaggacatga

SEQ ID NO: 7587625 - DNA, 22 bp, Homo sapiens
taataacaattgtaggacatga

SEQ ID NO: 7587626 - DNA, 22 bp, Homo sapiens
taataacaattgtaggacatga

SEQ ID NO: 7587627 - DNA, 22 bp, Homo sapiens
taataacaattgtaggacatga

SEQ ID NO: 7587628 - DNA, 22 bp, Homo sapiens
taataacaattgtaggacatga

SEQ ID NO: 7587629 - DNA, 22 bp, Homo sapiens
taataaatgaaagtgctggcat

SEQ ID NO: 7587630 - DNA, 22 bp, Homo sapiens
taataaatgaaagtgctggcat

SEQ ID NO: 7587631 - DNA, 22 bp, Homo sapiens
taataaatgaaagtgctggcat

SEQ ID NO: 7587632 - DNA, 22 bp, Homo sapiens
taataaatgaaagtgctggcat

SEQ ID NO: 7587633 - DNA, 22 bp, Homo sapiens
taataaatgaaagtgctggcat

SEQ ID NO: 7587634 - DNA, 22 bp, Homo sapiens
taataaatgaaagtgctggcat

SEQ ID NO: 7587635 - DNA, 22 bp, Homo sapiens
taataaatgaaagtgctggcat

SEQ ID NO: 7587636 - DNA, 22 bp, Homo sapiens
taataaatgaaagtgctggcat

SEQ ID NO: 7587637 - DNA, 22 bp, Homo sapiens
taagttagagcacaattcttac

SEQ ID NO: 7587638 - DNA, 22 bp, Homo sapiens
taagttaaccctgttaatagat

SEQ ID NO: 7587639 - DNA, 22 bp, Homo sapiens
taagttacacttaacttactag

SEQ ID NO: 7587640 - DNA, 22 bp, Homo sapiens
taagttacacttaacttactag

SEQ ID NO: 7587641 - DNA, 22 bp, Homo sapiens
taagttagatcttaattaaagt

SEQ ID NO: 7587642 - DNA, 22 bp, Homo sapiens
taagttagcaaggccaaggtaa

SEQ ID NO: 7587643 - DNA, 22 bp, Homo sapiens
taagttagccctattaaattaa

SEQ ID NO: 7587644 - DNA, 22 bp, Homo sapiens
taagttagtcctttttaaaagt

SEQ ID NO: 7587645 - DNA, 22 bp, Homo sapiens
taagttaaccctgttaatagat

SEQ ID NO: 7587646 - DNA, 22 bp, Homo sapiens
taagttaaccctgttaatagat

SEQ ID NO: 7587647 - DNA, 22 bp, Homo sapiens
taagtgtttctccagtgtcttt

SEQ ID NO: 7587648 - DNA, 22 bp, Homo sapiens
taagtgttgttttcaagagata

SEQ ID NO: 7587649 - DNA, 19 bp, Homo sapiens
taagtgttggtgaatttct

SEQ ID NO: 7587650 - DNA, 22 bp, Homo sapiens
taagtgttgttttcaagagata

SEQ ID NO: 7587651 - DNA, 22 bp, Homo sapiens
taagcatagtaccgtagcagct

SEQ ID NO: 7587652 - DNA, 22 bp, Homo sapiens
taagtgttggtaattacaatga

SEQ ID NO: 7587653 - DNA, 22 bp, Homo sapiens
taagcatacattctctcctttc

SEQ ID NO: 7587654 - DNA, 22 bp, Homo sapiens
taagcatacattctctcctttc

SEQ ID NO: 7587655 - DNA, 22 bp, Homo sapiens
taagcatagtaccgtagcagct

SEQ ID NO: 7587656 - DNA, 19 bp, Homo sapiens
taagtgttggtgaatttct

SEQ ID NO: 7587657 - DNA, 22 bp, Homo sapiens
taagttcataagcttattctta

SEQ ID NO: 7587658 - DNA, 22 bp, Homo sapiens
taagttcataagcttattctta

SEQ ID NO: 7587659 - DNA, 22 bp, Homo sapiens
taagttcagttggtcgaagtag

SEQ ID NO: 7587660 - DNA, 22 bp, Homo sapiens
taagttcagttggtcgaagtag

SEQ ID NO: 7587661 - DNA, 22 bp, Homo sapiens
taagttcagagttctcatttgt

SEQ ID NO: 7587662 - DNA, 22 bp, Homo sapiens
taagttcagagttctcatttgt

SEQ ID NO: 7587663 - DNA, 22 bp, Homo sapiens
taagttcaccagttgtaataag

SEQ ID NO: 7587664 - DNA, 22 bp, Homo sapiens
taagttcagagttctcatttgt

SEQ ID NO: 7587665 - DNA, 22 bp, Homo sapiens
taagttcctagcctttacatag

SEQ ID NO: 7587666 - DNA, 22 bp, Homo sapiens
taagttcattagactacagata

SEQ ID NO: 7587667 - DNA, 22 bp, Homo sapiens
taagttcattagactacagata

SEQ ID NO: 7587668 - DNA, 22 bp, Homo sapiens
taagttcataagcttattctta

SEQ ID NO: 7587669 - DNA, 22 bp, Homo sapiens
taagttcattagactacagata

SEQ ID NO: 7587670 - DNA, 22 bp, Homo sapiens
taagttcaccagttgtaataag

SEQ ID NO: 7587671 - DNA, 22 bp, Homo sapiens
taagttcaatgaactcagttct

SEQ ID NO: 7587672 - DNA, 22 bp, Homo sapiens
taagttcaagtcttggatataa

SEQ ID NO: 7587673 - DNA, 22 bp, Homo sapiens
taagttcaaatcatcccaactt

SEQ ID NO: 7587674 - DNA, 22 bp, Homo sapiens
taagttatcggagtgtgtttca

SEQ ID NO: 7587675 - DNA, 22 bp, Homo sapiens
taagttcaaatcatcccaactt

SEQ ID NO: 7587676 - DNA, 22 bp, Homo sapiens
taagttatcggagtgtgtttca

SEQ ID NO: 7587677 - DNA, 22 bp, Homo sapiens
taagttatcggagtgtgtttca

SEQ ID NO: 7587678 - DNA, 17 bp, Homo sapiens
taagttatagcagaaga

SEQ ID NO: 7587679 - DNA, 17 bp, Homo sapiens
taagttatagcagaaga

SEQ ID NO: 7587680 - DNA, 22 bp, Homo sapiens
taagcaatgctgtagttcagtc

SEQ ID NO: 7587681 - DNA, 22 bp, Homo sapiens
taagcaatgctgtagttcagtc

SEQ ID NO: 7587682 - DNA, 22 bp, Homo sapiens
taagcaatgagataatcatggg

SEQ ID NO: 7587683 - DNA, 22 bp, Homo sapiens
taagcaatgagataatcatggg

SEQ ID NO: 7587684 - DNA, 22 bp, Homo sapiens
taagcaatgagataatcatggg

SEQ ID NO: 7587685 - DNA, 22 bp, Homo sapiens
taagcacacaatatctggagag

SEQ ID NO: 7587686 - DNA, 20 bp, Homo sapiens
taagcacatgaacagtcctc

SEQ ID NO: 7587687 - DNA, 20 bp, Homo sapiens
taagcacatgaacagtcctc

SEQ ID NO: 7587688 - DNA, 22 bp, Homo sapiens
taagcacacaatatctggagag

SEQ ID NO: 7587689 - DNA, 22 bp, Homo sapiens
taagcacacaatatctggagag

SEQ ID NO: 7587690 - DNA, 22 bp, Homo sapiens
taagcacacaatatctggagag

SEQ ID NO: 7587691 - DNA, 22 bp, Homo sapiens
taagcaatgctgtagttcagtc

SEQ ID NO: 7587692 - DNA, 22 bp, Homo sapiens
taagcaatgctgtagttcagtc

SEQ ID NO: 7587693 - DNA, 22 bp, Homo sapiens
taagcaagtggtagaaggacaa

SEQ ID NO: 7587694 - DNA, 22 bp, Homo sapiens
taagcaatctaaaagccttacc

SEQ ID NO: 7587695 - DNA, 22 bp, Homo sapiens
taagcaatctaaaagccttacc

SEQ ID NO: 7587696 - DNA, 22 bp, Homo sapiens
taagcaatctgtagttggaatc

SEQ ID NO: 7587697 - DNA, 22 bp, Homo sapiens
taagcaatctgtagttggaatc

SEQ ID NO: 7587698 - DNA, 22 bp, Homo sapiens
taagcaatctgtagttggaatc

SEQ ID NO: 7587699 - DNA, 18 bp, Homo sapiens
taagcaatgacattgcaa

SEQ ID NO: 7587700 - DNA, 18 bp, Homo sapiens
taagcaatgacattgcaa

SEQ ID NO: 7587701 - DNA, 18 bp, Homo sapiens
taagcaatgacattgcaa

SEQ ID NO: 7587702 - DNA, 22 bp, Homo sapiens
taagcaatgagataatcatggg

SEQ ID NO: 7587703 - DNA, 18 bp, Homo sapiens
taagcaatgacattgcaa

SEQ ID NO: 7587704 - DNA, 18 bp, Homo sapiens
taagcaatgacattgcaa

SEQ ID NO: 7587705 - DNA, 22 bp, Homo sapiens
taagcagtttttcttgtattaa

SEQ ID NO: 7587706 - DNA, 22 bp, Homo sapiens
taagcaggggtcaagtgtacaa

SEQ ID NO: 7587707 - DNA, 22 bp, Homo sapiens
taagcaggtgccttctgtgacc

SEQ ID NO: 7587708 - DNA, 22 bp, Homo sapiens
taagcagtttttcttgtattaa

SEQ ID NO: 7587709 - DNA, 22 bp, Homo sapiens
taagcagaaaaagtgggagtta

SEQ ID NO: 7587710 - DNA, 22 bp, Homo sapiens
taagcagagccctctttattag

SEQ ID NO: 7587711 - DNA, 22 bp, Homo sapiens
taagcagatgctgtctgcacaa

SEQ ID NO: 7587712 - DNA, 22 bp, Homo sapiens
taagcagatgctgtctgcacaa

SEQ ID NO: 7587713 - DNA, 22 bp, Homo sapiens
taagcagatgctgtctgcacaa

SEQ ID NO: 7587714 - DNA, 20 bp, Homo sapiens
taagcacatgaacagtcctc

SEQ ID NO: 7587715 - DNA, 22 bp, Homo sapiens
taagcataagatacatgagaca

SEQ ID NO: 7587716 - DNA, 22 bp, Homo sapiens
taagcataagatacatgagaca

SEQ ID NO: 7587717 - DNA, 22 bp, Homo sapiens
taagcatacattctctcctttc

SEQ ID NO: 7587718 - DNA, 22 bp, Homo sapiens
taagcataactaaaaatgattt

SEQ ID NO: 7587719 - DNA, 22 bp, Homo sapiens
taagcagtttttcttgtattaa

SEQ ID NO: 7587720 - DNA, 22 bp, Homo sapiens
taagcataactaaaaatgattt

SEQ ID NO: 7587721 - DNA, 22 bp, Homo sapiens
taagcataactaaaaatgattt

SEQ ID NO: 7587722 - DNA, 22 bp, Homo sapiens
tacacatatgtccattaatcag

SEQ ID NO: 7587723 - DNA, 22 bp, Homo sapiens
tacacatatgtgtgtatatgtg

SEQ ID NO: 7587724 - DNA, 22 bp, Homo sapiens
tacacatatgtccattaatcag

SEQ ID NO: 7587725 - DNA, 22 bp, Homo sapiens
tacacatatgtccattaatcag

SEQ ID NO: 7587726 - DNA, 22 bp, Homo sapiens
tacacatatgtccattaatcag

SEQ ID NO: 7587727 - DNA, 22 bp, Homo sapiens
tacacatatgtccattaatcag

SEQ ID NO: 7587728 - DNA, 22 bp, Homo sapiens
tacacatcaacctggctttggc

SEQ ID NO: 7587729 - DNA, 22 bp, Homo sapiens
tacacatatgtgtgtatatgtg

SEQ ID NO: 7587730 - DNA, 22 bp, Homo sapiens
tacacatatgtgtgtatatgtg

SEQ ID NO: 7587731 - DNA, 22 bp, Homo sapiens
tacacatctggtgtgactgcca

SEQ ID NO: 7587732 - DNA, 22 bp, Homo sapiens
tacacatctctgtcagtagtga

SEQ ID NO: 7587733 - DNA, 22 bp, Homo sapiens
tacacatctctgtcagtagtga

SEQ ID NO: 7587734 - DNA, 22 bp, Homo sapiens
tacacatctctgtcagtagtga

SEQ ID NO: 7587735 - DNA, 22 bp, Homo sapiens
tacacatccttctgaacaacct

SEQ ID NO: 7587736 - DNA, 22 bp, Homo sapiens
tacacatccatgttttgacttt

SEQ ID NO: 7587737 - DNA, 22 bp, Homo sapiens
tacaatgttcatagctttggca

SEQ ID NO: 7587738 - DNA, 22 bp, Homo sapiens
tacaatgttcctagcaggaaag

SEQ ID NO: 7587739 - DNA, 22 bp, Homo sapiens
tacaatgttaaggaaagagaga

SEQ ID NO: 7587740 - DNA, 22 bp, Homo sapiens
tacaatgttaaggaaagagaga

SEQ ID NO: 7587741 - DNA, 22 bp, Homo sapiens
tacaatgtgtgcttcttgtcac

SEQ ID NO: 7587742 - DNA, 22 bp, Homo sapiens
tacaatgttaaggaaagagaga

SEQ ID NO: 7587743 - DNA, 22 bp, Homo sapiens
tacaatgttaaggaaagagaga

SEQ ID NO: 7587744 - DNA, 22 bp, Homo sapiens
tacaatgttaaggaaagagaga

SEQ ID NO: 7587745 - DNA, 22 bp, Homo sapiens
tacaatgttaaggaaagagaga

SEQ ID NO: 7587746 - DNA, 22 bp, Homo sapiens
tacaatgtgtgcttcttgtcac

SEQ ID NO: 7587747 - DNA, 17 bp, Homo sapiens
tacaatgtgattcaatc

SEQ ID NO: 7587748 - DNA, 17 bp, Homo sapiens
tacaatgtgattcaatc

SEQ ID NO: 7587749 - DNA, 17 bp, Homo sapiens
tacaatgtgattcaatc

SEQ ID NO: 7587750 - DNA, 22 bp, Homo sapiens
tacaatgtgtgcttcttgtcac

SEQ ID NO: 7587751 - DNA, 22 bp, Homo sapiens
tacaatgtgtgcttcttgtcac

SEQ ID NO: 7587752 - DNA, 22 bp, Homo sapiens
tacaatgtgtgcttcttgtcac

SEQ ID NO: 7587753 - DNA, 22 bp, Homo sapiens
tacaatgtgtgcttcttgtcac

SEQ ID NO: 7587754 - DNA, 22 bp, Homo sapiens
tacaattctttgtaaggtggtc

SEQ ID NO: 7587755 - DNA, 22 bp, Homo sapiens
tacaattactcagctctgctgt

SEQ ID NO: 7587756 - DNA, 22 bp, Homo sapiens
tacaattactcagctctgctgt

SEQ ID NO: 7587757 - DNA, 22 bp, Homo sapiens
tacaatgttggtaaagtatcat

SEQ ID NO: 7587758 - DNA, 22 bp, Homo sapiens
tacaatgttggtaaagtatcat

SEQ ID NO: 7587759 - DNA, 22 bp, Homo sapiens
tacaatgttggtaaagtatcat

SEQ ID NO: 7587760 - DNA, 22 bp, Homo sapiens
tacaatgttcgcattctctctg

SEQ ID NO: 7587761 - DNA, 22 bp, Homo sapiens
tacaatgttcgcattctctctg

SEQ ID NO: 7587762 - DNA, 22 bp, Homo sapiens
tacaatgttcctagcaggaaag

SEQ ID NO: 7587763 - DNA, 22 bp, Homo sapiens
tacaatgttcctagcaggaaag

SEQ ID NO: 7587764 - DNA, 22 bp, Homo sapiens
tacaatgttcctagcaggaaag

SEQ ID NO: 7587765 - DNA, 22 bp, Homo sapiens
tacaatgttggtaaagtatcat

SEQ ID NO: 7587766 - DNA, 22 bp, Homo sapiens
tacaatgttggtaaagtatcat

SEQ ID NO: 7587767 - DNA, 22 bp, Homo sapiens
tacaatgttggtaaagtatcat

SEQ ID NO: 7587768 - DNA, 22 bp, Homo sapiens
tacaatgttggtaaagtatcat

SEQ ID NO: 7587769 - DNA, 22 bp, Homo sapiens
tacaatgttggtaaagtatcat

SEQ ID NO: 7587770 - DNA, 22 bp, Homo sapiens
tacaatgttcgcattctctctg

SEQ ID NO: 7587771 - DNA, 21 bp, Homo sapiens
tacacaaagcgtggtccagag

SEQ ID NO: 7587772 - DNA, 21 bp, Homo sapiens
tacacaaagcgtggtccagag

SEQ ID NO: 7587773 - DNA, 21 bp, Homo sapiens
tacacaaagcgtggtccagag

SEQ ID NO: 7587774 - DNA, 21 bp, Homo sapiens
tacacaaagcgtggtccagag

SEQ ID NO: 7587775 - DNA, 21 bp, Homo sapiens
tacacaaagcgtggtccagag

SEQ ID NO: 7587776 - DNA, 22 bp, Homo sapiens
tacaatttagtggtgtgtggtt

SEQ ID NO: 7587777 - DNA, 22 bp, Homo sapiens
tacaatttagtggtgtgtggtt

SEQ ID NO: 7587778 - DNA, 19 bp, Homo sapiens
tacaattggctttccattg

SEQ ID NO: 7587779 - DNA, 19 bp, Homo sapiens
tacaattggctttccattg

SEQ ID NO: 7587780 - DNA, 22 bp, Homo sapiens
tacacaaaggcactctgttgtt

SEQ ID NO: 7587781 - DNA, 22 bp, Homo sapiens
tacacaaaggcactctgttgtt

SEQ ID NO: 7587782 - DNA, 22 bp, Homo sapiens
tacacaaaggcactctgttgtt

SEQ ID NO: 7587783 - DNA, 22 bp, Homo sapiens
tacacaaaggcactctgttgtt

SEQ ID NO: 7587784 - DNA, 22 bp, Homo sapiens
tacacaaaggcactctgttgtt

SEQ ID NO: 7587785 - DNA, 22 bp, Homo sapiens
tacacaaaggcactctgttgtt

SEQ ID NO: 7587786 - DNA, 22 bp, Homo sapiens
tacacaaaggcactctgttgtt

SEQ ID NO: 7587787 - DNA, 21 bp, Homo sapiens
tacacaaagcgtggtccagag

SEQ ID NO: 7587788 - DNA, 21 bp, Homo sapiens
tacacaaagcgtggtccagag

SEQ ID NO: 7587789 - DNA, 21 bp, Homo sapiens
tacacaaagcgtggtccagag

SEQ ID NO: 7587790 - DNA, 21 bp, Homo sapiens
tacacaaagcgtggtccagag

SEQ ID NO: 7587791 - DNA, 22 bp, Homo sapiens
tacacattacataatactatct

SEQ ID NO: 7587792 - DNA, 22 bp, Homo sapiens
tacacattacataatactatct

SEQ ID NO: 7587793 - DNA, 22 bp, Homo sapiens
tacacattacataatactatct

SEQ ID NO: 7587794 - DNA, 22 bp, Homo sapiens
tacacattacataatactatct

SEQ ID NO: 7587795 - DNA, 22 bp, Homo sapiens
tacacattacataatactatct

SEQ ID NO: 7587796 - DNA, 22 bp, Homo sapiens
tacacattacataatactatct

SEQ ID NO: 7587797 - DNA, 22 bp, Homo sapiens
tacacattacataatactatct

SEQ ID NO: 7587798 - DNA, 22 bp, Homo sapiens
tacacattctagggcacagtta

SEQ ID NO: 7587799 - DNA, 22 bp, Homo sapiens
tacacatttctcttagagacac

SEQ ID NO: 7587800 - DNA, 22 bp, Homo sapiens
tacacatttctcttagagacac

SEQ ID NO: 7587801 - DNA, 22 bp, Homo sapiens
tacacatttctcttagagacac

SEQ ID NO: 7587802 - DNA, 22 bp, Homo sapiens
tacacattagtgaggtattttg

SEQ ID NO: 7587803 - DNA, 22 bp, Homo sapiens
tacacattagtcaagagtttga

SEQ ID NO: 7587804 - DNA, 22 bp, Homo sapiens
tacacattagtcaagagtttga

SEQ ID NO: 7587805 - DNA, 22 bp, Homo sapiens
tacacattacataatactatct

SEQ ID NO: 7587806 - DNA, 22 bp, Homo sapiens
tacacattacataatactatct

SEQ ID NO: 7587807 - DNA, 22 bp, Homo sapiens
tacacatgtatttatgtgtaca

SEQ ID NO: 7587808 - DNA, 22 bp, Homo sapiens
tacacatgtttggcaagtatgt

SEQ ID NO: 7587809 - DNA, 22 bp, Homo sapiens
tacacatgtttggcaagtatgt

SEQ ID NO: 7587810 - DNA, 22 bp, Homo sapiens
tacacatgtttggcaagtatgt

SEQ ID NO: 7587811 - DNA, 22 bp, Homo sapiens
tacacatgatcatttagtagca

SEQ ID NO: 7587812 - DNA, 22 bp, Homo sapiens
tacacatgcatgtactccagga

SEQ ID NO: 7587813 - DNA, 22 bp, Homo sapiens
tacacatgcatgtactccagga

SEQ ID NO: 7587814 - DNA, 22 bp, Homo sapiens
tacacatgtatttatgtgtaca

SEQ ID NO: 7587815 - DNA, 22 bp, Homo sapiens
tacaccattcccaggtggattt

SEQ ID NO: 7587816 - DNA, 22 bp, Homo sapiens
tacaccattcccaggtggattt

SEQ ID NO: 7587817 - DNA, 22 bp, Homo sapiens
tacaccattcccaggtggattt

SEQ ID NO: 7587818 - DNA, 22 bp, Homo sapiens
tacaccattcccaggtggattt

SEQ ID NO: 7587819 - DNA, 22 bp, Homo sapiens
tacaccattcccaggtggattt

SEQ ID NO: 7587820 - DNA, 22 bp, Homo sapiens
tacacccacattgagcatggga

SEQ ID NO: 7587821 - DNA, 22 bp, Homo sapiens
tacacccacattgagcatggga

SEQ ID NO: 7587822 - DNA, 22 bp, Homo sapiens
tacacccacattgagcatggga

SEQ ID NO: 7587823 - DNA, 22 bp, Homo sapiens
tacaccattcccaggtggattt

SEQ ID NO: 7587824 - DNA, 22 bp, Homo sapiens
tacacccacatgcctaggaggg

SEQ ID NO: 7587825 - DNA, 22 bp, Homo sapiens
tacacccacatgcctaggaggg

SEQ ID NO: 7587826 - DNA, 22 bp, Homo sapiens
tacaccaggtgttatggtcaat

SEQ ID NO: 7587827 - DNA, 22 bp, Homo sapiens
tacaccaggtgttatggtcaat

SEQ ID NO: 7587828 - DNA, 22 bp, Homo sapiens
tacaccaggttaccaatcactg

SEQ ID NO: 7587829 - DNA, 22 bp, Homo sapiens
tacaccaggttaccaatcactg

SEQ ID NO: 7587830 - DNA, 22 bp, Homo sapiens
tacaccagtatcttaagcatga

SEQ ID NO: 7587831 - DNA, 22 bp, Homo sapiens
tacaccagtatcttaagcatga

SEQ ID NO: 7587832 - DNA, 22 bp, Homo sapiens
tacaccagtatcttaagcatga

SEQ ID NO: 7587833 - DNA, 22 bp, Homo sapiens
tacaccagtatcttaagcatga

SEQ ID NO: 7587834 - DNA, 22 bp, Homo sapiens
tacacatttctcttagagacac

SEQ ID NO: 7587835 - DNA, 22 bp, Homo sapiens
tacacatttctcttagagacac

SEQ ID NO: 7587836 - DNA, 22 bp, Homo sapiens
tacacattttgcgggtacatgt

SEQ ID NO: 7587837 - DNA, 22 bp, Homo sapiens
tacacattttgcgggtacatgt

SEQ ID NO: 7587838 - DNA, 22 bp, Homo sapiens
tacacattttgcgggtacatgt

SEQ ID NO: 7587839 - DNA, 22 bp, Homo sapiens
tacacattttgcgggtacatgt

SEQ ID NO: 7587840 - DNA, 22 bp, Homo sapiens
tacaccagaatctctgtgggga

SEQ ID NO: 7587841 - DNA, 22 bp, Homo sapiens
tacaccagattatttataacat

SEQ ID NO: 7587842 - DNA, 22 bp, Homo sapiens
tacaccagattatttataacat

SEQ ID NO: 7587843 - DNA, 22 bp, Homo sapiens
tacactaagaacaaagatctgt

SEQ ID NO: 7587844 - DNA, 22 bp, Homo sapiens
tacacgtgtgtgtatgtacata

SEQ ID NO: 7587845 - DNA, 22 bp, Homo sapiens
tacactaaatcttcatctttta

SEQ ID NO: 7587846 - DNA, 20 bp, Homo sapiens
tacactaagtatgaagtgct

SEQ ID NO: 7587847 - DNA, 22 bp, Homo sapiens
tacactaatagccacactaatg

SEQ ID NO: 7587848 - DNA, 22 bp, Homo sapiens
tacactaatagccacactaatg

SEQ ID NO: 7587849 - DNA, 22 bp, Homo sapiens
tacactaatagccacactaatg

SEQ ID NO: 7587850 - DNA, 22 bp, Homo sapiens
tacactaatagccacactaatg

SEQ ID NO: 7587851 - DNA, 22 bp, Homo sapiens
tacactaatgtttttgcaaagc

SEQ ID NO: 7587852 - DNA, 22 bp, Homo sapiens
tacactaatgtttttgcaaagc

SEQ ID NO: 7587853 - DNA, 22 bp, Homo sapiens
tacactaatgtttttgcaaagc

SEQ ID NO: 7587854 - DNA, 22 bp, Homo sapiens
tacactacacgaaggcattgca

SEQ ID NO: 7587855 - DNA, 22 bp, Homo sapiens
tacacccacattgagcatggga

SEQ ID NO: 7587856 - DNA, 22 bp, Homo sapiens
tacacccacattgagcatggga

SEQ ID NO: 7587857 - DNA, 22 bp, Homo sapiens
tacacccaggtaccgtgatttc

SEQ ID NO: 7587858 - DNA, 22 bp, Homo sapiens
tacacccaggtaccgtgatttc

SEQ ID NO: 7587859 - DNA, 22 bp, Homo sapiens
tacacccttctcctgagtgtgt

SEQ ID NO: 7587860 - DNA, 22 bp, Homo sapiens
tacacctgctgagcctgtcctc

SEQ ID NO: 7587861 - DNA, 22 bp, Homo sapiens
tacacctgctgagcctgtcctc

SEQ ID NO: 7587862 - DNA, 22 bp, Homo sapiens
tacacgatatttttacagatac

SEQ ID NO: 7587863 - DNA, 22 bp, Homo sapiens
tacacgtgcaaattcaatgtat

SEQ ID NO: 7587864 - DNA, 22 bp, Homo sapiens
taattttccactctgtttatct

SEQ ID NO: 7587865 - DNA, 22 bp, Homo sapiens
taattttccactctgtttatct

SEQ ID NO: 7587866 - DNA, 22 bp, Homo sapiens
taattttccactctgtttatct

SEQ ID NO: 7587867 - DNA, 22 bp, Homo sapiens
taattttccactctgtttatct

SEQ ID NO: 7587868 - DNA, 22 bp, Homo sapiens
taattttccactctgtttatct

SEQ ID NO: 7587869 - DNA, 22 bp, Homo sapiens
taattttccactctgtttatct

SEQ ID NO: 7587870 - DNA, 22 bp, Homo sapiens
taattttccactctgtttatct

SEQ ID NO: 7587871 - DNA, 22 bp, Homo sapiens
taattttccactctgtttatct

SEQ ID NO: 7587872 - DNA, 22 bp, Homo sapiens
taattttccactctgtttatct

SEQ ID NO: 7587873 - DNA, 22 bp, Homo sapiens
taattttgctgtgaccattgaa

SEQ ID NO: 7587874 - DNA, 22 bp, Homo sapiens
taattttgctgtgaccattgaa

SEQ ID NO: 7587875 - DNA, 22 bp, Homo sapiens
taattttatgacagtgtatttt

SEQ ID NO: 7587876 - DNA, 22 bp, Homo sapiens
taattttatgacagtgtatttt

SEQ ID NO: 7587877 - DNA, 22 bp, Homo sapiens
taattttatgacagtgtatttt

SEQ ID NO: 7587878 - DNA, 22 bp, Homo sapiens
taattttatgacagtgtatttt

SEQ ID NO: 7587879 - DNA, 22 bp, Homo sapiens
taattttatgacagtgtatttt

SEQ ID NO: 7587880 - DNA, 22 bp, Homo sapiens
taattttatgacagtgtatttt

SEQ ID NO: 7587881 - DNA, 22 bp, Homo sapiens
taattttatgacagtgtatttt

SEQ ID NO: 7587882 - DNA, 22 bp, Homo sapiens
taatttttccacgtacactggg

SEQ ID NO: 7587883 - DNA, 22 bp, Homo sapiens
taattttgtccccctgcacata

SEQ ID NO: 7587884 - DNA, 22 bp, Homo sapiens
taattttgtccccctgcacata

SEQ ID NO: 7587885 - DNA, 22 bp, Homo sapiens
taattttgtccccctgcacata

SEQ ID NO: 7587886 - DNA, 22 bp, Homo sapiens
taattttgtccccctgcacata

SEQ ID NO: 7587887 - DNA, 22 bp, Homo sapiens
taattttgtccccctgcacata

SEQ ID NO: 7587888 - DNA, 22 bp, Homo sapiens
taattttgtccccctgcacata

SEQ ID NO: 7587889 - DNA, 22 bp, Homo sapiens
taattttgtcacagtgacatgc

SEQ ID NO: 7587890 - DNA, 22 bp, Homo sapiens
taattttgtcacagtgacatgc

SEQ ID NO: 7587891 - DNA, 22 bp, Homo sapiens
taattttgtcacagtgacatgc

SEQ ID NO: 7587892 - DNA, 22 bp, Homo sapiens
taattttgtcacagtgacatgc

SEQ ID NO: 7587893 - DNA, 22 bp, Homo sapiens
taattttgctgtgaccattgaa

SEQ ID NO: 7587894 - DNA, 22 bp, Homo sapiens
taattttgctgtgaccattgaa

SEQ ID NO: 7587895 - DNA, 22 bp, Homo sapiens
taattttgtattgccattgtag

SEQ ID NO: 7587896 - DNA, 22 bp, Homo sapiens
taattttgctgtgaccattgaa

SEQ ID NO: 7587897 - DNA, 22 bp, Homo sapiens
taattttgtcacagtgacatgc

SEQ ID NO: 7587898 - DNA, 22 bp, Homo sapiens
taattttgtattgccattgtag

SEQ ID NO: 7587899 - DNA, 22 bp, Homo sapiens
taattttgtattgccattgtag

SEQ ID NO: 7587900 - DNA, 22 bp, Homo sapiens
taattttgtattgccattgtag

SEQ ID NO: 7587901 - DNA, 22 bp, Homo sapiens
taattttgtattgccattgtag

SEQ ID NO: 7587902 - DNA, 22 bp, Homo sapiens
taattttgtattgccattgtag

SEQ ID NO: 7587903 - DNA, 22 bp, Homo sapiens
taattttacttcctgagcacct

SEQ ID NO: 7587904 - DNA, 22 bp, Homo sapiens
taattttacttcctgagcacct

SEQ ID NO: 7587905 - DNA, 22 bp, Homo sapiens
taattttacttcctgagcacct

SEQ ID NO: 7587906 - DNA, 22 bp, Homo sapiens
taattttacttcctgagcacct

SEQ ID NO: 7587907 - DNA, 22 bp, Homo sapiens
taattttacttcctgagcacct

SEQ ID NO: 7587908 - DNA, 23 bp, Homo sapiens
taattttagccttacaggaccct

SEQ ID NO: 7587909 - DNA, 23 bp, Homo sapiens
taattttagccttacaggaccct

SEQ ID NO: 7587910 - DNA, 22 bp, Homo sapiens
taattttacttcctgagcacct

SEQ ID NO: 7587911 - DNA, 22 bp, Homo sapiens
taattttacttcctgagcacct

SEQ ID NO: 7587912 - DNA, 22 bp, Homo sapiens
taattttaatagtatgtggcat

SEQ ID NO: 7587913 - DNA, 22 bp, Homo sapiens
taattttaatagtatgtggcat

SEQ ID NO: 7587914 - DNA, 22 bp, Homo sapiens
taattttaactgtgctgtttgg

SEQ ID NO: 7587915 - DNA, 22 bp, Homo sapiens
taattttaatagtatgtggcat

SEQ ID NO: 7587916 - DNA, 20 bp, Homo sapiens
taatttgatatctataagtt

SEQ ID NO: 7587917 - DNA, 22 bp, Homo sapiens
taatttgaatctcgctatttta

SEQ ID NO: 7587918 - DNA, 22 bp, Homo sapiens
taatttgaatctcgctatttta

SEQ ID NO: 7587919 - DNA, 20 bp, Homo sapiens
taatttgatatctataagtt

SEQ ID NO: 7587920 - DNA, 18 bp, Homo sapiens
taatttgcacagttgcaa

SEQ ID NO: 7587921 - DNA, 22 bp, Homo sapiens
taattttaactgtgctgtttgg

SEQ ID NO: 7587922 - DNA, 22 bp, Homo sapiens
taattttaactgtgctgtttgg

SEQ ID NO: 7587923 - DNA, 22 bp, Homo sapiens
taatttctggagggagaaagag

SEQ ID NO: 7587924 - DNA, 22 bp, Homo sapiens
taatttctagggactaaggtgc

SEQ ID NO: 7587925 - DNA, 22 bp, Homo sapiens
taatttctagggactaaggtgc

SEQ ID NO: 7587926 - DNA, 22 bp, Homo sapiens
taatttcttcatctctgcagct

SEQ ID NO: 7587927 - DNA, 22 bp, Homo sapiens
taatttttccacgtacactggg

SEQ ID NO: 7587928 - DNA, 22 bp, Homo sapiens
taatttttccacgtacactggg

SEQ ID NO: 7587929 - DNA, 22 bp, Homo sapiens
taatttttccacgtacactggg

SEQ ID NO: 7587930 - DNA, 22 bp, Homo sapiens
taatttttccacgtacactggg

SEQ ID NO: 7587931 - DNA, 22 bp, Homo sapiens
tacaaaaaattgatactgacga

SEQ ID NO: 7587932 - DNA, 22 bp, Homo sapiens
tacaaaaaattgatactgacga

SEQ ID NO: 7587933 - DNA, 22 bp, Homo sapiens
taatttttccacgtacactggg

SEQ ID NO: 7587934 - DNA, 22 bp, Homo sapiens
taatttttccacgtacactggg

SEQ ID NO: 7587935 - DNA, 22 bp, Homo sapiens
taatttttccacgtacactggg

SEQ ID NO: 7587936 - DNA, 19 bp, Homo sapiens
tacaagcttaaagtaatgt

SEQ ID NO: 7587937 - DNA, 19 bp, Homo sapiens
tacaagcttaaagtaatgt

SEQ ID NO: 7587938 - DNA, 22 bp, Homo sapiens
tacaagctgaccctgaagatga

SEQ ID NO: 7587939 - DNA, 22 bp, Homo sapiens
tacaagctggcgcagttaagat

SEQ ID NO: 7587940 - DNA, 22 bp, Homo sapiens
tacaagctggcgcagttaagat

SEQ ID NO: 7587941 - DNA, 22 bp, Homo sapiens
tacaagctgaccctgaagatga

SEQ ID NO: 7587942 - DNA, 22 bp, Homo sapiens
tacaagctcgggcagctcatta

SEQ ID NO: 7587943 - DNA, 22 bp, Homo sapiens
tacaaaaaattgatactgacga

SEQ ID NO: 7587944 - DNA, 22 bp, Homo sapiens
tacaaaaaattgatactgacga

SEQ ID NO: 7587945 - DNA, 22 bp, Homo sapiens
tacaagctcacaaatttttaag

SEQ ID NO: 7587946 - DNA, 22 bp, Homo sapiens
tacaaaaaattgatactgacga

SEQ ID NO: 7587947 - DNA, 22 bp, Homo sapiens
tacaatcacccaaagagccaga

SEQ ID NO: 7587948 - DNA, 20 bp, Homo sapiens
tacaatattcccactttgct

SEQ ID NO: 7587949 - DNA, 20 bp, Homo sapiens
tacaatattcccactttgct

SEQ ID NO: 7587950 - DNA, 20 bp, Homo sapiens
tacaatattcccactttgct

SEQ ID NO: 7587951 - DNA, 22 bp, Homo sapiens
tacaatcaggataataatagtg

SEQ ID NO: 7587952 - DNA, 22 bp, Homo sapiens
tacaatcaggataataatagtg

SEQ ID NO: 7587953 - DNA, 22 bp, Homo sapiens
tacaatcaggataataatagtg

SEQ ID NO: 7587954 - DNA, 20 bp, Homo sapiens
tacaatattcccactttgct

SEQ ID NO: 7587955 - DNA, 20 bp, Homo sapiens
tacaatattcccactttgct

SEQ ID NO: 7587956 - DNA, 20 bp, Homo sapiens
tacaatattcccactttgct

SEQ ID NO: 7587957 - DNA, 20 bp, Homo sapiens
tacaatattcccactttgct

SEQ ID NO: 7587958 - DNA, 20 bp, Homo sapiens
tacaatattcccactttgct

SEQ ID NO: 7587959 - DNA, 22 bp, Homo sapiens
tacaagcttttgtgtataaatg

SEQ ID NO: 7587960 - DNA, 22 bp, Homo sapiens
tacaatatgtggccttttgtga

SEQ ID NO: 7587961 - DNA, 22 bp, Homo sapiens
tacaatatgtggccttttgtga

SEQ ID NO: 7587962 - DNA, 22 bp, Homo sapiens
tacaatatgtggccttttgtga

SEQ ID NO: 7587963 - DNA, 22 bp, Homo sapiens
tacaatatgtggccttttgtga

SEQ ID NO: 7587964 - DNA, 22 bp, Homo sapiens
tacaatgtaattctgattatgt

SEQ ID NO: 7587965 - DNA, 22 bp, Homo sapiens
tacaatgtaattctgattatgt

SEQ ID NO: 7587966 - DNA, 22 bp, Homo sapiens
tacaatgtaattctgattatgt

SEQ ID NO: 7587967 - DNA, 22 bp, Homo sapiens
tacaatgtaattctgattatgt

SEQ ID NO: 7587968 - DNA, 22 bp, Homo sapiens
tacaatgtaattctgattatgt

SEQ ID NO: 7587969 - DNA, 22 bp, Homo sapiens
tacaatgctgtttgtttctact

SEQ ID NO: 7587970 - DNA, 22 bp, Homo sapiens
tacaatgctgtttgtttctact

SEQ ID NO: 7587971 - DNA, 22 bp, Homo sapiens
tacaatgtctctcacctgactt

SEQ ID NO: 7587972 - DNA, 22 bp, Homo sapiens
tacaatgtctctcacctgactt

SEQ ID NO: 7587973 - DNA, 16 bp, Homo sapiens
tacaatgtagaaaaca

SEQ ID NO: 7587974 - DNA, 16 bp, Homo sapiens
tacaatgtagaaaaca

SEQ ID NO: 7587975 - DNA, 16 bp, Homo sapiens
tacaatgtagaaaaca

SEQ ID NO: 7587976 - DNA, 22 bp, Homo sapiens
tacaatgtaattctgattatgt

SEQ ID NO: 7587977 - DNA, 22 bp, Homo sapiens
tacaatgtaattctgattatgt

SEQ ID NO: 7587978 - DNA, 22 bp, Homo sapiens
tacaatgtacttccttgcacag

SEQ ID NO: 7587979 - DNA, 22 bp, Homo sapiens
tacaatgtacttccttgcacag

SEQ ID NO: 7587980 - DNA, 22 bp, Homo sapiens
tacaatgtacttccttgcacag

SEQ ID NO: 7587981 - DNA, 22 bp, Homo sapiens
tacaatgcattcgttgtctcgg

SEQ ID NO: 7587982 - DNA, 22 bp, Homo sapiens
tacaatgcattcatttttgagg

SEQ ID NO: 7587983 - DNA, 22 bp, Homo sapiens
tacaatgctgtgcatgtaatgg

SEQ ID NO: 7587984 - DNA, 22 bp, Homo sapiens
tacaatgcattcatttttgagg

SEQ ID NO: 7587985 - DNA, 22 bp, Homo sapiens
tacaatgctgtgcatgtaatgg

SEQ ID NO: 7587986 - DNA, 22 bp, Homo sapiens
tacaatgcagtgacctccttta

SEQ ID NO: 7587987 - DNA, 21 bp, Homo sapiens
tacaatgcacaggagagcctc

SEQ ID NO: 7587988 - DNA, 23 bp, Homo sapiens
tacaatgcaaacttggcccatgg

SEQ ID NO: 7587989 - DNA, 22 bp, Homo sapiens
tacaatgcaaaatactgtctgc

SEQ ID NO: 7587990 - DNA, 22 bp, Homo sapiens
tacaatgcaaaatactgtctgc

SEQ ID NO: 7587991 - DNA, 22 bp, Homo sapiens
tacaatgcaaaatactgtctgc

SEQ ID NO: 7587992 - DNA, 22 bp, Homo sapiens
tacaatgactctcagtttggct

SEQ ID NO: 7587993 - DNA, 22 bp, Homo sapiens
tacaatgactctcagtttggct

SEQ ID NO: 7587994 - DNA, 22 bp, Homo sapiens
tacaatgactctcagtttggct

SEQ ID NO: 7587995 - DNA, 22 bp, Homo sapiens
tacaatgaccatattatgtaag

SEQ ID NO: 7587996 - DNA, 22 bp, Homo sapiens
tacaatgaccatattatgtaag

SEQ ID NO: 7587997 - DNA, 22 bp, Homo sapiens
tacaatcaggctctagcttctc

SEQ ID NO: 7587998 - DNA, 22 bp, Homo sapiens
tacaatctttatgttgagtggt

SEQ ID NO: 7587999 - DNA, 22 bp, Homo sapiens
tacaatcaggataataatagtg

SEQ ID NO: 7588000 - DNA, 22 bp, Homo sapiens
tacaatgagctgtacatctcca

SEQ ID NO: 7588001 - DNA, 22 bp, Homo sapiens
tacaatgagctgtacatctcca

SEQ ID NO: 7588002 - DNA, 22 bp, Homo sapiens
tacaatgagctgtacatctcca

SEQ ID NO: 7588003 - DNA, 22 bp, Homo sapiens
tacaatgagctgtacatctcca

SEQ ID NO: 7588004 - DNA, 22 bp, Homo sapiens
tacaatgattagctaacttgcc

SEQ ID NO: 7588005 - DNA, 22 bp, Homo sapiens
tacaatgattagctaacttgcc

SEQ ID NO: 7588006 - DNA, 22 bp, Homo sapiens
tacgcctgtaatcccagcactt

SEQ ID NO: 7588007 - DNA, 22 bp, Homo sapiens
tacgagcgctcttgctggccaa

SEQ ID NO: 7588008 - DNA, 22 bp, Homo sapiens
tacgcctgtaatcccagcactt

SEQ ID NO: 7588009 - DNA, 22 bp, Homo sapiens
tacgcctgtaatcccagcactt

SEQ ID NO: 7588010 - DNA, 22 bp, Homo sapiens
tacgcctgtaatcccagcactt

SEQ ID NO: 7588011 - DNA, 22 bp, Homo sapiens
tacgcctgtaatcccagcactt

SEQ ID NO: 7588012 - DNA, 22 bp, Homo sapiens
tacgcctgtaatcccagcactt

SEQ ID NO: 7588013 - DNA, 22 bp, Homo sapiens
taccttgtgagatgtcagtgag

SEQ ID NO: 7588014 - DNA, 22 bp, Homo sapiens
taccttgtgagctttctaacat

SEQ ID NO: 7588015 - DNA, 23 bp, Homo sapiens
tacctttccctgggagactgctc

SEQ ID NO: 7588016 - DNA, 22 bp, Homo sapiens
tacctttaaggagatttgacaa

SEQ ID NO: 7588017 - DNA, 22 bp, Homo sapiens
taccttgtgagctttctaacat

SEQ ID NO: 7588018 - DNA, 22 bp, Homo sapiens
tacctttgatctggaattttaa

SEQ ID NO: 7588019 - DNA, 22 bp, Homo sapiens
taccttttgcttattatgacac

SEQ ID NO: 7588020 - DNA, 22 bp, Homo sapiens
tacctttgatctggaattttaa

SEQ ID NO: 7588021 - DNA, 22 bp, Homo sapiens
taccttttgcttattatgacac

SEQ ID NO: 7588022 - DNA, 22 bp, Homo sapiens
tacgaatcctgtggatgaatgt

SEQ ID NO: 7588023 - DNA, 22 bp, Homo sapiens
tactaaaccctcgatggatctt

SEQ ID NO: 7588024 - DNA, 22 bp, Homo sapiens
tactaaatagcaggttggctat

SEQ ID NO: 7588025 - DNA, 22 bp, Homo sapiens
tactaaatagtttaattcctca

SEQ ID NO: 7588026 - DNA, 22 bp, Homo sapiens
tactaaatagtttaattcctca

SEQ ID NO: 7588027 - DNA, 22 bp, Homo sapiens
tactaaatagcaggttggctat

SEQ ID NO: 7588028 - DNA, 22 bp, Homo sapiens
tactaaatgattaagcaggaat

SEQ ID NO: 7588029 - DNA, 22 bp, Homo sapiens
tactaaatagtttaattcctca

SEQ ID NO: 7588030 - DNA, 22 bp, Homo sapiens
tactaaatagtttaattcctca

SEQ ID NO: 7588031 - DNA, 22 bp, Homo sapiens
tactaaatgattaagcaggaat

SEQ ID NO: 7588032 - DNA, 21 bp, Homo sapiens
tacgtgtgtgcatgtttatat

SEQ ID NO: 7588033 - DNA, 22 bp, Homo sapiens
tactaaacatctggcattaaat

SEQ ID NO: 7588034 - DNA, 21 bp, Homo sapiens
tacgtgtgtgcatgtttatat

SEQ ID NO: 7588035 - DNA, 22 bp, Homo sapiens
tacgggcacgcaccacgatgcc

SEQ ID NO: 7588036 - DNA, 22 bp, Homo sapiens
tacggtcagtccgtgccccaag

SEQ ID NO: 7588037 - DNA, 22 bp, Homo sapiens
tacggtgacatttaatttatgg

SEQ ID NO: 7588038 - DNA, 22 bp, Homo sapiens
tacgggagagggcgcctgagtg

SEQ ID NO: 7588039 - DNA, 22 bp, Homo sapiens
tacgctccaaaatcagaattga

SEQ ID NO: 7588040 - DNA, 22 bp, Homo sapiens
tacgggaagtacagcggaaccc

SEQ ID NO: 7588041 - DNA, 22 bp, Homo sapiens
tactgaagcaccattaaagaca

SEQ ID NO: 7588042 - DNA, 22 bp, Homo sapiens
tactgaagcaccattaaagaca

SEQ ID NO: 7588043 - DNA, 22 bp, Homo sapiens
tactgaaggacttgagggtttc

SEQ ID NO: 7588044 - DNA, 22 bp, Homo sapiens
tactgaatatgttttcaagtct

SEQ ID NO: 7588045 - DNA, 22 bp, Homo sapiens
tactgaatggggcagtaagaaa

SEQ ID NO: 7588046 - DNA, 22 bp, Homo sapiens
tactgaaatggcagatatataa

SEQ ID NO: 7588047 - DNA, 22 bp, Homo sapiens
tactgaaatggcagatatataa

SEQ ID NO: 7588048 - DNA, 22 bp, Homo sapiens
tactgaaatggcagatatataa

SEQ ID NO: 7588049 - DNA, 22 bp, Homo sapiens
tactgaaatggcagatatataa

SEQ ID NO: 7588050 - DNA, 22 bp, Homo sapiens
tactgaaatggcagatatataa

SEQ ID NO: 7588051 - DNA, 22 bp, Homo sapiens
tactgaaatagcactctgatgc

SEQ ID NO: 7588052 - DNA, 22 bp, Homo sapiens
tactgaaatagcactctgatgc

SEQ ID NO: 7588053 - DNA, 22 bp, Homo sapiens
tactgaaatagcactctgatgc

SEQ ID NO: 7588054 - DNA, 22 bp, Homo sapiens
tactgaaatagcactctgatgc

SEQ ID NO: 7588055 - DNA, 22 bp, Homo sapiens
tactgaaatactaagaagttaa

SEQ ID NO: 7588056 - DNA, 22 bp, Homo sapiens
tactgaaatactaagaagttaa

SEQ ID NO: 7588057 - DNA, 22 bp, Homo sapiens
tactgaaatactaagaagttaa

SEQ ID NO: 7588058 - DNA, 22 bp, Homo sapiens
tactgaaatactaagaagttaa

SEQ ID NO: 7588059 - DNA, 22 bp, Homo sapiens
tactgaaatactaagaagttaa

SEQ ID NO: 7588060 - DNA, 22 bp, Homo sapiens
tactgaaagtggtcaacagtgg

SEQ ID NO: 7588061 - DNA, 22 bp, Homo sapiens
tactgaaagtggtcaacagtgg

SEQ ID NO: 7588062 - DNA, 22 bp, Homo sapiens
tactgaaagactgaatatttag

SEQ ID NO: 7588063 - DNA, 22 bp, Homo sapiens
tactgaaagactgaatatttag

SEQ ID NO: 7588064 - DNA, 22 bp, Homo sapiens
tactgaaagactgaatatttag

SEQ ID NO: 7588065 - DNA, 22 bp, Homo sapiens
tactgaaagactgaatatttag

SEQ ID NO: 7588066 - DNA, 22 bp, Homo sapiens
tactgaaagactgaatatttag

SEQ ID NO: 7588067 - DNA, 22 bp, Homo sapiens
tactgaaagactgaatatttag

SEQ ID NO: 7588068 - DNA, 22 bp, Homo sapiens
tactgaaagactgaatatttag

SEQ ID NO: 7588069 - DNA, 22 bp, Homo sapiens
tactgaaagtggtcaacagtgg

SEQ ID NO: 7588070 - DNA, 22 bp, Homo sapiens
tactgaaagtggtcaacagtgg

SEQ ID NO: 7588071 - DNA, 22 bp, Homo sapiens
tactgaaagtctgtgggtcctc

SEQ ID NO: 7588072 - DNA, 22 bp, Homo sapiens
tactgaaagtggtcaacagtgg

SEQ ID NO: 7588073 - DNA, 22 bp, Homo sapiens
tactgaaagtggtcaacagtgg

SEQ ID NO: 7588074 - DNA, 22 bp, Homo sapiens
tactgaaagtctgtgggtcctc

SEQ ID NO: 7588075 - DNA, 22 bp, Homo sapiens
tactgaaagagtggtggactct

SEQ ID NO: 7588076 - DNA, 22 bp, Homo sapiens
tactgaaagagtggtggactct

SEQ ID NO: 7588077 - DNA, 22 bp, Homo sapiens
tactgaaagagtggtggactct

SEQ ID NO: 7588078 - DNA, 22 bp, Homo sapiens
tactaacaatgagaacaagcca

SEQ ID NO: 7588079 - DNA, 22 bp, Homo sapiens
tactgaaagactgaatatttag

SEQ ID NO: 7588080 - DNA, 22 bp, Homo sapiens
tactgaaagactgaatatttag

SEQ ID NO: 7588081 - DNA, 22 bp, Homo sapiens
tactacaaggccgaagctctca

SEQ ID NO: 7588082 - DNA, 22 bp, Homo sapiens
tactgaaagaatacataatttc

SEQ ID NO: 7588083 - DNA, 22 bp, Homo sapiens
tactgaaagaatacataatttc

SEQ ID NO: 7588084 - DNA, 22 bp, Homo sapiens
tacccagatatactttatgtta

SEQ ID NO: 7588085 - DNA, 22 bp, Homo sapiens
tacccagattcacaagccaagg

SEQ ID NO: 7588086 - DNA, 22 bp, Homo sapiens
tacccagagggagagcaactat

SEQ ID NO: 7588087 - DNA, 22 bp, Homo sapiens
tacccagagggagagcaactat

SEQ ID NO: 7588088 - DNA, 22 bp, Homo sapiens
tacccagagggagagcaactat

SEQ ID NO: 7588089 - DNA, 22 bp, Homo sapiens
tacccagagggagagcaactat

SEQ ID NO: 7588090 - DNA, 22 bp, Homo sapiens
tacattccatgtgtgtgtattc

SEQ ID NO: 7588091 - DNA, 22 bp, Homo sapiens
taccattttgaggatggagaga

SEQ ID NO: 7588092 - DNA, 22 bp, Homo sapiens
taccattttgaggatggagaga

SEQ ID NO: 7588093 - DNA, 22 bp, Homo sapiens
tacccaaggccctttcaatttc

SEQ ID NO: 7588094 - DNA, 22 bp, Homo sapiens
tacccagaagattgtcagcaaa

SEQ ID NO: 7588095 - DNA, 22 bp, Homo sapiens
tacattccactagtgactggcg

SEQ ID NO: 7588096 - DNA, 22 bp, Homo sapiens
tacattccactagtgactggcg

SEQ ID NO: 7588097 - DNA, 19 bp, Homo sapiens
tacattccacacaatctct

SEQ ID NO: 7588098 - DNA, 22 bp, Homo sapiens
tacattccatgtgtgtgtattc

SEQ ID NO: 7588099 - DNA, 22 bp, Homo sapiens
tacattcccccaattaccaatg

SEQ ID NO: 7588100 - DNA, 22 bp, Homo sapiens
tacattccaaaggaaactggct

SEQ ID NO: 7588101 - DNA, 22 bp, Homo sapiens
tacattccaaaggaaactggct

SEQ ID NO: 7588102 - DNA, 22 bp, Homo sapiens
tacattccacaagcattgcttt

SEQ ID NO: 7588103 - DNA, 22 bp, Homo sapiens
tacattccacaagcattgcttt

SEQ ID NO: 7588104 - DNA, 22 bp, Homo sapiens
tacattccacaagcattgcttt

SEQ ID NO: 7588105 - DNA, 19 bp, Homo sapiens
tacattccacacaatctct

SEQ ID NO: 7588106 - DNA, 22 bp, Homo sapiens
tacctgagaagaaacccgtgtt

SEQ ID NO: 7588107 - DNA, 22 bp, Homo sapiens
tacctgagaagaaacccgtgtt

SEQ ID NO: 7588108 - DNA, 22 bp, Homo sapiens
tacctgaattaccaaaagcttt

SEQ ID NO: 7588109 - DNA, 23 bp, Homo sapiens
tacctgaagtaagcattcatcca

SEQ ID NO: 7588110 - DNA, 22 bp, Homo sapiens
tacccagcaatccctagaggtt

SEQ ID NO: 7588111 - DNA, 22 bp, Homo sapiens
tacccagcaatccctagaggtt

SEQ ID NO: 7588112 - DNA, 22 bp, Homo sapiens
tacccagcccatgcctacctca

SEQ ID NO: 7588113 - DNA, 22 bp, Homo sapiens
tacctgcacagccagccatgtg

SEQ ID NO: 7588114 - DNA, 22 bp, Homo sapiens
tacctgcaaagttccttttgcc

SEQ ID NO: 7588115 - DNA, 22 bp, Homo sapiens
tacctgcaaagttccttttgcc

SEQ ID NO: 7588116 - DNA, 22 bp, Homo sapiens
tacctgaggtaaggatgatgag

SEQ ID NO: 7588117 - DNA, 22 bp, Homo sapiens
tacctgagttatattaataatt

SEQ ID NO: 7588118 - DNA, 22 bp, Homo sapiens
tacctgagcccagtgcagcata

SEQ ID NO: 7588119 - DNA, 22 bp, Homo sapiens
tacctgagcccctgctggtgta

SEQ ID NO: 7588120 - DNA, 22 bp, Homo sapiens
tacctgagcccagtgcagcata

SEQ ID NO: 7588121 - DNA, 22 bp, Homo sapiens
tacctgagcccagtgcagcata

SEQ ID NO: 7588122 - DNA, 22 bp, Homo sapiens
tacctgttgtcacgataacact

SEQ ID NO: 7588123 - DNA, 22 bp, Homo sapiens
tacctgttttaaagctaaaagg

SEQ ID NO: 7588124 - DNA, 22 bp, Homo sapiens
taccttcaggctgccctttgat

SEQ ID NO: 7588125 - DNA, 22 bp, Homo sapiens
taccttcaccagcgaatgtttg

SEQ ID NO: 7588126 - DNA, 22 bp, Homo sapiens
taccttcaggctgccctttgat

SEQ ID NO: 7588127 - DNA, 22 bp, Homo sapiens
taccttctctagatctttattc

SEQ ID NO: 7588128 - DNA, 22 bp, Homo sapiens
taccttgaaccccaagctttgc

SEQ ID NO: 7588129 - DNA, 20 bp, Homo sapiens
taccttgaacctccacctgg

SEQ ID NO: 7588130 - DNA, 22 bp, Homo sapiens
taccttgattttgaatccatga

SEQ ID NO: 7588131 - DNA, 22 bp, Homo sapiens
taccttgggctattatctttga

SEQ ID NO: 7588132 - DNA, 22 bp, Homo sapiens
taccttggggttttgttgctct

SEQ ID NO: 7588133 - DNA, 22 bp, Homo sapiens
taccttgggttgagttcattct

SEQ ID NO: 7588134 - DNA, 22 bp, Homo sapiens
taccttgcagattctattagtt

SEQ ID NO: 7588135 - DNA, 22 bp, Homo sapiens
taccttgggagacgccaggccc

SEQ ID NO: 7588136 - DNA, 22 bp, Homo sapiens
taccttggaggccaagcagttt

SEQ ID NO: 7588137 - DNA, 22 bp, Homo sapiens
taccttggaaatgctagagtaa

SEQ ID NO: 7588138 - DNA, 22 bp, Homo sapiens
tacctgtcaaaagacatggaga

SEQ ID NO: 7588139 - DNA, 22 bp, Homo sapiens
tacctgggcccaccagtgcctg

SEQ ID NO: 7588140 - DNA, 22 bp, Homo sapiens
tacctgggcccaccagtgcctg

SEQ ID NO: 7588141 - DNA, 22 bp, Homo sapiens
tacctggggctgggctttgatt

SEQ ID NO: 7588142 - DNA, 22 bp, Homo sapiens
tacctggggctgggctttgatt

SEQ ID NO: 7588143 - DNA, 22 bp, Homo sapiens
tacctgggaagtgggacctgag

SEQ ID NO: 7588144 - DNA, 22 bp, Homo sapiens
tacctggcagtcagtctttccg

SEQ ID NO: 7588145 - DNA, 22 bp, Homo sapiens
tacctggatgtttagattggca

SEQ ID NO: 7588146 - DNA, 22 bp, Homo sapiens
tacctggaatttatatagctat

SEQ ID NO: 7588147 - DNA, 22 bp, Homo sapiens
tacctggaaatggctttagtta

SEQ ID NO: 7588148 - DNA, 22 bp, Homo sapiens
tacctggaatcacagaggctga

SEQ ID NO: 7588149 - DNA, 22 bp, Homo sapiens
tacctggaaaagttatatgtgt

SEQ ID NO: 7588150 - DNA, 22 bp, Homo sapiens
tacctggaatagagtctctcca

SEQ ID NO: 7588151 - DNA, 22 bp, Homo sapiens
tacctggaatcacagaggctga

SEQ ID NO: 7588152 - DNA, 22 bp, Homo sapiens
tacctggagcaggaggcagaat

SEQ ID NO: 7588153 - DNA, 22 bp, Homo sapiens
tacctggatatcattcattctc

SEQ ID NO: 7588154 - DNA, 22 bp, Homo sapiens
tacctggatcctggtagacatc

SEQ ID NO: 7588155 - DNA, 22 bp, Homo sapiens
tacttcaaccttctctattaga

SEQ ID NO: 7588156 - DNA, 22 bp, Homo sapiens
tacttcaacaccatatggtcct

SEQ ID NO: 7588157 - DNA, 22 bp, Homo sapiens
tacttcaaccttctctattaga

SEQ ID NO: 7588158 - DNA, 22 bp, Homo sapiens
tacttcaaacaatggtacaaac

SEQ ID NO: 7588159 - DNA, 19 bp, Homo sapiens
tacttattagaaatatggg

SEQ ID NO: 7588160 - DNA, 22 bp, Homo sapiens
tacttattgttgaactgaatca

SEQ ID NO: 7588161 - DNA, 22 bp, Homo sapiens
tacttcatacctgctagaatgg

SEQ ID NO: 7588162 - DNA, 22 bp, Homo sapiens
tacttcatacctgctagaatgg

SEQ ID NO: 7588163 - DNA, 22 bp, Homo sapiens
tacttcaatttgtatatgtgaa

SEQ ID NO: 7588164 - DNA, 22 bp, Homo sapiens
tacttcatacctgctagaatgg

SEQ ID NO: 7588165 - DNA, 22 bp, Homo sapiens
tacttcaattatatgccagtta

SEQ ID NO: 7588166 - DNA, 18 bp, Homo sapiens
tacttcaactcccagggc

SEQ ID NO: 7588167 - DNA, 22 bp, Homo sapiens
tacttcaaccttctctattaga

SEQ ID NO: 7588168 - DNA, 22 bp, Homo sapiens
tacttcaaccttctctattaga

SEQ ID NO: 7588169 - DNA, 19 bp, Homo sapiens
tacttattagaaatatggg

SEQ ID NO: 7588170 - DNA, 19 bp, Homo sapiens
tacttattagaaatatggg

SEQ ID NO: 7588171 - DNA, 22 bp, Homo sapiens
tacttataaggaggcacacaaa

SEQ ID NO: 7588172 - DNA, 22 bp, Homo sapiens
tacttaggtgagatattttctt

SEQ ID NO: 7588173 - DNA, 22 bp, Homo sapiens
tacttattggttcagaagttta

SEQ ID NO: 7588174 - DNA, 22 bp, Homo sapiens
tactgtaagtcaaatgaaacat

SEQ ID NO: 7588175 - DNA, 22 bp, Homo sapiens
tactgtaagtcaaatgaaacat

SEQ ID NO: 7588176 - DNA, 22 bp, Homo sapiens
tactgtaaactgtaacttcctt

SEQ ID NO: 7588177 - DNA, 22 bp, Homo sapiens
tactgtaaactgtaacttcctt

SEQ ID NO: 7588178 - DNA, 22 bp, Homo sapiens
tactgggtatacaaagatgaat

SEQ ID NO: 7588179 - DNA, 22 bp, Homo sapiens
tactggggtatgctcagatata

SEQ ID NO: 7588180 - DNA, 22 bp, Homo sapiens
tactggtggaaagagtgaatga

SEQ ID NO: 7588181 - DNA, 22 bp, Homo sapiens
tactgggtatacaaagatgaat

SEQ ID NO: 7588182 - DNA, 22 bp, Homo sapiens
tactgtaatgagattagcttcc

SEQ ID NO: 7588183 - DNA, 22 bp, Homo sapiens
tactgtaatgagattagcttcc

SEQ ID NO: 7588184 - DNA, 22 bp, Homo sapiens
tactgtaatgagattagcttcc

SEQ ID NO: 7588185 - DNA, 22 bp, Homo sapiens
tactgtaatcagggcttaggta

SEQ ID NO: 7588186 - DNA, 22 bp, Homo sapiens
tactgtaatcagggcttaggta

SEQ ID NO: 7588187 - DNA, 22 bp, Homo sapiens
tacttacatttctgtaatcggc

SEQ ID NO: 7588188 - DNA, 22 bp, Homo sapiens
tacttacatttctgtaatcggc

SEQ ID NO: 7588189 - DNA, 22 bp, Homo sapiens
tacttacttgcattttaagttg

SEQ ID NO: 7588190 - DNA, 22 bp, Homo sapiens
tacttagagcgataatttatac

SEQ ID NO: 7588191 - DNA, 22 bp, Homo sapiens
tacttagagcgataatttatac

SEQ ID NO: 7588192 - DNA, 23 bp, Homo sapiens
tacttgaaatcaggcttacttcc

SEQ ID NO: 7588193 - DNA, 20 bp, Homo sapiens
tacttgaatgttgcagcagt

SEQ ID NO: 7588194 - DNA, 23 bp, Homo sapiens
tacttgaaatcaggcttacttcc

SEQ ID NO: 7588195 - DNA, 22 bp, Homo sapiens
tacttctgtaagtgcgccaagg

SEQ ID NO: 7588196 - DNA, 22 bp, Homo sapiens
tacttctgttagctctgagagt

SEQ ID NO: 7588197 - DNA, 22 bp, Homo sapiens
tacttctgttcttaaaccaaga

SEQ ID NO: 7588198 - DNA, 22 bp, Homo sapiens
tacttgaattggtttctgcaga

SEQ ID NO: 7588199 - DNA, 22 bp, Homo sapiens
tacttgagtatagtcgcttcac

SEQ ID NO: 7588200 - DNA, 22 bp, Homo sapiens
tacttgccatcagagtttatta

SEQ ID NO: 7588201 - DNA, 22 bp, Homo sapiens
tacttcctgtttccatgtctgt

SEQ ID NO: 7588202 - DNA, 22 bp, Homo sapiens
tacttcctgtttccatgtctgt

SEQ ID NO: 7588203 - DNA, 22 bp, Homo sapiens
tacttctagcctgccccttgtg

SEQ ID NO: 7588204 - DNA, 22 bp, Homo sapiens
tacttctagcctgccccttgtg

SEQ ID NO: 7588205 - DNA, 22 bp, Homo sapiens
tacttctgccttagagaacact

SEQ ID NO: 7588206 - DNA, 22 bp, Homo sapiens
tacttctgcaccaaccttaata

SEQ ID NO: 7588207 - DNA, 22 bp, Homo sapiens
tacttccagcaatctgcatatt

SEQ ID NO: 7588208 - DNA, 22 bp, Homo sapiens
tacttccagcaatctgcatatt

SEQ ID NO: 7588209 - DNA, 22 bp, Homo sapiens
tacttcattcctttgtaaaatg

SEQ ID NO: 7588210 - DNA, 22 bp, Homo sapiens
tacttccaggcggacaaagccc

SEQ ID NO: 7588211 - DNA, 22 bp, Homo sapiens
tacttccaggcggacaaagccc

SEQ ID NO: 7588212 - DNA, 22 bp, Homo sapiens
tacttccatgtccttagagtcc

SEQ ID NO: 7588213 - DNA, 22 bp, Homo sapiens
tacttccatgtccttagagtcc

SEQ ID NO: 7588214 - DNA, 22 bp, Homo sapiens
tacttcctgtttccatgtctgt

SEQ ID NO: 7588215 - DNA, 22 bp, Homo sapiens
tacttcctgtttccatgtctgt

SEQ ID NO: 7588216 - DNA, 22 bp, Homo sapiens
tacttcccactggggtctacca

SEQ ID NO: 7588217 - DNA, 22 bp, Homo sapiens
tacttcatgagttaatatgcag

SEQ ID NO: 7588218 - DNA, 22 bp, Homo sapiens
tacttcatgggacagagagctg

SEQ ID NO: 7588219 - DNA, 22 bp, Homo sapiens
tacttcatgggacagagagctg

SEQ ID NO: 7588220 - DNA, 22 bp, Homo sapiens
tacttcattattctagttttga

SEQ ID NO: 7588221 - DNA, 22 bp, Homo sapiens
tacttcattcctttgtaaaatg

SEQ ID NO: 7588222 - DNA, 22 bp, Homo sapiens
tacttcattcctttgtaaaatg

SEQ ID NO: 7588223 - DNA, 22 bp, Homo sapiens
tacttcattattctagttttga

SEQ ID NO: 7588224 - DNA, 22 bp, Homo sapiens
tacttcattcaagttcgctata

SEQ ID NO: 7588225 - DNA, 22 bp, Homo sapiens
tacttcattcaagttcgctata

SEQ ID NO: 7588226 - DNA, 22 bp, Homo sapiens
tacttcattcaagttcgctata

SEQ ID NO: 7588227 - DNA, 22 bp, Homo sapiens
tactgcactccagcctgggtga

SEQ ID NO: 7588228 - DNA, 22 bp, Homo sapiens
tactgcacttgagaaagctgag

SEQ ID NO: 7588229 - DNA, 22 bp, Homo sapiens
tactgcagatggccttgttctt

SEQ ID NO: 7588230 - DNA, 22 bp, Homo sapiens
tactgcagatggccttgttctt

SEQ ID NO: 7588231 - DNA, 20 bp, Homo sapiens
tactgcaggaatcagctagc

SEQ ID NO: 7588232 - DNA, 22 bp, Homo sapiens
tactgcatagacactgggatat

SEQ ID NO: 7588233 - DNA, 22 bp, Homo sapiens
tactgagtggcaaaggcaagaa

SEQ ID NO: 7588234 - DNA, 22 bp, Homo sapiens
tactgagtaccaagcattgtgt

SEQ ID NO: 7588235 - DNA, 22 bp, Homo sapiens
tactgataagagttgtaggagt

SEQ ID NO: 7588236 - DNA, 22 bp, Homo sapiens
tactgatagcacaaatgacatt

SEQ ID NO: 7588237 - DNA, 22 bp, Homo sapiens
tactgcaaaactactcagtaat

SEQ ID NO: 7588238 - DNA, 22 bp, Homo sapiens
tactgcaaaccatttacagtag

SEQ ID NO: 7588239 - DNA, 22 bp, Homo sapiens
tactgcaaaccatttacagtag

SEQ ID NO: 7588240 - DNA, 18 bp, Homo sapiens
tactgatttttcagagtc

SEQ ID NO: 7588241 - DNA, 22 bp, Homo sapiens
tactgcaaaactactcagtaat

SEQ ID NO: 7588242 - DNA, 22 bp, Homo sapiens
tactgatatgatgtgctttaga

SEQ ID NO: 7588243 - DNA, 18 bp, Homo sapiens
tactgatttttcagagtc

SEQ ID NO: 7588244 - DNA, 18 bp, Homo sapiens
tactgatttttcagagtc

SEQ ID NO: 7588245 - DNA, 22 bp, Homo sapiens
tactgagctggtccactgaggt

SEQ ID NO: 7588246 - DNA, 18 bp, Homo sapiens
tactgagcaacaggagaa

SEQ ID NO: 7588247 - DNA, 22 bp, Homo sapiens
tactgaattgtaagatgatgcc

SEQ ID NO: 7588248 - DNA, 22 bp, Homo sapiens
tactgaggctgaattcttagca

SEQ ID NO: 7588249 - DNA, 22 bp, Homo sapiens
tactgagggcaaagagtgaagc

SEQ ID NO: 7588250 - DNA, 22 bp, Homo sapiens
tactgagggcaaagagtgaagc

SEQ ID NO: 7588251 - DNA, 17 bp, Homo sapiens
tactgaggggtctggag

SEQ ID NO: 7588252 - DNA, 22 bp, Homo sapiens
tactggagagccttgtccacat

SEQ ID NO: 7588253 - DNA, 22 bp, Homo sapiens
tactggaagttagagatctttt

SEQ ID NO: 7588254 - DNA, 22 bp, Homo sapiens
tactggaatcccgggtggctgg

SEQ ID NO: 7588255 - DNA, 22 bp, Homo sapiens
tactggaatcccgggtggctgg

SEQ ID NO: 7588256 - DNA, 22 bp, Homo sapiens
tactggaagttagagatctttt

SEQ ID NO: 7588257 - DNA, 22 bp, Homo sapiens
tactggaaggctggaagtcagg

SEQ ID NO: 7588258 - DNA, 22 bp, Homo sapiens
tactggaaggctggaagtcagg

SEQ ID NO: 7588259 - DNA, 23 bp, Homo sapiens
tactggaaatttgacagatttga

SEQ ID NO: 7588260 - DNA, 20 bp, Homo sapiens
tactggaaatttctccacct

SEQ ID NO: 7588261 - DNA, 20 bp, Homo sapiens
tactggaaatttctccacct

SEQ ID NO: 7588262 - DNA, 20 bp, Homo sapiens
tactggaaatttctccacct

SEQ ID NO: 7588263 - DNA, 22 bp, Homo sapiens
tactggggtatgctcagatata

SEQ ID NO: 7588264 - DNA, 22 bp, Homo sapiens
tactggggtatgctcagatata

SEQ ID NO: 7588265 - DNA, 23 bp, Homo sapiens
tactgggcagctgctctgacacc

SEQ ID NO: 7588266 - DNA, 23 bp, Homo sapiens
tactgggcagctgctctgacacc

SEQ ID NO: 7588267 - DNA, 20 bp, Homo sapiens
tactgggcaagcccacagac

SEQ ID NO: 7588268 - DNA, 22 bp, Homo sapiens
tactggagatggaatgcttttg

SEQ ID NO: 7588269 - DNA, 22 bp, Homo sapiens
tactggagagccttgtccacat

SEQ ID NO: 7588270 - DNA, 22 bp, Homo sapiens
tactggagagccttgtccacat

SEQ ID NO: 7588271 - DNA, 22 bp, Homo sapiens
tactggagtcagaaatgccttg

SEQ ID NO: 7588272 - DNA, 20 bp, Homo sapiens
tactggagtgagcctgtagc

SEQ ID NO: 7588273 - DNA, 20 bp, Homo sapiens
tactggagtgagcctgtagc

SEQ ID NO: 7588274 - DNA, 20 bp, Homo sapiens
tactggagtgagcctgtagc

SEQ ID NO: 7588275 - DNA, 22 bp, Homo sapiens
tactggatgtaaatctggaagc

SEQ ID NO: 7588276 - DNA, 22 bp, Homo sapiens
tactgccttggtaggaataacc

SEQ ID NO: 7588277 - DNA, 23 bp, Homo sapiens
tactgcctggggccagagagcgg

SEQ ID NO: 7588278 - DNA, 22 bp, Homo sapiens
tactgcctattcaattggaatt

SEQ ID NO: 7588279 - DNA, 22 bp, Homo sapiens
tactgcctagatattaaaagct

SEQ ID NO: 7588280 - DNA, 22 bp, Homo sapiens
tactgcctattcaattggaatt

SEQ ID NO: 7588281 - DNA, 22 bp, Homo sapiens
tactgcctggagatgaatcaat

SEQ ID NO: 7588282 - DNA, 22 bp, Homo sapiens
tactgccaaattgcagcaatgt

SEQ ID NO: 7588283 - DNA, 22 bp, Homo sapiens
tactgcccagagctgcccgtgg

SEQ ID NO: 7588284 - DNA, 22 bp, Homo sapiens
tactgcgccttcaccaagcggc

SEQ ID NO: 7588285 - DNA, 22 bp, Homo sapiens
tactgctagatgaaaatgtagg

SEQ ID NO: 7588286 - DNA, 22 bp, Homo sapiens
tactgctagatgaaaatgtagg

SEQ ID NO: 7588287 - DNA, 22 bp, Homo sapiens
tactgctgagctgggtagaagg

SEQ ID NO: 7588288 - DNA, 22 bp, Homo sapiens
tactgctgattagagctgaggt

SEQ ID NO: 7588289 - DNA, 22 bp, Homo sapiens
tactgctagatgaaaatgtagg

SEQ ID NO: 7588290 - DNA, 22 bp, Homo sapiens
tacattcaaacgatttattgat

SEQ ID NO: 7588291 - DNA, 22 bp, Homo sapiens
tacattcaaacgatttattgat

SEQ ID NO: 7588292 - DNA, 22 bp, Homo sapiens
tacattcaaacgatttattgat

SEQ ID NO: 7588293 - DNA, 22 bp, Homo sapiens
tacattcaaacgatttattgat

SEQ ID NO: 7588294 - DNA, 22 bp, Homo sapiens
tacattcaacatgtcactatgt

SEQ ID NO: 7588295 - DNA, 20 bp, Homo sapiens
tacattcaaaacaaactctg

SEQ ID NO: 7588296 - DNA, 20 bp, Homo sapiens
tacattcaaaacaaactctg

SEQ ID NO: 7588297 - DNA, 20 bp, Homo sapiens
tacattcaaaacaaactctg

SEQ ID NO: 7588298 - DNA, 20 bp, Homo sapiens
tacattcaaaacaaactctg

SEQ ID NO: 7588299 - DNA, 22 bp, Homo sapiens
tacattcaacatgtcactatgt

SEQ ID NO: 7588300 - DNA, 22 bp, Homo sapiens
tacattcaacatgtcactatgt

SEQ ID NO: 7588301 - DNA, 22 bp, Homo sapiens
tacattcaacatgtcactatgt

SEQ ID NO: 7588302 - DNA, 22 bp, Homo sapiens
tacattcaacatgtcactatgt

SEQ ID NO: 7588303 - DNA, 22 bp, Homo sapiens
tacattcaacatgtcactatgt

SEQ ID NO: 7588304 - DNA, 22 bp, Homo sapiens
tacattcaacatgtcactatgt

SEQ ID NO: 7588305 - DNA, 22 bp, Homo sapiens
tacattcaacatgtcactatgt

SEQ ID NO: 7588306 - DNA, 22 bp, Homo sapiens
tacattcaacatgtcactatgt

SEQ ID NO: 7588307 - DNA, 22 bp, Homo sapiens
tacattcacagttgttcatctc

SEQ ID NO: 7588308 - DNA, 22 bp, Homo sapiens
tacattcaacatgtcactatgt

SEQ ID NO: 7588309 - DNA, 22 bp, Homo sapiens
tacattacaggaaagataaaga

SEQ ID NO: 7588310 - DNA, 22 bp, Homo sapiens
tacattagctcatctatttatt

SEQ ID NO: 7588311 - DNA, 22 bp, Homo sapiens
tacattagcaaacatcttggtg

SEQ ID NO: 7588312 - DNA, 22 bp, Homo sapiens
tacattatcttgttatctttca

SEQ ID NO: 7588313 - DNA, 22 bp, Homo sapiens
tacattatcttgttatctttca

SEQ ID NO: 7588314 - DNA, 22 bp, Homo sapiens
tacattatcttgttatctttca

SEQ ID NO: 7588315 - DNA, 22 bp, Homo sapiens
tacattatcttgttatctttca

SEQ ID NO: 7588316 - DNA, 22 bp, Homo sapiens
tacattatcttgttatctttca

SEQ ID NO: 7588317 - DNA, 22 bp, Homo sapiens
tacattatcctgtctttgtcct

SEQ ID NO: 7588318 - DNA, 22 bp, Homo sapiens
tacattatttcatcagtcatct

SEQ ID NO: 7588319 - DNA, 22 bp, Homo sapiens
tacattatttcatcagtcatct

SEQ ID NO: 7588320 - DNA, 22 bp, Homo sapiens
tacattatttcatcagtcatct

SEQ ID NO: 7588321 - DNA, 22 bp, Homo sapiens
tacattatttcatcagtcatct

SEQ ID NO: 7588322 - DNA, 22 bp, Homo sapiens
tacattatttcatcagtcatct

SEQ ID NO: 7588323 - DNA, 22 bp, Homo sapiens
tacattatcttgttatctttca

SEQ ID NO: 7588324 - DNA, 22 bp, Homo sapiens
tacattatcttgttatctttca

SEQ ID NO: 7588325 - DNA, 22 bp, Homo sapiens
tacattatcttgttatctttca

SEQ ID NO: 7588326 - DNA, 22 bp, Homo sapiens
tacattatcttgttatctttca

SEQ ID NO: 7588327 - DNA, 23 bp, Homo sapiens
tacattcatttgcacagccagta

SEQ ID NO: 7588328 - DNA, 23 bp, Homo sapiens
tacattcatttgcacagccagta

SEQ ID NO: 7588329 - DNA, 23 bp, Homo sapiens
tacattcatttgcacagccagta

SEQ ID NO: 7588330 - DNA, 15 bp, Homo sapiens
tacattcatttccac

SEQ ID NO: 7588331 - DNA, 15 bp, Homo sapiens
tacattcatttccac

SEQ ID NO: 7588332 - DNA, 15 bp, Homo sapiens
tacattcatttccac

SEQ ID NO: 7588333 - DNA, 15 bp, Homo sapiens
tacattcatttccac

SEQ ID NO: 7588334 - DNA, 22 bp, Homo sapiens
tacattcatggtgacttgtatg

SEQ ID NO: 7588335 - DNA, 22 bp, Homo sapiens
tacattcatggtgacttgtatg

SEQ ID NO: 7588336 - DNA, 22 bp, Homo sapiens
tacattcatggtgacttgtatg

SEQ ID NO: 7588337 - DNA, 22 bp, Homo sapiens
tacattcatggtgacttgtatg

SEQ ID NO: 7588338 - DNA, 22 bp, Homo sapiens
tacattcatggtgacttgtatg

SEQ ID NO: 7588339 - DNA, 22 bp, Homo sapiens
tacattcatatgtgtgcataca

SEQ ID NO: 7588340 - DNA, 22 bp, Homo sapiens
tacattcatatgtgtgcataca

SEQ ID NO: 7588341 - DNA, 22 bp, Homo sapiens
tacattcatatgtgtgcataca

SEQ ID NO: 7588342 - DNA, 22 bp, Homo sapiens
tacattcagcaaaagaatggtt

SEQ ID NO: 7588343 - DNA, 22 bp, Homo sapiens
tacattcatggtgacttgtatg

SEQ ID NO: 7588344 - DNA, 22 bp, Homo sapiens
tacattcatggtgacttgtatg

SEQ ID NO: 7588345 - DNA, 22 bp, Homo sapiens
tacattcatggtgacttgtatg

SEQ ID NO: 7588346 - DNA, 22 bp, Homo sapiens
tacattcatatgtgtgcataca

SEQ ID NO: 7588347 - DNA, 22 bp, Homo sapiens
tacattcatggtgacttgtatg

SEQ ID NO: 7588348 - DNA, 22 bp, Homo sapiens
tacattcagaagaatggacacg

SEQ ID NO: 7588349 - DNA, 22 bp, Homo sapiens
tacattcagaattgggaggcaa

SEQ ID NO: 7588350 - DNA, 22 bp, Homo sapiens
tacattcagaattgggaggcaa

SEQ ID NO: 7588351 - DNA, 22 bp, Homo sapiens
tacattcagaattgggaggcaa

SEQ ID NO: 7588352 - DNA, 22 bp, Homo sapiens
tacattcagagaaagtttccat

SEQ ID NO: 7588353 - DNA, 22 bp, Homo sapiens
tacattcagcaaaagaatggtt

SEQ ID NO: 7588354 - DNA, 22 bp, Homo sapiens
tacattcagcaaaagaatggtt

SEQ ID NO: 7588355 - DNA, 22 bp, Homo sapiens
tacattcagcaaaagaatggtt

SEQ ID NO: 7588356 - DNA, 22 bp, Homo sapiens
tacattcagagaaagtttccat

SEQ ID NO: 7588357 - DNA, 22 bp, Homo sapiens
tacattcagagaaagtttccat

SEQ ID NO: 7588358 - DNA, 22 bp, Homo sapiens
tacattcagagaaagtttccat

SEQ ID NO: 7588359 - DNA, 22 bp, Homo sapiens
tacattcagagaaagtttccat

SEQ ID NO: 7588360 - DNA, 22 bp, Homo sapiens
tacattcacttgttgaaggtgg

SEQ ID NO: 7588361 - DNA, 22 bp, Homo sapiens
tacattcacttgttgaaggtgg

SEQ ID NO: 7588362 - DNA, 22 bp, Homo sapiens
tacattcacttgttgaaggtgg

SEQ ID NO: 7588363 - DNA, 22 bp, Homo sapiens
tacattcacagttgttcatctc

SEQ ID NO: 7588364 - DNA, 22 bp, Homo sapiens
tacattcacagttgttcatctc

SEQ ID NO: 7588365 - DNA, 22 bp, Homo sapiens
tacattcacagttgttcatctc

SEQ ID NO: 7588366 - DNA, 22 bp, Homo sapiens
tacattcacagttgttcatctc

SEQ ID NO: 7588367 - DNA, 22 bp, Homo sapiens
tacattcagaagaatggacacg

SEQ ID NO: 7588368 - DNA, 22 bp, Homo sapiens
tacattcagaagaatggacacg

SEQ ID NO: 7588369 - DNA, 22 bp, Homo sapiens
tacatacatattcatacaggtg

SEQ ID NO: 7588370 - DNA, 22 bp, Homo sapiens
tacatacagtggatgctttagg

SEQ ID NO: 7588371 - DNA, 22 bp, Homo sapiens
tacatacagtggatgctttagg

SEQ ID NO: 7588372 - DNA, 22 bp, Homo sapiens
tacatacagtggatgctttagg

SEQ ID NO: 7588373 - DNA, 22 bp, Homo sapiens
tacatacagtggatgctttagg

SEQ ID NO: 7588374 - DNA, 22 bp, Homo sapiens
tacatacagtggatgctttagg

SEQ ID NO: 7588375 - DNA, 22 bp, Homo sapiens
tacatacagccaagtatgaagt

SEQ ID NO: 7588376 - DNA, 22 bp, Homo sapiens
tacatacatggtggaatggtta

SEQ ID NO: 7588377 - DNA, 22 bp, Homo sapiens
tacatacatattcatacaggtg

SEQ ID NO: 7588378 - DNA, 22 bp, Homo sapiens
tacatacatattcatacaggtg

SEQ ID NO: 7588379 - DNA, 22 bp, Homo sapiens
tacatacatattcatacaggtg

SEQ ID NO: 7588380 - DNA, 22 bp, Homo sapiens
tacatacatattcatacaggtg

SEQ ID NO: 7588381 - DNA, 22 bp, Homo sapiens
tacatacatattcatacaggtg

SEQ ID NO: 7588382 - DNA, 22 bp, Homo sapiens
tacatacatattcatacaggtg

SEQ ID NO: 7588383 - DNA, 22 bp, Homo sapiens
tacatacatattcatacaggtg

SEQ ID NO: 7588384 - DNA, 22 bp, Homo sapiens
tacatacatattcatacaggtg

SEQ ID NO: 7588385 - DNA, 22 bp, Homo sapiens
tacatacatattcatacaggtg

SEQ ID NO: 7588386 - DNA, 22 bp, Homo sapiens
tacatacatattcatacaggtg

SEQ ID NO: 7588387 - DNA, 22 bp, Homo sapiens
tacatacatattcatacaggtg

SEQ ID NO: 7588388 - DNA, 22 bp, Homo sapiens
tacatacatattcatacaggtg

SEQ ID NO: 7588389 - DNA, 22 bp, Homo sapiens
tacatgtctgggttttgtttcc

SEQ ID NO: 7588390 - DNA, 22 bp, Homo sapiens
tacatgtctgggttttgtttcc

SEQ ID NO: 7588391 - DNA, 22 bp, Homo sapiens
tacatgtttggtaaatgatggc

SEQ ID NO: 7588392 - DNA, 22 bp, Homo sapiens
tacattaaggatatggacatga

SEQ ID NO: 7588393 - DNA, 22 bp, Homo sapiens
tacattaaggatatggacatga

SEQ ID NO: 7588394 - DNA, 22 bp, Homo sapiens
tacattaaggatatggacatga

SEQ ID NO: 7588395 - DNA, 22 bp, Homo sapiens
tacattaaggatatggacatga

SEQ ID NO: 7588396 - DNA, 22 bp, Homo sapiens
tacattaaggatatggacatga

SEQ ID NO: 7588397 - DNA, 22 bp, Homo sapiens
tacattaacttacgtccacatg

SEQ ID NO: 7588398 - DNA, 22 bp, Homo sapiens
tacatgtctacagccatgtctg

SEQ ID NO: 7588399 - DNA, 22 bp, Homo sapiens
tacatgtctacatgcatttttg

SEQ ID NO: 7588400 - DNA, 22 bp, Homo sapiens
tacatgtctacagccatgtctg

SEQ ID NO: 7588401 - DNA, 22 bp, Homo sapiens
tacatgtattgatttctcttct

SEQ ID NO: 7588402 - DNA, 22 bp, Homo sapiens
tacatacatggtggaatggtta

SEQ ID NO: 7588403 - DNA, 22 bp, Homo sapiens
tacatacatggtggaatggtta

SEQ ID NO: 7588404 - DNA, 22 bp, Homo sapiens
tacatacacaaatgctgaatgg

SEQ ID NO: 7588405 - DNA, 22 bp, Homo sapiens
tacatacacaaatgctgaatgg

SEQ ID NO: 7588406 - DNA, 22 bp, Homo sapiens
tacatacacaaatgctgaatgg

SEQ ID NO: 7588407 - DNA, 22 bp, Homo sapiens
tacatacacaaatgctgaatgg

SEQ ID NO: 7588408 - DNA, 22 bp, Homo sapiens
tacatacacaaatgctgaatgg

SEQ ID NO: 7588409 - DNA, 22 bp, Homo sapiens
tacatacacaaatgctgaatgg

SEQ ID NO: 7588410 - DNA, 22 bp, Homo sapiens
tacatacacaaatatactgttt

SEQ ID NO: 7588411 - DNA, 22 bp, Homo sapiens
tacatacacaaatatactgttt

SEQ ID NO: 7588412 - DNA, 22 bp, Homo sapiens
tacatacacaaatatactgttt

SEQ ID NO: 7588413 - DNA, 22 bp, Homo sapiens
tacatacacaaatatactgttt

SEQ ID NO: 7588414 - DNA, 22 bp, Homo sapiens
tacatacacaaatatactgttt

SEQ ID NO: 7588415 - DNA, 22 bp, Homo sapiens
tacatacagccaagtatgaagt

SEQ ID NO: 7588416 - DNA, 22 bp, Homo sapiens
tacatacagagatgctagttaa

SEQ ID NO: 7588417 - DNA, 22 bp, Homo sapiens
tacatacagccaagtatgaagt

SEQ ID NO: 7588418 - DNA, 22 bp, Homo sapiens
tacatacagccaagtatgaagt

SEQ ID NO: 7588419 - DNA, 22 bp, Homo sapiens
tacatacagccaagtatgaagt

SEQ ID NO: 7588420 - DNA, 22 bp, Homo sapiens
tacatacagccaagtatgaagt

SEQ ID NO: 7588421 - DNA, 22 bp, Homo sapiens
tacatacagccaagtatgaagt

SEQ ID NO: 7588422 - DNA, 22 bp, Homo sapiens
tacatacagagatgctagttaa

SEQ ID NO: 7588423 - DNA, 22 bp, Homo sapiens
tacatacagagatgctagttaa

SEQ ID NO: 7588424 - DNA, 22 bp, Homo sapiens
tacatacagagatgctagttaa

SEQ ID NO: 7588425 - DNA, 22 bp, Homo sapiens
tacatacagagatgctagttaa

SEQ ID NO: 7588426 - DNA, 22 bp, Homo sapiens
tacatacagagatgctagttaa

SEQ ID NO: 7588427 - DNA, 22 bp, Homo sapiens
tacatacaagcattcaatttta

SEQ ID NO: 7588428 - DNA, 22 bp, Homo sapiens
tacatacaagcattcaatttta

SEQ ID NO: 7588429 - DNA, 22 bp, Homo sapiens
tacatacaagcattcaatttta

SEQ ID NO: 7588430 - DNA, 22 bp, Homo sapiens
tacatacaagcattcaatttta

SEQ ID NO: 7588431 - DNA, 22 bp, Homo sapiens
tacatacaagatgtgtttaaaa

SEQ ID NO: 7588432 - DNA, 22 bp, Homo sapiens
tacatacaagatgtgtttaaaa

SEQ ID NO: 7588433 - DNA, 22 bp, Homo sapiens
tacatacacaaatatactgttt

SEQ ID NO: 7588434 - DNA, 22 bp, Homo sapiens
tacatacacaaatatactgttt

SEQ ID NO: 7588435 - DNA, 22 bp, Homo sapiens
tacatacaagcattcaatttta

SEQ ID NO: 7588436 - DNA, 22 bp, Homo sapiens
tacatacaagcattcaatttta

SEQ ID NO: 7588437 - DNA, 22 bp, Homo sapiens
tacatacaagcattcaatttta

SEQ ID NO: 7588438 - DNA, 22 bp, Homo sapiens
tacatacaagcattcaatttta

SEQ ID NO: 7588439 - DNA, 22 bp, Homo sapiens
tacatacacaaatatactgttt

SEQ ID NO: 7588440 - DNA, 22 bp, Homo sapiens
tacatacacaaatatactgttt

SEQ ID NO: 7588441 - DNA, 22 bp, Homo sapiens
tacatacacaaatatactgttt

SEQ ID NO: 7588442 - DNA, 22 bp, Homo sapiens
tacatacacaaatatactgttt

SEQ ID NO: 7588443 - DNA, 22 bp, Homo sapiens
tacatacacaaatatactgttt

SEQ ID NO: 7588444 - DNA, 22 bp, Homo sapiens
tacatacacaaatatactgttt

SEQ ID NO: 7588445 - DNA, 22 bp, Homo sapiens
tacatacacaaatatactgttt

SEQ ID NO: 7588446 - DNA, 22 bp, Homo sapiens
tacatacacaaatatactgttt

SEQ ID NO: 7588447 - DNA, 22 bp, Homo sapiens
tacatacacaaatatactgttt

SEQ ID NO: 7588448 - DNA, 22 bp, Homo sapiens
tacatacacaaatatactgttt

SEQ ID NO: 7588449 - DNA, 22 bp, Homo sapiens
tacagttacgctgagaaacgaa

SEQ ID NO: 7588450 - DNA, 22 bp, Homo sapiens
tacagttactgcatttctaata

SEQ ID NO: 7588451 - DNA, 22 bp, Homo sapiens
tacagttactgcatttctaata

SEQ ID NO: 7588452 - DNA, 22 bp, Homo sapiens
tacagttacgctgagaaacgaa

SEQ ID NO: 7588453 - DNA, 22 bp, Homo sapiens
tacagttacgctgagaaacgaa

SEQ ID NO: 7588454 - DNA, 22 bp, Homo sapiens
tacagttactgttatatgtgct

SEQ ID NO: 7588455 - DNA, 22 bp, Homo sapiens
tacagttactgcatttctaata

SEQ ID NO: 7588456 - DNA, 22 bp, Homo sapiens
tacagttactgcatttctaata

SEQ ID NO: 7588457 - DNA, 22 bp, Homo sapiens
tacagttactgcatttctaata

SEQ ID NO: 7588458 - DNA, 22 bp, Homo sapiens
tacagtttgttacattgttagt

SEQ ID NO: 7588459 - DNA, 22 bp, Homo sapiens
tacagtttgttacattgttagt

SEQ ID NO: 7588460 - DNA, 22 bp, Homo sapiens
tacagtttgttacattgttagt

SEQ ID NO: 7588461 - DNA, 22 bp, Homo sapiens
tacagtttgttacattgttagt

SEQ ID NO: 7588462 - DNA, 22 bp, Homo sapiens
tacagttaccctggaaagaaat

SEQ ID NO: 7588463 - DNA, 22 bp, Homo sapiens
tacagttaccctggaaagaaat

SEQ ID NO: 7588464 - DNA, 22 bp, Homo sapiens
tacagttaagctactggagaat

SEQ ID NO: 7588465 - DNA, 22 bp, Homo sapiens
tacagttaccctggaaagaaat

SEQ ID NO: 7588466 - DNA, 22 bp, Homo sapiens
tacagttaccctggaaagaaat

SEQ ID NO: 7588467 - DNA, 22 bp, Homo sapiens
tacagttaccctggaaagaaat

SEQ ID NO: 7588468 - DNA, 22 bp, Homo sapiens
tacagttaccctggaaagaaat

SEQ ID NO: 7588469 - DNA, 17 bp, Homo sapiens
tacaggagagcaggaac

SEQ ID NO: 7588470 - DNA, 17 bp, Homo sapiens
tacaggagagcaggaac

SEQ ID NO: 7588471 - DNA, 22 bp, Homo sapiens
tacaggagagatttagtaatca

SEQ ID NO: 7588472 - DNA, 17 bp, Homo sapiens
tacaggagagcaggaac

SEQ ID NO: 7588473 - DNA, 20 bp, Homo sapiens
tacaggaccttctttgtatc

SEQ ID NO: 7588474 - DNA, 20 bp, Homo sapiens
tacaggaatcaagactgcat

SEQ ID NO: 7588475 - DNA, 22 bp, Homo sapiens
tacaggaagttacagactatga

SEQ ID NO: 7588476 - DNA, 22 bp, Homo sapiens
tacaggaagttacagactatga

SEQ ID NO: 7588477 - DNA, 22 bp, Homo sapiens
tacaggaagttacagactatga

SEQ ID NO: 7588478 - DNA, 22 bp, Homo sapiens
tacaggaagttacagactatga

SEQ ID NO: 7588479 - DNA, 22 bp, Homo sapiens
tacaggaagttacagactatga

SEQ ID NO: 7588480 - DNA, 20 bp, Homo sapiens
tacaggaatcaagactgcat

SEQ ID NO: 7588481 - DNA, 20 bp, Homo sapiens
tacaggaatcaagactgcat

SEQ ID NO: 7588482 - DNA, 20 bp, Homo sapiens
tacaggaatcaagactgcat

SEQ ID NO: 7588483 - DNA, 20 bp, Homo sapiens
tacaggaatcaagactgcat

SEQ ID NO: 7588484 - DNA, 20 bp, Homo sapiens
tacaggaatcaagactgcat

SEQ ID NO: 7588485 - DNA, 22 bp, Homo sapiens
tacataattaatctttaagttc

SEQ ID NO: 7588486 - DNA, 22 bp, Homo sapiens
tacataattaatctttaagttc

SEQ ID NO: 7588487 - DNA, 22 bp, Homo sapiens
tacataattaatctttaagttc

SEQ ID NO: 7588488 - DNA, 22 bp, Homo sapiens
tacataattaatctttaagttc

SEQ ID NO: 7588489 - DNA, 22 bp, Homo sapiens
tacataattaatctttaagttc

SEQ ID NO: 7588490 - DNA, 22 bp, Homo sapiens
tacataattaatctttaagttc

SEQ ID NO: 7588491 - DNA, 22 bp, Homo sapiens
tacataatgagctagttaagtt

SEQ ID NO: 7588492 - DNA, 22 bp, Homo sapiens
tacataataaggggcatggtgt

SEQ ID NO: 7588493 - DNA, 22 bp, Homo sapiens
tacataatgagctagttaagtt

SEQ ID NO: 7588494 - DNA, 22 bp, Homo sapiens
tacataatgagctagttaagtt

SEQ ID NO: 7588495 - DNA, 22 bp, Homo sapiens
tacataatgagctagttaagtt

SEQ ID NO: 7588496 - DNA, 22 bp, Homo sapiens
tacataatgagctagttaagtt

SEQ ID NO: 7588497 - DNA, 22 bp, Homo sapiens
tacatacaagatgtgtttaaaa

SEQ ID NO: 7588498 - DNA, 22 bp, Homo sapiens
tacatacaagatgtgtttaaaa

SEQ ID NO: 7588499 - DNA, 22 bp, Homo sapiens
tacatacaagatgtgtttaaaa

SEQ ID NO: 7588500 - DNA, 22 bp, Homo sapiens
tacatacaagatgtgtttaaaa

SEQ ID NO: 7588501 - DNA, 22 bp, Homo sapiens
tacatacaagatgtgtttaaaa

SEQ ID NO: 7588502 - DNA, 22 bp, Homo sapiens
tacataattgtctttgtcctca

SEQ ID NO: 7588503 - DNA, 22 bp, Homo sapiens
tacataattgtctttgtcctca

SEQ ID NO: 7588504 - DNA, 22 bp, Homo sapiens
tacataattaatctttaagttc

SEQ ID NO: 7588505 - DNA, 22 bp, Homo sapiens
tacataattaatctttaagttc

SEQ ID NO: 7588506 - DNA, 22 bp, Homo sapiens
tacagtttttcactgaagatgt

SEQ ID NO: 7588507 - DNA, 22 bp, Homo sapiens
tacataataaggggcatggtgt

SEQ ID NO: 7588508 - DNA, 22 bp, Homo sapiens
tacagtttttcactgaagatgt

SEQ ID NO: 7588509 - DNA, 22 bp, Homo sapiens
tacataataaggggcatggtgt

SEQ ID NO: 7588510 - DNA, 22 bp, Homo sapiens
tacataataaggggcatggtgt

SEQ ID NO: 7588511 - DNA, 22 bp, Homo sapiens
tacagtttttcactgaagatgt

SEQ ID NO: 7588512 - DNA, 22 bp, Homo sapiens
tacagtttttcactgaagatgt

SEQ ID NO: 7588513 - DNA, 22 bp, Homo sapiens
tacagtttttcactgaagatgt

SEQ ID NO: 7588514 - DNA, 22 bp, Homo sapiens
tacagtttttcactgaagatgt

SEQ ID NO: 7588515 - DNA, 22 bp, Homo sapiens
tacagtttttcactgaagatgt

SEQ ID NO: 7588516 - DNA, 22 bp, Homo sapiens
tacagtttttattcatgacaag

SEQ ID NO: 7588517 - DNA, 22 bp, Homo sapiens
tacagtttttattcatgacaag

SEQ ID NO: 7588518 - DNA, 22 bp, Homo sapiens
tacagttttggtgatgatgatg

SEQ ID NO: 7588519 - DNA, 22 bp, Homo sapiens
tacagttttggtgatgatgatg

SEQ ID NO: 7588520 - DNA, 22 bp, Homo sapiens
tacagtttttattcatgacaag

SEQ ID NO: 7588521 - DNA, 22 bp, Homo sapiens
tacagtttttattcatgacaag

SEQ ID NO: 7588522 - DNA, 22 bp, Homo sapiens
tacagtttttattcatgacaag

SEQ ID NO: 7588523 - DNA, 22 bp, Homo sapiens
tacagtttttattcatgacaag

SEQ ID NO: 7588524 - DNA, 22 bp, Homo sapiens
tacagtttttattcatgacaag

SEQ ID NO: 7588525 - DNA, 22 bp, Homo sapiens
tacagtttttattcatgacaag

SEQ ID NO: 7588526 - DNA, 22 bp, Homo sapiens
tacaggaagtaagtaatgaaat

SEQ ID NO: 7588527 - DNA, 22 bp, Homo sapiens
tacaggaagtaagtaatgaaat

SEQ ID NO: 7588528 - DNA, 22 bp, Homo sapiens
tacaggaagtaagtaatgaaat

SEQ ID NO: 7588529 - DNA, 22 bp, Homo sapiens
tacaggaagtaagtaatgaaat

SEQ ID NO: 7588530 - DNA, 22 bp, Homo sapiens
tacaggaagtaagtaatgaaat

SEQ ID NO: 7588531 - DNA, 22 bp, Homo sapiens
tacaggaagtctcagtacagta

SEQ ID NO: 7588532 - DNA, 22 bp, Homo sapiens
tacaggaagtctcagtacagta

SEQ ID NO: 7588533 - DNA, 22 bp, Homo sapiens
tacaggaagtctcagtacagta

SEQ ID NO: 7588534 - DNA, 22 bp, Homo sapiens
tacaggaagtctcagtacagta

SEQ ID NO: 7588535 - DNA, 22 bp, Homo sapiens
tacaggaagtctcagtacagta

SEQ ID NO: 7588536 - DNA, 22 bp, Homo sapiens
tacaggaaggagcacatcggga

SEQ ID NO: 7588537 - DNA, 22 bp, Homo sapiens
tacaggaaggagcacatcggga

SEQ ID NO: 7588538 - DNA, 22 bp, Homo sapiens
tacaggaagcactcaagaaatg

SEQ ID NO: 7588539 - DNA, 22 bp, Homo sapiens
tacaggaagcactcaagaaatg

SEQ ID NO: 7588540 - DNA, 18 bp, Homo sapiens
tacaggaaggggttctcg

SEQ ID NO: 7588541 - DNA, 18 bp, Homo sapiens
tacaggaaggggttctcg

SEQ ID NO: 7588542 - DNA, 22 bp, Homo sapiens
tacaggaaggctctggaggtgc

SEQ ID NO: 7588543 - DNA, 22 bp, Homo sapiens
tacaggaaggctctggaggtgc

SEQ ID NO: 7588544 - DNA, 22 bp, Homo sapiens
tacaggaactgggcaggacatt

SEQ ID NO: 7588545 - DNA, 22 bp, Homo sapiens
tacaggaaccagattgttcagc

SEQ ID NO: 7588546 - DNA, 22 bp, Homo sapiens
tacaggaaccagattgttcagc

SEQ ID NO: 7588547 - DNA, 22 bp, Homo sapiens
tacaggaactgggcaggacatt

SEQ ID NO: 7588548 - DNA, 22 bp, Homo sapiens
tacaggaactgggcaggacatt

SEQ ID NO: 7588549 - DNA, 22 bp, Homo sapiens
tacaggaactgggcaggacatt

SEQ ID NO: 7588550 - DNA, 22 bp, Homo sapiens
tacaggaactgggcaggacatt

SEQ ID NO: 7588551 - DNA, 22 bp, Homo sapiens
tacaggaactgggcaggacatt

SEQ ID NO: 7588552 - DNA, 22 bp, Homo sapiens
tacaggaactgggcaggacatt

SEQ ID NO: 7588553 - DNA, 22 bp, Homo sapiens
tacaggaagcactcaagaaatg

SEQ ID NO: 7588554 - DNA, 22 bp, Homo sapiens
tacaggaagcactcaagaaatg

SEQ ID NO: 7588555 - DNA, 22 bp, Homo sapiens
tacaggaagcactcaagaaatg

SEQ ID NO: 7588556 - DNA, 22 bp, Homo sapiens
tacaggaagcactcaagaaatg

SEQ ID NO: 7588557 - DNA, 22 bp, Homo sapiens
tacaggaagcactcaagaaatg

SEQ ID NO: 7588558 - DNA, 18 bp, Homo sapiens
tacaggaaaagtgttaca

SEQ ID NO: 7588559 - DNA, 22 bp, Homo sapiens
tacagcttttgcagctgttttg

SEQ ID NO: 7588560 - DNA, 22 bp, Homo sapiens
tacaggaaccagattgttcagc

SEQ ID NO: 7588561 - DNA, 22 bp, Homo sapiens
tacaggaaccagattgttcagc

SEQ ID NO: 7588562 - DNA, 22 bp, Homo sapiens
tacaggaaagaaatttgaactc

SEQ ID NO: 7588563 - DNA, 22 bp, Homo sapiens
tacaggaaagaaatttgaactc

SEQ ID NO: 7588564 - DNA, 22 bp, Homo sapiens
tacaggaaagaaatttgaactc

SEQ ID NO: 7588565 - DNA, 18 bp, Homo sapiens
tacaggaaaagtgttaca

SEQ ID NO: 7588566 - DNA, 18 bp, Homo sapiens
tacaggaaaagtgttaca

SEQ ID NO: 7588567 - DNA, 18 bp, Homo sapiens
tacaggaaaagtgttaca

SEQ ID NO: 7588568 - DNA, 22 bp, Homo sapiens
tacactattttactgatacaaa

SEQ ID NO: 7588569 - DNA, 22 bp, Homo sapiens
tacactattttactgatacaaa

SEQ ID NO: 7588570 - DNA, 22 bp, Homo sapiens
tacactacacgaaggcattgca

SEQ ID NO: 7588571 - DNA, 22 bp, Homo sapiens
tacactatgggctttgtgtaat

SEQ ID NO: 7588572 - DNA, 22 bp, Homo sapiens
tacactatgggctttgtgtaat

SEQ ID NO: 7588573 - DNA, 22 bp, Homo sapiens
tacagcactgtgcatagtggtt

SEQ ID NO: 7588574 - DNA, 22 bp, Homo sapiens
tacagcactgtgcatagtggtt

SEQ ID NO: 7588575 - DNA, 22 bp, Homo sapiens
tacagcacttaattaccttgag

SEQ ID NO: 7588576 - DNA, 20 bp, Homo sapiens
tacagcagaaatgttttgct

SEQ ID NO: 7588577 - DNA, 20 bp, Homo sapiens
tacagcagaaatgttttgct

SEQ ID NO: 7588578 - DNA, 22 bp, Homo sapiens
tacagcactgtgcatagtggtt

SEQ ID NO: 7588579 - DNA, 22 bp, Homo sapiens
tacagcagactgaaggttgtgt

SEQ ID NO: 7588580 - DNA, 22 bp, Homo sapiens
tacagcagagtgggatgcatct

SEQ ID NO: 7588581 - DNA, 22 bp, Homo sapiens
tacagcagcatcgcagtgacct

SEQ ID NO: 7588582 - DNA, 22 bp, Homo sapiens
tacagcagagtgggatgcatct

SEQ ID NO: 7588583 - DNA, 22 bp, Homo sapiens
tacagcttaaaagatgcattta

SEQ ID NO: 7588584 - DNA, 22 bp, Homo sapiens
tacagcttatccagcttgatag

SEQ ID NO: 7588585 - DNA, 22 bp, Homo sapiens
tacagcagcccaccttcttctg

SEQ ID NO: 7588586 - DNA, 22 bp, Homo sapiens
tacagcttgatgtttgtgtgtt

SEQ ID NO: 7588587 - DNA, 22 bp, Homo sapiens
tacagctttagcaaattaccta

SEQ ID NO: 7588588 - DNA, 22 bp, Homo sapiens
tacagctttagcaaattaccta

SEQ ID NO: 7588589 - DNA, 22 bp, Homo sapiens
tacagctttatacccatcaaaa

SEQ ID NO: 7588590 - DNA, 22 bp, Homo sapiens
tacagctttatacccatcaaaa

SEQ ID NO: 7588591 - DNA, 22 bp, Homo sapiens
tacagctttgggaaggccccat

SEQ ID NO: 7588592 - DNA, 22 bp, Homo sapiens
tacagcttttcatatttgtgtt

SEQ ID NO: 7588593 - DNA, 22 bp, Homo sapiens
tacagcttcagtgtgccccagt

SEQ ID NO: 7588594 - DNA, 18 bp, Homo sapiens
tacagcttgagttgactg

SEQ ID NO: 7588595 - DNA, 22 bp, Homo sapiens
tacagcttgacccataatgtct

SEQ ID NO: 7588596 - DNA, 22 bp, Homo sapiens
tacagcttgatgagagcgcgag

SEQ ID NO: 7588597 - DNA, 22 bp, Homo sapiens
tacagcttcagtgtgccccagt

SEQ ID NO: 7588598 - DNA, 22 bp, Homo sapiens
tacagcttcagtgtgccccagt

SEQ ID NO: 7588599 - DNA, 22 bp, Homo sapiens
tacagcttgacccataatgtct

SEQ ID NO: 7588600 - DNA, 22 bp, Homo sapiens
tagaggcaccctggaggagact

SEQ ID NO: 7588601 - DNA, 22 bp, Homo sapiens
tagaggcagaagaaattgacaa

SEQ ID NO: 7588602 - DNA, 22 bp, Homo sapiens
tagaggcagaagaaattgacaa

SEQ ID NO: 7588603 - DNA, 22 bp, Homo sapiens
tagaggcaccctggaggagact

SEQ ID NO: 7588604 - DNA, 22 bp, Homo sapiens
tagaggcaccctggaggagact

SEQ ID NO: 7588605 - DNA, 22 bp, Homo sapiens
tagatgataaccataggtctat

SEQ ID NO: 7588606 - DNA, 22 bp, Homo sapiens
tagatgatagggccagaatttg

SEQ ID NO: 7588607 - DNA, 22 bp, Homo sapiens
tagatgatggaaaaaagcaata

SEQ ID NO: 7588608 - DNA, 22 bp, Homo sapiens
tagatgcatagagcacagcaca

SEQ ID NO: 7588609 - DNA, 22 bp, Homo sapiens
tagatgatttatgactatacct

SEQ ID NO: 7588610 - DNA, 22 bp, Homo sapiens
tagatgattttcagtcaaagca

SEQ ID NO: 7588611 - DNA, 22 bp, Homo sapiens
tagatgattttcagtcaaagca

SEQ ID NO: 7588612 - DNA, 22 bp, Homo sapiens
tagatgatagggccagaatttg

SEQ ID NO: 7588613 - DNA, 22 bp, Homo sapiens
tagatgatggaaaaaagcaata

SEQ ID NO: 7588614 - DNA, 22 bp, Homo sapiens
tagatgatggtaaaaagaagtt

SEQ ID NO: 7588615 - DNA, 22 bp, Homo sapiens
tagatgctgtagaaatacttat

SEQ ID NO: 7588616 - DNA, 22 bp, Homo sapiens
tagatgctgaaacatggaggcg

SEQ ID NO: 7588617 - DNA, 22 bp, Homo sapiens
tagatgctcatgagtcagccag

SEQ ID NO: 7588618 - DNA, 22 bp, Homo sapiens
tagatggacgtcaagtctactc

SEQ ID NO: 7588619 - DNA, 22 bp, Homo sapiens
tagatggaggctagatgcaggg

SEQ ID NO: 7588620 - DNA, 22 bp, Homo sapiens
tagatggaggctagatgcaggg

SEQ ID NO: 7588621 - DNA, 22 bp, Homo sapiens
tagatgcttgcagacagaatga

SEQ ID NO: 7588622 - DNA, 22 bp, Homo sapiens
tagaggcacagtctatgtagag

SEQ ID NO: 7588623 - DNA, 22 bp, Homo sapiens
tagaggcaaccagtgttgagaa

SEQ ID NO: 7588624 - DNA, 22 bp, Homo sapiens
tagaggcaccctggaggagact

SEQ ID NO: 7588625 - DNA, 22 bp, Homo sapiens
tagaggcaccctggaggagact

SEQ ID NO: 7588626 - DNA, 22 bp, Homo sapiens
tagaggcacagtctatgtagag

SEQ ID NO: 7588627 - DNA, 22 bp, Homo sapiens
tagaggcaaccagtgttgagaa

SEQ ID NO: 7588628 - DNA, 22 bp, Homo sapiens
tagaggattttgcatttcatat

SEQ ID NO: 7588629 - DNA, 22 bp, Homo sapiens
tagaggatgcaggattgtttgt

SEQ ID NO: 7588630 - DNA, 22 bp, Homo sapiens
tagaggcaaccagtgttgagaa

SEQ ID NO: 7588631 - DNA, 22 bp, Homo sapiens
tagaggagggctgttcttcagt

SEQ ID NO: 7588632 - DNA, 22 bp, Homo sapiens
tagaggaggcaaggccctccct

SEQ ID NO: 7588633 - DNA, 22 bp, Homo sapiens
tagaggagggctgttcttcagt

SEQ ID NO: 7588634 - DNA, 22 bp, Homo sapiens
tagaggagggctgttcttcagt

SEQ ID NO: 7588635 - DNA, 22 bp, Homo sapiens
tagaggagggctgttcttcagt

SEQ ID NO: 7588636 - DNA, 22 bp, Homo sapiens
tagaggaggtgattcttgagct

SEQ ID NO: 7588637 - DNA, 22 bp, Homo sapiens
tagaggaggtgattcttgagct

SEQ ID NO: 7588638 - DNA, 22 bp, Homo sapiens
tagaggagagttgctggatgga

SEQ ID NO: 7588639 - DNA, 22 bp, Homo sapiens
tagaggagagttgctggatgga

SEQ ID NO: 7588640 - DNA, 22 bp, Homo sapiens
tagaggagagttgctggatgga

SEQ ID NO: 7588641 - DNA, 22 bp, Homo sapiens
tagaggagagttgctggatgga

SEQ ID NO: 7588642 - DNA, 22 bp, Homo sapiens
tagagctgataatgaggccaag

SEQ ID NO: 7588643 - DNA, 22 bp, Homo sapiens
tagaggagcggcgagctgagct

SEQ ID NO: 7588644 - DNA, 23 bp, Homo sapiens
tagaggaggatgtgatgcatatt

SEQ ID NO: 7588645 - DNA, 22 bp, Homo sapiens
tagaggagcggcgagctgagct

SEQ ID NO: 7588646 - DNA, 22 bp, Homo sapiens
tagaggagcggcgagctgagct

SEQ ID NO: 7588647 - DNA, 22 bp, Homo sapiens
tagaggagcggcgagctgagct

SEQ ID NO: 7588648 - DNA, 22 bp, Homo sapiens
tagagatgccctagctgaagta

SEQ ID NO: 7588649 - DNA, 22 bp, Homo sapiens
tagagatgccctagctgaagta

SEQ ID NO: 7588650 - DNA, 22 bp, Homo sapiens
tagagatgaattctgcagtctt

SEQ ID NO: 7588651 - DNA, 21 bp, Homo sapiens
tagagatgacgagctctagca

SEQ ID NO: 7588652 - DNA, 21 bp, Homo sapiens
tagagatgacgagctctagca

SEQ ID NO: 7588653 - DNA, 22 bp, Homo sapiens
tagagagtcgggaacttacctg

SEQ ID NO: 7588654 - DNA, 22 bp, Homo sapiens
tagaatctgtgttcaaacctac

SEQ ID NO: 7588655 - DNA, 22 bp, Homo sapiens
tagaatctgtgttcaaacctac

SEQ ID NO: 7588656 - DNA, 22 bp, Homo sapiens
tagagaggtttgaattggctgc

SEQ ID NO: 7588657 - DNA, 18 bp, Homo sapiens
tagaatctgttattgcct

SEQ ID NO: 7588658 - DNA, 22 bp, Homo sapiens
tagagatgaattctgcagtctt

SEQ ID NO: 7588659 - DNA, 22 bp, Homo sapiens
tagaatctgcctgcagcaaaga

SEQ ID NO: 7588660 - DNA, 22 bp, Homo sapiens
tagaatctggaaggggctattc

SEQ ID NO: 7588661 - DNA, 22 bp, Homo sapiens
tagaatctgaatgtagagctga

SEQ ID NO: 7588662 - DNA, 22 bp, Homo sapiens
tagaatctgatggcccgtctgg

SEQ ID NO: 7588663 - DNA, 22 bp, Homo sapiens
tagaatctgattaccctatgaa

SEQ ID NO: 7588664 - DNA, 22 bp, Homo sapiens
tagaatctggatctgggcgcat

SEQ ID NO: 7588665 - DNA, 22 bp, Homo sapiens
tagaatctccagcattggttgt

SEQ ID NO: 7588666 - DNA, 22 bp, Homo sapiens
tagaatctggaaggggctattc

SEQ ID NO: 7588667 - DNA, 23 bp, Homo sapiens
tagaatctgtatttctgcagttc

SEQ ID NO: 7588668 - DNA, 20 bp, Homo sapiens
tagaatctggtgatgtatcg

SEQ ID NO: 7588669 - DNA, 23 bp, Homo sapiens
tagaatctgtatttctgcagttc

SEQ ID NO: 7588670 - DNA, 22 bp, Homo sapiens
tagagatgtgatatagcagagt

SEQ ID NO: 7588671 - DNA, 22 bp, Homo sapiens
tagagatggggtcttgctatga

SEQ ID NO: 7588672 - DNA, 22 bp, Homo sapiens
tagagatggggtcttgctatga

SEQ ID NO: 7588673 - DNA, 22 bp, Homo sapiens
tagagcaatgctctactccttg

SEQ ID NO: 7588674 - DNA, 21 bp, Homo sapiens
tagagatgtttgctaagtagc

SEQ ID NO: 7588675 - DNA, 22 bp, Homo sapiens
tagagatgaattctgcagtctt

SEQ ID NO: 7588676 - DNA, 21 bp, Homo sapiens
tagagatgtttgctaagtagc

SEQ ID NO: 7588677 - DNA, 22 bp, Homo sapiens
tagagcacagtttcagggtgta

SEQ ID NO: 7588678 - DNA, 22 bp, Homo sapiens
tagagcaatgctctactccttg

SEQ ID NO: 7588679 - DNA, 22 bp, Homo sapiens
tagagcaatgctctactccttg

SEQ ID NO: 7588680 - DNA, 22 bp, Homo sapiens
tagagcagaacttgttaacacc

SEQ ID NO: 7588681 - DNA, 22 bp, Homo sapiens
tagagcagaacttgttaacacc

SEQ ID NO: 7588682 - DNA, 22 bp, Homo sapiens
tagagcagaacttgttaacacc

SEQ ID NO: 7588683 - DNA, 22 bp, Homo sapiens
tagagcagatagtgaaacagaa

SEQ ID NO: 7588684 - DNA, 22 bp, Homo sapiens
tagagcagccttcagagcagtt

SEQ ID NO: 7588685 - DNA, 22 bp, Homo sapiens
tagagcagccttcagagcagtt

SEQ ID NO: 7588686 - DNA, 23 bp, Homo sapiens
tagagcagccccgaggtgctgtc

SEQ ID NO: 7588687 - DNA, 23 bp, Homo sapiens
tagagcagccccgaggtgctgtc

SEQ ID NO: 7588688 - DNA, 22 bp, Homo sapiens
tagagcagccttcagagcagtt

SEQ ID NO: 7588689 - DNA, 23 bp, Homo sapiens
tagagcagggaaatctgtcagag

SEQ ID NO: 7588690 - DNA, 23 bp, Homo sapiens
tagagcagggaaatctgtcagag

SEQ ID NO: 7588691 - DNA, 22 bp, Homo sapiens
tagagctctccttcctctgtgg

SEQ ID NO: 7588692 - DNA, 22 bp, Homo sapiens
tagagctgagttgactccattt

SEQ ID NO: 7588693 - DNA, 22 bp, Homo sapiens
tagagctatttagagcatttta

SEQ ID NO: 7588694 - DNA, 22 bp, Homo sapiens
tagagctatttatcagccagaa

SEQ ID NO: 7588695 - DNA, 22 bp, Homo sapiens
tagagctcattttaagcagaca

SEQ ID NO: 7588696 - DNA, 22 bp, Homo sapiens
tagagctgataatgaggccaag

SEQ ID NO: 7588697 - DNA, 22 bp, Homo sapiens
tagagctgataatgaggccaag

SEQ ID NO: 7588698 - DNA, 22 bp, Homo sapiens
tagagctgataatgaggccaag

SEQ ID NO: 7588699 - DNA, 22 bp, Homo sapiens
tagagcatttagaggggcagga

SEQ ID NO: 7588700 - DNA, 22 bp, Homo sapiens
tagagcatttagaggggcagga

SEQ ID NO: 7588701 - DNA, 21 bp, Homo sapiens
tagagccagtggtgttctgac

SEQ ID NO: 7588702 - DNA, 22 bp, Homo sapiens
tagagcccaatacatttggttg

SEQ ID NO: 7588703 - DNA, 17 bp, Homo sapiens
tagagcccacccgctgg

SEQ ID NO: 7588704 - DNA, 22 bp, Homo sapiens
tagagctatacactgagtaaaa

SEQ ID NO: 7588705 - DNA, 22 bp, Homo sapiens
tagagctagcttcaaaatgcga

SEQ ID NO: 7588706 - DNA, 22 bp, Homo sapiens
tagagctagcttcaaaatgcga

SEQ ID NO: 7588707 - DNA, 22 bp, Homo sapiens
tagagccctcttcactaaagga

SEQ ID NO: 7588708 - DNA, 22 bp, Homo sapiens
tagagctagcttcaaaatgcga

SEQ ID NO: 7588709 - DNA, 22 bp, Homo sapiens
tagagcccatgtacccgctatt

SEQ ID NO: 7588710 - DNA, 22 bp, Homo sapiens
tagagccctctggccacgttgc

SEQ ID NO: 7588711 - DNA, 22 bp, Homo sapiens
tagagctactggcagcctcttc

SEQ ID NO: 7588712 - DNA, 22 bp, Homo sapiens
tagagcagttggcagctgtatt

SEQ ID NO: 7588713 - DNA, 22 bp, Homo sapiens
tagagcagttggcagctgtatt

SEQ ID NO: 7588714 - DNA, 22 bp, Homo sapiens
tagagcagttggcagctgtatt

SEQ ID NO: 7588715 - DNA, 22 bp, Homo sapiens
tagagcagttggcagctgtatt

SEQ ID NO: 7588716 - DNA, 22 bp, Homo sapiens
tagagcattagaaattagtgta

SEQ ID NO: 7588717 - DNA, 23 bp, Homo sapiens
tagagcagtagatcaccatggga

SEQ ID NO: 7588718 - DNA, 23 bp, Homo sapiens
tagagcagtagatcaccatggga

SEQ ID NO: 7588719 - DNA, 22 bp, Homo sapiens
tagagcagtgggtaccatggca

SEQ ID NO: 7588720 - DNA, 22 bp, Homo sapiens
tagagcagtgggtaccatggca

SEQ ID NO: 7588721 - DNA, 23 bp, Homo sapiens
tagagcagggaaatctgtcagag

SEQ ID NO: 7588722 - DNA, 23 bp, Homo sapiens
tagagcagtagatcaccatggga

SEQ ID NO: 7588723 - DNA, 23 bp, Homo sapiens
tagagcagtagatcaccatggga

SEQ ID NO: 7588724 - DNA, 22 bp, Homo sapiens
tagagcagtgggtaccatggca

SEQ ID NO: 7588725 - DNA, 22 bp, Homo sapiens
tagagcagtgggtaccatggca

SEQ ID NO: 7588726 - DNA, 22 bp, Homo sapiens
tagagcagtgttgtccatcaga

SEQ ID NO: 7588727 - DNA, 22 bp, Homo sapiens
tagagcagtgttgtccatcaga

SEQ ID NO: 7588728 - DNA, 22 bp, Homo sapiens
tactttctttctgatccttatg

SEQ ID NO: 7588729 - DNA, 22 bp, Homo sapiens
tactttctttcccaagaggtgg

SEQ ID NO: 7588730 - DNA, 22 bp, Homo sapiens
tactttctttctgatccttatg

SEQ ID NO: 7588731 - DNA, 22 bp, Homo sapiens
tactttctttctgatccttatg

SEQ ID NO: 7588732 - DNA, 22 bp, Homo sapiens
tactttctttctgatccttatg

SEQ ID NO: 7588733 - DNA, 19 bp, Homo sapiens
tagaagcactaggcaaact

SEQ ID NO: 7588734 - DNA, 19 bp, Homo sapiens
tagaagcactaggcaaact

SEQ ID NO: 7588735 - DNA, 19 bp, Homo sapiens
tagaagcactaggcaaact

SEQ ID NO: 7588736 - DNA, 22 bp, Homo sapiens
tactttgaagacaatatctgga

SEQ ID NO: 7588737 - DNA, 22 bp, Homo sapiens
tagaagcaccactcatcacgtg

SEQ ID NO: 7588738 - DNA, 22 bp, Homo sapiens
tagaagcaccactcatcacgtg

SEQ ID NO: 7588739 - DNA, 22 bp, Homo sapiens
tagaagcaccactcatcacgtg

SEQ ID NO: 7588740 - DNA, 22 bp, Homo sapiens
tactttcttgttcctttcataa

SEQ ID NO: 7588741 - DNA, 22 bp, Homo sapiens
tactttcttgttcctttcataa

SEQ ID NO: 7588742 - DNA, 22 bp, Homo sapiens
tactttcttgttcctttcataa

SEQ ID NO: 7588743 - DNA, 22 bp, Homo sapiens
tactttctgtccttctgttaaa

SEQ ID NO: 7588744 - DNA, 22 bp, Homo sapiens
tactttctgtccttctgttaaa

SEQ ID NO: 7588745 - DNA, 22 bp, Homo sapiens
tactttctttcccaagaggtgg

SEQ ID NO: 7588746 - DNA, 22 bp, Homo sapiens
tactttctttcccaagaggtgg

SEQ ID NO: 7588747 - DNA, 22 bp, Homo sapiens
tactttctttcccaagaggtgg

SEQ ID NO: 7588748 - DNA, 22 bp, Homo sapiens
tactttcttgttcctttcataa

SEQ ID NO: 7588749 - DNA, 22 bp, Homo sapiens
tactttcttgttcctttcataa

SEQ ID NO: 7588750 - DNA, 22 bp, Homo sapiens
tactttcttgttcctttcataa

SEQ ID NO: 7588751 - DNA, 22 bp, Homo sapiens
tactttcttgttcctttcataa

SEQ ID NO: 7588752 - DNA, 22 bp, Homo sapiens
tagaagcagcaggagtaaaggc

SEQ ID NO: 7588753 - DNA, 22 bp, Homo sapiens
tagaagcagcaggagtaaaggc

SEQ ID NO: 7588754 - DNA, 22 bp, Homo sapiens
tagaagcagcaggagtaaaggc

SEQ ID NO: 7588755 - DNA, 22 bp, Homo sapiens
tagaagcagcaggactcatggt

SEQ ID NO: 7588756 - DNA, 22 bp, Homo sapiens
tagaagcagtaatagaaatagg

SEQ ID NO: 7588757 - DNA, 22 bp, Homo sapiens
tagaagcagtaatagaaatagg

SEQ ID NO: 7588758 - DNA, 22 bp, Homo sapiens
tagaagcagtaatagaaatagg

SEQ ID NO: 7588759 - DNA, 19 bp, Homo sapiens
tagaagcagggaagctgag

SEQ ID NO: 7588760 - DNA, 19 bp, Homo sapiens
tagaagcagggaagctgag

SEQ ID NO: 7588761 - DNA, 22 bp, Homo sapiens
tagaagcagcaggagtaaaggc

SEQ ID NO: 7588762 - DNA, 19 bp, Homo sapiens
tagaagcagggaagctgag

SEQ ID NO: 7588763 - DNA, 19 bp, Homo sapiens
tagaagcactaggcaaact

SEQ ID NO: 7588764 - DNA, 19 bp, Homo sapiens
tagaagcactaggcaaact

SEQ ID NO: 7588765 - DNA, 19 bp, Homo sapiens
tagaagcactaggcaaact

SEQ ID NO: 7588766 - DNA, 22 bp, Homo sapiens
tagaagcactgacagagtttga

SEQ ID NO: 7588767 - DNA, 22 bp, Homo sapiens
tagaagcactgacagagtttga

SEQ ID NO: 7588768 - DNA, 22 bp, Homo sapiens
tagaagcactgacagagtttga

SEQ ID NO: 7588769 - DNA, 22 bp, Homo sapiens
tagaagcagaaggaaggtggct

SEQ ID NO: 7588770 - DNA, 22 bp, Homo sapiens
tagaagcagaaggaaggtggct

SEQ ID NO: 7588771 - DNA, 22 bp, Homo sapiens
tagaagcagcaggactcatggt

SEQ ID NO: 7588772 - DNA, 22 bp, Homo sapiens
tagaagcagaaggaaggtggct

SEQ ID NO: 7588773 - DNA, 22 bp, Homo sapiens
tactttctaagacatacaactt

SEQ ID NO: 7588774 - DNA, 22 bp, Homo sapiens
tactttctagctctccccagtt

SEQ ID NO: 7588775 - DNA, 22 bp, Homo sapiens
tactttctaagacatacaactt

SEQ ID NO: 7588776 - DNA, 22 bp, Homo sapiens
tactttctgtccttctgttaaa

SEQ ID NO: 7588777 - DNA, 22 bp, Homo sapiens
tactttctgtccttctgttaaa

SEQ ID NO: 7588778 - DNA, 22 bp, Homo sapiens
tactttctgtccttctgttaaa

SEQ ID NO: 7588779 - DNA, 22 bp, Homo sapiens
tactttctgtccttctgttaaa

SEQ ID NO: 7588780 - DNA, 22 bp, Homo sapiens
tactttctgtccttctgttaaa

SEQ ID NO: 7588781 - DNA, 22 bp, Homo sapiens
tactttccctcatcaacaatca

SEQ ID NO: 7588782 - DNA, 22 bp, Homo sapiens
tactttctaagacatacaactt

SEQ ID NO: 7588783 - DNA, 22 bp, Homo sapiens
tactttcatgtctatacatatt

SEQ ID NO: 7588784 - DNA, 22 bp, Homo sapiens
tactttcatgtctatacatatt

SEQ ID NO: 7588785 - DNA, 22 bp, Homo sapiens
tactttcatgtctatacatatt

SEQ ID NO: 7588786 - DNA, 22 bp, Homo sapiens
tactttcatgtctatacatatt

SEQ ID NO: 7588787 - DNA, 22 bp, Homo sapiens
tactttcatgtctatacatatt

SEQ ID NO: 7588788 - DNA, 22 bp, Homo sapiens
tactttcatgtctatacatatt

SEQ ID NO: 7588789 - DNA, 22 bp, Homo sapiens
tactttcatgggttttctttat

SEQ ID NO: 7588790 - DNA, 22 bp, Homo sapiens
tactttcatgggttttctttat

SEQ ID NO: 7588791 - DNA, 22 bp, Homo sapiens
tactttcatgggttttctttat

SEQ ID NO: 7588792 - DNA, 22 bp, Homo sapiens
tactttcatgggttttctttat

SEQ ID NO: 7588793 - DNA, 22 bp, Homo sapiens
tactttcagtttcagctgaagt

SEQ ID NO: 7588794 - DNA, 22 bp, Homo sapiens
tactttattgtaaatgctgatg

SEQ ID NO: 7588795 - DNA, 22 bp, Homo sapiens
tacttgtctcttctgacaaagt

SEQ ID NO: 7588796 - DNA, 22 bp, Homo sapiens
tacttgtgttctactagagaaa

SEQ ID NO: 7588797 - DNA, 22 bp, Homo sapiens
tacttgtagcaggtggcattta

SEQ ID NO: 7588798 - DNA, 22 bp, Homo sapiens
tacttggattaataatttgttt

SEQ ID NO: 7588799 - DNA, 22 bp, Homo sapiens
tacttggtaaatgcttatggaa

SEQ ID NO: 7588800 - DNA, 22 bp, Homo sapiens
tacttgctgttagtattttaca

SEQ ID NO: 7588801 - DNA, 22 bp, Homo sapiens
tacttggagttcataatctggt

SEQ ID NO: 7588802 - DNA, 22 bp, Homo sapiens
tacttggattaataatttgttt

SEQ ID NO: 7588803 - DNA, 22 bp, Homo sapiens
tacttgctgggtgtaattttct

SEQ ID NO: 7588804 - DNA, 22 bp, Homo sapiens
tacttgctgggtgtaattttct

SEQ ID NO: 7588805 - DNA, 22 bp, Homo sapiens
tacttgcttggatttcaccaga

SEQ ID NO: 7588806 - DNA, 22 bp, Homo sapiens
tacttgctgttagtattttaca

SEQ ID NO: 7588807 - DNA, 22 bp, Homo sapiens
tagaataagttgatgatatatg

SEQ ID NO: 7588808 - DNA, 22 bp, Homo sapiens
tagaataagttgatgatatatg

SEQ ID NO: 7588809 - DNA, 22 bp, Homo sapiens
tagaataagttgatgatatatg

SEQ ID NO: 7588810 - DNA, 22 bp, Homo sapiens
tagaataagttgatgatatatg

SEQ ID NO: 7588811 - DNA, 22 bp, Homo sapiens
tagaatcagaagatttgactgt

SEQ ID NO: 7588812 - DNA, 22 bp, Homo sapiens
tagaatcagaagatttgactgt

SEQ ID NO: 7588813 - DNA, 22 bp, Homo sapiens
tagaataagttgatgatatatg

SEQ ID NO: 7588814 - DNA, 22 bp, Homo sapiens
tagaatcagaagatttgactgt

SEQ ID NO: 7588815 - DNA, 22 bp, Homo sapiens
tagaagtttcaaaagacttcat

SEQ ID NO: 7588816 - DNA, 22 bp, Homo sapiens
tagaagtttcaaaagacttcat

SEQ ID NO: 7588817 - DNA, 22 bp, Homo sapiens
tagaagttgctcaataaatgtt

SEQ ID NO: 7588818 - DNA, 22 bp, Homo sapiens
tagaagtttaaattcaccatgc

SEQ ID NO: 7588819 - DNA, 22 bp, Homo sapiens
tagaagttgctcaataaatgtt

SEQ ID NO: 7588820 - DNA, 22 bp, Homo sapiens
tagaagttgctcaataaatgtt

SEQ ID NO: 7588821 - DNA, 22 bp, Homo sapiens
tagaagttgctcaataaatgtt

SEQ ID NO: 7588822 - DNA, 22 bp, Homo sapiens
tagaataagttgatgatatatg

SEQ ID NO: 7588823 - DNA, 22 bp, Homo sapiens
tagaataagttgatgatatatg

SEQ ID NO: 7588824 - DNA, 22 bp, Homo sapiens
tagaataagttgatgatatatg

SEQ ID NO: 7588825 - DNA, 22 bp, Homo sapiens
tagaatcatacctctaggaaca

SEQ ID NO: 7588826 - DNA, 22 bp, Homo sapiens
tagaatcatacctctaggaaca

SEQ ID NO: 7588827 - DNA, 22 bp, Homo sapiens
tagaatcattgagaataacagg

SEQ ID NO: 7588828 - DNA, 22 bp, Homo sapiens
tagaatcattgagaataacagg

SEQ ID NO: 7588829 - DNA, 22 bp, Homo sapiens
tagaatccaagaaggtgagcaa

SEQ ID NO: 7588830 - DNA, 22 bp, Homo sapiens
tagaatcattgagaataacagg

SEQ ID NO: 7588831 - DNA, 22 bp, Homo sapiens
tagaatcccagccagctggaag

SEQ ID NO: 7588832 - DNA, 22 bp, Homo sapiens
tagaatcattgagaataacagg

SEQ ID NO: 7588833 - DNA, 23 bp, Homo sapiens
tagaatcctctgagatggaatag

SEQ ID NO: 7588834 - DNA, 21 bp, Homo sapiens
tagaatcctggactgggactc

SEQ ID NO: 7588835 - DNA, 20 bp, Homo sapiens
tagaatctactatttggccc

SEQ ID NO: 7588836 - DNA, 22 bp, Homo sapiens
tagaatctagttcattcatttg

SEQ ID NO: 7588837 - DNA, 22 bp, Homo sapiens
tagaatctagttcattcatttg

SEQ ID NO: 7588838 - DNA, 22 bp, Homo sapiens
tagaatctgaaagtggctgtga

SEQ ID NO: 7588839 - DNA, 22 bp, Homo sapiens
tagaatctgaatattcttattt

SEQ ID NO: 7588840 - DNA, 22 bp, Homo sapiens
tagaatctgaatattcttattt

SEQ ID NO: 7588841 - DNA, 22 bp, Homo sapiens
tagaagttatgataataatagt

SEQ ID NO: 7588842 - DNA, 22 bp, Homo sapiens
tagaagttaggaaataggaata

SEQ ID NO: 7588843 - DNA, 22 bp, Homo sapiens
tagaagttatgataataatagt

SEQ ID NO: 7588844 - DNA, 22 bp, Homo sapiens
tagaagttcatgcgaattattt

SEQ ID NO: 7588845 - DNA, 22 bp, Homo sapiens
tagaagttcatgcgaattattt

SEQ ID NO: 7588846 - DNA, 22 bp, Homo sapiens
tagaagttgaactaaaaatatt

SEQ ID NO: 7588847 - DNA, 22 bp, Homo sapiens
tagaagttgaactaaaaatatt

SEQ ID NO: 7588848 - DNA, 22 bp, Homo sapiens
tagaagttcatgcgaattattt

SEQ ID NO: 7588849 - DNA, 22 bp, Homo sapiens
tagaagttcatgcgaattattt

SEQ ID NO: 7588850 - DNA, 18 bp, Homo sapiens
tagaagtgtgctatacaa

SEQ ID NO: 7588851 - DNA, 18 bp, Homo sapiens
tagaagtgtgctatacaa

SEQ ID NO: 7588852 - DNA, 22 bp, Homo sapiens
tagaagtgggaatataaaatat

SEQ ID NO: 7588853 - DNA, 22 bp, Homo sapiens
tagaagtgtctgtgaaatatac

SEQ ID NO: 7588854 - DNA, 22 bp, Homo sapiens
tagaagtgtctgtgaaatatac

SEQ ID NO: 7588855 - DNA, 22 bp, Homo sapiens
tagaagtggcaacactcagaaa

SEQ ID NO: 7588856 - DNA, 22 bp, Homo sapiens
tagaagttaggaaataggaata

SEQ ID NO: 7588857 - DNA, 22 bp, Homo sapiens
tagaagttaggaaataggaata

SEQ ID NO: 7588858 - DNA, 22 bp, Homo sapiens
tagaagttaggaaataggaata

SEQ ID NO: 7588859 - DNA, 22 bp, Homo sapiens
tagaagttaaaggaatacagaa

SEQ ID NO: 7588860 - DNA, 22 bp, Homo sapiens
tagaagttaaaggaatacagaa

SEQ ID NO: 7588861 - DNA, 17 bp, Homo sapiens
tagaagttagaacactt

SEQ ID NO: 7588862 - DNA, 22 bp, Homo sapiens
tagaagctcaggaataggcata

SEQ ID NO: 7588863 - DNA, 22 bp, Homo sapiens
tagaagcagtaatagaaatagg

SEQ ID NO: 7588864 - DNA, 22 bp, Homo sapiens
tagaagctcaggaataggcata

SEQ ID NO: 7588865 - DNA, 22 bp, Homo sapiens
tagaaggaggactggcagtgtt

SEQ ID NO: 7588866 - DNA, 22 bp, Homo sapiens
tagaaggaggactggcagtgtt

SEQ ID NO: 7588867 - DNA, 22 bp, Homo sapiens
tagaaggaggactggcagtgtt

SEQ ID NO: 7588868 - DNA, 22 bp, Homo sapiens
tagaaggaggactggcagtgtt

SEQ ID NO: 7588869 - DNA, 22 bp, Homo sapiens
tagaaggaggactggcagtgtt

SEQ ID NO: 7588870 - DNA, 22 bp, Homo sapiens
tagaaggcaagcttggtacagg

SEQ ID NO: 7588871 - DNA, 22 bp, Homo sapiens
tagaaggcaagcttggtacagg

SEQ ID NO: 7588872 - DNA, 22 bp, Homo sapiens
tagaaggcaggtggttggagtt

SEQ ID NO: 7588873 - DNA, 22 bp, Homo sapiens
tagaaggcaggtggttggagtt

SEQ ID NO: 7588874 - DNA, 22 bp, Homo sapiens
tagaaggcccattcatttgttc

SEQ ID NO: 7588875 - DNA, 22 bp, Homo sapiens
tagaaggcatttcctttatttt

SEQ ID NO: 7588876 - DNA, 22 bp, Homo sapiens
tagaaggcggactctccctctg

SEQ ID NO: 7588877 - DNA, 22 bp, Homo sapiens
tagaaggtaatgaaatgctgat

SEQ ID NO: 7588878 - DNA, 22 bp, Homo sapiens
tagaagtctctcaagaaacata

SEQ ID NO: 7588879 - DNA, 22 bp, Homo sapiens
tagaagtgaaagacttgatgtc

SEQ ID NO: 7588880 - DNA, 22 bp, Homo sapiens
tagaagtgaaagacttgatgtc

SEQ ID NO: 7588881 - DNA, 22 bp, Homo sapiens
tagaagtggcaacactcagaaa

SEQ ID NO: 7588882 - DNA, 22 bp, Homo sapiens
tagaagtggattgaagtttgga

SEQ ID NO: 7588883 - DNA, 22 bp, Homo sapiens
tagccaggcaattatgggtgat

SEQ ID NO: 7588884 - DNA, 22 bp, Homo sapiens
tagccaggcaattatgggtgat

SEQ ID NO: 7588885 - DNA, 22 bp, Homo sapiens
tagccaggcaattatgggtgat

SEQ ID NO: 7588886 - DNA, 23 bp, Homo sapiens
tagccaggcccagcatggacacc

SEQ ID NO: 7588887 - DNA, 22 bp, Homo sapiens
tagccaggcaattatgggtgat

SEQ ID NO: 7588888 - DNA, 22 bp, Homo sapiens
tagccagctggataatgtgggg

SEQ ID NO: 7588889 - DNA, 22 bp, Homo sapiens
tagccactattcctgagctaga

SEQ ID NO: 7588890 - DNA, 22 bp, Homo sapiens
tagccactacctataccataag

SEQ ID NO: 7588891 - DNA, 22 bp, Homo sapiens
tagccactacctataccataag

SEQ ID NO: 7588892 - DNA, 22 bp, Homo sapiens
tagccactattcctgagctaga

SEQ ID NO: 7588893 - DNA, 22 bp, Homo sapiens
tagccactattcctgagctaga

SEQ ID NO: 7588894 - DNA, 22 bp, Homo sapiens
tagccactcccttaaggaggtt

SEQ ID NO: 7588895 - DNA, 22 bp, Homo sapiens
tagccactcccttaaggaggtt

SEQ ID NO: 7588896 - DNA, 22 bp, Homo sapiens
tagccagctgaatgcactacag

SEQ ID NO: 7588897 - DNA, 22 bp, Homo sapiens
tagccaggcctttgatcccggc

SEQ ID NO: 7588898 - DNA, 23 bp, Homo sapiens
tagccaggcccagcatggacacc

SEQ ID NO: 7588899 - DNA, 22 bp, Homo sapiens
tagccaggcgaggtcagtgtcg

SEQ ID NO: 7588900 - DNA, 22 bp, Homo sapiens
tagccaggcgaggtcagtgtcg

SEQ ID NO: 7588901 - DNA, 22 bp, Homo sapiens
tagccaggcctttgatcccggc

SEQ ID NO: 7588902 - DNA, 22 bp, Homo sapiens
tagccaggcgaggtcagtgtcg

SEQ ID NO: 7588903 - DNA, 22 bp, Homo sapiens
tagccaggctgcagctgatccg

SEQ ID NO: 7588904 - DNA, 22 bp, Homo sapiens
tagccaggctgcagctgatccg

SEQ ID NO: 7588905 - DNA, 22 bp, Homo sapiens
tagccaggctggaagcaaaagg

SEQ ID NO: 7588906 - DNA, 22 bp, Homo sapiens
tagccaggctggaagcaaaagg

SEQ ID NO: 7588907 - DNA, 22 bp, Homo sapiens
tagccaggtcacactgtgtgtt

SEQ ID NO: 7588908 - DNA, 22 bp, Homo sapiens
tagccagggagacactgtggag

SEQ ID NO: 7588909 - DNA, 22 bp, Homo sapiens
tagccaggtcacactgtgtgtt

SEQ ID NO: 7588910 - DNA, 22 bp, Homo sapiens
tagccagtgaatgtttccagtg

SEQ ID NO: 7588911 - DNA, 22 bp, Homo sapiens
tagccagtgagacccagaaata

SEQ ID NO: 7588912 - DNA, 22 bp, Homo sapiens
tagccatgtgtggaacacagcc

SEQ ID NO: 7588913 - DNA, 22 bp, Homo sapiens
tagccatgagcagatcactata

SEQ ID NO: 7588914 - DNA, 22 bp, Homo sapiens
tagccagggagacactgtggag

SEQ ID NO: 7588915 - DNA, 22 bp, Homo sapiens
tagccagtttctttaacagcaa

SEQ ID NO: 7588916 - DNA, 22 bp, Homo sapiens
tagccactacctataccataag

SEQ ID NO: 7588917 - DNA, 22 bp, Homo sapiens
tagccacatgcagactttcatg

SEQ ID NO: 7588918 - DNA, 22 bp, Homo sapiens
tagccacatgcagactttcatg

SEQ ID NO: 7588919 - DNA, 22 bp, Homo sapiens
tagccaaagaaggtatatttgt

SEQ ID NO: 7588920 - DNA, 22 bp, Homo sapiens
tagccaaagaaggtatatttgt

SEQ ID NO: 7588921 - DNA, 22 bp, Homo sapiens
tagcattttagctgttttctct

SEQ ID NO: 7588922 - DNA, 22 bp, Homo sapiens
tagcattttagctgttttctct

SEQ ID NO: 7588923 - DNA, 21 bp, Homo sapiens
tagcatttttgtattgctgaa

SEQ ID NO: 7588924 - DNA, 21 bp, Homo sapiens
tagcatttttgtattgctgaa

SEQ ID NO: 7588925 - DNA, 21 bp, Homo sapiens
tagcatttttgtattgctgaa

SEQ ID NO: 7588926 - DNA, 22 bp, Homo sapiens
tagcatttggcaccagttattt

SEQ ID NO: 7588927 - DNA, 22 bp, Homo sapiens
tagcatttggcaccagttattt

SEQ ID NO: 7588928 - DNA, 22 bp, Homo sapiens
tagcatttggcaccagttattt

SEQ ID NO: 7588929 - DNA, 22 bp, Homo sapiens
tagcatttggcaccagttattt

SEQ ID NO: 7588930 - DNA, 22 bp, Homo sapiens
tagcatttggacattgtcacct

SEQ ID NO: 7588931 - DNA, 22 bp, Homo sapiens
tagcatttctggcctctactca

SEQ ID NO: 7588932 - DNA, 22 bp, Homo sapiens
tagcatttctggcctctactca

SEQ ID NO: 7588933 - DNA, 22 bp, Homo sapiens
tagcatttctggcctctactca

SEQ ID NO: 7588934 - DNA, 22 bp, Homo sapiens
tagcatttggacattgtcacct

SEQ ID NO: 7588935 - DNA, 22 bp, Homo sapiens
tagcatttggacattgtcacct

SEQ ID NO: 7588936 - DNA, 22 bp, Homo sapiens
tagcatttatggtcatgtgtcc

SEQ ID NO: 7588937 - DNA, 22 bp, Homo sapiens
tagcatttatggtcatgtgtcc

SEQ ID NO: 7588938 - DNA, 22 bp, Homo sapiens
tagcatttatggtcatgtgtcc

SEQ ID NO: 7588939 - DNA, 22 bp, Homo sapiens
tagcatttatggtcatgtgtcc

SEQ ID NO: 7588940 - DNA, 22 bp, Homo sapiens
tagcatttattccagatttgga

SEQ ID NO: 7588941 - DNA, 22 bp, Homo sapiens
tagcatttattccagatttgga

SEQ ID NO: 7588942 - DNA, 22 bp, Homo sapiens
tagcatttattccagatttgga

SEQ ID NO: 7588943 - DNA, 22 bp, Homo sapiens
tagcagtggaatcttttgtcca

SEQ ID NO: 7588944 - DNA, 22 bp, Homo sapiens
tagcagtggaatcttttgtcca

SEQ ID NO: 7588945 - DNA, 22 bp, Homo sapiens
tagcattccttgtggcttctga

SEQ ID NO: 7588946 - DNA, 22 bp, Homo sapiens
tagcatttagaacaccttgaga

SEQ ID NO: 7588947 - DNA, 22 bp, Homo sapiens
tagcatttagaacaccttgaga

SEQ ID NO: 7588948 - DNA, 22 bp, Homo sapiens
tagcatttagaacaccttgaga

SEQ ID NO: 7588949 - DNA, 17 bp, Homo sapiens
tagcatttatcttcctt

SEQ ID NO: 7588950 - DNA, 22 bp, Homo sapiens
tagcatttcactgatcttcact

SEQ ID NO: 7588951 - DNA, 22 bp, Homo sapiens
tagcatttcactgatcttcact

SEQ ID NO: 7588952 - DNA, 22 bp, Homo sapiens
tagcatttcactgatcttcact

SEQ ID NO: 7588953 - DNA, 22 bp, Homo sapiens
tagcatttcactgatcttcact

SEQ ID NO: 7588954 - DNA, 22 bp, Homo sapiens
tagcatttcactgatcttcact

SEQ ID NO: 7588955 - DNA, 22 bp, Homo sapiens
tagcatttcccaaatgcatttg

SEQ ID NO: 7588956 - DNA, 22 bp, Homo sapiens
tagcatttcccaaatgcatttg

SEQ ID NO: 7588957 - DNA, 22 bp, Homo sapiens
tagcatttcccaaatgcatttg

SEQ ID NO: 7588958 - DNA, 22 bp, Homo sapiens
tagcatttcccaaatgcatttg

SEQ ID NO: 7588959 - DNA, 22 bp, Homo sapiens
tagcacctggtcaattcagtca

SEQ ID NO: 7588960 - DNA, 22 bp, Homo sapiens
tagcaccttaactctgctgcgt

SEQ ID NO: 7588961 - DNA, 22 bp, Homo sapiens
tagcacctgtgcacaccaggca

SEQ ID NO: 7588962 - DNA, 22 bp, Homo sapiens
tagcacctgcaggatgtgcaca

SEQ ID NO: 7588963 - DNA, 22 bp, Homo sapiens
tagcacctgcaggatgtgcaca

SEQ ID NO: 7588964 - DNA, 22 bp, Homo sapiens
tagcacctagagtattttatca

SEQ ID NO: 7588965 - DNA, 22 bp, Homo sapiens
tagcacctgatacctagtatgt

SEQ ID NO: 7588966 - DNA, 22 bp, Homo sapiens
tagcacccatggaatctgctgg

SEQ ID NO: 7588967 - DNA, 22 bp, Homo sapiens
tagcaccggatggcaagcaaca

SEQ ID NO: 7588968 - DNA, 22 bp, Homo sapiens
tagcacccacctcgtggggttt

SEQ ID NO: 7588969 - DNA, 22 bp, Homo sapiens
tagcacccatggaatctgctgg

SEQ ID NO: 7588970 - DNA, 22 bp, Homo sapiens
tagcaccatgatggaagagctg

SEQ ID NO: 7588971 - DNA, 22 bp, Homo sapiens
tagcaccatacccggcagctcg

SEQ ID NO: 7588972 - DNA, 22 bp, Homo sapiens
tagcaccacaatcaagatacag

SEQ ID NO: 7588973 - DNA, 22 bp, Homo sapiens
tagcaccatacccggcagctcg

SEQ ID NO: 7588974 - DNA, 22 bp, Homo sapiens
tagcaccatacccggcagctcg

SEQ ID NO: 7588975 - DNA, 22 bp, Homo sapiens
tagcaccacttcatgctttcag

SEQ ID NO: 7588976 - DNA, 22 bp, Homo sapiens
tagcacataacttagaatagtt

SEQ ID NO: 7588977 - DNA, 22 bp, Homo sapiens
tagcacataacttagaatagtt

SEQ ID NO: 7588978 - DNA, 22 bp, Homo sapiens
tagcacagttcctgactctttg

SEQ ID NO: 7588979 - DNA, 22 bp, Homo sapiens
tagcacatacataatagataga

SEQ ID NO: 7588980 - DNA, 22 bp, Homo sapiens
tagcacagttcctgactctttg

SEQ ID NO: 7588981 - DNA, 22 bp, Homo sapiens
tagcacagttcactatgataca

SEQ ID NO: 7588982 - DNA, 22 bp, Homo sapiens
tagcacagttcactatgataca

SEQ ID NO: 7588983 - DNA, 22 bp, Homo sapiens
tagcacagttcactatgataca

SEQ ID NO: 7588984 - DNA, 22 bp, Homo sapiens
tagcacatgccgggagtgatct

SEQ ID NO: 7588985 - DNA, 22 bp, Homo sapiens
tagcacattgttgaccagaagg

SEQ ID NO: 7588986 - DNA, 22 bp, Homo sapiens
tagcacatctggcgcttatagg

SEQ ID NO: 7588987 - DNA, 22 bp, Homo sapiens
tagcaccaaacatatactcagt

SEQ ID NO: 7588988 - DNA, 22 bp, Homo sapiens
tagcacattgttgaccagaagg

SEQ ID NO: 7588989 - DNA, 22 bp, Homo sapiens
tagcagaaccagcagtcaattt

SEQ ID NO: 7588990 - DNA, 22 bp, Homo sapiens
tagcagggttttgaagagggtt

SEQ ID NO: 7588991 - DNA, 22 bp, Homo sapiens
tagcagaaccagcagtcaattt

SEQ ID NO: 7588992 - DNA, 22 bp, Homo sapiens
tagcagaacaatagtcaatgat

SEQ ID NO: 7588993 - DNA, 22 bp, Homo sapiens
tagcagggttttgaagagggtt

SEQ ID NO: 7588994 - DNA, 22 bp, Homo sapiens
tagcaggtgctcatttaactcc

SEQ ID NO: 7588995 - DNA, 20 bp, Homo sapiens
tagcaggtagctgcacgttt

SEQ ID NO: 7588996 - DNA, 22 bp, Homo sapiens
tagcagtattccggaatacttt

SEQ ID NO: 7588997 - DNA, 22 bp, Homo sapiens
tagcaggttactattttaatat

SEQ ID NO: 7588998 - DNA, 22 bp, Homo sapiens
tagcagtgccaggattttgctg

SEQ ID NO: 7588999 - DNA, 22 bp, Homo sapiens
tagcagtgccaggattttgctg

SEQ ID NO: 7589000 - DNA, 22 bp, Homo sapiens
tagcagtgccctgtggaataag

SEQ ID NO: 7589001 - DNA, 22 bp, Homo sapiens
tagcagtctttctttgggacta

SEQ ID NO: 7589002 - DNA, 22 bp, Homo sapiens
tagcagtctggtgggcagattc

SEQ ID NO: 7589003 - DNA, 21 bp, Homo sapiens
tagcagaaacagttcaggcca

SEQ ID NO: 7589004 - DNA, 22 bp, Homo sapiens
tagcagaaactgttacagaagg

SEQ ID NO: 7589005 - DNA, 22 bp, Homo sapiens
tagcagaaactgttacagaagg

SEQ ID NO: 7589006 - DNA, 21 bp, Homo sapiens
tagcagaaacagttcaggcca

SEQ ID NO: 7589007 - DNA, 22 bp, Homo sapiens
tagcagaaactgttacagaagg

SEQ ID NO: 7589008 - DNA, 22 bp, Homo sapiens
tagcagaaactgttacagaagg

SEQ ID NO: 7589009 - DNA, 22 bp, Homo sapiens
tagcagaacaatagtcaatgat

SEQ ID NO: 7589010 - DNA, 21 bp, Homo sapiens
tagcagaaacagttcaggcca

SEQ ID NO: 7589011 - DNA, 21 bp, Homo sapiens
tagcagaaacagttcaggcca

SEQ ID NO: 7589012 - DNA, 21 bp, Homo sapiens
tagcagaaacagttcaggcca

SEQ ID NO: 7589013 - DNA, 22 bp, Homo sapiens
tagcacttgtgttatgccttgt

SEQ ID NO: 7589014 - DNA, 21 bp, Homo sapiens
tagcacttcgctgtaattggg

SEQ ID NO: 7589015 - DNA, 22 bp, Homo sapiens
tagcacttctggggaatagaat

SEQ ID NO: 7589016 - DNA, 22 bp, Homo sapiens
tagcactgagtctagctttgga

SEQ ID NO: 7589017 - DNA, 22 bp, Homo sapiens
tagcactgttctagcatgtttt

SEQ ID NO: 7589018 - DNA, 22 bp, Homo sapiens
tagcactgaatcacatgctgct

SEQ ID NO: 7589019 - DNA, 22 bp, Homo sapiens
tagcactacttaggtacagcca

SEQ ID NO: 7589020 - DNA, 22 bp, Homo sapiens
tagcactatcttgggatttgga

SEQ ID NO: 7589021 - DNA, 22 bp, Homo sapiens
tagcactatctattgcatgcaa

SEQ ID NO: 7589022 - DNA, 22 bp, Homo sapiens
tagattttgcatttctaacaag

SEQ ID NO: 7589023 - DNA, 22 bp, Homo sapiens
tagattttgcatttctaacaag

SEQ ID NO: 7589024 - DNA, 22 bp, Homo sapiens
tagattttgcatttctaacaag

SEQ ID NO: 7589025 - DNA, 22 bp, Homo sapiens
tagattttgcatttctaacaag

SEQ ID NO: 7589026 - DNA, 22 bp, Homo sapiens
tagattttgcatttctaacaag

SEQ ID NO: 7589027 - DNA, 22 bp, Homo sapiens
tagattttgcatttctaacaag

SEQ ID NO: 7589028 - DNA, 22 bp, Homo sapiens
tagattttaggagattttactg

SEQ ID NO: 7589029 - DNA, 22 bp, Homo sapiens
tagattttaggagattttactg

SEQ ID NO: 7589030 - DNA, 22 bp, Homo sapiens
tagattttgcatttctaacaag

SEQ ID NO: 7589031 - DNA, 22 bp, Homo sapiens
tagattttgcatttctaacaag

SEQ ID NO: 7589032 - DNA, 22 bp, Homo sapiens
tagattttaggagattttactg

SEQ ID NO: 7589033 - DNA, 22 bp, Homo sapiens
tagattttaggagattttactg

SEQ ID NO: 7589034 - DNA, 22 bp, Homo sapiens
tagattttaggagattttactg

SEQ ID NO: 7589035 - DNA, 22 bp, Homo sapiens
tagattttaggagattttactg

SEQ ID NO: 7589036 - DNA, 22 bp, Homo sapiens
tagattttacttctgtcattac

SEQ ID NO: 7589037 - DNA, 22 bp, Homo sapiens
tagattttaggagattttactg

SEQ ID NO: 7589038 - DNA, 22 bp, Homo sapiens
tagattttaggagattttactg

SEQ ID NO: 7589039 - DNA, 22 bp, Homo sapiens
tagattttaggagattttactg

SEQ ID NO: 7589040 - DNA, 22 bp, Homo sapiens
tagattaagatgccagttttga

SEQ ID NO: 7589041 - DNA, 22 bp, Homo sapiens
tagattaacagttttgttgaag

SEQ ID NO: 7589042 - DNA, 22 bp, Homo sapiens
tagattaacagttttgttgaag

SEQ ID NO: 7589043 - DNA, 18 bp, Homo sapiens
tagattaaaattgaattc

SEQ ID NO: 7589044 - DNA, 18 bp, Homo sapiens
tagattaaaattgaattc

SEQ ID NO: 7589045 - DNA, 22 bp, Homo sapiens
tagatgttttgatatttgctga

SEQ ID NO: 7589046 - DNA, 18 bp, Homo sapiens
tagattaaaattgaattc

SEQ ID NO: 7589047 - DNA, 17 bp, Homo sapiens
tagattaaacacggcca

SEQ ID NO: 7589048 - DNA, 22 bp, Homo sapiens
tagattttacttctgtcattac

SEQ ID NO: 7589049 - DNA, 22 bp, Homo sapiens
tagattttacttctgtcattac

SEQ ID NO: 7589050 - DNA, 22 bp, Homo sapiens
tagattttacttctgtcattac

SEQ ID NO: 7589051 - DNA, 22 bp, Homo sapiens
tagattttacttctgtcattac

SEQ ID NO: 7589052 - DNA, 22 bp, Homo sapiens
tagattttacttctgtcattac

SEQ ID NO: 7589053 - DNA, 22 bp, Homo sapiens
tagatttgtttccttctctcca

SEQ ID NO: 7589054 - DNA, 22 bp, Homo sapiens
tagattttacttctgtcattac

SEQ ID NO: 7589055 - DNA, 22 bp, Homo sapiens
tagatttgtttccttctctcca

SEQ ID NO: 7589056 - DNA, 20 bp, Homo sapiens
tagatgtttcctgtcataaa

SEQ ID NO: 7589057 - DNA, 20 bp, Homo sapiens
tagatgtttcctgtcataaa

SEQ ID NO: 7589058 - DNA, 20 bp, Homo sapiens
tagatgtttcctgtcataaa

SEQ ID NO: 7589059 - DNA, 22 bp, Homo sapiens
tagatgttaagcttctagaagg

SEQ ID NO: 7589060 - DNA, 22 bp, Homo sapiens
tagatgttgaagtcatatttgg

SEQ ID NO: 7589061 - DNA, 20 bp, Homo sapiens
tagatgtttcctgtcataaa

SEQ ID NO: 7589062 - DNA, 23 bp, Homo sapiens
tagatgtttggggaactttgccc

SEQ ID NO: 7589063 - DNA, 22 bp, Homo sapiens
tagatgttttgatatttgctga

SEQ ID NO: 7589064 - DNA, 22 bp, Homo sapiens
tagatgttttaactcttggtta

SEQ ID NO: 7589065 - DNA, 22 bp, Homo sapiens
tagatgtatcttctcttatcgt

SEQ ID NO: 7589066 - DNA, 23 bp, Homo sapiens
tagatgtattaagtgcattttca

SEQ ID NO: 7589067 - DNA, 22 bp, Homo sapiens
tagatgtatcttctcttatcgt

SEQ ID NO: 7589068 - DNA, 22 bp, Homo sapiens
tagatgtaagcagaagaacagc

SEQ ID NO: 7589069 - DNA, 22 bp, Homo sapiens
tagatgtagccactgctaaaag

SEQ ID NO: 7589070 - DNA, 22 bp, Homo sapiens
tagatgtaagaggtttcttaca

SEQ ID NO: 7589071 - DNA, 22 bp, Homo sapiens
tagatgtaaaattgagactatt

SEQ ID NO: 7589072 - DNA, 22 bp, Homo sapiens
tagatgtgttgcctggagttgt

SEQ ID NO: 7589073 - DNA, 22 bp, Homo sapiens
tagatgttaagcttctagaagg

SEQ ID NO: 7589074 - DNA, 22 bp, Homo sapiens
tagatgtgttgcctggagttgt

SEQ ID NO: 7589075 - DNA, 22 bp, Homo sapiens
tagatgtgttgcctggagttgt

SEQ ID NO: 7589076 - DNA, 22 bp, Homo sapiens
tagatgtgttgcctggagttgt

SEQ ID NO: 7589077 - DNA, 22 bp, Homo sapiens
tagatgtgtagggctccagcta

SEQ ID NO: 7589078 - DNA, 22 bp, Homo sapiens
tagatgtgtgatattctcagat

SEQ ID NO: 7589079 - DNA, 22 bp, Homo sapiens
tagatgtgttcagttggtgcag

SEQ ID NO: 7589080 - DNA, 22 bp, Homo sapiens
tagatgtgtagggctccagcta

SEQ ID NO: 7589081 - DNA, 22 bp, Homo sapiens
tagatgtgaggattcaggagtt
